United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 76

SEQ ID NO: 2748261 - RNA, 13 nt, Human
ccccucugcagcu

SEQ ID NO: 2748262 - RNA, 16 nt, Human
ccccucuggcuccagc

SEQ ID NO: 2748263 - RNA, 20 nt, Human
ccccucuggcuccagcuggc

SEQ ID NO: 2748264 - RNA, 23 nt, Human
ccccucuggcuccagcuggccgg

SEQ ID NO: 2748265 - RNA, 17 nt, Human
ccccugaauuuaaauag

SEQ ID NO: 2748266 - RNA, 14 nt, Human
ccccugagcuugca

SEQ ID NO: 2748267 - RNA, 19 nt, Human
ccccugagcuugcagagau

SEQ ID NO: 2748268 - RNA, 21 nt, Human
ccccugcaaagcccagcuuga

SEQ ID NO: 2748269 - RNA, 22 nt, Human
ccccugcaaagcccagcuugaa

SEQ ID NO: 2748270 - RNA, 20 nt, Human
ccccugcacuccagccugag

SEQ ID NO: 2748271 - RNA, 10 nt, Human
ccccugccuc

SEQ ID NO: 2748272 - RNA, 11 nt, Human
ccccugccucu

SEQ ID NO: 2748273 - RNA, 12 nt, Human
ccccugggacca

SEQ ID NO: 2748274 - RNA, 17 nt, Human
ccccuggguucacagau

SEQ ID NO: 2748275 - RNA, 14 nt, Human
ccccuucacuccca

SEQ ID NO: 2748276 - RNA, 22 nt, Human
ccccuuccuaauuccacagcug

SEQ ID NO: 2748277 - RNA, 21 nt, Human
ccccuugcccagggcucagcc

SEQ ID NO: 2748278 - RNA, 15 nt, Human
ccccuugguucucau

SEQ ID NO: 2748279 - RNA, 22 nt, Human
ccccuuugcugacccuccccaa

SEQ ID NO: 2748280 - RNA, 20 nt, Human
ccccuuugcuucauucaagu

SEQ ID NO: 2748281 - RNA, 15 nt, Human
cccgcaugcggccca

SEQ ID NO: 2748282 - RNA, 21 nt, Human
cccgcaugcggcccaggaugg

SEQ ID NO: 2748283 - RNA, 13 nt, Human
cccgcccaccgca

SEQ ID NO: 2748284 - RNA, 20 nt, Human
cccggccgcgcugcgcgccg

SEQ ID NO: 2748285 - RNA, 22 nt, Human
cccggccgcgcugcgcgccgcg

SEQ ID NO: 2748286 - RNA, 12 nt, Human
cccggccggcgc

SEQ ID NO: 2748287 - RNA, 15 nt, Human
cccggccggcgcgcu

SEQ ID NO: 2748288 - RNA, 20 nt, Human
cccgggaguggcgcgcgcca

SEQ ID NO: 2748289 - RNA, 18 nt, Human
cccgggccgacggagccg

SEQ ID NO: 2748290 - RNA, 19 nt, Human
cccgggccgacggagccgg

SEQ ID NO: 2748291 - RNA, 13 nt, Human
cccggggaggggc

SEQ ID NO: 2748292 - RNA, 15 nt, Human
cccggggaggggcgc

SEQ ID NO: 2748293 - RNA, 15 nt, Human
cccguucacauuuuu

SEQ ID NO: 2748294 - RNA, 18 nt, Human
cccuaauaaagcugugug

SEQ ID NO: 2748295 - RNA, 14 nt, Human
cccuacaccccucc

SEQ ID NO: 2748296 - RNA, 23 nt, Human
cccuagaaagccaugugcagcca

SEQ ID NO: 2748297 - RNA, 23 nt, Human
cccuagccagaggcucuaaugua

SEQ ID NO: 2748298 - RNA, 14 nt, Human
cccuaggugagaac

SEQ ID NO: 2748299 - RNA, 21 nt, Human
cccuauccuacuuccccuucc

SEQ ID NO: 2748300 - RNA, 14 nt, Human
cccuauuccuccuu

SEQ ID NO: 2748301 - RNA, 15 nt, Human
cccucaaacccauuc

SEQ ID NO: 2748302 - RNA, 22 nt, Human
cccucacugcaggcuccccucc

SEQ ID NO: 2748303 - RNA, 12 nt, Human
cccucaugcugc

SEQ ID NO: 2748304 - RNA, 13 nt, Human
cccucaugcugcc

SEQ ID NO: 2748305 - RNA, 15 nt, Human
cccucaugcugccaa

SEQ ID NO: 2748306 - RNA, 23 nt, Human
cccucauuucucaucuuuuuacu

SEQ ID NO: 2748307 - RNA, 23 nt, Human
cccuccacauuucccccuagccu

SEQ ID NO: 2748308 - RNA, 16 nt, Human
cccuccaccucccugc

SEQ ID NO: 2748309 - RNA, 21 nt, Human
cccuccagauauacuugguuc

SEQ ID NO: 2748310 - RNA, 15 nt, Human
cccucccccuccucu

SEQ ID NO: 2748311 - RNA, 12 nt, Human
cccuccccugcc

SEQ ID NO: 2748312 - RNA, 16 nt, Human
cccucccuccaccucc

SEQ ID NO: 2748313 - RNA, 14 nt, Human
cccuccgccauucu

SEQ ID NO: 2748314 - RNA, 13 nt, Human
cccuccucuccca

SEQ ID NO: 2748315 - RNA, 12 nt, Human
cccucuccugga

SEQ ID NO: 2748316 - RNA, 14 nt, Human
cccucuccugggca

SEQ ID NO: 2748317 - RNA, 19 nt, Human
cccucuccugggcagcugc

SEQ ID NO: 2748318 - RNA, 12 nt, Human
cccucugcagcu

SEQ ID NO: 2748319 - RNA, 16 nt, Human
cccucuggcuccagcu

SEQ ID NO: 2748320 - RNA, 17 nt, Human
cccucugggucucagug

SEQ ID NO: 2748321 - RNA, 22 nt, Human
cccucuguucugcacacagcac

SEQ ID NO: 2748322 - RNA, 15 nt, Human
cccucuucugacacu

SEQ ID NO: 2748323 - RNA, 18 nt, Human
cccucuucugacacuaaa

SEQ ID NO: 2748324 - RNA, 18 nt, Human
cccugaaagucccagauc

SEQ ID NO: 2748325 - RNA, 22 nt, Human
cccugaauuuaaauagcuuuuu

SEQ ID NO: 2748326 - RNA, 18 nt, Human
cccugaccucccucuaau

SEQ ID NO: 2748327 - RNA, 13 nt, Human
cccugagcaggau

SEQ ID NO: 2748328 - RNA, 21 nt, Human
cccugagcuugcagagaugag

SEQ ID NO: 2748329 - RNA, 22 nt, Human
cccugaggccuagacucugucu

SEQ ID NO: 2748330 - RNA, 15 nt, Human
cccugagguugugug

SEQ ID NO: 2748331 - RNA, 14 nt, Human
cccugaugaaaaca

SEQ ID NO: 2748332 - RNA, 14 nt, Human
cccugcaaagccca

SEQ ID NO: 2748333 - RNA, 15 nt, Human
cccugcaaagcccag

SEQ ID NO: 2748334 - RNA, 17 nt, Human
cccugcaaagcccagcu

SEQ ID NO: 2748335 - RNA, 19 nt, Human
cccugcaaagcccagcuug

SEQ ID NO: 2748336 - RNA, 13 nt, Human
cccugcaccaugc

SEQ ID NO: 2748337 - RNA, 15 nt, Human
cccugcaccaugcug

SEQ ID NO: 2748338 - RNA, 20 nt, Human
cccugcacuccagccugagc

SEQ ID NO: 2748339 - RNA, 14 nt, Human
cccugccccccagc

SEQ ID NO: 2748340 - RNA, 14 nt, Human
cccugccucaagcu

SEQ ID NO: 2748341 - RNA, 15 nt, Human
cccugccuucccagg

SEQ ID NO: 2748342 - RNA, 16 nt, Human
cccugccuucccagga

SEQ ID NO: 2748343 - RNA, 16 nt, Human
cccugcugcccucccc

SEQ ID NO: 2748344 - RNA, 14 nt, Human
cccuggacugugug

SEQ ID NO: 2748345 - RNA, 21 nt, Human
cccuggacugugugcucagga

SEQ ID NO: 2748346 - RNA, 14 nt, Human
cccuggacuugccu

SEQ ID NO: 2748347 - RNA, 15 nt, Human
cccuggacuugccuc

SEQ ID NO: 2748348 - RNA, 18 nt, Human
cccuggacuugccucugc

SEQ ID NO: 2748349 - RNA, 17 nt, Human
cccuggauugaucggag

SEQ ID NO: 2748350 - RNA, 22 nt, Human
cccuggauugaucggagccucc

SEQ ID NO: 2748351 - RNA, 17 nt, Human
cccuggauuuuuaccag

SEQ ID NO: 2748352 - RNA, 15 nt, Human
cccuggccucugcuc

SEQ ID NO: 2748353 - RNA, 16 nt, Human
cccuggccucugcuca

SEQ ID NO: 2748354 - RNA, 20 nt, Human
cccugggaggcucuggagcc

SEQ ID NO: 2748355 - RNA, 16 nt, Human
cccuggucccuuggag

SEQ ID NO: 2748356 - RNA, 21 nt, Human
cccuguaugauuccuugaugg

SEQ ID NO: 2748357 - RNA, 14 nt, Human
cccugucucaauaa

SEQ ID NO: 2748358 - RNA, 12 nt, Human
cccugucucagg

SEQ ID NO: 2748359 - RNA, 18 nt, Human
cccugucucuacaaaaaa

SEQ ID NO: 2748360 - RNA, 11 nt, Human
cccuguugcua

SEQ ID NO: 2748361 - RNA, 19 nt, Human
cccuuccccucugcagcuu

SEQ ID NO: 2748362 - RNA, 20 nt, Human
cccuuccuaauuccacagcu

SEQ ID NO: 2748363 - RNA, 21 nt, Human
cccuuccugcaggcaggaaca

SEQ ID NO: 2748364 - RNA, 19 nt, Human
cccuuccugggucuaccac

SEQ ID NO: 2748365 - RNA, 19 nt, Human
cccuucucuacacucuugu

SEQ ID NO: 2748366 - RNA, 13 nt, Human
cccuucucuguau

SEQ ID NO: 2748367 - RNA, 22 nt, Human
cccuugccauggagguuaagca

SEQ ID NO: 2748368 - RNA, 14 nt, Human
cccuugcccagggc

SEQ ID NO: 2748369 - RNA, 14 nt, Human
cccuuucugccccu

SEQ ID NO: 2748370 - RNA, 20 nt, Human
cccuuugcugacccucccca

SEQ ID NO: 2748371 - RNA, 16 nt, Human
cccuuugcuucauuca

SEQ ID NO: 2748372 - RNA, 21 nt, Human
ccgaaggaaaagggcuuucuc

SEQ ID NO: 2748373 - RNA, 20 nt, Human
ccgaccucagccuuccccuu

SEQ ID NO: 2748374 - RNA, 15 nt, Human
ccgacggagccggga

SEQ ID NO: 2748375 - RNA, 17 nt, Human
ccgacggagccgggaaa

SEQ ID NO: 2748376 - RNA, 19 nt, Human
ccgacggagccgggaaaga

SEQ ID NO: 2748377 - RNA, 21 nt, Human
ccgaggccccugucucagggu

SEQ ID NO: 2748378 - RNA, 22 nt, Human
ccgaggccccugucucagggug

SEQ ID NO: 2748379 - RNA, 20 nt, Human
ccgauaucuucagaaaaccu

SEQ ID NO: 2748380 - RNA, 19 nt, Human
ccgcagggugaacugcagc

SEQ ID NO: 2748381 - RNA, 13 nt, Human
ccgcagugagaga

SEQ ID NO: 2748382 - RNA, 16 nt, Human
ccgcauccuagucucu

SEQ ID NO: 2748383 - RNA, 13 nt, Human
ccgccacccuccc

SEQ ID NO: 2748384 - RNA, 16 nt, Human
ccgccacccucccacu

SEQ ID NO: 2748385 - RNA, 15 nt, Human
ccgcccaccgcaggg

SEQ ID NO: 2748386 - RNA, 19 nt, Human
ccgccucagccucccaaag

SEQ ID NO: 2748387 - RNA, 17 nt, Human
ccgcgcagcucaggcug

SEQ ID NO: 2748388 - RNA, 22 nt, Human
ccgcgcagcucaggcuggcacc

SEQ ID NO: 2748389 - RNA, 13 nt, Human
ccgcgcugcgcgc

SEQ ID NO: 2748390 - RNA, 14 nt, Human
ccgcuacuuccagg

SEQ ID NO: 2748391 - RNA, 13 nt, Human
ccgcuaucauucc

SEQ ID NO: 2748392 - RNA, 10 nt, Human
ccgcucucuc

SEQ ID NO: 2748393 - RNA, 11 nt, Human
ccgcucucucu

SEQ ID NO: 2748394 - RNA, 14 nt, Human
ccgcucucucugag

SEQ ID NO: 2748395 - RNA, 15 nt, Human
ccgcuguacgcgagc

SEQ ID NO: 2748396 - RNA, 17 nt, Human
ccgcuguacgcgagcgc

SEQ ID NO: 2748397 - RNA, 9 nt, Human
ccgcugucu

SEQ ID NO: 2748398 - RNA, 11 nt, Human
ccgcugucucu

SEQ ID NO: 2748399 - RNA, 15 nt, Human
ccgcuguuccucgcc

SEQ ID NO: 2748400 - RNA, 14 nt, Human
ccgcuuaagcuuuc

SEQ ID NO: 2748401 - RNA, 14 nt, Human
ccgcuuucucugag

SEQ ID NO: 2748402 - RNA, 14 nt, Human
ccggacgcccagga

SEQ ID NO: 2748403 - RNA, 15 nt, Human
ccggagaaccccagg

SEQ ID NO: 2748404 - RNA, 17 nt, Human
ccggagaaccccaggac

SEQ ID NO: 2748405 - RNA, 20 nt, Human
ccggagaaccccaggacgcc

SEQ ID NO: 2748406 - RNA, 22 nt, Human
ccggagccccuugggcagguca

SEQ ID NO: 2748407 - RNA, 14 nt, Human
ccggagccuccagc

SEQ ID NO: 2748408 - RNA, 17 nt, Human
ccggagccuccagcugc

SEQ ID NO: 2748409 - RNA, 18 nt, Human
ccggagccuccagcugcc

SEQ ID NO: 2748410 - RNA, 11 nt, Human
ccggccgcgcu

SEQ ID NO: 2748411 - RNA, 13 nt, Human
ccggccgcgcugc

SEQ ID NO: 2748412 - RNA, 19 nt, Human
ccggccgcgcugcgcgccg

SEQ ID NO: 2748413 - RNA, 19 nt, Human
ccggcgcgcucaucccacc

SEQ ID NO: 2748414 - RNA, 22 nt, Human
ccggcgcgcucaucccacccgc

SEQ ID NO: 2748415 - RNA, 15 nt, Human
ccggcuaauuuuugu

SEQ ID NO: 2748416 - RNA, 19 nt, Human
ccgggaaagaagagccgga

SEQ ID NO: 2748417 - RNA, 23 nt, Human
ccgggaaagaagagccggagccu

SEQ ID NO: 2748418 - RNA, 22 nt, Human
ccgggaggcagagguugcagug

SEQ ID NO: 2748419 - RNA, 13 nt, Human
ccgggaguggcgc

SEQ ID NO: 2748420 - RNA, 11 nt, Human
ccgggccgacg

SEQ ID NO: 2748421 - RNA, 19 nt, Human
ccgggccgacggagccggg

SEQ ID NO: 2748422 - RNA, 20 nt, Human
ccgggccgacggagccggga

SEQ ID NO: 2748423 - RNA, 21 nt, Human
ccgggccgacggagccgggaa

SEQ ID NO: 2748424 - RNA, 11 nt, Human
ccgggcgcggu

SEQ ID NO: 2748425 - RNA, 18 nt, Human
ccgggcgcgguggcucac

SEQ ID NO: 2748426 - RNA, 16 nt, Human
ccgggcguggugguga

SEQ ID NO: 2748427 - RNA, 19 nt, Human
ccgggcgugguggugagug

SEQ ID NO: 2748428 - RNA, 14 nt, Human
ccggggaggggcgc

SEQ ID NO: 2748429 - RNA, 18 nt, Human
ccggggaggggcgcucgc

SEQ ID NO: 2748430 - RNA, 22 nt, Human
ccgggucgcaggaccaucccgg

SEQ ID NO: 2748431 - RNA, 17 nt, Human
aauauuuuuaugugcaa

SEQ ID NO: 2748432 - RNA, 19 nt, Human
aauauuuuuucuuuucuau

SEQ ID NO: 2748433 - RNA, 18 nt, Human
aaucaaaagacuuuuucc

SEQ ID NO: 2748434 - RNA, 13 nt, Human
uuuguaauauuuc

SEQ ID NO: 2748435 - RNA, 22 nt, Human
uuuguagaagucacauuccuga

SEQ ID NO: 2748436 - RNA, 21 nt, Human
uuuguagcauccucuuuaaug

SEQ ID NO: 2748437 - RNA, 16 nt, Human
uuuguaguguuggaga

SEQ ID NO: 2748438 - RNA, 13 nt, Human
uuuguauuuuguu

SEQ ID NO: 2748439 - RNA, 15 nt, Human
uuuguccuuuuuguu

SEQ ID NO: 2748440 - RNA, 20 nt, Human
uuugugaaaaaaaauuuuau

SEQ ID NO: 2748441 - RNA, 22 nt, Human
uuugugaagguggaaauaaacu

SEQ ID NO: 2748442 - RNA, 16 nt, Human
uuugugguuagaaaag

SEQ ID NO: 2748443 - RNA, 15 nt, Human
uuuguuaaaauagaa

SEQ ID NO: 2748444 - RNA, 18 nt, Human
uuuguuaaaugauuucau

SEQ ID NO: 2748445 - RNA, 20 nt, Human
uuuguuauggcuuaaugaca

SEQ ID NO: 2748446 - RNA, 24 nt, Human
uuuguucauauaacgucaugugca

SEQ ID NO: 2748447 - RNA, 16 nt, Human
uuuuaaaaaaaaauac

SEQ ID NO: 2748448 - RNA, 17 nt, Human
uuuuaaaaaaaaauacu

SEQ ID NO: 2748449 - RNA, 17 nt, Human
uuuuaaaaauuaaauca

SEQ ID NO: 2748450 - RNA, 20 nt, Human
uuuuaaaagaaugauuauga

SEQ ID NO: 2748451 - RNA, 23 nt, Human
uuuuaaacaaaaaaagcauugua

SEQ ID NO: 2748452 - RNA, 20 nt, Human
uuuuaaagaaacaaaaauca

SEQ ID NO: 2748453 - RNA, 13 nt, Human
uuuuaaauguuuu

SEQ ID NO: 2748454 - RNA, 21 nt, Human
uuuuaaguaauuucagaagaa

SEQ ID NO: 2748455 - RNA, 14 nt, Human
uuuuaaguuacaca

SEQ ID NO: 2748456 - RNA, 16 nt, Human
uuuuaaguuacacauu

SEQ ID NO: 2748457 - RNA, 14 nt, Human
uuuuaauaaacacu

SEQ ID NO: 2748458 - RNA, 13 nt, Human
uuuuaauaaauuu

SEQ ID NO: 2748459 - RNA, 15 nt, Human
uuuuaaucuuuaauu

SEQ ID NO: 2748460 - RNA, 19 nt, Human
uuuuaaugagauaauguga

SEQ ID NO: 2748461 - RNA, 17 nt, Human
uuuuaauuucugcaaau

SEQ ID NO: 2748462 - RNA, 21 nt, Human
uuuuaauuugguuuucacauu

SEQ ID NO: 2748463 - RNA, 14 nt, Human
uuuuaauuuugaau

SEQ ID NO: 2748464 - RNA, 23 nt, Human
uuuuacacauguaucuaugcauu

SEQ ID NO: 2748465 - RNA, 14 nt, Human
uuuuacauguggcc

SEQ ID NO: 2748466 - RNA, 22 nt, Human
uuuuacauuuccuaaauauauu

SEQ ID NO: 2748467 - RNA, 20 nt, Human
uuuuaccaaauaaaguagaa

SEQ ID NO: 2748468 - RNA, 15 nt, Human
uuuuaccagucucac

SEQ ID NO: 2748469 - RNA, 21 nt, Human
uuuuacccggcacauuccccu

SEQ ID NO: 2748470 - RNA, 15 nt, Human
uuuuaggaauacaua

SEQ ID NO: 2748471 - RNA, 13 nt, Human
uuuuagugaaaua

SEQ ID NO: 2748472 - RNA, 18 nt, Human
uuuuagugaaauauuauu

SEQ ID NO: 2748473 - RNA, 14 nt, Human
uuuuaguuuaaaaa

SEQ ID NO: 2748474 - RNA, 13 nt, Human
uuuuauacgauaa

SEQ ID NO: 2748475 - RNA, 18 nt, Human
uuuuauaucaauuuaaaa

SEQ ID NO: 2748476 - RNA, 18 nt, Human
uuuuaucugcuaugcuau

SEQ ID NO: 2748477 - RNA, 19 nt, Human
uuuuaucugcuaugcuauu

SEQ ID NO: 2748478 - RNA, 12 nt, Human
uuuuauuaauaa

SEQ ID NO: 2748479 - RNA, 13 nt, Human
uuuuauuaugcau

SEQ ID NO: 2748480 - RNA, 16 nt, Human
uuuuauuguuuaaaau

SEQ ID NO: 2748481 - RNA, 15 nt, Human
uuuuauuuugccaag

SEQ ID NO: 2748482 - RNA, 23 nt, Human
uuuucaaaaucaaauuccagaau

SEQ ID NO: 2748483 - RNA, 16 nt, Human
uuuucaaaauuggacu

SEQ ID NO: 2748484 - RNA, 14 nt, Human
uuuucaauauuuau

SEQ ID NO: 2748485 - RNA, 20 nt, Human
uuuucaggcuagauguaugu

SEQ ID NO: 2748486 - RNA, 21 nt, Human
uuuucaggcuagauguaugua

SEQ ID NO: 2748487 - RNA, 15 nt, Human
uuuucauuaaaauuu

SEQ ID NO: 2748488 - RNA, 19 nt, Human
uuuucauuaaaauuuuuuu

SEQ ID NO: 2748489 - RNA, 17 nt, Human
uuuucauuaucucaaaa

SEQ ID NO: 2748490 - RNA, 23 nt, Human
uuuuccuuccuuaucacugacac

SEQ ID NO: 2748491 - RNA, 20 nt, Human
uuuuccuuugaauccucucu

SEQ ID NO: 2748492 - RNA, 12 nt, Human
uuuucuaaagua

SEQ ID NO: 2748493 - RNA, 21 nt, Human
uuuucucuaacucagaaacau

SEQ ID NO: 2748494 - RNA, 19 nt, Human
uuuucugcauguucuaaau

SEQ ID NO: 2748495 - RNA, 15 nt, Human
uuuucugcuuuaauu

SEQ ID NO: 2748496 - RNA, 19 nt, Human
uuggcaagcucuaucacca

SEQ ID NO: 2748497 - RNA, 18 nt, Human
uuggcccaggaguuuggc

SEQ ID NO: 2748498 - RNA, 22 nt, Human
uuggcccaggaguuuggccaga

SEQ ID NO: 2748499 - RNA, 16 nt, Human
uuggcugaaaggaagc

SEQ ID NO: 2748500 - RNA, 16 nt, Human
uuggcugcauaaaugu

SEQ ID NO: 2748501 - RNA, 19 nt, Human
uugggaaaggaguagaaaa

SEQ ID NO: 2748502 - RNA, 13 nt, Human
uugggaccccuga

SEQ ID NO: 2748503 - RNA, 16 nt, Human
uugggacuacaggcgu

SEQ ID NO: 2748504 - RNA, 14 nt, Human
uugggaugcuacuc

SEQ ID NO: 2748505 - RNA, 18 nt, Human
uugggcgggacacaggcu

SEQ ID NO: 2748506 - RNA, 16 nt, Human
uugggcugagcaguca

SEQ ID NO: 2748507 - RNA, 15 nt, Human
uuggggaauauguua

SEQ ID NO: 2748508 - RNA, 18 nt, Human
uuggggccuaugcagagg

SEQ ID NO: 2748509 - RNA, 18 nt, Human
uuggggggaguaaagaau

SEQ ID NO: 2748510 - RNA, 17 nt, Human
uugggguugggggggag

SEQ ID NO: 2748511 - RNA, 15 nt, Human
uugguagauucuaau

SEQ ID NO: 2748512 - RNA, 14 nt, Human
uugguauuguauuu

SEQ ID NO: 2748513 - RNA, 19 nt, Human
uuggucucagugucaaugc

SEQ ID NO: 2748514 - RNA, 22 nt, Human
uuggucugugagaugcuagaac

SEQ ID NO: 2748515 - RNA, 20 nt, Human
uugguucuaauagaacucag

SEQ ID NO: 2748516 - RNA, 14 nt, Human
uugguucucuccac

SEQ ID NO: 2748517 - RNA, 12 nt, Human
uugguuucccuu

SEQ ID NO: 2748518 - RNA, 14 nt, Human
uugguuucuagcau

SEQ ID NO: 2748519 - RNA, 19 nt, Human
uugguuuuaauuagugaac

SEQ ID NO: 2748520 - RNA, 13 nt, Human
uuguaaaauggug

SEQ ID NO: 2748521 - RNA, 24 nt, Human
uuguaaagacaauuguuggagagc

SEQ ID NO: 2748522 - RNA, 18 nt, Human
uuguaaaggaauuuaaaa

SEQ ID NO: 2748523 - RNA, 19 nt, Human
uuguaaaggaauuuaaaaa

SEQ ID NO: 2748524 - RNA, 23 nt, Human
uuguaaagguccuggcaaagaug

SEQ ID NO: 2748525 - RNA, 20 nt, Human
uuguaaaugugcuuuuaaaa

SEQ ID NO: 2748526 - RNA, 22 nt, Human
uuguaacaagccuccuuuuaaa

SEQ ID NO: 2748527 - RNA, 13 nt, Human
uuguaacugucuu

SEQ ID NO: 2748528 - RNA, 23 nt, Human
uuguaacuuaugaaccuuuacau

SEQ ID NO: 2748529 - RNA, 16 nt, Human
uuguaacuuucucuau

SEQ ID NO: 2748530 - RNA, 20 nt, Human
uuguaauaggcguaacuaau

SEQ ID NO: 2748531 - RNA, 14 nt, Human
uuguaauucuaaau

SEQ ID NO: 2748532 - RNA, 22 nt, Human
uuguacacaacaauccuucuau

SEQ ID NO: 2748533 - RNA, 16 nt, Human
uuguacaccaauauuc

SEQ ID NO: 2748534 - RNA, 16 nt, Human
uuguacauauaaguga

SEQ ID NO: 2748535 - RNA, 17 nt, Human
uuguaccgcaaugugac

SEQ ID NO: 2748536 - RNA, 20 nt, Human
uuguaccucucuuauagaau

SEQ ID NO: 2748537 - RNA, 15 nt, Human
uuguacuaugcuguu

SEQ ID NO: 2748538 - RNA, 19 nt, Human
uuguagaagucacauuccu

SEQ ID NO: 2748539 - RNA, 19 nt, Human
uuguagcauccucuuuaau

SEQ ID NO: 2748540 - RNA, 20 nt, Human
uuguaggcauguagcuacag

SEQ ID NO: 2748541 - RNA, 20 nt, Human
uuguagguaauauugcaagg

SEQ ID NO: 2748542 - RNA, 14 nt, Human
uuguauuuaaggau

SEQ ID NO: 2748543 - RNA, 17 nt, Human
uuguauuuuguuuaaau

SEQ ID NO: 2748544 - RNA, 13 nt, Human
uuguauuuuucca

SEQ ID NO: 2748545 - RNA, 17 nt, Human
uuguauuuuuuuucuug

SEQ ID NO: 2748546 - RNA, 16 nt, Human
uugucaauaaaaucca

SEQ ID NO: 2748547 - RNA, 16 nt, Human
uugucauuguuauaua

SEQ ID NO: 2748548 - RNA, 15 nt, Human
uuguccuuagucaca

SEQ ID NO: 2748549 - RNA, 15 nt, Human
uugucuagugaaacu

SEQ ID NO: 2748550 - RNA, 19 nt, Human
uugucucccagcucagggc

SEQ ID NO: 2748551 - RNA, 20 nt, Human
uugucucccagcucagggcu

SEQ ID NO: 2748552 - RNA, 23 nt, Human
uugucugaaauuuucuagaauac

SEQ ID NO: 2748553 - RNA, 14 nt, Human
uugucuuuuccuuc

SEQ ID NO: 2748554 - RNA, 17 nt, Human
uugugaaaaaaaauuuu

SEQ ID NO: 2748555 - RNA, 17 nt, Human
uugugaagcaaaauuuu

SEQ ID NO: 2748556 - RNA, 14 nt, Human
uugugauugauuau

SEQ ID NO: 2748557 - RNA, 14 nt, Human
uugugcuucuuucu

SEQ ID NO: 2748558 - RNA, 17 nt, Human
uugugcuugagccagga

SEQ ID NO: 2748559 - RNA, 19 nt, Human
uugugggauacuauuuaau

SEQ ID NO: 2748560 - RNA, 14 nt, Human
uugugguuagaaaa

SEQ ID NO: 2748561 - RNA, 19 nt, Human
uuguguaaugaaaaugaau

SEQ ID NO: 2748562 - RNA, 19 nt, Human
uugugugaaagguacuuca

SEQ ID NO: 2748563 - RNA, 16 nt, Human
uuguguguuauuuaaa

SEQ ID NO: 2748564 - RNA, 17 nt, Human
uuguguuuauaauuuua

SEQ ID NO: 2748565 - RNA, 14 nt, Human
uuguguuuugcaag

SEQ ID NO: 2748566 - RNA, 19 nt, Human
uuguuaaaauuaucaauau

SEQ ID NO: 2748567 - RNA, 13 nt, Human
uuguuaaaugauu

SEQ ID NO: 2748568 - RNA, 18 nt, Human
uuguuacaaauuguagaa

SEQ ID NO: 2748569 - RNA, 18 nt, Human
uuguuauguauauuuuau

SEQ ID NO: 2748570 - RNA, 23 nt, Human
uuguuauguauauuuuauaucaa

SEQ ID NO: 2748571 - RNA, 22 nt, Human
uuguuauuggguaucaccacug

SEQ ID NO: 2748572 - RNA, 18 nt, Human
uuguugacaacugugacu

SEQ ID NO: 2748573 - RNA, 16 nt, Human
uuguugugauuuucac

SEQ ID NO: 2748574 - RNA, 16 nt, Human
uuguuucaacaguuuu

SEQ ID NO: 2748575 - RNA, 21 nt, Human
uuguuuuaaaauuaaagcuaa

SEQ ID NO: 2748576 - RNA, 14 nt, Human
uuguuuucauuauc

SEQ ID NO: 2748577 - RNA, 19 nt, Human
uuguuuucauuaucucaaa

SEQ ID NO: 2748578 - RNA, 12 nt, Human
uuguuuuggaug

SEQ ID NO: 2748579 - RNA, 21 nt, Human
uuguuuuucagcguuaaugua

SEQ ID NO: 2748580 - RNA, 19 nt, Human
uuuaaaaaaaaaaaaaaag

SEQ ID NO: 2748581 - RNA, 17 nt, Human
uuuaaaaaaaaaacgua

SEQ ID NO: 2748582 - RNA, 21 nt, Human
uuuaaaaaaaaaccugagccc

SEQ ID NO: 2748583 - RNA, 12 nt, Human
uuuaaaacauua

SEQ ID NO: 2748584 - RNA, 18 nt, Human
uuuaaaauacacacucaa

SEQ ID NO: 2748585 - RNA, 19 nt, Human
uuuaaaaucucaaacuucu

SEQ ID NO: 2748586 - RNA, 21 nt, Human
uuuaaaauuuuuuuagaaagc

SEQ ID NO: 2748587 - RNA, 13 nt, Human
uuuaaacaaaaaa

SEQ ID NO: 2748588 - RNA, 17 nt, Human
uuuaaaccauuuucuuu

SEQ ID NO: 2748589 - RNA, 15 nt, Human
uuuaaagacaaagac

SEQ ID NO: 2748590 - RNA, 17 nt, Human
uuuaaagacuuuuauga

SEQ ID NO: 2748591 - RNA, 20 nt, Human
uuuaaagcuuauuaaaacuc

SEQ ID NO: 2748592 - RNA, 20 nt, Human
uuuaaauaaaguguuugaaa

SEQ ID NO: 2748593 - RNA, 15 nt, Human
uuuaaauaggguugu

SEQ ID NO: 2748594 - RNA, 14 nt, Human
uuuaaauauuuuuu

SEQ ID NO: 2748595 - RNA, 19 nt, Human
uuuaaaucacucaaauugu

SEQ ID NO: 2748596 - RNA, 11 nt, Human
uuuaaaugaag

SEQ ID NO: 2748597 - RNA, 23 nt, Human
uuuaaaugaguguguuugucacc

SEQ ID NO: 2748598 - RNA, 15 nt, Human
uuuaaaugucugaaa

SEQ ID NO: 2748599 - RNA, 13 nt, Human
uuuaaauuguaau

SEQ ID NO: 2748600 - RNA, 16 nt, Human
uuuaacaucugagaaa

SEQ ID NO: 2748601 - RNA, 23 nt, Human
uuuaacauuccucaugaauguaa

SEQ ID NO: 2748602 - RNA, 11 nt, Human
uuuaacuccug

SEQ ID NO: 2748603 - RNA, 19 nt, Human
uuuaagaauccaaacguua

SEQ ID NO: 2748604 - RNA, 15 nt, Human
uuuaagauaauuaua

SEQ ID NO: 2748605 - RNA, 16 nt, Human
uuuaagauuuuguuuu

SEQ ID NO: 2748606 - RNA, 20 nt, Human
uuuaaggccaggcauggugg

SEQ ID NO: 2748607 - RNA, 19 nt, Human
uuuaaguuauuuuuacauu

SEQ ID NO: 2748608 - RNA, 17 nt, Human
uuuaauaaauguauauu

SEQ ID NO: 2748609 - RNA, 18 nt, Human
uuuaauaaauuucaccaa

SEQ ID NO: 2748610 - RNA, 18 nt, Human
uuuaauagguuuggacaa

SEQ ID NO: 2748611 - RNA, 20 nt, Human
uuuaaugagauaaugugaua

SEQ ID NO: 2748612 - RNA, 21 nt, Human
uuuaauuagccagugaaaaac

SEQ ID NO: 2748613 - RNA, 15 nt, Human
uuuaauuauuucacu

SEQ ID NO: 2748614 - RNA, 16 nt, Human
uuuaauuucaugaaaa

SEQ ID NO: 2748615 - RNA, 18 nt, Human
uuuaauuugguuuucaca

SEQ ID NO: 2748616 - RNA, 20 nt, Human
uuuaauuuuacauuuccuaa

SEQ ID NO: 2748617 - RNA, 19 nt, Human
uuuacaaauagaauuugag

SEQ ID NO: 2748618 - RNA, 16 nt, Human
uuuacacacauuaaaa

SEQ ID NO: 2748619 - RNA, 15 nt, Human
uuuacaugaauugca

SEQ ID NO: 2748620 - RNA, 22 nt, Human
uuuacauggcuggagcuagaau

SEQ ID NO: 2748621 - RNA, 14 nt, Human
uuuacccuucuuuu

SEQ ID NO: 2748622 - RNA, 15 nt, Human
uuuaccugugaaaua

SEQ ID NO: 2748623 - RNA, 17 nt, Human
uuuacuacuuuaaaaaa

SEQ ID NO: 2748624 - RNA, 12 nt, Human
uuuacuuuucca

SEQ ID NO: 2748625 - RNA, 22 nt, Human
uuuagaaagaagcccaauauua

SEQ ID NO: 2748626 - RNA, 23 nt, Human
uuuagaaagaagcccaauauuau

SEQ ID NO: 2748627 - RNA, 14 nt, Human
uuuagaauaugccu

SEQ ID NO: 2748628 - RNA, 20 nt, Human
uuuagacauucuuuaucuuu

SEQ ID NO: 2748629 - RNA, 16 nt, Human
uuuagcaaagauaucu

SEQ ID NO: 2748630 - RNA, 15 nt, Human
uuuagccuuaaagau

SEQ ID NO: 2748631 - RNA, 13 nt, Human
uuuagcuggaaaa

SEQ ID NO: 2748632 - RNA, 15 nt, Human
uuuaguauuuuguuu

SEQ ID NO: 2748633 - RNA, 15 nt, Human
uuuagugaaauauua

SEQ ID NO: 2748634 - RNA, 15 nt, Human
uuuaguguucauaaa

SEQ ID NO: 2748635 - RNA, 19 nt, Human
uuuaguguucauaaauaaa

SEQ ID NO: 2748636 - RNA, 18 nt, Human
uuuaguuauaaaaauaua

SEQ ID NO: 2748637 - RNA, 20 nt, Human
uuuauaaaaauaaaaaacac

SEQ ID NO: 2748638 - RNA, 13 nt, Human
uuuauaaacuuuu

SEQ ID NO: 2748639 - RNA, 16 nt, Human
uuuauaacucaucaua

SEQ ID NO: 2748640 - RNA, 22 nt, Human
uuuauaacucaucauaaaauaa

SEQ ID NO: 2748641 - RNA, 21 nt, Human
uuuauaauagcaacuuuugug

SEQ ID NO: 2748642 - RNA, 19 nt, Human
uuuauaauuccuauauccu

SEQ ID NO: 2748643 - RNA, 13 nt, Human
uuuauaauuuuaa

SEQ ID NO: 2748644 - RNA, 15 nt, Human
uuuauacagugucuu

SEQ ID NO: 2748645 - RNA, 21 nt, Human
uuuauagccagguaccuucuc

SEQ ID NO: 2748646 - RNA, 17 nt, Human
uuuauagcuacuaauuu

SEQ ID NO: 2748647 - RNA, 22 nt, Human
uuuauagcuacuaauuuuaaaa

SEQ ID NO: 2748648 - RNA, 19 nt, Human
uuuauaucaauuuaaaaaa

SEQ ID NO: 2748649 - RNA, 14 nt, Human
uuuauaugcuucug

SEQ ID NO: 2748650 - RNA, 16 nt, Human
uuuauauuugaaauau

SEQ ID NO: 2748651 - RNA, 17 nt, Human
uuuaucaugugaaauca

SEQ ID NO: 2748652 - RNA, 15 nt, Human
uuuaucaugugucuu

SEQ ID NO: 2748653 - RNA, 17 nt, Human
uuuauccuaucucucca

SEQ ID NO: 2748654 - RNA, 20 nt, Human
uuuaugauacuugaaaauua

SEQ ID NO: 2748655 - RNA, 21 nt, Human
uuuaugauacuugaaaauuaa

SEQ ID NO: 2748656 - RNA, 15 nt, Human
uuuaugcauacagua

SEQ ID NO: 2748657 - RNA, 18 nt, Human
uuuaugcauagauaaucu

SEQ ID NO: 2748658 - RNA, 16 nt, Human
uuuaugcauauuauuu

SEQ ID NO: 2748659 - RNA, 22 nt, Human
uuuauggcacuaguauuucuau

SEQ ID NO: 2748660 - RNA, 15 nt, Human
uuuaugguuguauua

SEQ ID NO: 2748661 - RNA, 20 nt, Human
uuuaugugcaucuuauuucu

SEQ ID NO: 2748662 - RNA, 23 nt, Human
uuuauuaggaguaccauaauucu

SEQ ID NO: 2748663 - RNA, 13 nt, Human
uuuauuauauaua

SEQ ID NO: 2748664 - RNA, 16 nt, Human
uuuauucauauuuucu

SEQ ID NO: 2748665 - RNA, 13 nt, Human
uuuauuuugccaa

SEQ ID NO: 2748666 - RNA, 21 nt, Human
uuucaaaacucauuuccuaug

SEQ ID NO: 2748667 - RNA, 14 nt, Human
uuucaauaaaacuu

SEQ ID NO: 2748668 - RNA, 12 nt, Human
uuucaauauuua

SEQ ID NO: 2748669 - RNA, 19 nt, Human
uuucacaagugaaaaacau

SEQ ID NO: 2748670 - RNA, 15 nt, Human
uuucacauuuaaaua

SEQ ID NO: 2748671 - RNA, 13 nt, Human
uuucaccauguug

SEQ ID NO: 2748672 - RNA, 14 nt, Human
uuucacugugcaaa

SEQ ID NO: 2748673 - RNA, 18 nt, Human
uuucacugugcaaauaua

SEQ ID NO: 2748674 - RNA, 20 nt, Human
uuucacuguguuggccagga

SEQ ID NO: 2748675 - RNA, 23 nt, Human
uuucaguucucuugauuuucauu

SEQ ID NO: 2748676 - RNA, 16 nt, Human
uuucauaaagcaggca

SEQ ID NO: 2748677 - RNA, 18 nt, Human
uuucauaaagucuugccu

SEQ ID NO: 2748678 - RNA, 20 nt, Human
uuucauaagaauucuguuga

SEQ ID NO: 2748679 - RNA, 14 nt, Human
uuucauacauuuuc

SEQ ID NO: 2748680 - RNA, 19 nt, Human
uuucaugaaggggcggcgg

SEQ ID NO: 2748681 - RNA, 15 nt, Human
uuucaugauuuugaa

SEQ ID NO: 2748682 - RNA, 16 nt, Human
uuucaugauuuugaaa

SEQ ID NO: 2748683 - RNA, 21 nt, Human
uuucaugcuguucaugaaaga

SEQ ID NO: 2748684 - RNA, 20 nt, Human
uuucauguauuuuaaaauaa

SEQ ID NO: 2748685 - RNA, 21 nt, Human
uuucauuaucucaaaacugca

SEQ ID NO: 2748686 - RNA, 15 nt, Human
uuucauugcucagaa

SEQ ID NO: 2748687 - RNA, 14 nt, Human
uuucauuucuuuga

SEQ ID NO: 2748688 - RNA, 15 nt, Human
uuuccaaauucacaa

SEQ ID NO: 2748689 - RNA, 19 nt, Human
uuuccaagaaauauuccuu

SEQ ID NO: 2748690 - RNA, 22 nt, Human
uuuccaagcaaguauuagaaua

SEQ ID NO: 2748691 - RNA, 20 nt, Human
uuuccaaugacauuuuguug

SEQ ID NO: 2748692 - RNA, 17 nt, Human
uguuccuuauauuuacu

SEQ ID NO: 2748693 - RNA, 14 nt, Human
uguuccuuucucug

SEQ ID NO: 2748694 - RNA, 12 nt, Human
uguuccuuuugu

SEQ ID NO: 2748695 - RNA, 22 nt, Human
uguucuaaauaaaaagcauuau

SEQ ID NO: 2748696 - RNA, 16 nt, Human
uguucuaagaagugaa

SEQ ID NO: 2748697 - RNA, 22 nt, Human
uguucuaagaagugaaaaucua

SEQ ID NO: 2748698 - RNA, 16 nt, Human
uguucuauaacaacaa

SEQ ID NO: 2748699 - RNA, 23 nt, Human
uguucuugugaacccaaagugug

SEQ ID NO: 2748700 - RNA, 19 nt, Human
uguugaagagguuuuaaag

SEQ ID NO: 2748701 - RNA, 14 nt, Human
uguugaauuuugau

SEQ ID NO: 2748702 - RNA, 17 nt, Human
uguugacaacugugacu

SEQ ID NO: 2748703 - RNA, 19 nt, Human
uguugacaacugugacugu

SEQ ID NO: 2748704 - RNA, 12 nt, Human
uguugacauggg

SEQ ID NO: 2748705 - RNA, 22 nt, Human
uguugagcuguuuucccugacc

SEQ ID NO: 2748706 - RNA, 14 nt, Human
uguugauggaaaua

SEQ ID NO: 2748707 - RNA, 18 nt, Human
uguugcagugucugcugg

SEQ ID NO: 2748708 - RNA, 23 nt, Human
uguugcauagaauaaaauuuuua

SEQ ID NO: 2748709 - RNA, 14 nt, Human
uguugccaaggcug

SEQ ID NO: 2748710 - RNA, 24 nt, Human
uguugccaaggcuggagugcagug

SEQ ID NO: 2748711 - RNA, 13 nt, Human
uguugccaggcug

SEQ ID NO: 2748712 - RNA, 18 nt, Human
uguugccaggcuggagug

SEQ ID NO: 2748713 - RNA, 23 nt, Human
uguugcccacagcuguaugauuc

SEQ ID NO: 2748714 - RNA, 16 nt, Human
uguugcuaucaaucca

SEQ ID NO: 2748715 - RNA, 20 nt, Human
uguugcuaucaauccaagaa

SEQ ID NO: 2748716 - RNA, 19 nt, Human
uguuggacgagaaaacaau

SEQ ID NO: 2748717 - RNA, 21 nt, Human
uguuggacgagaaaacaauaa

SEQ ID NO: 2748718 - RNA, 20 nt, Human
uguugggguggguauaaaag

SEQ ID NO: 2748719 - RNA, 18 nt, Human
uguugguacuagauacug

SEQ ID NO: 2748720 - RNA, 17 nt, Human
uguuguguuuuuaacau

SEQ ID NO: 2748721 - RNA, 14 nt, Human
uguuguuauuuaaa

SEQ ID NO: 2748722 - RNA, 17 nt, Human
uguuucaacaguuuuug

SEQ ID NO: 2748723 - RNA, 19 nt, Human
uguuucaacaguuuuugcu

SEQ ID NO: 2748724 - RNA, 19 nt, Human
uguuucacugugcaaauau

SEQ ID NO: 2748725 - RNA, 22 nt, Human
uguuucagugcacuaaugugua

SEQ ID NO: 2748726 - RNA, 13 nt, Human
uguuucauauuuu

SEQ ID NO: 2748727 - RNA, 22 nt, Human
uguuuccucuguauacaaaacc

SEQ ID NO: 2748728 - RNA, 13 nt, Human
uguuucuuucuuu

SEQ ID NO: 2748729 - RNA, 22 nt, Human
uguuugccuucuacuuuuaagu

SEQ ID NO: 2748730 - RNA, 16 nt, Human
uguuugcuaagcauuc

SEQ ID NO: 2748731 - RNA, 21 nt, Human
uguuugcuaagcauuccaacu

SEQ ID NO: 2748732 - RNA, 18 nt, Human
uguuugcucagcuucucc

SEQ ID NO: 2748733 - RNA, 17 nt, Human
uguuuuaaaaugagaaa

SEQ ID NO: 2748734 - RNA, 15 nt, Human
uguuuuaaaauuaaa

SEQ ID NO: 2748735 - RNA, 22 nt, Human
uguuuuauuuaaccucuaaauu

SEQ ID NO: 2748736 - RNA, 13 nt, Human
uguuuucccuccu

SEQ ID NO: 2748737 - RNA, 21 nt, Human
uguuuucuuaaccagaucauu

SEQ ID NO: 2748738 - RNA, 18 nt, Human
uguuuugacauuuuuagu

SEQ ID NO: 2748739 - RNA, 22 nt, Human
uguuuugccguggcuuggggau

SEQ ID NO: 2748740 - RNA, 15 nt, Human
uguuuuuaaacugga

SEQ ID NO: 2748741 - RNA, 21 nt, Human
uguuuuuaacaugucaaucug

SEQ ID NO: 2748742 - RNA, 22 nt, Human
uguuuuuccaguaguuagcuuu

SEQ ID NO: 2748743 - RNA, 15 nt, Human
uuaaaaaagaaacau

SEQ ID NO: 2748744 - RNA, 16 nt, Human
uuaaaaaauagcagcu

SEQ ID NO: 2748745 - RNA, 23 nt, Human
uuaaaaauaguugcugucaucca

SEQ ID NO: 2748746 - RNA, 13 nt, Human
uuaaaagaaugau

SEQ ID NO: 2748747 - RNA, 14 nt, Human
uuaaaagaugaaaa

SEQ ID NO: 2748748 - RNA, 19 nt, Human
uuaaaagaugaaaauauuu

SEQ ID NO: 2748749 - RNA, 14 nt, Human
uuaaaaguuuuuua

SEQ ID NO: 2748750 - RNA, 17 nt, Human
uuaaaauaugcucuaaa

SEQ ID NO: 2748751 - RNA, 21 nt, Human
uuaaaauauuuuuaugugcaa

SEQ ID NO: 2748752 - RNA, 19 nt, Human
uuaaaaucaguauuugucu

SEQ ID NO: 2748753 - RNA, 22 nt, Human
uuaaaaugucuugcuugauugu

SEQ ID NO: 2748754 - RNA, 18 nt, Human
uuaaaauguuagaaaaaa

SEQ ID NO: 2748755 - RNA, 13 nt, Human
uuaaacaaaaaaa

SEQ ID NO: 2748756 - RNA, 24 nt, Human
uuaaacaaaaaaagcauuguaacu

SEQ ID NO: 2748757 - RNA, 17 nt, Human
uuaaacacauuaggaaa

SEQ ID NO: 2748758 - RNA, 16 nt, Human
uuaaacauuaauauuu

SEQ ID NO: 2748759 - RNA, 16 nt, Human
uuaaacuggaaauaaa

SEQ ID NO: 2748760 - RNA, 14 nt, Human
uuaaacuuugauuu

SEQ ID NO: 2748761 - RNA, 16 nt, Human
uuaaagaauuuucaaa

SEQ ID NO: 2748762 - RNA, 15 nt, Human
uuaaagacaaagaca

SEQ ID NO: 2748763 - RNA, 14 nt, Human
uuaaagaucugcaa

SEQ ID NO: 2748764 - RNA, 19 nt, Human
uuaaagcuaaaguaucugu

SEQ ID NO: 2748765 - RNA, 14 nt, Human
uuaaagcugccggc

SEQ ID NO: 2748766 - RNA, 20 nt, Human
uuaaagcuguuauuuaauua

SEQ ID NO: 2748767 - RNA, 17 nt, Human
uuaaagcuuauuaaaac

SEQ ID NO: 2748768 - RNA, 18 nt, Human
uuaaauaaauuguauauu

SEQ ID NO: 2748769 - RNA, 18 nt, Human
uuaaauagagaaauauga

SEQ ID NO: 2748770 - RNA, 16 nt, Human
uuaaauagcuuuuuuc

SEQ ID NO: 2748771 - RNA, 15 nt, Human
uuaaauauuuauuua

SEQ ID NO: 2748772 - RNA, 19 nt, Human
uuaaaucaaccuugcuuug

SEQ ID NO: 2748773 - RNA, 13 nt, Human
uuaaaugaagaaa

SEQ ID NO: 2748774 - RNA, 13 nt, Human
uuaaaugccaggc

SEQ ID NO: 2748775 - RNA, 19 nt, Human
uuaaauggagaaaggaccc

SEQ ID NO: 2748776 - RNA, 16 nt, Human
uuaaauuguaauaggc

SEQ ID NO: 2748777 - RNA, 16 nt, Human
uuaacacaugauccug

SEQ ID NO: 2748778 - RNA, 18 nt, Human
uuaacaccuuuaaagugu

SEQ ID NO: 2748779 - RNA, 13 nt, Human
uuaacauuauuua

SEQ ID NO: 2748780 - RNA, 23 nt, Human
uuaaccagaucauugugaaauua

SEQ ID NO: 2748781 - RNA, 18 nt, Human
uuaacuagaauuuauuca

SEQ ID NO: 2748782 - RNA, 21 nt, Human
uuaacuagaauuuauucaauu

SEQ ID NO: 2748783 - RNA, 18 nt, Human
uuaacugccuuguguaca

SEQ ID NO: 2748784 - RNA, 22 nt, Human
uuaagaaucuuuauaguucuac

SEQ ID NO: 2748785 - RNA, 19 nt, Human
uuaagacgaaacauuuguu

SEQ ID NO: 2748786 - RNA, 16 nt, Human
uuaagagaacaagcaa

SEQ ID NO: 2748787 - RNA, 21 nt, Human
uuaagauaugggacauuuuug

SEQ ID NO: 2748788 - RNA, 16 nt, Human
uuaaggguaggcucaa

SEQ ID NO: 2748789 - RNA, 23 nt, Human
uuaaguagauaaggaaauaagaa

SEQ ID NO: 2748790 - RNA, 20 nt, Human
uuaaguuuuuuuuuaaaaaa

SEQ ID NO: 2748791 - RNA, 12 nt, Human
uuaauaaaccau

SEQ ID NO: 2748792 - RNA, 16 nt, Human
uuaauaaauguauauu

SEQ ID NO: 2748793 - RNA, 15 nt, Human
uuaauaauuuuuaau

SEQ ID NO: 2748794 - RNA, 14 nt, Human
uuaauauauauuau

SEQ ID NO: 2748795 - RNA, 16 nt, Human
uuaauauauguauuau

SEQ ID NO: 2748796 - RNA, 17 nt, Human
uuaauauguuauuauua

SEQ ID NO: 2748797 - RNA, 20 nt, Human
uuaauauuuaacauuauuua

SEQ ID NO: 2748798 - RNA, 18 nt, Human
uuaauccccaguaaaauu

SEQ ID NO: 2748799 - RNA, 16 nt, Human
uuaaucuguauuuccc

SEQ ID NO: 2748800 - RNA, 16 nt, Human
uuaaugaauaaacauu

SEQ ID NO: 2748801 - RNA, 22 nt, Human
uuaaugcugaaaaaucauccaa

SEQ ID NO: 2748802 - RNA, 11 nt, Human
uuaauguuucu

SEQ ID NO: 2748803 - RNA, 11 nt, Human
uuaauuaaaag

SEQ ID NO: 2748804 - RNA, 13 nt, Human
uuaauuagugcua

SEQ ID NO: 2748805 - RNA, 19 nt, Human
uuaauuaucuaguuuaauu

SEQ ID NO: 2748806 - RNA, 14 nt, Human
uuaauuauuauuua

SEQ ID NO: 2748807 - RNA, 14 nt, Human
uuaauuauuucacu

SEQ ID NO: 2748808 - RNA, 15 nt, Human
uuaauucugaaagca

SEQ ID NO: 2748809 - RNA, 19 nt, Human
uuaauuugguuuucacauu

SEQ ID NO: 2748810 - RNA, 18 nt, Human
uuaauuuuugaaaacugg

SEQ ID NO: 2748811 - RNA, 18 nt, Human
uuacaaaugggaaacaaa

SEQ ID NO: 2748812 - RNA, 21 nt, Human
uuacaaugcauucugagguaa

SEQ ID NO: 2748813 - RNA, 13 nt, Human
uuacacacauuaa

SEQ ID NO: 2748814 - RNA, 17 nt, Human
uuacacacauuaaaaug

SEQ ID NO: 2748815 - RNA, 18 nt, Human
uucacaagugaaaaacau

SEQ ID NO: 2748816 - RNA, 10 nt, Human
uucacauuua

SEQ ID NO: 2748817 - RNA, 16 nt, Human
uucacauuuuuguauu

SEQ ID NO: 2748818 - RNA, 23 nt, Human
uucaccaauaaguauucuguguu

SEQ ID NO: 2748819 - RNA, 14 nt, Human
uucacuaucuguaa

SEQ ID NO: 2748820 - RNA, 15 nt, Human
uucacuaucuguaau

SEQ ID NO: 2748821 - RNA, 15 nt, Human
uucacuguaaaauaa

SEQ ID NO: 2748822 - RNA, 17 nt, Human
uucacuguaaaauaaua

SEQ ID NO: 2748823 - RNA, 23 nt, Human
uucacuuccaagagccuuuuuuu

SEQ ID NO: 2748824 - RNA, 16 nt, Human
uucagacauagaauua

SEQ ID NO: 2748825 - RNA, 14 nt, Human
uucagacuguuuuu

SEQ ID NO: 2748826 - RNA, 15 nt, Human
uucagaguuuguauu

SEQ ID NO: 2748827 - RNA, 13 nt, Human
uucagauaaucac

SEQ ID NO: 2748828 - RNA, 15 nt, Human
uucagauaaucacaa

SEQ ID NO: 2748829 - RNA, 15 nt, Human
uucagauauaaaaga

SEQ ID NO: 2748830 - RNA, 16 nt, Human
uucagauauaaaagac

SEQ ID NO: 2748831 - RNA, 19 nt, Human
uucagauauaaaagacuga

SEQ ID NO: 2748832 - RNA, 18 nt, Human
uucagcagagaaguuuuc

SEQ ID NO: 2748833 - RNA, 14 nt, Human
uucagcccucagaa

SEQ ID NO: 2748834 - RNA, 14 nt, Human
uucagccugaaaga

SEQ ID NO: 2748835 - RNA, 21 nt, Human
uucagccugaaagaggaauga

SEQ ID NO: 2748836 - RNA, 19 nt, Human
uucagggcuauuuuuuccc

SEQ ID NO: 2748837 - RNA, 20 nt, Human
uucaguucucuugauuuuca

SEQ ID NO: 2748838 - RNA, 16 nt, Human
uucauaaagcaggcag

SEQ ID NO: 2748839 - RNA, 13 nt, Human
uucauaaagucuu

SEQ ID NO: 2748840 - RNA, 17 nt, Human
uucauaaagucuugccu

SEQ ID NO: 2748841 - RNA, 21 nt, Human
uucauacauuuucuaagaaac

SEQ ID NO: 2748842 - RNA, 22 nt, Human
uucauagaguucccaugaacua

SEQ ID NO: 2748843 - RNA, 22 nt, Human
uucauagcagcuuauucacaag

SEQ ID NO: 2748844 - RNA, 23 nt, Human
uucauagcagcuuauucacaaga

SEQ ID NO: 2748845 - RNA, 15 nt, Human
uucaucaaugaauga

SEQ ID NO: 2748846 - RNA, 12 nt, Human
uucaucaugcuu

SEQ ID NO: 2748847 - RNA, 12 nt, Human
uucauccgcaaa

SEQ ID NO: 2748848 - RNA, 20 nt, Human
uucauccucacucaguccag

SEQ ID NO: 2748849 - RNA, 10 nt, Human
uucaugauuu

SEQ ID NO: 2748850 - RNA, 21 nt, Human
uucaugcugucuacacuaaga

SEQ ID NO: 2748851 - RNA, 21 nt, Human
uucauucaagucagcucuucu

SEQ ID NO: 2748852 - RNA, 19 nt, Human
uucauuguucuauaacaac

SEQ ID NO: 2748853 - RNA, 19 nt, Human
uuccaaauucucacagaag

SEQ ID NO: 2748854 - RNA, 17 nt, Human
uuccaacuaucucauuu

SEQ ID NO: 2748855 - RNA, 15 nt, Human
uuccaagaaauauuc

SEQ ID NO: 2748856 - RNA, 18 nt, Human
uuccaagaaauauuccuu

SEQ ID NO: 2748857 - RNA, 17 nt, Human
uuccaagccucaugucc

SEQ ID NO: 2748858 - RNA, 16 nt, Human
uuccaagugauugaaa

SEQ ID NO: 2748859 - RNA, 23 nt, Human
uuccaauuagcuccuccuuuuuc

SEQ ID NO: 2748860 - RNA, 20 nt, Human
uuccacagaagcuccaggua

SEQ ID NO: 2748861 - RNA, 17 nt, Human
uuccagaccugaagaau

SEQ ID NO: 2748862 - RNA, 17 nt, Human
uuccagggcuacgcgcg

SEQ ID NO: 2748863 - RNA, 23 nt, Human
uuccaggugguaagcaccaggac

SEQ ID NO: 2748864 - RNA, 14 nt, Human
uuccaguggcggca

SEQ ID NO: 2748865 - RNA, 16 nt, Human
uuccauauaaauauua

SEQ ID NO: 2748866 - RNA, 14 nt, Human
uuccauauuaaaau

SEQ ID NO: 2748867 - RNA, 15 nt, Human
uuccaucaccucccc

SEQ ID NO: 2748868 - RNA, 11 nt, Human
uuccauuuuuu

SEQ ID NO: 2748869 - RNA, 19 nt, Human
uucccaaauuucauaccua

SEQ ID NO: 2748870 - RNA, 18 nt, Human
uucccaaccauacaaaaa

SEQ ID NO: 2748871 - RNA, 21 nt, Human
uucccaacuccagaaagugac

SEQ ID NO: 2748872 - RNA, 15 nt, Human
uucccaauugcuuua

SEQ ID NO: 2748873 - RNA, 18 nt, Human
uucccacacuguccauuc

SEQ ID NO: 2748874 - RNA, 18 nt, Human
uucccaccaggcugcuca

SEQ ID NO: 2748875 - RNA, 18 nt, Human
uucccauucuacauacua

SEQ ID NO: 2748876 - RNA, 11 nt, Human
uuccccauggc

SEQ ID NO: 2748877 - RNA, 23 nt, Human
uucccccagugcggccagcuccg

SEQ ID NO: 2748878 - RNA, 14 nt, Human
uuccccucugcagc

SEQ ID NO: 2748879 - RNA, 13 nt, Human
uuccccuugccca

SEQ ID NO: 2748880 - RNA, 18 nt, Human
uucccgcuguuccucgcc

SEQ ID NO: 2748881 - RNA, 21 nt, Human
uucccgcuguuccucgccacg

SEQ ID NO: 2748882 - RNA, 18 nt, Human
uucccguggaacguuuuu

SEQ ID NO: 2748883 - RNA, 15 nt, Human
uucccgugugccuga

SEQ ID NO: 2748884 - RNA, 22 nt, Human
uucccucuugcucagugggggc

SEQ ID NO: 2748885 - RNA, 12 nt, Human
uucccugaccuc

SEQ ID NO: 2748886 - RNA, 11 nt, Human
uucccugccug

SEQ ID NO: 2748887 - RNA, 16 nt, Human
uucccuguuucuucca

SEQ ID NO: 2748888 - RNA, 19 nt, Human
uucccuguuucuuccacag

SEQ ID NO: 2748889 - RNA, 15 nt, Human
uucccuugagcccuc

SEQ ID NO: 2748890 - RNA, 16 nt, Human
uucccuugagcccucu

SEQ ID NO: 2748891 - RNA, 18 nt, Human
uucccuugaugaagaagu

SEQ ID NO: 2748892 - RNA, 19 nt, Human
uucccuugaugaagaaguu

SEQ ID NO: 2748893 - RNA, 13 nt, Human
uuccgacugccau

SEQ ID NO: 2748894 - RNA, 16 nt, Human
uuccgcauccuagucu

SEQ ID NO: 2748895 - RNA, 17 nt, Human
uuccuaaauauauuuua

SEQ ID NO: 2748896 - RNA, 13 nt, Human
uuccuaagugauu

SEQ ID NO: 2748897 - RNA, 16 nt, Human
uuccuaauuccacagc

SEQ ID NO: 2748898 - RNA, 20 nt, Human
uuccuaauuccacagcugcu

SEQ ID NO: 2748899 - RNA, 21 nt, Human
uuccuaauuccacagcugcuc

SEQ ID NO: 2748900 - RNA, 14 nt, Human
uuccuagaaacuga

SEQ ID NO: 2748901 - RNA, 21 nt, Human
uuccuagucuguuuucccucc

SEQ ID NO: 2748902 - RNA, 22 nt, Human
uuccuagucuguuuucccuccu

SEQ ID NO: 2748903 - RNA, 15 nt, Human
uuccucaaaaagauu

SEQ ID NO: 2748904 - RNA, 18 nt, Human
uuccucacuuugaagagu

SEQ ID NO: 2748905 - RNA, 19 nt, Human
uuccucagacucuaagaaa

SEQ ID NO: 2748906 - RNA, 18 nt, Human
uuccucagcugugugggu

SEQ ID NO: 2748907 - RNA, 23 nt, Human
uuccucaugaauguaaauuugua

SEQ ID NO: 2748908 - RNA, 14 nt, Human
uuccuccacaccau

SEQ ID NO: 2748909 - RNA, 15 nt, Human
uuccuccuucccuug

SEQ ID NO: 2748910 - RNA, 13 nt, Human
uuccucugagccu

SEQ ID NO: 2748911 - RNA, 11 nt, Human
uuccucugccc

SEQ ID NO: 2748912 - RNA, 19 nt, Human
uuccucugcccuuccugca

SEQ ID NO: 2748913 - RNA, 22 nt, Human
uuccucuguauacaaaacccuu

SEQ ID NO: 2748914 - RNA, 12 nt, Human
uuccugaacagg

SEQ ID NO: 2748915 - RNA, 15 nt, Human
uuccugagaccagcc

SEQ ID NO: 2748916 - RNA, 18 nt, Human
uuccugagaccagccaac

SEQ ID NO: 2748917 - RNA, 13 nt, Human
uuccugcaggcag

SEQ ID NO: 2748918 - RNA, 16 nt, Human
uuccugggagcuuuug

SEQ ID NO: 2748919 - RNA, 16 nt, Human
uuccugggucuaccac

SEQ ID NO: 2748920 - RNA, 16 nt, Human
uuccuuacucuugauu

SEQ ID NO: 2748921 - RNA, 12 nt, Human
uuccuuauauuu

SEQ ID NO: 2748922 - RNA, 12 nt, Human
uuccuuauucag

SEQ ID NO: 2748923 - RNA, 17 nt, Human
uuccuucauuuccuccg

SEQ ID NO: 2748924 - RNA, 15 nt, Human
uuccuucucaucugu

SEQ ID NO: 2748925 - RNA, 22 nt, Human
uuccuucugagccugccuuucu

SEQ ID NO: 2748926 - RNA, 13 nt, Human
uuccuucugcucc

SEQ ID NO: 2748927 - RNA, 16 nt, Human
uuccuucuuuuuuucu

SEQ ID NO: 2748928 - RNA, 22 nt, Human
uuccuuggacucauuuuaaaaa

SEQ ID NO: 2748929 - RNA, 18 nt, Human
uuccuugggcuuuagccu

SEQ ID NO: 2748930 - RNA, 12 nt, Human
uuccuuuuacuu

SEQ ID NO: 2748931 - RNA, 15 nt, Human
uuccuuuuacuuuuc

SEQ ID NO: 2748932 - RNA, 20 nt, Human
uucgaugguacauauuucuu

SEQ ID NO: 2748933 - RNA, 12 nt, Human
uucggccuccau

SEQ ID NO: 2748934 - RNA, 21 nt, Human
uucggccuccauccugaggcu

SEQ ID NO: 2748935 - RNA, 20 nt, Human
uucgugaaguauacuguauu

SEQ ID NO: 2748936 - RNA, 14 nt, Human
uucguuuucaaaau

SEQ ID NO: 2748937 - RNA, 22 nt, Human
uucuaaaguaaaaacaaagaaa

SEQ ID NO: 2748938 - RNA, 17 nt, Human
uucuaaauaaaaagcau

SEQ ID NO: 2748939 - RNA, 17 nt, Human
uucuaaaugaauguuua

SEQ ID NO: 2748940 - RNA, 13 nt, Human
uucuaagaaguga

SEQ ID NO: 2748941 - RNA, 15 nt, Human
uucuaagaagugaaa

SEQ ID NO: 2748942 - RNA, 12 nt, Human
uucuaauagaac

SEQ ID NO: 2748943 - RNA, 13 nt, Human
uucuaccacccac

SEQ ID NO: 2748944 - RNA, 15 nt, Human
uucuacuacauggaa

SEQ ID NO: 2748945 - RNA, 22 nt, Human
uucuacuggcugccagaaucua

SEQ ID NO: 2748946 - RNA, 14 nt, Human
uucuagaauacuaa

SEQ ID NO: 2748947 - RNA, 22 nt, Human
uucuagcuguugagcuguuuuc

SEQ ID NO: 2748948 - RNA, 19 nt, Human
uucuagggaaaugaaagaa

SEQ ID NO: 2748949 - RNA, 14 nt, Human
uucuagguucuaaa

SEQ ID NO: 2748950 - RNA, 17 nt, Human
uucuagguucuaaaaau

SEQ ID NO: 2748951 - RNA, 22 nt, Human
uucuauaauguaaacaauauca

SEQ ID NO: 2748952 - RNA, 13 nt, Human
uucuauaauuuaa

SEQ ID NO: 2748953 - RNA, 17 nt, Human
uucuauaauuuaaauau

SEQ ID NO: 2748954 - RNA, 16 nt, Human
uucuauagcuuuuccc

SEQ ID NO: 2748955 - RNA, 17 nt, Human
uucuauagcuuuucccu

SEQ ID NO: 2748956 - RNA, 13 nt, Human
uucuaugaaauau

SEQ ID NO: 2748957 - RNA, 21 nt, Human
uucuaugagauagguacuauu

SEQ ID NO: 2748958 - RNA, 17 nt, Human
uucuauggcauauugau

SEQ ID NO: 2748959 - RNA, 17 nt, Human
uucuauucuagccugca

SEQ ID NO: 2748960 - RNA, 19 nt, Human
uucuauugugcuuucuauc

SEQ ID NO: 2748961 - RNA, 15 nt, Human
uucuauuuauuuacu

SEQ ID NO: 2748962 - RNA, 16 nt, Human
uucucaccugugagac

SEQ ID NO: 2748963 - RNA, 19 nt, Human
uucucagaaucaugcugag

SEQ ID NO: 2748964 - RNA, 15 nt, Human
uucucauaacucugu

SEQ ID NO: 2748965 - RNA, 17 nt, Human
uucucauaacucuguga

SEQ ID NO: 2748966 - RNA, 14 nt, Human
uucucaugauuauu

SEQ ID NO: 2748967 - RNA, 17 nt, Human
uucuccacuggaaaacu

SEQ ID NO: 2748968 - RNA, 17 nt, Human
uucuccauacucuguaa

SEQ ID NO: 2748969 - RNA, 15 nt, Human
uucuccuaaaacuuu

SEQ ID NO: 2748970 - RNA, 19 nt, Human
uucucuaacucagaaacau

SEQ ID NO: 2748971 - RNA, 12 nt, Human
uucucuaggaaa

SEQ ID NO: 2748972 - RNA, 16 nt, Human
uucucuaggaaauauu

SEQ ID NO: 2748973 - RNA, 17 nt, Human
uucucuaggaaauauuu

SEQ ID NO: 2748974 - RNA, 20 nt, Human
uucucuaucauuuaauaaua

SEQ ID NO: 2748975 - RNA, 23 nt, Human
uucucucuccuguacuuuuucca

SEQ ID NO: 2748976 - RNA, 17 nt, Human
uucucuucacagucaca

SEQ ID NO: 2748977 - RNA, 16 nt, Human
uucugaaauuuccugg

SEQ ID NO: 2748978 - RNA, 13 nt, Human
uucugaagaagau

SEQ ID NO: 2748979 - RNA, 14 nt, Human
uucugaagaagaug

SEQ ID NO: 2748980 - RNA, 17 nt, Human
uucugacacuaaaacac

SEQ ID NO: 2748981 - RNA, 20 nt, Human
uucugacuauuuuucagaau

SEQ ID NO: 2748982 - RNA, 14 nt, Human
uucugagccugccu

SEQ ID NO: 2748983 - RNA, 14 nt, Human
uucugaggccaggg

SEQ ID NO: 2748984 - RNA, 19 nt, Human
uucugauaaugaaaauuau

SEQ ID NO: 2748985 - RNA, 18 nt, Human
uucugauauuggacagua

SEQ ID NO: 2748986 - RNA, 14 nt, Human
uucuggaauaaucc

SEQ ID NO: 2748987 - RNA, 21 nt, Human
uucuggacuguuuuuaaaaaa

SEQ ID NO: 2748988 - RNA, 20 nt, Human
uucuggcaccaggaaucccc

SEQ ID NO: 2748989 - RNA, 16 nt, Human
uucuggguucaagcga

SEQ ID NO: 2748990 - RNA, 22 nt, Human
uucugguagcuaaauauauauu

SEQ ID NO: 2748991 - RNA, 19 nt, Human
uucugucaacuuguauuuu

SEQ ID NO: 2748992 - RNA, 22 nt, Human
uucugucauuucaaagacucuc

SEQ ID NO: 2748993 - RNA, 16 nt, Human
uucugugauauaagug

SEQ ID NO: 2748994 - RNA, 15 nt, Human
uucuguguuaaaaau

SEQ ID NO: 2748995 - RNA, 15 nt, Human
uucuguuaaaauaua

SEQ ID NO: 2748996 - RNA, 22 nt, Human
uucuuaaaugggcuacuuuguc

SEQ ID NO: 2748997 - RNA, 21 nt, Human
uucuuaaccagaucauuguga

SEQ ID NO: 2748998 - RNA, 22 nt, Human
uucuucaccuuaggaauaaucu

SEQ ID NO: 2748999 - RNA, 13 nt, Human
uucuuccacagug

SEQ ID NO: 2749000 - RNA, 15 nt, Human
uucuuccucccauuc

SEQ ID NO: 2749001 - RNA, 20 nt, Human
ugggacagucaccucaugga

SEQ ID NO: 2749002 - RNA, 21 nt, Human
ugggacagucaccucauggaa

SEQ ID NO: 2749003 - RNA, 23 nt, Human
ugggacagucaccucauggaauu

SEQ ID NO: 2749004 - RNA, 13 nt, Human
ugggacaguuccu

SEQ ID NO: 2749005 - RNA, 17 nt, Human
ugggacaguuccugaga

SEQ ID NO: 2749006 - RNA, 21 nt, Human
ugggacauuugcucauggaau

SEQ ID NO: 2749007 - RNA, 14 nt, Human
ugggacccugucuc

SEQ ID NO: 2749008 - RNA, 22 nt, Human
ugggacuaaguguaccagagaa

SEQ ID NO: 2749009 - RNA, 16 nt, Human
ugggacuacaggcgug

SEQ ID NO: 2749010 - RNA, 15 nt, Human
ugggacugggacacu

SEQ ID NO: 2749011 - RNA, 13 nt, Human
ugggagaaaugaa

SEQ ID NO: 2749012 - RNA, 17 nt, Human
ugggagaaaugaaaaaa

SEQ ID NO: 2749013 - RNA, 18 nt, Human
ugggagaaucacuugaac

SEQ ID NO: 2749014 - RNA, 22 nt, Human
ugggagagacuuguuuuggaug

SEQ ID NO: 2749015 - RNA, 17 nt, Human
ugggagccagggcuguc

SEQ ID NO: 2749016 - RNA, 19 nt, Human
ugggagcuuuuguagaagu

SEQ ID NO: 2749017 - RNA, 12 nt, Human
ugggaggcugag

SEQ ID NO: 2749018 - RNA, 21 nt, Human
ugggaggcugagaugggagaa

SEQ ID NO: 2749019 - RNA, 15 nt, Human
ugggaguacaaaagu

SEQ ID NO: 2749020 - RNA, 20 nt, Human
ugggagugcccccaacagca

SEQ ID NO: 2749021 - RNA, 21 nt, Human
ugggagugcccccaacagcac

SEQ ID NO: 2749022 - RNA, 17 nt, Human
ugggauagcugacccag

SEQ ID NO: 2749023 - RNA, 13 nt, Human
ugggcaaaaaacc

SEQ ID NO: 2749024 - RNA, 18 nt, Human
ugggcacaggguuuaugu

SEQ ID NO: 2749025 - RNA, 15 nt, Human
ugggcagaaggccaa

SEQ ID NO: 2749026 - RNA, 19 nt, Human
ugggcagaaggccaagagg

SEQ ID NO: 2749027 - RNA, 23 nt, Human
ugggcagccagaccagcaggcug

SEQ ID NO: 2749028 - RNA, 19 nt, Human
ugggcaggcagauguuccu

SEQ ID NO: 2749029 - RNA, 19 nt, Human
ugggcagugaugucacuag

SEQ ID NO: 2749030 - RNA, 18 nt, Human
ugggcaugguggugugug

SEQ ID NO: 2749031 - RNA, 22 nt, Human
ugggcccaguaccuagcuggcu

SEQ ID NO: 2749032 - RNA, 20 nt, Human
ugggccccagauaccaugau

SEQ ID NO: 2749033 - RNA, 22 nt, Human
ugggccccagauaccaugaugc

SEQ ID NO: 2749034 - RNA, 21 nt, Human
ugggccuccucuguccagggc

SEQ ID NO: 2749035 - RNA, 16 nt, Human
uggggaagacaguggc

SEQ ID NO: 2749036 - RNA, 16 nt, Human
uggggauagugaggca

SEQ ID NO: 2749037 - RNA, 16 nt, Human
uggggaugaacuuuuu

SEQ ID NO: 2749038 - RNA, 19 nt, Human
uggggcagugcuuggccca

SEQ ID NO: 2749039 - RNA, 22 nt, Human
uggggccuaugcagagguccac

SEQ ID NO: 2749040 - RNA, 20 nt, Human
uggggcuaaggcaggaggau

SEQ ID NO: 2749041 - RNA, 15 nt, Human
uggggcuuccuaacu

SEQ ID NO: 2749042 - RNA, 19 nt, Human
uggggcuuuaacuccugcu

SEQ ID NO: 2749043 - RNA, 20 nt, Human
uggggcuuuaacuccugcua

SEQ ID NO: 2749044 - RNA, 21 nt, Human
uggggcuuuaacuccugcuag

SEQ ID NO: 2749045 - RNA, 15 nt, Human
ugggggcagagccac

SEQ ID NO: 2749046 - RNA, 16 nt, Human
uggggggaguaaagaa

SEQ ID NO: 2749047 - RNA, 18 nt, Human
ugggguaccuagucccca

SEQ ID NO: 2749048 - RNA, 17 nt, Human
ugggguggguauaaaag

SEQ ID NO: 2749049 - RNA, 15 nt, Human
ugggguggguggggc

SEQ ID NO: 2749050 - RNA, 19 nt, Human
ugggguguguggcagagcc

SEQ ID NO: 2749051 - RNA, 12 nt, Human
uggguagacaca

SEQ ID NO: 2749052 - RNA, 16 nt, Human
ugggucgcccuggacu

SEQ ID NO: 2749053 - RNA, 22 nt, Human
ugggucgcccuggacugugugc

SEQ ID NO: 2749054 - RNA, 16 nt, Human
ugggucucaguguccu

SEQ ID NO: 2749055 - RNA, 21 nt, Human
ugggucucaguguccucaucu

SEQ ID NO: 2749056 - RNA, 18 nt, Human
ugggugaaagauggaacu

SEQ ID NO: 2749057 - RNA, 22 nt, Human
ugggugccccccuugccagaca

SEQ ID NO: 2749058 - RNA, 19 nt, Human
uggguuucacaagugaaaa

SEQ ID NO: 2749059 - RNA, 22 nt, Human
uggguuuuuuaguugaauuuuu

SEQ ID NO: 2749060 - RNA, 17 nt, Human
ugguaaaauacuucuug

SEQ ID NO: 2749061 - RNA, 17 nt, Human
ugguaaaccuuuuauau

SEQ ID NO: 2749062 - RNA, 22 nt, Human
ugguaaggggaauugaggacac

SEQ ID NO: 2749063 - RNA, 17 nt, Human
ugguagaggaugaggaa

SEQ ID NO: 2749064 - RNA, 21 nt, Human
ugguagauucuaauggcuuua

SEQ ID NO: 2749065 - RNA, 15 nt, Human
ugguagcuaaauaua

SEQ ID NO: 2749066 - RNA, 16 nt, Human
ugguagcuaaauauau

SEQ ID NO: 2749067 - RNA, 17 nt, Human
ugguagcuaaauauaua

SEQ ID NO: 2749068 - RNA, 17 nt, Human
ugguaggacuguagaaa

SEQ ID NO: 2749069 - RNA, 13 nt, Human
ugguauagaaaug

SEQ ID NO: 2749070 - RNA, 16 nt, Human
ugguauagaaaugcug

SEQ ID NO: 2749071 - RNA, 21 nt, Human
ugguauguuuucaggcuagau

SEQ ID NO: 2749072 - RNA, 18 nt, Human
uggucaauuuuguuaugu

SEQ ID NO: 2749073 - RNA, 11 nt, Human
uggucccuugg

SEQ ID NO: 2749074 - RNA, 21 nt, Human
uggucugguugggcagccaga

SEQ ID NO: 2749075 - RNA, 14 nt, Human
uggucugugagaug

SEQ ID NO: 2749076 - RNA, 16 nt, Human
uggucugugagaugcu

SEQ ID NO: 2749077 - RNA, 18 nt, Human
uggucugugagaugcuag

SEQ ID NO: 2749078 - RNA, 19 nt, Human
uggugaacuugguuuuaau

SEQ ID NO: 2749079 - RNA, 19 nt, Human
uggugagugccuguaauca

SEQ ID NO: 2749080 - RNA, 21 nt, Human
uggugcccaguuagccucugc

SEQ ID NO: 2749081 - RNA, 20 nt, Human
uggugccucaccccuugcca

SEQ ID NO: 2749082 - RNA, 15 nt, Human
uggugccuucauuug

SEQ ID NO: 2749083 - RNA, 13 nt, Human
ugguggccugggg

SEQ ID NO: 2749084 - RNA, 16 nt, Human
uggugggacagggacc

SEQ ID NO: 2749085 - RNA, 23 nt, Human
uggugggcagagagguagggaug

SEQ ID NO: 2749086 - RNA, 22 nt, Human
uggugggccuccucuguccagg

SEQ ID NO: 2749087 - RNA, 24 nt, Human
uggugugcuggcuuaaaauguaau

SEQ ID NO: 2749088 - RNA, 23 nt, Human
ugguguguucaagaccagccugg

SEQ ID NO: 2749089 - RNA, 23 nt, Human
ugguuagaaaaguuauguagaaa

SEQ ID NO: 2749090 - RNA, 18 nt, Human
ugguuccauucucucucc

SEQ ID NO: 2749091 - RNA, 17 nt, Human
ugguucccuugaugaag

SEQ ID NO: 2749092 - RNA, 19 nt, Human
ugguucucauaacucugug

SEQ ID NO: 2749093 - RNA, 22 nt, Human
ugguuguauuauuuuuuaaaaa

SEQ ID NO: 2749094 - RNA, 20 nt, Human
ugguuuaaauggucaauuuu

SEQ ID NO: 2749095 - RNA, 20 nt, Human
ugguuuuagugauuuuaaua

SEQ ID NO: 2749096 - RNA, 19 nt, Human
uguaaaagacuuuuuuuua

SEQ ID NO: 2749097 - RNA, 16 nt, Human
uguaaaauaauaacug

SEQ ID NO: 2749098 - RNA, 11 nt, Human
uguaaaauggu

SEQ ID NO: 2749099 - RNA, 20 nt, Human
uguaaagcuuugugcagauu

SEQ ID NO: 2749100 - RNA, 16 nt, Human
uguaaaggaauuuaaa

SEQ ID NO: 2749101 - RNA, 19 nt, Human
uguaaaggaauuuaaaaau

SEQ ID NO: 2749102 - RNA, 13 nt, Human
uguaaaguacaga

SEQ ID NO: 2749103 - RNA, 19 nt, Human
uguaaagugauauuucccc

SEQ ID NO: 2749104 - RNA, 14 nt, Human
uguaaagugauuuu

SEQ ID NO: 2749105 - RNA, 23 nt, Human
uguaaaugugcuuuuaaaaaaaa

SEQ ID NO: 2749106 - RNA, 14 nt, Human
uguaacuaaaguua

SEQ ID NO: 2749107 - RNA, 22 nt, Human
uguaacugucuucuagcaguga

SEQ ID NO: 2749108 - RNA, 12 nt, Human
uguaacuuauga

SEQ ID NO: 2749109 - RNA, 15 nt, Human
uguaacuuaugaacc

SEQ ID NO: 2749110 - RNA, 23 nt, Human
uguaacuucccugaaaaaucuaa

SEQ ID NO: 2749111 - RNA, 18 nt, Human
uguaacuugaagguggcu

SEQ ID NO: 2749112 - RNA, 14 nt, Human
uguaacuuucucua

SEQ ID NO: 2749113 - RNA, 13 nt, Human
uguaagacaaaua

SEQ ID NO: 2749114 - RNA, 18 nt, Human
uguaagggaaacugccag

SEQ ID NO: 2749115 - RNA, 23 nt, Human
uguaauaaaacauguuccuuaua

SEQ ID NO: 2749116 - RNA, 14 nt, Human
uguaauaaaauguc

SEQ ID NO: 2749117 - RNA, 20 nt, Human
uguaauaaacucauuucuag

SEQ ID NO: 2749118 - RNA, 23 nt, Human
uguaaucccagcuacuugggagg

SEQ ID NO: 2749119 - RNA, 13 nt, Human
uguaauguuaaua

SEQ ID NO: 2749120 - RNA, 21 nt, Human
uguaauuaaucuuguaaauau

SEQ ID NO: 2749121 - RNA, 22 nt, Human
uguaauuaaucuuguaaauaua

SEQ ID NO: 2749122 - RNA, 13 nt, Human
uguaauucuaaau

SEQ ID NO: 2749123 - RNA, 16 nt, Human
uguaauugauuuauuu

SEQ ID NO: 2749124 - RNA, 16 nt, Human
uguaauuugaaauauu

SEQ ID NO: 2749125 - RNA, 21 nt, Human
uguaauuuuuuugugggaaau

SEQ ID NO: 2749126 - RNA, 23 nt, Human
uguacaauaaagcaaugugguag

SEQ ID NO: 2749127 - RNA, 12 nt, Human
uguacaauguga

SEQ ID NO: 2749128 - RNA, 22 nt, Human
uguacacaacaauccuucuauu

SEQ ID NO: 2749129 - RNA, 21 nt, Human
uguacagacagaaaaaacuga

SEQ ID NO: 2749130 - RNA, 17 nt, Human
uguacagucuuguauua

SEQ ID NO: 2749131 - RNA, 16 nt, Human
uguacaugaagaagcu

SEQ ID NO: 2749132 - RNA, 14 nt, Human
uguacauguacuga

SEQ ID NO: 2749133 - RNA, 21 nt, Human
uguacauuuccaaauucacaa

SEQ ID NO: 2749134 - RNA, 15 nt, Human
uguaccauguacaug

SEQ ID NO: 2749135 - RNA, 11 nt, Human
uguacccagua

SEQ ID NO: 2749136 - RNA, 15 nt, Human
uguacuugcucuuga

SEQ ID NO: 2749137 - RNA, 18 nt, Human
uguacuuuauuuucuaua

SEQ ID NO: 2749138 - RNA, 15 nt, Human
ugagcucaccagucc

SEQ ID NO: 2749139 - RNA, 15 nt, Human
ugagcucagcccugg

SEQ ID NO: 2749140 - RNA, 16 nt, Human
ugagcucagcccuggu

SEQ ID NO: 2749141 - RNA, 18 nt, Human
ugagcucagcccuggugg

SEQ ID NO: 2749142 - RNA, 21 nt, Human
ugagcucagcccuggugggca

SEQ ID NO: 2749143 - RNA, 23 nt, Human
ugagcugauaucaugccccugua

SEQ ID NO: 2749144 - RNA, 19 nt, Human
ugaggacuugggcgggaca

SEQ ID NO: 2749145 - RNA, 11 nt, Human
ugaggagcugu

SEQ ID NO: 2749146 - RNA, 17 nt, Human
ugaggcauuugcagcug

SEQ ID NO: 2749147 - RNA, 11 nt, Human
ugaggccaggg

SEQ ID NO: 2749148 - RNA, 17 nt, Human
ugaggcccuaucuuuug

SEQ ID NO: 2749149 - RNA, 14 nt, Human
ugaggcuacagaac

SEQ ID NO: 2749150 - RNA, 14 nt, Human
ugaggcuuuaaaac

SEQ ID NO: 2749151 - RNA, 15 nt, Human
ugagggcuugaggac

SEQ ID NO: 2749152 - RNA, 12 nt, Human
ugccaaaauaua

SEQ ID NO: 2749153 - RNA, 17 nt, Human
ugccaaauauaaauaaa

SEQ ID NO: 2749154 - RNA, 21 nt, Human
ugccaaaucaaaagacuuuuu

SEQ ID NO: 2749155 - RNA, 13 nt, Human
ugccaagagccug

SEQ ID NO: 2749156 - RNA, 12 nt, Human
ugccacccaguu

SEQ ID NO: 2749157 - RNA, 15 nt, Human
ugccacuagcccucc

SEQ ID NO: 2749158 - RNA, 21 nt, Human
ugccacuagcccuccucuccc

SEQ ID NO: 2749159 - RNA, 12 nt, Human
ugccagccagca

SEQ ID NO: 2749160 - RNA, 13 nt, Human
ugccagcuggccu

SEQ ID NO: 2749161 - RNA, 21 nt, Human
ugccagcuggccuugugagga

SEQ ID NO: 2749162 - RNA, 13 nt, Human
ugccaggcacacu

SEQ ID NO: 2749163 - RNA, 13 nt, Human
ugccaggccuggc

SEQ ID NO: 2749164 - RNA, 19 nt, Human
ugccaggcuggagugcagu

SEQ ID NO: 2749165 - RNA, 15 nt, Human
ugccauaaaacuuag

SEQ ID NO: 2749166 - RNA, 15 nt, Human
ugccaucccucccuc

SEQ ID NO: 2749167 - RNA, 19 nt, Human
ugccaucccucccuccacc

SEQ ID NO: 2749168 - RNA, 20 nt, Human
ugccaucccucccuccaccu

SEQ ID NO: 2749169 - RNA, 17 nt, Human
ugcccacggcuggagcu

SEQ ID NO: 2749170 - RNA, 17 nt, Human
ugcccaguuagccucug

SEQ ID NO: 2749171 - RNA, 17 nt, Human
ugcccauaccccuggcc

SEQ ID NO: 2749172 - RNA, 21 nt, Human
ugcccauccugccccugagcc

SEQ ID NO: 2749173 - RNA, 17 nt, Human
ugcccccaacagcaccc

SEQ ID NO: 2749174 - RNA, 23 nt, Human
ugcccccaacagcacccucucca

SEQ ID NO: 2749175 - RNA, 15 nt, Human
ugccccccagcccuc

SEQ ID NO: 2749176 - RNA, 20 nt, Human
ugccccccagcccuccuuau

SEQ ID NO: 2749177 - RNA, 14 nt, Human
ugccccccuugcca

SEQ ID NO: 2749178 - RNA, 13 nt, Human
ugccccggggagg

SEQ ID NO: 2749179 - RNA, 15 nt, Human
ugccccggggagggg

SEQ ID NO: 2749180 - RNA, 15 nt, Human
ugccccgucccccuc

SEQ ID NO: 2749181 - RNA, 18 nt, Human
ugccccugcacuccagcc

SEQ ID NO: 2749182 - RNA, 20 nt, Human
ugcccgucuucagccuagcc

SEQ ID NO: 2749183 - RNA, 18 nt, Human
ugcccucccccuccucuc

SEQ ID NO: 2749184 - RNA, 12 nt, Human
ugcccucuccug

SEQ ID NO: 2749185 - RNA, 17 nt, Human
ugcccucuccugggcag

SEQ ID NO: 2749186 - RNA, 19 nt, Human
ugcccucuccugggcagcu

SEQ ID NO: 2749187 - RNA, 19 nt, Human
ugcccugaaagucccagau

SEQ ID NO: 2749188 - RNA, 17 nt, Human
ugcccugcugcccuccc

SEQ ID NO: 2749189 - RNA, 18 nt, Human
ugcccugcugcccucccc

SEQ ID NO: 2749190 - RNA, 16 nt, Human
ugcccuguugcugccu

SEQ ID NO: 2749191 - RNA, 20 nt, Human
ugcccuuccccuucccacac

SEQ ID NO: 2749192 - RNA, 19 nt, Human
ugcccuuccugcaggcagg

SEQ ID NO: 2749193 - RNA, 20 nt, Human
ugcccuuccugcaggcagga

SEQ ID NO: 2749194 - RNA, 18 nt, Human
ugccgacagcucuccaau

SEQ ID NO: 2749195 - RNA, 18 nt, Human
ugccgauaucuucagaaa

SEQ ID NO: 2749196 - RNA, 22 nt, Human
ugccgcuagauacaugcuuuuu

SEQ ID NO: 2749197 - RNA, 17 nt, Human
ugccgcucucucugagg

SEQ ID NO: 2749198 - RNA, 14 nt, Human
ugccgcuuucucug

SEQ ID NO: 2749199 - RNA, 20 nt, Human
ugccgugugugugcguccug

SEQ ID NO: 2749200 - RNA, 16 nt, Human
ugccuaagugcagccc

SEQ ID NO: 2749201 - RNA, 13 nt, Human
ugccuaauuuguu

SEQ ID NO: 2749202 - RNA, 18 nt, Human
ugccuaauuuguuuuccc

SEQ ID NO: 2749203 - RNA, 18 nt, Human
ugccuaggcauagcccug

SEQ ID NO: 2749204 - RNA, 21 nt, Human
ugccuaggcauagcccugccu

SEQ ID NO: 2749205 - RNA, 15 nt, Human
ugccuauuuuaauaa

SEQ ID NO: 2749206 - RNA, 18 nt, Human
ugccuauuuuaauaaaca

SEQ ID NO: 2749207 - RNA, 16 nt, Human
ugccucaaccucccaa

SEQ ID NO: 2749208 - RNA, 21 nt, Human
ugccucagaaaacaaggauga

SEQ ID NO: 2749209 - RNA, 11 nt, Human
ugccucagccu

SEQ ID NO: 2749210 - RNA, 23 nt, Human
ugccucagccucccgaguagcug

SEQ ID NO: 2749211 - RNA, 15 nt, Human
ugccucccagguuca

SEQ ID NO: 2749212 - RNA, 16 nt, Human
ugccuccccuccucug

SEQ ID NO: 2749213 - RNA, 17 nt, Human
ugccuccccuccucugc

SEQ ID NO: 2749214 - RNA, 18 nt, Human
ugccuccccuccucugcu

SEQ ID NO: 2749215 - RNA, 20 nt, Human
ugccuccccuccucugcuug

SEQ ID NO: 2749216 - RNA, 22 nt, Human
ugccuccccuccucugcuugcc

SEQ ID NO: 2749217 - RNA, 13 nt, Human
ugccuccccugcc

SEQ ID NO: 2749218 - RNA, 16 nt, Human
ugccuccccugccuca

SEQ ID NO: 2749219 - RNA, 23 nt, Human
ugccucuaaaaggccugucccug

SEQ ID NO: 2749220 - RNA, 15 nt, Human
ugccucucucaucca

SEQ ID NO: 2749221 - RNA, 13 nt, Human
ugccucugagagc

SEQ ID NO: 2749222 - RNA, 22 nt, Human
ugccucugcacacccuccagag

SEQ ID NO: 2749223 - RNA, 12 nt, Human
ugccucuguauu

SEQ ID NO: 2749224 - RNA, 18 nt, Human
ugccucuguauuuaaaaa

SEQ ID NO: 2749225 - RNA, 22 nt, Human
ugccugagcggaccuucccagc

SEQ ID NO: 2749226 - RNA, 13 nt, Human
ugccugcaggcau

SEQ ID NO: 2749227 - RNA, 19 nt, Human
ugccugcaggcaugaguca

SEQ ID NO: 2749228 - RNA, 17 nt, Human
ugccugccccuacccug

SEQ ID NO: 2749229 - RNA, 14 nt, Human
ugccuguaaucaca

SEQ ID NO: 2749230 - RNA, 23 nt, Human
ugccuucccaggaguacacccca

SEQ ID NO: 2749231 - RNA, 14 nt, Human
ugccuucuggccuu

SEQ ID NO: 2749232 - RNA, 17 nt, Human
ugccuucuggccuugua

SEQ ID NO: 2749233 - RNA, 18 nt, Human
ugccuucuggccuuguaa

SEQ ID NO: 2749234 - RNA, 22 nt, Human
ugccuucuggccuuguaagacc

SEQ ID NO: 2749235 - RNA, 13 nt, Human
ugccuuuaaaaau

SEQ ID NO: 2749236 - RNA, 18 nt, Human
ugccuuucuucucuccag

SEQ ID NO: 2749237 - RNA, 18 nt, Human
ugcgccaccauggccagc

SEQ ID NO: 2749238 - RNA, 18 nt, Human
ugcgcuguguacaaugug

SEQ ID NO: 2749239 - RNA, 14 nt, Human
ugcggccuggucua

SEQ ID NO: 2749240 - RNA, 20 nt, Human
ugcguccugucggagcccug

SEQ ID NO: 2749241 - RNA, 19 nt, Human
ugcuaacugguuaaacauu

SEQ ID NO: 2749242 - RNA, 18 nt, Human
ugcuaauuauauaauauu

SEQ ID NO: 2749243 - RNA, 17 nt, Human
ugcuaauuuugaaaaac

SEQ ID NO: 2749244 - RNA, 20 nt, Human
ugcuaauuuugaaaaacugc

SEQ ID NO: 2749245 - RNA, 16 nt, Human
ugcuacaaaaacacag

SEQ ID NO: 2749246 - RNA, 19 nt, Human
ugcuacaggauuugaaauu

SEQ ID NO: 2749247 - RNA, 18 nt, Human
ugcuacucuguuccuuca

SEQ ID NO: 2749248 - RNA, 13 nt, Human
ugcuagaacuccc

SEQ ID NO: 2749249 - RNA, 14 nt, Human
ugcuagaacucccu

SEQ ID NO: 2749250 - RNA, 15 nt, Human
ugcuagagugacuca

SEQ ID NO: 2749251 - RNA, 15 nt, Human
ugcuauucuccauac

SEQ ID NO: 2749252 - RNA, 18 nt, Human
ugcuauuuauuaaguauu

SEQ ID NO: 2749253 - RNA, 22 nt, Human
ugcucacacugcugaugauuua

SEQ ID NO: 2749254 - RNA, 12 nt, Human
ugcucagcccug

SEQ ID NO: 2749255 - RNA, 13 nt, Human
ugcucagcccugc

SEQ ID NO: 2749256 - RNA, 18 nt, Human
ugcucagcccugcaccau

SEQ ID NO: 2749257 - RNA, 15 nt, Human
ugcucagcuucucca

SEQ ID NO: 2749258 - RNA, 20 nt, Human
ugcucagcuucuccaacaau

SEQ ID NO: 2749259 - RNA, 12 nt, Human
ugcucaggagcc

SEQ ID NO: 2749260 - RNA, 16 nt, Human
ugcucaggagcccugg

SEQ ID NO: 2749261 - RNA, 14 nt, Human
ugcucagggcuggu

SEQ ID NO: 2749262 - RNA, 20 nt, Human
ugcucagugggggcagagcc

SEQ ID NO: 2749263 - RNA, 14 nt, Human
ugcucauggaauug

SEQ ID NO: 2749264 - RNA, 18 nt, Human
ugcucauggaauuggagc

SEQ ID NO: 2749265 - RNA, 23 nt, Human
ugcucauuuuuucuucuccuaaa

SEQ ID NO: 2749266 - RNA, 15 nt, Human
ugcucccuagccaga

SEQ ID NO: 2749267 - RNA, 18 nt, Human
ugcucgcccacuuccucc

SEQ ID NO: 2749268 - RNA, 11 nt, Human
ugcucucccag

SEQ ID NO: 2749269 - RNA, 13 nt, Human
ugcucucccagcc

SEQ ID NO: 2749270 - RNA, 14 nt, Human
ugcucucccagccc

SEQ ID NO: 2749271 - RNA, 17 nt, Human
ugcucucggugcuucca

SEQ ID NO: 2749272 - RNA, 19 nt, Human
ugcucucggugcuuccaac

SEQ ID NO: 2749273 - RNA, 17 nt, Human
ugcucugucuucuuugc

SEQ ID NO: 2749274 - RNA, 18 nt, Human
ugcucuguguuuacagac

SEQ ID NO: 2749275 - RNA, 15 nt, Human
ugcugaacucccucu

SEQ ID NO: 2749276 - RNA, 18 nt, Human
ugcugaacucccucucug

SEQ ID NO: 2749277 - RNA, 13 nt, Human
ugcugacccuccc

SEQ ID NO: 2749278 - RNA, 15 nt, Human
ugcugacccucccca

SEQ ID NO: 2749279 - RNA, 13 nt, Human
ugcugacuggcuu

SEQ ID NO: 2749280 - RNA, 20 nt, Human
ugcugagccccaaguggaac

SEQ ID NO: 2749281 - RNA, 11 nt, Human
ugcugauuguu

SEQ ID NO: 2749282 - RNA, 18 nt, Human
ugcugcagccccugggac

SEQ ID NO: 2749283 - RNA, 18 nt, Human
ugcugccucuaaaaggcc

SEQ ID NO: 2749284 - RNA, 21 nt, Human
ugcugcgcagcaucccuaguc

SEQ ID NO: 2749285 - RNA, 14 nt, Human
ugcuggagcucugc

SEQ ID NO: 2749286 - RNA, 14 nt, Human
ugcuggagugcagu

SEQ ID NO: 2749287 - RNA, 16 nt, Human
ugcuggauucaaguga

SEQ ID NO: 2749288 - RNA, 18 nt, Human
ugcuggauucaagugauc

SEQ ID NO: 2749289 - RNA, 21 nt, Human
ugcuggcaguggaacuaagaa

SEQ ID NO: 2749290 - RNA, 21 nt, Human
ugcuggccaccugcugagccc

SEQ ID NO: 2749291 - RNA, 12 nt, Human
ugcuggccaggc

SEQ ID NO: 2749292 - RNA, 16 nt, Human
ugcugggccccugccu

SEQ ID NO: 2749293 - RNA, 15 nt, Human
ugcugguggcgcugg

SEQ ID NO: 2749294 - RNA, 14 nt, Human
ugcugguuuuucag

SEQ ID NO: 2749295 - RNA, 11 nt, Human
ugcuguagaag

SEQ ID NO: 2749296 - RNA, 13 nt, Human
ugcuguagaagau

SEQ ID NO: 2749297 - RNA, 13 nt, Human
ugcuguauaaaau

SEQ ID NO: 2749298 - RNA, 14 nt, Human
ugcuguauaaaauc

SEQ ID NO: 2749299 - RNA, 13 nt, Human
ugcuguauuuuaa

SEQ ID NO: 2749300 - RNA, 14 nt, Human
ugcuguauuuuaaa

SEQ ID NO: 2749301 - RNA, 15 nt, Human
ugcuguauuuuaaaa

SEQ ID NO: 2749302 - RNA, 23 nt, Human
ugcugucauaaugguuuuuaaca

SEQ ID NO: 2749303 - RNA, 13 nt, Human
ugcugucauccac

SEQ ID NO: 2749304 - RNA, 17 nt, Human
ugcuguucaugaaagau

SEQ ID NO: 2749305 - RNA, 17 nt, Human
ugcuuaaggccaugauu

SEQ ID NO: 2749306 - RNA, 23 nt, Human
ugcuuauccguuagccgugguga

SEQ ID NO: 2749307 - RNA, 18 nt, Human
ugcuuccaacucauccac

SEQ ID NO: 2749308 - RNA, 16 nt, Human
ugcuucuccagccuca

SEQ ID NO: 2749309 - RNA, 22 nt, Human
ugcuucuccagccucagccucc

SEQ ID NO: 2749310 - RNA, 14 nt, Human
ugcuucuguuuuau

SEQ ID NO: 2749311 - RNA, 15 nt, Human
ugcuucuguuuuaua

SEQ ID NO: 2749312 - RNA, 16 nt, Human
ugcuucuguuuuauaa

SEQ ID NO: 2749313 - RNA, 20 nt, Human
ugcuucuuggacuucuugaa

SEQ ID NO: 2749314 - RNA, 14 nt, Human
ugcuugagccagga

SEQ ID NO: 2749315 - RNA, 13 nt, Human
ugcuugccauccc

SEQ ID NO: 2749316 - RNA, 20 nt, Human
ugcuugccaucccucccucc

SEQ ID NO: 2749317 - RNA, 13 nt, Human
ugcuuggcccagg

SEQ ID NO: 2749318 - RNA, 15 nt, Human
ugcuugucccugugg

SEQ ID NO: 2749319 - RNA, 16 nt, Human
ugcuuucuucucccaa

SEQ ID NO: 2749320 - RNA, 15 nt, Human
ugcuuugccccugag

SEQ ID NO: 2749321 - RNA, 12 nt, Human
ugcuuuuaaaaa

SEQ ID NO: 2749322 - RNA, 13 nt, Human
ugcuuuuaaaaaa

SEQ ID NO: 2749323 - RNA, 12 nt, Human
ugcuuuuuaaug

SEQ ID NO: 2749324 - RNA, 21 nt, Human
uggaaaaaaaggaagaaauuc

SEQ ID NO: 2749325 - RNA, 14 nt, Human
uggaaaaguauguu

SEQ ID NO: 2749326 - RNA, 16 nt, Human
uggaaaaugugcaaua

SEQ ID NO: 2749327 - RNA, 20 nt, Human
uggaaacacauguuccccuu

SEQ ID NO: 2749328 - RNA, 15 nt, Human
uggaaacgaagcacc

SEQ ID NO: 2749329 - RNA, 16 nt, Human
uggaaacgaagcacca

SEQ ID NO: 2749330 - RNA, 18 nt, Human
uggaaacgaagcaccauc

SEQ ID NO: 2749331 - RNA, 21 nt, Human
uggaaacguauucaaacaauu

SEQ ID NO: 2749332 - RNA, 13 nt, Human
uggaaagaaguug

SEQ ID NO: 2749333 - RNA, 15 nt, Human
uggaaaggcagcucu

SEQ ID NO: 2749334 - RNA, 22 nt, Human
uggaaaggggcaggccagagcu

SEQ ID NO: 2749335 - RNA, 23 nt, Human
uggaaaggggcaggccagagcua

SEQ ID NO: 2749336 - RNA, 22 nt, Human
uggaaaguuuaugguuguauua

SEQ ID NO: 2749337 - RNA, 19 nt, Human
uggaaauagugauuuccac

SEQ ID NO: 2749338 - RNA, 19 nt, Human
uggaaauguuuacagaucc

SEQ ID NO: 2749339 - RNA, 23 nt, Human
uggaaauguuuacagauccccaa

SEQ ID NO: 2749340 - RNA, 19 nt, Human
uggaacaguuaccucugcc

SEQ ID NO: 2749341 - RNA, 18 nt, Human
uggaacauaaaauacaau

SEQ ID NO: 2749342 - RNA, 23 nt, Human
uggaacgagacaagcagcccuua

SEQ ID NO: 2749343 - RNA, 16 nt, Human
uggaacucucgagcgu

SEQ ID NO: 2749344 - RNA, 21 nt, Human
uggaagccccugggcccagua

SEQ ID NO: 2749345 - RNA, 13 nt, Human
uggaaggcuucca

SEQ ID NO: 2749346 - RNA, 14 nt, Human
uggaaguaaauguu

SEQ ID NO: 2749347 - RNA, 20 nt, Human
uggaauaauccuaaacauau

SEQ ID NO: 2749348 - RNA, 18 nt, Human
uggaauauguaaauagaa

SEQ ID NO: 2749349 - RNA, 19 nt, Human
uggaaucauauugugugua

SEQ ID NO: 2749350 - RNA, 22 nt, Human
uggaaugccgcugucucugagg

SEQ ID NO: 2749351 - RNA, 15 nt, Human
uggaauuggagcucg

SEQ ID NO: 2749352 - RNA, 16 nt, Human
uggaauuuaaaucacu

SEQ ID NO: 2749353 - RNA, 17 nt, Human
uggacaaaauggaauac

SEQ ID NO: 2749354 - RNA, 19 nt, Human
uggacccguucaacuuuuc

SEQ ID NO: 2749355 - RNA, 18 nt, Human
uggacucaagcaagauuu

SEQ ID NO: 2749356 - RNA, 21 nt, Human
uggacucaagcaagauuucag

SEQ ID NO: 2749357 - RNA, 17 nt, Human
uggacucaccuccccca

SEQ ID NO: 2749358 - RNA, 16 nt, Human
uggacucauuuuaaaa

SEQ ID NO: 2749359 - RNA, 18 nt, Human
uggacuguuuuuaaaaaa

SEQ ID NO: 2749360 - RNA, 19 nt, Human
uggacuguuuuuaaaaaau

SEQ ID NO: 2749361 - RNA, 19 nt, Human
uggacuucuugaaaucaau

SEQ ID NO: 2749362 - RNA, 16 nt, Human
uggacuugccucugca

SEQ ID NO: 2749363 - RNA, 20 nt, Human
uggacuuuccagagaccagu

SEQ ID NO: 2749364 - RNA, 16 nt, Human
uggagacaaaaucuua

SEQ ID NO: 2749365 - RNA, 12 nt, Human
uggagacaccac

SEQ ID NO: 2749366 - RNA, 19 nt, Human
uggagagccccucacacag

SEQ ID NO: 2749367 - RNA, 23 nt, Human
uggagagggaaugugaaauuuac

SEQ ID NO: 2749368 - RNA, 21 nt, Human
uggagaugggguuucaccaug

SEQ ID NO: 2749369 - RNA, 18 nt, Human
uggagccaaggguucaga

SEQ ID NO: 2749370 - RNA, 20 nt, Human
uggagccaaggguucagaga

SEQ ID NO: 2749371 - RNA, 19 nt, Human
uggagccuacuaaaugcuc

SEQ ID NO: 2749372 - RNA, 16 nt, Human
uggagcucguggaaca

SEQ ID NO: 2749373 - RNA, 23 nt, Human
uggagcucguggaacaguuaccu

SEQ ID NO: 2749374 - RNA, 23 nt, Human
uggagcucgugggacagucaccu

SEQ ID NO: 2749375 - RNA, 14 nt, Human
uggaggaaagugau

SEQ ID NO: 2749376 - RNA, 18 nt, Human
uggagggaagccuugggg

SEQ ID NO: 2749377 - RNA, 21 nt, Human
uggagggaccuugucucccag

SEQ ID NO: 2749378 - RNA, 23 nt, Human
uggagggaccuugucucccagcu

SEQ ID NO: 2749379 - RNA, 14 nt, Human
uggagucacagcca

SEQ ID NO: 2749380 - RNA, 19 nt, Human
uggagucacagccacuugg

SEQ ID NO: 2749381 - RNA, 11 nt, Human
uggagugcagu

SEQ ID NO: 2749382 - RNA, 13 nt, Human
uggagugcagugg

SEQ ID NO: 2749383 - RNA, 13 nt, Human
uggaguugaaaau

SEQ ID NO: 2749384 - RNA, 19 nt, Human
uggauacgcaucagacaga

SEQ ID NO: 2749385 - RNA, 18 nt, Human
uggaugcacuuuauauua

SEQ ID NO: 2749386 - RNA, 15 nt, Human
uggauuccucacuuu

SEQ ID NO: 2749387 - RNA, 20 nt, Human
uggauuuaauguggaaauga

SEQ ID NO: 2749388 - RNA, 21 nt, Human
uggauuuuacauguggcccaa

SEQ ID NO: 2749389 - RNA, 16 nt, Human
uggcaaacguuucuca

SEQ ID NO: 2749390 - RNA, 13 nt, Human
uggcaagaugugg

SEQ ID NO: 2749391 - RNA, 16 nt, Human
uggcaagcucuaucac

SEQ ID NO: 2749392 - RNA, 16 nt, Human
uggcaauugacuauag

SEQ ID NO: 2749393 - RNA, 23 nt, Human
uggcaccgcuguacgcgagcgcg

SEQ ID NO: 2749394 - RNA, 13 nt, Human
uggcacuugggac

SEQ ID NO: 2749395 - RNA, 23 nt, Human
uggcagaucuacaugucuagaga

SEQ ID NO: 2749396 - RNA, 24 nt, Human
uggcagaucuacaugucuagagaa

SEQ ID NO: 2749397 - RNA, 21 nt, Human
uggcaggaaaauggacaucaa

SEQ ID NO: 2749398 - RNA, 19 nt, Human
uggcaguggaacuaagaaa

SEQ ID NO: 2749399 - RNA, 15 nt, Human
uggcaguuuuccauu

SEQ ID NO: 2749400 - RNA, 18 nt, Human
uggcaucaucucagcuca

SEQ ID NO: 2749401 - RNA, 22 nt, Human
uggcauuacaggugugagccac

SEQ ID NO: 2749402 - RNA, 18 nt, Human
uggccaccugcugagccc

SEQ ID NO: 2749403 - RNA, 24 nt, Human
uggccagaauuuaaaccuauacuc

SEQ ID NO: 2749404 - RNA, 22 nt, Human
uggccaggauggucuccaucuc

SEQ ID NO: 2749405 - RNA, 13 nt, Human
uggccaggcuggu

SEQ ID NO: 2749406 - RNA, 18 nt, Human
uggccaggcuggucucga

SEQ ID NO: 2749407 - RNA, 16 nt, Human
uggccauuacccccag

SEQ ID NO: 2749408 - RNA, 21 nt, Human
uggcccaggaguuuggccaga

SEQ ID NO: 2749409 - RNA, 17 nt, Human
uggccccugccuuccca

SEQ ID NO: 2749410 - RNA, 14 nt, Human
uggccugcuggaug

SEQ ID NO: 2749411 - RNA, 15 nt, Human
uggccuguacccagu

SEQ ID NO: 2749412 - RNA, 12 nt, Human
uggccuucggcc

SEQ ID NO: 2749413 - RNA, 16 nt, Human
uggccuucggccucca

SEQ ID NO: 2749414 - RNA, 19 nt, Human
uggccuugugaggagcugg

SEQ ID NO: 2749415 - RNA, 15 nt, Human
uggcgcgcaccugua

SEQ ID NO: 2749416 - RNA, 12 nt, Human
uggcgcgcgcca

SEQ ID NO: 2749417 - RNA, 16 nt, Human
uggcgcgcgccaccac

SEQ ID NO: 2749418 - RNA, 18 nt, Human
uggcgcgcgccaccacgc

SEQ ID NO: 2749419 - RNA, 16 nt, Human
uggcgcuggcugcgcu

SEQ ID NO: 2749420 - RNA, 20 nt, Human
uggcgcuggcugcgcucggc

SEQ ID NO: 2749421 - RNA, 17 nt, Human
uggcgugcagcaucagc

SEQ ID NO: 2749422 - RNA, 14 nt, Human
uggcuacugcucug

SEQ ID NO: 2749423 - RNA, 16 nt, Human
uggcuaguaucaaaag

SEQ ID NO: 2749424 - RNA, 15 nt, Human
uggcuaucugugggu

SEQ ID NO: 2749425 - RNA, 22 nt, Human
uggcucacgccuguaaucccag

SEQ ID NO: 2749426 - RNA, 14 nt, Human
uggcuccagcuggc

SEQ ID NO: 2749427 - RNA, 15 nt, Human
uggcuccagcuggcc

SEQ ID NO: 2749428 - RNA, 14 nt, Human
uggcuccuccauau

SEQ ID NO: 2749429 - RNA, 15 nt, Human
uggcucucccagcca

SEQ ID NO: 2749430 - RNA, 20 nt, Human
uggcucucccagccagguuc

SEQ ID NO: 2749431 - RNA, 18 nt, Human
uggcucuggacaggcacu

SEQ ID NO: 2749432 - RNA, 22 nt, Human
uggcucuuuccuggcuacucca

SEQ ID NO: 2749433 - RNA, 12 nt, Human
uggcugaaagga

SEQ ID NO: 2749434 - RNA, 18 nt, Human
uggcugaaaggaagcugu

SEQ ID NO: 2749435 - RNA, 22 nt, Human
uggcugaaaggaagcugugcgu

SEQ ID NO: 2749436 - RNA, 13 nt, Human
uggcugacaugaa

SEQ ID NO: 2749437 - RNA, 15 nt, Human
uggcugcauaaaugu

SEQ ID NO: 2749438 - RNA, 12 nt, Human
uggcugccagaa

SEQ ID NO: 2749439 - RNA, 17 nt, Human
uggcugcuuggagcagc

SEQ ID NO: 2749440 - RNA, 15 nt, Human
uggcuggggcaugga

SEQ ID NO: 2749441 - RNA, 20 nt, Human
uggcuggggcauggaaggca

SEQ ID NO: 2749442 - RNA, 21 nt, Human
uggcuguaucuuguuuuucca

SEQ ID NO: 2749443 - RNA, 18 nt, Human
uggcuguuaaucuuucaa

SEQ ID NO: 2749444 - RNA, 14 nt, Human
uggcuucaaauugu

SEQ ID NO: 2749445 - RNA, 14 nt, Human
uggcuugaguuuaa

SEQ ID NO: 2749446 - RNA, 22 nt, Human
uggcuuuuggcuccacccucuu

SEQ ID NO: 2749447 - RNA, 17 nt, Human
ugggaaacaaaaggaua

SEQ ID NO: 2749448 - RNA, 16 nt, Human
ugggaaagauuacuuu

SEQ ID NO: 2749449 - RNA, 20 nt, Human
ucuguuuucccuccuuggag

SEQ ID NO: 2749450 - RNA, 20 nt, Human
ucuuaacucauugcaaccuc

SEQ ID NO: 2749451 - RNA, 16 nt, Human
ucuuaagaagacugca

SEQ ID NO: 2749452 - RNA, 16 nt, Human
ucuuaauuaaaagaau

SEQ ID NO: 2749453 - RNA, 11 nt, Human
ucuuaauuauu

SEQ ID NO: 2749454 - RNA, 13 nt, Human
ucuuacaauaauu

SEQ ID NO: 2749455 - RNA, 19 nt, Human
ucuuacucuguugccaggc

SEQ ID NO: 2749456 - RNA, 16 nt, Human
ucuuacugaagguaaa

SEQ ID NO: 2749457 - RNA, 14 nt, Human
ucuuacugauuuuu

SEQ ID NO: 2749458 - RNA, 16 nt, Human
ucuuacugauuuuuaa

SEQ ID NO: 2749459 - RNA, 19 nt, Human
ucuuacugauuuuuaaguu

SEQ ID NO: 2749460 - RNA, 19 nt, Human
ucuuacugucuuuuuucua

SEQ ID NO: 2749461 - RNA, 18 nt, Human
ucuuagaugcaguucuga

SEQ ID NO: 2749462 - RNA, 20 nt, Human
ucuuaggguuaugauuaagu

SEQ ID NO: 2749463 - RNA, 21 nt, Human
ucuuaggguuaugauuaagua

SEQ ID NO: 2749464 - RNA, 15 nt, Human
ucuuauaauuuaaaa

SEQ ID NO: 2749465 - RNA, 17 nt, Human
ucuuauaauuuaaaaua

SEQ ID NO: 2749466 - RNA, 17 nt, Human
ucuuauagaauauuuau

SEQ ID NO: 2749467 - RNA, 18 nt, Human
ucuuauagaauauuuauu

SEQ ID NO: 2749468 - RNA, 20 nt, Human
ucuuauauauuguagauaau

SEQ ID NO: 2749469 - RNA, 21 nt, Human
ucuuauaucuauauuuuacau

SEQ ID NO: 2749470 - RNA, 19 nt, Human
ucuuaucuuccuauaauuu

SEQ ID NO: 2749471 - RNA, 21 nt, Human
ucuuauuauuuuugagacaga

SEQ ID NO: 2749472 - RNA, 13 nt, Human
ucuuauucacauc

SEQ ID NO: 2749473 - RNA, 13 nt, Human
ucuuauuucuguc

SEQ ID NO: 2749474 - RNA, 22 nt, Human
ucuucaaagcaaagcucuuuac

SEQ ID NO: 2749475 - RNA, 17 nt, Human
ucuucaaauaaaucucu

SEQ ID NO: 2749476 - RNA, 18 nt, Human
ucuucaacucccugcccc

SEQ ID NO: 2749477 - RNA, 21 nt, Human
ucuucaacucccugcccccca

SEQ ID NO: 2749478 - RNA, 21 nt, Human
ucuucaccuuaggaauaaucu

SEQ ID NO: 2749479 - RNA, 19 nt, Human
ucuucacuuuuauaagaaa

SEQ ID NO: 2749480 - RNA, 14 nt, Human
ucuucagaaaaccu

SEQ ID NO: 2749481 - RNA, 15 nt, Human
ucuucagaccuagaa

SEQ ID NO: 2749482 - RNA, 18 nt, Human
ucuucagaccuagaauaa

SEQ ID NO: 2749483 - RNA, 20 nt, Human
ucuucauagcagauuuuaau

SEQ ID NO: 2749484 - RNA, 15 nt, Human
ucuuccacagugccu

SEQ ID NO: 2749485 - RNA, 16 nt, Human
ucuucccuuuuacaua

SEQ ID NO: 2749486 - RNA, 14 nt, Human
ucuuccucccauuc

SEQ ID NO: 2749487 - RNA, 24 nt, Human
ucuuccucccuguguauucauucu

SEQ ID NO: 2749488 - RNA, 22 nt, Human
ucuuccuggauuccucacuuug

SEQ ID NO: 2749489 - RNA, 22 nt, Human
ucuuccuuuuuuaguucuucaa

SEQ ID NO: 2749490 - RNA, 16 nt, Human
ucuucucagaaggaaa

SEQ ID NO: 2749491 - RNA, 18 nt, Human
ucuucucauacuauuuaa

SEQ ID NO: 2749492 - RNA, 20 nt, Human
ucuucucauacuauuuaaga

SEQ ID NO: 2749493 - RNA, 16 nt, Human
ucuucuccuaaaacuu

SEQ ID NO: 2749494 - RNA, 16 nt, Human
ucuucugacacuaaaa

SEQ ID NO: 2749495 - RNA, 18 nt, Human
ucuucuggguuccuuccu

SEQ ID NO: 2749496 - RNA, 21 nt, Human
ucuucuuugaauuuccuaucu

SEQ ID NO: 2749497 - RNA, 22 nt, Human
ucuucuuuuaaaccauuuucuu

SEQ ID NO: 2749498 - RNA, 15 nt, Human
ucuugaaucucugaa

SEQ ID NO: 2749499 - RNA, 15 nt, Human
ucuugagaagagaau

SEQ ID NO: 2749500 - RNA, 15 nt, Human
ucuugaggcacagaa

SEQ ID NO: 2749501 - RNA, 16 nt, Human
ucuugagguaaaagca

SEQ ID NO: 2749502 - RNA, 16 nt, Human
ucuugauaaauggcuu

SEQ ID NO: 2749503 - RNA, 16 nt, Human
ucuuggaauccugggg

SEQ ID NO: 2749504 - RNA, 18 nt, Human
ucuuggcacagcauggag

SEQ ID NO: 2749505 - RNA, 20 nt, Human
ucuugggaauuuucuuccaa

SEQ ID NO: 2749506 - RNA, 16 nt, Human
ucuuggggaauauguu

SEQ ID NO: 2749507 - RNA, 16 nt, Human
ucuuggucucaguguc

SEQ ID NO: 2749508 - RNA, 18 nt, Human
ucuuguauuaaguuguua

SEQ ID NO: 2749509 - RNA, 17 nt, Human
ucuuguauuuuuccaau

SEQ ID NO: 2749510 - RNA, 19 nt, Human
ucuugugaacccaaagugu

SEQ ID NO: 2749511 - RNA, 21 nt, Human
ucuugugaacccaaaguguga

SEQ ID NO: 2749512 - RNA, 17 nt, Human
ucuuguuuaaauucaag

SEQ ID NO: 2749513 - RNA, 14 nt, Human
ucuuguuuuuccac

SEQ ID NO: 2749514 - RNA, 14 nt, Human
ucuuuacugcacuc

SEQ ID NO: 2749515 - RNA, 15 nt, Human
ucuuuacuuuccccu

SEQ ID NO: 2749516 - RNA, 20 nt, Human
ucuuuagcuguuaauuugag

SEQ ID NO: 2749517 - RNA, 21 nt, Human
ucuuuaggcauuaaauuuuag

SEQ ID NO: 2749518 - RNA, 18 nt, Human
ucuuucacaggggacagg

SEQ ID NO: 2749519 - RNA, 21 nt, Human
ucuuucacauuggcuauuuaa

SEQ ID NO: 2749520 - RNA, 20 nt, Human
ucuuucacuaucuguaaugc

SEQ ID NO: 2749521 - RNA, 20 nt, Human
ucuuuccacagaagcuccag

SEQ ID NO: 2749522 - RNA, 20 nt, Human
ucuuuccucuggggcauuau

SEQ ID NO: 2749523 - RNA, 13 nt, Human
ucuuucuuagaaa

SEQ ID NO: 2749524 - RNA, 16 nt, Human
ucuuucuuagaaauuu

SEQ ID NO: 2749525 - RNA, 23 nt, Human
ucuuucuuugggaauauuugaau

SEQ ID NO: 2749526 - RNA, 21 nt, Human
ucuuuguaagaguggaaccaa

SEQ ID NO: 2749527 - RNA, 14 nt, Human
ucuuuguucuucua

SEQ ID NO: 2749528 - RNA, 16 nt, Human
ucuuuuaguuuuuaaa

SEQ ID NO: 2749529 - RNA, 23 nt, Human
ucuuuucauacauuuucuaagaa

SEQ ID NO: 2749530 - RNA, 11 nt, Human
ucuuuucucug

SEQ ID NO: 2749531 - RNA, 15 nt, Human
ucuuuucucugccuu

SEQ ID NO: 2749532 - RNA, 12 nt, Human
ucuuuucugacu

SEQ ID NO: 2749533 - RNA, 21 nt, Human
ucuuuucuggaauguaaucaa

SEQ ID NO: 2749534 - RNA, 15 nt, Human
ucuuuugccauuaaa

SEQ ID NO: 2749535 - RNA, 15 nt, Human
ucuuuuuaauuucug

SEQ ID NO: 2749536 - RNA, 15 nt, Human
ucuuuuuucuaaagu

SEQ ID NO: 2749537 - RNA, 16 nt, Human
ucuuuuuucuaaagua

SEQ ID NO: 2749538 - RNA, 14 nt, Human
ucuuuuuuuuaaua

SEQ ID NO: 2749539 - RNA, 13 nt, Human
ugaaaaaaagcuu

SEQ ID NO: 2749540 - RNA, 13 nt, Human
ugaaaaaauauau

SEQ ID NO: 2749541 - RNA, 21 nt, Human
ugaaaaaauauauaucaaaua

SEQ ID NO: 2749542 - RNA, 14 nt, Human
ugaaaaacuauuaa

SEQ ID NO: 2749543 - RNA, 18 nt, Human
ugaaaaaguucugcagau

SEQ ID NO: 2749544 - RNA, 22 nt, Human
ugaaaaaguucugcagauaaac

SEQ ID NO: 2749545 - RNA, 22 nt, Human
ugaaaaaucuaaguguuucaua

SEQ ID NO: 2749546 - RNA, 19 nt, Human
ugaaaagacuccaaagaaa

SEQ ID NO: 2749547 - RNA, 16 nt, Human
ugaaaaggacuuuaua

SEQ ID NO: 2749548 - RNA, 20 nt, Human
ugaaaaucuuauaauuuaaa

SEQ ID NO: 2749549 - RNA, 23 nt, Human
ugaaaaucuuauaauuuaaaaua

SEQ ID NO: 2749550 - RNA, 21 nt, Human
ugaaaaugaauaucuauuaau

SEQ ID NO: 2749551 - RNA, 17 nt, Human
ugaaaaugucauuguuc

SEQ ID NO: 2749552 - RNA, 20 nt, Human
ugaaaauuaacaugaauauu

SEQ ID NO: 2749553 - RNA, 13 nt, Human
ugaaacaacaaau

SEQ ID NO: 2749554 - RNA, 14 nt, Human
ugaaacaagaagcc

SEQ ID NO: 2749555 - RNA, 22 nt, Human
ugaaacagagaaaauaaaagca

SEQ ID NO: 2749556 - RNA, 19 nt, Human
ugaaaccaaaccagagccu

SEQ ID NO: 2749557 - RNA, 14 nt, Human
ugaaaccuggucuc

SEQ ID NO: 2749558 - RNA, 21 nt, Human
ugaaacgaggauugggaaaaa

SEQ ID NO: 2749559 - RNA, 23 nt, Human
ugaaacgaggauugggaaaaagu

SEQ ID NO: 2749560 - RNA, 22 nt, Human
ugaaacuaagauuuguaauauu

SEQ ID NO: 2749561 - RNA, 16 nt, Human
ugaaacucauagacac

SEQ ID NO: 2749562 - RNA, 12 nt, Human
ugaaagaaaaua

SEQ ID NO: 2749563 - RNA, 18 nt, Human
ugaaagaaaauaacaaua

SEQ ID NO: 2749564 - RNA, 22 nt, Human
ugaaagaaaauaacaauaaaag

SEQ ID NO: 2749565 - RNA, 23 nt, Human
uccagugauaagagauguugacu

SEQ ID NO: 2749566 - RNA, 15 nt, Human
uccauauaaauauua

SEQ ID NO: 2749567 - RNA, 15 nt, Human
uccauaucauuugag

SEQ ID NO: 2749568 - RNA, 18 nt, Human
uccauaucucccucuucc

SEQ ID NO: 2749569 - RNA, 21 nt, Human
uccauaucucccucuucccua

SEQ ID NO: 2749570 - RNA, 15 nt, Human
uccaucaccuccccc

SEQ ID NO: 2749571 - RNA, 17 nt, Human
uccauccugaggcucca

SEQ ID NO: 2749572 - RNA, 21 nt, Human
uccauccugaggcuccacuug

SEQ ID NO: 2749573 - RNA, 18 nt, Human
uccaugaacuucuccccu

SEQ ID NO: 2749574 - RNA, 22 nt, Human
uccaugaguugcaguuuuuucc

SEQ ID NO: 2749575 - RNA, 15 nt, Human
uccauguacuggcaa

SEQ ID NO: 2749576 - RNA, 22 nt, Human
uccauuacggagaguuuccuau

SEQ ID NO: 2749577 - RNA, 14 nt, Human
uccauucuucccuu

SEQ ID NO: 2749578 - RNA, 17 nt, Human
uccauucuucccuugau

SEQ ID NO: 2749579 - RNA, 15 nt, Human
uccauugggcaggca

SEQ ID NO: 2749580 - RNA, 16 nt, Human
uccauuuuuagugaaa

SEQ ID NO: 2749581 - RNA, 17 nt, Human
uccauuuuuuucuaaua

SEQ ID NO: 2749582 - RNA, 17 nt, Human
ucccaaagugcugggaa

SEQ ID NO: 2749583 - RNA, 17 nt, Human
ucccaaauuucauaccu

SEQ ID NO: 2749584 - RNA, 12 nt, Human
ucccaaccucuc

SEQ ID NO: 2749585 - RNA, 14 nt, Human
ucccaacuauaaaa

SEQ ID NO: 2749586 - RNA, 14 nt, Human
ucccaacuccagaa

SEQ ID NO: 2749587 - RNA, 13 nt, Human
ucccaaguaaaug

SEQ ID NO: 2749588 - RNA, 19 nt, Human
ucccaauucauccucacuc

SEQ ID NO: 2749589 - RNA, 21 nt, Human
ucccaauugcuuuaccuuuuu

SEQ ID NO: 2749590 - RNA, 15 nt, Human
ucccaccaccucacc

SEQ ID NO: 2749591 - RNA, 12 nt, Human
ucccaccaggcu

SEQ ID NO: 2749592 - RNA, 13 nt, Human
ucccaccaggcug

SEQ ID NO: 2749593 - RNA, 14 nt, Human
ucccacccgcccac

SEQ ID NO: 2749594 - RNA, 15 nt, Human
ucccacccgcccacc

SEQ ID NO: 2749595 - RNA, 16 nt, Human
ucccagaucaagccug

SEQ ID NO: 2749596 - RNA, 19 nt, Human
ucccagaucaagccugccu

SEQ ID NO: 2749597 - RNA, 21 nt, Human
ucccagaucaagccugccuca

SEQ ID NO: 2749598 - RNA, 22 nt, Human
ucccagccagcaguucagagcu

SEQ ID NO: 2749599 - RNA, 19 nt, Human
ucccaggaguacaccccaa

SEQ ID NO: 2749600 - RNA, 20 nt, Human
ucccaggaguacaccccaac

SEQ ID NO: 2749601 - RNA, 11 nt, Human
ucccagggcaa

SEQ ID NO: 2749602 - RNA, 13 nt, Human
ucccaucuaggga

SEQ ID NO: 2749603 - RNA, 20 nt, Human
ucccaugaagaaagggaacg

SEQ ID NO: 2749604 - RNA, 14 nt, Human
ucccauucccccag

SEQ ID NO: 2749605 - RNA, 17 nt, Human
uccccaaaaagaauggg

SEQ ID NO: 2749606 - RNA, 20 nt, Human
uccccaaaaagaaugggaug

SEQ ID NO: 2749607 - RNA, 20 nt, Human
uccccaaaggcuuugcccug

SEQ ID NO: 2749608 - RNA, 13 nt, Human
uccccaaaugcuu

SEQ ID NO: 2749609 - RNA, 15 nt, Human
uccccaagccuggca

SEQ ID NO: 2749610 - RNA, 17 nt, Human
uccccaagccuggcaag

SEQ ID NO: 2749611 - RNA, 19 nt, Human
uccccagagcuacaggccc

SEQ ID NO: 2749612 - RNA, 22 nt, Human
uccccagccugcucccuagcca

SEQ ID NO: 2749613 - RNA, 21 nt, Human
uccccaucaagcccuuuacuu

SEQ ID NO: 2749614 - RNA, 19 nt, Human
uccccaugauguuuagaaa

SEQ ID NO: 2749615 - RNA, 22 nt, Human
ucccccagugcggccagcuccg

SEQ ID NO: 2749616 - RNA, 15 nt, Human
ucccccaucucuucu

SEQ ID NO: 2749617 - RNA, 16 nt, Human
ucccccuccucuccac

SEQ ID NO: 2749618 - RNA, 12 nt, Human
ucccccucuggc

SEQ ID NO: 2749619 - RNA, 18 nt, Human
uccccgcccguuuuacaa

SEQ ID NO: 2749620 - RNA, 15 nt, Human
uccccuauccuacuu

SEQ ID NO: 2749621 - RNA, 18 nt, Human
uccccuauccuacuuccc

SEQ ID NO: 2749622 - RNA, 15 nt, Human
uccccuccucugcuu

SEQ ID NO: 2749623 - RNA, 22 nt, Human
uccccuggaacugucucucaug

SEQ ID NO: 2749624 - RNA, 17 nt, Human
uccccuucucuguauuc

SEQ ID NO: 2749625 - RNA, 21 nt, Human
uccccuugggggugguggaug

SEQ ID NO: 2749626 - RNA, 20 nt, Human
ucccgcuguuccucgccacg

SEQ ID NO: 2749627 - RNA, 18 nt, Human
ucccggccgcgcugcgcg

SEQ ID NO: 2749628 - RNA, 13 nt, Human
ucccggccggcgc

SEQ ID NO: 2749629 - RNA, 17 nt, Human
ucccggccggcgcgcuc

SEQ ID NO: 2749630 - RNA, 19 nt, Human
ucccguggaacguuuuucc

SEQ ID NO: 2749631 - RNA, 20 nt, Human
ucccuaauaaagcugugugg

SEQ ID NO: 2749632 - RNA, 17 nt, Human
ucccuagccagaggcuc

SEQ ID NO: 2749633 - RNA, 22 nt, Human
ucccuagccagaggcucuaaug

SEQ ID NO: 2749634 - RNA, 15 nt, Human
ucccuauuccuccuu

SEQ ID NO: 2749635 - RNA, 17 nt, Human
ucccuauuccuccuucc

SEQ ID NO: 2749636 - RNA, 21 nt, Human
ucccuauuccuccuucccuug

SEQ ID NO: 2749637 - RNA, 23 nt, Human
ucccuauuccuccuucccuugcu

SEQ ID NO: 2749638 - RNA, 14 nt, Human
ucccuccacauuuc

SEQ ID NO: 2749639 - RNA, 16 nt, Human
ucccuccaccucccug

SEQ ID NO: 2749640 - RNA, 18 nt, Human
ucccuccaccucccugca

SEQ ID NO: 2749641 - RNA, 17 nt, Human
ucccuccccaaaugcuu

SEQ ID NO: 2749642 - RNA, 22 nt, Human
ucccuccuuggugauuccgcag

SEQ ID NO: 2749643 - RNA, 22 nt, Human
ucccugaagaucuagugaacau

SEQ ID NO: 2749644 - RNA, 16 nt, Human
ucccugcaauaaaaug

SEQ ID NO: 2749645 - RNA, 17 nt, Human
ucccugcaauaaaaugg

SEQ ID NO: 2749646 - RNA, 21 nt, Human
ucccugcaauaaaauggguuu

SEQ ID NO: 2749647 - RNA, 24 nt, Human
ucccugcagacaugagagacagca

SEQ ID NO: 2749648 - RNA, 14 nt, Human
ucccugcugcccuu

SEQ ID NO: 2749649 - RNA, 17 nt, Human
ucccugcugcccuuccc

SEQ ID NO: 2749650 - RNA, 20 nt, Human
ucccuggaaucuuguaaagg

SEQ ID NO: 2749651 - RNA, 14 nt, Human
ucccuguuucuucc

SEQ ID NO: 2749652 - RNA, 16 nt, Human
ucccuuauauuaauau

SEQ ID NO: 2749653 - RNA, 22 nt, Human
ucccuucucuacacucuuguaa

SEQ ID NO: 2749654 - RNA, 12 nt, Human
ucccuucuuuuu

SEQ ID NO: 2749655 - RNA, 14 nt, Human
ucccuugaugaaga

SEQ ID NO: 2749656 - RNA, 19 nt, Human
ucccuugaugaagaaguug

SEQ ID NO: 2749657 - RNA, 20 nt, Human
ucccuuuugcugccucuaaa

SEQ ID NO: 2749658 - RNA, 15 nt, Human
uccgacucuucugag

SEQ ID NO: 2749659 - RNA, 14 nt, Human
uccgacugccaucu

SEQ ID NO: 2749660 - RNA, 22 nt, Human
uccgcauccuagucucuaucau

SEQ ID NO: 2749661 - RNA, 14 nt, Human
uccgcgccaggaug

SEQ ID NO: 2749662 - RNA, 15 nt, Human
uccgucaacucauau

SEQ ID NO: 2749663 - RNA, 16 nt, Human
uccgugcuugucccug

SEQ ID NO: 2749664 - RNA, 21 nt, Human
uccguggcacugcauacaauc

SEQ ID NO: 2749665 - RNA, 21 nt, Human
uccguuuacuuguuucagagu

SEQ ID NO: 2749666 - RNA, 14 nt, Human
uccuaaauauauuu

SEQ ID NO: 2749667 - RNA, 14 nt, Human
uccuaagcuggagu

SEQ ID NO: 2749668 - RNA, 15 nt, Human
uccuaagucccugcu

SEQ ID NO: 2749669 - RNA, 22 nt, Human
uccuaauuccacagcugcucaa

SEQ ID NO: 2749670 - RNA, 11 nt, Human
uccuacaagac

SEQ ID NO: 2749671 - RNA, 15 nt, Human
uccuacaagacacag

SEQ ID NO: 2749672 - RNA, 17 nt, Human
uccuacaagacacagug

SEQ ID NO: 2749673 - RNA, 21 nt, Human
uccuacaagacacagugacca

SEQ ID NO: 2749674 - RNA, 17 nt, Human
uccuacaagcuaaaauu

SEQ ID NO: 2749675 - RNA, 18 nt, Human
uccuacaagcuaaaauua

SEQ ID NO: 2749676 - RNA, 16 nt, Human
uccuacauuaauuauc

SEQ ID NO: 2749677 - RNA, 21 nt, Human
uccuaccacaaugcagugccu

SEQ ID NO: 2749678 - RNA, 23 nt, Human
uccuagaaacugacacaugcuga

SEQ ID NO: 2749679 - RNA, 14 nt, Human
uccuaggaaaauac

SEQ ID NO: 2749680 - RNA, 14 nt, Human
uccuaguaauuuaa

SEQ ID NO: 2749681 - RNA, 16 nt, Human
uccuagucucuaucau

SEQ ID NO: 2749682 - RNA, 19 nt, Human
uccuagucucuaucauuaa

SEQ ID NO: 2749683 - RNA, 23 nt, Human
uccuagugaaagaggcagcuuga

SEQ ID NO: 2749684 - RNA, 19 nt, Human
uccuauaauuuuagacauu

SEQ ID NO: 2749685 - RNA, 14 nt, Human
uccuauguaacugc

SEQ ID NO: 2749686 - RNA, 17 nt, Human
uccuauuuuuggaagag

SEQ ID NO: 2749687 - RNA, 15 nt, Human
uccucaacucugagu

SEQ ID NO: 2749688 - RNA, 16 nt, Human
uccucacuuugaagag

SEQ ID NO: 2749689 - RNA, 20 nt, Human
uccucauauccaguauuguu

SEQ ID NO: 2749690 - RNA, 17 nt, Human
uccuccauaucucccuc

SEQ ID NO: 2749691 - RNA, 19 nt, Human
uccuccauaucucccucuu

SEQ ID NO: 2749692 - RNA, 21 nt, Human
uccucccacuucagccuccca

SEQ ID NO: 2749693 - RNA, 23 nt, Human
uccucccuccagauauacuuggu

SEQ ID NO: 2749694 - RNA, 14 nt, Human
uccucccuucucuu

SEQ ID NO: 2749695 - RNA, 15 nt, Human
uccuccuuuuuccuu

SEQ ID NO: 2749696 - RNA, 13 nt, Human
uccucggacggcu

SEQ ID NO: 2749697 - RNA, 22 nt, Human
uccucuccaccaucgucuucuu

SEQ ID NO: 2749698 - RNA, 15 nt, Human
uccucucucuguguu

SEQ ID NO: 2749699 - RNA, 17 nt, Human
uccucugagccuuggga

SEQ ID NO: 2749700 - RNA, 17 nt, Human
uccucugcccuuccugc

SEQ ID NO: 2749701 - RNA, 19 nt, Human
uccucugcuugccaucccu

SEQ ID NO: 2749702 - RNA, 11 nt, Human
uccucugggaa

SEQ ID NO: 2749703 - RNA, 20 nt, Human
uccucugugucuucaaagca

SEQ ID NO: 2749704 - RNA, 20 nt, Human
uccucuugccaaaucaaaag

SEQ ID NO: 2749705 - RNA, 15 nt, Human
uccugaccucaggca

SEQ ID NO: 2749706 - RNA, 16 nt, Human
uccugagaccagccaa

SEQ ID NO: 2749707 - RNA, 21 nt, Human
uccugagaccagccaaccugg

SEQ ID NO: 2749708 - RNA, 13 nt, Human
uccugaggcucca

SEQ ID NO: 2749709 - RNA, 17 nt, Human
uccugcaagcagaggug

SEQ ID NO: 2749710 - RNA, 16 nt, Human
uccugcaauuccacuu

SEQ ID NO: 2749711 - RNA, 12 nt, Human
uccugcaggcag

SEQ ID NO: 2749712 - RNA, 16 nt, Human
uccugccccugagccc

SEQ ID NO: 2749713 - RNA, 14 nt, Human
uccugccucagccu

SEQ ID NO: 2749714 - RNA, 17 nt, Human
uccugccucagccuccc

SEQ ID NO: 2749715 - RNA, 22 nt, Human
uccugcuuuuccccaaguacaa

SEQ ID NO: 2749716 - RNA, 13 nt, Human
uccuggaaaucag

SEQ ID NO: 2749717 - RNA, 14 nt, Human
uccuggaggggcug

SEQ ID NO: 2749718 - RNA, 16 nt, Human
uccuggaggggcuggg

SEQ ID NO: 2749719 - RNA, 18 nt, Human
uccuggaggggcugggga

SEQ ID NO: 2749720 - RNA, 23 nt, Human
uccuggaggggcuggggacuugu

SEQ ID NO: 2749721 - RNA, 17 nt, Human
uccuggcaauagucaaa

SEQ ID NO: 2749722 - RNA, 12 nt, Human
uccugggcagcu

SEQ ID NO: 2749723 - RNA, 18 nt, Human
uccugggcagcugccucc

SEQ ID NO: 2749724 - RNA, 14 nt, Human
uccuguacuuuuuc

SEQ ID NO: 2749725 - RNA, 20 nt, Human
uccugucggagcccugucuc

SEQ ID NO: 2749726 - RNA, 17 nt, Human
uccugucugccagccag

SEQ ID NO: 2749727 - RNA, 20 nt, Human
uccugucuguuuccucugua

SEQ ID NO: 2749728 - RNA, 13 nt, Human
uccugugggaccu

SEQ ID NO: 2749729 - RNA, 18 nt, Human
uccugugggaccugggcc

SEQ ID NO: 2749730 - RNA, 16 nt, Human
uccuuaggccucugag

SEQ ID NO: 2749731 - RNA, 13 nt, Human
uccuucauuuccu

SEQ ID NO: 2749732 - RNA, 14 nt, Human
uccuucauuuccuc

SEQ ID NO: 2749733 - RNA, 14 nt, Human
uccuucccuugcuu

SEQ ID NO: 2749734 - RNA, 17 nt, Human
uccuucccuugcuucuu

SEQ ID NO: 2749735 - RNA, 13 nt, Human
uccuuccucugag

SEQ ID NO: 2749736 - RNA, 15 nt, Human
uccuucuauucuagc

SEQ ID NO: 2749737 - RNA, 19 nt, Human
uccuucugagccugccuuu

SEQ ID NO: 2749738 - RNA, 19 nt, Human
uccuucuuuuuuucuugaa

SEQ ID NO: 2749739 - RNA, 20 nt, Human
uccuugauuuuagccuucuc

SEQ ID NO: 2749740 - RNA, 17 nt, Human
uccuugcaucaauuuuu

SEQ ID NO: 2749741 - RNA, 18 nt, Human
uccuugcuuaagguaugg

SEQ ID NO: 2749742 - RNA, 20 nt, Human
uccuuggagacagggcccug

SEQ ID NO: 2749743 - RNA, 23 nt, Human
uccuugggcuuuagccuuaaaga

SEQ ID NO: 2749744 - RNA, 15 nt, Human
uccuuggugauuccg

SEQ ID NO: 2749745 - RNA, 20 nt, Human
uccuuggugauuccgcagug

SEQ ID NO: 2749746 - RNA, 15 nt, Human
uccuugucuuuuuac

SEQ ID NO: 2749747 - RNA, 22 nt, Human
uccuuuuaaagaaacaaaaauc

SEQ ID NO: 2749748 - RNA, 22 nt, Human
uccuuuucccgaaggaaaaggg

SEQ ID NO: 2749749 - RNA, 22 nt, Human
uccuuuucgaugguacauauuu

SEQ ID NO: 2749750 - RNA, 11 nt, Human
uccuuuuuaau

SEQ ID NO: 2749751 - RNA, 12 nt, Human
uccuuuuuccuu

SEQ ID NO: 2749752 - RNA, 13 nt, Human
uccuuuuuccuuc

SEQ ID NO: 2749753 - RNA, 13 nt, Human
uccuuuuuuauuc

SEQ ID NO: 2749754 - RNA, 19 nt, Human
ucgcagauucucccuugcu

SEQ ID NO: 2749755 - RNA, 18 nt, Human
ucgcaggaccaucccggc

SEQ ID NO: 2749756 - RNA, 13 nt, Human
ucgccacgcucug

SEQ ID NO: 2749757 - RNA, 15 nt, Human
ucgccacgcucuggg

SEQ ID NO: 2749758 - RNA, 18 nt, Human
ucgcccagcggcaucagg

SEQ ID NO: 2749759 - RNA, 17 nt, Human
ucgcuccaccuugcagc

SEQ ID NO: 2749760 - RNA, 21 nt, Human
ucggaaagaagaaggugggag

SEQ ID NO: 2749761 - RNA, 12 nt, Human
ucggacggcucc

SEQ ID NO: 2749762 - RNA, 11 nt, Human
ucggagaagag

SEQ ID NO: 2749763 - RNA, 13 nt, Human
ucggccuccaucc

SEQ ID NO: 2749764 - RNA, 17 nt, Human
ucggccuccauccugag

SEQ ID NO: 2749765 - RNA, 22 nt, Human
ucguaaaauuaagaaaggauaa

SEQ ID NO: 2749766 - RNA, 13 nt, Human
ucguaagauuucc

SEQ ID NO: 2749767 - RNA, 22 nt, Human
ucgucgucuugacuuuggcaaa

SEQ ID NO: 2749768 - RNA, 19 nt, Human
ucgucuucuuggccauggg

SEQ ID NO: 2749769 - RNA, 16 nt, Human
ucgugagcucuuguga

SEQ ID NO: 2749770 - RNA, 12 nt, Human
ucgugggacagu

SEQ ID NO: 2749771 - RNA, 20 nt, Human
ucgugguaggacuguagaaa

SEQ ID NO: 2749772 - RNA, 17 nt, Human
ucguguguguuuuaaac

SEQ ID NO: 2749773 - RNA, 13 nt, Human
ucguuuucaaaau

SEQ ID NO: 2749774 - RNA, 22 nt, Human
ucuaaaaaaggaauccucugug

SEQ ID NO: 2749775 - RNA, 23 nt, Human
ucuaaaaauugugaucagaccau

SEQ ID NO: 2749776 - RNA, 12 nt, Human
ucuaaaaguuua

SEQ ID NO: 2749777 - RNA, 14 nt, Human
ucuaaacauguuua

SEQ ID NO: 2749778 - RNA, 22 nt, Human
ucuaaaguaaaaacaaagaaau

SEQ ID NO: 2749779 - RNA, 15 nt, Human
ucuaaaucuauuuau

SEQ ID NO: 2749780 - RNA, 16 nt, Human
ucuaaaucuauuuauu

SEQ ID NO: 2749781 - RNA, 17 nt, Human
ucuaaauucuuucauuu

SEQ ID NO: 2749782 - RNA, 22 nt, Human
ucuaacaaauuccaaauucuca

SEQ ID NO: 2749783 - RNA, 14 nt, Human
ucuaaccugaacug

SEQ ID NO: 2749784 - RNA, 12 nt, Human
ucuaagaaagaa

SEQ ID NO: 2749785 - RNA, 15 nt, Human
ucuaaguaaaaccac

SEQ ID NO: 2749786 - RNA, 17 nt, Human
ucuaauagggcaauuaa

SEQ ID NO: 2749787 - RNA, 22 nt, Human
ucuaauagggcaauuaauuccu

SEQ ID NO: 2749788 - RNA, 16 nt, Human
ucuaauaguuuuauua

SEQ ID NO: 2749789 - RNA, 18 nt, Human
ucuaauaguuuuauuaau

SEQ ID NO: 2749790 - RNA, 16 nt, Human
ucuaauguacaauaaa

SEQ ID NO: 2749791 - RNA, 18 nt, Human
ucuaauuggcaugaaggu

SEQ ID NO: 2749792 - RNA, 23 nt, Human
ucuaauuggcaugaaggugucau

SEQ ID NO: 2749793 - RNA, 18 nt, Human
ucuaauuuuuauuaauuu

SEQ ID NO: 2749794 - RNA, 12 nt, Human
ucuacacuccag

SEQ ID NO: 2749795 - RNA, 15 nt, Human
ucuacaguacaccac

SEQ ID NO: 2749796 - RNA, 18 nt, Human
ucuacaguacaccacaag

SEQ ID NO: 2749797 - RNA, 23 nt, Human
ucuacauaaaauacaaaaacuua

SEQ ID NO: 2749798 - RNA, 13 nt, Human
ucuaccaaaaaaa

SEQ ID NO: 2749799 - RNA, 17 nt, Human
ucuaccaaaaaaaggaa

SEQ ID NO: 2749800 - RNA, 21 nt, Human
ucuaccacucagagaaacaau

SEQ ID NO: 2749801 - RNA, 20 nt, Human
ucuacccaguagaugccacu

SEQ ID NO: 2749802 - RNA, 17 nt, Human
ucuaccuggucucuccu

SEQ ID NO: 2749803 - RNA, 13 nt, Human
ucuacuaaaaaua

SEQ ID NO: 2749804 - RNA, 16 nt, Human
ucuacuaaaaauacaa

SEQ ID NO: 2749805 - RNA, 22 nt, Human
ucuacuaaaaauacaaaaaaaa

SEQ ID NO: 2749806 - RNA, 16 nt, Human
ucuacuuuuaaguugc

SEQ ID NO: 2749807 - RNA, 11 nt, Human
ucuagcaugaa

SEQ ID NO: 2749808 - RNA, 14 nt, Human
ucuaggaaauauuu

SEQ ID NO: 2749809 - RNA, 21 nt, Human
ucuaggacacaguuccuggga

SEQ ID NO: 2749810 - RNA, 18 nt, Human
ucuaggacugaauuauga

SEQ ID NO: 2749811 - RNA, 23 nt, Human
ucuaggacugaauuaugaaacuu

SEQ ID NO: 2749812 - RNA, 17 nt, Human
ucuagguucuaaaaauu

SEQ ID NO: 2749813 - RNA, 21 nt, Human
ucuagguucuaaaaauuguga

SEQ ID NO: 2749814 - RNA, 12 nt, Human
ucuagugagcag

SEQ ID NO: 2749815 - RNA, 13 nt, Human
ucuauaacaacaa

SEQ ID NO: 2749816 - RNA, 22 nt, Human
ucuauaauguaaacaauaucag

SEQ ID NO: 2749817 - RNA, 17 nt, Human
ucuauaauuuaaauaua

SEQ ID NO: 2749818 - RNA, 15 nt, Human
ucuauauuuuacaua

SEQ ID NO: 2749819 - RNA, 16 nt, Human
ucuaucauuaaaguuc

SEQ ID NO: 2749820 - RNA, 20 nt, Human
ucuaucuuugagcgcccacu

SEQ ID NO: 2749821 - RNA, 12 nt, Human
ucuauguagaau

SEQ ID NO: 2749822 - RNA, 13 nt, Human
ucuauguagaaua

SEQ ID NO: 2749823 - RNA, 17 nt, Human
ucuauguagaauauauu

SEQ ID NO: 2749824 - RNA, 18 nt, Human
ucuauguagaauauauuu

SEQ ID NO: 2749825 - RNA, 17 nt, Human
ucuauuaauauauguau

SEQ ID NO: 2749826 - RNA, 16 nt, Human
ucuauuaggaaauauu

SEQ ID NO: 2749827 - RNA, 21 nt, Human
ucuauuaggaaauauucugua

SEQ ID NO: 2749828 - RNA, 14 nt, Human
ucuauucuagccug

SEQ ID NO: 2749829 - RNA, 13 nt, Human
ucuauuuaaauau

SEQ ID NO: 2749830 - RNA, 15 nt, Human
ucuauuuauuaauau

SEQ ID NO: 2749831 - RNA, 16 nt, Human
ucuauuuauuaauauu

SEQ ID NO: 2749832 - RNA, 14 nt, Human
ucuauuuauuuacu

SEQ ID NO: 2749833 - RNA, 17 nt, Human
ucuauuuuuauguuuaa

SEQ ID NO: 2749834 - RNA, 13 nt, Human
ucucaaaaaaaaa

SEQ ID NO: 2749835 - RNA, 17 nt, Human
ucucaaaaaaaaaaaca

SEQ ID NO: 2749836 - RNA, 13 nt, Human
ucucaaaaaauaa

SEQ ID NO: 2749837 - RNA, 14 nt, Human
ucucaaaaaauaaa

SEQ ID NO: 2749838 - RNA, 17 nt, Human
ucucaaaaaauaaaaau

SEQ ID NO: 2749839 - RNA, 18 nt, Human
ucucaaaaaauaaaaaua

SEQ ID NO: 2749840 - RNA, 17 nt, Human
ucucaaacuccugaccu

SEQ ID NO: 2749841 - RNA, 13 nt, Human
ucucaaagugcug

SEQ ID NO: 2749842 - RNA, 19 nt, Human
ucucaaggagaggcaaaga

SEQ ID NO: 2749843 - RNA, 12 nt, Human
ucucaauauuuc

SEQ ID NO: 2749844 - RNA, 15 nt, Human
ucucaauuucuacaa

SEQ ID NO: 2749845 - RNA, 13 nt, Human
ucucacacucaug

SEQ ID NO: 2749846 - RNA, 20 nt, Human
ucucacagugggagccaggg

SEQ ID NO: 2749847 - RNA, 20 nt, Human
ucucacaugauuccagccau

SEQ ID NO: 2749848 - RNA, 22 nt, Human
ucucacauuuauauuuuuguga

SEQ ID NO: 2749849 - RNA, 14 nt, Human
ucucagaaggaaag

SEQ ID NO: 2749850 - RNA, 15 nt, Human
ucucagaaggaaaga

SEQ ID NO: 2749851 - RNA, 19 nt, Human
ucucagccaacgaguaauu

SEQ ID NO: 2749852 - RNA, 19 nt, Human
ucucagcucacuacaaccu

SEQ ID NO: 2749853 - RNA, 19 nt, Human
ucucagcuucacccugagg

SEQ ID NO: 2749854 - RNA, 22 nt, Human
ucucagcuucacccugagguga

SEQ ID NO: 2749855 - RNA, 13 nt, Human
ucucagggcagau

SEQ ID NO: 2749856 - RNA, 13 nt, Human
ucucagguguguu

SEQ ID NO: 2749857 - RNA, 18 nt, Human
ucucagguguguugcagu

SEQ ID NO: 2749858 - RNA, 15 nt, Human
ucucagucugucacc

SEQ ID NO: 2749859 - RNA, 14 nt, Human
ucucaguucacugu

SEQ ID NO: 2749860 - RNA, 15 nt, Human
ucucauaccuucccc

SEQ ID NO: 2749861 - RNA, 15 nt, Human
ucucauccacuuucc

SEQ ID NO: 2749862 - RNA, 17 nt, Human
ucucauccugcaggcag

SEQ ID NO: 2749863 - RNA, 14 nt, Human
ucucaucucuucuu

SEQ ID NO: 2749864 - RNA, 16 nt, Human
ucucaucuuuuuacua

SEQ ID NO: 2749865 - RNA, 14 nt, Human
ucucauuuccaagc

SEQ ID NO: 2749866 - RNA, 15 nt, Human
ucuccaaagcccucc

SEQ ID NO: 2749867 - RNA, 18 nt, Human
ucuccaaagcccucccua

SEQ ID NO: 2749868 - RNA, 17 nt, Human
ucuccaacaauaagaag

SEQ ID NO: 2749869 - RNA, 23 nt, Human
ucuccaauacucagguuaaugcu

SEQ ID NO: 2749870 - RNA, 16 nt, Human
ucuccaccaucgucuu

SEQ ID NO: 2749871 - RNA, 12 nt, Human
ucuccagaugag

SEQ ID NO: 2749872 - RNA, 13 nt, Human
ucuccagaugaga

SEQ ID NO: 2749873 - RNA, 15 nt, Human
ucuccagaugagagu

SEQ ID NO: 2749874 - RNA, 17 nt, Human
ucuccagaugagaguac

SEQ ID NO: 2749875 - RNA, 15 nt, Human
ucuccagccucagcc

SEQ ID NO: 2749876 - RNA, 16 nt, Human
ucuccagccucagccu

SEQ ID NO: 2749877 - RNA, 15 nt, Human
ucuccauacucugua

SEQ ID NO: 2749878 - RNA, 17 nt, Human
ucuccauacucuguaac

SEQ ID NO: 2749879 - RNA, 22 nt, Human
ucuccauccuaccacaaugcag

SEQ ID NO: 2749880 - RNA, 23 nt, Human
ucuccauguacuggcaagaccug

SEQ ID NO: 2749881 - RNA, 23 nt, Human
ucuccauucccguggaacguuuu

SEQ ID NO: 2749882 - RNA, 19 nt, Human
ucucccaccaccucaccag

SEQ ID NO: 2749883 - RNA, 16 nt, Human
ucuccccuucucugua

SEQ ID NO: 2749884 - RNA, 14 nt, Human
ucucccucuguugc

SEQ ID NO: 2749885 - RNA, 18 nt, Human
ucucccuggauuuuuacc

SEQ ID NO: 2749886 - RNA, 18 nt, Human
ucuccgucucccaaagug

SEQ ID NO: 2749887 - RNA, 13 nt, Human
ucuccucucucug

SEQ ID NO: 2749888 - RNA, 15 nt, Human
ucuccugccucagcc

SEQ ID NO: 2749889 - RNA, 19 nt, Human
ucuccugccucagccuccc

SEQ ID NO: 2749890 - RNA, 17 nt, Human
ucuccugggcagcugcc

SEQ ID NO: 2749891 - RNA, 19 nt, Human
ucuccugggcagcugccuc

SEQ ID NO: 2749892 - RNA, 22 nt, Human
ucuccugggcagcugccucccc

SEQ ID NO: 2749893 - RNA, 17 nt, Human
ucucguaagauuuccuu

SEQ ID NO: 2749894 - RNA, 20 nt, Human
ucucguugacccucacagga

SEQ ID NO: 2749895 - RNA, 14 nt, Human
ucucuaaagaaaau

SEQ ID NO: 2749896 - RNA, 14 nt, Human
ucucuaacucagaa

SEQ ID NO: 2749897 - RNA, 14 nt, Human
ucucuacuaaaaau

SEQ ID NO: 2749898 - RNA, 18 nt, Human
ucucuaggaaauauuuau

SEQ ID NO: 2749899 - RNA, 16 nt, Human
ucucuaucauuaaagu

SEQ ID NO: 2749900 - RNA, 22 nt, Human
ucucuaucauuaaaguucuagu

SEQ ID NO: 2749901 - RNA, 17 nt, Human
ucucuccuuguucugau

SEQ ID NO: 2749902 - RNA, 14 nt, Human
ucucugaauuugag

SEQ ID NO: 2749903 - RNA, 11 nt, Human
ucucugagggg

SEQ ID NO: 2749904 - RNA, 19 nt, Human
ucucugagggggugggggu

SEQ ID NO: 2749905 - RNA, 18 nt, Human
ucucugaggggugggggu

SEQ ID NO: 2749906 - RNA, 17 nt, Human
ucucugcaaacugccuu

SEQ ID NO: 2749907 - RNA, 20 nt, Human
ucucugcaaacugccuucuu

SEQ ID NO: 2749908 - RNA, 22 nt, Human
ucucugcaaacugccuucuucg

SEQ ID NO: 2749909 - RNA, 16 nt, Human
ucucugcaggucccua

SEQ ID NO: 2749910 - RNA, 14 nt, Human
ucucuggaagcccc

SEQ ID NO: 2749911 - RNA, 14 nt, Human
ucucuggaauuuga

SEQ ID NO: 2749912 - RNA, 17 nt, Human
ucucuggccuguaccca

SEQ ID NO: 2749913 - RNA, 17 nt, Human
ucucuggccuucggccu

SEQ ID NO: 2749914 - RNA, 21 nt, Human
ucucuggccuucggccuccau

SEQ ID NO: 2749915 - RNA, 21 nt, Human
ucucuggcgacaguuuuccuu

SEQ ID NO: 2749916 - RNA, 17 nt, Human
ucucuguaauaaacuca

SEQ ID NO: 2749917 - RNA, 16 nt, Human
ucucuguucauuuccu

SEQ ID NO: 2749918 - RNA, 17 nt, Human
ucucuuaaacacuaaaa

SEQ ID NO: 2749919 - RNA, 22 nt, Human
ucucuuaaacacuaaaaaggca

SEQ ID NO: 2749920 - RNA, 17 nt, Human
ucucuuauagaauauuu

SEQ ID NO: 2749921 - RNA, 14 nt, Human
ucucuuauugccuc

SEQ ID NO: 2749922 - RNA, 12 nt, Human
ucucuucuuuuc

SEQ ID NO: 2749923 - RNA, 14 nt, Human
ucucuucuuuucaa

SEQ ID NO: 2749924 - RNA, 19 nt, Human
ucucuuuuuagagaaauuu

SEQ ID NO: 2749925 - RNA, 20 nt, Human
ucugaaaguuuuggaaacgu

SEQ ID NO: 2749926 - RNA, 16 nt, Human
ucugaagcucaacucu

SEQ ID NO: 2749927 - RNA, 17 nt, Human
ucugaauauguccuuuu

SEQ ID NO: 2749928 - RNA, 23 nt, Human
ucugaauauguccuuuuuaaugu

SEQ ID NO: 2749929 - RNA, 13 nt, Human
ucugaauuauuuu

SEQ ID NO: 2749930 - RNA, 15 nt, Human
ucugacuauuuuuca

SEQ ID NO: 2749931 - RNA, 18 nt, Human
ucugacuguuuccaucaa

SEQ ID NO: 2749932 - RNA, 15 nt, Human
ucugagaaaagcuuu

SEQ ID NO: 2749933 - RNA, 18 nt, Human
ucugagagcaucaggccu

SEQ ID NO: 2749934 - RNA, 13 nt, Human
ucugaggccaggg

SEQ ID NO: 2749935 - RNA, 16 nt, Human
ucugaggggguggggg

SEQ ID NO: 2749936 - RNA, 21 nt, Human
ucugaggucacagggccuggg

SEQ ID NO: 2749937 - RNA, 19 nt, Human
ucugagucaacuccuuucu

SEQ ID NO: 2749938 - RNA, 22 nt, Human
ucugauaaugaaaauuaugaua

SEQ ID NO: 2749939 - RNA, 23 nt, Human
ucugauacagaaaaguugaauuu

SEQ ID NO: 2749940 - RNA, 17 nt, Human
ucugauaccucaacccc

SEQ ID NO: 2749941 - RNA, 21 nt, Human
ucugauaucaguccaguuugu

SEQ ID NO: 2749942 - RNA, 17 nt, Human
ucugcaaacugccuucu

SEQ ID NO: 2749943 - RNA, 12 nt, Human
ucugcacacagc

SEQ ID NO: 2749944 - RNA, 16 nt, Human
ucugcagauaaacagu

SEQ ID NO: 2749945 - RNA, 13 nt, Human
ucugcagcuucca

SEQ ID NO: 2749946 - RNA, 12 nt, Human
ucugcaggaugu

SEQ ID NO: 2749947 - RNA, 17 nt, Human
ucugcaggucccuaaua

SEQ ID NO: 2749948 - RNA, 15 nt, Human
ucugccacaccucuc

SEQ ID NO: 2749949 - RNA, 19 nt, Human
ucugccacaccucuccaaa

SEQ ID NO: 2749950 - RNA, 17 nt, Human
ucugccagccagcagcc

SEQ ID NO: 2749951 - RNA, 18 nt, Human
ucugccagccagcagcca

SEQ ID NO: 2749952 - RNA, 12 nt, Human
ucugccuccccu

SEQ ID NO: 2749953 - RNA, 15 nt, Human
ucugccuccccuuca

SEQ ID NO: 2749954 - RNA, 22 nt, Human
ucugccuccccuucacucccac

SEQ ID NO: 2749955 - RNA, 13 nt, Human
ucugccucccucu

SEQ ID NO: 2749956 - RNA, 16 nt, Human
ucugcgcuguguacaa

SEQ ID NO: 2749957 - RNA, 21 nt, Human
ucugcuacccucauuucucau

SEQ ID NO: 2749958 - RNA, 23 nt, Human
ucugcuacccucauuucucaucu

SEQ ID NO: 2749959 - RNA, 14 nt, Human
ucugcuggagacau

SEQ ID NO: 2749960 - RNA, 22 nt, Human
ucugcuggagacauugaggcag

SEQ ID NO: 2749961 - RNA, 13 nt, Human
ucugcuugccauc

SEQ ID NO: 2749962 - RNA, 19 nt, Human
ucagugucaaugcagcccc

SEQ ID NO: 2749963 - RNA, 16 nt, Human
ucaguucccucuugcu

SEQ ID NO: 2749964 - RNA, 18 nt, Human
ucaguucucuugauuuuc

SEQ ID NO: 2749965 - RNA, 22 nt, Human
ucaguucucuugauuuucauua

SEQ ID NO: 2749966 - RNA, 22 nt, Human
ucaguugauuuuacaauugaaa

SEQ ID NO: 2749967 - RNA, 21 nt, Human
ucaguuuccugaccuaugaaa

SEQ ID NO: 2749968 - RNA, 15 nt, Human
ucaguuuuugugaaa

SEQ ID NO: 2749969 - RNA, 16 nt, Human
ucaguuuuugugaaaa

SEQ ID NO: 2749970 - RNA, 16 nt, Human
ucauaaagucuugccu

SEQ ID NO: 2749971 - RNA, 20 nt, Human
ucauaaagucuugccuugcu

SEQ ID NO: 2749972 - RNA, 16 nt, Human
ucauaaauaaaguuug

SEQ ID NO: 2749973 - RNA, 20 nt, Human
ucauaaccuuaccagauuuu

SEQ ID NO: 2749974 - RNA, 14 nt, Human
ucauaagauauuuu

SEQ ID NO: 2749975 - RNA, 23 nt, Human
ucauaagauauuuuucaugauuu

SEQ ID NO: 2749976 - RNA, 15 nt, Human
ucauaagauuuaaau

SEQ ID NO: 2749977 - RNA, 18 nt, Human
ucauaauauaaaacagga

SEQ ID NO: 2749978 - RNA, 12 nt, Human
ucauacauuuuc

SEQ ID NO: 2749979 - RNA, 22 nt, Human
ucauacauuuucuaagaaacau

SEQ ID NO: 2749980 - RNA, 17 nt, Human
ucauacuucuuaggguu

SEQ ID NO: 2749981 - RNA, 11 nt, Human
ucauagcuaaa

SEQ ID NO: 2749982 - RNA, 13 nt, Human
ucauagcuaaaaa

SEQ ID NO: 2749983 - RNA, 17 nt, Human
ucauauauauacauaca

SEQ ID NO: 2749984 - RNA, 17 nt, Human
ucauauuuauagccagg

SEQ ID NO: 2749985 - RNA, 20 nt, Human
ucauauuucaaaugauuuuc

SEQ ID NO: 2749986 - RNA, 17 nt, Human
ucauauuuucaugcugu

SEQ ID NO: 2749987 - RNA, 19 nt, Human
ucauauuuuucauagcuaa

SEQ ID NO: 2749988 - RNA, 19 nt, Human
ucaucaaucaaauaaguau

SEQ ID NO: 2749989 - RNA, 13 nt, Human
ucaucauuuccau

SEQ ID NO: 2749990 - RNA, 14 nt, Human
ucaucauuuccauu

SEQ ID NO: 2749991 - RNA, 13 nt, Human
ucauccacuuucc

SEQ ID NO: 2749992 - RNA, 14 nt, Human
ucaucccacccgcc

SEQ ID NO: 2749993 - RNA, 15 nt, Human
ucaucccacccgccc

SEQ ID NO: 2749994 - RNA, 14 nt, Human
ucauccgaggcagg

SEQ ID NO: 2749995 - RNA, 12 nt, Human
ucaucuaagccu

SEQ ID NO: 2749996 - RNA, 14 nt, Human
ucaucucagcucac

SEQ ID NO: 2749997 - RNA, 23 nt, Human
ucaucucuucuuuuaaaccauuu

SEQ ID NO: 2749998 - RNA, 16 nt, Human
ucaucuuggucacaua

SEQ ID NO: 2749999 - RNA, 18 nt, Human
ucaucuuguccccaacac

SEQ ID NO: 2750000 - RNA, 20 nt, Human
ucaugaaccucaagcugcau

SEQ ID NO: 2750001 - RNA, 21 nt, Human
ucaugaaccucaagcugcauc

SEQ ID NO: 2750002 - RNA, 11 nt, Human
ucaugauuuug

SEQ ID NO: 2750003 - RNA, 20 nt, Human
ucaugcaaaugcuguauucu

SEQ ID NO: 2750004 - RNA, 18 nt, Human
ucaugcauuguccucuuu

SEQ ID NO: 2750005 - RNA, 23 nt, Human
ucaugcauuugcacuauuggaag

SEQ ID NO: 2750006 - RNA, 23 nt, Human
ucaugcccauaccccuggccaag

SEQ ID NO: 2750007 - RNA, 23 nt, Human
ucaugcuuaaggccaugauuuua

SEQ ID NO: 2750008 - RNA, 13 nt, Human
ucauggaauugga

SEQ ID NO: 2750009 - RNA, 14 nt, Human
ucauggaauuggag

SEQ ID NO: 2750010 - RNA, 16 nt, Human
ucauggaauuggagcu

SEQ ID NO: 2750011 - RNA, 18 nt, Human
ucauggaauuggagcucg

SEQ ID NO: 2750012 - RNA, 18 nt, Human
ucauguaagcugaaaaua

SEQ ID NO: 2750013 - RNA, 20 nt, Human
ucauguaucgcuucauguaa

SEQ ID NO: 2750014 - RNA, 14 nt, Human
ucauguauuuuaaa

SEQ ID NO: 2750015 - RNA, 19 nt, Human
ucauguugccuugcauaau

SEQ ID NO: 2750016 - RNA, 19 nt, Human
ucauuaauacagggcauuu

SEQ ID NO: 2750017 - RNA, 21 nt, Human
ucauuagaacuucaagcucuc

SEQ ID NO: 2750018 - RNA, 17 nt, Human
ucauuauuacuuuugcu

SEQ ID NO: 2750019 - RNA, 18 nt, Human
ucauuauugguugggcug

SEQ ID NO: 2750020 - RNA, 21 nt, Human
ucauucaaaaguugaaauuaa

SEQ ID NO: 2750021 - RNA, 18 nt, Human
ucauucacucaacaaaca

SEQ ID NO: 2750022 - RNA, 13 nt, Human
ucauucaugucau

SEQ ID NO: 2750023 - RNA, 14 nt, Human
ucauuccaaaggag

SEQ ID NO: 2750024 - RNA, 20 nt, Human
ucauuccccaaccacuucau

SEQ ID NO: 2750025 - RNA, 22 nt, Human
ucauucccguugaacgucacau

SEQ ID NO: 2750026 - RNA, 16 nt, Human
ucauucugccugcccu

SEQ ID NO: 2750027 - RNA, 15 nt, Human
ucauucuuauuucau

SEQ ID NO: 2750028 - RNA, 18 nt, Human
ucauucuugaaagcugug

SEQ ID NO: 2750029 - RNA, 13 nt, Human
ucauuguagaaaa

SEQ ID NO: 2750030 - RNA, 13 nt, Human
ucauugugaaauu

SEQ ID NO: 2750031 - RNA, 20 nt, Human
ucauuguuauauaaucauua

SEQ ID NO: 2750032 - RNA, 22 nt, Human
ucauuuaguuauaaaaauauau

SEQ ID NO: 2750033 - RNA, 15 nt, Human
ucauuuauuuccaua

SEQ ID NO: 2750034 - RNA, 11 nt, Human
ucauuucaaaa

SEQ ID NO: 2750035 - RNA, 23 nt, Human
ucauuucaaaacucauuuccuau

SEQ ID NO: 2750036 - RNA, 14 nt, Human
ucauuuccuauuuu

SEQ ID NO: 2750037 - RNA, 15 nt, Human
ucauuuguuaaaauu

SEQ ID NO: 2750038 - RNA, 11 nt, Human
ucauuuuaaaa

SEQ ID NO: 2750039 - RNA, 13 nt, Human
ucauuuuaaaaaa

SEQ ID NO: 2750040 - RNA, 16 nt, Human
ucauuuuaaaaaaugg

SEQ ID NO: 2750041 - RNA, 17 nt, Human
ucauuuuaaaaaaugga

SEQ ID NO: 2750042 - RNA, 21 nt, Human
ucauuuugaagggaaauuuca

SEQ ID NO: 2750043 - RNA, 16 nt, Human
ucauuuugguaaaaua

SEQ ID NO: 2750044 - RNA, 19 nt, Human
uccaaaaauguguaagaac

SEQ ID NO: 2750045 - RNA, 22 nt, Human
uccaaacagaacuauggaaaaa

SEQ ID NO: 2750046 - RNA, 16 nt, Human
uccaaagcccucccua

SEQ ID NO: 2750047 - RNA, 19 nt, Human
uccaaagcugaauacauuc

SEQ ID NO: 2750048 - RNA, 12 nt, Human
uccaaagggcau

SEQ ID NO: 2750049 - RNA, 15 nt, Human
uccaaauucacaagu

SEQ ID NO: 2750050 - RNA, 15 nt, Human
gacacaugugcuggc

SEQ ID NO: 2750051 - RNA, 16 nt, Human
gacacccccucaaacc

SEQ ID NO: 2750052 - RNA, 13 nt, Human
gacacugauaugg

SEQ ID NO: 2750053 - RNA, 18 nt, Human
gacacugaucuggcugca

SEQ ID NO: 2750054 - RNA, 14 nt, Human
gacacuuaaaaaug

SEQ ID NO: 2750055 - RNA, 13 nt, Human
gacagaaagcaga

SEQ ID NO: 2750056 - RNA, 14 nt, Human
gacagaaagcagaa

SEQ ID NO: 2750057 - RNA, 13 nt, Human
gacagaaucucag

SEQ ID NO: 2750058 - RNA, 19 nt, Human
gacagacauacauuucuca

SEQ ID NO: 2750059 - RNA, 17 nt, Human
gacagcagcucaggcac

SEQ ID NO: 2750060 - RNA, 14 nt, Human
gacagcaggucuca

SEQ ID NO: 2750061 - RNA, 17 nt, Human
gacagcuucucauccug

SEQ ID NO: 2750062 - RNA, 22 nt, Human
gacagcuugaucaaaggcacac

SEQ ID NO: 2750063 - RNA, 19 nt, Human
gacaggcacuaucuggguu

SEQ ID NO: 2750064 - RNA, 22 nt, Human
gacagggaaagggucucccucu

SEQ ID NO: 2750065 - RNA, 15 nt, Human
gacagggacccacuu

SEQ ID NO: 2750066 - RNA, 12 nt, Human
gacagugaaaga

SEQ ID NO: 2750067 - RNA, 23 nt, Human
gacagugaaagaaaauaacgaua

SEQ ID NO: 2750068 - RNA, 22 nt, Human
gacagugagacucugucucagu

SEQ ID NO: 2750069 - RNA, 17 nt, Human
gacaguguuuucuggga

SEQ ID NO: 2750070 - RNA, 14 nt, Human
gacaguuuuccuuc

SEQ ID NO: 2750071 - RNA, 13 nt, Human
gacauaagcaaag

SEQ ID NO: 2750072 - RNA, 19 nt, Human
gacauacauuucucauacc

SEQ ID NO: 2750073 - RNA, 16 nt, Human
gacauagaauuaacac

SEQ ID NO: 2750074 - RNA, 16 nt, Human
gacaugggacauuugc

SEQ ID NO: 2750075 - RNA, 14 nt, Human
gacaugggccccag

SEQ ID NO: 2750076 - RNA, 20 nt, Human
gacaugggccccagauacca

SEQ ID NO: 2750077 - RNA, 12 nt, Human
gacauguggugg

SEQ ID NO: 2750078 - RNA, 21 nt, Human
gacauguggugggacagggac

SEQ ID NO: 2750079 - RNA, 15 nt, Human
gacauuugcucaugg

SEQ ID NO: 2750080 - RNA, 18 nt, Human
gacauuugcucauggaau

SEQ ID NO: 2750081 - RNA, 20 nt, Human
gacauuugcucauggaauug

SEQ ID NO: 2750082 - RNA, 22 nt, Human
gacauuugcucauggaauugga

SEQ ID NO: 2750083 - RNA, 14 nt, Human
gaccacaagcaggc

SEQ ID NO: 2750084 - RNA, 19 nt, Human
gaccaccaagccuugauug

SEQ ID NO: 2750085 - RNA, 15 nt, Human
gaccacugcagaaga

SEQ ID NO: 2750086 - RNA, 15 nt, Human
gaccagccaaccugg

SEQ ID NO: 2750087 - RNA, 16 nt, Human
gaccagccaaccuggg

SEQ ID NO: 2750088 - RNA, 13 nt, Human
gaccagccugguc

SEQ ID NO: 2750089 - RNA, 17 nt, Human
gaccaggcacccccaga

SEQ ID NO: 2750090 - RNA, 21 nt, Human
gaccaggcacccccagaauga

SEQ ID NO: 2750091 - RNA, 16 nt, Human
gaccaguaugcuugga

SEQ ID NO: 2750092 - RNA, 21 nt, Human
gaccaucccggccggcgcgcu

SEQ ID NO: 2750093 - RNA, 20 nt, Human
gaccauugucucagagcagg

SEQ ID NO: 2750094 - RNA, 14 nt, Human
gacccaaaaggcag

SEQ ID NO: 2750095 - RNA, 19 nt, Human
gacccaaaaggcagaagca

SEQ ID NO: 2750096 - RNA, 21 nt, Human
gacccacuucacacacaggca

SEQ ID NO: 2750097 - RNA, 18 nt, Human
gaccccaaguuauccacc

SEQ ID NO: 2750098 - RNA, 16 nt, Human
gaccccugagcuugca

SEQ ID NO: 2750099 - RNA, 15 nt, Human
gacccucaugcugcc

SEQ ID NO: 2750100 - RNA, 12 nt, Human
gacccugucuca

SEQ ID NO: 2750101 - RNA, 18 nt, Human
gaccuaaaauaaaaugaa

SEQ ID NO: 2750102 - RNA, 15 nt, Human
gaccuacccuccaca

SEQ ID NO: 2750103 - RNA, 14 nt, Human
gaccucaagugauc

SEQ ID NO: 2750104 - RNA, 11 nt, Human
gaccucagccu

SEQ ID NO: 2750105 - RNA, 15 nt, Human
gaccucagccuuccc

SEQ ID NO: 2750106 - RNA, 12 nt, Human
gaccugaagaau

SEQ ID NO: 2750107 - RNA, 19 nt, Human
gaccugacagcccaagggu

SEQ ID NO: 2750108 - RNA, 17 nt, Human
gaccugacuauugaagu

SEQ ID NO: 2750109 - RNA, 22 nt, Human
gaccugaguauccccagcucag

SEQ ID NO: 2750110 - RNA, 15 nt, Human
gaccugccaggcaca

SEQ ID NO: 2750111 - RNA, 16 nt, Human
gaccugccgcaggggu

SEQ ID NO: 2750112 - RNA, 21 nt, Human
gaccuggucgucgucuugacu

SEQ ID NO: 2750113 - RNA, 14 nt, Human
gaccuuccagaaau

SEQ ID NO: 2750114 - RNA, 14 nt, Human
gaccuugucuccca

SEQ ID NO: 2750115 - RNA, 16 nt, Human
gaccuugucucccagc

SEQ ID NO: 2750116 - RNA, 12 nt, Human
gacgagaaaaca

SEQ ID NO: 2750117 - RNA, 15 nt, Human
gacgcccaggacccc

SEQ ID NO: 2750118 - RNA, 22 nt, Human
gacgcccucacugcaggcuccc

SEQ ID NO: 2750119 - RNA, 12 nt, Human
gacgcucucugg

SEQ ID NO: 2750120 - RNA, 21 nt, Human
uagugcuaguggauuuuacau

SEQ ID NO: 2750121 - RNA, 11 nt, Human
uaguuagcuuu

SEQ ID NO: 2750122 - RNA, 22 nt, Human
uaguucuguagaaaugguugua

SEQ ID NO: 2750123 - RNA, 18 nt, Human
uaguuggaaucauauugu

SEQ ID NO: 2750124 - RNA, 17 nt, Human
uaguuguaccgcaaugu

SEQ ID NO: 2750125 - RNA, 13 nt, Human
uaguuuauauaga

SEQ ID NO: 2750126 - RNA, 23 nt, Human
uaguuuauauagaaauguauucu

SEQ ID NO: 2750127 - RNA, 19 nt, Human
uaguuuaugauuccaccua

SEQ ID NO: 2750128 - RNA, 18 nt, Human
uaguuucuccuuguugug

SEQ ID NO: 2750129 - RNA, 12 nt, Human
uaguuuuuaaag

SEQ ID NO: 2750130 - RNA, 13 nt, Human
uaguuuuuaaagu

SEQ ID NO: 2750131 - RNA, 20 nt, Human
uauaaaagggacugagaaau

SEQ ID NO: 2750132 - RNA, 21 nt, Human
uauaaaauaauuuuuauauuu

SEQ ID NO: 2750133 - RNA, 22 nt, Human
uauaaaaugaauacaauuaaag

SEQ ID NO: 2750134 - RNA, 17 nt, Human
uauaaacuuuuuucuua

SEQ ID NO: 2750135 - RNA, 20 nt, Human
uauaaagcaagauaauaaaa

SEQ ID NO: 2750136 - RNA, 12 nt, Human
uauaaauaaaau

SEQ ID NO: 2750137 - RNA, 16 nt, Human
uauaaauuuaucauuu

SEQ ID NO: 2750138 - RNA, 13 nt, Human
uauaaccaaagcc

SEQ ID NO: 2750139 - RNA, 13 nt, Human
uauaacgucaugu

SEQ ID NO: 2750140 - RNA, 19 nt, Human
uauaacucaucauaaaaua

SEQ ID NO: 2750141 - RNA, 20 nt, Human
uauaacucaucauaaaauaa

SEQ ID NO: 2750142 - RNA, 21 nt, Human
uauaacucaucauaaaauaaa

SEQ ID NO: 2750143 - RNA, 21 nt, Human
uauaagaaauaggaaauauuu

SEQ ID NO: 2750144 - RNA, 22 nt, Human
uauaagcuguuuuuauauaugu

SEQ ID NO: 2750145 - RNA, 18 nt, Human
uauaagugcuguauaaaa

SEQ ID NO: 2750146 - RNA, 19 nt, Human
uauaagugcuguauaaaau

SEQ ID NO: 2750147 - RNA, 16 nt, Human
uauaauaaauguacau

SEQ ID NO: 2750148 - RNA, 17 nt, Human
uauaauaaauguacauu

SEQ ID NO: 2750149 - RNA, 20 nt, Human
uauaauaaauguacauuaau

SEQ ID NO: 2750150 - RNA, 21 nt, Human
uauaauaaauguacauuaauu

SEQ ID NO: 2750151 - RNA, 22 nt, Human
uauaauacaaaggcuuauuaau

SEQ ID NO: 2750152 - RNA, 15 nt, Human
uauaauauacuauau

SEQ ID NO: 2750153 - RNA, 17 nt, Human
uauaauauacuauauuu

SEQ ID NO: 2750154 - RNA, 19 nt, Human
uauaauauacuauauuuau

SEQ ID NO: 2750155 - RNA, 14 nt, Human
uauaauauuuuuaa

SEQ ID NO: 2750156 - RNA, 19 nt, Human
uauaaucaagccuaaaauu

SEQ ID NO: 2750157 - RNA, 13 nt, Human
uauaaucauuauu

SEQ ID NO: 2750158 - RNA, 12 nt, Human
uauaauguaaac

SEQ ID NO: 2750159 - RNA, 14 nt, Human
uauaauguagcagc

SEQ ID NO: 2750160 - RNA, 20 nt, Human
uauaauucaaaggcauuucu

SEQ ID NO: 2750161 - RNA, 14 nt, Human
uauaauuccuauau

SEQ ID NO: 2750162 - RNA, 14 nt, Human
uauaauuuaaaaua

SEQ ID NO: 2750163 - RNA, 14 nt, Human
uauaauuuaaauau

SEQ ID NO: 2750164 - RNA, 15 nt, Human
uauaauuuaaauaua

SEQ ID NO: 2750165 - RNA, 14 nt, Human
uauacaaaacccuu

SEQ ID NO: 2750166 - RNA, 19 nt, Human
uauacacuuuuuaaaaucu

SEQ ID NO: 2750167 - RNA, 23 nt, Human
uauacccccugcaaagcccagcu

SEQ ID NO: 2750168 - RNA, 20 nt, Human
uauaccugauauauuccacc

SEQ ID NO: 2750169 - RNA, 17 nt, Human
uauacucacuuucccaa

SEQ ID NO: 2750170 - RNA, 18 nt, Human
uauacucacuuucuagau

SEQ ID NO: 2750171 - RNA, 21 nt, Human
uauacucucaccauuuggauc

SEQ ID NO: 2750172 - RNA, 16 nt, Human
uauacuguauuuuuac

SEQ ID NO: 2750173 - RNA, 19 nt, Human
uauacugugugcuaaaaca

SEQ ID NO: 2750174 - RNA, 19 nt, Human
uauacuugguucucuccac

SEQ ID NO: 2750175 - RNA, 17 nt, Human
uauacuuuaauaaaugu

SEQ ID NO: 2750176 - RNA, 20 nt, Human
uauacuuuaauaaauguaua

SEQ ID NO: 2750177 - RNA, 18 nt, Human
uauacuuuguaaagacaa

SEQ ID NO: 2750178 - RNA, 13 nt, Human
uauagaaaugcug

SEQ ID NO: 2750179 - RNA, 21 nt, Human
uauagaaaugcugguuuuuca

SEQ ID NO: 2750180 - RNA, 14 nt, Human
uauagaauauuuau

SEQ ID NO: 2750181 - RNA, 15 nt, Human
uauagaccuaaaaua

SEQ ID NO: 2750182 - RNA, 16 nt, Human
uauagaccuaaaauaa

SEQ ID NO: 2750183 - RNA, 17 nt, Human
uauagcauauguuuuug

SEQ ID NO: 2750184 - RNA, 22 nt, Human
uauagccagguaccuucucacc

SEQ ID NO: 2750185 - RNA, 18 nt, Human
uauagcuacuaauuuuaa

SEQ ID NO: 2750186 - RNA, 21 nt, Human
uauagcuacuaauuuuaaaau

SEQ ID NO: 2750187 - RNA, 22 nt, Human
uauagcuuugccauguggcaga

SEQ ID NO: 2750188 - RNA, 12 nt, Human
uauaggccaggc

SEQ ID NO: 2750189 - RNA, 17 nt, Human
uauaguccagcuuuguu

SEQ ID NO: 2750190 - RNA, 17 nt, Human
uauauaacaaugcugua

SEQ ID NO: 2750191 - RNA, 14 nt, Human
uauauaagcuugua

SEQ ID NO: 2750192 - RNA, 13 nt, Human
uauauaauauuuu

SEQ ID NO: 2750193 - RNA, 20 nt, Human
uauauagauggcgagaaccu

SEQ ID NO: 2750194 - RNA, 13 nt, Human
uauauauagaauc

SEQ ID NO: 2750195 - RNA, 15 nt, Human
uauauauauauauuu

SEQ ID NO: 2750196 - RNA, 14 nt, Human
uauauauauauuuu

SEQ ID NO: 2750197 - RNA, 12 nt, Human
uauauauauuuu

SEQ ID NO: 2750198 - RNA, 20 nt, Human
uauauauguauuuauaaaua

SEQ ID NO: 2750199 - RNA, 22 nt, Human
uauauauuuauaacucaucaua

SEQ ID NO: 2750200 - RNA, 14 nt, Human
uauauauuuuagau

SEQ ID NO: 2750201 - RNA, 13 nt, Human
uauauauuuuuuu

SEQ ID NO: 2750202 - RNA, 13 nt, Human
uauaucaaauaua

SEQ ID NO: 2750203 - RNA, 14 nt, Human
uauaucaaaucuac

SEQ ID NO: 2750204 - RNA, 16 nt, Human
uauaucaauuuaaaaa

SEQ ID NO: 2750205 - RNA, 17 nt, Human
uauaucaauuuaaaaaa

SEQ ID NO: 2750206 - RNA, 20 nt, Human
uauaugcuaagucuuauaua

SEQ ID NO: 2750207 - RNA, 23 nt, Human
uauauggcuugaguuuaaauugu

SEQ ID NO: 2750208 - RNA, 16 nt, Human
uauaugucacuuugcu

SEQ ID NO: 2750209 - RNA, 16 nt, Human
uauauguguuuuucac

SEQ ID NO: 2750210 - RNA, 19 nt, Human
uauauguguuuuucacauu

SEQ ID NO: 2750211 - RNA, 15 nt, Human
uauauuaugaagcuu

SEQ ID NO: 2750212 - RNA, 14 nt, Human
uauauuauuuugaa

SEQ ID NO: 2750213 - RNA, 20 nt, Human
uauauucaaaaauuauauuu

SEQ ID NO: 2750214 - RNA, 22 nt, Human
uauauugauaagaucuuuuauu

SEQ ID NO: 2750215 - RNA, 17 nt, Human
uauauuguagauaauac

SEQ ID NO: 2750216 - RNA, 15 nt, Human
uauauuuacaaaugg

SEQ ID NO: 2750217 - RNA, 20 nt, Human
uauauuuacaaaugggaaac

SEQ ID NO: 2750218 - RNA, 17 nt, Human
uauauuuccaagaaaua

SEQ ID NO: 2750219 - RNA, 19 nt, Human
uauauuuccaagaaauauu

SEQ ID NO: 2750220 - RNA, 12 nt, Human
uauauuuccuua

SEQ ID NO: 2750221 - RNA, 13 nt, Human
uauauuuuagaua

SEQ ID NO: 2750222 - RNA, 15 nt, Human
uauauuuuuuaugaa

SEQ ID NO: 2750223 - RNA, 16 nt, Human
uauauuuuuuaugaaa

SEQ ID NO: 2750224 - RNA, 19 nt, Human
uauauuuuuuaugaaacau

SEQ ID NO: 2750225 - RNA, 19 nt, Human
uauauuuuuuguuaaauga

SEQ ID NO: 2750226 - RNA, 18 nt, Human
uauauuuuuuuuuuuaaa

SEQ ID NO: 2750227 - RNA, 16 nt, Human
uaucaaaagaaagaaa

SEQ ID NO: 2750228 - RNA, 18 nt, Human
uaucaaaagaaagaaaau

SEQ ID NO: 2750229 - RNA, 13 nt, Human
uaucaaaauuacc

SEQ ID NO: 2750230 - RNA, 23 nt, Human
uaucaauagaaggauguacauuu

SEQ ID NO: 2750231 - RNA, 17 nt, Human
uaucaauuaccacacca

SEQ ID NO: 2750232 - RNA, 15 nt, Human
uaucaauuuaaaaaa

SEQ ID NO: 2750233 - RNA, 16 nt, Human
uaucaauuuaaaaaaa

SEQ ID NO: 2750234 - RNA, 17 nt, Human
uaucaauuuaaaaaaaa

SEQ ID NO: 2750235 - RNA, 13 nt, Human
uaucacuugucaa

SEQ ID NO: 2750236 - RNA, 18 nt, Human
uaucacuugucaauaaaa

SEQ ID NO: 2750237 - RNA, 19 nt, Human
uaucacuugucaauaaaau

SEQ ID NO: 2750238 - RNA, 15 nt, Human
uaucaguccaaaggg

SEQ ID NO: 2750239 - RNA, 15 nt, Human
uaucaguccucuuuc

SEQ ID NO: 2750240 - RNA, 19 nt, Human
uaucauauuucaaaugauu

SEQ ID NO: 2750241 - RNA, 15 nt, Human
uaucaugugaaauca

SEQ ID NO: 2750242 - RNA, 17 nt, Human
uaucaugugaaaucauu

SEQ ID NO: 2750243 - RNA, 21 nt, Human
uaucaugugaaaucauucauu

SEQ ID NO: 2750244 - RNA, 20 nt, Human
uaucauuuaguuauaaaaau

SEQ ID NO: 2750245 - RNA, 14 nt, Human
uauccaaaaaugug

SEQ ID NO: 2750246 - RNA, 19 nt, Human
uauccaaagcugaauacau

SEQ ID NO: 2750247 - RNA, 14 nt, Human
uauccaccugccuu

SEQ ID NO: 2750248 - RNA, 14 nt, Human
uauccccauuucuu

SEQ ID NO: 2750249 - RNA, 13 nt, Human
uaucccccagccu

SEQ ID NO: 2750250 - RNA, 22 nt, Human
uauccuaauaaaaaggugacca

SEQ ID NO: 2750251 - RNA, 22 nt, Human
uauccuacuuccccuuccuaau

SEQ ID NO: 2750252 - RNA, 23 nt, Human
uaucuaauagggcaauuaauucc

SEQ ID NO: 2750253 - RNA, 12 nt, Human
uaucuaauauau

SEQ ID NO: 2750254 - RNA, 15 nt, Human
uaucuaauauauaug

SEQ ID NO: 2750255 - RNA, 21 nt, Human
uaucuaauauauaugaauaaa

SEQ ID NO: 2750256 - RNA, 21 nt, Human
uaucuaauguugaguuauuaa

SEQ ID NO: 2750257 - RNA, 12 nt, Human
uaucuagccugg

SEQ ID NO: 2750258 - RNA, 16 nt, Human
uaucuaugcauuuucu

SEQ ID NO: 2750259 - RNA, 19 nt, Human
uaucuauguagaauauauu

SEQ ID NO: 2750260 - RNA, 23 nt, Human
uaucuauguagaauauauuuccu

SEQ ID NO: 2750261 - RNA, 15 nt, Human
uaucuauuaauauau

SEQ ID NO: 2750262 - RNA, 12 nt, Human
uaucuauuuaaa

SEQ ID NO: 2750263 - RNA, 13 nt, Human
uaucuauuuaaau

SEQ ID NO: 2750264 - RNA, 14 nt, Human
uaucuauuuaaaua

SEQ ID NO: 2750265 - RNA, 17 nt, Human
uaucucaucucuucuuu

SEQ ID NO: 2750266 - RNA, 19 nt, Human
uaucucauuuccaagcaag

SEQ ID NO: 2750267 - RNA, 20 nt, Human
uaucugcuauucuccauacu

SEQ ID NO: 2750268 - RNA, 17 nt, Human
uaucuucagaaaaccua

SEQ ID NO: 2750269 - RNA, 16 nt, Human
uaucuuccuauaauuu

SEQ ID NO: 2750270 - RNA, 13 nt, Human
uaucuugaauaau

SEQ ID NO: 2750271 - RNA, 14 nt, Human
uaucuuuuuauuca

SEQ ID NO: 2750272 - RNA, 17 nt, Human
uaucuuuuuuuuaauaa

SEQ ID NO: 2750273 - RNA, 20 nt, Human
uaugaaaaggcuaagcuuca

SEQ ID NO: 2750274 - RNA, 15 nt, Human
uaugaaacauuacag

SEQ ID NO: 2750275 - RNA, 16 nt, Human
uaugaaccuuuacauc

SEQ ID NO: 2750276 - RNA, 19 nt, Human
uaugaacucuguuuucuuu

SEQ ID NO: 2750277 - RNA, 22 nt, Human
uaugaagcuuuuaugugaaaca

SEQ ID NO: 2750278 - RNA, 16 nt, Human
uaugaaguuuuuuuua

SEQ ID NO: 2750279 - RNA, 14 nt, Human
uaugaauuacauuu

SEQ ID NO: 2750280 - RNA, 16 nt, Human
uaugacacaucucuga

SEQ ID NO: 2750281 - RNA, 22 nt, Human
uaugacgugacuggccugcugg

SEQ ID NO: 2750282 - RNA, 16 nt, Human
uaugagaaucagauca

SEQ ID NO: 2750283 - RNA, 17 nt, Human
uaugaguggcuuuaaug

SEQ ID NO: 2750284 - RNA, 20 nt, Human
uaugaguggcuuuaaugaau

SEQ ID NO: 2750285 - RNA, 19 nt, Human
uaugauaaggaugauaaaa

SEQ ID NO: 2750286 - RNA, 20 nt, Human
uaugauaaggaugauaaaag

SEQ ID NO: 2750287 - RNA, 22 nt, Human
uaugcaaccuuuggaugcacuu

SEQ ID NO: 2750288 - RNA, 22 nt, Human
uaugcauacaguaauuuuaagu

SEQ ID NO: 2750289 - RNA, 17 nt, Human
uaugcuaagugaaauaa

SEQ ID NO: 2750290 - RNA, 13 nt, Human
uaugcuauuuauu

SEQ ID NO: 2750291 - RNA, 14 nt, Human
uaugcuauuuauua

SEQ ID NO: 2750292 - RNA, 15 nt, Human
uaugcuucuguuuua

SEQ ID NO: 2750293 - RNA, 20 nt, Human
uaugcuucuguuuuauaauu

SEQ ID NO: 2750294 - RNA, 16 nt, Human
uaugcuucuuuguguu

SEQ ID NO: 2750295 - RNA, 15 nt, Human
uaugcuuguaacugu

SEQ ID NO: 2750296 - RNA, 23 nt, Human
uauggcauauugauaauaaaauu

SEQ ID NO: 2750297 - RNA, 14 nt, Human
uauggcuccuccau

SEQ ID NO: 2750298 - RNA, 21 nt, Human
uauguaaauagaaacguguau

SEQ ID NO: 2750299 - RNA, 19 nt, Human
uauguaacugcauugagaa

SEQ ID NO: 2750300 - RNA, 16 nt, Human
uauguaccauguacau

SEQ ID NO: 2750301 - RNA, 17 nt, Human
uauguacuucaugcugu

SEQ ID NO: 2750302 - RNA, 19 nt, Human
uauguagaauauauuuccu

SEQ ID NO: 2750303 - RNA, 20 nt, Human
uauguagaauauauuuccuu

SEQ ID NO: 2750304 - RNA, 15 nt, Human
uauguauuauuuaua

SEQ ID NO: 2750305 - RNA, 21 nt, Human
uauguauuauuuauaauuccu

SEQ ID NO: 2750306 - RNA, 14 nt, Human
uaugugaaauaaaa

SEQ ID NO: 2750307 - RNA, 16 nt, Human
uaugugcaauaaaaug

SEQ ID NO: 2750308 - RNA, 14 nt, Human
uaugugcauauuuu

SEQ ID NO: 2750309 - RNA, 17 nt, Human
uaugugcauauuuuauu

SEQ ID NO: 2750310 - RNA, 19 nt, Human
uauguguaucucacacuca

SEQ ID NO: 2750311 - RNA, 21 nt, Human
uauguguuugacgggaaacaa

SEQ ID NO: 2750312 - RNA, 23 nt, Human
uauguuaaaacugggacagggga

SEQ ID NO: 2750313 - RNA, 18 nt, Human
uauguuagagaauuuccu

SEQ ID NO: 2750314 - RNA, 18 nt, Human
uauguuccuuuuaaagaa

SEQ ID NO: 2750315 - RNA, 16 nt, Human
uauguucuaagaagug

SEQ ID NO: 2750316 - RNA, 23 nt, Human
uauguucuaagaagugaaaaucu

SEQ ID NO: 2750317 - RNA, 21 nt, Human
uauguuguaauauuucuucaa

SEQ ID NO: 2750318 - RNA, 22 nt, Human
uauguuuaacguuuucauuaaa

SEQ ID NO: 2750319 - RNA, 14 nt, Human
uauguuuaauuaaa

SEQ ID NO: 2750320 - RNA, 16 nt, Human
uauguuuaauuaaaau

SEQ ID NO: 2750321 - RNA, 16 nt, Human
uauguuuugacauuuu

SEQ ID NO: 2750322 - RNA, 13 nt, Human
uauuaaaacucau

SEQ ID NO: 2750323 - RNA, 16 nt, Human
uauuaaauagagaaau

SEQ ID NO: 2750324 - RNA, 17 nt, Human
uauuaacaacuugucua

SEQ ID NO: 2750325 - RNA, 14 nt, Human
uauuaaguauuuua

SEQ ID NO: 2750326 - RNA, 17 nt, Human
uauuaaguauuuuauua

SEQ ID NO: 2750327 - RNA, 16 nt, Human
uauuaaguuguuaaua

SEQ ID NO: 2750328 - RNA, 14 nt, Human
uauuaauuuguaag

SEQ ID NO: 2750329 - RNA, 15 nt, Human
uauuacaaauauuuu

SEQ ID NO: 2750330 - RNA, 19 nt, Human
uauuaccuguuaguauuau

SEQ ID NO: 2750331 - RNA, 15 nt, Human
uauuacuguaagaaa

SEQ ID NO: 2750332 - RNA, 17 nt, Human
uauuagauguucucuau

SEQ ID NO: 2750333 - RNA, 20 nt, Human
uauuagcuuuacuguuuguu

SEQ ID NO: 2750334 - RNA, 16 nt, Human
uauuauauuuacaaau

SEQ ID NO: 2750335 - RNA, 14 nt, Human
uauuauauuuccaa

SEQ ID NO: 2750336 - RNA, 16 nt, Human
uauuauccccauuucu

SEQ ID NO: 2750337 - RNA, 12 nt, Human
uauuaucuuuuc

SEQ ID NO: 2750338 - RNA, 14 nt, Human
uauuaugcauuaua

SEQ ID NO: 2750339 - RNA, 17 nt, Human
uauuauucuuauuauuu

SEQ ID NO: 2750340 - RNA, 19 nt, Human
uauuauucuucauaacaau

SEQ ID NO: 2750341 - RNA, 20 nt, Human
uauuauuguugcauuaaaaa

SEQ ID NO: 2750342 - RNA, 12 nt, Human
uauuauuuaaac

SEQ ID NO: 2750343 - RNA, 14 nt, Human
uauuauuuauauau

SEQ ID NO: 2750344 - RNA, 19 nt, Human
uauuauuuuauguugcaua

SEQ ID NO: 2750345 - RNA, 22 nt, Human
uauuauuuuugagacagagucu

SEQ ID NO: 2750346 - RNA, 21 nt, Human
uaauuuugaauaaauaaaugu

SEQ ID NO: 2750347 - RNA, 20 nt, Human
uaauuuugugaagcaaaauu

SEQ ID NO: 2750348 - RNA, 13 nt, Human
uaauuuuucacuu

SEQ ID NO: 2750349 - RNA, 13 nt, Human
uaauuuuuuucaa

SEQ ID NO: 2750350 - RNA, 11 nt, Human
uacaaaaaaaa

SEQ ID NO: 2750351 - RNA, 19 nt, Human
uacaaaaaaaaaaaaaaau

SEQ ID NO: 2750352 - RNA, 16 nt, Human
uacaaaaccacuggaa

SEQ ID NO: 2750353 - RNA, 16 nt, Human
uacaaauccaaugaaa

SEQ ID NO: 2750354 - RNA, 15 nt, Human
uacaaaugcauuucu

SEQ ID NO: 2750355 - RNA, 16 nt, Human
uacaaaugggaaacaa

SEQ ID NO: 2750356 - RNA, 18 nt, Human
uacaagcaaugccugccc

SEQ ID NO: 2750357 - RNA, 17 nt, Human
uacaagcauucugucuu

SEQ ID NO: 2750358 - RNA, 15 nt, Human
uacaauaaagcaaug

SEQ ID NO: 2750359 - RNA, 16 nt, Human
uacaauaaagcaaugu

SEQ ID NO: 2750360 - RNA, 12 nt, Human
uacaaucaucaa

SEQ ID NO: 2750361 - RNA, 16 nt, Human
uacaauuaaagcuguu

SEQ ID NO: 2750362 - RNA, 19 nt, Human
uacaauuaaagcuguuauu

SEQ ID NO: 2750363 - RNA, 14 nt, Human
uacacaacaauccu

SEQ ID NO: 2750364 - RNA, 19 nt, Human
uacacacuuguugauuaau

SEQ ID NO: 2750365 - RNA, 15 nt, Human
uacacagaaauacag

SEQ ID NO: 2750366 - RNA, 23 nt, Human
uacacagaucacagcuucagcca

SEQ ID NO: 2750367 - RNA, 16 nt, Human
uacacauacauguaaa

SEQ ID NO: 2750368 - RNA, 12 nt, Human
uacacauuuuuc

SEQ ID NO: 2750369 - RNA, 13 nt, Human
uacacauuuuuca

SEQ ID NO: 2750370 - RNA, 11 nt, Human
uacaccccaac

SEQ ID NO: 2750371 - RNA, 16 nt, Human
uacaccccaacagcac

SEQ ID NO: 2750372 - RNA, 22 nt, Human
uacaccccaacagcacccucuc

SEQ ID NO: 2750373 - RNA, 23 nt, Human
uacaccccaacagcacccucucc

SEQ ID NO: 2750374 - RNA, 14 nt, Human
uacaccccuccccu

SEQ ID NO: 2750375 - RNA, 20 nt, Human
uacacgagauacagaauuuu

SEQ ID NO: 2750376 - RNA, 21 nt, Human
uacacucucaaagcaaauaau

SEQ ID NO: 2750377 - RNA, 23 nt, Human
uacacugcacgaauggaagaggc

SEQ ID NO: 2750378 - RNA, 23 nt, Human
uacacuuugaacuacuagaaaau

SEQ ID NO: 2750379 - RNA, 15 nt, Human
uacacuuuuuaaaau

SEQ ID NO: 2750380 - RNA, 17 nt, Human
uacagaaaaguugaauu

SEQ ID NO: 2750381 - RNA, 17 nt, Human
uacagaacuaaaaauua

SEQ ID NO: 2750382 - RNA, 22 nt, Human
uacagaauucugcuaccucacu

SEQ ID NO: 2750383 - RNA, 13 nt, Human
uacagaauuuuau

SEQ ID NO: 2750384 - RNA, 17 nt, Human
uacagacagaaaaaacu

SEQ ID NO: 2750385 - RNA, 12 nt, Human
uacagagaaaag

SEQ ID NO: 2750386 - RNA, 14 nt, Human
uacagagaaaagac

SEQ ID NO: 2750387 - RNA, 13 nt, Human
uacagagacagaa

SEQ ID NO: 2750388 - RNA, 17 nt, Human
uacagagacagaaagca

SEQ ID NO: 2750389 - RNA, 11 nt, Human
uacaggauuug

SEQ ID NO: 2750390 - RNA, 15 nt, Human
uacaggauuugaaau

SEQ ID NO: 2750391 - RNA, 17 nt, Human
uacaggccucacacaca

SEQ ID NO: 2750392 - RNA, 18 nt, Human
uacaggccucacacacaa

SEQ ID NO: 2750393 - RNA, 15 nt, Human
uacaggcgugagcca

SEQ ID NO: 2750394 - RNA, 14 nt, Human
uacaguaauuuuaa

SEQ ID NO: 2750395 - RNA, 18 nt, Human
uacaguaauuuuaaguaa

SEQ ID NO: 2750396 - RNA, 20 nt, Human
uacaguaauuuuaaguaauu

SEQ ID NO: 2750397 - RNA, 23 nt, Human
uacagucuuguauuaaguuguua

SEQ ID NO: 2750398 - RNA, 20 nt, Human
uacaguggggaaugaagaua

SEQ ID NO: 2750399 - RNA, 22 nt, Human
uacagugucuuacagagaaaag

SEQ ID NO: 2750400 - RNA, 17 nt, Human
uacaguuaaguuuugug

SEQ ID NO: 2750401 - RNA, 19 nt, Human
uacaguuagagauuuuuaa

SEQ ID NO: 2750402 - RNA, 22 nt, Human
uacaguuagagauuuuuaaaua

SEQ ID NO: 2750403 - RNA, 20 nt, Human
uacaguucggugagcuacaa

SEQ ID NO: 2750404 - RNA, 13 nt, Human
uacauaaaauaca

SEQ ID NO: 2750405 - RNA, 18 nt, Human
uacauaaaguaugugcau

SEQ ID NO: 2750406 - RNA, 21 nt, Human
uacauaaaguaugugcauauu

SEQ ID NO: 2750407 - RNA, 21 nt, Human
uacauaaauuuaguauuuugu

SEQ ID NO: 2750408 - RNA, 22 nt, Human
uacauauugucacugacacaca

SEQ ID NO: 2750409 - RNA, 21 nt, Human
uacaucccuuaccugggaaag

SEQ ID NO: 2750410 - RNA, 22 nt, Human
uacaucccuuaccugggaaagg

SEQ ID NO: 2750411 - RNA, 15 nt, Human
uacaucuuucacauu

SEQ ID NO: 2750412 - RNA, 15 nt, Human
uacaugcuuuuuaau

SEQ ID NO: 2750413 - RNA, 15 nt, Human
uacauggaagaccuc

SEQ ID NO: 2750414 - RNA, 12 nt, Human
uacaugguguuu

SEQ ID NO: 2750415 - RNA, 20 nt, Human
uacauguacugauuacugcc

SEQ ID NO: 2750416 - RNA, 18 nt, Human
uacaugucuagagaacac

SEQ ID NO: 2750417 - RNA, 13 nt, Human
uacauguggccca

SEQ ID NO: 2750418 - RNA, 19 nt, Human
uacauguuuucuuugcuuu

SEQ ID NO: 2750419 - RNA, 21 nt, Human
uacauuauuaucaacaauagu

SEQ ID NO: 2750420 - RNA, 19 nt, Human
uacauucugcuuucaucuu

SEQ ID NO: 2750421 - RNA, 20 nt, Human
uacauuuccuaaauauauuu

SEQ ID NO: 2750422 - RNA, 14 nt, Human
uacauuuguauaaa

SEQ ID NO: 2750423 - RNA, 15 nt, Human
uacauuuguauaaaa

SEQ ID NO: 2750424 - RNA, 18 nt, Human
uacauuuguauaaaauaa

SEQ ID NO: 2750425 - RNA, 20 nt, Human
uacauuuguauaaaauaauu

SEQ ID NO: 2750426 - RNA, 17 nt, Human
uaccaaaaaaaggaagg

SEQ ID NO: 2750427 - RNA, 20 nt, Human
uaccaacagugagagcccuu

SEQ ID NO: 2750428 - RNA, 15 nt, Human
uaccaagauauaccu

SEQ ID NO: 2750429 - RNA, 18 nt, Human
uaccacaccaucucccau

SEQ ID NO: 2750430 - RNA, 18 nt, Human
uaccacaugggugaacac

SEQ ID NO: 2750431 - RNA, 18 nt, Human
uaccaccagucugacugu

SEQ ID NO: 2750432 - RNA, 19 nt, Human
uaccauuauggauaaagau

SEQ ID NO: 2750433 - RNA, 16 nt, Human
uacccaguaacucauc

SEQ ID NO: 2750434 - RNA, 20 nt, Human
uacccaguagaugccaccca

SEQ ID NO: 2750435 - RNA, 18 nt, Human
uacccaugucuacacaga

SEQ ID NO: 2750436 - RNA, 14 nt, Human
uacccccugggagc

SEQ ID NO: 2750437 - RNA, 13 nt, Human
uaccccuggccaa

SEQ ID NO: 2750438 - RNA, 12 nt, Human
uacccucugggu

SEQ ID NO: 2750439 - RNA, 16 nt, Human
uacccucugggucuca

SEQ ID NO: 2750440 - RNA, 12 nt, Human
uacccuucuuuu

SEQ ID NO: 2750441 - RNA, 13 nt, Human
uacccuucuuuuc

SEQ ID NO: 2750442 - RNA, 16 nt, Human
uagccagugaaaaacu

SEQ ID NO: 2750443 - RNA, 18 nt, Human
uagcccuuccccucugca

SEQ ID NO: 2750444 - RNA, 15 nt, Human
uagccgaccucagcc

SEQ ID NO: 2750445 - RNA, 22 nt, Human
uagccgggcaugguggcgcgca

SEQ ID NO: 2750446 - RNA, 19 nt, Human
uagccuggguguaaaaccu

SEQ ID NO: 2750447 - RNA, 13 nt, Human
uagcuaaguuuug

SEQ ID NO: 2750448 - RNA, 21 nt, Human
uagcuacaggacauuuuuaag

SEQ ID NO: 2750449 - RNA, 14 nt, Human
uagcuacuaauuuu

SEQ ID NO: 2750450 - RNA, 16 nt, Human
uagcuacuaauuuuaa

SEQ ID NO: 2750451 - RNA, 17 nt, Human
uagcuccuccuuuuucc

SEQ ID NO: 2750452 - RNA, 22 nt, Human
uagcuccuccuuuuuccuucca

SEQ ID NO: 2750453 - RNA, 14 nt, Human
uagcugagacuaca

SEQ ID NO: 2750454 - RNA, 15 nt, Human
uagcuggcucuguga

SEQ ID NO: 2750455 - RNA, 23 nt, Human
uagcuuuucccuuuuuuuaagua

SEQ ID NO: 2750456 - RNA, 13 nt, Human
uagcuuuuuucuc

SEQ ID NO: 2750457 - RNA, 14 nt, Human
uagcuuuuuucucu

SEQ ID NO: 2750458 - RNA, 13 nt, Human
uaggaaaauacua

SEQ ID NO: 2750459 - RNA, 16 nt, Human
uaggaaauauuuuaau

SEQ ID NO: 2750460 - RNA, 19 nt, Human
uaggaggacaaaaggaaug

SEQ ID NO: 2750461 - RNA, 20 nt, Human
uaggaggccaacccaaaaua

SEQ ID NO: 2750462 - RNA, 23 nt, Human
uaggauggcuaguaucaaaagaa

SEQ ID NO: 2750463 - RNA, 15 nt, Human
uaggauguugaaaaa

SEQ ID NO: 2750464 - RNA, 16 nt, Human
uaggccaugggacagg

SEQ ID NO: 2750465 - RNA, 15 nt, Human
uaggccugguguguu

SEQ ID NO: 2750466 - RNA, 21 nt, Human
uaggccuugcggcuccucagg

SEQ ID NO: 2750467 - RNA, 23 nt, Human
uaggcguggacuuacuauuuauu

SEQ ID NO: 2750468 - RNA, 15 nt, Human
uaggcucaaaacagg

SEQ ID NO: 2750469 - RNA, 22 nt, Human
uaggcucaaaacaggguuguug

SEQ ID NO: 2750470 - RNA, 16 nt, Human
uagggaaaauucuaac

SEQ ID NO: 2750471 - RNA, 19 nt, Human
uagggcguggaaaggggca

SEQ ID NO: 2750472 - RNA, 21 nt, Human
uagggugauauuaaccagggg

SEQ ID NO: 2750473 - RNA, 22 nt, Human
uagggugcugcgcagcaucccu

SEQ ID NO: 2750474 - RNA, 16 nt, Human
uagguagaucuggucu

SEQ ID NO: 2750475 - RNA, 22 nt, Human
uaggugagaacccuugcacuag

SEQ ID NO: 2750476 - RNA, 16 nt, Human
uaggugcugcagcccc

SEQ ID NO: 2750477 - RNA, 20 nt, Human
uagguucuaaaaauugugau

SEQ ID NO: 2750478 - RNA, 17 nt, Human
uaguaaacucaauaagu

SEQ ID NO: 2750479 - RNA, 16 nt, Human
uaguaauuggaaaggc

SEQ ID NO: 2750480 - RNA, 15 nt, Human
uaguaauuuguagau

SEQ ID NO: 2750481 - RNA, 12 nt, Human
uaguacacacuu

SEQ ID NO: 2750482 - RNA, 19 nt, Human
uaguaccaaucauuuuaau

SEQ ID NO: 2750483 - RNA, 23 nt, Human
uaguaccaaucauuuuaauuauu

SEQ ID NO: 2750484 - RNA, 18 nt, Human
uaguaucaaaagaaagaa

SEQ ID NO: 2750485 - RNA, 14 nt, Human
uaguauggcaaacu

SEQ ID NO: 2750486 - RNA, 15 nt, Human
uaguauggcaaacug

SEQ ID NO: 2750487 - RNA, 21 nt, Human
uaguauuccagaccugaagaa

SEQ ID NO: 2750488 - RNA, 15 nt, Human
uaguauuucuaugaa

SEQ ID NO: 2750489 - RNA, 17 nt, Human
uagucaugcuaauuaua

SEQ ID NO: 2750490 - RNA, 23 nt, Human
uagucauuugcugagcauguacu

SEQ ID NO: 2750491 - RNA, 13 nt, Human
uaguccccagccu

SEQ ID NO: 2750492 - RNA, 17 nt, Human
uaguccccagccugcuc

SEQ ID NO: 2750493 - RNA, 22 nt, Human
uagucucaaacuccugaccuca

SEQ ID NO: 2750494 - RNA, 15 nt, Human
uagucucuacccagu

SEQ ID NO: 2750495 - RNA, 16 nt, Human
uagucucuaucauuaa

SEQ ID NO: 2750496 - RNA, 13 nt, Human
uagucuuauaaua

SEQ ID NO: 2750497 - RNA, 19 nt, Human
uagugagacacugucucua

SEQ ID NO: 2750498 - RNA, 19 nt, Human
uagugaucaaauugugcag

SEQ ID NO: 2750499 - RNA, 13 nt, Human
uagugauuuccac

SEQ ID NO: 2750500 - RNA, 23 nt, Human
uagugauuuuaauaauauauuuu

SEQ ID NO: 2750501 - RNA, 21 nt, Human
aaaauaccaugccauuuaaag

SEQ ID NO: 2750502 - RNA, 23 nt, Human
aaaauaucacuugucaauaaaau

SEQ ID NO: 2750503 - RNA, 19 nt, Human
aaaauaugccccauucaac

SEQ ID NO: 2750504 - RNA, 14 nt, Human
aaaaucaaauucca

SEQ ID NO: 2750505 - RNA, 15 nt, Human
aaaaucauaagauau

SEQ ID NO: 2750506 - RNA, 17 nt, Human
aaaaucauaagauauuu

SEQ ID NO: 2750507 - RNA, 18 nt, Human
aaaauccacagaccaacc

SEQ ID NO: 2750508 - RNA, 19 nt, Human
aaaauccacagaccaaccu

SEQ ID NO: 2750509 - RNA, 16 nt, Human
aaaauccauacauuug

SEQ ID NO: 2750510 - RNA, 16 nt, Human
aaaauccuacuuucau

SEQ ID NO: 2750511 - RNA, 20 nt, Human
aaaaucuaaguguuucauaa

SEQ ID NO: 2750512 - RNA, 20 nt, Human
aaaaucucaauauuucagau

SEQ ID NO: 2750513 - RNA, 18 nt, Human
aaaaucuuauaauuuaaa

SEQ ID NO: 2750514 - RNA, 19 nt, Human
aaaaucuuauaauuuaaaa

SEQ ID NO: 2750515 - RNA, 20 nt, Human
aaaaucuuauaauuuaaaau

SEQ ID NO: 2750516 - RNA, 24 nt, Human
aaaaugaaucccucuaucucuaaa

SEQ ID NO: 2750517 - RNA, 21 nt, Human
aaaauggaacauaaaauacaa

SEQ ID NO: 2750518 - RNA, 14 nt, Human
aaaauggaauacuc

SEQ ID NO: 2750519 - RNA, 19 nt, Human
aaaauggagggaauaauac

SEQ ID NO: 2750520 - RNA, 23 nt, Human
aaaaugggcuuuggaugauuauu

SEQ ID NO: 2750521 - RNA, 15 nt, Human
aaaauggguuuuacu

SEQ ID NO: 2750522 - RNA, 10 nt, Human
aaaauguaau

SEQ ID NO: 2750523 - RNA, 16 nt, Human
aaaaugugauauguac

SEQ ID NO: 2750524 - RNA, 18 nt, Human
aaaaugugcaauauguga

SEQ ID NO: 2750525 - RNA, 23 nt, Human
aaaauguguauuuuauuacaucu

SEQ ID NO: 2750526 - RNA, 16 nt, Human
aaaauguuagaaaaaa

SEQ ID NO: 2750527 - RNA, 17 nt, Human
aaaauguuagaaaaaau

SEQ ID NO: 2750528 - RNA, 14 nt, Human
aaaauuaacaugaa

SEQ ID NO: 2750529 - RNA, 16 nt, Human
aaaauuauauuuugaa

SEQ ID NO: 2750530 - RNA, 24 nt, Human
aaaauuccuuagcuuagaccucag

SEQ ID NO: 2750531 - RNA, 16 nt, Human
aaaauuccuuuucccg

SEQ ID NO: 2750532 - RNA, 19 nt, Human
aaaauuguauagaccuaaa

SEQ ID NO: 2750533 - RNA, 19 nt, Human
aaaauugugaucagaccau

SEQ ID NO: 2750534 - RNA, 12 nt, Human
aaaauuuaaaac

SEQ ID NO: 2750535 - RNA, 21 nt, Human
aaaauuugccaagagccugag

SEQ ID NO: 2750536 - RNA, 21 nt, Human
aaaauuuuuaaucuuuaauuu

SEQ ID NO: 2750537 - RNA, 14 nt, Human
aaacaaaaaaagca

SEQ ID NO: 2750538 - RNA, 17 nt, Human
aaacaaaaaaagcauug

SEQ ID NO: 2750539 - RNA, 21 nt, Human
aaacaaaaaaagcauuguaac

SEQ ID NO: 2750540 - RNA, 18 nt, Human
aaacaaaacuagguaaaa

SEQ ID NO: 2750541 - RNA, 18 nt, Human
aaacaaaauuagaaaugu

SEQ ID NO: 2750542 - RNA, 16 nt, Human
aaacaaacaaaaaaaa

SEQ ID NO: 2750543 - RNA, 17 nt, Human
aaacaaacaaacaaaaa

SEQ ID NO: 2750544 - RNA, 16 nt, Human
aaacaaggaugaauua

SEQ ID NO: 2750545 - RNA, 17 nt, Human
aaacaaggaugaauuaa

SEQ ID NO: 2750546 - RNA, 22 nt, Human
aaacaaggaugaauuaaguuuu

SEQ ID NO: 2750547 - RNA, 12 nt, Human
aaacaauaacga

SEQ ID NO: 2750548 - RNA, 13 nt, Human
aaacaauaacgau

SEQ ID NO: 2750549 - RNA, 14 nt, Human
aaacaauaacgaua

SEQ ID NO: 2750550 - RNA, 16 nt, Human
aaacaauaucagacuu

SEQ ID NO: 2750551 - RNA, 12 nt, Human
aaacacagcaag

SEQ ID NO: 2750552 - RNA, 10 nt, Human
aaacacaugu

SEQ ID NO: 2750553 - RNA, 17 nt, Human
aaacaccucagcugccu

SEQ ID NO: 2750554 - RNA, 13 nt, Human
aaacacucuugaa

SEQ ID NO: 2750555 - RNA, 18 nt, Human
aaacagcaacuuguguuc

SEQ ID NO: 2750556 - RNA, 13 nt, Human
aaacaggcaaauu

SEQ ID NO: 2750557 - RNA, 21 nt, Human
aaacagucucaggaaaucaaa

SEQ ID NO: 2750558 - RNA, 18 nt, Human
aaacaucagcaaaaaagu

SEQ ID NO: 2750559 - RNA, 21 nt, Human
aaacaucaguuacucugaagg

SEQ ID NO: 2750560 - RNA, 21 nt, Human
aaacauccuaagcucaucuau

SEQ ID NO: 2750561 - RNA, 15 nt, Human
aaacauccuacaaga

SEQ ID NO: 2750562 - RNA, 17 nt, Human
aaacauccuacaagaca

SEQ ID NO: 2750563 - RNA, 20 nt, Human
aaacauccuacaagacacag

SEQ ID NO: 2750564 - RNA, 22 nt, Human
aaacauccuacaagacacagug

SEQ ID NO: 2750565 - RNA, 19 nt, Human
aaacauguuccugggauca

SEQ ID NO: 2750566 - RNA, 23 nt, Human
aaacauguuccugggaucacuga

SEQ ID NO: 2750567 - RNA, 16 nt, Human
aaacauguuuaucgua

SEQ ID NO: 2750568 - RNA, 22 nt, Human
aaacauguuuaucguauuugau

SEQ ID NO: 2750569 - RNA, 13 nt, Human
aaacauguuucuu

SEQ ID NO: 2750570 - RNA, 21 nt, Human
aaacauuacaguuagagauuu

SEQ ID NO: 2750571 - RNA, 22 nt, Human
aaacauuucaaaagguauuuau

SEQ ID NO: 2750572 - RNA, 16 nt, Human
aaacauuuucucccug

SEQ ID NO: 2750573 - RNA, 20 nt, Human
aaaccaaauauuccagagac

SEQ ID NO: 2750574 - RNA, 14 nt, Human
aaaccacagcaguu

SEQ ID NO: 2750575 - RNA, 18 nt, Human
aaaccacagcaguugaaa

SEQ ID NO: 2750576 - RNA, 23 nt, Human
aaaccacauuggagauguuuagu

SEQ ID NO: 2750577 - RNA, 12 nt, Human
aaaccaugaaga

SEQ ID NO: 2750578 - RNA, 16 nt, Human
aaaccauuuucuuuuu

SEQ ID NO: 2750579 - RNA, 18 nt, Human
aaacccggccugauuaaa

SEQ ID NO: 2750580 - RNA, 14 nt, Human
aaaccgaacugaug

SEQ ID NO: 2750581 - RNA, 19 nt, Human
aaaccgaacugauguaagu

SEQ ID NO: 2750582 - RNA, 17 nt, Human
aaaccuuauuguaccuc

SEQ ID NO: 2750583 - RNA, 18 nt, Human
aaaccuuuguuugcaucu

SEQ ID NO: 2750584 - RNA, 21 nt, Human
aaacgaggauugggaaaaagu

SEQ ID NO: 2750585 - RNA, 22 nt, Human
aaacguauucaaacaauuugaa

SEQ ID NO: 2750586 - RNA, 17 nt, Human
aaacgucuuaaauauuc

SEQ ID NO: 2750587 - RNA, 15 nt, Human
aaacuaauagaauua

SEQ ID NO: 2750588 - RNA, 21 nt, Human
aaacuaggugcauauuuauaa

SEQ ID NO: 2750589 - RNA, 13 nt, Human
aaacuauuuguaa

SEQ ID NO: 2750590 - RNA, 20 nt, Human
aaacucauagacacugaucu

SEQ ID NO: 2750591 - RNA, 22 nt, Human
aaacucauuuuuguuuucauua

SEQ ID NO: 2750592 - RNA, 18 nt, Human
aaacuccugaccucaggc

SEQ ID NO: 2750593 - RNA, 16 nt, Human
aaacucguuaauuugu

SEQ ID NO: 2750594 - RNA, 15 nt, Human
aaacugagauccuuc

SEQ ID NO: 2750595 - RNA, 18 nt, Human
aaacugagauccuuccuu

SEQ ID NO: 2750596 - RNA, 20 nt, Human
aaacugauacccuuugaaaa

SEQ ID NO: 2750597 - RNA, 23 nt, Human
aaacugauuuaucuauuuaaaua

SEQ ID NO: 2750598 - RNA, 17 nt, Human
aaacugcaaagcucggu

SEQ ID NO: 2750599 - RNA, 18 nt, Human
aaacugccaucauuuacu

SEQ ID NO: 2750600 - RNA, 11 nt, Human
aaacugccuuc

SEQ ID NO: 2750601 - RNA, 16 nt, Human
aaacuggaaauaaaag

SEQ ID NO: 2750602 - RNA, 17 nt, Human
aaacuggggccucccug

SEQ ID NO: 2750603 - RNA, 15 nt, Human
aaacugguaggaaac

SEQ ID NO: 2750604 - RNA, 18 nt, Human
aaacuguaaauuuauuau

SEQ ID NO: 2750605 - RNA, 19 nt, Human
aaacuguaaauuuauuaug

SEQ ID NO: 2750606 - RNA, 21 nt, Human
aaacuucagacauagaauuaa

SEQ ID NO: 2750607 - RNA, 21 nt, Human
aaacuuguauuauguguguuu

SEQ ID NO: 2750608 - RNA, 22 nt, Human
aaacuuuacagaaagauuugau

SEQ ID NO: 2750609 - RNA, 20 nt, Human
aaacuuuaugcuaagugaaa

SEQ ID NO: 2750610 - RNA, 23 nt, Human
aaacuuuauuuuguguuuaggaa

SEQ ID NO: 2750611 - RNA, 18 nt, Human
aaacuuugauuuuauaug

SEQ ID NO: 2750612 - RNA, 16 nt, Human
aaacuuuuccaaugac

SEQ ID NO: 2750613 - RNA, 21 nt, Human
aaacuuuuccaaugacauuuu

SEQ ID NO: 2750614 - RNA, 13 nt, Human
aaacuuuuggaag

SEQ ID NO: 2750615 - RNA, 17 nt, Human
aaagaaaauaaaucuau

SEQ ID NO: 2750616 - RNA, 12 nt, Human
aaagaaacaaaa

SEQ ID NO: 2750617 - RNA, 14 nt, Human
aaagaaacaaaaau

SEQ ID NO: 2750618 - RNA, 13 nt, Human
aaagaaacauuug

SEQ ID NO: 2750619 - RNA, 15 nt, Human
aaagaaagaaaauca

SEQ ID NO: 2750620 - RNA, 16 nt, Human
aaagaaaggagauaca

SEQ ID NO: 2750621 - RNA, 21 nt, Human
aaagaacuucuccuacuguag

SEQ ID NO: 2750622 - RNA, 13 nt, Human
aaagaagagccgg

SEQ ID NO: 2750623 - RNA, 18 nt, Human
aaagaauauuuuaacuuc

SEQ ID NO: 2750624 - RNA, 19 nt, Human
aaagaaugauuaugaauua

SEQ ID NO: 2750625 - RNA, 17 nt, Human
aaagacaaggaaaaaau

SEQ ID NO: 2750626 - RNA, 20 nt, Human
aaagacaaggaaaaaauaac

SEQ ID NO: 2750627 - RNA, 21 nt, Human
aaagacaauuguuggagagcc

SEQ ID NO: 2750628 - RNA, 19 nt, Human
aaagacagugaaagaaaau

SEQ ID NO: 2750629 - RNA, 16 nt, Human
aaagaccauuuuuccu

SEQ ID NO: 2750630 - RNA, 17 nt, Human
aaagaccauuuuuccuc

SEQ ID NO: 2750631 - RNA, 14 nt, Human
aaagacuccaaaga

SEQ ID NO: 2750632 - RNA, 22 nt, Human
aaagacugaccaauauuguaca

SEQ ID NO: 2750633 - RNA, 21 nt, Human
aaagacuuuuaugauacuuga

SEQ ID NO: 2750634 - RNA, 18 nt, Human
aaagacuuuuuuuuauac

SEQ ID NO: 2750635 - RNA, 14 nt, Human
aaagagaacuucca

SEQ ID NO: 2750636 - RNA, 14 nt, Human
aaagaggaaugaag

SEQ ID NO: 2750637 - RNA, 15 nt, Human
aaagaggcagcuuga

SEQ ID NO: 2750638 - RNA, 20 nt, Human
aaagagucacucacauccau

SEQ ID NO: 2750639 - RNA, 18 nt, Human
aaagagugaaggauuuau

SEQ ID NO: 2750640 - RNA, 13 nt, Human
aaagauaaauuau

SEQ ID NO: 2750641 - RNA, 18 nt, Human
aaagauaucucaucucuu

SEQ ID NO: 2750642 - RNA, 22 nt, Human
aaagauaucucaucucuucuuu

SEQ ID NO: 2750643 - RNA, 19 nt, Human
aaagaucugcaacuacuau

SEQ ID NO: 2750644 - RNA, 14 nt, Human
aaagaugaaaauau

SEQ ID NO: 2750645 - RNA, 19 nt, Human
aaaugcauauacuuuaaua

SEQ ID NO: 2750646 - RNA, 22 nt, Human
aaaugcauauacuuuaauaaau

SEQ ID NO: 2750647 - RNA, 15 nt, Human
aaaugcauuucuaaa

SEQ ID NO: 2750648 - RNA, 23 nt, Human
aaaugccuuuguacuuuagggaa

SEQ ID NO: 2750649 - RNA, 17 nt, Human
aaauggacaucaaaauc

SEQ ID NO: 2750650 - RNA, 14 nt, Human
aaauggagaaagga

SEQ ID NO: 2750651 - RNA, 17 nt, Human
aaauggauaugacacau

SEQ ID NO: 2750652 - RNA, 13 nt, Human
aaaugggaaacaa

SEQ ID NO: 2750653 - RNA, 15 nt, Human
aaauggguuuuacug

SEQ ID NO: 2750654 - RNA, 19 nt, Human
aaauggugaaaugcagagu

SEQ ID NO: 2750655 - RNA, 19 nt, Human
aaauggugugaccacugca

SEQ ID NO: 2750656 - RNA, 19 nt, Human
aaauguaauuaaucuugua

SEQ ID NO: 2750657 - RNA, 11 nt, Human
aaauguauucu

SEQ ID NO: 2750658 - RNA, 21 nt, Human
aaaugucuugcuugauuguau

SEQ ID NO: 2750659 - RNA, 12 nt, Human
aaaugugaauca

SEQ ID NO: 2750660 - RNA, 18 nt, Human
aaaugugauauguaccua

SEQ ID NO: 2750661 - RNA, 18 nt, Human
aaaugugcaauaugugau

SEQ ID NO: 2750662 - RNA, 22 nt, Human
aaaugugguacaagcauucugu

SEQ ID NO: 2750663 - RNA, 20 nt, Human
aaauguuauuuuuuaauuau

SEQ ID NO: 2750664 - RNA, 17 nt, Human
aaauguucaucaaugaa

SEQ ID NO: 2750665 - RNA, 21 nt, Human
aaauguucaucaaugaaugaa

SEQ ID NO: 2750666 - RNA, 17 nt, Human
aaauguucuauuuuaau

SEQ ID NO: 2750667 - RNA, 20 nt, Human
aaauguuuacagauccccaa

SEQ ID NO: 2750668 - RNA, 19 nt, Human
aaauuaacaugaauauuua

SEQ ID NO: 2750669 - RNA, 17 nt, Human
aaauuaaggcauaagaa

SEQ ID NO: 2750670 - RNA, 14 nt, Human
aaauuaauucuuua

SEQ ID NO: 2750671 - RNA, 12 nt, Human
aaauuagaaaug

SEQ ID NO: 2750672 - RNA, 16 nt, Human
aaauuagaaauguaau

SEQ ID NO: 2750673 - RNA, 16 nt, Human
aaauuagaugacugaa

SEQ ID NO: 2750674 - RNA, 16 nt, Human
aaauuagccgggcaug

SEQ ID NO: 2750675 - RNA, 23 nt, Human
aaauuaucaauaucuaauauaua

SEQ ID NO: 2750676 - RNA, 17 nt, Human
aaauuaucuuaaaacuc

SEQ ID NO: 2750677 - RNA, 22 nt, Human
aaauuaugugccagauuuaugc

SEQ ID NO: 2750678 - RNA, 15 nt, Human
aaauuauucauaauu

SEQ ID NO: 2750679 - RNA, 18 nt, Human
aaauuauuguuuuucuuu

SEQ ID NO: 2750680 - RNA, 17 nt, Human
aaauuccaggaaaaucu

SEQ ID NO: 2750681 - RNA, 17 nt, Human
aaauucugcaagcuuuu

SEQ ID NO: 2750682 - RNA, 18 nt, Human
aaauugaaaggcauucuc

SEQ ID NO: 2750683 - RNA, 14 nt, Human
aaauugaauuucca

SEQ ID NO: 2750684 - RNA, 15 nt, Human
aaauugacacuuaaa

SEQ ID NO: 2750685 - RNA, 19 nt, Human
aaauuggacuuaaaaucua

SEQ ID NO: 2750686 - RNA, 18 nt, Human
aaauuguaagcaugcaca

SEQ ID NO: 2750687 - RNA, 20 nt, Human
aaauugucacaggacagccc

SEQ ID NO: 2750688 - RNA, 23 nt, Human
aaauugugaucagaccauaaugu

SEQ ID NO: 2750689 - RNA, 14 nt, Human
aaauuuauaaacuu

SEQ ID NO: 2750690 - RNA, 14 nt, Human
aaauuuaucauuua

SEQ ID NO: 2750691 - RNA, 17 nt, Human
aaauuugaugaaaucag

SEQ ID NO: 2750692 - RNA, 10 nt, Human
aaauuugguu

SEQ ID NO: 2750693 - RNA, 19 nt, Human
aaauuuucuagaauacuaa

SEQ ID NO: 2750694 - RNA, 13 nt, Human
aacaaaauuagaa

SEQ ID NO: 2750695 - RNA, 20 nt, Human
aacaaacgaaaaacauuuca

SEQ ID NO: 2750696 - RNA, 18 nt, Human
aacaaaguugauuaagaa

SEQ ID NO: 2750697 - RNA, 15 nt, Human
aacaaaucucaagca

SEQ ID NO: 2750698 - RNA, 13 nt, Human
aacaacaacaaca

SEQ ID NO: 2750699 - RNA, 15 nt, Human
aacaagcacuaaaca

SEQ ID NO: 2750700 - RNA, 18 nt, Human
aacaagccuccuuuuaaa

SEQ ID NO: 2750701 - RNA, 20 nt, Human
aacaagccuccuuuuaaagu

SEQ ID NO: 2750702 - RNA, 15 nt, Human
aacaaggaaggaaag

SEQ ID NO: 2750703 - RNA, 22 nt, Human
aacaaggaaggaaagaugugaa

SEQ ID NO: 2750704 - RNA, 14 nt, Human
aacaaggaugaauu

SEQ ID NO: 2750705 - RNA, 13 nt, Human
aacaauaaaagac

SEQ ID NO: 2750706 - RNA, 13 nt, Human
aacaauaacgaua

SEQ ID NO: 2750707 - RNA, 15 nt, Human
aacaauaacgauaaa

SEQ ID NO: 2750708 - RNA, 16 nt, Human
aacaauaacgauaaaa

SEQ ID NO: 2750709 - RNA, 17 nt, Human
aacaaugcuguauuuua

SEQ ID NO: 2750710 - RNA, 19 nt, Human
aacaaugcuguauuuuaaa

SEQ ID NO: 2750711 - RNA, 13 nt, Human
aacacaacuauau

SEQ ID NO: 2750712 - RNA, 19 nt, Human
aacacaacuauauuguuug

SEQ ID NO: 2750713 - RNA, 20 nt, Human
aacacaauucuucuuccaac

SEQ ID NO: 2750714 - RNA, 11 nt, Human
aacacacagau

SEQ ID NO: 2750715 - RNA, 18 nt, Human
aacacauaucgauuuuua

SEQ ID NO: 2750716 - RNA, 19 nt, Human
aacacauaucgauuuuuaa

SEQ ID NO: 2750717 - RNA, 19 nt, Human
aacacaucaggaaagagag

SEQ ID NO: 2750718 - RNA, 16 nt, Human
aacacaugauccugca

SEQ ID NO: 2750719 - RNA, 17 nt, Human
aacacaugauccugcaa

SEQ ID NO: 2750720 - RNA, 22 nt, Human
aacacaugauccugcaauucca

SEQ ID NO: 2750721 - RNA, 13 nt, Human
aacaccccacaga

SEQ ID NO: 2750722 - RNA, 14 nt, Human
aacacgcucucucc

SEQ ID NO: 2750723 - RNA, 19 nt, Human
aacacggugcucauuuuuu

SEQ ID NO: 2750724 - RNA, 12 nt, Human
aacacucaaugg

SEQ ID NO: 2750725 - RNA, 13 nt, Human
aacacucuugaaa

SEQ ID NO: 2750726 - RNA, 17 nt, Human
aacacucuugaaaaaug

SEQ ID NO: 2750727 - RNA, 19 nt, Human
aacacucuugaaaaaugca

SEQ ID NO: 2750728 - RNA, 19 nt, Human
aacacugggagaaaugaaa

SEQ ID NO: 2750729 - RNA, 16 nt, Human
aacagaagcuuccauu

SEQ ID NO: 2750730 - RNA, 16 nt, Human
aacagauuucaaaaaa

SEQ ID NO: 2750731 - RNA, 18 nt, Human
aacagauuucaaaaaaaa

SEQ ID NO: 2750732 - RNA, 20 nt, Human
aacagauuucaaaaaaaaac

SEQ ID NO: 2750733 - RNA, 17 nt, Human
aacagcacccucuccag

SEQ ID NO: 2750734 - RNA, 17 nt, Human
aacaggcaaaaggaagc

SEQ ID NO: 2750735 - RNA, 15 nt, Human
aacagggcugccuuc

SEQ ID NO: 2750736 - RNA, 15 nt, Human
aacaggguuguuguu

SEQ ID NO: 2750737 - RNA, 16 nt, Human
aacaguauccaguacu

SEQ ID NO: 2750738 - RNA, 21 nt, Human
aacagucucaggaaaucaaau

SEQ ID NO: 2750739 - RNA, 20 nt, Human
aacagucucuugaggcacag

SEQ ID NO: 2750740 - RNA, 19 nt, Human
aacagugagcuuggaaagg

SEQ ID NO: 2750741 - RNA, 22 nt, Human
aacagugauuaccagggacuga

SEQ ID NO: 2750742 - RNA, 19 nt, Human
aacaguuguguuugaagca

SEQ ID NO: 2750743 - RNA, 20 nt, Human
aacaguuuuugcuaauuuuu

SEQ ID NO: 2750744 - RNA, 21 nt, Human
aacaguuuuugcuaauuuuua

SEQ ID NO: 2750745 - RNA, 12 nt, Human
aacauaaaauac

SEQ ID NO: 2750746 - RNA, 14 nt, Human
aacauaaaauacaa

SEQ ID NO: 2750747 - RNA, 17 nt, Human
aacauaagcuagaaaaa

SEQ ID NO: 2750748 - RNA, 19 nt, Human
aacauaagcuagaaaaauu

SEQ ID NO: 2750749 - RNA, 12 nt, Human
aacauagaacuc

SEQ ID NO: 2750750 - RNA, 21 nt, Human
aacauagugagacacugucuc

SEQ ID NO: 2750751 - RNA, 23 nt, Human
aacaucacauuccucugcccuuc

SEQ ID NO: 2750752 - RNA, 22 nt, Human
aacaucagcaaaaaaguacuua

SEQ ID NO: 2750753 - RNA, 16 nt, Human
aacaucugagaaaagc

SEQ ID NO: 2750754 - RNA, 20 nt, Human
aacaugaauauuuaguguuc

SEQ ID NO: 2750755 - RNA, 21 nt, Human
aacaugauuuggggaaaggag

SEQ ID NO: 2750756 - RNA, 15 nt, Human
aacaugcacuuccuu

SEQ ID NO: 2750757 - RNA, 16 nt, Human
aacauguuccuuauau

SEQ ID NO: 2750758 - RNA, 14 nt, Human
aacauguuuaucgu

SEQ ID NO: 2750759 - RNA, 23 nt, Human
aacauguuucuuuguaaugaaaa

SEQ ID NO: 2750760 - RNA, 14 nt, Human
aacauuaauauuua

SEQ ID NO: 2750761 - RNA, 22 nt, Human
aacauuacucugaaauuguaac

SEQ ID NO: 2750762 - RNA, 20 nt, Human
aacauuauuuauauggggaa

SEQ ID NO: 2750763 - RNA, 17 nt, Human
aacauucgaccuccauu

SEQ ID NO: 2750764 - RNA, 16 nt, Human
aacauuuaucuuugua

SEQ ID NO: 2750765 - RNA, 11 nt, Human
aacauuuaugu

SEQ ID NO: 2750766 - RNA, 13 nt, Human
aacauuuauguuc

SEQ ID NO: 2750767 - RNA, 20 nt, Human
aacauuuguagcauccucuu

SEQ ID NO: 2750768 - RNA, 14 nt, Human
aaccaacacccuga

SEQ ID NO: 2750769 - RNA, 15 nt, Human
aaccaacacccugag

SEQ ID NO: 2750770 - RNA, 22 nt, Human
aaccacagcaguugaaaagacu

SEQ ID NO: 2750771 - RNA, 19 nt, Human
aaccaccgcgcccagccuu

SEQ ID NO: 2750772 - RNA, 17 nt, Human
aaccaggacccugucca

SEQ ID NO: 2750773 - RNA, 18 nt, Human
aaccaggacccuguccaa

SEQ ID NO: 2750774 - RNA, 11 nt, Human
aaccauuuucu

SEQ ID NO: 2750775 - RNA, 18 nt, Human
aaccauuuuuacuugggu

SEQ ID NO: 2750776 - RNA, 12 nt, Human
aacccagauaaa

SEQ ID NO: 2750777 - RNA, 16 nt, Human
aacccauucccucucc

SEQ ID NO: 2750778 - RNA, 23 nt, Human
aaccccgucucuacuaaaaauac

SEQ ID NO: 2750779 - RNA, 22 nt, Human
aacccugcacccauuagcaguc

SEQ ID NO: 2750780 - RNA, 11 nt, Human
aacccugggac

SEQ ID NO: 2750781 - RNA, 22 nt, Human
aacccuuucauaaagucuugcc

SEQ ID NO: 2750782 - RNA, 13 nt, Human
aacccuuucugcc

SEQ ID NO: 2750783 - RNA, 19 nt, Human
aaccgaacugauguaagua

SEQ ID NO: 2750784 - RNA, 22 nt, Human
aaccuacacgagauacagaauu

SEQ ID NO: 2750785 - RNA, 17 nt, Human
aaccucuaaauucuuuc

SEQ ID NO: 2750786 - RNA, 11 nt, Human
aaccugagccc

SEQ ID NO: 2750787 - RNA, 17 nt, Human
aaccuucugaggagcug

SEQ ID NO: 2750788 - RNA, 16 nt, Human
aaccuuuuauauuuag

SEQ ID NO: 2750789 - RNA, 19 nt, Human
aaccuuuuuggacacacaa

SEQ ID NO: 2750790 - RNA, 14 nt, Human
aagaguggguuuca

SEQ ID NO: 2750791 - RNA, 17 nt, Human
aagaguuuaauuuuuga

SEQ ID NO: 2750792 - RNA, 17 nt, Human
aagauacugaaauaaac

SEQ ID NO: 2750793 - RNA, 14 nt, Human
aagauauuuuucau

SEQ ID NO: 2750794 - RNA, 23 nt, Human
aagauauuuuucaugauuuugaa

SEQ ID NO: 2750795 - RNA, 17 nt, Human
aagaucagccugggcaa

SEQ ID NO: 2750796 - RNA, 21 nt, Human
aagaugaaggcaaagcacgaa

SEQ ID NO: 2750797 - RNA, 15 nt, Human
aagaugaaugagcaa

SEQ ID NO: 2750798 - RNA, 21 nt, Human
aagaugacggaugccuagagu

SEQ ID NO: 2750799 - RNA, 22 nt, Human
aagaugagaugguuucuagaga

SEQ ID NO: 2750800 - RNA, 22 nt, Human
aagaugaugaugaucuuuaaaa

SEQ ID NO: 2750801 - RNA, 20 nt, Human
aagaugguaccaccagucug

SEQ ID NO: 2750802 - RNA, 13 nt, Human
aagaugugggcag

SEQ ID NO: 2750803 - RNA, 16 nt, Human
aagauuguuccugcuu

SEQ ID NO: 2750804 - RNA, 12 nt, Human
aagauuuaaauu

SEQ ID NO: 2750805 - RNA, 17 nt, Human
aagauuuaaauuauuuu

SEQ ID NO: 2750806 - RNA, 14 nt, Human
aagauuuaccacuu

SEQ ID NO: 2750807 - RNA, 16 nt, Human
aagauuuguaauauuu

SEQ ID NO: 2750808 - RNA, 17 nt, Human
aagcaaaauuuuuucuc

SEQ ID NO: 2750809 - RNA, 12 nt, Human
aagcaaauauaa

SEQ ID NO: 2750810 - RNA, 13 nt, Human
aagcaaauauaaa

SEQ ID NO: 2750811 - RNA, 16 nt, Human
aagcaagauaauaaaa

SEQ ID NO: 2750812 - RNA, 14 nt, Human
aagcaaugugguag

SEQ ID NO: 2750813 - RNA, 20 nt, Human
aagcacagugaucaaguuau

SEQ ID NO: 2750814 - RNA, 17 nt, Human
aagcaccaaucaugaau

SEQ ID NO: 2750815 - RNA, 19 nt, Human
aagcaccaaucaugaauua

SEQ ID NO: 2750816 - RNA, 14 nt, Human
aagcaccugggauu

SEQ ID NO: 2750817 - RNA, 21 nt, Human
aagcaccuuuagaauauuaaa

SEQ ID NO: 2750818 - RNA, 15 nt, Human
aagcacgaaauguua

SEQ ID NO: 2750819 - RNA, 15 nt, Human
aagcacuaaacaaag

SEQ ID NO: 2750820 - RNA, 22 nt, Human
aagcacugacuucuaaguaaaa

SEQ ID NO: 2750821 - RNA, 14 nt, Human
aagcacuuucccuc

SEQ ID NO: 2750822 - RNA, 21 nt, Human
aagcacuuucccucuuggugc

SEQ ID NO: 2750823 - RNA, 15 nt, Human
aagcagaagagaaaa

SEQ ID NO: 2750824 - RNA, 18 nt, Human
aagcaggaagaaggaaaa

SEQ ID NO: 2750825 - RNA, 20 nt, Human
aagcaguugagacaagaaaa

SEQ ID NO: 2750826 - RNA, 15 nt, Human
aagcauaccaacacg

SEQ ID NO: 2750827 - RNA, 14 nt, Human
aagcaucacaugaa

SEQ ID NO: 2750828 - RNA, 13 nt, Human
aagcauuccaacu

SEQ ID NO: 2750829 - RNA, 19 nt, Human
aagcauuccaacuaucuca

SEQ ID NO: 2750830 - RNA, 14 nt, Human
aagcauucugucuu

SEQ ID NO: 2750831 - RNA, 12 nt, Human
aagcauuguaaa

SEQ ID NO: 2750832 - RNA, 12 nt, Human
aagcauuguaac

SEQ ID NO: 2750833 - RNA, 20 nt, Human
aagcauuugaaugcauuuug

SEQ ID NO: 2750834 - RNA, 23 nt, Human
aagccagaucuaugccacaagaa

SEQ ID NO: 2750835 - RNA, 24 nt, Human
aagccagcugcccccagagccaca

SEQ ID NO: 2750836 - RNA, 23 nt, Human
aagccauccccgcuccugguugg

SEQ ID NO: 2750837 - RNA, 17 nt, Human
aagccauggguagccug

SEQ ID NO: 2750838 - RNA, 22 nt, Human
aagccauggguagccugggugu

SEQ ID NO: 2750839 - RNA, 15 nt, Human
aagccaugugcagcc

SEQ ID NO: 2750840 - RNA, 16 nt, Human
aagccaugugcagcca

SEQ ID NO: 2750841 - RNA, 17 nt, Human
aagccaugugcagccac

SEQ ID NO: 2750842 - RNA, 19 nt, Human
aagccaugugcagccacca

SEQ ID NO: 2750843 - RNA, 15 nt, Human
aagccccagcaagca

SEQ ID NO: 2750844 - RNA, 21 nt, Human
aagcccccacuacaagugauc

SEQ ID NO: 2750845 - RNA, 22 nt, Human
aagcccucccuaccuaccaaga

SEQ ID NO: 2750846 - RNA, 19 nt, Human
aagcccuccgccauucuca

SEQ ID NO: 2750847 - RNA, 19 nt, Human
aagccuaagggauccugcc

SEQ ID NO: 2750848 - RNA, 16 nt, Human
aagccuccuuuuaaag

SEQ ID NO: 2750849 - RNA, 22 nt, Human
aagccuuggggcugaugcaguu

SEQ ID NO: 2750850 - RNA, 14 nt, Human
aagcuacuuauugu

SEQ ID NO: 2750851 - RNA, 16 nt, Human
aagcuacuuauuguag

SEQ ID NO: 2750852 - RNA, 21 nt, Human
aagcuagaaaugauccccagc

SEQ ID NO: 2750853 - RNA, 19 nt, Human
aagcuaugugagcucacca

SEQ ID NO: 2750854 - RNA, 22 nt, Human
aagcuccauuuuuagugaaaua

SEQ ID NO: 2750855 - RNA, 23 nt, Human
aagcuccauuuuuagugaaauau

SEQ ID NO: 2750856 - RNA, 12 nt, Human
aagcucuaucac

SEQ ID NO: 2750857 - RNA, 22 nt, Human
aagcucuaucaccaaggagcca

SEQ ID NO: 2750858 - RNA, 17 nt, Human
aagcugaauacauucug

SEQ ID NO: 2750859 - RNA, 22 nt, Human
aagcugcauuucagaaaugcug

SEQ ID NO: 2750860 - RNA, 17 nt, Human
aagcugccauauauuuu

SEQ ID NO: 2750861 - RNA, 22 nt, Human
aagcugguggcucugugugcuc

SEQ ID NO: 2750862 - RNA, 16 nt, Human
aagcuucacuguaaaa

SEQ ID NO: 2750863 - RNA, 17 nt, Human
aagcuuccauuguuguc

SEQ ID NO: 2750864 - RNA, 13 nt, Human
aagcuucuguucc

SEQ ID NO: 2750865 - RNA, 17 nt, Human
aagcuugcaacaaaauu

SEQ ID NO: 2750866 - RNA, 20 nt, Human
aagcuuguauuccuuuuucu

SEQ ID NO: 2750867 - RNA, 21 nt, Human
aagcuuguauuccuuuuucuc

SEQ ID NO: 2750868 - RNA, 16 nt, Human
aagcuuuuaugugaaa

SEQ ID NO: 2750869 - RNA, 20 nt, Human
aagcuuuuaugugaaacaug

SEQ ID NO: 2750870 - RNA, 17 nt, Human
aagcuuuuuuugaauca

SEQ ID NO: 2750871 - RNA, 15 nt, Human
aaggaaaaaauaaca

SEQ ID NO: 2750872 - RNA, 18 nt, Human
aaggaaaagggcuuucuc

SEQ ID NO: 2750873 - RNA, 21 nt, Human
aaggaagaaauuccaggaaaa

SEQ ID NO: 2750874 - RNA, 19 nt, Human
aaggaaguauaggccaggc

SEQ ID NO: 2750875 - RNA, 13 nt, Human
aaggaauccucug

SEQ ID NO: 2750876 - RNA, 15 nt, Human
aaggaauuuaaaaau

SEQ ID NO: 2750877 - RNA, 22 nt, Human
aaggacuuuauagaucagccag

SEQ ID NO: 2750878 - RNA, 18 nt, Human
aaggagaggcaaagaaag

SEQ ID NO: 2750879 - RNA, 22 nt, Human
aaggagaggcaaagaaaggaga

SEQ ID NO: 2750880 - RNA, 16 nt, Human
aaggagauacagugga

SEQ ID NO: 2750881 - RNA, 13 nt, Human
aaggagccaaaca

SEQ ID NO: 2750882 - RNA, 18 nt, Human
aaggagcucccaggaggg

SEQ ID NO: 2750883 - RNA, 13 nt, Human
aaggaggcugaga

SEQ ID NO: 2750884 - RNA, 14 nt, Human
aaggaggcugagag

SEQ ID NO: 2750885 - RNA, 15 nt, Human
aaggaggcugagagc

SEQ ID NO: 2750886 - RNA, 12 nt, Human
aaggauaaaguu

SEQ ID NO: 2750887 - RNA, 23 nt, Human
aaggauaaaguugguaaaccuuu

SEQ ID NO: 2750888 - RNA, 12 nt, Human
aaggaugccccg

SEQ ID NO: 2750889 - RNA, 18 nt, Human
aaggaugccccguccccc

SEQ ID NO: 2750890 - RNA, 20 nt, Human
aaggaugccccgucccccuc

SEQ ID NO: 2750891 - RNA, 12 nt, Human
aaggaugucugc

SEQ ID NO: 2750892 - RNA, 22 nt, Human
aaggcaaagcacgaaauguuau

SEQ ID NO: 2750893 - RNA, 19 nt, Human
aaggcagcucuaaauguca

SEQ ID NO: 2750894 - RNA, 17 nt, Human
aaggcauuucuuuucug

SEQ ID NO: 2750895 - RNA, 12 nt, Human
aaggccuguccc

SEQ ID NO: 2750896 - RNA, 17 nt, Human
aaggccugucccugcag

SEQ ID NO: 2750897 - RNA, 19 nt, Human
aaggccuuuaaaauuuuuu

SEQ ID NO: 2750898 - RNA, 15 nt, Human
aaggcuccugagaca

SEQ ID NO: 2750899 - RNA, 12 nt, Human
aaggcuggagug

SEQ ID NO: 2750900 - RNA, 18 nt, Human
aaggcuuugcccugcugc

SEQ ID NO: 2750901 - RNA, 23 nt, Human
aagggaacugaacauuccagagc

SEQ ID NO: 2750902 - RNA, 18 nt, Human
aagggaauuucuucaacu

SEQ ID NO: 2750903 - RNA, 19 nt, Human
aagggaauuucuucaacuc

SEQ ID NO: 2750904 - RNA, 19 nt, Human
aagggagauucagacuguu

SEQ ID NO: 2750905 - RNA, 16 nt, Human
aagggaggaaaaaaaa

SEQ ID NO: 2750906 - RNA, 17 nt, Human
aagggauggcaagaugu

SEQ ID NO: 2750907 - RNA, 19 nt, Human
aagggauuuucagcccuca

SEQ ID NO: 2750908 - RNA, 12 nt, Human
aagggcaggggc

SEQ ID NO: 2750909 - RNA, 14 nt, Human
aaggguaauuauau

SEQ ID NO: 2750910 - RNA, 23 nt, Human
aaggguacacugccuucucaacu

SEQ ID NO: 2750911 - RNA, 20 nt, Human
aaggguaggcucaaaacagg

SEQ ID NO: 2750912 - RNA, 16 nt, Human
aagggugugugcagca

SEQ ID NO: 2750913 - RNA, 20 nt, Human
aagguaaaauugaaaggcau

SEQ ID NO: 2750914 - RNA, 19 nt, Human
aagguauuuauugagcacc

SEQ ID NO: 2750915 - RNA, 16 nt, Human
aagguccuggcaaaga

SEQ ID NO: 2750916 - RNA, 19 nt, Human
aagguccuggcaaagauga

SEQ ID NO: 2750917 - RNA, 13 nt, Human
aaggugaucuggc

SEQ ID NO: 2750918 - RNA, 17 nt, Human
aaggugaucuggcucug

SEQ ID NO: 2750919 - RNA, 23 nt, Human
aagguggcuacaaagaugacugu

SEQ ID NO: 2750920 - RNA, 13 nt, Human
aaguaaaggcaaa

SEQ ID NO: 2750921 - RNA, 16 nt, Human
aaguaaaggcaaacuu

SEQ ID NO: 2750922 - RNA, 22 nt, Human
aaguaacucauuuguuaaaauu

SEQ ID NO: 2750923 - RNA, 15 nt, Human
aaguaaggaauuuua

SEQ ID NO: 2750924 - RNA, 20 nt, Human
aaguaaguuugauuucauua

SEQ ID NO: 2750925 - RNA, 16 nt, Human
aaguaauuucagaaga

SEQ ID NO: 2750926 - RNA, 22 nt, Human
aaguacccguucacauuuuugu

SEQ ID NO: 2750927 - RNA, 18 nt, Human
aaguacucauacauguua

SEQ ID NO: 2750928 - RNA, 16 nt, Human
aaguauaggccaggca

SEQ ID NO: 2750929 - RNA, 11 nt, Human
aaguauauaua

SEQ ID NO: 2750930 - RNA, 23 nt, Human
aaguauccuucagccugaaagag

SEQ ID NO: 2750931 - RNA, 23 nt, Human
aaguaucuguauugcauuaaaua

SEQ ID NO: 2750932 - RNA, 18 nt, Human
aaguauucuguguuaaaa

SEQ ID NO: 2750933 - RNA, 15 nt, Human
aaguauuuauauauu

SEQ ID NO: 2750934 - RNA, 21 nt, Human
aauaugccccauucaacaucu

SEQ ID NO: 2750935 - RNA, 17 nt, Human
aauaugcucuaaacaug

SEQ ID NO: 2750936 - RNA, 18 nt, Human
aauaugcucuaaacaugu

SEQ ID NO: 2750937 - RNA, 23 nt, Human
aauaugcucuaaacauguuuauc

SEQ ID NO: 2750938 - RNA, 19 nt, Human
aauauggggaaaaaacugu

SEQ ID NO: 2750939 - RNA, 12 nt, Human
aauauguuagag

SEQ ID NO: 2750940 - RNA, 15 nt, Human
aauauguuauuauua

SEQ ID NO: 2750941 - RNA, 16 nt, Human
aauauguucugacaua

SEQ ID NO: 2750942 - RNA, 16 nt, Human
aauauuaaaaauuaau

SEQ ID NO: 2750943 - RNA, 22 nt, Human
aauauuagaaacagcuucucaa

SEQ ID NO: 2750944 - RNA, 11 nt, Human
aauauuauaau

SEQ ID NO: 2750945 - RNA, 14 nt, Human
aauauuauguuaaa

SEQ ID NO: 2750946 - RNA, 17 nt, Human
aauauuauguuaaaacu

SEQ ID NO: 2750947 - RNA, 12 nt, Human
aauauuccagag

SEQ ID NO: 2750948 - RNA, 15 nt, Human
aauauuccuuaagau

SEQ ID NO: 2750949 - RNA, 23 nt, Human
aauauuccuuaagauauuaacug

SEQ ID NO: 2750950 - RNA, 17 nt, Human
aauauuuauuaccucug

SEQ ID NO: 2750951 - RNA, 21 nt, Human
aauauuuauuuuaauaauguu

SEQ ID NO: 2750952 - RNA, 18 nt, Human
aauauuucagauaaucac

SEQ ID NO: 2750953 - RNA, 19 nt, Human
aauauuucucucuuuuuag

SEQ ID NO: 2750954 - RNA, 16 nt, Human
aauauuuuaauguuuc

SEQ ID NO: 2750955 - RNA, 15 nt, Human
aauauuuucuuuguu

SEQ ID NO: 2750956 - RNA, 23 nt, Human
aauauuuuuaugugcaauaaaau

SEQ ID NO: 2750957 - RNA, 20 nt, Human
aaucaaaagacuuuuuccuu

SEQ ID NO: 2750958 - RNA, 19 nt, Human
aaucaaacuuuacagaaag

SEQ ID NO: 2750959 - RNA, 18 nt, Human
aaucaaauaugcaaagca

SEQ ID NO: 2750960 - RNA, 15 nt, Human
aaucaaauuccagaa

SEQ ID NO: 2750961 - RNA, 20 nt, Human
aaucaagacugcaaacccuu

SEQ ID NO: 2750962 - RNA, 12 nt, Human
aaucaauguuuc

SEQ ID NO: 2750963 - RNA, 19 nt, Human
aaucacaaacucauccauu

SEQ ID NO: 2750964 - RNA, 19 nt, Human
aaucacaauaauuuucuac

SEQ ID NO: 2750965 - RNA, 15 nt, Human
aaucacucauuuauu

SEQ ID NO: 2750966 - RNA, 22 nt, Human
aaucacucauuuauuuccauau

SEQ ID NO: 2750967 - RNA, 22 nt, Human
aaucacuggcuguuaaucuuuc

SEQ ID NO: 2750968 - RNA, 12 nt, Human
aaucacuugaac

SEQ ID NO: 2750969 - RNA, 18 nt, Human
aaucagaccuggcugcuu

SEQ ID NO: 2750970 - RNA, 16 nt, Human
aaucagagaccuucca

SEQ ID NO: 2750971 - RNA, 23 nt, Human
aaucagagaccuuccagaaauac

SEQ ID NO: 2750972 - RNA, 13 nt, Human
aaucaggcuggcc

SEQ ID NO: 2750973 - RNA, 17 nt, Human
aaucaggguuaguauug

SEQ ID NO: 2750974 - RNA, 14 nt, Human
aaucauaagauauu

SEQ ID NO: 2750975 - RNA, 20 nt, Human
aaucauauaauaaauguaca

SEQ ID NO: 2750976 - RNA, 12 nt, Human
aaucaugaauua

SEQ ID NO: 2750977 - RNA, 17 nt, Human
aaucaugaauuaguuuu

SEQ ID NO: 2750978 - RNA, 22 nt, Human
aaucaugaauuaguuuuauaug

SEQ ID NO: 2750979 - RNA, 23 nt, Human
aaucauucuuauuucaugaaaau

SEQ ID NO: 2750980 - RNA, 14 nt, Human
aaucauuuaucaua

SEQ ID NO: 2750981 - RNA, 15 nt, Human
aaucauuucugcauc

SEQ ID NO: 2750982 - RNA, 13 nt, Human
aauccaagcagga

SEQ ID NO: 2750983 - RNA, 15 nt, Human
aauccaaugaaauga

SEQ ID NO: 2750984 - RNA, 20 nt, Human
aaucccagcuacuugggagg

SEQ ID NO: 2750985 - RNA, 15 nt, Human
aaucccuuaaacuca

SEQ ID NO: 2750986 - RNA, 21 nt, Human
aauccuagguaggguuuaauc

SEQ ID NO: 2750987 - RNA, 15 nt, Human
aauccucucucugug

SEQ ID NO: 2750988 - RNA, 19 nt, Human
aauccuuuguuuucugacu

SEQ ID NO: 2750989 - RNA, 21 nt, Human
aauccuuuuuuauuccauaag

SEQ ID NO: 2750990 - RNA, 23 nt, Human
aaucgcuaccuuuugcuguggca

SEQ ID NO: 2750991 - RNA, 16 nt, Human
aaucuaauucaaacua

SEQ ID NO: 2750992 - RNA, 19 nt, Human
aaucuacacuccagugaga

SEQ ID NO: 2750993 - RNA, 14 nt, Human
aaucuaucaaaauu

SEQ ID NO: 2750994 - RNA, 20 nt, Human
aaucuauuuauuaauauuua

SEQ ID NO: 2750995 - RNA, 14 nt, Human
aaucucaauauuuc

SEQ ID NO: 2750996 - RNA, 21 nt, Human
aaucugcuucauccaauguga

SEQ ID NO: 2750997 - RNA, 17 nt, Human
aaucuguauuuccccaa

SEQ ID NO: 2750998 - RNA, 19 nt, Human
aaucuuaacucauugcaac

SEQ ID NO: 2750999 - RNA, 17 nt, Human
aaucuuauaauuuaaaa

SEQ ID NO: 2751000 - RNA, 17 nt, Human
aaucuuucacaggggac

SEQ ID NO: 2751001 - RNA, 12 nt, Human
aaugaaagaaag

SEQ ID NO: 2751002 - RNA, 22 nt, Human
aaugaaagaaaggccagcaaau

SEQ ID NO: 2751003 - RNA, 16 nt, Human
aaugaaagcagggacu

SEQ ID NO: 2751004 - RNA, 18 nt, Human
aaugaaaguugauaagua

SEQ ID NO: 2751005 - RNA, 19 nt, Human
aaugaaauggugaaaugca

SEQ ID NO: 2751006 - RNA, 15 nt, Human
aaugaacuuuccaca

SEQ ID NO: 2751007 - RNA, 13 nt, Human
aaugaaguguuua

SEQ ID NO: 2751008 - RNA, 14 nt, Human
aaugaaguuugaau

SEQ ID NO: 2751009 - RNA, 19 nt, Human
aaugaauggcuaagcaaaa

SEQ ID NO: 2751010 - RNA, 22 nt, Human
aaugaauggcuaagcaaaaugu

SEQ ID NO: 2751011 - RNA, 12 nt, Human
aaugaauguuua

SEQ ID NO: 2751012 - RNA, 21 nt, Human
aaugacacuagcuaauaucaa

SEQ ID NO: 2751013 - RNA, 23 nt, Human
aaugacgguguuaauuuugcuaa

SEQ ID NO: 2751014 - RNA, 17 nt, Human
aaugacuaaaaaacaaa

SEQ ID NO: 2751015 - RNA, 12 nt, Human
aaugacugucua

SEQ ID NO: 2751016 - RNA, 20 nt, Human
aaugagagacacacugaaga

SEQ ID NO: 2751017 - RNA, 12 nt, Human
aaugagauauua

SEQ ID NO: 2751018 - RNA, 14 nt, Human
aaugagcaaaaguu

SEQ ID NO: 2751019 - RNA, 19 nt, Human
aaugagcacgcauggaaaa

SEQ ID NO: 2751020 - RNA, 14 nt, Human
aaugauaacuggaa

SEQ ID NO: 2751021 - RNA, 16 nt, Human
aaugauaacuggaaac

SEQ ID NO: 2751022 - RNA, 22 nt, Human
aaugauaacuggaaacuucagc

SEQ ID NO: 2751023 - RNA, 22 nt, Human
aaugauguuucauaagaauucu

SEQ ID NO: 2751024 - RNA, 15 nt, Human
aaugauuaugaauua

SEQ ID NO: 2751025 - RNA, 16 nt, Human
aaugauuaugaauuac

SEQ ID NO: 2751026 - RNA, 12 nt, Human
aaugcagccccc

SEQ ID NO: 2751027 - RNA, 17 nt, Human
aaugcagugccuuucuu

SEQ ID NO: 2751028 - RNA, 18 nt, Human
aaugcagugccuuucuuc

SEQ ID NO: 2751029 - RNA, 19 nt, Human
aaugcagugccuuucuucu

SEQ ID NO: 2751030 - RNA, 17 nt, Human
aaugcauauacuuuaau

SEQ ID NO: 2751031 - RNA, 14 nt, Human
aaugcauguugccc

SEQ ID NO: 2751032 - RNA, 23 nt, Human
aaugcugguuuuucaguuuucag

SEQ ID NO: 2751033 - RNA, 22 nt, Human
aaugcuuaugaaacuaagauuu

SEQ ID NO: 2751034 - RNA, 16 nt, Human
aaugcuuuccaugagu

SEQ ID NO: 2751035 - RNA, 16 nt, Human
aauggaggccuguccu

SEQ ID NO: 2751036 - RNA, 21 nt, Human
aauggauaugacacaucucug

SEQ ID NO: 2751037 - RNA, 17 nt, Human
aauggcuaagauaccaa

SEQ ID NO: 2751038 - RNA, 14 nt, Human
aauggcuaagcaaa

SEQ ID NO: 2751039 - RNA, 22 nt, Human
aaugggcacaggguuuauguuu

SEQ ID NO: 2751040 - RNA, 21 nt, Human
aauggggaacuacugcuggca

SEQ ID NO: 2751041 - RNA, 10 nt, Human
aauggucaau

SEQ ID NO: 2751042 - RNA, 14 nt, Human
aauggugccuucau

SEQ ID NO: 2751043 - RNA, 17 nt, Human
aauguaaaauagugaau

SEQ ID NO: 2751044 - RNA, 13 nt, Human
aauguaaacaaag

SEQ ID NO: 2751045 - RNA, 18 nt, Human
aauguaccuucacaccaa

SEQ ID NO: 2751046 - RNA, 14 nt, Human
aauguagauaaagc

SEQ ID NO: 2751047 - RNA, 23 nt, Human
aauguagcagcucauaaaugaaa

SEQ ID NO: 2751048 - RNA, 17 nt, Human
aauguaucuuauucaca

SEQ ID NO: 2751049 - RNA, 23 nt, Human
aauguauucuuuuaguuuuuaaa

SEQ ID NO: 2751050 - RNA, 23 nt, Human
aauguauuuguuuguauuuugug

SEQ ID NO: 2751051 - RNA, 21 nt, Human
aaugucauuguucuugugaac

SEQ ID NO: 2751052 - RNA, 15 nt, Human
aaugucugaaaugga

SEQ ID NO: 2751053 - RNA, 21 nt, Human
aaugugcuuuuaaaaaaaaau

SEQ ID NO: 2751054 - RNA, 19 nt, Human
aaugugguacaagcauucu

SEQ ID NO: 2751055 - RNA, 20 nt, Human
aauguuacauuauuaucaac

SEQ ID NO: 2751056 - RNA, 13 nt, Human
aauguugaauuuu

SEQ ID NO: 2751057 - RNA, 23 nt, Human
aauguugaguuauuaauauguua

SEQ ID NO: 2751058 - RNA, 17 nt, Human
aauguuguuuuaggaau

SEQ ID NO: 2751059 - RNA, 19 nt, Human
aauguuuacagauccccaa

SEQ ID NO: 2751060 - RNA, 16 nt, Human
aauuaaagaagagaac

SEQ ID NO: 2751061 - RNA, 20 nt, Human
aauuaaagcuguuauuuaau

SEQ ID NO: 2751062 - RNA, 15 nt, Human
aauuaacacaugauc

SEQ ID NO: 2751063 - RNA, 14 nt, Human
aauuaacucagaca

SEQ ID NO: 2751064 - RNA, 16 nt, Human
aauuaagagagucuau

SEQ ID NO: 2751065 - RNA, 11 nt, Human
aauuaaucugu

SEQ ID NO: 2751066 - RNA, 13 nt, Human
aauuaaucuugua

SEQ ID NO: 2751067 - RNA, 20 nt, Human
aauuaauggaauauguaaau

SEQ ID NO: 2751068 - RNA, 14 nt, Human
aauuaauuuuagaa

SEQ ID NO: 2751069 - RNA, 16 nt, Human
aauuacacuuugaacu

SEQ ID NO: 2751070 - RNA, 16 nt, Human
aauuacauuuguauaa

SEQ ID NO: 2751071 - RNA, 22 nt, Human
aauuacauuuguauaaaauaau

SEQ ID NO: 2751072 - RNA, 14 nt, Human
aauuaccacaccau

SEQ ID NO: 2751073 - RNA, 12 nt, Human
aauuagaugaac

SEQ ID NO: 2751074 - RNA, 21 nt, Human
aauuagaugacugaauuucua

SEQ ID NO: 2751075 - RNA, 13 nt, Human
aauuagccgggca

SEQ ID NO: 2751076 - RNA, 20 nt, Human
aauuagcuccuccuuuuucc

SEQ ID NO: 2751077 - RNA, 21 nt, Human
aauuagcuccuccuuuuuccu

SEQ ID NO: 2751078 - RNA, 22 nt, Human
aauuagcuccuccuuuuuccuu

SEQ ID NO: 2751079 - RNA, 19 nt, Human
acaagcugcauuucagaaa

SEQ ID NO: 2751080 - RNA, 20 nt, Human
acaagcuuuuuuuuuuuuuc

SEQ ID NO: 2751081 - RNA, 13 nt, Human
acaaggaaaaaau

SEQ ID NO: 2751082 - RNA, 14 nt, Human
acaaggaaaaaaua

SEQ ID NO: 2751083 - RNA, 18 nt, Human
acaaggaaggaaagaugu

SEQ ID NO: 2751084 - RNA, 21 nt, Human
acaaggaugaauuaaguuuuu

SEQ ID NO: 2751085 - RNA, 14 nt, Human
acaaggccuuggag

SEQ ID NO: 2751086 - RNA, 18 nt, Human
acaaguauggcuccucca

SEQ ID NO: 2751087 - RNA, 12 nt, Human
acaauaaagcaa

SEQ ID NO: 2751088 - RNA, 19 nt, Human
acaauaacgauaaaagaca

SEQ ID NO: 2751089 - RNA, 14 nt, Human
acaauaauuuucua

SEQ ID NO: 2751090 - RNA, 15 nt, Human
acaauacaucccuua

SEQ ID NO: 2751091 - RNA, 19 nt, Human
acaauagcagacaguguuu

SEQ ID NO: 2751092 - RNA, 23 nt, Human
acaaucuaggaugggaacaagga

SEQ ID NO: 2751093 - RNA, 19 nt, Human
acaaucugaggccuccucu

SEQ ID NO: 2751094 - RNA, 13 nt, Human
acaaugaaaagga

SEQ ID NO: 2751095 - RNA, 16 nt, Human
acaaugaaaaggacuu

SEQ ID NO: 2751096 - RNA, 20 nt, Human
acaaugacuuguacucugaa

SEQ ID NO: 2751097 - RNA, 23 nt, Human
acaaugcagugccuuucuucucu

SEQ ID NO: 2751098 - RNA, 16 nt, Human
acaaugcuuugccccu

SEQ ID NO: 2751099 - RNA, 18 nt, Human
acaauuaaagcuguuauu

SEQ ID NO: 2751100 - RNA, 15 nt, Human
acaauuauaagcugu

SEQ ID NO: 2751101 - RNA, 21 nt, Human
acaauuauaagcuguuuuuau

SEQ ID NO: 2751102 - RNA, 17 nt, Human
acaauuugaauauaaau

SEQ ID NO: 2751103 - RNA, 20 nt, Human
acaauuugaauauaaauuua

SEQ ID NO: 2751104 - RNA, 23 nt, Human
acacaaauaaaggaaacccagcu

SEQ ID NO: 2751105 - RNA, 15 nt, Human
acacaaauuaucuua

SEQ ID NO: 2751106 - RNA, 18 nt, Human
acacaaauuaucuuaaaa

SEQ ID NO: 2751107 - RNA, 22 nt, Human
acacaaauuaucuuaaaacucc

SEQ ID NO: 2751108 - RNA, 20 nt, Human
acacacaaauuaucuuaaaa

SEQ ID NO: 2751109 - RNA, 13 nt, Human
acacacaugaagu

SEQ ID NO: 2751110 - RNA, 14 nt, Human
acacacauuaaaau

SEQ ID NO: 2751111 - RNA, 16 nt, Human
acacacauuaaaaugu

SEQ ID NO: 2751112 - RNA, 16 nt, Human
acacaccaccacgccu

SEQ ID NO: 2751113 - RNA, 13 nt, Human
acacacugaagaa

SEQ ID NO: 2751114 - RNA, 15 nt, Human
acacagauuugagcu

SEQ ID NO: 2751115 - RNA, 16 nt, Human
acacagauuugagcuc

SEQ ID NO: 2751116 - RNA, 16 nt, Human
acacagcugucccaag

SEQ ID NO: 2751117 - RNA, 13 nt, Human
acacaggcuccaa

SEQ ID NO: 2751118 - RNA, 20 nt, Human
acacagucuaacaaauucca

SEQ ID NO: 2751119 - RNA, 13 nt, Human
acacagugucugg

SEQ ID NO: 2751120 - RNA, 22 nt, Human
acacauaucaaacugaaacaaa

SEQ ID NO: 2751121 - RNA, 14 nt, Human
acacaucagcuugc

SEQ ID NO: 2751122 - RNA, 15 nt, Human
acacaucagcuugcc

SEQ ID NO: 2751123 - RNA, 15 nt, Human
acacaucucccgcuc

SEQ ID NO: 2751124 - RNA, 16 nt, Human
acacaugugcuggcca

SEQ ID NO: 2751125 - RNA, 14 nt, Human
acacauuaaaaugu

SEQ ID NO: 2751126 - RNA, 10 nt, Human
acaccaccac

SEQ ID NO: 2751127 - RNA, 20 nt, Human
acaccaccacccuugccaug

SEQ ID NO: 2751128 - RNA, 17 nt, Human
acaccagagauaauaug

SEQ ID NO: 2751129 - RNA, 12 nt, Human
acaccaggcuug

SEQ ID NO: 2751130 - RNA, 21 nt, Human
acaccaggcuugccugcaggc

SEQ ID NO: 2751131 - RNA, 22 nt, Human
acaccauucaggucuuucuuuc

SEQ ID NO: 2751132 - RNA, 23 nt, Human
acaccauuuuggcaagcucuauc

SEQ ID NO: 2751133 - RNA, 16 nt, Human
acaccccaacagcacc

SEQ ID NO: 2751134 - RNA, 21 nt, Human
acaccuaugucauuucauuuc

SEQ ID NO: 2751135 - RNA, 14 nt, Human
acaccucagcugcc

SEQ ID NO: 2751136 - RNA, 18 nt, Human
acaccucagcugccuccc

SEQ ID NO: 2751137 - RNA, 12 nt, Human
acaccuuaucua

SEQ ID NO: 2751138 - RNA, 22 nt, Human
acaccuuguacuuuauuuucua

SEQ ID NO: 2751139 - RNA, 18 nt, Human
acaccuuuuacucuucuu

SEQ ID NO: 2751140 - RNA, 17 nt, Human
acacguggcuggcggcc

SEQ ID NO: 2751141 - RNA, 16 nt, Human
acacguuauaaucauu

SEQ ID NO: 2751142 - RNA, 16 nt, Human
acacuaaaacaccuca

SEQ ID NO: 2751143 - RNA, 14 nt, Human
acacuaacauauaa

SEQ ID NO: 2751144 - RNA, 15 nt, Human
acacuaacauauaau

SEQ ID NO: 2751145 - RNA, 13 nt, Human
acacucaaaucaa

SEQ ID NO: 2751146 - RNA, 14 nt, Human
acacucaaaucaag

SEQ ID NO: 2751147 - RNA, 16 nt, Human
acacucaaaucaagaa

SEQ ID NO: 2751148 - RNA, 18 nt, Human
acacucagauccuccuca

SEQ ID NO: 2751149 - RNA, 16 nt, Human
acacucuugaaaaaug

SEQ ID NO: 2751150 - RNA, 14 nt, Human
acacugaagaagca

SEQ ID NO: 2751151 - RNA, 15 nt, Human
acacugaucuggcug

SEQ ID NO: 2751152 - RNA, 16 nt, Human
acacugaucuggcugc

SEQ ID NO: 2751153 - RNA, 20 nt, Human
acacugauguaugaggaauu

SEQ ID NO: 2751154 - RNA, 21 nt, Human
acacugggagaaaugaaaaaa

SEQ ID NO: 2751155 - RNA, 22 nt, Human
acacugucucuaccaaaaaaag

SEQ ID NO: 2751156 - RNA, 11 nt, Human
acacuguuauc

SEQ ID NO: 2751157 - RNA, 19 nt, Human
acacuguuaucuucacuuu

SEQ ID NO: 2751158 - RNA, 12 nt, Human
acacuuaaaaau

SEQ ID NO: 2751159 - RNA, 13 nt, Human
acacuuaaaaaug

SEQ ID NO: 2751160 - RNA, 14 nt, Human
acacuuauaaguga

SEQ ID NO: 2751161 - RNA, 17 nt, Human
acagaaaaguugaauuu

SEQ ID NO: 2751162 - RNA, 20 nt, Human
acagaaagauuugauguaug

SEQ ID NO: 2751163 - RNA, 16 nt, Human
acagaaagcagaacag

SEQ ID NO: 2751164 - RNA, 18 nt, Human
acagaaagcagaacagug

SEQ ID NO: 2751165 - RNA, 21 nt, Human
acagaagcuccagguagaggg

SEQ ID NO: 2751166 - RNA, 15 nt, Human
acagaagcuuccauu

SEQ ID NO: 2751167 - RNA, 16 nt, Human
acagaagugcuuucuu

SEQ ID NO: 2751168 - RNA, 14 nt, Human
acagaauuuuaugc

SEQ ID NO: 2751169 - RNA, 19 nt, Human
acagaccuuugaacuagag

SEQ ID NO: 2751170 - RNA, 22 nt, Human
acagagaaaauaaaagcacuua

SEQ ID NO: 2751171 - RNA, 12 nt, Human
acagagacagaa

SEQ ID NO: 2751172 - RNA, 16 nt, Human
acagagacagaaagca

SEQ ID NO: 2751173 - RNA, 13 nt, Human
acagaggaucugc

SEQ ID NO: 2751174 - RNA, 16 nt, Human
acagagguagucucac

SEQ ID NO: 2751175 - RNA, 21 nt, Human
acagauuugagcucagcccug

SEQ ID NO: 2751176 - RNA, 22 nt, Human
acagauuugagcucagcccugg

SEQ ID NO: 2751177 - RNA, 13 nt, Human
acagauuugcaaa

SEQ ID NO: 2751178 - RNA, 16 nt, Human
acagcaagucaggguu

SEQ ID NO: 2751179 - RNA, 16 nt, Human
acagcacccucuccag

SEQ ID NO: 2751180 - RNA, 19 nt, Human
acagcacccucuccagaug

SEQ ID NO: 2751181 - RNA, 15 nt, Human
acagcaguugaaaag

SEQ ID NO: 2751182 - RNA, 21 nt, Human
acagccagacuggcacaguuu

SEQ ID NO: 2751183 - RNA, 20 nt, Human
acagccccuggucagucugc

SEQ ID NO: 2751184 - RNA, 20 nt, Human
acagcccuucuuuccacaga

SEQ ID NO: 2751185 - RNA, 22 nt, Human
acagccgcuccugucugccagc

SEQ ID NO: 2751186 - RNA, 16 nt, Human
acagccucuuagaugc

SEQ ID NO: 2751187 - RNA, 19 nt, Human
acagcuacuugggaggcug

SEQ ID NO: 2751188 - RNA, 14 nt, Human
acagcuaugaaggc

SEQ ID NO: 2751189 - RNA, 17 nt, Human
acagcuccaccuuacuu

SEQ ID NO: 2751190 - RNA, 13 nt, Human
acagcugcucaau

SEQ ID NO: 2751191 - RNA, 20 nt, Human
acagcuuauuuccucauuuu

SEQ ID NO: 2751192 - RNA, 16 nt, Human
acagcuucucaauuuc

SEQ ID NO: 2751193 - RNA, 18 nt, Human
acagcuucucauccugca

SEQ ID NO: 2751194 - RNA, 20 nt, Human
acagcuugaucaaaggcaca

SEQ ID NO: 2751195 - RNA, 12 nt, Human
acaggaaaaagu

SEQ ID NO: 2751196 - RNA, 18 nt, Human
acaggagcuuaaacagcu

SEQ ID NO: 2751197 - RNA, 21 nt, Human
acaggauggcaggaggcaucc

SEQ ID NO: 2751198 - RNA, 22 nt, Human
acaggauggcaggaggcaucca

SEQ ID NO: 2751199 - RNA, 23 nt, Human
acaggaugguucccuugaugaag

SEQ ID NO: 2751200 - RNA, 22 nt, Human
acaggauguuugcucagcuucu

SEQ ID NO: 2751201 - RNA, 15 nt, Human
acaggauuugaaauu

SEQ ID NO: 2751202 - RNA, 14 nt, Human
acaggcacuaucug

SEQ ID NO: 2751203 - RNA, 17 nt, Human
acaggccucacacacaa

SEQ ID NO: 2751204 - RNA, 11 nt, Human
acaggcgugag

SEQ ID NO: 2751205 - RNA, 14 nt, Human
acaggcgugagcca

SEQ ID NO: 2751206 - RNA, 16 nt, Human
acaggcgugagccacc

SEQ ID NO: 2751207 - RNA, 20 nt, Human
acaggcuugaaucaaagaac

SEQ ID NO: 2751208 - RNA, 17 nt, Human
acagggaccagggauga

SEQ ID NO: 2751209 - RNA, 15 nt, Human
acagggaggacgcuc

SEQ ID NO: 2751210 - RNA, 18 nt, Human
acagggaggacgcucucu

SEQ ID NO: 2751211 - RNA, 18 nt, Human
acagggaugaggcagacc

SEQ ID NO: 2751212 - RNA, 15 nt, Human
acaggguuuauguuu

SEQ ID NO: 2751213 - RNA, 18 nt, Human
acagguccccagaugaga

SEQ ID NO: 2751214 - RNA, 13 nt, Human
acaguaauuuuaa

SEQ ID NO: 2751215 - RNA, 14 nt, Human
acaguaauuuuaag

SEQ ID NO: 2751216 - RNA, 15 nt, Human
acaguacaccacaag

SEQ ID NO: 2751217 - RNA, 15 nt, Human
acaguagagagggaa

SEQ ID NO: 2751218 - RNA, 19 nt, Human
acagucaccucauggaauu

SEQ ID NO: 2751219 - RNA, 19 nt, Human
acagucucaggaaaucaaa

SEQ ID NO: 2751220 - RNA, 18 nt, Human
acagucucuugaggcaca

SEQ ID NO: 2751221 - RNA, 14 nt, Human
acagucuuguauua

SEQ ID NO: 2751222 - RNA, 15 nt, Human
acagugaaagaaaau

SEQ ID NO: 2751223 - RNA, 21 nt, Human
acagugaaagaaaauaacaau

SEQ ID NO: 2751224 - RNA, 18 nt, Human
acagugaccauacuaauu

SEQ ID NO: 2751225 - RNA, 13 nt, Human
accauuucuugag

SEQ ID NO: 2751226 - RNA, 22 nt, Human
accauuucuugagguaaaagca

SEQ ID NO: 2751227 - RNA, 11 nt, Human
accauuuuuac

SEQ ID NO: 2751228 - RNA, 14 nt, Human
accauuuuuacuug

SEQ ID NO: 2751229 - RNA, 14 nt, Human
acccaaaaggcaga

SEQ ID NO: 2751230 - RNA, 17 nt, Human
acccaaaauaagcaggc

SEQ ID NO: 2751231 - RNA, 22 nt, Human
acccaaggaugucugccacacc

SEQ ID NO: 2751232 - RNA, 22 nt, Human
acccacaguggaaagacagcuu

SEQ ID NO: 2751233 - RNA, 17 nt, Human
acccacuggacucaccu

SEQ ID NO: 2751234 - RNA, 18 nt, Human
acccacuugcuuuuaaaa

SEQ ID NO: 2751235 - RNA, 16 nt, Human
acccagccccuugaga

SEQ ID NO: 2751236 - RNA, 19 nt, Human
acccagcucacaggagcuu

SEQ ID NO: 2751237 - RNA, 19 nt, Human
acccagguuggagugcagu

SEQ ID NO: 2751238 - RNA, 12 nt, Human
acccaguagaug

SEQ ID NO: 2751239 - RNA, 14 nt, Human
acccaguagaugcc

SEQ ID NO: 2751240 - RNA, 17 nt, Human
acccaguagaugccacc

SEQ ID NO: 2751241 - RNA, 18 nt, Human
acccaguagaugccaccc

SEQ ID NO: 2751242 - RNA, 19 nt, Human
acccaguagaugccaccca

SEQ ID NO: 2751243 - RNA, 17 nt, Human
acccaguagaugccacu

SEQ ID NO: 2751244 - RNA, 18 nt, Human
acccaguagaugccacua

SEQ ID NO: 2751245 - RNA, 23 nt, Human
acccaguguuuuaggagcaugag

SEQ ID NO: 2751246 - RNA, 18 nt, Human
accccaacagcacccucu

SEQ ID NO: 2751247 - RNA, 22 nt, Human
accccaaguuauccaccugccu

SEQ ID NO: 2751248 - RNA, 20 nt, Human
accccagauucaugcacugu

SEQ ID NO: 2751249 - RNA, 14 nt, Human
accccaggacgccc

SEQ ID NO: 2751250 - RNA, 14 nt, Human
accccaucauccuc

SEQ ID NO: 2751251 - RNA, 21 nt, Human
acccccugcaaagcccagcuu

SEQ ID NO: 2751252 - RNA, 15 nt, Human
accccugagcuugca

SEQ ID NO: 2751253 - RNA, 20 nt, Human
accccugagcuugcagagau

SEQ ID NO: 2751254 - RNA, 22 nt, Human
accccugagcuugcagagauga

SEQ ID NO: 2751255 - RNA, 12 nt, Human
accccuggccaa

SEQ ID NO: 2751256 - RNA, 16 nt, Human
accccuggccaaggaa

SEQ ID NO: 2751257 - RNA, 19 nt, Human
accccuucauccucugagu

SEQ ID NO: 2751258 - RNA, 14 nt, Human
acccgcccaccgca

SEQ ID NO: 2751259 - RNA, 14 nt, Human
acccgggaggcaga

SEQ ID NO: 2751260 - RNA, 18 nt, Human
acccguggcgcuuucugc

SEQ ID NO: 2751261 - RNA, 14 nt, Human
acccucaugcugcc

SEQ ID NO: 2751262 - RNA, 15 nt, Human
acccucaugcugcca

SEQ ID NO: 2751263 - RNA, 17 nt, Human
acccuccacaggcacag

SEQ ID NO: 2751264 - RNA, 15 nt, Human
acccuccagagacaa

SEQ ID NO: 2751265 - RNA, 18 nt, Human
acccuccagagacaacag

SEQ ID NO: 2751266 - RNA, 18 nt, Human
acccuccccaaaggcuuu

SEQ ID NO: 2751267 - RNA, 23 nt, Human
acccuccccaaaggcuuugcccu

SEQ ID NO: 2751268 - RNA, 22 nt, Human
acccucuccagaugcagcccca

SEQ ID NO: 2751269 - RNA, 15 nt, Human
acccucugggucuca

SEQ ID NO: 2751270 - RNA, 12 nt, Human
acccugauuuua

SEQ ID NO: 2751271 - RNA, 13 nt, Human
acccuggaaaaug

SEQ ID NO: 2751272 - RNA, 16 nt, Human
acccuggacuugccuc

SEQ ID NO: 2751273 - RNA, 22 nt, Human
acccuuauugcuguccuggagg

SEQ ID NO: 2751274 - RNA, 13 nt, Human
acccuugccaugg

SEQ ID NO: 2751275 - RNA, 22 nt, Human
acccuuucauaaagucuugccu

SEQ ID NO: 2751276 - RNA, 23 nt, Human
acccuuucauaaagucuugccuu

SEQ ID NO: 2751277 - RNA, 22 nt, Human
acccuuucugccccugcugaca

SEQ ID NO: 2751278 - RNA, 13 nt, Human
accgaguggcccu

SEQ ID NO: 2751279 - RNA, 14 nt, Human
accgcgcccagccu

SEQ ID NO: 2751280 - RNA, 20 nt, Human
accgcuguacgcgagcgcgc

SEQ ID NO: 2751281 - RNA, 20 nt, Human
accggccuuugcaccuccau

SEQ ID NO: 2751282 - RNA, 15 nt, Human
accuaaacauagaaa

SEQ ID NO: 2751283 - RNA, 19 nt, Human
accuaaacauagaaauugc

SEQ ID NO: 2751284 - RNA, 22 nt, Human
accuaacgaaguauccuucagc

SEQ ID NO: 2751285 - RNA, 15 nt, Human
accuaccaagauaua

SEQ ID NO: 2751286 - RNA, 13 nt, Human
accuacuuacaug

SEQ ID NO: 2751287 - RNA, 16 nt, Human
accuacuuacaugcau

SEQ ID NO: 2751288 - RNA, 18 nt, Human
accuagcuggcucuguga

SEQ ID NO: 2751289 - RNA, 16 nt, Human
accuagggugauauua

SEQ ID NO: 2751290 - RNA, 13 nt, Human
accuaguccccag

SEQ ID NO: 2751291 - RNA, 16 nt, Human
accuaguccccagccu

SEQ ID NO: 2751292 - RNA, 17 nt, Human
accuaguccccagccug

SEQ ID NO: 2751293 - RNA, 16 nt, Human
accucaagccagccuu

SEQ ID NO: 2751294 - RNA, 18 nt, Human
accucacauacccucacu

SEQ ID NO: 2751295 - RNA, 20 nt, Human
accucaccaguuuccaggug

SEQ ID NO: 2751296 - RNA, 12 nt, Human
accucaggcaau

SEQ ID NO: 2751297 - RNA, 15 nt, Human
accucaguucccucu

SEQ ID NO: 2751298 - RNA, 13 nt, Human
accucaguuuuau

SEQ ID NO: 2751299 - RNA, 19 nt, Human
accucaguuuuaucauuuu

SEQ ID NO: 2751300 - RNA, 21 nt, Human
accucauggaauuggagcucg

SEQ ID NO: 2751301 - RNA, 14 nt, Human
accuccaccuccug

SEQ ID NO: 2751302 - RNA, 21 nt, Human
accuccaccuucuggguucaa

SEQ ID NO: 2751303 - RNA, 15 nt, Human
accuccauggaaacg

SEQ ID NO: 2751304 - RNA, 15 nt, Human
accucccccaucucu

SEQ ID NO: 2751305 - RNA, 14 nt, Human
accucccccccccc

SEQ ID NO: 2751306 - RNA, 11 nt, Human
accucccugca

SEQ ID NO: 2751307 - RNA, 18 nt, Human
accucccugcaauaaaau

SEQ ID NO: 2751308 - RNA, 20 nt, Human
accucccugcaauaaaaugg

SEQ ID NO: 2751309 - RNA, 13 nt, Human
accuccgccuccc

SEQ ID NO: 2751310 - RNA, 14 nt, Human
accuccgccuccca

SEQ ID NO: 2751311 - RNA, 16 nt, Human
accuccuaagaaggca

SEQ ID NO: 2751312 - RNA, 19 nt, Human
accuccuaagaaggcaccu

SEQ ID NO: 2751313 - RNA, 14 nt, Human
accuccuggguuca

SEQ ID NO: 2751314 - RNA, 18 nt, Human
accuccuuccaggggagg

SEQ ID NO: 2751315 - RNA, 18 nt, Human
accucuccaaagcccucc

SEQ ID NO: 2751316 - RNA, 20 nt, Human
accucuccaaagcccucccu

SEQ ID NO: 2751317 - RNA, 15 nt, Human
accucuccccuggaa

SEQ ID NO: 2751318 - RNA, 23 nt, Human
accucucuggguugaagggcagu

SEQ ID NO: 2751319 - RNA, 13 nt, Human
accucugccuccc

SEQ ID NO: 2751320 - RNA, 11 nt, Human
accugaagaau

SEQ ID NO: 2751321 - RNA, 15 nt, Human
accugaagaaucaca

SEQ ID NO: 2751322 - RNA, 17 nt, Human
accugaagcuaucguaa

SEQ ID NO: 2751323 - RNA, 22 nt, Human
accugacuauugaaguugcaga

SEQ ID NO: 2751324 - RNA, 14 nt, Human
accugacucuugca

SEQ ID NO: 2751325 - RNA, 11 nt, Human
accugagcccc

SEQ ID NO: 2751326 - RNA, 17 nt, Human
accugagccccaaaagg

SEQ ID NO: 2751327 - RNA, 18 nt, Human
accugccaggcacacuga

SEQ ID NO: 2751328 - RNA, 15 nt, Human
accugcucagcccug

SEQ ID NO: 2751329 - RNA, 16 nt, Human
accugcucagcccugc

SEQ ID NO: 2751330 - RNA, 19 nt, Human
accugcucagcccugcacc

SEQ ID NO: 2751331 - RNA, 14 nt, Human
accugcuguuuccu

SEQ ID NO: 2751332 - RNA, 13 nt, Human
accuggccgcagu

SEQ ID NO: 2751333 - RNA, 21 nt, Human
accugggaaagggcuguuaua

SEQ ID NO: 2751334 - RNA, 13 nt, Human
accugggauuaca

SEQ ID NO: 2751335 - RNA, 12 nt, Human
accugggcauuc

SEQ ID NO: 2751336 - RNA, 15 nt, Human
accugggcauucuug

SEQ ID NO: 2751337 - RNA, 16 nt, Human
accuguaaucauauaa

SEQ ID NO: 2751338 - RNA, 14 nt, Human
accuguaaucccag

SEQ ID NO: 2751339 - RNA, 15 nt, Human
accuguaaucccagc

SEQ ID NO: 2751340 - RNA, 19 nt, Human
accugucccagcgagggac

SEQ ID NO: 2751341 - RNA, 13 nt, Human
accuguccccgaa

SEQ ID NO: 2751342 - RNA, 15 nt, Human
accuguccccgaaac

SEQ ID NO: 2751343 - RNA, 14 nt, Human
accugugagaccaa

SEQ ID NO: 2751344 - RNA, 17 nt, Human
accugugccguccccag

SEQ ID NO: 2751345 - RNA, 16 nt, Human
accuuacuucuucuca

SEQ ID NO: 2751346 - RNA, 22 nt, Human
accuuaucuauguagaauauau

SEQ ID NO: 2751347 - RNA, 23 nt, Human
accuuauguuuaauuaaaaucag

SEQ ID NO: 2751348 - RNA, 16 nt, Human
accuuauuguaccucu

SEQ ID NO: 2751349 - RNA, 22 nt, Human
accuucaacaaccggccaccag

SEQ ID NO: 2751350 - RNA, 17 nt, Human
accuuccagaaauacua

SEQ ID NO: 2751351 - RNA, 15 nt, Human
accuucccagcuaga

SEQ ID NO: 2751352 - RNA, 21 nt, Human
accuuccuuuuacuuuucuuc

SEQ ID NO: 2751353 - RNA, 12 nt, Human
accuucucaccu

SEQ ID NO: 2751354 - RNA, 16 nt, Human
accuucugaggagcug

SEQ ID NO: 2751355 - RNA, 14 nt, Human
accuucuggguuca

SEQ ID NO: 2751356 - RNA, 16 nt, Human
accuuguacuuuauuu

SEQ ID NO: 2751357 - RNA, 23 nt, Human
accuuguacuuuauuuucuauaa

SEQ ID NO: 2751358 - RNA, 16 nt, Human
accuuuagaauauuaa

SEQ ID NO: 2751359 - RNA, 22 nt, Human
accuuuguuugcaucugaaaau

SEQ ID NO: 2751360 - RNA, 14 nt, Human
accuuuuauauuua

SEQ ID NO: 2751361 - RNA, 15 nt, Human
accuuuuauauuuag

SEQ ID NO: 2751362 - RNA, 14 nt, Human
acgaaacauuuguu

SEQ ID NO: 2751363 - RNA, 13 nt, Human
acgaaccuugaaa

SEQ ID NO: 2751364 - RNA, 22 nt, Human
acgaaguauccuucagccugaa

SEQ ID NO: 2751365 - RNA, 11 nt, Human
acgagaaaaca

SEQ ID NO: 2751366 - RNA, 14 nt, Human
acgagaaaacaaua

SEQ ID NO: 2751367 - RNA, 18 nt, Human
acgagaaaacaauaacga

SEQ ID NO: 2751368 - RNA, 15 nt, Human
acgagauacagaauu

SEQ ID NO: 2751369 - RNA, 16 nt, Human
acgaggauugggaaaa

SEQ ID NO: 2751370 - RNA, 13 nt, Human
acgauaaaagaca

SEQ ID NO: 2751371 - RNA, 14 nt, Human
acgauaaaagacag

SEQ ID NO: 2751372 - RNA, 20 nt, Human
acucuuguuuccuuauauua

SEQ ID NO: 2751373 - RNA, 21 nt, Human
acugaaacaaaauuagaaaug

SEQ ID NO: 2751374 - RNA, 11 nt, Human
acugaaaucau

SEQ ID NO: 2751375 - RNA, 12 nt, Human
acugaaaucaua

SEQ ID NO: 2751376 - RNA, 16 nt, Human
acugaauguaaacaaa

SEQ ID NO: 2751377 - RNA, 13 nt, Human
acugacaacuuga

SEQ ID NO: 2751378 - RNA, 22 nt, Human
acugacuauucuugauguaaaa

SEQ ID NO: 2751379 - RNA, 18 nt, Human
acugacucuuaagaagac

SEQ ID NO: 2751380 - RNA, 17 nt, Human
acugacuucuaaguaaa

SEQ ID NO: 2751381 - RNA, 12 nt, Human
acugagaaauuu

SEQ ID NO: 2751382 - RNA, 14 nt, Human
acugagaugugaac

SEQ ID NO: 2751383 - RNA, 22 nt, Human
acugaggcagacagcagcucag

SEQ ID NO: 2751384 - RNA, 16 nt, Human
acugaugacuuuuuau

SEQ ID NO: 2751385 - RNA, 19 nt, Human
acugauggguuucuccaga

SEQ ID NO: 2751386 - RNA, 22 nt, Human
acugauguuccuagugaaagag

SEQ ID NO: 2751387 - RNA, 23 nt, Human
acugauuuggccguuuugugaag

SEQ ID NO: 2751388 - RNA, 17 nt, Human
acugauuuuuaaguuau

SEQ ID NO: 2751389 - RNA, 13 nt, Human
acugcaaacccuu

SEQ ID NO: 2751390 - RNA, 21 nt, Human
acugcaaccucugccucccag

SEQ ID NO: 2751391 - RNA, 15 nt, Human
acugcacugucaaga

SEQ ID NO: 2751392 - RNA, 20 nt, Human
acugcacugucaagaugaug

SEQ ID NO: 2751393 - RNA, 15 nt, Human
acugcaggcuccccu

SEQ ID NO: 2751394 - RNA, 14 nt, Human
acugcauuauauuu

SEQ ID NO: 2751395 - RNA, 17 nt, Human
acugccaagccaugggu

SEQ ID NO: 2751396 - RNA, 18 nt, Human
acugccuucucaacucca

SEQ ID NO: 2751397 - RNA, 12 nt, Human
acugcuacaaau

SEQ ID NO: 2751398 - RNA, 16 nt, Human
acugcuaguuuauaua

SEQ ID NO: 2751399 - RNA, 15 nt, Human
acugcucacacugcu

SEQ ID NO: 2751400 - RNA, 23 nt, Human
acugcucacacugcugaugauuu

SEQ ID NO: 2751401 - RNA, 12 nt, Human
acugcuccagag

SEQ ID NO: 2751402 - RNA, 18 nt, Human
acugcugucccaaacaug

SEQ ID NO: 2751403 - RNA, 16 nt, Human
acugcuugaacuaggc

SEQ ID NO: 2751404 - RNA, 14 nt, Human
acuggaaagaaguu

SEQ ID NO: 2751405 - RNA, 17 nt, Human
acuggacccuguugcua

SEQ ID NO: 2751406 - RNA, 14 nt, Human
acuggacucaccuc

SEQ ID NO: 2751407 - RNA, 18 nt, Human
acuggacucaccuccccc

SEQ ID NO: 2751408 - RNA, 15 nt, Human
acuggaugaaaaugu

SEQ ID NO: 2751409 - RNA, 16 nt, Human
acuggccacacaggau

SEQ ID NO: 2751410 - RNA, 14 nt, Human
acuggccugcugga

SEQ ID NO: 2751411 - RNA, 15 nt, Human
acuggccugcuggau

SEQ ID NO: 2751412 - RNA, 23 nt, Human
acuggcuaauuagcauggccaca

SEQ ID NO: 2751413 - RNA, 11 nt, Human
acugggacagg

SEQ ID NO: 2751414 - RNA, 20 nt, Human
acugggauuacaggcgugag

SEQ ID NO: 2751415 - RNA, 18 nt, Human
acugggguggguggggca

SEQ ID NO: 2751416 - RNA, 19 nt, Human
acugggguggguggggcag

SEQ ID NO: 2751417 - RNA, 21 nt, Human
acugggguggguggggcagug

SEQ ID NO: 2751418 - RNA, 15 nt, Human
acuggguuaaauauu

SEQ ID NO: 2751419 - RNA, 13 nt, Human
acuggucugaggu

SEQ ID NO: 2751420 - RNA, 14 nt, Human
acugguuaaacauu

SEQ ID NO: 2751421 - RNA, 17 nt, Human
acuguaaaauaauaacu

SEQ ID NO: 2751422 - RNA, 18 nt, Human
acuguaaagcuuugugca

SEQ ID NO: 2751423 - RNA, 12 nt, Human
acuguaaauuua

SEQ ID NO: 2751424 - RNA, 20 nt, Human
acuguacagacagaaaaaac

SEQ ID NO: 2751425 - RNA, 22 nt, Human
acuguacagacagaaaaaacug

SEQ ID NO: 2751426 - RNA, 17 nt, Human
acuguacuccagccagg

SEQ ID NO: 2751427 - RNA, 18 nt, Human
acuguacuccagccaggg

SEQ ID NO: 2751428 - RNA, 16 nt, Human
acuguacuugcucuug

SEQ ID NO: 2751429 - RNA, 20 nt, Human
acugucucacuuaauccuuu

SEQ ID NO: 2751430 - RNA, 17 nt, Human
acugugacuguacccaa

SEQ ID NO: 2751431 - RNA, 12 nt, Human
acugugggaagg

SEQ ID NO: 2751432 - RNA, 15 nt, Human
acugugugcucagga

SEQ ID NO: 2751433 - RNA, 16 nt, Human
acuguguuggccagga

SEQ ID NO: 2751434 - RNA, 20 nt, Human
acuguuaucaaaacuuucuu

SEQ ID NO: 2751435 - RNA, 18 nt, Human
acuguuuuucagggaggu

SEQ ID NO: 2751436 - RNA, 16 nt, Human
acuuaaaaucuaauuc

SEQ ID NO: 2751437 - RNA, 19 nt, Human
acuuaaaaucuaauucaaa

SEQ ID NO: 2751438 - RNA, 23 nt, Human
acuuaaggauggagccagcucug

SEQ ID NO: 2751439 - RNA, 23 nt, Human
acuuaaguggcuuccaauuuuug

SEQ ID NO: 2751440 - RNA, 22 nt, Human
acuuacaugcauuacugcaugc

SEQ ID NO: 2751441 - RNA, 20 nt, Human
acuuaccugggcauucuugu

SEQ ID NO: 2751442 - RNA, 17 nt, Human
acuuauaggaauugacc

SEQ ID NO: 2751443 - RNA, 20 nt, Human
acuuauaggaauugacccac

SEQ ID NO: 2751444 - RNA, 15 nt, Human
acuuaugaaccuuua

SEQ ID NO: 2751445 - RNA, 19 nt, Human
acuuauugacuauuauaga

SEQ ID NO: 2751446 - RNA, 13 nt, Human
acuuauuggaaug

SEQ ID NO: 2751447 - RNA, 18 nt, Human
acuuauuggaauguugag

SEQ ID NO: 2751448 - RNA, 23 nt, Human
acuuauuguagcauccuggaaua

SEQ ID NO: 2751449 - RNA, 21 nt, Human
acuuauuuauauaaauuuuuu

SEQ ID NO: 2751450 - RNA, 19 nt, Human
acuuauuuguacauuuuuu

SEQ ID NO: 2751451 - RNA, 13 nt, Human
acuucacuuuuuu

SEQ ID NO: 2751452 - RNA, 16 nt, Human
acuucagacauagaau

SEQ ID NO: 2751453 - RNA, 13 nt, Human
acuucagccuccc

SEQ ID NO: 2751454 - RNA, 16 nt, Human
acuucagccucccaag

SEQ ID NO: 2751455 - RNA, 22 nt, Human
acuucauuuaaaauauuuuuau

SEQ ID NO: 2751456 - RNA, 22 nt, Human
acuuccagauccuggaaaucag

SEQ ID NO: 2751457 - RNA, 21 nt, Human
acuuccagggcuacgcgcgcu

SEQ ID NO: 2751458 - RNA, 19 nt, Human
acuucccgcuguuccucgc

SEQ ID NO: 2751459 - RNA, 14 nt, Human
acuuccucagcugu

SEQ ID NO: 2751460 - RNA, 17 nt, Human
acuuccucccggccgcg

SEQ ID NO: 2751461 - RNA, 20 nt, Human
acuucguguccgacucuucu

SEQ ID NO: 2751462 - RNA, 13 nt, Human
acuucuauuuuua

SEQ ID NO: 2751463 - RNA, 21 nt, Human
acuucugccagcauaauacuu

SEQ ID NO: 2751464 - RNA, 15 nt, Human
acuucuuaggguuau

SEQ ID NO: 2751465 - RNA, 19 nt, Human
acuugaaaauuaacaugaa

SEQ ID NO: 2751466 - RNA, 17 nt, Human
acuugaccuccuaacaa

SEQ ID NO: 2751467 - RNA, 18 nt, Human
acuugccaaauuuagauu

SEQ ID NO: 2751468 - RNA, 11 nt, Human
acuugccauaa

SEQ ID NO: 2751469 - RNA, 14 nt, Human
acuugccauaaaac

SEQ ID NO: 2751470 - RNA, 18 nt, Human
acuugccauaaaacuuag

SEQ ID NO: 2751471 - RNA, 16 nt, Human
acuugccucugcacac

SEQ ID NO: 2751472 - RNA, 22 nt, Human
acuugcucuugaugccuggcgg

SEQ ID NO: 2751473 - RNA, 21 nt, Human
acuugcugcaguaugaaaaua

SEQ ID NO: 2751474 - RNA, 12 nt, Human
acuugcuuuuaa

SEQ ID NO: 2751475 - RNA, 16 nt, Human
acuugcuuuuaaaauc

SEQ ID NO: 2751476 - RNA, 13 nt, Human
acuuggcugcaua

SEQ ID NO: 2751477 - RNA, 18 nt, Human
acuuggcugcauaaaugu

SEQ ID NO: 2751478 - RNA, 16 nt, Human
acuugggucuucccug

SEQ ID NO: 2751479 - RNA, 14 nt, Human
acuuggucugugag

SEQ ID NO: 2751480 - RNA, 17 nt, Human
acuuggucugugagaug

SEQ ID NO: 2751481 - RNA, 19 nt, Human
acuuggucugugagaugcu

SEQ ID NO: 2751482 - RNA, 20 nt, Human
acuuguaaaggaauuuaaaa

SEQ ID NO: 2751483 - RNA, 22 nt, Human
acuuguaaaggaauuuaaaaau

SEQ ID NO: 2751484 - RNA, 17 nt, Human
acuuguauuuuuuuucu

SEQ ID NO: 2751485 - RNA, 15 nt, Human
acuugucaauaaaau

SEQ ID NO: 2751486 - RNA, 15 nt, Human
acuugugcaguguug

SEQ ID NO: 2751487 - RNA, 15 nt, Human
acuuguggacuaaaa

SEQ ID NO: 2751488 - RNA, 21 nt, Human
acuuguggacuaaaagauaua

SEQ ID NO: 2751489 - RNA, 23 nt, Human
acuuguguuuugcaagccagauu

SEQ ID NO: 2751490 - RNA, 13 nt, Human
acuuguuucagag

SEQ ID NO: 2751491 - RNA, 19 nt, Human
acuuguuucagaguuugua

SEQ ID NO: 2751492 - RNA, 16 nt, Human
acuuguuuuauuuaac

SEQ ID NO: 2751493 - RNA, 16 nt, Human
acuuuaacacaguguc

SEQ ID NO: 2751494 - RNA, 22 nt, Human
acuuuaauaaauguauauugua

SEQ ID NO: 2751495 - RNA, 23 nt, Human
acuuuacacaauagaauuauaac

SEQ ID NO: 2751496 - RNA, 15 nt, Human
acuuuauaaaggauu

SEQ ID NO: 2751497 - RNA, 17 nt, Human
acuuuauauuauuuuga

SEQ ID NO: 2751498 - RNA, 18 nt, Human
acuuuaugcuaagugaaa

SEQ ID NO: 2751499 - RNA, 20 nt, Human
acuuuauuuucuauaauuua

SEQ ID NO: 2751500 - RNA, 23 nt, Human
acuuuccaauaaagaguuccuuc

SEQ ID NO: 2751501 - RNA, 21 nt, Human
acuuuccccuugguucucaua

SEQ ID NO: 2751502 - RNA, 15 nt, Human
acuuucuuaaaacau

SEQ ID NO: 2751503 - RNA, 22 nt, Human
acuuugacaaccaugagaccac

SEQ ID NO: 2751504 - RNA, 15 nt, Human
acuuugauuuuauau

SEQ ID NO: 2751505 - RNA, 22 nt, Human
acuuugauuuuauaugcuauuu

SEQ ID NO: 2751506 - RNA, 15 nt, Human
acuuuggcaaaugag

SEQ ID NO: 2751507 - RNA, 16 nt, Human
acuuuggcaaaugagc

SEQ ID NO: 2751508 - RNA, 23 nt, Human
acuuugugaaaaaaaauuuuaua

SEQ ID NO: 2751509 - RNA, 14 nt, Human
acuuuuauaagaaa

SEQ ID NO: 2751510 - RNA, 16 nt, Human
acuuuuauaagaaaua

SEQ ID NO: 2751511 - RNA, 19 nt, Human
acuuuuauaagaaauagga

SEQ ID NO: 2751512 - RNA, 17 nt, Human
acuuuucuccucucagu

SEQ ID NO: 2751513 - RNA, 20 nt, Human
acuuuuggcauuuuacugua

SEQ ID NO: 2751514 - RNA, 18 nt, Human
acuuuuguguaaugaaaa

SEQ ID NO: 2751515 - RNA, 22 nt, Human
acuuuuuaaaaucucaaacuuc

SEQ ID NO: 2751516 - RNA, 22 nt, Human
agacccacuggacucaccuccc

SEQ ID NO: 2751517 - RNA, 22 nt, Human
agacccugucucaauaaauaaa

SEQ ID NO: 2751518 - RNA, 14 nt, Human
agaccuaaaauaaa

SEQ ID NO: 2751519 - RNA, 19 nt, Human
agaccuaaaauaaaaugaa

SEQ ID NO: 2751520 - RNA, 12 nt, Human
agaccucagccu

SEQ ID NO: 2751521 - RNA, 19 nt, Human
agaccuguaaucauauaau

SEQ ID NO: 2751522 - RNA, 14 nt, Human
agaccuuccagaaa

SEQ ID NO: 2751523 - RNA, 15 nt, Human
agacgaaacauuugu

SEQ ID NO: 2751524 - RNA, 17 nt, Human
agacgggguuugccaug

SEQ ID NO: 2751525 - RNA, 16 nt, Human
agacggguuucaccau

SEQ ID NO: 2751526 - RNA, 14 nt, Human
agacuaugaaguuu

SEQ ID NO: 2751527 - RNA, 19 nt, Human
agacucacugugggaagga

SEQ ID NO: 2751528 - RNA, 14 nt, Human
agacucagggcccc

SEQ ID NO: 2751529 - RNA, 16 nt, Human
agacucagggccccag

SEQ ID NO: 2751530 - RNA, 14 nt, Human
agacuccaaagaaa

SEQ ID NO: 2751531 - RNA, 17 nt, Human
agacuccaaagaaaugu

SEQ ID NO: 2751532 - RNA, 19 nt, Human
agacuccaaagaaauguaa

SEQ ID NO: 2751533 - RNA, 22 nt, Human
agacucgggauuaguacacacu

SEQ ID NO: 2751534 - RNA, 22 nt, Human
agacucuacccauauuacagau

SEQ ID NO: 2751535 - RNA, 20 nt, Human
agacucuaggacauaaauua

SEQ ID NO: 2751536 - RNA, 12 nt, Human
agacucugucua

SEQ ID NO: 2751537 - RNA, 15 nt, Human
agacucugucuaccu

SEQ ID NO: 2751538 - RNA, 17 nt, Human
agacucugucuaccugg

SEQ ID NO: 2751539 - RNA, 22 nt, Human
agacucugucucaaaaaauaaa

SEQ ID NO: 2751540 - RNA, 18 nt, Human
agacugcauuauauuuau

SEQ ID NO: 2751541 - RNA, 23 nt, Human
agacuggauaguccgucucugcu

SEQ ID NO: 2751542 - RNA, 21 nt, Human
agacuggcacaguuuucugag

SEQ ID NO: 2751543 - RNA, 19 nt, Human
agacuuuauguaguuuuua

SEQ ID NO: 2751544 - RNA, 18 nt, Human
agacuuugugaaaaaaaa

SEQ ID NO: 2751545 - RNA, 13 nt, Human
agagaaacaaugg

SEQ ID NO: 2751546 - RNA, 10 nt, Human
agagaaguuc

SEQ ID NO: 2751547 - RNA, 14 nt, Human
agagaauuuccuua

SEQ ID NO: 2751548 - RNA, 20 nt, Human
agagacacacugaagaagca

SEQ ID NO: 2751549 - RNA, 14 nt, Human
agagacagaaagca

SEQ ID NO: 2751550 - RNA, 23 nt, Human
agagacagcuugaucaaaggcac

SEQ ID NO: 2751551 - RNA, 11 nt, Human
agagacggggu

SEQ ID NO: 2751552 - RNA, 19 nt, Human
agagacgggguuugccaug

SEQ ID NO: 2751553 - RNA, 14 nt, Human
agagacucaaagag

SEQ ID NO: 2751554 - RNA, 17 nt, Human
agagacucagggcccca

SEQ ID NO: 2751555 - RNA, 16 nt, Human
agagagcuggaggcac

SEQ ID NO: 2751556 - RNA, 22 nt, Human
agagaguggcuggggcauggaa

SEQ ID NO: 2751557 - RNA, 13 nt, Human
agagauaaagcuu

SEQ ID NO: 2751558 - RNA, 20 nt, Human
agagaucucuguagaaggag

SEQ ID NO: 2751559 - RNA, 14 nt, Human
agagaugacaggga

SEQ ID NO: 2751560 - RNA, 20 nt, Human
agagaugacagggaaaacug

SEQ ID NO: 2751561 - RNA, 21 nt, Human
agagauuuuuaaauaaagaau

SEQ ID NO: 2751562 - RNA, 21 nt, Human
agagcaagaccccaucucaaa

SEQ ID NO: 2751563 - RNA, 23 nt, Human
agagcaagacucugucucaaaaa

SEQ ID NO: 2751564 - RNA, 16 nt, Human
agagcaggugcuggcu

SEQ ID NO: 2751565 - RNA, 14 nt, Human
agagcaguagcagc

SEQ ID NO: 2751566 - RNA, 15 nt, Human
agagcaguguuucgu

SEQ ID NO: 2751567 - RNA, 14 nt, Human
agagccaaucagua

SEQ ID NO: 2751568 - RNA, 21 nt, Human
agagccacaguauauuucccu

SEQ ID NO: 2751569 - RNA, 19 nt, Human
agagccggagccuccagcu

SEQ ID NO: 2751570 - RNA, 21 nt, Human
agagccggagccuccagcugc

SEQ ID NO: 2751571 - RNA, 22 nt, Human
agagccggagccuccagcugcc

SEQ ID NO: 2751572 - RNA, 15 nt, Human
agagccuccuuucug

SEQ ID NO: 2751573 - RNA, 16 nt, Human
agagccucgaggaggu

SEQ ID NO: 2751574 - RNA, 17 nt, Human
agagccugagugacaga

SEQ ID NO: 2751575 - RNA, 19 nt, Human
agagccuuuuuuugaaaaa

SEQ ID NO: 2751576 - RNA, 21 nt, Human
agagccuuuuuuugaaaaaaa

SEQ ID NO: 2751577 - RNA, 21 nt, Human
agagcuacaggccccaucugg

SEQ ID NO: 2751578 - RNA, 16 nt, Human
agagcuacccgcagag

SEQ ID NO: 2751579 - RNA, 17 nt, Human
agagcugcccucuccug

SEQ ID NO: 2751580 - RNA, 14 nt, Human
agagcuuaagaacc

SEQ ID NO: 2751581 - RNA, 15 nt, Human
agaggaagcagccaa

SEQ ID NO: 2751582 - RNA, 15 nt, Human
agaggaaugaaguac

SEQ ID NO: 2751583 - RNA, 20 nt, Human
agaggagaaacuggaacucu

SEQ ID NO: 2751584 - RNA, 22 nt, Human
agaggauguguggcauuuucac

SEQ ID NO: 2751585 - RNA, 17 nt, Human
agaggcaaagaaaggag

SEQ ID NO: 2751586 - RNA, 15 nt, Human
agaggcagugacagc

SEQ ID NO: 2751587 - RNA, 22 nt, Human
agaggccugacugccaagccau

SEQ ID NO: 2751588 - RNA, 14 nt, Human
agaggcucuaaugu

SEQ ID NO: 2751589 - RNA, 18 nt, Human
agaggcucuaauguacaa

SEQ ID NO: 2751590 - RNA, 21 nt, Human
agaggcucuaauguacaauaa

SEQ ID NO: 2751591 - RNA, 22 nt, Human
agaggcucuaauguacaauaaa

SEQ ID NO: 2751592 - RNA, 19 nt, Human
agaggcuuccuucauuucc

SEQ ID NO: 2751593 - RNA, 16 nt, Human
agagggaauugcagag

SEQ ID NO: 2751594 - RNA, 19 nt, Human
agagggauuagggagagaa

SEQ ID NO: 2751595 - RNA, 15 nt, Human
agaggggcagaacag

SEQ ID NO: 2751596 - RNA, 13 nt, Human
agagguccacaac

SEQ ID NO: 2751597 - RNA, 16 nt, Human
agagguccacaacaca

SEQ ID NO: 2751598 - RNA, 19 nt, Human
agagguggccaagccaacc

SEQ ID NO: 2751599 - RNA, 17 nt, Human
agagguguuuuuucuaa

SEQ ID NO: 2751600 - RNA, 19 nt, Human
agaguacaccccaacagca

SEQ ID NO: 2751601 - RNA, 20 nt, Human
agaguacaccccaacagcac

SEQ ID NO: 2751602 - RNA, 13 nt, Human
agaguacuggcug

SEQ ID NO: 2751603 - RNA, 14 nt, Human
agaguacuggcuga

SEQ ID NO: 2751604 - RNA, 15 nt, Human
agagucacucacauc

SEQ ID NO: 2751605 - RNA, 18 nt, Human
agagucuuccucugucuc

SEQ ID NO: 2751606 - RNA, 20 nt, Human
agagugaagggaagagacag

SEQ ID NO: 2751607 - RNA, 15 nt, Human
agagugugaggaaaa

SEQ ID NO: 2751608 - RNA, 16 nt, Human
agaguuccuucugcuc

SEQ ID NO: 2751609 - RNA, 19 nt, Human
agaguuggugacacagcug

SEQ ID NO: 2751610 - RNA, 22 nt, Human
agaguuuaauuuuugaaaacug

SEQ ID NO: 2751611 - RNA, 19 nt, Human
agaguuuagcuggaaaagu

SEQ ID NO: 2751612 - RNA, 21 nt, Human
agaguuuccuauguuucacug

SEQ ID NO: 2751613 - RNA, 16 nt, Human
agauaaggcuguucuu

SEQ ID NO: 2751614 - RNA, 20 nt, Human
agauaaugugauauuauaca

SEQ ID NO: 2751615 - RNA, 16 nt, Human
agauaauuauaauaua

SEQ ID NO: 2751616 - RNA, 21 nt, Human
agauacugaauguaaacaaag

SEQ ID NO: 2751617 - RNA, 16 nt, Human
agauaggccaugggca

SEQ ID NO: 2751618 - RNA, 23 nt, Human
agauagguacuauuauccccauu

SEQ ID NO: 2751619 - RNA, 14 nt, Human
agauauaaaagacu

SEQ ID NO: 2751620 - RNA, 22 nt, Human
agauaucucaucucuucuuuua

SEQ ID NO: 2751621 - RNA, 19 nt, Human
agauaugauucaaaugucu

SEQ ID NO: 2751622 - RNA, 19 nt, Human
agauaugggacauuuuuga

SEQ ID NO: 2751623 - RNA, 18 nt, Human
agauauuaacugagaagg

SEQ ID NO: 2751624 - RNA, 16 nt, Human
agauauuuuucaugau

SEQ ID NO: 2751625 - RNA, 22 nt, Human
agauauuuuucaugauuuugaa

SEQ ID NO: 2751626 - RNA, 12 nt, Human
agaucaagccug

SEQ ID NO: 2751627 - RNA, 18 nt, Human
agaucaagccugccucaa

SEQ ID NO: 2751628 - RNA, 17 nt, Human
agaucacagcuucagcc

SEQ ID NO: 2751629 - RNA, 19 nt, Human
agaucacuugagcucagga

SEQ ID NO: 2751630 - RNA, 21 nt, Human
agaucacuugagcucaggagg

SEQ ID NO: 2751631 - RNA, 14 nt, Human
agaucauugugaaa

SEQ ID NO: 2751632 - RNA, 18 nt, Human
agaucauugugaaauuau

SEQ ID NO: 2751633 - RNA, 23 nt, Human
agaucauugugaaauuauucaua

SEQ ID NO: 2751634 - RNA, 17 nt, Human
agauccccaagccuggc

SEQ ID NO: 2751635 - RNA, 18 nt, Human
agauccccaagccuggca

SEQ ID NO: 2751636 - RNA, 14 nt, Human
agauccuggaaauc

SEQ ID NO: 2751637 - RNA, 16 nt, Human
agauccuggaaaucag

SEQ ID NO: 2751638 - RNA, 18 nt, Human
agaucuuuuauuuugcca

SEQ ID NO: 2751639 - RNA, 20 nt, Human
agaugacagggaaaacugca

SEQ ID NO: 2751640 - RNA, 16 nt, Human
agaugagagaacaggg

SEQ ID NO: 2751641 - RNA, 17 nt, Human
agaugcaguucugaaga

SEQ ID NO: 2751642 - RNA, 18 nt, Human
agaugcaguucugaagaa

SEQ ID NO: 2751643 - RNA, 20 nt, Human
agaugcaguucugaagaaga

SEQ ID NO: 2751644 - RNA, 14 nt, Human
agaugcuagaacuc

SEQ ID NO: 2751645 - RNA, 16 nt, Human
agaugcuagaacuccc

SEQ ID NO: 2751646 - RNA, 17 nt, Human
agaugcuagaacucccu

SEQ ID NO: 2751647 - RNA, 18 nt, Human
agaugcuagaacucccuu

SEQ ID NO: 2751648 - RNA, 23 nt, Human
agaugcuagaacucccuuucaac

SEQ ID NO: 2751649 - RNA, 23 nt, Human
agaugggagugcccccaacagca

SEQ ID NO: 2751650 - RNA, 15 nt, Human
agaugggcauggugg

SEQ ID NO: 2751651 - RNA, 17 nt, Human
agaugggguuucaccau

SEQ ID NO: 2751652 - RNA, 22 nt, Human
agaugguaccaccagucugacu

SEQ ID NO: 2751653 - RNA, 14 nt, Human
agauguaaaagacu

SEQ ID NO: 2751654 - RNA, 17 nt, Human
agauuacuuuuucuuua

SEQ ID NO: 2751655 - RNA, 18 nt, Human
agauuaugaucucagaaa

SEQ ID NO: 2751656 - RNA, 16 nt, Human
agauucagacuguuuu

SEQ ID NO: 2751657 - RNA, 17 nt, Human
agauucaugcacuguag

SEQ ID NO: 2751658 - RNA, 16 nt, Human
agauugugccccugca

SEQ ID NO: 2751659 - RNA, 23 nt, Human
agauugugccccugcacuccagc

SEQ ID NO: 2751660 - RNA, 19 nt, Human
agccuccagcugccccggg

SEQ ID NO: 2751661 - RNA, 10 nt, Human
agccucccaa

SEQ ID NO: 2751662 - RNA, 16 nt, Human
agccucugcaggaugu

SEQ ID NO: 2751663 - RNA, 17 nt, Human
agccucuuagaugcagu

SEQ ID NO: 2751664 - RNA, 18 nt, Human
agccucuuagaugcaguu

SEQ ID NO: 2751665 - RNA, 11 nt, Human
agccugaccac

SEQ ID NO: 2751666 - RNA, 15 nt, Human
agccugaguagaaag

SEQ ID NO: 2751667 - RNA, 16 nt, Human
agccugaucaccugcc

SEQ ID NO: 2751668 - RNA, 18 nt, Human
agccugaucaccugcccu

SEQ ID NO: 2751669 - RNA, 19 nt, Human
agccugaucaccugcccug

SEQ ID NO: 2751670 - RNA, 21 nt, Human
agccugaucaccugcccugcu

SEQ ID NO: 2751671 - RNA, 22 nt, Human
agccugccucaaucaguauuca

SEQ ID NO: 2751672 - RNA, 11 nt, Human
agccugccuuu

SEQ ID NO: 2751673 - RNA, 14 nt, Human
agccugccuuucuc

SEQ ID NO: 2751674 - RNA, 20 nt, Human
agccugcucccuagccagag

SEQ ID NO: 2751675 - RNA, 21 nt, Human
agccugcucccuagccagagg

SEQ ID NO: 2751676 - RNA, 14 nt, Human
agccuggcaaggga

SEQ ID NO: 2751677 - RNA, 22 nt, Human
agccuggcaaggguucaccugg

SEQ ID NO: 2751678 - RNA, 21 nt, Human
agccuggguguaaaaccugga

SEQ ID NO: 2751679 - RNA, 19 nt, Human
agccuggucaacaugguga

SEQ ID NO: 2751680 - RNA, 16 nt, Human
agccuggugggccucc

SEQ ID NO: 2751681 - RNA, 18 nt, Human
agccuggugggccuccuc

SEQ ID NO: 2751682 - RNA, 16 nt, Human
agccugugcugcccgu

SEQ ID NO: 2751683 - RNA, 15 nt, Human
agccuguuuaagaga

SEQ ID NO: 2751684 - RNA, 13 nt, Human
agccuuccccuug

SEQ ID NO: 2751685 - RNA, 23 nt, Human
agccuuccccuugcccagggcuc

SEQ ID NO: 2751686 - RNA, 13 nt, Human
agccuucucuguu

SEQ ID NO: 2751687 - RNA, 17 nt, Human
agccuuggauacuccau

SEQ ID NO: 2751688 - RNA, 17 nt, Human
agccuugggaccccuga

SEQ ID NO: 2751689 - RNA, 23 nt, Human
agccuugggaccccugagcuugc

SEQ ID NO: 2751690 - RNA, 20 nt, Human
agccuuggggcugaugcagu

SEQ ID NO: 2751691 - RNA, 21 nt, Human
agccuuggggcugaugcaguu

SEQ ID NO: 2751692 - RNA, 13 nt, Human
agcgacagugaga

SEQ ID NO: 2751693 - RNA, 15 nt, Human
agcgagggacaccga

SEQ ID NO: 2751694 - RNA, 21 nt, Human
agcgagugggggccagccacg

SEQ ID NO: 2751695 - RNA, 17 nt, Human
agcgauucuccugccuc

SEQ ID NO: 2751696 - RNA, 20 nt, Human
agcgauucuccugccucagc

SEQ ID NO: 2751697 - RNA, 23 nt, Human
agcgauucuccugccucagccuc

SEQ ID NO: 2751698 - RNA, 14 nt, Human
agcgcagccaugug

SEQ ID NO: 2751699 - RNA, 14 nt, Human
agcgcgcgcgcccu

SEQ ID NO: 2751700 - RNA, 14 nt, Human
agcggaccuuccca

SEQ ID NO: 2751701 - RNA, 16 nt, Human
agcggcaucaggcuuu

SEQ ID NO: 2751702 - RNA, 14 nt, Human
agcguugagccacc

SEQ ID NO: 2751703 - RNA, 19 nt, Human
agcguugagccaccaagcu

SEQ ID NO: 2751704 - RNA, 13 nt, Human
agcuaaauauaua

SEQ ID NO: 2751705 - RNA, 16 nt, Human
agcuaaauauauauuu

SEQ ID NO: 2751706 - RNA, 22 nt, Human
agcuaaaucccuccccgugacu

SEQ ID NO: 2751707 - RNA, 21 nt, Human
agcuaaguugcaccaacuuug

SEQ ID NO: 2751708 - RNA, 22 nt, Human
agcuaaugaaguguuuagcaua

SEQ ID NO: 2751709 - RNA, 15 nt, Human
agcuaauuuuuguau

SEQ ID NO: 2751710 - RNA, 16 nt, Human
agcuacaggccccauc

SEQ ID NO: 2751711 - RNA, 19 nt, Human
agcuaccugcucagcccug

SEQ ID NO: 2751712 - RNA, 21 nt, Human
agcuaccugcucagcccugca

SEQ ID NO: 2751713 - RNA, 14 nt, Human
agcuacuaauuuua

SEQ ID NO: 2751714 - RNA, 17 nt, Human
agcuacuaauuuuaaaa

SEQ ID NO: 2751715 - RNA, 12 nt, Human
agcuacuuggga

SEQ ID NO: 2751716 - RNA, 19 nt, Human
agcuacuugggaggcugag

SEQ ID NO: 2751717 - RNA, 22 nt, Human
agcuacuugggaggcugaggca

SEQ ID NO: 2751718 - RNA, 18 nt, Human
agcuagaauucacuccac

SEQ ID NO: 2751719 - RNA, 17 nt, Human
agcuaggaauuguguuu

SEQ ID NO: 2751720 - RNA, 13 nt, Human
agcuauaaaauga

SEQ ID NO: 2751721 - RNA, 20 nt, Human
agcucacagaccuuugaacu

SEQ ID NO: 2751722 - RNA, 15 nt, Human
agcucacaggagcuu

SEQ ID NO: 2751723 - RNA, 15 nt, Human
agcucacugcaaccu

SEQ ID NO: 2751724 - RNA, 22 nt, Human
agcucacugcaaccuccaccuc

SEQ ID NO: 2751725 - RNA, 20 nt, Human
agcucagaaguuucuucuuu

SEQ ID NO: 2751726 - RNA, 20 nt, Human
agcucaggaggucaagauca

SEQ ID NO: 2751727 - RNA, 22 nt, Human
agcucaggaugagggaaaagaa

SEQ ID NO: 2751728 - RNA, 15 nt, Human
agcucaggcacacuu

SEQ ID NO: 2751729 - RNA, 16 nt, Human
agcucaggcacacuuc

SEQ ID NO: 2751730 - RNA, 16 nt, Human
agcucaggcuggcacc

SEQ ID NO: 2751731 - RNA, 12 nt, Human
agcucagggcuc

SEQ ID NO: 2751732 - RNA, 16 nt, Human
agcucagggcucuuuc

SEQ ID NO: 2751733 - RNA, 16 nt, Human
agcucagggggguggu

SEQ ID NO: 2751734 - RNA, 14 nt, Human
agcucauaaaugaa

SEQ ID NO: 2751735 - RNA, 17 nt, Human
agcucaucuauuucuuu

SEQ ID NO: 2751736 - RNA, 13 nt, Human
agcuccagcugcu

SEQ ID NO: 2751737 - RNA, 21 nt, Human
agcuccagcugcucugucuuc

SEQ ID NO: 2751738 - RNA, 13 nt, Human
agcuccagguaga

SEQ ID NO: 2751739 - RNA, 17 nt, Human
agcucccaggaggggcu

SEQ ID NO: 2751740 - RNA, 20 nt, Human
agcuccuccuuuuuccuucc

SEQ ID NO: 2751741 - RNA, 21 nt, Human
agcuccuccuuuuuccuucca

SEQ ID NO: 2751742 - RNA, 16 nt, Human
agcucgguggacccag

SEQ ID NO: 2751743 - RNA, 20 nt, Human
agcucgguggacccagggau

SEQ ID NO: 2751744 - RNA, 21 nt, Human
agcucgguggacccagggaug

SEQ ID NO: 2751745 - RNA, 13 nt, Human
agcucguggaaca

SEQ ID NO: 2751746 - RNA, 14 nt, Human
agcucguggaacag

SEQ ID NO: 2751747 - RNA, 16 nt, Human
agcucguggaacaguu

SEQ ID NO: 2751748 - RNA, 14 nt, Human
agcucgugggacag

SEQ ID NO: 2751749 - RNA, 18 nt, Human
agcucgugggacagucac

SEQ ID NO: 2751750 - RNA, 20 nt, Human
agcucuaaaugucaaucagc

SEQ ID NO: 2751751 - RNA, 18 nt, Human
agcucuaauuauuaagau

SEQ ID NO: 2751752 - RNA, 14 nt, Human
agcucuaucaccaa

SEQ ID NO: 2751753 - RNA, 15 nt, Human
agcucuaucaccaag

SEQ ID NO: 2751754 - RNA, 12 nt, Human
agcucucagcca

SEQ ID NO: 2751755 - RNA, 19 nt, Human
agcucuccccuucucugua

SEQ ID NO: 2751756 - RNA, 23 nt, Human
agcucuccccuucucuguauucc

SEQ ID NO: 2751757 - RNA, 11 nt, Human
agcucucuuuc

SEQ ID NO: 2751758 - RNA, 15 nt, Human
agcucugaagaacuc

SEQ ID NO: 2751759 - RNA, 20 nt, Human
agcucugcauuaucugaggu

SEQ ID NO: 2751760 - RNA, 13 nt, Human
agcucugcccauc

SEQ ID NO: 2751761 - RNA, 18 nt, Human
agcucugcccauccugcc

SEQ ID NO: 2751762 - RNA, 22 nt, Human
agcucugcccauccugccccug

SEQ ID NO: 2751763 - RNA, 23 nt, Human
agcucugcccauccugccccuga

SEQ ID NO: 2751764 - RNA, 15 nt, Human
agcucuuuacuuucc

SEQ ID NO: 2751765 - RNA, 17 nt, Human
agcugacccagccccuu

SEQ ID NO: 2751766 - RNA, 19 nt, Human
agcugauaucaugccccug

SEQ ID NO: 2751767 - RNA, 14 nt, Human
agcugcauuucaga

SEQ ID NO: 2751768 - RNA, 17 nt, Human
agcugccccggggaggg

SEQ ID NO: 2751769 - RNA, 19 nt, Human
agcugccccggggaggggc

SEQ ID NO: 2751770 - RNA, 20 nt, Human
agcugccccggggaggggcg

SEQ ID NO: 2751771 - RNA, 16 nt, Human
agcugcccucuccugg

SEQ ID NO: 2751772 - RNA, 22 nt, Human
agcugcccucuccugggcagcu

SEQ ID NO: 2751773 - RNA, 13 nt, Human
agcugccuccccu

SEQ ID NO: 2751774 - RNA, 13 nt, Human
agcugccucucuc

SEQ ID NO: 2751775 - RNA, 14 nt, Human
agcugccucucuca

SEQ ID NO: 2751776 - RNA, 20 nt, Human
agcugccucucucauccacu

SEQ ID NO: 2751777 - RNA, 19 nt, Human
agcugcucaauaaaguaca

SEQ ID NO: 2751778 - RNA, 11 nt, Human
agcugcucugu

SEQ ID NO: 2751779 - RNA, 20 nt, Human
agcugcucugucuucuuugc

SEQ ID NO: 2751780 - RNA, 18 nt, Human
agcugcugaaacaacaaa

SEQ ID NO: 2751781 - RNA, 14 nt, Human
agcuggaaacacau

SEQ ID NO: 2751782 - RNA, 23 nt, Human
agcuggaaacacauguuccccuu

SEQ ID NO: 2751783 - RNA, 14 nt, Human
agcuggagggaccu

SEQ ID NO: 2751784 - RNA, 13 nt, Human
agcuggagugcag

SEQ ID NO: 2751785 - RNA, 14 nt, Human
agcuggagugcagu

SEQ ID NO: 2751786 - RNA, 19 nt, Human
agcuggagugcaguggcau

SEQ ID NO: 2751787 - RNA, 14 nt, Human
agcuggggccaggc

SEQ ID NO: 2751788 - RNA, 16 nt, Human
agcuggggccaggcug

SEQ ID NO: 2751789 - RNA, 18 nt, Human
agcuggggccaggcuggg

SEQ ID NO: 2751790 - RNA, 12 nt, Human
agcuguggccag

SEQ ID NO: 2751791 - RNA, 13 nt, Human
agcuguggccagc

SEQ ID NO: 2751792 - RNA, 22 nt, Human
agcuguguccucaugagggcug

SEQ ID NO: 2751793 - RNA, 21 nt, Human
agcuguucacagccagacugg

SEQ ID NO: 2751794 - RNA, 13 nt, Human
agcuguugagcug

SEQ ID NO: 2751795 - RNA, 21 nt, Human
agcuuaacccuggaaaaugaa

SEQ ID NO: 2751796 - RNA, 18 nt, Human
agcuuacuuaaaauugua

SEQ ID NO: 2751797 - RNA, 16 nt, Human
agcuuagaccucagcc

SEQ ID NO: 2751798 - RNA, 22 nt, Human
agcuuagauaagacacccccuc

SEQ ID NO: 2751799 - RNA, 13 nt, Human
agcuuauuaaaac

SEQ ID NO: 2751800 - RNA, 17 nt, Human
agcuuauuaaaacucau

SEQ ID NO: 2751801 - RNA, 22 nt, Human
agcuuauucacaagacccaaaa

SEQ ID NO: 2751802 - RNA, 17 nt, Human
agcuuauugucuaguga

SEQ ID NO: 2751803 - RNA, 17 nt, Human
agcuucaagaaauuacu

SEQ ID NO: 2751804 - RNA, 16 nt, Human
agcuucacuguaaaau

SEQ ID NO: 2751805 - RNA, 20 nt, Human
aggccugacugccaagccau

SEQ ID NO: 2751806 - RNA, 21 nt, Human
aggccuugccuaggcauagcc

SEQ ID NO: 2751807 - RNA, 18 nt, Human
aggcguaacuaauuuuaa

SEQ ID NO: 2751808 - RNA, 16 nt, Human
aggcuaaagcccagag

SEQ ID NO: 2751809 - RNA, 13 nt, Human
aggcuaccccuuu

SEQ ID NO: 2751810 - RNA, 23 nt, Human
aggcuaccccuuuacaaauagaa

SEQ ID NO: 2751811 - RNA, 16 nt, Human
aggcuacugucagcuc

SEQ ID NO: 2751812 - RNA, 21 nt, Human
aggcuaugauugucuuuguuc

SEQ ID NO: 2751813 - RNA, 15 nt, Human
aggcuccaaacugga

SEQ ID NO: 2751814 - RNA, 16 nt, Human
aggcuccacuuggucu

SEQ ID NO: 2751815 - RNA, 22 nt, Human
aggcuccacuuggucugugaga

SEQ ID NO: 2751816 - RNA, 22 nt, Human
aggcuccugagacacaugggug

SEQ ID NO: 2751817 - RNA, 15 nt, Human
aggcucuaauguaca

SEQ ID NO: 2751818 - RNA, 17 nt, Human
aggcucuaauguacaau

SEQ ID NO: 2751819 - RNA, 20 nt, Human
aggcucuaauguacaauaaa

SEQ ID NO: 2751820 - RNA, 23 nt, Human
aggcucuaauguacaauaaagca

SEQ ID NO: 2751821 - RNA, 21 nt, Human
aggcucuuuugggauuuuuga

SEQ ID NO: 2751822 - RNA, 15 nt, Human
aggcugagagcccaa

SEQ ID NO: 2751823 - RNA, 20 nt, Human
aggcugagaugggagaauca

SEQ ID NO: 2751824 - RNA, 22 nt, Human
aggcugagaugggagaaucacu

SEQ ID NO: 2751825 - RNA, 14 nt, Human
aggcugaggcaaga

SEQ ID NO: 2751826 - RNA, 16 nt, Human
aggcugaggcaggagg

SEQ ID NO: 2751827 - RNA, 22 nt, Human
aggcugaugggcaaaaaaccaa

SEQ ID NO: 2751828 - RNA, 18 nt, Human
aggcugcucagggcuggu

SEQ ID NO: 2751829 - RNA, 12 nt, Human
aggcuggagugc

SEQ ID NO: 2751830 - RNA, 14 nt, Human
aggcuggagugcag

SEQ ID NO: 2751831 - RNA, 15 nt, Human
aggcuggagugcagu

SEQ ID NO: 2751832 - RNA, 22 nt, Human
aggcuggagugcaguggcgcaa

SEQ ID NO: 2751833 - RNA, 15 nt, Human
aggcuggcaccgcug

SEQ ID NO: 2751834 - RNA, 18 nt, Human
aggcugggucgcccugga

SEQ ID NO: 2751835 - RNA, 17 nt, Human
aggcuguggauuuaaug

SEQ ID NO: 2751836 - RNA, 15 nt, Human
aggcuguucccacca

SEQ ID NO: 2751837 - RNA, 21 nt, Human
aggcuguucccaccaggcugc

SEQ ID NO: 2751838 - RNA, 22 nt, Human
aggcuguucccaccaggcugcu

SEQ ID NO: 2751839 - RNA, 20 nt, Human
aggcuguucuuuaaaugucu

SEQ ID NO: 2751840 - RNA, 15 nt, Human
aggcuguugucuuuu

SEQ ID NO: 2751841 - RNA, 21 nt, Human
aggcuuagacccucaugcugc

SEQ ID NO: 2751842 - RNA, 23 nt, Human
aggcuuuaaaacuuauccuccau

SEQ ID NO: 2751843 - RNA, 20 nt, Human
aggcuuucuuaaagugagag

SEQ ID NO: 2751844 - RNA, 16 nt, Human
aggcuuugcauagauu

SEQ ID NO: 2751845 - RNA, 14 nt, Human
agggaaaagaaaaa

SEQ ID NO: 2751846 - RNA, 23 nt, Human
agggaaaagaaaaagauugagag

SEQ ID NO: 2751847 - RNA, 18 nt, Human
agggaaaauucuaaccca

SEQ ID NO: 2751848 - RNA, 23 nt, Human
agggaaacugccagcaacgcagg

SEQ ID NO: 2751849 - RNA, 18 nt, Human
agggaacaaguacuucuu

SEQ ID NO: 2751850 - RNA, 15 nt, Human
agggaagacaagaag

SEQ ID NO: 2751851 - RNA, 20 nt, Human
agggaagacaagaaggaaag

SEQ ID NO: 2751852 - RNA, 13 nt, Human
agggaaggcugga

SEQ ID NO: 2751853 - RNA, 19 nt, Human
agggacaggauaagaggga

SEQ ID NO: 2751854 - RNA, 13 nt, Human
agggaccugcugu

SEQ ID NO: 2751855 - RNA, 20 nt, Human
agggacucaucauuuccauu

SEQ ID NO: 2751856 - RNA, 19 nt, Human
agggacucaucuuucccuc

SEQ ID NO: 2751857 - RNA, 15 nt, Human
agggacuugaaccca

SEQ ID NO: 2751858 - RNA, 23 nt, Human
agggagaacgggaauucagacaa

SEQ ID NO: 2751859 - RNA, 17 nt, Human
agggagagaagauagca

SEQ ID NO: 2751860 - RNA, 14 nt, Human
agggagauucagac

SEQ ID NO: 2751861 - RNA, 19 nt, Human
agggagcaaguccuucccu

SEQ ID NO: 2751862 - RNA, 22 nt, Human
agggagugcauuuaugagcucu

SEQ ID NO: 2751863 - RNA, 22 nt, Human
agggaguuguggguagugggga

SEQ ID NO: 2751864 - RNA, 17 nt, Human
agggauggcaagaugug

SEQ ID NO: 2751865 - RNA, 18 nt, Human
agggauggcaagaugugg

SEQ ID NO: 2751866 - RNA, 12 nt, Human
agggauggggcu

SEQ ID NO: 2751867 - RNA, 18 nt, Human
agggauuuucagcccuca

SEQ ID NO: 2751868 - RNA, 19 nt, Human
agggcaagagccacaguau

SEQ ID NO: 2751869 - RNA, 13 nt, Human
agggcagaugaug

SEQ ID NO: 2751870 - RNA, 20 nt, Human
agggcaguguucccuggggc

SEQ ID NO: 2751871 - RNA, 17 nt, Human
agggcauagaaguaaaa

SEQ ID NO: 2751872 - RNA, 15 nt, Human
agggcucacagaauu

SEQ ID NO: 2751873 - RNA, 13 nt, Human
agggcucagccug

SEQ ID NO: 2751874 - RNA, 22 nt, Human
agggcugccuucuggccuugua

SEQ ID NO: 2751875 - RNA, 21 nt, Human
agggcuggagucugcacggga

SEQ ID NO: 2751876 - RNA, 22 nt, Human
agggcuggucuuuuaggacccu

SEQ ID NO: 2751877 - RNA, 14 nt, Human
aggggcagcagugc

SEQ ID NO: 2751878 - RNA, 16 nt, Human
aggggccaugaaucac

SEQ ID NO: 2751879 - RNA, 13 nt, Human
aggggcgcucgcu

SEQ ID NO: 2751880 - RNA, 14 nt, Human
aggggcgcucgcuu

SEQ ID NO: 2751881 - RNA, 20 nt, Human
agggggaggcuaaagcccag

SEQ ID NO: 2751882 - RNA, 12 nt, Human
aggggguggggg

SEQ ID NO: 2751883 - RNA, 14 nt, Human
aggggugcugggac

SEQ ID NO: 2751884 - RNA, 11 nt, Human
agggguggggg

SEQ ID NO: 2751885 - RNA, 13 nt, Human
aggggugggggug

SEQ ID NO: 2751886 - RNA, 22 nt, Human
aggggugggggugccgcucucu

SEQ ID NO: 2751887 - RNA, 23 nt, Human
aggggugggggugccgcucucuc

SEQ ID NO: 2751888 - RNA, 15 nt, Human
agggguugugaagag

SEQ ID NO: 2751889 - RNA, 16 nt, Human
agggguugugaagagg

SEQ ID NO: 2751890 - RNA, 17 nt, Human
agggguugugaagaggu

SEQ ID NO: 2751891 - RNA, 17 nt, Human
aggguacacugccuucu

SEQ ID NO: 2751892 - RNA, 13 nt, Human
agggucucccucu

SEQ ID NO: 2751893 - RNA, 18 nt, Human
agggugcacacaggaugg

SEQ ID NO: 2751894 - RNA, 16 nt, Human
aggguguguaaguaga

SEQ ID NO: 2751895 - RNA, 17 nt, Human
aggguguguaaguagau

SEQ ID NO: 2751896 - RNA, 21 nt, Human
aggguuaugauuaaguaauga

SEQ ID NO: 2751897 - RNA, 17 nt, Human
aggguucaccugggcug

SEQ ID NO: 2751898 - RNA, 21 nt, Human
aggguucaccugggcugaggc

SEQ ID NO: 2751899 - RNA, 16 nt, Human
aggguugguuucccuu

SEQ ID NO: 2751900 - RNA, 21 nt, Human
agguaaaucagacuaugaagu

SEQ ID NO: 2751901 - RNA, 19 nt, Human
agguaaccucauuaucagu

SEQ ID NO: 2751902 - RNA, 13 nt, Human
agguaccagccuu

SEQ ID NO: 2751903 - RNA, 15 nt, Human
agguacugagaguga

SEQ ID NO: 2751904 - RNA, 22 nt, Human
agguacugagagugaacaaauu

SEQ ID NO: 2751905 - RNA, 16 nt, Human
agguacuucaaauccu

SEQ ID NO: 2751906 - RNA, 14 nt, Human
agguagccaucaug

SEQ ID NO: 2751907 - RNA, 15 nt, Human
agguauaccucacuu

SEQ ID NO: 2751908 - RNA, 13 nt, Human
agguauucguuau

SEQ ID NO: 2751909 - RNA, 15 nt, Human
agguauuuaauaggu

SEQ ID NO: 2751910 - RNA, 11 nt, Human
agguauuuauu

SEQ ID NO: 2751911 - RNA, 19 nt, Human
agguauuuauugagcaccu

SEQ ID NO: 2751912 - RNA, 17 nt, Human
aggucauuaaaauuaca

SEQ ID NO: 2751913 - RNA, 21 nt, Human
agguccccagaugagaagucu

SEQ ID NO: 2751914 - RNA, 19 nt, Human
aggucuaccaaaaaucuca

SEQ ID NO: 2751915 - RNA, 12 nt, Human
aggucuuucuuu

SEQ ID NO: 2751916 - RNA, 18 nt, Human
aggugacccugaugaaaa

SEQ ID NO: 2751917 - RNA, 18 nt, Human
aggugacuauuauauuuc

SEQ ID NO: 2751918 - RNA, 19 nt, Human
aggugaucuggcucuggac

SEQ ID NO: 2751919 - RNA, 23 nt, Human
aggugaucuggcucuggacaggc

SEQ ID NO: 2751920 - RNA, 14 nt, Human
aggugcuacaaaaa

SEQ ID NO: 2751921 - RNA, 19 nt, Human
aggugcuacaaaaacacag

SEQ ID NO: 2751922 - RNA, 21 nt, Human
aggugcuacaaaaacacagca

SEQ ID NO: 2751923 - RNA, 20 nt, Human
aggugcuuuaaccucacaua

SEQ ID NO: 2751924 - RNA, 14 nt, Human
agguggaaauaaac

SEQ ID NO: 2751925 - RNA, 20 nt, Human
aggugggcagaucacuugag

SEQ ID NO: 2751926 - RNA, 18 nt, Human
aggugugagccaccacau

SEQ ID NO: 2751927 - RNA, 14 nt, Human
agguuaucuuggaa

SEQ ID NO: 2751928 - RNA, 16 nt, Human
agguuauuuucaguua

SEQ ID NO: 2751929 - RNA, 22 nt, Human
agguucaagugcuucuccagcc

SEQ ID NO: 2751930 - RNA, 17 nt, Human
agguucugacucuuggc

SEQ ID NO: 2751931 - RNA, 14 nt, Human
agguugcagugagc

SEQ ID NO: 2751932 - RNA, 17 nt, Human
agguuggagugcagugg

SEQ ID NO: 2751933 - RNA, 18 nt, Human
agguuuaauaauuuuuaa

SEQ ID NO: 2751934 - RNA, 12 nt, Human
agguuucugagu

SEQ ID NO: 2751935 - RNA, 18 nt, Human
agguuuuaauaauuuuuu

SEQ ID NO: 2751936 - RNA, 17 nt, Human
aguaaaaggaaaugcuc

SEQ ID NO: 2751937 - RNA, 13 nt, Human
aguaaagaacauc

SEQ ID NO: 2751938 - RNA, 16 nt, Human
aguaaagaacaucccu

SEQ ID NO: 2751939 - RNA, 23 nt, Human
aguaaagaauuauuuugugaugc

SEQ ID NO: 2751940 - RNA, 16 nt, Human
aguaaaggcaaacuua

SEQ ID NO: 2751941 - RNA, 15 nt, Human
aguaaauguuguuuu

SEQ ID NO: 2751942 - RNA, 16 nt, Human
aguaacggaacaguau

SEQ ID NO: 2751943 - RNA, 16 nt, Human
aguaagagauuccuga

SEQ ID NO: 2751944 - RNA, 15 nt, Human
aguaagcaccuuuag

SEQ ID NO: 2751945 - RNA, 23 nt, Human
aguaauuccguagguuauuuuca

SEQ ID NO: 2751946 - RNA, 23 nt, Human
aguaauuggaaaggcagcucuaa

SEQ ID NO: 2751947 - RNA, 23 nt, Human
aguaauuuauuguuuuuccuugu

SEQ ID NO: 2751948 - RNA, 15 nt, Human
aguacaagagcuuaa

SEQ ID NO: 2751949 - RNA, 13 nt, Human
aguuauaaaaaua

SEQ ID NO: 2751950 - RNA, 17 nt, Human
aguuauuuuuaaacugu

SEQ ID NO: 2751951 - RNA, 19 nt, Human
aguuauuuuuaaacuguaa

SEQ ID NO: 2751952 - RNA, 17 nt, Human
aguuauuuuuaauuugg

SEQ ID NO: 2751953 - RNA, 13 nt, Human
aguucagagcugc

SEQ ID NO: 2751954 - RNA, 14 nt, Human
aguucagagcugcc

SEQ ID NO: 2751955 - RNA, 17 nt, Human
aguucauauguaccaug

SEQ ID NO: 2751956 - RNA, 20 nt, Human
aguucaucuugcagcauuua

SEQ ID NO: 2751957 - RNA, 17 nt, Human
aguuccugagaccagcc

SEQ ID NO: 2751958 - RNA, 22 nt, Human
aguucuacuccauuaaauauaa

SEQ ID NO: 2751959 - RNA, 23 nt, Human
aguucuacuccauuaaauauaaa

SEQ ID NO: 2751960 - RNA, 15 nt, Human
aguucuagugaccga

SEQ ID NO: 2751961 - RNA, 23 nt, Human
aguucuauaauauaagcugccau

SEQ ID NO: 2751962 - RNA, 16 nt, Human
aguucuauaauguaaa

SEQ ID NO: 2751963 - RNA, 17 nt, Human
aguucuauaauguaaac

SEQ ID NO: 2751964 - RNA, 15 nt, Human
aguucugaagaagau

SEQ ID NO: 2751965 - RNA, 23 nt, Human
aguucugucuggacuuuccagag

SEQ ID NO: 2751966 - RNA, 17 nt, Human
aguucuucaaagauagg

SEQ ID NO: 2751967 - RNA, 14 nt, Human
aguugaaaagacuc

SEQ ID NO: 2751968 - RNA, 16 nt, Human
aguugaauuuuacaug

SEQ ID NO: 2751969 - RNA, 23 nt, Human
aguugagacaagaaaauaagagc

SEQ ID NO: 2751970 - RNA, 17 nt, Human
aguugauaaguacauga

SEQ ID NO: 2751971 - RNA, 11 nt, Human
aguugauaugc

SEQ ID NO: 2751972 - RNA, 20 nt, Human
aguugauuuaaggccaggca

SEQ ID NO: 2751973 - RNA, 15 nt, Human
aguugcaacuuugua

SEQ ID NO: 2751974 - RNA, 22 nt, Human
aguuguaccgcaaugugacuua

SEQ ID NO: 2751975 - RNA, 20 nt, Human
aguuguuucuacuacaugga

SEQ ID NO: 2751976 - RNA, 22 nt, Human
aguuuaauggugccuucauuug

SEQ ID NO: 2751977 - RNA, 13 nt, Human
aguuuaauuuuug

SEQ ID NO: 2751978 - RNA, 14 nt, Human
aguuuaauuuuuga

SEQ ID NO: 2751979 - RNA, 13 nt, Human
aguuuauauagaa

SEQ ID NO: 2751980 - RNA, 16 nt, Human
aguuuauauagaaaug

SEQ ID NO: 2751981 - RNA, 18 nt, Human
aguuuauauagaaaugua

SEQ ID NO: 2751982 - RNA, 22 nt, Human
aguuuauauagaaauguauucu

SEQ ID NO: 2751983 - RNA, 20 nt, Human
aguuuaugauuccaccuaca

SEQ ID NO: 2751984 - RNA, 15 nt, Human
aguuucccuugcaug

SEQ ID NO: 2751985 - RNA, 20 nt, Human
aguuucccuugcaugguuua

SEQ ID NO: 2751986 - RNA, 14 nt, Human
aguuuccuauguuu

SEQ ID NO: 2751987 - RNA, 15 nt, Human
aguuucuucuuuagg

SEQ ID NO: 2751988 - RNA, 17 nt, Human
aguuugguuucuagcau

SEQ ID NO: 2751989 - RNA, 14 nt, Human
aguuuguugaaaca

SEQ ID NO: 2751990 - RNA, 21 nt, Human
aguuuuauaugcuucuguuuu

SEQ ID NO: 2751991 - RNA, 19 nt, Human
aguuuuauuaauaaacauu

SEQ ID NO: 2751992 - RNA, 19 nt, Human
aguuuucauguauuuuaaa

SEQ ID NO: 2751993 - RNA, 13 nt, Human
aguuuuccuucuc

SEQ ID NO: 2751994 - RNA, 15 nt, Human
aguuuuugauagcuu

SEQ ID NO: 2751995 - RNA, 16 nt, Human
aguuuuugugaaaagc

SEQ ID NO: 2751996 - RNA, 18 nt, Human
aguuuuugugaaaagcuc

SEQ ID NO: 2751997 - RNA, 22 nt, Human
aguuuuugugaaaagcuccauu

SEQ ID NO: 2751998 - RNA, 14 nt, Human
aguuuuuuuuuaaa

SEQ ID NO: 2751999 - RNA, 20 nt, Human
aguuuuuuuuuaaaaaagaa

SEQ ID NO: 2752000 - RNA, 12 nt, Human
auaaaaacaaag

SEQ ID NO: 2752001 - RNA, 12 nt, Human
auaaaaauaaaa

SEQ ID NO: 2752002 - RNA, 12 nt, Human
auaaaaauaaau

SEQ ID NO: 2752003 - RNA, 14 nt, Human
auaaaaauaauccu

SEQ ID NO: 2752004 - RNA, 21 nt, Human
auaaaaauaauccucaguuuu

SEQ ID NO: 2752005 - RNA, 13 nt, Human
auaaaaauauaua

SEQ ID NO: 2752006 - RNA, 18 nt, Human
auaaaaauauauagcgac

SEQ ID NO: 2752007 - RNA, 15 nt, Human
auaaaacauguuccu

SEQ ID NO: 2752008 - RNA, 14 nt, Human
auaaaacuuuucca

SEQ ID NO: 2752009 - RNA, 19 nt, Human
auaaaagacaaggaaaaaa

SEQ ID NO: 2752010 - RNA, 23 nt, Human
auaaaagccuguuuaagagacag

SEQ ID NO: 2752011 - RNA, 12 nt, Human
auaaaauacaaa

SEQ ID NO: 2752012 - RNA, 19 nt, Human
auaaaauacauacuauaga

SEQ ID NO: 2752013 - RNA, 21 nt, Human
auaaaaucagccaauuauguu

SEQ ID NO: 2752014 - RNA, 19 nt, Human
auaaaauccauacauuugu

SEQ ID NO: 2752015 - RNA, 16 nt, Human
auaaaaugagcaaaag

SEQ ID NO: 2752016 - RNA, 12 nt, Human
auaaaauggguu

SEQ ID NO: 2752017 - RNA, 14 nt, Human
auaaaauuuuuaau

SEQ ID NO: 2752018 - RNA, 13 nt, Human
auaaaccauuuuu

SEQ ID NO: 2752019 - RNA, 22 nt, Human
auaaaccuuuuuggacacacaa

SEQ ID NO: 2752020 - RNA, 17 nt, Human
auaaagaauggaaagcu

SEQ ID NO: 2752021 - RNA, 14 nt, Human
auaaagaauuuuaa

SEQ ID NO: 2752022 - RNA, 16 nt, Human
auaaagcaauguggua

SEQ ID NO: 2752023 - RNA, 20 nt, Human
auaaagcuuaggucaaaguu

SEQ ID NO: 2752024 - RNA, 17 nt, Human
auaaaguacaagagcuu

SEQ ID NO: 2752025 - RNA, 17 nt, Human
auaaaguaugugcauau

SEQ ID NO: 2752026 - RNA, 23 nt, Human
auaaaguaugugcauauuuuauu

SEQ ID NO: 2752027 - RNA, 18 nt, Human
auaaaguguuugaaagcu

SEQ ID NO: 2752028 - RNA, 13 nt, Human
auaaauaaaaaua

SEQ ID NO: 2752029 - RNA, 15 nt, Human
auaaauaaaaauaau

SEQ ID NO: 2752030 - RNA, 14 nt, Human
auaaauaaauaaaa

SEQ ID NO: 2752031 - RNA, 16 nt, Human
auaaauaaauaaaaac

SEQ ID NO: 2752032 - RNA, 14 nt, Human
auaaauaaauaaau

SEQ ID NO: 2752033 - RNA, 15 nt, Human
auaaauaaauaaaua

SEQ ID NO: 2752034 - RNA, 16 nt, Human
auaaauaaauaaauaa

SEQ ID NO: 2752035 - RNA, 14 nt, Human
auaaauaccaaaaa

SEQ ID NO: 2752036 - RNA, 21 nt, Human
auaaaugugccuucauuuuuu

SEQ ID NO: 2752037 - RNA, 21 nt, Human
auaaauuagaggucuccaaaa

SEQ ID NO: 2752038 - RNA, 20 nt, Human
auaaauuauuauuuaaacau

SEQ ID NO: 2752039 - RNA, 14 nt, Human
auaaauuguauauu

SEQ ID NO: 2752040 - RNA, 20 nt, Human
auaaauuuucccaaaacuga

SEQ ID NO: 2752041 - RNA, 11 nt, Human
auaacaacaac

SEQ ID NO: 2752042 - RNA, 14 nt, Human
auaacaauaaaaga

SEQ ID NO: 2752043 - RNA, 17 nt, Human
auaacaauaaaagacaa

SEQ ID NO: 2752044 - RNA, 12 nt, Human
auaacaaugaaa

SEQ ID NO: 2752045 - RNA, 20 nt, Human
auaacaaugaaaguugauaa

SEQ ID NO: 2752046 - RNA, 18 nt, Human
auaacaaugcuguauuuu

SEQ ID NO: 2752047 - RNA, 20 nt, Human
auaacaaugcuguauuuuaa

SEQ ID NO: 2752048 - RNA, 22 nt, Human
auaacaaugcuguauuuuaaaa

SEQ ID NO: 2752049 - RNA, 20 nt, Human
auaaccaugcccaagaauga

SEQ ID NO: 2752050 - RNA, 22 nt, Human
auaaccaugcccaagaaugaga

SEQ ID NO: 2752051 - RNA, 14 nt, Human
auaaccuuaccaga

SEQ ID NO: 2752052 - RNA, 12 nt, Human
auaacgauaaaa

SEQ ID NO: 2752053 - RNA, 22 nt, Human
auaacgauaaaagacagugaaa

SEQ ID NO: 2752054 - RNA, 17 nt, Human
auaacguauaaaagccu

SEQ ID NO: 2752055 - RNA, 13 nt, Human
auaacucaucaua

SEQ ID NO: 2752056 - RNA, 15 nt, Human
auaacucaucauaaa

SEQ ID NO: 2752057 - RNA, 12 nt, Human
auaacuggaaac

SEQ ID NO: 2752058 - RNA, 13 nt, Human
auaacuggaaacu

SEQ ID NO: 2752059 - RNA, 14 nt, Human
auaacuggaaagaa

SEQ ID NO: 2752060 - RNA, 18 nt, Human
auaagaaccacucauaau

SEQ ID NO: 2752061 - RNA, 15 nt, Human
auaagacacccccuc

SEQ ID NO: 2752062 - RNA, 20 nt, Human
auaagacggauuuauuuuuc

SEQ ID NO: 2752063 - RNA, 21 nt, Human
auaagacggauuuauuuuucc

SEQ ID NO: 2752064 - RNA, 17 nt, Human
auaagagcuuaagaacc

SEQ ID NO: 2752065 - RNA, 21 nt, Human
auaagcaaagacuaugaggaa

SEQ ID NO: 2752066 - RNA, 16 nt, Human
auaagccagacaucaa

SEQ ID NO: 2752067 - RNA, 20 nt, Human
auaagccagacaucaacaga

SEQ ID NO: 2752068 - RNA, 22 nt, Human
auaagcugccauauauuuugua

SEQ ID NO: 2752069 - RNA, 23 nt, Human
auaagcuguuuuuauauauguga

SEQ ID NO: 2752070 - RNA, 22 nt, Human
auaagcuuguauuccuuuuucu

SEQ ID NO: 2752071 - RNA, 23 nt, Human
auaagcuuguauuccuuuuucuc

SEQ ID NO: 2752072 - RNA, 16 nt, Human
auaagcuuuucuuuuc

SEQ ID NO: 2752073 - RNA, 17 nt, Human
auaaguacaugauaagc

SEQ ID NO: 2752074 - RNA, 21 nt, Human
auaaguauucuguguuaaaaa

SEQ ID NO: 2752075 - RNA, 23 nt, Human
auaaguauuuaauucauguugcc

SEQ ID NO: 2752076 - RNA, 21 nt, Human
auaaguuuauuucuuaaaucu

SEQ ID NO: 2752077 - RNA, 11 nt, Human
auaauaaaauu

SEQ ID NO: 2752078 - RNA, 13 nt, Human
auaauaaauguac

SEQ ID NO: 2752079 - RNA, 19 nt, Human
auaauacaccagagauaau

SEQ ID NO: 2752080 - RNA, 19 nt, Human
auaauacuugcuuuggaaa

SEQ ID NO: 2752081 - RNA, 15 nt, Human
auaauauaaaacagg

SEQ ID NO: 2752082 - RNA, 18 nt, Human
auaauauacuauauuuau

SEQ ID NO: 2752083 - RNA, 15 nt, Human
auaauauauuuuaaa

SEQ ID NO: 2752084 - RNA, 22 nt, Human
auaauauuuuuaauauauacua

SEQ ID NO: 2752085 - RNA, 18 nt, Human
auaaucaagccuaaaauu

SEQ ID NO: 2752086 - RNA, 16 nt, Human
auaaucauuauuacuu

SEQ ID NO: 2752087 - RNA, 18 nt, Human
auaauccuaaacauauga

SEQ ID NO: 2752088 - RNA, 20 nt, Human
auaauccuaaacauaugaau

SEQ ID NO: 2752089 - RNA, 14 nt, Human
auaaucuuuuauac

SEQ ID NO: 2752090 - RNA, 16 nt, Human
auaaugguuuuuaaca

SEQ ID NO: 2752091 - RNA, 19 nt, Human
auaauguaaacaauaucag

SEQ ID NO: 2752092 - RNA, 18 nt, Human
auaaugugauauuauaca

SEQ ID NO: 2752093 - RNA, 16 nt, Human
auaauguuacauuauu

SEQ ID NO: 2752094 - RNA, 20 nt, Human
auaucauagcaaauaaguca

SEQ ID NO: 2752095 - RNA, 16 nt, Human
auauccacuaaaauca

SEQ ID NO: 2752096 - RNA, 17 nt, Human
auauccaguauuguucc

SEQ ID NO: 2752097 - RNA, 16 nt, Human
auauccugugacuguc

SEQ ID NO: 2752098 - RNA, 14 nt, Human
auaucuaauauaua

SEQ ID NO: 2752099 - RNA, 17 nt, Human
auaucuauauuuuacau

SEQ ID NO: 2752100 - RNA, 20 nt, Human
auaucuccgucaacucauau

SEQ ID NO: 2752101 - RNA, 21 nt, Human
auaucuccgucaacucauauu

SEQ ID NO: 2752102 - RNA, 17 nt, Human
auaucugcuauucucca

SEQ ID NO: 2752103 - RNA, 17 nt, Human
auaucuuaucuuccuau

SEQ ID NO: 2752104 - RNA, 16 nt, Human
auaucuucacuuguca

SEQ ID NO: 2752105 - RNA, 13 nt, Human
auaugauucaaau

SEQ ID NO: 2752106 - RNA, 16 nt, Human
auaugauucaaauguc

SEQ ID NO: 2752107 - RNA, 18 nt, Human
auaugcauagucauguaa

SEQ ID NO: 2752108 - RNA, 18 nt, Human
auaugcauuauaaauaaa

SEQ ID NO: 2752109 - RNA, 18 nt, Human
auaugcuauuuauuaagu

SEQ ID NO: 2752110 - RNA, 20 nt, Human
auaugcuauuuauuaaguau

SEQ ID NO: 2752111 - RNA, 19 nt, Human
auaugcuucuguuuuauaa

SEQ ID NO: 2752112 - RNA, 15 nt, Human
auaugcuucuuugug

SEQ ID NO: 2752113 - RNA, 14 nt, Human
auaugggacauuuu

SEQ ID NO: 2752114 - RNA, 17 nt, Human
auaugggacauuuuuga

SEQ ID NO: 2752115 - RNA, 15 nt, Human
auauguauuuauaaa

SEQ ID NO: 2752116 - RNA, 18 nt, Human
auauguauuuauaaauau

SEQ ID NO: 2752117 - RNA, 20 nt, Human
auauguauuuauaaauauau

SEQ ID NO: 2752118 - RNA, 16 nt, Human
auaugucuuucuuuuu

SEQ ID NO: 2752119 - RNA, 12 nt, Human
auaugugaaaua

SEQ ID NO: 2752120 - RNA, 16 nt, Human
auaugugaaauaaaag

SEQ ID NO: 2752121 - RNA, 21 nt, Human
auauguuagagaauuuccuua

SEQ ID NO: 2752122 - RNA, 15 nt, Human
auauguuauuauuaa

SEQ ID NO: 2752123 - RNA, 15 nt, Human
auauuaaaaauuaau

SEQ ID NO: 2752124 - RNA, 23 nt, Human
auauuagaaacagcuucucaauu

SEQ ID NO: 2752125 - RNA, 17 nt, Human
auauuaugaagcuuuua

SEQ ID NO: 2752126 - RNA, 14 nt, Human
auauuauguuaaaa

SEQ ID NO: 2752127 - RNA, 13 nt, Human
auauuauuuuaua

SEQ ID NO: 2752128 - RNA, 17 nt, Human
auauuauuuuauagcua

SEQ ID NO: 2752129 - RNA, 15 nt, Human
auauucaaaaauuau

SEQ ID NO: 2752130 - RNA, 24 nt, Human
auauucucacagcuccaagaauuu

SEQ ID NO: 2752131 - RNA, 21 nt, Human
auauucuggacuguuuuuaaa

SEQ ID NO: 2752132 - RNA, 15 nt, Human
auauugacuuuuuau

SEQ ID NO: 2752133 - RNA, 18 nt, Human
auauugauaagaucuuuu

SEQ ID NO: 2752134 - RNA, 15 nt, Human
auauugauaauaaaa

SEQ ID NO: 2752135 - RNA, 16 nt, Human
auauugauaauaaaau

SEQ ID NO: 2752136 - RNA, 20 nt, Human
auauugauaauaaaauucau

SEQ ID NO: 2752137 - RNA, 16 nt, Human
auauugauuuauuaau

SEQ ID NO: 2752138 - RNA, 19 nt, Human
auauugauuuauuaauaua

SEQ ID NO: 2752139 - RNA, 20 nt, Human
auauugucacugacacacac

SEQ ID NO: 2752140 - RNA, 21 nt, Human
auauugucacugacacacacg

SEQ ID NO: 2752141 - RNA, 15 nt, Human
auauuuaacauuauu

SEQ ID NO: 2752142 - RNA, 19 nt, Human
auauuuaacauuauuuaua

SEQ ID NO: 2752143 - RNA, 21 nt, Human
auauuuaagauaauuauaaua

SEQ ID NO: 2752144 - RNA, 13 nt, Human
auauuuacaaaug

SEQ ID NO: 2752145 - RNA, 23 nt, Human
auauuuacaugaauugcauuuua

SEQ ID NO: 2752146 - RNA, 14 nt, Human
auauuuaguaucuu

SEQ ID NO: 2752147 - RNA, 21 nt, Human
auauuuauaaaaauaaaaaac

SEQ ID NO: 2752148 - RNA, 14 nt, Human
auauuuauuuuaau

SEQ ID NO: 2752149 - RNA, 15 nt, Human
auauuucaaaugauu

SEQ ID NO: 2752150 - RNA, 16 nt, Human
auauuuccaagaaaua

SEQ ID NO: 2752151 - RNA, 23 nt, Human
auauuuccccaugguuuuaaucu

SEQ ID NO: 2752152 - RNA, 21 nt, Human
auauuuccuuauucagaauuu

SEQ ID NO: 2752153 - RNA, 22 nt, Human
auauuuccuuauucagaauuuc

SEQ ID NO: 2752154 - RNA, 11 nt, Human
auauuucuguu

SEQ ID NO: 2752155 - RNA, 18 nt, Human
auauuucuguuaaaauau

SEQ ID NO: 2752156 - RNA, 21 nt, Human
auauuucuuugccuuuauaau

SEQ ID NO: 2752157 - RNA, 14 nt, Human
auauuugaaauauu

SEQ ID NO: 2752158 - RNA, 16 nt, Human
auauuuguacaccaau

SEQ ID NO: 2752159 - RNA, 18 nt, Human
auauuuuaacuuccuugg

SEQ ID NO: 2752160 - RNA, 17 nt, Human
auauuuuacauaaauuu

SEQ ID NO: 2752161 - RNA, 22 nt, Human
auauuuuagauagaugaagaag

SEQ ID NO: 2752162 - RNA, 18 nt, Human
auauuuuuaugugcaaua

SEQ ID NO: 2752163 - RNA, 14 nt, Human
auauuuuuccauuu

SEQ ID NO: 2752164 - RNA, 17 nt, Human
auauuuuuuaugaaaca

SEQ ID NO: 2752165 - RNA, 19 nt, Human
auauuuuuuaugaaacauu

SEQ ID NO: 2752166 - RNA, 13 nt, Human
auauuuuuucuuu

SEQ ID NO: 2752167 - RNA, 14 nt, Human
auauuuuuuguuaa

SEQ ID NO: 2752168 - RNA, 15 nt, Human
auauuuuuuuuuuua

SEQ ID NO: 2752169 - RNA, 17 nt, Human
auauuuuuuuuuuuaaa

SEQ ID NO: 2752170 - RNA, 21 nt, Human
auauuuuuuuuuuuaaaaaaa

SEQ ID NO: 2752171 - RNA, 14 nt, Human
aucaaaagaaagaa

SEQ ID NO: 2752172 - RNA, 18 nt, Human
aucaaaagacuuuuuccu

SEQ ID NO: 2752173 - RNA, 20 nt, Human
aucaaaagacuuuuuccuug

SEQ ID NO: 2752174 - RNA, 16 nt, Human
aucaaacuuuacagaa

SEQ ID NO: 2752175 - RNA, 16 nt, Human
aucaaauaugcaaagc

SEQ ID NO: 2752176 - RNA, 12 nt, Human
aucaacaauagu

SEQ ID NO: 2752177 - RNA, 13 nt, Human
aucaacagauaaa

SEQ ID NO: 2752178 - RNA, 15 nt, Human
aucaaccaaauggag

SEQ ID NO: 2752179 - RNA, 15 nt, Human
aucaaccuugcuuug

SEQ ID NO: 2752180 - RNA, 18 nt, Human
aucaacuaaugauuuagu

SEQ ID NO: 2752181 - RNA, 16 nt, Human
aucaagccugccucaa

SEQ ID NO: 2752182 - RNA, 17 nt, Human
aucaaggguacacugcc

SEQ ID NO: 2752183 - RNA, 19 nt, Human
aucaaggguacacugccuu

SEQ ID NO: 2752184 - RNA, 16 nt, Human
aucaaguuauuuuuaa

SEQ ID NO: 2752185 - RNA, 16 nt, Human
aucaauacuuugaaca

SEQ ID NO: 2752186 - RNA, 17 nt, Human
aucaauaucuaauauau

SEQ ID NO: 2752187 - RNA, 17 nt, Human
aucaauccaagaacuua

SEQ ID NO: 2752188 - RNA, 15 nt, Human
aucaauuuaaaaaaa

SEQ ID NO: 2752189 - RNA, 11 nt, Human
aucaauuuuuc

SEQ ID NO: 2752190 - RNA, 15 nt, Human
aucacaaaucuuaac

SEQ ID NO: 2752191 - RNA, 15 nt, Human
aucacaauaauuuuc

SEQ ID NO: 2752192 - RNA, 17 nt, Human
aucacagcuucagccag

SEQ ID NO: 2752193 - RNA, 18 nt, Human
aucacauucagggcuauu

SEQ ID NO: 2752194 - RNA, 18 nt, Human
aucacauuccucugcccu

SEQ ID NO: 2752195 - RNA, 15 nt, Human
aucaccaaggagcca

SEQ ID NO: 2752196 - RNA, 14 nt, Human
aucaccaaggcuga

SEQ ID NO: 2752197 - RNA, 22 nt, Human
aucaccaaggcugauuaaacca

SEQ ID NO: 2752198 - RNA, 19 nt, Human
aucaccugcccugcugagu

SEQ ID NO: 2752199 - RNA, 18 nt, Human
aucacucaaauuguucuc

SEQ ID NO: 2752200 - RNA, 22 nt, Human
aucacucuguucauuccuccag

SEQ ID NO: 2752201 - RNA, 13 nt, Human
aucacugcucaca

SEQ ID NO: 2752202 - RNA, 13 nt, Human
aucacuugaaccc

SEQ ID NO: 2752203 - RNA, 16 nt, Human
aucacuugagccccgg

SEQ ID NO: 2752204 - RNA, 16 nt, Human
aucacuuuaggccugg

SEQ ID NO: 2752205 - RNA, 13 nt, Human
aucagacuaugaa

SEQ ID NO: 2752206 - RNA, 19 nt, Human
aucagagcgcacagggagu

SEQ ID NO: 2752207 - RNA, 13 nt, Human
aucagcaucccua

SEQ ID NO: 2752208 - RNA, 23 nt, Human
aucagcauuuuacuacuuuaaaa

SEQ ID NO: 2752209 - RNA, 16 nt, Human
aucagccaauuauguu

SEQ ID NO: 2752210 - RNA, 23 nt, Human
aucagccagugaccaaccuuuuc

SEQ ID NO: 2752211 - RNA, 16 nt, Human
aucagcccaaaaguca

SEQ ID NO: 2752212 - RNA, 22 nt, Human
aucagccuacaggccucacaca

SEQ ID NO: 2752213 - RNA, 21 nt, Human
aucagccuaguugaucagcuu

SEQ ID NO: 2752214 - RNA, 17 nt, Human
aucagcuccagcugcuc

SEQ ID NO: 2752215 - RNA, 20 nt, Human
aucagcuugcccuguuaaaa

SEQ ID NO: 2752216 - RNA, 22 nt, Human
aucagcuugcccuguuaaaaga

SEQ ID NO: 2752217 - RNA, 13 nt, Human
aucaggcuuucuu

SEQ ID NO: 2752218 - RNA, 14 nt, Human
aucaggcuuucuuu

SEQ ID NO: 2752219 - RNA, 20 nt, Human
aucaggguuaguauugucca

SEQ ID NO: 2752220 - RNA, 15 nt, Human
aucaguaugaaaaug

SEQ ID NO: 2752221 - RNA, 16 nt, Human
aucaguaugaaaaugu

SEQ ID NO: 2752222 - RNA, 16 nt, Human
aucagucauaacuaaa

SEQ ID NO: 2752223 - RNA, 14 nt, Human
aucaguuauuuuua

SEQ ID NO: 2752224 - RNA, 21 nt, Human
aucaguuccagccuucucuca

SEQ ID NO: 2752225 - RNA, 18 nt, Human
aucauaagauauuuuuca

SEQ ID NO: 2752226 - RNA, 22 nt, Human
aucauaagauauuuuucaugau

SEQ ID NO: 2752227 - RNA, 16 nt, Human
aucauauaauaaaugu

SEQ ID NO: 2752228 - RNA, 23 nt, Human
aucauauuguguguaauguugua

SEQ ID NO: 2752229 - RNA, 18 nt, Human
aucauauuucaaaugauu

SEQ ID NO: 2752230 - RNA, 19 nt, Human
aucaucaagucuuucacau

SEQ ID NO: 2752231 - RNA, 22 nt, Human
aucaucaagucuuucacauuua

SEQ ID NO: 2752232 - RNA, 12 nt, Human
aucaucuuaagu

SEQ ID NO: 2752233 - RNA, 19 nt, Human
aucaugaagauauuuuucc

SEQ ID NO: 2752234 - RNA, 17 nt, Human
aucaugaauuaguuuua

SEQ ID NO: 2752235 - RNA, 19 nt, Human
aucaugaauuaguuuuaua

SEQ ID NO: 2752236 - RNA, 14 nt, Human
aucaugcaucuuac

SEQ ID NO: 2752237 - RNA, 17 nt, Human
aucaugccccuguacuc

SEQ ID NO: 2752238 - RNA, 14 nt, Human
aucaugcugagaga

SEQ ID NO: 2752239 - RNA, 13 nt, Human
augaauaucaguu

SEQ ID NO: 2752240 - RNA, 20 nt, Human
augaauaucuauuaauauau

SEQ ID NO: 2752241 - RNA, 13 nt, Human
augaaugaaugaa

SEQ ID NO: 2752242 - RNA, 16 nt, Human
augaaugaauggcuaa

SEQ ID NO: 2752243 - RNA, 12 nt, Human
augaauggcuaa

SEQ ID NO: 2752244 - RNA, 12 nt, Human
augaauguaaau

SEQ ID NO: 2752245 - RNA, 23 nt, Human
augaauuaaguuuuuuuuuaaaa

SEQ ID NO: 2752246 - RNA, 19 nt, Human
augaauuacauuuguauaa

SEQ ID NO: 2752247 - RNA, 24 nt, Human
augaauuacauuuguauaaaauaa

SEQ ID NO: 2752248 - RNA, 20 nt, Human
augaauucugucauuucaaa

SEQ ID NO: 2752249 - RNA, 14 nt, Human
augaauuugugaag

SEQ ID NO: 2752250 - RNA, 21 nt, Human
augaauuugugaagguggaaa

SEQ ID NO: 2752251 - RNA, 22 nt, Human
augaauuuuuuucaucuucucu

SEQ ID NO: 2752252 - RNA, 13 nt, Human
augacauuuuguu

SEQ ID NO: 2752253 - RNA, 14 nt, Human
augaccuucaacaa

SEQ ID NO: 2752254 - RNA, 15 nt, Human
augacggaagaguug

SEQ ID NO: 2752255 - RNA, 21 nt, Human
augacgugacuggccugcugg

SEQ ID NO: 2752256 - RNA, 19 nt, Human
augacugacaaagacaucg

SEQ ID NO: 2752257 - RNA, 19 nt, Human
augacuggccacacaggau

SEQ ID NO: 2752258 - RNA, 23 nt, Human
augagaaaucuaaaaaacgaaaa

SEQ ID NO: 2752259 - RNA, 22 nt, Human
augagaccacuguuaucaaaac

SEQ ID NO: 2752260 - RNA, 19 nt, Human
augagagaacagggcugaa

SEQ ID NO: 2752261 - RNA, 21 nt, Human
augagagacacacugaagaag

SEQ ID NO: 2752262 - RNA, 12 nt, Human
augagagacagc

SEQ ID NO: 2752263 - RNA, 14 nt, Human
augagaguacaccc

SEQ ID NO: 2752264 - RNA, 17 nt, Human
augagaguacaccccaa

SEQ ID NO: 2752265 - RNA, 21 nt, Human
augagaguacaccccaacagc

SEQ ID NO: 2752266 - RNA, 22 nt, Human
augagaguacaccccaacagca

SEQ ID NO: 2752267 - RNA, 16 nt, Human
augagcacgcauggaa

SEQ ID NO: 2752268 - RNA, 22 nt, Human
augagcuggcgggauugaagga

SEQ ID NO: 2752269 - RNA, 15 nt, Human
augaggaauauuugc

SEQ ID NO: 2752270 - RNA, 21 nt, Human
augaggcauuugcagcugugc

SEQ ID NO: 2752271 - RNA, 22 nt, Human
augaggcuguugucuuuuccuu

SEQ ID NO: 2752272 - RNA, 14 nt, Human
augagggaaaagaa

SEQ ID NO: 2752273 - RNA, 15 nt, Human
augagggaaaagaaa

SEQ ID NO: 2752274 - RNA, 16 nt, Human
augagggaaaagaaaa

SEQ ID NO: 2752275 - RNA, 18 nt, Human
augagguacugagaguga

SEQ ID NO: 2752276 - RNA, 19 nt, Human
augaguaacugauuuguaa

SEQ ID NO: 2752277 - RNA, 17 nt, Human
augaguggcuuuaauga

SEQ ID NO: 2752278 - RNA, 13 nt, Human
augaguugcaguu

SEQ ID NO: 2752279 - RNA, 15 nt, Human
augauaacuggaaac

SEQ ID NO: 2752280 - RNA, 17 nt, Human
augaucauguauuuauu

SEQ ID NO: 2752281 - RNA, 14 nt, Human
augaucuuuaaaau

SEQ ID NO: 2752282 - RNA, 15 nt, Human
augaugacuauggaa

SEQ ID NO: 2752283 - RNA, 14 nt, Human
augaugauuucagc

SEQ ID NO: 2752284 - RNA, 18 nt, Human
augaugauuucagcaggg

SEQ ID NO: 2752285 - RNA, 14 nt, Human
augaugcuuugaga

SEQ ID NO: 2752286 - RNA, 15 nt, Human
augauguacauguac

SEQ ID NO: 2752287 - RNA, 18 nt, Human
augauguuuagaaacaca

SEQ ID NO: 2752288 - RNA, 17 nt, Human
augauuauuuuauguuu

SEQ ID NO: 2752289 - RNA, 13 nt, Human
augauuccaccua

SEQ ID NO: 2752290 - RNA, 15 nt, Human
augauugucuuuguu

SEQ ID NO: 2752291 - RNA, 17 nt, Human
augauuucauuucaacu

SEQ ID NO: 2752292 - RNA, 23 nt, Human
augauuuugaaaucaugaagaua

SEQ ID NO: 2752293 - RNA, 16 nt, Human
augcaaacuuuauuuu

SEQ ID NO: 2752294 - RNA, 18 nt, Human
augcaaacuuuauuuugu

SEQ ID NO: 2752295 - RNA, 18 nt, Human
augcaacauccuugucuu

SEQ ID NO: 2752296 - RNA, 14 nt, Human
augcacaacagagu

SEQ ID NO: 2752297 - RNA, 21 nt, Human
augcacuuccuugcuuaaggu

SEQ ID NO: 2752298 - RNA, 17 nt, Human
augcacuuuauauuauu

SEQ ID NO: 2752299 - RNA, 22 nt, Human
augcagagguccacaacacaca

SEQ ID NO: 2752300 - RNA, 17 nt, Human
augcagagucaaugaac

SEQ ID NO: 2752301 - RNA, 12 nt, Human
augcagccccau

SEQ ID NO: 2752302 - RNA, 16 nt, Human
augcaguucugaagaa

SEQ ID NO: 2752303 - RNA, 17 nt, Human
augcaguucugaagaag

SEQ ID NO: 2752304 - RNA, 19 nt, Human
augcaguucugaagaagau

SEQ ID NO: 2752305 - RNA, 20 nt, Human
augcaguuguugcccacagc

SEQ ID NO: 2752306 - RNA, 16 nt, Human
augcauacaguaauuu

SEQ ID NO: 2752307 - RNA, 17 nt, Human
augcauacaguaauuuu

SEQ ID NO: 2752308 - RNA, 22 nt, Human
augcauauacuuuaauaaaugu

SEQ ID NO: 2752309 - RNA, 14 nt, Human
augcauuucuaaag

SEQ ID NO: 2752310 - RNA, 19 nt, Human
augccacuaaauugacacu

SEQ ID NO: 2752311 - RNA, 18 nt, Human
augccacuagcccuccuc

SEQ ID NO: 2752312 - RNA, 19 nt, Human
augccaggccuggcaagug

SEQ ID NO: 2752313 - RNA, 20 nt, Human
augccaggccuggcaagugg

SEQ ID NO: 2752314 - RNA, 22 nt, Human
augcccaagaaugagaagaaug

SEQ ID NO: 2752315 - RNA, 17 nt, Human
augcccacggcuggagc

SEQ ID NO: 2752316 - RNA, 19 nt, Human
augcccacggcuggagcug

SEQ ID NO: 2752317 - RNA, 15 nt, Human
augcccauaccccug

SEQ ID NO: 2752318 - RNA, 17 nt, Human
augccccgucccccucu

SEQ ID NO: 2752319 - RNA, 19 nt, Human
augccuggugcuuccaaau

SEQ ID NO: 2752320 - RNA, 17 nt, Human
augcggcccaggauggc

SEQ ID NO: 2752321 - RNA, 23 nt, Human
augcuaaucagggaggucauuuu

SEQ ID NO: 2752322 - RNA, 23 nt, Human
augcuacaggauuugaaauugua

SEQ ID NO: 2752323 - RNA, 13 nt, Human
augcuagaacucc

SEQ ID NO: 2752324 - RNA, 15 nt, Human
augcuagaacucccu

SEQ ID NO: 2752325 - RNA, 19 nt, Human
augcuagaacucccuuuca

SEQ ID NO: 2752326 - RNA, 21 nt, Human
augcuagaacucccuuucaac

SEQ ID NO: 2752327 - RNA, 22 nt, Human
augcuagaacucccuuucaaca

SEQ ID NO: 2752328 - RNA, 21 nt, Human
augcucacacauuacaacagu

SEQ ID NO: 2752329 - RNA, 20 nt, Human
augcugaaaaaucauccaag

SEQ ID NO: 2752330 - RNA, 13 nt, Human
augcugagagagc

SEQ ID NO: 2752331 - RNA, 16 nt, Human
augcugagcccggaaa

SEQ ID NO: 2752332 - RNA, 23 nt, Human
augcugagcccggaaacuccaca

SEQ ID NO: 2752333 - RNA, 11 nt, Human
augcugccaau

SEQ ID NO: 2752334 - RNA, 15 nt, Human
augcuggccaggcug

SEQ ID NO: 2752335 - RNA, 16 nt, Human
augcugguuuuucagu

SEQ ID NO: 2752336 - RNA, 18 nt, Human
augcugguuuuucaguuu

SEQ ID NO: 2752337 - RNA, 15 nt, Human
augcuguauuuuaaa

SEQ ID NO: 2752338 - RNA, 22 nt, Human
augcuguauuuuaaaagaauga

SEQ ID NO: 2752339 - RNA, 21 nt, Human
augcuuaaggccaugauuuua

SEQ ID NO: 2752340 - RNA, 22 nt, Human
augcuuaaggccaugauuuuag

SEQ ID NO: 2752341 - RNA, 17 nt, Human
augcuucuguuuuauaa

SEQ ID NO: 2752342 - RNA, 13 nt, Human
augcuugaaaaga

SEQ ID NO: 2752343 - RNA, 20 nt, Human
augcuugaaaagauaaauua

SEQ ID NO: 2752344 - RNA, 15 nt, Human
auggaacucaaggaa

SEQ ID NO: 2752345 - RNA, 14 nt, Human
auggaacuugcugc

SEQ ID NO: 2752346 - RNA, 19 nt, Human
auggaacuugcugcugagu

SEQ ID NO: 2752347 - RNA, 14 nt, Human
auggaaguaaaugu

SEQ ID NO: 2752348 - RNA, 18 nt, Human
auggaaguaaauguuguu

SEQ ID NO: 2752349 - RNA, 15 nt, Human
auggaauauguaaau

SEQ ID NO: 2752350 - RNA, 11 nt, Human
auggaauuaca

SEQ ID NO: 2752351 - RNA, 19 nt, Human
auggaauuggagcucgugg

SEQ ID NO: 2752352 - RNA, 15 nt, Human
auggagaaaggaccc

SEQ ID NO: 2752353 - RNA, 15 nt, Human
auggagccagcucug

SEQ ID NO: 2752354 - RNA, 16 nt, Human
auggaggcuuugcaua

SEQ ID NO: 2752355 - RNA, 16 nt, Human
auggagguuaagcacu

SEQ ID NO: 2752356 - RNA, 15 nt, Human
auggagucacagcca

SEQ ID NO: 2752357 - RNA, 13 nt, Human
auggcaagaugug

SEQ ID NO: 2752358 - RNA, 17 nt, Human
auggcacuaguauuucu

SEQ ID NO: 2752359 - RNA, 18 nt, Human
auggcauguguuuacuuu

SEQ ID NO: 2752360 - RNA, 17 nt, Human
auggcuaguaucaaaag

SEQ ID NO: 2752361 - RNA, 23 nt, Human
auggcuaguaucaaaagaaagaa

SEQ ID NO: 2752362 - RNA, 23 nt, Human
auggcuauaggugcuacaaaaac

SEQ ID NO: 2752363 - RNA, 12 nt, Human
auggcuaucugu

SEQ ID NO: 2752364 - RNA, 17 nt, Human
auggcuccuccauaucu

SEQ ID NO: 2752365 - RNA, 22 nt, Human
auggcuuccuggcaauagucaa

SEQ ID NO: 2752366 - RNA, 24 nt, Human
auggcuugaguuuaaauuguaaua

SEQ ID NO: 2752367 - RNA, 17 nt, Human
augggaaagcauuguaa

SEQ ID NO: 2752368 - RNA, 14 nt, Human
augggaacaaggaa

SEQ ID NO: 2752369 - RNA, 16 nt, Human
augggaacaaggaagg

SEQ ID NO: 2752370 - RNA, 13 nt, Human
augggaagugacg

SEQ ID NO: 2752371 - RNA, 11 nt, Human
augggacaggg

SEQ ID NO: 2752372 - RNA, 15 nt, Human
augggacagggagga

SEQ ID NO: 2752373 - RNA, 13 nt, Human
augggacauuugc

SEQ ID NO: 2752374 - RNA, 21 nt, Human
augggacauuugcucauggaa

SEQ ID NO: 2752375 - RNA, 20 nt, Human
augggagugcccccaacagc

SEQ ID NO: 2752376 - RNA, 22 nt, Human
augggaugaucauguauuuauu

SEQ ID NO: 2752377 - RNA, 13 nt, Human
augggcaggaugg

SEQ ID NO: 2752378 - RNA, 24 nt, Human
augggcaggauggcaaccagacca

SEQ ID NO: 2752379 - RNA, 14 nt, Human
augggccauaugaa

SEQ ID NO: 2752380 - RNA, 20 nt, Human
augggccauaugaaaaggcu

SEQ ID NO: 2752381 - RNA, 20 nt, Human
augggccccagauaccauga

SEQ ID NO: 2752382 - RNA, 17 nt, Human
augggcuuuggaugauu

SEQ ID NO: 2752383 - RNA, 20 nt, Human
auuauaauuuuuuucaauau

SEQ ID NO: 2752384 - RNA, 14 nt, Human
auuauacauaacac

SEQ ID NO: 2752385 - RNA, 13 nt, Human
auuauauauauuu

SEQ ID NO: 2752386 - RNA, 13 nt, Human
auuauaucaauuu

SEQ ID NO: 2752387 - RNA, 23 nt, Human
auuauauggcuugaguuuaaauu

SEQ ID NO: 2752388 - RNA, 11 nt, Human
auuauauguca

SEQ ID NO: 2752389 - RNA, 15 nt, Human
auuauauuuacaaau

SEQ ID NO: 2752390 - RNA, 16 nt, Human
auuauauuuacaaaug

SEQ ID NO: 2752391 - RNA, 15 nt, Human
auuauauuuauuacu

SEQ ID NO: 2752392 - RNA, 21 nt, Human
auuauauuuauuacuguaaga

SEQ ID NO: 2752393 - RNA, 12 nt, Human
auuauauuucca

SEQ ID NO: 2752394 - RNA, 21 nt, Human
auuauauuuccaagaaauauu

SEQ ID NO: 2752395 - RNA, 18 nt, Human
auuauccaucuuucacua

SEQ ID NO: 2752396 - RNA, 16 nt, Human
auuaucuaguuuaauu

SEQ ID NO: 2752397 - RNA, 18 nt, Human
auuaucucaaaacugcac

SEQ ID NO: 2752398 - RNA, 18 nt, Human
auuaugaauuacauuugu

SEQ ID NO: 2752399 - RNA, 21 nt, Human
auuaugaauuacauuuguaua

SEQ ID NO: 2752400 - RNA, 19 nt, Human
auuaugaguuucuuuuugc

SEQ ID NO: 2752401 - RNA, 23 nt, Human
auuaugaguuucuuuuugcuauu

SEQ ID NO: 2752402 - RNA, 18 nt, Human
auuaugaucucagaaauu

SEQ ID NO: 2752403 - RNA, 22 nt, Human
auuaugaucucagaaauuguau

SEQ ID NO: 2752404 - RNA, 20 nt, Human
auuaugugccagauuuaugc

SEQ ID NO: 2752405 - RNA, 23 nt, Human
auuaugugccagauuuaugcaua

SEQ ID NO: 2752406 - RNA, 17 nt, Human
auuauguguguuuuaaa

SEQ ID NO: 2752407 - RNA, 18 nt, Human
auuauguguguuuuaaaa

SEQ ID NO: 2752408 - RNA, 15 nt, Human
auuauuaccuuacag

SEQ ID NO: 2752409 - RNA, 11 nt, Human
auuauuauuua

SEQ ID NO: 2752410 - RNA, 12 nt, Human
auuauuauuuau

SEQ ID NO: 2752411 - RNA, 17 nt, Human
auuauuguacauuuaua

SEQ ID NO: 2752412 - RNA, 20 nt, Human
auuauuguguguuauuuaaa

SEQ ID NO: 2752413 - RNA, 14 nt, Human
auuauuucacuuua

SEQ ID NO: 2752414 - RNA, 18 nt, Human
auuauuucacuuuagaaa

SEQ ID NO: 2752415 - RNA, 14 nt, Human
auuauuugcagaga

SEQ ID NO: 2752416 - RNA, 14 nt, Human
auuauuuuauguug

SEQ ID NO: 2752417 - RNA, 12 nt, Human
auuauuuucucu

SEQ ID NO: 2752418 - RNA, 13 nt, Human
auuauuuuuuaaa

SEQ ID NO: 2752419 - RNA, 17 nt, Human
auuauuuuuuaaaaaaa

SEQ ID NO: 2752420 - RNA, 18 nt, Human
auuauuuuuuaaaaaaau

SEQ ID NO: 2752421 - RNA, 19 nt, Human
auuauuuuuuaaaaaaauu

SEQ ID NO: 2752422 - RNA, 20 nt, Human
auuauuuuuuaaaaaaauuc

SEQ ID NO: 2752423 - RNA, 14 nt, Human
auucaaaaauuaua

SEQ ID NO: 2752424 - RNA, 14 nt, Human
auucaaaaguugaa

SEQ ID NO: 2752425 - RNA, 22 nt, Human
auucaaaggcauuucuuuucug

SEQ ID NO: 2752426 - RNA, 18 nt, Human
auucaaauguauuacagu

SEQ ID NO: 2752427 - RNA, 17 nt, Human
auucaaugccccugaau

SEQ ID NO: 2752428 - RNA, 22 nt, Human
auucaaugccccugaauuuaaa

SEQ ID NO: 2752429 - RNA, 17 nt, Human
auucacaaccacucauu

SEQ ID NO: 2752430 - RNA, 19 nt, Human
auucacaucgcagauucuc

SEQ ID NO: 2752431 - RNA, 17 nt, Human
auucacccugauuuuac

SEQ ID NO: 2752432 - RNA, 15 nt, Human
auucaccuuccagug

SEQ ID NO: 2752433 - RNA, 15 nt, Human
auucacucaacaaac

SEQ ID NO: 2752434 - RNA, 19 nt, Human
auucacucaacaaacauaa

SEQ ID NO: 2752435 - RNA, 17 nt, Human
auucagaauuucuaaaa

SEQ ID NO: 2752436 - RNA, 17 nt, Human
auucagacuguuuuuca

SEQ ID NO: 2752437 - RNA, 21 nt, Human
auucagagcuuacuuaaaauu

SEQ ID NO: 2752438 - RNA, 21 nt, Human
auucagggagugggcuaagca

SEQ ID NO: 2752439 - RNA, 17 nt, Human
auucagggcuauuuuuu

SEQ ID NO: 2752440 - RNA, 22 nt, Human
auucagggcuauuuuuuccccc

SEQ ID NO: 2752441 - RNA, 23 nt, Human
auucagggcuauuuuuuccccca

SEQ ID NO: 2752442 - RNA, 22 nt, Human
auucauagcagcuuauucacaa

SEQ ID NO: 2752443 - RNA, 20 nt, Human
auucauauuuucuuucaaaa

SEQ ID NO: 2752444 - RNA, 22 nt, Human
auucauguugccuugcauaaug

SEQ ID NO: 2752445 - RNA, 12 nt, Human
auuccaauacau

SEQ ID NO: 2752446 - RNA, 16 nt, Human
auuccaauacauuauu

SEQ ID NO: 2752447 - RNA, 14 nt, Human
auuccacagcugcu

SEQ ID NO: 2752448 - RNA, 16 nt, Human
auuccacagcugcuca

SEQ ID NO: 2752449 - RNA, 19 nt, Human
auuccacagcugcucaaua

SEQ ID NO: 2752450 - RNA, 16 nt, Human
auuccaccuacaugag

SEQ ID NO: 2752451 - RNA, 22 nt, Human
auuccaccuacaugagguacug

SEQ ID NO: 2752452 - RNA, 21 nt, Human
auucccagccagcacagccuc

SEQ ID NO: 2752453 - RNA, 16 nt, Human
auuccccuugccuaaa

SEQ ID NO: 2752454 - RNA, 21 nt, Human
auucccuccugcuacucuguu

SEQ ID NO: 2752455 - RNA, 22 nt, Human
auucccugagcaggauuuuaau

SEQ ID NO: 2752456 - RNA, 21 nt, Human
auuccuauauccugugacugu

SEQ ID NO: 2752457 - RNA, 19 nt, Human
auuccucaguucauccauu

SEQ ID NO: 2752458 - RNA, 20 nt, Human
auuccucaguucauccauuc

SEQ ID NO: 2752459 - RNA, 18 nt, Human
auuccucaugaauguaaa

SEQ ID NO: 2752460 - RNA, 13 nt, Human
auuccuccuuccc

SEQ ID NO: 2752461 - RNA, 15 nt, Human
auuccuccuucccuu

SEQ ID NO: 2752462 - RNA, 16 nt, Human
auuccuccuucccuug

SEQ ID NO: 2752463 - RNA, 11 nt, Human
auuccucugcc

SEQ ID NO: 2752464 - RNA, 12 nt, Human
auuccucugccc

SEQ ID NO: 2752465 - RNA, 23 nt, Human
auuccugaacaggauauucucac

SEQ ID NO: 2752466 - RNA, 23 nt, Human
auuccugacugcuaguuuauaua

SEQ ID NO: 2752467 - RNA, 14 nt, Human
auuccuuuuucucu

SEQ ID NO: 2752468 - RNA, 19 nt, Human
auucgcaaacuuucuuaaa

SEQ ID NO: 2752469 - RNA, 22 nt, Human
auucuaaaugaauguuuacacu

SEQ ID NO: 2752470 - RNA, 15 nt, Human
auucuagucuauuug

SEQ ID NO: 2752471 - RNA, 13 nt, Human
auucuaucuauuc

SEQ ID NO: 2752472 - RNA, 13 nt, Human
auucuaugagaua

SEQ ID NO: 2752473 - RNA, 22 nt, Human
auucucaagcccugcagucaca

SEQ ID NO: 2752474 - RNA, 23 nt, Human
auucucaugauuauuauuuuagu

SEQ ID NO: 2752475 - RNA, 13 nt, Human
auucuccugccuc

SEQ ID NO: 2752476 - RNA, 17 nt, Human
auucuccugccucagcc

SEQ ID NO: 2752477 - RNA, 18 nt, Human
auucuccugccucagccu

SEQ ID NO: 2752478 - RNA, 13 nt, Human
auucucuugccuc

SEQ ID NO: 2752479 - RNA, 12 nt, Human
auucugaaagca

SEQ ID NO: 2752480 - RNA, 23 nt, Human
auucugagguaaccucauuauca

SEQ ID NO: 2752481 - RNA, 16 nt, Human
auucugcaagcuuuuc

SEQ ID NO: 2752482 - RNA, 19 nt, Human
auucugcaagcuuuucaaa

SEQ ID NO: 2752483 - RNA, 18 nt, Human
auucugguagcuaaauau

SEQ ID NO: 2752484 - RNA, 22 nt, Human
auucugucucuggauuauauua

SEQ ID NO: 2752485 - RNA, 14 nt, Human
auucuguguuaaaa

SEQ ID NO: 2752486 - RNA, 16 nt, Human
auucuguguuaaaaau

SEQ ID NO: 2752487 - RNA, 23 nt, Human
auucuguguuaaaaauguucuau

SEQ ID NO: 2752488 - RNA, 23 nt, Human
auucuuacauguuuucuuugcuu

SEQ ID NO: 2752489 - RNA, 17 nt, Human
auucuuauuauuuuuga

SEQ ID NO: 2752490 - RNA, 12 nt, Human
auucuuccuccc

SEQ ID NO: 2752491 - RNA, 15 nt, Human
auucuuccucccauu

SEQ ID NO: 2752492 - RNA, 16 nt, Human
auucuuggguguuuau

SEQ ID NO: 2752493 - RNA, 12 nt, Human
auucuuuaucuu

SEQ ID NO: 2752494 - RNA, 20 nt, Human
auucuuuuaguuuuuaaagu

SEQ ID NO: 2752495 - RNA, 18 nt, Human
auugaaggaugcugucuu

SEQ ID NO: 2752496 - RNA, 13 nt, Human
auugaaguuuugg

SEQ ID NO: 2752497 - RNA, 20 nt, Human
auugaaucccuuaaacucag

SEQ ID NO: 2752498 - RNA, 19 nt, Human
auugacacuuaaaaauggu

SEQ ID NO: 2752499 - RNA, 15 nt, Human
auugacugucacaua

SEQ ID NO: 2752500 - RNA, 14 nt, Human
auugagaaggagcu

SEQ ID NO: 2752501 - RNA, 18 nt, Human
auugagaaggagcuccca

SEQ ID NO: 2752502 - RNA, 16 nt, Human
auugagcaccugcagg

SEQ ID NO: 2752503 - RNA, 15 nt, Human
auugauaagaucuuu

SEQ ID NO: 2752504 - RNA, 12 nt, Human
auugauaauaaa

SEQ ID NO: 2752505 - RNA, 14 nt, Human
auugauaauaaaau

SEQ ID NO: 2752506 - RNA, 23 nt, Human
auugaucggagccuccucucuca

SEQ ID NO: 2752507 - RNA, 13 nt, Human
auugauuauaugu

SEQ ID NO: 2752508 - RNA, 19 nt, Human
auugauuuugaaccugaug

SEQ ID NO: 2752509 - RNA, 21 nt, Human
auugcaagaguuuaauuuuug

SEQ ID NO: 2752510 - RNA, 13 nt, Human
auugcaaggcaaa

SEQ ID NO: 2752511 - RNA, 13 nt, Human
auugcauuaaaua

SEQ ID NO: 2752512 - RNA, 18 nt, Human
auugcauuuaauuuauug

SEQ ID NO: 2752513 - RNA, 15 nt, Human
auugcauuuuacuuu

SEQ ID NO: 2752514 - RNA, 13 nt, Human
auugccucugaga

SEQ ID NO: 2752515 - RNA, 15 nt, Human
auugcuaucgccauc

SEQ ID NO: 2752516 - RNA, 17 nt, Human
auugcucagaaauguca

SEQ ID NO: 2752517 - RNA, 19 nt, Human
auugcucucccagcccuug

SEQ ID NO: 2752518 - RNA, 23 nt, Human
auugcuguccuggaggggcuggg

SEQ ID NO: 2752519 - RNA, 20 nt, Human
auugcuugaacccaggagau

SEQ ID NO: 2752520 - RNA, 16 nt, Human
auugcuuguuggauuu

SEQ ID NO: 2752521 - RNA, 14 nt, Human
auuggacuuaaaau

SEQ ID NO: 2752522 - RNA, 15 nt, Human
auuggacuuccauuu

SEQ ID NO: 2752523 - RNA, 19 nt, Human
auuggagcucgugggacag

SEQ ID NO: 2752524 - RNA, 21 nt, Human
auugggaaaggaguagaaaaa

SEQ ID NO: 2752525 - RNA, 13 nt, Human
auugggcaggcag

SEQ ID NO: 2752526 - RNA, 13 nt, Human
auugguuuaccug

SEQ ID NO: 2752527 - RNA, 13 nt, Human
auuguaaaauggu

SEQ ID NO: 2752528 - RNA, 13 nt, Human
auuuguauaaaau

SEQ ID NO: 2752529 - RNA, 14 nt, Human
auuuguauaaaaua

SEQ ID NO: 2752530 - RNA, 16 nt, Human
auuuguauaaaauaau

SEQ ID NO: 2752531 - RNA, 21 nt, Human
auuuguauaaaauaauuuuua

SEQ ID NO: 2752532 - RNA, 13 nt, Human
auuugucaacaaa

SEQ ID NO: 2752533 - RNA, 19 nt, Human
auuugugaagguggaaaua

SEQ ID NO: 2752534 - RNA, 22 nt, Human
auuugugaagguggaaauaaac

SEQ ID NO: 2752535 - RNA, 14 nt, Human
auuuguguauuaua

SEQ ID NO: 2752536 - RNA, 16 nt, Human
auuuguguauuauaau

SEQ ID NO: 2752537 - RNA, 17 nt, Human
auuuguuaaaauuauca

SEQ ID NO: 2752538 - RNA, 23 nt, Human
auuuuaaaaaauggaacauaaaa

SEQ ID NO: 2752539 - RNA, 12 nt, Human
auuuuaaaagaa

SEQ ID NO: 2752540 - RNA, 13 nt, Human
auuuuaaaauaaa

SEQ ID NO: 2752541 - RNA, 22 nt, Human
auuuuaaacacauuaggaaaag

SEQ ID NO: 2752542 - RNA, 12 nt, Human
auuuuaaauauu

SEQ ID NO: 2752543 - RNA, 20 nt, Human
auuuuaacaucugagaaaag

SEQ ID NO: 2752544 - RNA, 21 nt, Human
auuuuaacaucugagaaaagc

SEQ ID NO: 2752545 - RNA, 18 nt, Human
auuuuaagggaaggggaa

SEQ ID NO: 2752546 - RNA, 14 nt, Human
auuuuaaguaauuu

SEQ ID NO: 2752547 - RNA, 22 nt, Human
auuuuaauaauauauuuuaaau

SEQ ID NO: 2752548 - RNA, 16 nt, Human
auuuuaauaauguuuc

SEQ ID NO: 2752549 - RNA, 17 nt, Human
auuuuaauuauuauucu

SEQ ID NO: 2752550 - RNA, 17 nt, Human
auuuuacaauugaaaug

SEQ ID NO: 2752551 - RNA, 22 nt, Human
auuuuacacacauuaaaauguu

SEQ ID NO: 2752552 - RNA, 14 nt, Human
auuuuacauaaauu

SEQ ID NO: 2752553 - RNA, 22 nt, Human
auuuuacauguggcccaacaca

SEQ ID NO: 2752554 - RNA, 12 nt, Human
auuuuacuguac

SEQ ID NO: 2752555 - RNA, 13 nt, Human
auuuuacuguaca

SEQ ID NO: 2752556 - RNA, 17 nt, Human
auuuuagaacauuuuca

SEQ ID NO: 2752557 - RNA, 23 nt, Human
auuuuagauagaugaagaagcua

SEQ ID NO: 2752558 - RNA, 22 nt, Human
auuuuauagcuacuaauuuuaa

SEQ ID NO: 2752559 - RNA, 23 nt, Human
auuuuauagcuacuaauuuuaaa

SEQ ID NO: 2752560 - RNA, 15 nt, Human
auuuuauuuuuuucu

SEQ ID NO: 2752561 - RNA, 15 nt, Human
auuuucaaaaucaaa

SEQ ID NO: 2752562 - RNA, 20 nt, Human
auuuucaaauuugaugaaau

SEQ ID NO: 2752563 - RNA, 13 nt, Human
auuuucaccuguu

SEQ ID NO: 2752564 - RNA, 17 nt, Human
auuuucaccuguuauaa

SEQ ID NO: 2752565 - RNA, 20 nt, Human
auuuucaccuguuauaauaa

SEQ ID NO: 2752566 - RNA, 16 nt, Human
auuuucaccuguuuuu

SEQ ID NO: 2752567 - RNA, 17 nt, Human
auuuucagcccucagaa

SEQ ID NO: 2752568 - RNA, 15 nt, Human
auuuucaucaccccu

SEQ ID NO: 2752569 - RNA, 19 nt, Human
auuuucaugcuguucauga

SEQ ID NO: 2752570 - RNA, 17 nt, Human
auuuucuaagaaacauu

SEQ ID NO: 2752571 - RNA, 20 nt, Human
auuuucuaccuggucucucc

SEQ ID NO: 2752572 - RNA, 23 nt, Human
auuuucuagaauacuaauaaaau

SEQ ID NO: 2752573 - RNA, 17 nt, Human
auuuucuauaauuuaaa

SEQ ID NO: 2752574 - RNA, 18 nt, Human
auuuucuauaauuuaaau

SEQ ID NO: 2752575 - RNA, 18 nt, Human
auuuucuuccaaacagaa

SEQ ID NO: 2752576 - RNA, 16 nt, Human
auuuucuuuguuaaaa

SEQ ID NO: 2752577 - RNA, 18 nt, Human
auuuugaauccagaaaua

SEQ ID NO: 2752578 - RNA, 14 nt, Human
auuuugcuaacugg

SEQ ID NO: 2752579 - RNA, 20 nt, Human
auuuugcuaacuggguuaaa

SEQ ID NO: 2752580 - RNA, 19 nt, Human
auuuugcuaacugguuaaa

SEQ ID NO: 2752581 - RNA, 23 nt, Human
auuuuggcaagcucuaucaccaa

SEQ ID NO: 2752582 - RNA, 16 nt, Human
auuuugguaaaauacu

SEQ ID NO: 2752583 - RNA, 20 nt, Human
auuuugguaaaauacuucuu

SEQ ID NO: 2752584 - RNA, 18 nt, Human
auuuugugaagcaaaauu

SEQ ID NO: 2752585 - RNA, 14 nt, Human
auuuugugauugau

SEQ ID NO: 2752586 - RNA, 20 nt, Human
auuuugugauugauuauaug

SEQ ID NO: 2752587 - RNA, 14 nt, Human
auuuuguuuaaauu

SEQ ID NO: 2752588 - RNA, 15 nt, Human
auuuuguuuaaauua

SEQ ID NO: 2752589 - RNA, 23 nt, Human
auuuuguuugguauuguauuuau

SEQ ID NO: 2752590 - RNA, 21 nt, Human
auuuuuaaacuguaaagcuuu

SEQ ID NO: 2752591 - RNA, 20 nt, Human
auuuuuaaauaaagaauuuu

SEQ ID NO: 2752592 - RNA, 13 nt, Human
auuuuuacacaug

SEQ ID NO: 2752593 - RNA, 16 nt, Human
auuuuuacacauguau

SEQ ID NO: 2752594 - RNA, 20 nt, Human
auuuuuaggcugaaagauga

SEQ ID NO: 2752595 - RNA, 16 nt, Human
auuuuuagugaaauau

SEQ ID NO: 2752596 - RNA, 12 nt, Human
auuuuuauauuu

SEQ ID NO: 2752597 - RNA, 23 nt, Human
auuuuucuuauuucauuucuuug

SEQ ID NO: 2752598 - RNA, 11 nt, Human
auuuuugaagc

SEQ ID NO: 2752599 - RNA, 16 nt, Human
auuuuuguaguuuuag

SEQ ID NO: 2752600 - RNA, 23 nt, Human
auuuuugugauuuugugauugau

SEQ ID NO: 2752601 - RNA, 13 nt, Human
auuuuuuaaaaaa

SEQ ID NO: 2752602 - RNA, 15 nt, Human
auuuuuuaaguauuu

SEQ ID NO: 2752603 - RNA, 21 nt, Human
auuuuuucucuaggaaauauu

SEQ ID NO: 2752604 - RNA, 17 nt, Human
auuuuuucuuuucuauu

SEQ ID NO: 2752605 - RNA, 19 nt, Human
auuuuuuuagaaagcauuu

SEQ ID NO: 2752606 - RNA, 21 nt, Human
auuuuuuucuaauaguuuuau

SEQ ID NO: 2752607 - RNA, 20 nt, Human
auuuuuuucugaauuauuuu

SEQ ID NO: 2752608 - RNA, 15 nt, Human
auuuuuuuuaacauu

SEQ ID NO: 2752609 - RNA, 14 nt, Human
caaaaaaaaaaaca

SEQ ID NO: 2752610 - RNA, 13 nt, Human
caaaaaaaaaacc

SEQ ID NO: 2752611 - RNA, 13 nt, Human
caaaaaaaaaauu

SEQ ID NO: 2752612 - RNA, 19 nt, Human
caaaaaaaaaauuugccaa

SEQ ID NO: 2752613 - RNA, 13 nt, Human
caaaaaaagcauu

SEQ ID NO: 2752614 - RNA, 15 nt, Human
caaaaaaaggaagga

SEQ ID NO: 2752615 - RNA, 16 nt, Human
caaaaaaaggaaggaa

SEQ ID NO: 2752616 - RNA, 22 nt, Human
caaaaacaaacaaacgaaaaac

SEQ ID NO: 2752617 - RNA, 15 nt, Human
caaaaaccaaauuug

SEQ ID NO: 2752618 - RNA, 23 nt, Human
caaaaacuuagaugggcauggug

SEQ ID NO: 2752619 - RNA, 13 nt, Human
caaaaagaauggg

SEQ ID NO: 2752620 - RNA, 18 nt, Human
caaaaagcuacuuauugu

SEQ ID NO: 2752621 - RNA, 11 nt, Human
caaaaaucaaa

SEQ ID NO: 2752622 - RNA, 14 nt, Human
caaaaaucaaacuu

SEQ ID NO: 2752623 - RNA, 23 nt, Human
caaaaaucucaauauuucagaua

SEQ ID NO: 2752624 - RNA, 16 nt, Human
caaaaauuagccgggc

SEQ ID NO: 2752625 - RNA, 13 nt, Human
caaaacccuuucu

SEQ ID NO: 2752626 - RNA, 17 nt, Human
caaaacccuuucugccc

SEQ ID NO: 2752627 - RNA, 19 nt, Human
caaaacccuuucugccccu

SEQ ID NO: 2752628 - RNA, 17 nt, Human
caaaacuagguaaaauc

SEQ ID NO: 2752629 - RNA, 17 nt, Human
caaaacuuauuggaaug

SEQ ID NO: 2752630 - RNA, 19 nt, Human
caaaacuuauuggaauguu

SEQ ID NO: 2752631 - RNA, 17 nt, Human
caaaagacuuuuuccuu

SEQ ID NO: 2752632 - RNA, 21 nt, Human
caaaagagucuuaauauauau

SEQ ID NO: 2752633 - RNA, 17 nt, Human
caaaagcgauuauuauu

SEQ ID NO: 2752634 - RNA, 23 nt, Human
caaaagcgauuauuauuuuagag

SEQ ID NO: 2752635 - RNA, 13 nt, Human
caaaaggaaugug

SEQ ID NO: 2752636 - RNA, 23 nt, Human
caaaagguauuuauugagcaccu

SEQ ID NO: 2752637 - RNA, 21 nt, Human
caaaagguauuuuaaucacca

SEQ ID NO: 2752638 - RNA, 21 nt, Human
caaaaguauauucaaaaauua

SEQ ID NO: 2752639 - RNA, 21 nt, Human
caaaauaugccccauucaaca

SEQ ID NO: 2752640 - RNA, 23 nt, Human
caaaauaugccccauucaacauc

SEQ ID NO: 2752641 - RNA, 15 nt, Human
caaaauggaauacuc

SEQ ID NO: 2752642 - RNA, 23 nt, Human
caaaauggaauacucuuauaucu

SEQ ID NO: 2752643 - RNA, 15 nt, Human
caaaauugggaaagg

SEQ ID NO: 2752644 - RNA, 11 nt, Human
caaacaaaaaa

SEQ ID NO: 2752645 - RNA, 14 nt, Human
caaacaaacaaaaa

SEQ ID NO: 2752646 - RNA, 17 nt, Human
caaacauauauaacaau

SEQ ID NO: 2752647 - RNA, 19 nt, Human
caaacauauauaacaaugc

SEQ ID NO: 2752648 - RNA, 20 nt, Human
caaacauguuccugggauca

SEQ ID NO: 2752649 - RNA, 22 nt, Human
caaaccagagccugaguguugc

SEQ ID NO: 2752650 - RNA, 19 nt, Human
caaaccaggacccugucca

SEQ ID NO: 2752651 - RNA, 14 nt, Human
caaacguuaagaau

SEQ ID NO: 2752652 - RNA, 14 nt, Human
caaacucauccauu

SEQ ID NO: 2752653 - RNA, 15 nt, Human
caaacuccugaccuc

SEQ ID NO: 2752654 - RNA, 16 nt, Human
caaacuccugaccuca

SEQ ID NO: 2752655 - RNA, 19 nt, Human
caaacuccugaccucaagu

SEQ ID NO: 2752656 - RNA, 21 nt, Human
caaacugaaacaaaauuagaa

SEQ ID NO: 2752657 - RNA, 16 nt, Human
caaacugaagccagaa

SEQ ID NO: 2752658 - RNA, 17 nt, Human
caaacuggggccucccu

SEQ ID NO: 2752659 - RNA, 17 nt, Human
caaacuucuauuuuuau

SEQ ID NO: 2752660 - RNA, 14 nt, Human
caaacuuuacagaa

SEQ ID NO: 2752661 - RNA, 16 nt, Human
caaacuuuacagaaag

SEQ ID NO: 2752662 - RNA, 15 nt, Human
caaagaagacaacau

SEQ ID NO: 2752663 - RNA, 18 nt, Human
caaagacuaugaggaaua

SEQ ID NO: 2752664 - RNA, 17 nt, Human
caaagagaaagaggguu

SEQ ID NO: 2752665 - RNA, 17 nt, Human
caaagagugaaggauuu

SEQ ID NO: 2752666 - RNA, 20 nt, Human
caaagcacgaaauguuauuu

SEQ ID NO: 2752667 - RNA, 15 nt, Human
caaagcccagcuuga

SEQ ID NO: 2752668 - RNA, 21 nt, Human
caaagcccagcuugaaaccuu

SEQ ID NO: 2752669 - RNA, 18 nt, Human
caaagccuucauugccuu

SEQ ID NO: 2752670 - RNA, 21 nt, Human
caaagcucuuuacuuuccccu

SEQ ID NO: 2752671 - RNA, 23 nt, Human
caaagcugaaauggacuuuugua

SEQ ID NO: 2752672 - RNA, 22 nt, Human
caagccuaagggauccugccug

SEQ ID NO: 2752673 - RNA, 18 nt, Human
caagccucauguccacug

SEQ ID NO: 2752674 - RNA, 17 nt, Human
caagccuccuuuuaaag

SEQ ID NO: 2752675 - RNA, 18 nt, Human
caagcgauucuccugccu

SEQ ID NO: 2752676 - RNA, 20 nt, Human
caagcgauucuccugccuca

SEQ ID NO: 2752677 - RNA, 18 nt, Human
caagcuaugugagcucac

SEQ ID NO: 2752678 - RNA, 15 nt, Human
caagcucacagaccu

SEQ ID NO: 2752679 - RNA, 20 nt, Human
caagcucuaucaccaaggag

SEQ ID NO: 2752680 - RNA, 13 nt, Human
caagcugcauuuc

SEQ ID NO: 2752681 - RNA, 19 nt, Human
caaggaaaaaauaacaaug

SEQ ID NO: 2752682 - RNA, 14 nt, Human
caaggaaggaaaga

SEQ ID NO: 2752683 - RNA, 21 nt, Human
caaggaaggaaagaugugaau

SEQ ID NO: 2752684 - RNA, 14 nt, Human
caaggagcuuagau

SEQ ID NO: 2752685 - RNA, 18 nt, Human
caaggaugucugccacac

SEQ ID NO: 2752686 - RNA, 20 nt, Human
caaggcccccgggccgacgg

SEQ ID NO: 2752687 - RNA, 14 nt, Human
caaggcuagaacca

SEQ ID NO: 2752688 - RNA, 18 nt, Human
caaggcugauuaaaccaa

SEQ ID NO: 2752689 - RNA, 18 nt, Human
caaggcuuagacccucau

SEQ ID NO: 2752690 - RNA, 18 nt, Human
caagggaacaaguacuuc

SEQ ID NO: 2752691 - RNA, 23 nt, Human
caagggaguuaggcuauucacaa

SEQ ID NO: 2752692 - RNA, 21 nt, Human
caagggugaugggaaagcauu

SEQ ID NO: 2752693 - RNA, 16 nt, Human
caaggguggguggggu

SEQ ID NO: 2752694 - RNA, 18 nt, Human
caaggguucagagacuca

SEQ ID NO: 2752695 - RNA, 15 nt, Human
caagguucuucccuu

SEQ ID NO: 2752696 - RNA, 16 nt, Human
caaguaaaaggaaaug

SEQ ID NO: 2752697 - RNA, 19 nt, Human
caaguaaaaggaaaugcuc

SEQ ID NO: 2752698 - RNA, 12 nt, Human
caaguauaauau

SEQ ID NO: 2752699 - RNA, 13 nt, Human
caaguauaauauu

SEQ ID NO: 2752700 - RNA, 18 nt, Human
caaguauggcuccuccau

SEQ ID NO: 2752701 - RNA, 16 nt, Human
caaguccugcaagcag

SEQ ID NO: 2752702 - RNA, 23 nt, Human
caaguccugccucuuaaauaaac

SEQ ID NO: 2752703 - RNA, 17 nt, Human
caagucuuauuuccuca

SEQ ID NO: 2752704 - RNA, 19 nt, Human
caagucuuauuuccucaac

SEQ ID NO: 2752705 - RNA, 18 nt, Human
caagugauccgcccaucu

SEQ ID NO: 2752706 - RNA, 19 nt, Human
caagugauccgcccaucuc

SEQ ID NO: 2752707 - RNA, 16 nt, Human
caagugauccucaggc

SEQ ID NO: 2752708 - RNA, 16 nt, Human
caagugcuucuccagc

SEQ ID NO: 2752709 - RNA, 15 nt, Human
caaguuagaacuagc

SEQ ID NO: 2752710 - RNA, 17 nt, Human
caaguuagaacuagcca

SEQ ID NO: 2752711 - RNA, 22 nt, Human
caaguuuuguggggcuuuuuau

SEQ ID NO: 2752712 - RNA, 11 nt, Human
caauaaaagac

SEQ ID NO: 2752713 - RNA, 12 nt, Human
caauaaaagaca

SEQ ID NO: 2752714 - RNA, 22 nt, Human
caauaaaagacaaggaaaaaau

SEQ ID NO: 2752715 - RNA, 15 nt, Human
caauaaaauggguuu

SEQ ID NO: 2752716 - RNA, 13 nt, Human
caauaaagaguuc

SEQ ID NO: 2752717 - RNA, 19 nt, Human
caauaaagaguuccuucug

SEQ ID NO: 2752718 - RNA, 15 nt, Human
caauaaaguauuuaa

SEQ ID NO: 2752719 - RNA, 12 nt, Human
caauaaauaaau

SEQ ID NO: 2752720 - RNA, 17 nt, Human
caauaaauaaauaaaua

SEQ ID NO: 2752721 - RNA, 19 nt, Human
caauaaauagaccauuaau

SEQ ID NO: 2752722 - RNA, 14 nt, Human
caauaacgauaaaa

SEQ ID NO: 2752723 - RNA, 16 nt, Human
caauaacgauaaaaga

SEQ ID NO: 2752724 - RNA, 17 nt, Human
caauaacgauaaaagac

SEQ ID NO: 2752725 - RNA, 20 nt, Human
caauaacgauaaaagacagu

SEQ ID NO: 2752726 - RNA, 23 nt, Human
caauaacgauaaaagacagugaa

SEQ ID NO: 2752727 - RNA, 12 nt, Human
caauacauuauu

SEQ ID NO: 2752728 - RNA, 22 nt, Human
caauaccugaagcuaucguaaa

SEQ ID NO: 2752729 - RNA, 17 nt, Human
caauacuucauuuaaaa

SEQ ID NO: 2752730 - RNA, 21 nt, Human
caauagucaaauugugugaaa

SEQ ID NO: 2752731 - RNA, 16 nt, Human
caauauaagcuuuucu

SEQ ID NO: 2752732 - RNA, 12 nt, Human
caauaucagacu

SEQ ID NO: 2752733 - RNA, 19 nt, Human
caauauucauagcagcuua

SEQ ID NO: 2752734 - RNA, 15 nt, Human
caauauuugaauuuu

SEQ ID NO: 2752735 - RNA, 23 nt, Human
caauauuugaauuuuaaaucuaa

SEQ ID NO: 2752736 - RNA, 19 nt, Human
caaucaaauaaguauuuau

SEQ ID NO: 2752737 - RNA, 22 nt, Human
caaucaaauaaguauuuauaau

SEQ ID NO: 2752738 - RNA, 18 nt, Human
caaucaguauucauauuu

SEQ ID NO: 2752739 - RNA, 13 nt, Human
caaucaucaaccc

SEQ ID NO: 2752740 - RNA, 13 nt, Human
caaucaugaauua

SEQ ID NO: 2752741 - RNA, 13 nt, Human
caauccaagaacu

SEQ ID NO: 2752742 - RNA, 22 nt, Human
caauccuagguaggguuuaauc

SEQ ID NO: 2752743 - RNA, 19 nt, Human
caauccucccacuucagcc

SEQ ID NO: 2752744 - RNA, 12 nt, Human
caauccuucuau

SEQ ID NO: 2752745 - RNA, 21 nt, Human
caaucugaggccuccucucuc

SEQ ID NO: 2752746 - RNA, 15 nt, Human
caaugccccugaauu

SEQ ID NO: 2752747 - RNA, 16 nt, Human
caaugcuguauuuuaa

SEQ ID NO: 2752748 - RNA, 22 nt, Human
caaugcuguauuuuaaaagaau

SEQ ID NO: 2752749 - RNA, 17 nt, Human
caaugcuuugccccuga

SEQ ID NO: 2752750 - RNA, 19 nt, Human
caauguuuucaguucucuu

SEQ ID NO: 2752751 - RNA, 16 nt, Human
caauuaaaagugucuu

SEQ ID NO: 2752752 - RNA, 17 nt, Human
caauuaaacccaguagu

SEQ ID NO: 2752753 - RNA, 14 nt, Human
caauuaauuuuaga

SEQ ID NO: 2752754 - RNA, 22 nt, Human
caauuagcuccuccuuuuuccu

SEQ ID NO: 2752755 - RNA, 21 nt, Human
caauuauaagcuguuuuuaua

SEQ ID NO: 2752756 - RNA, 23 nt, Human
caauuauaagcuguuuuuauaua

SEQ ID NO: 2752757 - RNA, 17 nt, Human
caauuauaucaguccuc

SEQ ID NO: 2752758 - RNA, 19 nt, Human
caauuauaucaguccucuu

SEQ ID NO: 2752759 - RNA, 20 nt, Human
caauuauuuuuacaguucuc

SEQ ID NO: 2752760 - RNA, 13 nt, Human
caauucagggagu

SEQ ID NO: 2752761 - RNA, 19 nt, Human
caauucagggagugggcua

SEQ ID NO: 2752762 - RNA, 20 nt, Human
caauucuauuacgugcaaua

SEQ ID NO: 2752763 - RNA, 21 nt, Human
caauucuauuacgugcaauac

SEQ ID NO: 2752764 - RNA, 19 nt, Human
caauucuugccaaauauaa

SEQ ID NO: 2752765 - RNA, 23 nt, Human
caauucuugccaaauauaaauaa

SEQ ID NO: 2752766 - RNA, 16 nt, Human
caauuguuggagagcc

SEQ ID NO: 2752767 - RNA, 18 nt, Human
caauuguuggagagcccc

SEQ ID NO: 2752768 - RNA, 18 nt, Human
caauuuaaaaaaaaaccu

SEQ ID NO: 2752769 - RNA, 21 nt, Human
caauuuuguuauguauauuuu

SEQ ID NO: 2752770 - RNA, 14 nt, Human
cacaaaauugggaa

SEQ ID NO: 2752771 - RNA, 19 nt, Human
cacaaacucauccauuaau

SEQ ID NO: 2752772 - RNA, 19 nt, Human
cacaaauuaucuuaaaacu

SEQ ID NO: 2752773 - RNA, 16 nt, Human
cacaaauucucacaca

SEQ ID NO: 2752774 - RNA, 17 nt, Human
cacaaauucugucucug

SEQ ID NO: 2752775 - RNA, 12 nt, Human
cacaacacacag

SEQ ID NO: 2752776 - RNA, 13 nt, Human
cacaacacacaga

SEQ ID NO: 2752777 - RNA, 14 nt, Human
cacaacacacagau

SEQ ID NO: 2752778 - RNA, 20 nt, Human
cacaacacacagauuugagc

SEQ ID NO: 2752779 - RNA, 13 nt, Human
cacaacuauauug

SEQ ID NO: 2752780 - RNA, 14 nt, Human
cacaacuauauugu

SEQ ID NO: 2752781 - RNA, 14 nt, Human
cacaagaaaugaaa

SEQ ID NO: 2752782 - RNA, 18 nt, Human
cacaaguaaaaggaaaug

SEQ ID NO: 2752783 - RNA, 20 nt, Human
cacaaucuaggaugggaaca

SEQ ID NO: 2752784 - RNA, 23 nt, Human
cacaaugcagugccuuucuucuc

SEQ ID NO: 2752785 - RNA, 16 nt, Human
cacaaugugucugaga

SEQ ID NO: 2752786 - RNA, 15 nt, Human
cacacagauuugagc

SEQ ID NO: 2752787 - RNA, 16 nt, Human
cacacagcccuggccu

SEQ ID NO: 2752788 - RNA, 15 nt, Human
cacacaugaagucca

SEQ ID NO: 2752789 - RNA, 17 nt, Human
cacacaugggaucaagu

SEQ ID NO: 2752790 - RNA, 15 nt, Human
cacacauuaaaaugu

SEQ ID NO: 2752791 - RNA, 15 nt, Human
cacaccaaccuucug

SEQ ID NO: 2752792 - RNA, 13 nt, Human
cacaccaggcuug

SEQ ID NO: 2752793 - RNA, 13 nt, Human
cacaccucuccaa

SEQ ID NO: 2752794 - RNA, 15 nt, Human
cacaccuuaucuaug

SEQ ID NO: 2752795 - RNA, 19 nt, Human
cacacuaugguauuugagu

SEQ ID NO: 2752796 - RNA, 12 nt, Human
cacacucaaauc

SEQ ID NO: 2752797 - RNA, 20 nt, Human
cacacucuguccagccccgu

SEQ ID NO: 2752798 - RNA, 11 nt, Human
cacacugaaga

SEQ ID NO: 2752799 - RNA, 13 nt, Human
cacacugaagaag

SEQ ID NO: 2752800 - RNA, 14 nt, Human
cacacugaagaagc

SEQ ID NO: 2752801 - RNA, 18 nt, Human
cacacugaagaagcacca

SEQ ID NO: 2752802 - RNA, 16 nt, Human
cacacuguccauucuu

SEQ ID NO: 2752803 - RNA, 23 nt, Human
cacacuguccauucuuccuccca

SEQ ID NO: 2752804 - RNA, 23 nt, Human
cacagaaacuccuguucaugccc

SEQ ID NO: 2752805 - RNA, 18 nt, Human
cacagaaugacugacaaa

SEQ ID NO: 2752806 - RNA, 19 nt, Human
cacagaccuuugaacuaga

SEQ ID NO: 2752807 - RNA, 22 nt, Human
cacagaccuuugaacuagaguu

SEQ ID NO: 2752808 - RNA, 13 nt, Human
cacagaggaucug

SEQ ID NO: 2752809 - RNA, 21 nt, Human
cacagagguagucucacugcu

SEQ ID NO: 2752810 - RNA, 14 nt, Human
cacagaucacagcu

SEQ ID NO: 2752811 - RNA, 22 nt, Human
cacagauuugagcucagcccug

SEQ ID NO: 2752812 - RNA, 23 nt, Human
cacagauuugagcucagcccugg

SEQ ID NO: 2752813 - RNA, 17 nt, Human
cacagcaagucaggguu

SEQ ID NO: 2752814 - RNA, 19 nt, Human
cacagcaagucaggguugg

SEQ ID NO: 2752815 - RNA, 23 nt, Human
cacagcaagucaggguuggagca

SEQ ID NO: 2752816 - RNA, 19 nt, Human
cacagcaguugaaaagacu

SEQ ID NO: 2752817 - RNA, 23 nt, Human
cacugggguguguggcagagcca

SEQ ID NO: 2752818 - RNA, 13 nt, Human
cacuguaaaauaa

SEQ ID NO: 2752819 - RNA, 17 nt, Human
cacuguaaaauguggga

SEQ ID NO: 2752820 - RNA, 18 nt, Human
cacuguacuugcucuuga

SEQ ID NO: 2752821 - RNA, 20 nt, Human
cacuguacuugcucuugaug

SEQ ID NO: 2752822 - RNA, 19 nt, Human
cacuguagcauuacagugg

SEQ ID NO: 2752823 - RNA, 21 nt, Human
cacuguagcauuacagugggu

SEQ ID NO: 2752824 - RNA, 15 nt, Human
cacugucaagaugau

SEQ ID NO: 2752825 - RNA, 14 nt, Human
cacuguccauucuu

SEQ ID NO: 2752826 - RNA, 19 nt, Human
cacugucugcccccguucc

SEQ ID NO: 2752827 - RNA, 20 nt, Human
cacugugggaaggagacaaa

SEQ ID NO: 2752828 - RNA, 20 nt, Human
cacuguggguagacacacau

SEQ ID NO: 2752829 - RNA, 22 nt, Human
cacugugguuaguguaauaaaa

SEQ ID NO: 2752830 - RNA, 16 nt, Human
cacuguguauuuaacu

SEQ ID NO: 2752831 - RNA, 16 nt, Human
cacuguuaucaaaacu

SEQ ID NO: 2752832 - RNA, 16 nt, Human
cacuguuaucuucacu

SEQ ID NO: 2752833 - RNA, 14 nt, Human
cacuuaaaaauggu

SEQ ID NO: 2752834 - RNA, 15 nt, Human
cacuuaaaaaugguu

SEQ ID NO: 2752835 - RNA, 18 nt, Human
cacuuaccuugcaucuca

SEQ ID NO: 2752836 - RNA, 13 nt, Human
cacuuauaggaau

SEQ ID NO: 2752837 - RNA, 23 nt, Human
cacuucaccaauaaguauucugu

SEQ ID NO: 2752838 - RNA, 16 nt, Human
cacuucagccucccaa

SEQ ID NO: 2752839 - RNA, 22 nt, Human
cacuuccaagagccuuuuuuug

SEQ ID NO: 2752840 - RNA, 18 nt, Human
cacuuccucccggccgcg

SEQ ID NO: 2752841 - RNA, 21 nt, Human
cacuucuuacaauaauucuau

SEQ ID NO: 2752842 - RNA, 17 nt, Human
cacuugaacccgggagg

SEQ ID NO: 2752843 - RNA, 18 nt, Human
cacuugccauaaaacuua

SEQ ID NO: 2752844 - RNA, 15 nt, Human
cacuugcuuuuaaaa

SEQ ID NO: 2752845 - RNA, 14 nt, Human
cacuuggacauggg

SEQ ID NO: 2752846 - RNA, 22 nt, Human
cacuuggacaugggccccagau

SEQ ID NO: 2752847 - RNA, 23 nt, Human
cacuuggagccaaggguucagag

SEQ ID NO: 2752848 - RNA, 19 nt, Human
cacuuggcugcauaaaugu

SEQ ID NO: 2752849 - RNA, 20 nt, Human
cacuugggacaaaaacaaac

SEQ ID NO: 2752850 - RNA, 15 nt, Human
cacuuggucugugag

SEQ ID NO: 2752851 - RNA, 14 nt, Human
cacuugguucagua

SEQ ID NO: 2752852 - RNA, 12 nt, Human
cacuugucaaua

SEQ ID NO: 2752853 - RNA, 19 nt, Human
cacuuguguuuugcaagcc

SEQ ID NO: 2752854 - RNA, 22 nt, Human
cacuuguguuuugcaagccaga

SEQ ID NO: 2752855 - RNA, 15 nt, Human
cacuuuaacacagug

SEQ ID NO: 2752856 - RNA, 19 nt, Human
cacuuuaacacagugucug

SEQ ID NO: 2752857 - RNA, 21 nt, Human
cacuuuaacacagugucuggc

SEQ ID NO: 2752858 - RNA, 17 nt, Human
cacuuuauauuauuuug

SEQ ID NO: 2752859 - RNA, 19 nt, Human
cacuuuauauuauuuugaa

SEQ ID NO: 2752860 - RNA, 16 nt, Human
cacuuuccaauaaaga

SEQ ID NO: 2752861 - RNA, 17 nt, Human
cacuuuccaauaaagag

SEQ ID NO: 2752862 - RNA, 13 nt, Human
cacuuucccucuu

SEQ ID NO: 2752863 - RNA, 13 nt, Human
cacuuugaagagu

SEQ ID NO: 2752864 - RNA, 21 nt, Human
cacuuugcauaacguauaaaa

SEQ ID NO: 2752865 - RNA, 18 nt, Human
cacuuuuauaagaaauag

SEQ ID NO: 2752866 - RNA, 12 nt, Human
cagaaaaagcau

SEQ ID NO: 2752867 - RNA, 20 nt, Human
cagaaaaccuaagcaaacuu

SEQ ID NO: 2752868 - RNA, 20 nt, Human
cagaaacaucaguuacucug

SEQ ID NO: 2752869 - RNA, 13 nt, Human
cagaaacuccugu

SEQ ID NO: 2752870 - RNA, 14 nt, Human
cagaaagaaaacuu

SEQ ID NO: 2752871 - RNA, 16 nt, Human
cagaaagaaaacuugu

SEQ ID NO: 2752872 - RNA, 19 nt, Human
cagaaagcagaacagugau

SEQ ID NO: 2752873 - RNA, 18 nt, Human
cagaaaugcugucauaau

SEQ ID NO: 2752874 - RNA, 19 nt, Human
cagaaauuuaauucauguu

SEQ ID NO: 2752875 - RNA, 15 nt, Human
cagaacuauggaaaa

SEQ ID NO: 2752876 - RNA, 17 nt, Human
cagaacuuaaggaugga

SEQ ID NO: 2752877 - RNA, 16 nt, Human
cagaagaaauucugca

SEQ ID NO: 2752878 - RNA, 14 nt, Human
cagaagaaggaaau

SEQ ID NO: 2752879 - RNA, 18 nt, Human
cagaagcuccagguagag

SEQ ID NO: 2752880 - RNA, 22 nt, Human
cagaagcuuccauuccaagccu

SEQ ID NO: 2752881 - RNA, 13 nt, Human
cagaaggccaaga

SEQ ID NO: 2752882 - RNA, 18 nt, Human
cagaaggccaagaggcug

SEQ ID NO: 2752883 - RNA, 13 nt, Human
cagaagucaaggc

SEQ ID NO: 2752884 - RNA, 14 nt, Human
cagaaucaugcuga

SEQ ID NO: 2752885 - RNA, 17 nt, Human
cagaaucaugcugagag

SEQ ID NO: 2752886 - RNA, 16 nt, Human
cagaaucucucuucuu

SEQ ID NO: 2752887 - RNA, 20 nt, Human
cagaaucucucuucuuuuca

SEQ ID NO: 2752888 - RNA, 23 nt, Human
cagaaugauuuuacggagauauc

SEQ ID NO: 2752889 - RNA, 15 nt, Human
cagacacaaauaaag

SEQ ID NO: 2752890 - RNA, 12 nt, Human
cagacacaugug

SEQ ID NO: 2752891 - RNA, 17 nt, Human
cagacacaugugcuggc

SEQ ID NO: 2752892 - RNA, 19 nt, Human
cagacacaugugcuggcca

SEQ ID NO: 2752893 - RNA, 21 nt, Human
cagacacaugugcuggccacc

SEQ ID NO: 2752894 - RNA, 22 nt, Human
cagacacaugugcuggccaccu

SEQ ID NO: 2752895 - RNA, 15 nt, Human
cagacagaacuugaa

SEQ ID NO: 2752896 - RNA, 12 nt, Human
cagacagcagcu

SEQ ID NO: 2752897 - RNA, 22 nt, Human
cagacagcagcucaggcacacu

SEQ ID NO: 2752898 - RNA, 16 nt, Human
cagacaugagagacag

SEQ ID NO: 2752899 - RNA, 23 nt, Human
cagacaugagagacagcaggucu

SEQ ID NO: 2752900 - RNA, 18 nt, Human
cagaccagcaggcuggcc

SEQ ID NO: 2752901 - RNA, 20 nt, Human
cagaccagcaggcuggccua

SEQ ID NO: 2752902 - RNA, 14 nt, Human
cagaccgggguucc

SEQ ID NO: 2752903 - RNA, 16 nt, Human
cagacgugugcaguug

SEQ ID NO: 2752904 - RNA, 19 nt, Human
cagacucacugugggaagg

SEQ ID NO: 2752905 - RNA, 17 nt, Human
cagacucuaagaaagaa

SEQ ID NO: 2752906 - RNA, 19 nt, Human
cagacucuggucaagaagc

SEQ ID NO: 2752907 - RNA, 20 nt, Human
cagacuuuuuuuuuuuauaa

SEQ ID NO: 2752908 - RNA, 22 nt, Human
cagacuuuuuuuuuuuuuuaaa

SEQ ID NO: 2752909 - RNA, 21 nt, Human
cagagaaacaauggcuaagau

SEQ ID NO: 2752910 - RNA, 14 nt, Human
cagagaaguuuucu

SEQ ID NO: 2752911 - RNA, 20 nt, Human
cagagacgggguuugccaug

SEQ ID NO: 2752912 - RNA, 15 nt, Human
cagagacucagggcc

SEQ ID NO: 2752913 - RNA, 16 nt, Human
cagagacucagggccc

SEQ ID NO: 2752914 - RNA, 13 nt, Human
cagagacugcucc

SEQ ID NO: 2752915 - RNA, 14 nt, Human
cagagacugggacu

SEQ ID NO: 2752916 - RNA, 19 nt, Human
cagagaugaggccgccaug

SEQ ID NO: 2752917 - RNA, 12 nt, Human
cagagccacagu

SEQ ID NO: 2752918 - RNA, 17 nt, Human
cagagccaccugacucu

SEQ ID NO: 2752919 - RNA, 20 nt, Human
cagagccaggacccaggagg

SEQ ID NO: 2752920 - RNA, 14 nt, Human
cagagccuccuuuc

SEQ ID NO: 2752921 - RNA, 18 nt, Human
cagagccucgaggaggua

SEQ ID NO: 2752922 - RNA, 14 nt, Human
cagagcgcacaggg

SEQ ID NO: 2752923 - RNA, 16 nt, Human
cagagcuacaggcccc

SEQ ID NO: 2752924 - RNA, 19 nt, Human
cagagcuacccgcagaguu

SEQ ID NO: 2752925 - RNA, 22 nt, Human
cagagcugcccucuccugggca

SEQ ID NO: 2752926 - RNA, 14 nt, Human
cagaggcucuaaug

SEQ ID NO: 2752927 - RNA, 18 nt, Human
cagaggggcccaugaaag

SEQ ID NO: 2752928 - RNA, 21 nt, Human
cagagguccacaacacacaga

SEQ ID NO: 2752929 - RNA, 23 nt, Human
cagagguugcagugagccgagau

SEQ ID NO: 2752930 - RNA, 18 nt, Human
cagaguacuggcugaugg

SEQ ID NO: 2752931 - RNA, 16 nt, Human
cagagucaaugaacuu

SEQ ID NO: 2752932 - RNA, 23 nt, Human
cagagucuuacucuguugccagg

SEQ ID NO: 2752933 - RNA, 19 nt, Human
cagagucuuccucugucuc

SEQ ID NO: 2752934 - RNA, 21 nt, Human
cagagucuuccucugucuccu

SEQ ID NO: 2752935 - RNA, 20 nt, Human
cagaguucuauaauguaaac

SEQ ID NO: 2752936 - RNA, 21 nt, Human
cagaguucuauaauguaaaca

SEQ ID NO: 2752937 - RNA, 19 nt, Human
cagaguuuucauguauuuu

SEQ ID NO: 2752938 - RNA, 21 nt, Human
cagauacagggaugaggcaga

SEQ ID NO: 2752939 - RNA, 18 nt, Human
cagauagguuaccaguaa

SEQ ID NO: 2752940 - RNA, 11 nt, Human
cagauauaaaa

SEQ ID NO: 2752941 - RNA, 18 nt, Human
cagauaugauucaaaugu

SEQ ID NO: 2752942 - RNA, 18 nt, Human
cagaucaagccugccuca

SEQ ID NO: 2752943 - RNA, 16 nt, Human
cagaucacagcuucag

SEQ ID NO: 2752944 - RNA, 23 nt, Human
cagaucacuugagcucaggaggu

SEQ ID NO: 2752945 - RNA, 21 nt, Human
cagaucauugugaaauuauuc

SEQ ID NO: 2752946 - RNA, 14 nt, Human
cagauccccaagcc

SEQ ID NO: 2752947 - RNA, 16 nt, Human
cagauccccaagccug

SEQ ID NO: 2752948 - RNA, 20 nt, Human
cagaucuaugccacaagaac

SEQ ID NO: 2752949 - RNA, 17 nt, Human
cagaugagaagucugcu

SEQ ID NO: 2752950 - RNA, 23 nt, Human
cagaugagaagucugcuacccuc

SEQ ID NO: 2752951 - RNA, 19 nt, Human
cagaugagaguacacccca

SEQ ID NO: 2752952 - RNA, 19 nt, Human
cagaugcacaugagcuggc

SEQ ID NO: 2752953 - RNA, 23 nt, Human
cagaugggagugcccccaacagc

SEQ ID NO: 2752954 - RNA, 20 nt, Human
cagauguaaaagacuuuuuu

SEQ ID NO: 2752955 - RNA, 20 nt, Human
cagauguucacccaaccaca

SEQ ID NO: 2752956 - RNA, 21 nt, Human
cagauuuaugcauauuauuuu

SEQ ID NO: 2752957 - RNA, 18 nt, Human
cagauuugagcucagccc

SEQ ID NO: 2752958 - RNA, 17 nt, Human
cagauuugcaaaguuua

SEQ ID NO: 2752959 - RNA, 11 nt, Human
cagcaaauucg

SEQ ID NO: 2752960 - RNA, 21 nt, Human
cagcaacuuguguuccuaaca

SEQ ID NO: 2752961 - RNA, 21 nt, Human
caggaguacaccccaacagca

SEQ ID NO: 2752962 - RNA, 15 nt, Human
caggaguauccucuu

SEQ ID NO: 2752963 - RNA, 19 nt, Human
caggaguauccucuugcca

SEQ ID NO: 2752964 - RNA, 20 nt, Human
caggaguuccuaaccagccu

SEQ ID NO: 2752965 - RNA, 22 nt, Human
caggaguuccuaaccagccugg

SEQ ID NO: 2752966 - RNA, 23 nt, Human
caggaguuccuaaccagccuggu

SEQ ID NO: 2752967 - RNA, 20 nt, Human
caggaguucucccaccaccu

SEQ ID NO: 2752968 - RNA, 14 nt, Human
caggaguuuggcca

SEQ ID NO: 2752969 - RNA, 17 nt, Human
caggaguuuggccagaa

SEQ ID NO: 2752970 - RNA, 21 nt, Human
caggauauccucccuccagau

SEQ ID NO: 2752971 - RNA, 15 nt, Human
caggaugagggaaaa

SEQ ID NO: 2752972 - RNA, 15 nt, Human
caggauggcaggagg

SEQ ID NO: 2752973 - RNA, 16 nt, Human
caggauggcgcaggaa

SEQ ID NO: 2752974 - RNA, 17 nt, Human
caggauggcuuugaaug

SEQ ID NO: 2752975 - RNA, 19 nt, Human
caggaugguggcaggaaaa

SEQ ID NO: 2752976 - RNA, 16 nt, Human
caggcaaaaggaagca

SEQ ID NO: 2752977 - RNA, 20 nt, Human
caggcaaaaggaagcagggu

SEQ ID NO: 2752978 - RNA, 15 nt, Human
caggcaaauuccuga

SEQ ID NO: 2752979 - RNA, 14 nt, Human
caggcacagcagcu

SEQ ID NO: 2752980 - RNA, 18 nt, Human
caggcacaguggcucaca

SEQ ID NO: 2752981 - RNA, 18 nt, Human
caggcaccaggacuaggg

SEQ ID NO: 2752982 - RNA, 15 nt, Human
caggcacccccagaa

SEQ ID NO: 2752983 - RNA, 14 nt, Human
caggcagcaggaua

SEQ ID NO: 2752984 - RNA, 15 nt, Human
caggcagcuuuuucu

SEQ ID NO: 2752985 - RNA, 13 nt, Human
caggcaggaacaa

SEQ ID NO: 2752986 - RNA, 20 nt, Human
caggcaggaacaaacagggc

SEQ ID NO: 2752987 - RNA, 11 nt, Human
caggcauggug

SEQ ID NO: 2752988 - RNA, 12 nt, Human
caggcauggugg

SEQ ID NO: 2752989 - RNA, 23 nt, Human
caggcauggugguuuacgccuau

SEQ ID NO: 2752990 - RNA, 16 nt, Human
caggccccaucugguc

SEQ ID NO: 2752991 - RNA, 22 nt, Human
caggcccuccuugucuuuuuac

SEQ ID NO: 2752992 - RNA, 15 nt, Human
caggccucacacaca

SEQ ID NO: 2752993 - RNA, 18 nt, Human
caggcggguccgggucgc

SEQ ID NO: 2752994 - RNA, 22 nt, Human
caggcgugaccugacagcccaa

SEQ ID NO: 2752995 - RNA, 17 nt, Human
caggcgugaccugccag

SEQ ID NO: 2752996 - RNA, 19 nt, Human
caggcgugagccaccaaac

SEQ ID NO: 2752997 - RNA, 14 nt, Human
caggcuagauguau

SEQ ID NO: 2752998 - RNA, 17 nt, Human
caggcuagauguaugua

SEQ ID NO: 2752999 - RNA, 21 nt, Human
caggcuccaaacuggagcuug

SEQ ID NO: 2753000 - RNA, 20 nt, Human
caggcugagccucagucucc

SEQ ID NO: 2753001 - RNA, 17 nt, Human
caggcugcucagggcug

SEQ ID NO: 2753002 - RNA, 17 nt, Human
caggcuggagugcagug

SEQ ID NO: 2753003 - RNA, 17 nt, Human
caggcuggcaccgcugu

SEQ ID NO: 2753004 - RNA, 17 nt, Human
caggcuggcgugcagca

SEQ ID NO: 2753005 - RNA, 20 nt, Human
caggcuggcgugcagcauca

SEQ ID NO: 2753006 - RNA, 21 nt, Human
caggcugggucgcccuggacu

SEQ ID NO: 2753007 - RNA, 18 nt, Human
caggcuugaaucaaagaa

SEQ ID NO: 2753008 - RNA, 16 nt, Human
cagggacuugaaccca

SEQ ID NO: 2753009 - RNA, 13 nt, Human
cagggaggacgcu

SEQ ID NO: 2753010 - RNA, 14 nt, Human
cagggaggacgcuc

SEQ ID NO: 2753011 - RNA, 18 nt, Human
cagggaggacgcucucug

SEQ ID NO: 2753012 - RNA, 14 nt, Human
cagggagguggcug

SEQ ID NO: 2753013 - RNA, 18 nt, Human
cagggagucucagcuuca

SEQ ID NO: 2753014 - RNA, 22 nt, Human
cagggaugaggcagaccugacu

SEQ ID NO: 2753015 - RNA, 22 nt, Human
cagggaugaugcaacauccuug

SEQ ID NO: 2753016 - RNA, 12 nt, Human
cagggcauggcu

SEQ ID NO: 2753017 - RNA, 16 nt, Human
cagggccacauagaug

SEQ ID NO: 2753018 - RNA, 19 nt, Human
cagggccuggggagaugga

SEQ ID NO: 2753019 - RNA, 17 nt, Human
cagggccuguaauccca

SEQ ID NO: 2753020 - RNA, 19 nt, Human
cagggcuacgcgcgcuccg

SEQ ID NO: 2753021 - RNA, 16 nt, Human
cagggcucacagaauu

SEQ ID NO: 2753022 - RNA, 17 nt, Human
cagggcugaagcugugu

SEQ ID NO: 2753023 - RNA, 14 nt, Human
cagggcugucuucg

SEQ ID NO: 2753024 - RNA, 15 nt, Human
caggguuuauguuua

SEQ ID NO: 2753025 - RNA, 14 nt, Human
caggguuucaccau

SEQ ID NO: 2753026 - RNA, 16 nt, Human
caggguuucaccaugu

SEQ ID NO: 2753027 - RNA, 15 nt, Human
cagguaaaacagggc

SEQ ID NO: 2753028 - RNA, 23 nt, Human
cagguaaccccagauucaugcac

SEQ ID NO: 2753029 - RNA, 18 nt, Human
cagguaccuucucaccug

SEQ ID NO: 2753030 - RNA, 19 nt, Human
cagguaccuucucaccugu

SEQ ID NO: 2753031 - RNA, 20 nt, Human
cagguaccuucucaccugug

SEQ ID NO: 2753032 - RNA, 22 nt, Human
cagguaccuucucaccugugag

SEQ ID NO: 2753033 - RNA, 19 nt, Human
cagguaggaggcaaauauc

SEQ ID NO: 2753034 - RNA, 18 nt, Human
cagguauaccucacuuua

SEQ ID NO: 2753035 - RNA, 22 nt, Human
cagguauaccucacuuuacaca

SEQ ID NO: 2753036 - RNA, 20 nt, Human
cagguauccaaaaaugugua

SEQ ID NO: 2753037 - RNA, 19 nt, Human
caggucccuaauaaagcug

SEQ ID NO: 2753038 - RNA, 22 nt, Human
caggucccuaauaaagcugugu

SEQ ID NO: 2753039 - RNA, 20 nt, Human
caggugacccugaugaaaac

SEQ ID NO: 2753040 - RNA, 20 nt, Human
cagguguguugcagugucug

SEQ ID NO: 2753041 - RNA, 19 nt, Human
cagguucaagcaauccucc

SEQ ID NO: 2753042 - RNA, 20 nt, Human
cagguucaagcaauccuccc

SEQ ID NO: 2753043 - RNA, 21 nt, Human
cagguucaagcaauccuccca

SEQ ID NO: 2753044 - RNA, 23 nt, Human
cagguucuuucuuuaaagcagga

SEQ ID NO: 2753045 - RNA, 16 nt, Human
cagguuggagugcagu

SEQ ID NO: 2753046 - RNA, 13 nt, Human
caguaaaauccac

SEQ ID NO: 2753047 - RNA, 22 nt, Human
caguaccuagcuggcucuguga

SEQ ID NO: 2753048 - RNA, 23 nt, Human
caguagaaugggggcagcaccuc

SEQ ID NO: 2753049 - RNA, 16 nt, Human
caguagaugccaccca

SEQ ID NO: 2753050 - RNA, 13 nt, Human
caguagcuggagg

SEQ ID NO: 2753051 - RNA, 14 nt, Human
caguagcuggaggg

SEQ ID NO: 2753052 - RNA, 16 nt, Human
caguagucagacugga

SEQ ID NO: 2753053 - RNA, 21 nt, Human
caguaguuagcuuucuuccug

SEQ ID NO: 2753054 - RNA, 20 nt, Human
caguauauuucccuguuucu

SEQ ID NO: 2753055 - RNA, 14 nt, Human
caguaugaaaauaa

SEQ ID NO: 2753056 - RNA, 21 nt, Human
caguauucccuuuugcugccu

SEQ ID NO: 2753057 - RNA, 15 nt, Human
caguauuguuccuuu

SEQ ID NO: 2753058 - RNA, 20 nt, Human
caguauuguuccuuuugugg

SEQ ID NO: 2753059 - RNA, 15 nt, Human
cagucaccucaugga

SEQ ID NO: 2753060 - RNA, 14 nt, Human
cagucagaagaccu

SEQ ID NO: 2753061 - RNA, 15 nt, Human
cagucaggaaagaga

SEQ ID NO: 2753062 - RNA, 18 nt, Human
cagucagggacagacaua

SEQ ID NO: 2753063 - RNA, 19 nt, Human
cagucauucagauaugauu

SEQ ID NO: 2753064 - RNA, 18 nt, Human
caguccauugggcaggca

SEQ ID NO: 2753065 - RNA, 20 nt, Human
cagucccugcagcucucuuu

SEQ ID NO: 2753066 - RNA, 17 nt, Human
caguccucuuucaaagg

SEQ ID NO: 2753067 - RNA, 21 nt, Human
cagucucaggaaaucaaauau

SEQ ID NO: 2753068 - RNA, 14 nt, Human
cagucucccucccu

SEQ ID NO: 2753069 - RNA, 15 nt, Human
cagucucccucccuu

SEQ ID NO: 2753070 - RNA, 18 nt, Human
cagucucccucccuuggg

SEQ ID NO: 2753071 - RNA, 17 nt, Human
cagucucuugaggcaca

SEQ ID NO: 2753072 - RNA, 13 nt, Human
cagucugaugaga

SEQ ID NO: 2753073 - RNA, 14 nt, Human
cagucugaugagaa

SEQ ID NO: 2753074 - RNA, 14 nt, Human
cagucugucaccca

SEQ ID NO: 2753075 - RNA, 23 nt, Human
cagucuuccucccuguguauuca

SEQ ID NO: 2753076 - RNA, 11 nt, Human
cagucuuuucc

SEQ ID NO: 2753077 - RNA, 15 nt, Human
cagugaaagaaaaua

SEQ ID NO: 2753078 - RNA, 17 nt, Human
cagugaaagaaaauaac

SEQ ID NO: 2753079 - RNA, 19 nt, Human
cagugaaagaaaauaacaa

SEQ ID NO: 2753080 - RNA, 20 nt, Human
cagugaaagaaaauaacgau

SEQ ID NO: 2753081 - RNA, 22 nt, Human
cagugacagcagucagggacag

SEQ ID NO: 2753082 - RNA, 20 nt, Human
cagugagacucugucucagu

SEQ ID NO: 2753083 - RNA, 19 nt, Human
cagugagccaaauguaaaa

SEQ ID NO: 2753084 - RNA, 22 nt, Human
cagugagccaaauguaaaauag

SEQ ID NO: 2753085 - RNA, 22 nt, Human
cagugagccgagauugugcccc

SEQ ID NO: 2753086 - RNA, 21 nt, Human
cagugaugucacuagggcagg

SEQ ID NO: 2753087 - RNA, 14 nt, Human
cagugauuaccagg

SEQ ID NO: 2753088 - RNA, 20 nt, Human
cagugauuaccagggacuga

SEQ ID NO: 2753089 - RNA, 23 nt, Human
cagugcaccugucauaugcucug

SEQ ID NO: 2753090 - RNA, 17 nt, Human
cagugcuugaaugaagu

SEQ ID NO: 2753091 - RNA, 13 nt, Human
cagugcuuggccc

SEQ ID NO: 2753092 - RNA, 16 nt, Human
cagugcuuggcccagg

SEQ ID NO: 2753093 - RNA, 20 nt, Human
cagugcuuggcccaggaguu

SEQ ID NO: 2753094 - RNA, 15 nt, Human
cagugcuuuaauggc

SEQ ID NO: 2753095 - RNA, 14 nt, Human
cagugcuuuccgug

SEQ ID NO: 2753096 - RNA, 19 nt, Human
caguggacaccaggagucc

SEQ ID NO: 2753097 - RNA, 21 nt, Human
caguggcgcgaucucagcuca

SEQ ID NO: 2753098 - RNA, 18 nt, Human
cagugggagccagggcug

SEQ ID NO: 2753099 - RNA, 19 nt, Human
cagugggagccagggcugu

SEQ ID NO: 2753100 - RNA, 22 nt, Human
cagugggagccagggcugucuu

SEQ ID NO: 2753101 - RNA, 20 nt, Human
cagugggugccccccuugcc

SEQ ID NO: 2753102 - RNA, 18 nt, Human
caguguacagucuuguau

SEQ ID NO: 2753103 - RNA, 16 nt, Human
cagugucaaugcagcc

SEQ ID NO: 2753104 - RNA, 18 nt, Human
cagugucaaugcagcccc

SEQ ID NO: 2753105 - RNA, 14 nt, Human
cauccugugggacc

SEQ ID NO: 2753106 - RNA, 17 nt, Human
cauccugugggaccugg

SEQ ID NO: 2753107 - RNA, 16 nt, Human
cauccuuccucacacc

SEQ ID NO: 2753108 - RNA, 13 nt, Human
caucgcagacaca

SEQ ID NO: 2753109 - RNA, 17 nt, Human
caucgcagacacaugug

SEQ ID NO: 2753110 - RNA, 23 nt, Human
caucgcagacacaugugcuggcc

SEQ ID NO: 2753111 - RNA, 14 nt, Human
caucgcagauucuc

SEQ ID NO: 2753112 - RNA, 20 nt, Human
caucuagaggcuuccuucau

SEQ ID NO: 2753113 - RNA, 16 nt, Human
caucuagcaaauguua

SEQ ID NO: 2753114 - RNA, 22 nt, Human
caucuagcaugucgucaaagcu

SEQ ID NO: 2753115 - RNA, 11 nt, Human
caucuagugag

SEQ ID NO: 2753116 - RNA, 23 nt, Human
caucuagugagcagucaggaaag

SEQ ID NO: 2753117 - RNA, 14 nt, Human
caucucagcucacu

SEQ ID NO: 2753118 - RNA, 20 nt, Human
caucucagcucacugcaacc

SEQ ID NO: 2753119 - RNA, 14 nt, Human
caucucccaugaag

SEQ ID NO: 2753120 - RNA, 16 nt, Human
caucuccucagcaccc

SEQ ID NO: 2753121 - RNA, 22 nt, Human
caucucuucuggguuccuuccu

SEQ ID NO: 2753122 - RNA, 21 nt, Human
caucugagaaaagcuuugaac

SEQ ID NO: 2753123 - RNA, 13 nt, Human
caucugagccccg

SEQ ID NO: 2753124 - RNA, 14 nt, Human
caucugauugugau

SEQ ID NO: 2753125 - RNA, 14 nt, Human
caucugcagcucuu

SEQ ID NO: 2753126 - RNA, 14 nt, Human
caucugccuccccu

SEQ ID NO: 2753127 - RNA, 18 nt, Human
caucugucaccaagccuu

SEQ ID NO: 2753128 - RNA, 16 nt, Human
caucuugcagcauuua

SEQ ID NO: 2753129 - RNA, 13 nt, Human
caucuuucacauu

SEQ ID NO: 2753130 - RNA, 22 nt, Human
caugaaccucaagcugcaucua

SEQ ID NO: 2753131 - RNA, 14 nt, Human
caugaacuuguaaa

SEQ ID NO: 2753132 - RNA, 13 nt, Human
caugaagacagag

SEQ ID NO: 2753133 - RNA, 17 nt, Human
caugaagacagagcccc

SEQ ID NO: 2753134 - RNA, 18 nt, Human
caugaagacagagcccca

SEQ ID NO: 2753135 - RNA, 18 nt, Human
caugaagagauuuuucau

SEQ ID NO: 2753136 - RNA, 13 nt, Human
caugaagauauuu

SEQ ID NO: 2753137 - RNA, 15 nt, Human
caugaagcuguugug

SEQ ID NO: 2753138 - RNA, 17 nt, Human
caugaaguccaagcauu

SEQ ID NO: 2753139 - RNA, 18 nt, Human
caugaaguccaagcauuu

SEQ ID NO: 2753140 - RNA, 23 nt, Human
caugaauauuuaguguucauaaa

SEQ ID NO: 2753141 - RNA, 13 nt, Human
caugaauguaaau

SEQ ID NO: 2753142 - RNA, 18 nt, Human
caugaauuaguuuuauau

SEQ ID NO: 2753143 - RNA, 12 nt, Human
caugaauucugu

SEQ ID NO: 2753144 - RNA, 18 nt, Human
caugagaccacuguuauc

SEQ ID NO: 2753145 - RNA, 20 nt, Human
caugagagacagcaggucuc

SEQ ID NO: 2753146 - RNA, 13 nt, Human
caugagguacuga

SEQ ID NO: 2753147 - RNA, 22 nt, Human
caugaguaacugauuuguaaca

SEQ ID NO: 2753148 - RNA, 17 nt, Human
caugagucacuacgccu

SEQ ID NO: 2753149 - RNA, 23 nt, Human
caugaguuacacuggaugaaaau

SEQ ID NO: 2753150 - RNA, 15 nt, Human
caugauuauuauuuu

SEQ ID NO: 2753151 - RNA, 23 nt, Human
caugauucauuuuaacaucugag

SEQ ID NO: 2753152 - RNA, 19 nt, Human
caugauuuggggaaaggag

SEQ ID NO: 2753153 - RNA, 23 nt, Human
caugcaaacuuuauuuuguguuu

SEQ ID NO: 2753154 - RNA, 17 nt, Human
caugcacuuccuugcuu

SEQ ID NO: 2753155 - RNA, 14 nt, Human
caugcacuuggcug

SEQ ID NO: 2753156 - RNA, 16 nt, Human
caugcauuguccucuu

SEQ ID NO: 2753157 - RNA, 18 nt, Human
caugcccaagaaugagaa

SEQ ID NO: 2753158 - RNA, 21 nt, Human
caugcccauaccccuggccaa

SEQ ID NO: 2753159 - RNA, 18 nt, Human
caugccccuguacuccag

SEQ ID NO: 2753160 - RNA, 17 nt, Human
caugcgccaccauggcc

SEQ ID NO: 2753161 - RNA, 13 nt, Human
caugcggcccagg

SEQ ID NO: 2753162 - RNA, 15 nt, Human
caugcugcuggggaa

SEQ ID NO: 2753163 - RNA, 20 nt, Human
caugcugcuggggaagacag

SEQ ID NO: 2753164 - RNA, 16 nt, Human
caugcuggagugcagu

SEQ ID NO: 2753165 - RNA, 21 nt, Human
caugcuggccaggcuggucuc

SEQ ID NO: 2753166 - RNA, 16 nt, Human
caugcuugcauaagag

SEQ ID NO: 2753167 - RNA, 12 nt, Human
caugcuuuuuaa

SEQ ID NO: 2753168 - RNA, 13 nt, Human
cauggaaaaguuu

SEQ ID NO: 2753169 - RNA, 13 nt, Human
cauggaauuggag

SEQ ID NO: 2753170 - RNA, 17 nt, Human
cauggaauuggagcucg

SEQ ID NO: 2753171 - RNA, 18 nt, Human
cauggaauuggagcucgu

SEQ ID NO: 2753172 - RNA, 20 nt, Human
cauggaauuggagcucgugg

SEQ ID NO: 2753173 - RNA, 17 nt, Human
cauggagucacagccac

SEQ ID NO: 2753174 - RNA, 22 nt, Human
cauggauacagccaggcccaga

SEQ ID NO: 2753175 - RNA, 19 nt, Human
cauggccacaucugagccc

SEQ ID NO: 2753176 - RNA, 13 nt, Human
caugggaagugac

SEQ ID NO: 2753177 - RNA, 16 nt, Human
caugggacagggagga

SEQ ID NO: 2753178 - RNA, 21 nt, Human
caugggacagggaggacgcuc

SEQ ID NO: 2753179 - RNA, 22 nt, Human
caugggacagggaggacgcucu

SEQ ID NO: 2753180 - RNA, 21 nt, Human
caugggacauuugcucaugga

SEQ ID NO: 2753181 - RNA, 16 nt, Human
caugggagacacugau

SEQ ID NO: 2753182 - RNA, 13 nt, Human
caugggccccaga

SEQ ID NO: 2753183 - RNA, 14 nt, Human
caugggccccagau

SEQ ID NO: 2753184 - RNA, 16 nt, Human
cauggguuuuauuaua

SEQ ID NO: 2753185 - RNA, 16 nt, Human
cauggugaaaccccgu

SEQ ID NO: 2753186 - RNA, 13 nt, Human
cauggugaaaccu

SEQ ID NO: 2753187 - RNA, 18 nt, Human
cauggugaaaccuggucu

SEQ ID NO: 2753188 - RNA, 22 nt, Human
cauggugcucagagcaguguuu

SEQ ID NO: 2753189 - RNA, 16 nt, Human
caugguuuagaaagcu

SEQ ID NO: 2753190 - RNA, 21 nt, Human
cauguaaaauaugucuuucuu

SEQ ID NO: 2753191 - RNA, 14 nt, Human
cauguaauugcuug

SEQ ID NO: 2753192 - RNA, 23 nt, Human
cauguacauagcuugauaaaggg

SEQ ID NO: 2753193 - RNA, 15 nt, Human
cauguacauccaugg

SEQ ID NO: 2753194 - RNA, 17 nt, Human
cauguacugauuacugc

SEQ ID NO: 2753195 - RNA, 18 nt, Human
cauguagcuacaggacau

SEQ ID NO: 2753196 - RNA, 19 nt, Human
cauguaugacgugacuggc

SEQ ID NO: 2753197 - RNA, 17 nt, Human
cauguauuuauuuuuuu

SEQ ID NO: 2753198 - RNA, 22 nt, Human
cauguauuuauuuuuuuacuuc

SEQ ID NO: 2753199 - RNA, 15 nt, Human
cauguauuuggugau

SEQ ID NO: 2753200 - RNA, 11 nt, Human
cauguauuuua

SEQ ID NO: 2753201 - RNA, 16 nt, Human
cauguauuuuaaaaua

SEQ ID NO: 2753202 - RNA, 22 nt, Human
caugucagcaaguccuaagccu

SEQ ID NO: 2753203 - RNA, 15 nt, Human
cauguccacugguuc

SEQ ID NO: 2753204 - RNA, 17 nt, Human
caugucuagagaacacu

SEQ ID NO: 2753205 - RNA, 22 nt, Human
caugucuagagaacacugugcu

SEQ ID NO: 2753206 - RNA, 20 nt, Human
caugugaaaucauucauuuu

SEQ ID NO: 2753207 - RNA, 19 nt, Human
caugugcuaguaauuggaa

SEQ ID NO: 2753208 - RNA, 17 nt, Human
caugugcuggccaccug

SEQ ID NO: 2753209 - RNA, 16 nt, Human
caugugucuucugccc

SEQ ID NO: 2753210 - RNA, 16 nt, Human
cauguguuuacuuuau

SEQ ID NO: 2753211 - RNA, 12 nt, Human
cauguuccccuu

SEQ ID NO: 2753212 - RNA, 18 nt, Human
cauguuccccuugggggu

SEQ ID NO: 2753213 - RNA, 16 nt, Human
cauguucuaaauaaaa

SEQ ID NO: 2753214 - RNA, 14 nt, Human
cauguuggccaggc

SEQ ID NO: 2753215 - RNA, 18 nt, Human
cauguuggcuagccucug

SEQ ID NO: 2753216 - RNA, 20 nt, Human
cauguuuaagaaauuuuugc

SEQ ID NO: 2753217 - RNA, 21 nt, Human
cauguuucuuuguaaugaaaa

SEQ ID NO: 2753218 - RNA, 22 nt, Human
cauguuucuuuguaaugaaaac

SEQ ID NO: 2753219 - RNA, 13 nt, Human
cauuaaaauguua

SEQ ID NO: 2753220 - RNA, 14 nt, Human
cauuaaaguucuag

SEQ ID NO: 2753221 - RNA, 15 nt, Human
cauuaaaguucuagu

SEQ ID NO: 2753222 - RNA, 22 nt, Human
cauuaaauggaaguaaauguug

SEQ ID NO: 2753223 - RNA, 19 nt, Human
cauuaaucugccucccucu

SEQ ID NO: 2753224 - RNA, 23 nt, Human
cauuacaacaguagagagggaac

SEQ ID NO: 2753225 - RNA, 18 nt, Human
cauuacaggugugagcca

SEQ ID NO: 2753226 - RNA, 18 nt, Human
cauuacggagaguuuccu

SEQ ID NO: 2753227 - RNA, 19 nt, Human
cauuacggagaguuuccua

SEQ ID NO: 2753228 - RNA, 19 nt, Human
cauuacuucaaacugagau

SEQ ID NO: 2753229 - RNA, 14 nt, Human
cauuauaucaaauc

SEQ ID NO: 2753230 - RNA, 12 nt, Human
cauuauauuuau

SEQ ID NO: 2753231 - RNA, 14 nt, Human
cauuaucucaaaac

SEQ ID NO: 2753232 - RNA, 18 nt, Human
cauuauggauaaagauga

SEQ ID NO: 2753233 - RNA, 16 nt, Human
cauuauuccuguggau

SEQ ID NO: 2753234 - RNA, 15 nt, Human
cauuauuuauauggg

SEQ ID NO: 2753235 - RNA, 21 nt, Human
cauucacaucgcagauucucc

SEQ ID NO: 2753236 - RNA, 17 nt, Human
cauucagggcuauuuuu

SEQ ID NO: 2753237 - RNA, 16 nt, Human
cauucaggucuuucuu

SEQ ID NO: 2753238 - RNA, 13 nt, Human
cauuccccuugcc

SEQ ID NO: 2753239 - RNA, 15 nt, Human
cauucucaugauuau

SEQ ID NO: 2753240 - RNA, 12 nt, Human
cauucugccugc

SEQ ID NO: 2753241 - RNA, 15 nt, Human
cauucugccugcccu

SEQ ID NO: 2753242 - RNA, 17 nt, Human
cauucuggaauaauccu

SEQ ID NO: 2753243 - RNA, 17 nt, Human
cauucuggauuuuaaaa

SEQ ID NO: 2753244 - RNA, 18 nt, Human
cauucuuauuucaugaaa

SEQ ID NO: 2753245 - RNA, 10 nt, Human
cauucuuccu

SEQ ID NO: 2753246 - RNA, 15 nt, Human
cauucuuccugauua

SEQ ID NO: 2753247 - RNA, 19 nt, Human
cauucuuuacugcacucag

SEQ ID NO: 2753248 - RNA, 18 nt, Human
cauugaacaaguuguuuc

SEQ ID NO: 2753249 - RNA, 13 nt, Human
cauugacugucac

SEQ ID NO: 2753250 - RNA, 16 nt, Human
cauugaggcaggcacu

SEQ ID NO: 2753251 - RNA, 14 nt, Human
ccaccugcugagcc

SEQ ID NO: 2753252 - RNA, 15 nt, Human
ccaccugcugagccc

SEQ ID NO: 2753253 - RNA, 16 nt, Human
ccaccugcugagcccc

SEQ ID NO: 2753254 - RNA, 17 nt, Human
ccaccugcugagcccca

SEQ ID NO: 2753255 - RNA, 15 nt, Human
ccaccuuacuucuuc

SEQ ID NO: 2753256 - RNA, 16 nt, Human
ccaccuucuggguuca

SEQ ID NO: 2753257 - RNA, 20 nt, Human
ccaccuugcagcucuccccu

SEQ ID NO: 2753258 - RNA, 12 nt, Human
ccacgccacagc

SEQ ID NO: 2753259 - RNA, 15 nt, Human
ccacgccacagcccu

SEQ ID NO: 2753260 - RNA, 18 nt, Human
ccacgcucugggucgccg

SEQ ID NO: 2753261 - RNA, 21 nt, Human
ccacgcucugggucgccggca

SEQ ID NO: 2753262 - RNA, 21 nt, Human
ccacggugccuccagauggca

SEQ ID NO: 2753263 - RNA, 14 nt, Human
ccacuacugcuacc

SEQ ID NO: 2753264 - RNA, 16 nt, Human
ccacuagacccacugg

SEQ ID NO: 2753265 - RNA, 21 nt, Human
ccacuagcccuccucucccag

SEQ ID NO: 2753266 - RNA, 18 nt, Human
ccacuagcuaugguguca

SEQ ID NO: 2753267 - RNA, 15 nt, Human
ccacucugaguccca

SEQ ID NO: 2753268 - RNA, 19 nt, Human
ccacucuuagcuaaauccc

SEQ ID NO: 2753269 - RNA, 15 nt, Human
ccacuggaaaguuua

SEQ ID NO: 2753270 - RNA, 14 nt, Human
ccacuggacucacc

SEQ ID NO: 2753271 - RNA, 13 nt, Human
ccacuggacugac

SEQ ID NO: 2753272 - RNA, 20 nt, Human
ccacugggguguguggcaga

SEQ ID NO: 2753273 - RNA, 16 nt, Human
ccacuguuaucaaaac

SEQ ID NO: 2753274 - RNA, 18 nt, Human
ccacuuauaggaauugac

SEQ ID NO: 2753275 - RNA, 17 nt, Human
ccacuucaccaauaagu

SEQ ID NO: 2753276 - RNA, 15 nt, Human
ccacuucacuuuuuu

SEQ ID NO: 2753277 - RNA, 16 nt, Human
ccacuucagccuccca

SEQ ID NO: 2753278 - RNA, 16 nt, Human
ccacuuccucccggcc

SEQ ID NO: 2753279 - RNA, 17 nt, Human
ccacuuccucccggccg

SEQ ID NO: 2753280 - RNA, 16 nt, Human
ccacuugcuuuuaaaa

SEQ ID NO: 2753281 - RNA, 20 nt, Human
ccacuuggacaugggcccca

SEQ ID NO: 2753282 - RNA, 22 nt, Human
ccacuuggacaugggccccaga

SEQ ID NO: 2753283 - RNA, 16 nt, Human
ccacuuggucugugag

SEQ ID NO: 2753284 - RNA, 18 nt, Human
ccacuuggucugugagau

SEQ ID NO: 2753285 - RNA, 19 nt, Human
ccacuuggucugugagaug

SEQ ID NO: 2753286 - RNA, 21 nt, Human
ccacuuggucugugagaugcu

SEQ ID NO: 2753287 - RNA, 21 nt, Human
ccacuuuccaauaaagaguuc

SEQ ID NO: 2753288 - RNA, 14 nt, Human
ccagaaaaagcauc

SEQ ID NO: 2753289 - RNA, 14 nt, Human
ccagaagucaaggc

SEQ ID NO: 2753290 - RNA, 20 nt, Human
ccagaaugaccuggccgcag

SEQ ID NO: 2753291 - RNA, 14 nt, Human
ccagacacuuuuuu

SEQ ID NO: 2753292 - RNA, 12 nt, Human
ccagagaagggc

SEQ ID NO: 2753293 - RNA, 14 nt, Human
ccagagacaacagg

SEQ ID NO: 2753294 - RNA, 20 nt, Human
ccagagacagcuugaucaaa

SEQ ID NO: 2753295 - RNA, 13 nt, Human
ccagagacuggga

SEQ ID NO: 2753296 - RNA, 13 nt, Human
ccagagccacagu

SEQ ID NO: 2753297 - RNA, 19 nt, Human
ccagagccacaguuccccu

SEQ ID NO: 2753298 - RNA, 15 nt, Human
ccagagcguguagug

SEQ ID NO: 2753299 - RNA, 16 nt, Human
ccagaggcucuaaugu

SEQ ID NO: 2753300 - RNA, 23 nt, Human
ccagagggaauugcagaguacug

SEQ ID NO: 2753301 - RNA, 20 nt, Human
ccagauacacccaaaguauc

SEQ ID NO: 2753302 - RNA, 19 nt, Human
ccagaucaagccugccuca

SEQ ID NO: 2753303 - RNA, 23 nt, Human
ccagaucaagccugccucaauca

SEQ ID NO: 2753304 - RNA, 15 nt, Human
ccagauccuggaaau

SEQ ID NO: 2753305 - RNA, 19 nt, Human
ccagaucuaugccacaaga

SEQ ID NO: 2753306 - RNA, 12 nt, Human
ccagcacagccu

SEQ ID NO: 2753307 - RNA, 15 nt, Human
ccagcacagccucuu

SEQ ID NO: 2753308 - RNA, 17 nt, Human
ccagcagccagcucuca

SEQ ID NO: 2753309 - RNA, 19 nt, Human
ccagcaguucagagcugcc

SEQ ID NO: 2753310 - RNA, 21 nt, Human
ccagcaguucagagcugcccu

SEQ ID NO: 2753311 - RNA, 18 nt, Human
ccagcaucugccuccccu

SEQ ID NO: 2753312 - RNA, 20 nt, Human
ccagccacggggacucagcc

SEQ ID NO: 2753313 - RNA, 21 nt, Human
ccagccacggggacucagccc

SEQ ID NO: 2753314 - RNA, 12 nt, Human
ccagccagcagc

SEQ ID NO: 2753315 - RNA, 13 nt, Human
ccagccagcagcc

SEQ ID NO: 2753316 - RNA, 22 nt, Human
ccagccagcaguucagagcugc

SEQ ID NO: 2753317 - RNA, 13 nt, Human
ccagccucagccu

SEQ ID NO: 2753318 - RNA, 13 nt, Human
ccagccugcuccc

SEQ ID NO: 2753319 - RNA, 15 nt, Human
ccagccugcugccug

SEQ ID NO: 2753320 - RNA, 21 nt, Human
ccagccuggucaacauaguga

SEQ ID NO: 2753321 - RNA, 12 nt, Human
ccagcucagggc

SEQ ID NO: 2753322 - RNA, 13 nt, Human
ccagcucucagcc

SEQ ID NO: 2753323 - RNA, 19 nt, Human
ccagcugcucugucuucuu

SEQ ID NO: 2753324 - RNA, 14 nt, Human
ccagcuggccggga

SEQ ID NO: 2753325 - RNA, 20 nt, Human
ccagcuggccgggagccuga

SEQ ID NO: 2753326 - RNA, 22 nt, Human
ccagcuggccuugugaggagcu

SEQ ID NO: 2753327 - RNA, 21 nt, Human
ccagcuggggccaggcugggu

SEQ ID NO: 2753328 - RNA, 13 nt, Human
ccagcuguuuaug

SEQ ID NO: 2753329 - RNA, 20 nt, Human
ccagcuugaaaccuucacuu

SEQ ID NO: 2753330 - RNA, 16 nt, Human
ccaggaaacucugcau

SEQ ID NO: 2753331 - RNA, 23 nt, Human
ccaggacccuguccaaucuuuga

SEQ ID NO: 2753332 - RNA, 13 nt, Human
ccaggaccugagu

SEQ ID NO: 2753333 - RNA, 18 nt, Human
ccaggacuagggcuggag

SEQ ID NO: 2753334 - RNA, 20 nt, Human
ccaggagcugggcagaaggc

SEQ ID NO: 2753335 - RNA, 15 nt, Human
ccaggaggccugcua

SEQ ID NO: 2753336 - RNA, 18 nt, Human
ccaggaggggcuucuggg

SEQ ID NO: 2753337 - RNA, 21 nt, Human
ccaggaggggcuucugggcag

SEQ ID NO: 2753338 - RNA, 21 nt, Human
ccaggaguacaccccaacagc

SEQ ID NO: 2753339 - RNA, 16 nt, Human
ccaggaguauccucuu

SEQ ID NO: 2753340 - RNA, 21 nt, Human
ccaggaguuuggccagaaguc

SEQ ID NO: 2753341 - RNA, 23 nt, Human
ccaggaguuuggccagaagucaa

SEQ ID NO: 2753342 - RNA, 16 nt, Human
ccaggauauccucccu

SEQ ID NO: 2753343 - RNA, 17 nt, Human
ccaggauauccucccuc

SEQ ID NO: 2753344 - RNA, 14 nt, Human
ccaggcacacugag

SEQ ID NO: 2753345 - RNA, 23 nt, Human
ccaggcacaguggcucacaccug

SEQ ID NO: 2753346 - RNA, 16 nt, Human
ccaggcacccccagaa

SEQ ID NO: 2753347 - RNA, 14 nt, Human
ccaggcaugguggu

SEQ ID NO: 2753348 - RNA, 18 nt, Human
ccaggcccugcucuuccu

SEQ ID NO: 2753349 - RNA, 20 nt, Human
ccaggcggguccgggucgca

SEQ ID NO: 2753350 - RNA, 16 nt, Human
ccaggcugagccucag

SEQ ID NO: 2753351 - RNA, 16 nt, Human
ccaggcugcucagggc

SEQ ID NO: 2753352 - RNA, 18 nt, Human
ccaggcugcucagggcug

SEQ ID NO: 2753353 - RNA, 17 nt, Human
ccagggaagacaagaag

SEQ ID NO: 2753354 - RNA, 21 nt, Human
ccagggaugaugcaacauccu

SEQ ID NO: 2753355 - RNA, 19 nt, Human
ccagggccuggcugggagu

SEQ ID NO: 2753356 - RNA, 16 nt, Human
ccagggcuacgcgcgc

SEQ ID NO: 2753357 - RNA, 16 nt, Human
ccagguaccuucucac

SEQ ID NO: 2753358 - RNA, 17 nt, Human
ccagguaccuucucacc

SEQ ID NO: 2753359 - RNA, 24 nt, Human
ccagguaccuucucaccugugaga

SEQ ID NO: 2753360 - RNA, 13 nt, Human
ccagguagagggu

SEQ ID NO: 2753361 - RNA, 19 nt, Human
ccaggugguaagcaccagg

SEQ ID NO: 2753362 - RNA, 21 nt, Human
ccaggugguaagcaccaggac

SEQ ID NO: 2753363 - RNA, 17 nt, Human
ccagguuggagugcagu

SEQ ID NO: 2753364 - RNA, 18 nt, Human
ccagguuggagugcagug

SEQ ID NO: 2753365 - RNA, 17 nt, Human
ccaguaccuagcuggcu

SEQ ID NO: 2753366 - RNA, 17 nt, Human
ccaguaguuagcuuucu

SEQ ID NO: 2753367 - RNA, 17 nt, Human
ccaguauuguuccuuuu

SEQ ID NO: 2753368 - RNA, 12 nt, Human
ccagucucacau

SEQ ID NO: 2753369 - RNA, 22 nt, Human
ccagucugacuguuuccaucaa

SEQ ID NO: 2753370 - RNA, 15 nt, Human
ccagucuuccucccu

SEQ ID NO: 2753371 - RNA, 15 nt, Human
ccagugaaaaacuau

SEQ ID NO: 2753372 - RNA, 15 nt, Human
ccagugcggccagcu

SEQ ID NO: 2753373 - RNA, 14 nt, Human
ccaguuguccuccu

SEQ ID NO: 2753374 - RNA, 18 nt, Human
ccauaauguuacauuauu

SEQ ID NO: 2753375 - RNA, 12 nt, Human
ccauaccccugg

SEQ ID NO: 2753376 - RNA, 20 nt, Human
ccauacuaauuauacccccu

SEQ ID NO: 2753377 - RNA, 22 nt, Human
ccauacuaauuauacccccugc

SEQ ID NO: 2753378 - RNA, 14 nt, Human
ccauagggugacac

SEQ ID NO: 2753379 - RNA, 17 nt, Human
ccauaucucccucuucc

SEQ ID NO: 2753380 - RNA, 23 nt, Human
ccauaugaaaaggcuaagcuuca

SEQ ID NO: 2753381 - RNA, 14 nt, Human
ccaucaccuccccc

SEQ ID NO: 2753382 - RNA, 18 nt, Human
ccaucagcuccagcugcu

SEQ ID NO: 2753383 - RNA, 16 nt, Human
ccaucccggccggcgc

SEQ ID NO: 2753384 - RNA, 15 nt, Human
ccaucccucccucca

SEQ ID NO: 2753385 - RNA, 16 nt, Human
ccaucccucccuccac

SEQ ID NO: 2753386 - RNA, 22 nt, Human
ccaucccucccuccaccucccu

SEQ ID NO: 2753387 - RNA, 13 nt, Human
ccauccuaccaca

SEQ ID NO: 2753388 - RNA, 21 nt, Human
ccauccugaggcuccacuugg

SEQ ID NO: 2753389 - RNA, 21 nt, Human
ccauccugccccugagcccau

SEQ ID NO: 2753390 - RNA, 19 nt, Human
ccaucuccucagcacccca

SEQ ID NO: 2753391 - RNA, 19 nt, Human
ccaucuugcccgcucaggc

SEQ ID NO: 2753392 - RNA, 17 nt, Human
ccaugaacuauaugacu

SEQ ID NO: 2753393 - RNA, 15 nt, Human
ccaugaugcugagcc

SEQ ID NO: 2753394 - RNA, 12 nt, Human
ccaugcccggcu

SEQ ID NO: 2753395 - RNA, 16 nt, Human
ccaugcugcuggggaa

SEQ ID NO: 2753396 - RNA, 17 nt, Human
ccaugcugcuggggaag

SEQ ID NO: 2753397 - RNA, 23 nt, Human
ccaugcugcuggggaagacagug

SEQ ID NO: 2753398 - RNA, 11 nt, Human
ccaugcuggcc

SEQ ID NO: 2753399 - RNA, 19 nt, Human
ccaugcuggccaggcuggu

SEQ ID NO: 2753400 - RNA, 12 nt, Human
ccaugggacagg

SEQ ID NO: 2753401 - RNA, 13 nt, Human
ccaugggacaggg

SEQ ID NO: 2753402 - RNA, 14 nt, Human
ccaugggacaggga

SEQ ID NO: 2753403 - RNA, 19 nt, Human
ccaugggaggccuuucccu

SEQ ID NO: 2753404 - RNA, 15 nt, Human
ccauguacauagcuu

SEQ ID NO: 2753405 - RNA, 21 nt, Human
ccaugucaaggguucaagauu

SEQ ID NO: 2753406 - RNA, 13 nt, Human
ccaugucuacaca

SEQ ID NO: 2753407 - RNA, 16 nt, Human
ccaugucuacacagau

SEQ ID NO: 2753408 - RNA, 21 nt, Human
ccaugucuacacagauguuca

SEQ ID NO: 2753409 - RNA, 15 nt, Human
ccaugugcagccacc

SEQ ID NO: 2753410 - RNA, 21 nt, Human
ccaugugcagccaccagucca

SEQ ID NO: 2753411 - RNA, 16 nt, Human
ccauuagaccaagcuu

SEQ ID NO: 2753412 - RNA, 20 nt, Human
ccauuagcauuugucaacaa

SEQ ID NO: 2753413 - RNA, 20 nt, Human
ccauucaggaugcccacggc

SEQ ID NO: 2753414 - RNA, 13 nt, Human
ccauuccaagccu

SEQ ID NO: 2753415 - RNA, 16 nt, Human
ccauucccccagugcg

SEQ ID NO: 2753416 - RNA, 14 nt, Human
ccauucucaagccc

SEQ ID NO: 2753417 - RNA, 15 nt, Human
ccauucucaagcccu

SEQ ID NO: 2753418 - RNA, 21 nt, Human
ccauucucaagcccugcaguc

SEQ ID NO: 2753419 - RNA, 17 nt, Human
ccauucugaggccaggg

SEQ ID NO: 2753420 - RNA, 13 nt, Human
ccauucuucccuu

SEQ ID NO: 2753421 - RNA, 22 nt, Human
ccauucuuccucccauucagga

SEQ ID NO: 2753422 - RNA, 16 nt, Human
ccauugucucagagca

SEQ ID NO: 2753423 - RNA, 20 nt, Human
ccauuguggucacaggaagu

SEQ ID NO: 2753424 - RNA, 13 nt, Human
ccauuuaaagcuu

SEQ ID NO: 2753425 - RNA, 14 nt, Human
ccauuuaaagcuua

SEQ ID NO: 2753426 - RNA, 15 nt, Human
ccauuuccucagacu

SEQ ID NO: 2753427 - RNA, 15 nt, Human
ccauuucuauuuauu

SEQ ID NO: 2753428 - RNA, 22 nt, Human
ccauuucuugagguaaaagcau

SEQ ID NO: 2753429 - RNA, 18 nt, Human
ccauuuuuagugaaauau

SEQ ID NO: 2753430 - RNA, 11 nt, Human
ccauuuuuccu

SEQ ID NO: 2753431 - RNA, 13 nt, Human
ccauuuuuuucua

SEQ ID NO: 2753432 - RNA, 14 nt, Human
ccauuuuuuucuaa

SEQ ID NO: 2753433 - RNA, 13 nt, Human
cccaaaaggcaga

SEQ ID NO: 2753434 - RNA, 20 nt, Human
cccaaacaugcacuuccuug

SEQ ID NO: 2753435 - RNA, 16 nt, Human
cccaaaguccugggau

SEQ ID NO: 2753436 - RNA, 17 nt, Human
cccaaagugcugggaau

SEQ ID NO: 2753437 - RNA, 17 nt, Human
cccaaagugcugggauu

SEQ ID NO: 2753438 - RNA, 21 nt, Human
cccaaauguucaucaaugaau

SEQ ID NO: 2753439 - RNA, 13 nt, Human
cccaacaccccac

SEQ ID NO: 2753440 - RNA, 21 nt, Human
cccaacagcacccucuccaga

SEQ ID NO: 2753441 - RNA, 11 nt, Human
cccaacagcuc

SEQ ID NO: 2753442 - RNA, 17 nt, Human
cccaaccacaucccacu

SEQ ID NO: 2753443 - RNA, 20 nt, Human
cccaagcccacuggggugug

SEQ ID NO: 2753444 - RNA, 14 nt, Human
cccaagccuggcaa

SEQ ID NO: 2753445 - RNA, 17 nt, Human
cccaaggaugucugcca

SEQ ID NO: 2753446 - RNA, 21 nt, Human
cccaaggguggguggggugag

SEQ ID NO: 2753447 - RNA, 13 nt, Human
cccaccaccucac

SEQ ID NO: 2753448 - RNA, 12 nt, Human
cccacccaggag

SEQ ID NO: 2753449 - RNA, 13 nt, Human
cccacgccacagc

SEQ ID NO: 2753450 - RNA, 17 nt, Human
cccacuagacccacugg

SEQ ID NO: 2753451 - RNA, 18 nt, Human
cccacuagacccacugga

SEQ ID NO: 2753452 - RNA, 20 nt, Human
cccacucugcaagaagaaau

SEQ ID NO: 2753453 - RNA, 16 nt, Human
cccacuggacucaccu

SEQ ID NO: 2753454 - RNA, 18 nt, Human
cccacuggacucaccucc

SEQ ID NO: 2753455 - RNA, 23 nt, Human
cccacuggacucaccucccccau

SEQ ID NO: 2753456 - RNA, 14 nt, Human
cccacuugccauaa

SEQ ID NO: 2753457 - RNA, 18 nt, Human
cccacuugccauaaaacu

SEQ ID NO: 2753458 - RNA, 16 nt, Human
cccacuugcuuuuaaa

SEQ ID NO: 2753459 - RNA, 18 nt, Human
cccagaaugaccuggccg

SEQ ID NO: 2753460 - RNA, 22 nt, Human
cccagaaugaccuggccgcagu

SEQ ID NO: 2753461 - RNA, 20 nt, Human
cccagagaagccaaaagauu

SEQ ID NO: 2753462 - RNA, 16 nt, Human
cccagagcuacaggcc

SEQ ID NO: 2753463 - RNA, 20 nt, Human
cccagaucaagccugccuca

SEQ ID NO: 2753464 - RNA, 17 nt, Human
cccagaugagaagucug

SEQ ID NO: 2753465 - RNA, 17 nt, Human
cccagccagcacagccu

SEQ ID NO: 2753466 - RNA, 22 nt, Human
cccagcccuccuuaucaaagga

SEQ ID NO: 2753467 - RNA, 18 nt, Human
cccagccugcucccuagc

SEQ ID NO: 2753468 - RNA, 19 nt, Human
cccagccugcucccuagcc

SEQ ID NO: 2753469 - RNA, 23 nt, Human
cccagccugcucccuagccagag

SEQ ID NO: 2753470 - RNA, 20 nt, Human
cccagcuagaauucacucca

SEQ ID NO: 2753471 - RNA, 14 nt, Human
cccagcucacagga

SEQ ID NO: 2753472 - RNA, 22 nt, Human
cccagcucacaggagcuuaaac

SEQ ID NO: 2753473 - RNA, 14 nt, Human
cccagcucagggcu

SEQ ID NO: 2753474 - RNA, 17 nt, Human
cccagcuggggccaggc

SEQ ID NO: 2753475 - RNA, 19 nt, Human
cccagcuggggccaggcug

SEQ ID NO: 2753476 - RNA, 13 nt, Human
cccaggacgcccu

SEQ ID NO: 2753477 - RNA, 14 nt, Human
cccaggacgcccuc

SEQ ID NO: 2753478 - RNA, 16 nt, Human
cccaggaguacacccc

SEQ ID NO: 2753479 - RNA, 21 nt, Human
cccaggaguacaccccaacag

SEQ ID NO: 2753480 - RNA, 17 nt, Human
cccaggaguauccucuu

SEQ ID NO: 2753481 - RNA, 18 nt, Human
cccaggaguuuggccaga

SEQ ID NO: 2753482 - RNA, 19 nt, Human
cccaggaguuuggccagaa

SEQ ID NO: 2753483 - RNA, 21 nt, Human
cccaggaucguuuuuucccag

SEQ ID NO: 2753484 - RNA, 17 nt, Human
cccaggcugagccucag

SEQ ID NO: 2753485 - RNA, 14 nt, Human
cccaguagaugcca

SEQ ID NO: 2753486 - RNA, 19 nt, Human
cccaguagaugccacccag

SEQ ID NO: 2753487 - RNA, 15 nt, Human
cccaguuagccucug

SEQ ID NO: 2753488 - RNA, 23 nt, Human
cccaguuagccucugcaggaugu

SEQ ID NO: 2753489 - RNA, 11 nt, Human
cccauccugcc

SEQ ID NO: 2753490 - RNA, 22 nt, Human
cccaucugggggccucuucugc

SEQ ID NO: 2753491 - RNA, 22 nt, Human
cccaugauguuuagaaacacaa

SEQ ID NO: 2753492 - RNA, 19 nt, Human
cccauggcacucuauguuc

SEQ ID NO: 2753493 - RNA, 15 nt, Human
cccauggccacuugg

SEQ ID NO: 2753494 - RNA, 19 nt, Human
cccauucaggaugcccacg

SEQ ID NO: 2753495 - RNA, 14 nt, Human
cccauucccucucc

SEQ ID NO: 2753496 - RNA, 19 nt, Human
ccccaacagcacccucucc

SEQ ID NO: 2753497 - RNA, 22 nt, Human
ccccaaguuauccaccugccuu

SEQ ID NO: 2753498 - RNA, 23 nt, Human
ccccacagaagugcuuucuucuc

SEQ ID NO: 2753499 - RNA, 12 nt, Human
ccccacagcccc

SEQ ID NO: 2753500 - RNA, 15 nt, Human
ccccacgccacagcc

SEQ ID NO: 2753501 - RNA, 17 nt, Human
ccccagaaugaccuggc

SEQ ID NO: 2753502 - RNA, 13 nt, Human
ccccagcccuccu

SEQ ID NO: 2753503 - RNA, 14 nt, Human
ccccagccugcucc

SEQ ID NO: 2753504 - RNA, 17 nt, Human
ccccagccugcucccua

SEQ ID NO: 2753505 - RNA, 22 nt, Human
ccccagccugcucccuagccag

SEQ ID NO: 2753506 - RNA, 21 nt, Human
ccccagcuggggccaggcugg

SEQ ID NO: 2753507 - RNA, 13 nt, Human
ccccaggacgccc

SEQ ID NO: 2753508 - RNA, 22 nt, Human
ccccaggacgcccucacugcag

SEQ ID NO: 2753509 - RNA, 20 nt, Human
ccccaggcccugcucuuccu

SEQ ID NO: 2753510 - RNA, 16 nt, Human
ccccagugcggccagc

SEQ ID NO: 2753511 - RNA, 17 nt, Human
ccccagugcggccagcu

SEQ ID NO: 2753512 - RNA, 20 nt, Human
ccccagugcggccagcuccg

SEQ ID NO: 2753513 - RNA, 17 nt, Human
ccccaguuguuucuacu

SEQ ID NO: 2753514 - RNA, 14 nt, Human
ccccaucagcucca

SEQ ID NO: 2753515 - RNA, 17 nt, Human
ccccauuucuauuuauu

SEQ ID NO: 2753516 - RNA, 22 nt, Human
cccccaacagcacccucuccag

SEQ ID NO: 2753517 - RNA, 15 nt, Human
cccccagcccuccuu

SEQ ID NO: 2753518 - RNA, 16 nt, Human
cccccagcccuccuua

SEQ ID NO: 2753519 - RNA, 21 nt, Human
cccccauuguggucacaggaa

SEQ ID NO: 2753520 - RNA, 19 nt, Human
cccccgccacccucccacu

SEQ ID NO: 2753521 - RNA, 15 nt, Human
cccccuagccugccu

SEQ ID NO: 2753522 - RNA, 17 nt, Human
cccccuagccugccucc

SEQ ID NO: 2753523 - RNA, 23 nt, Human
cccccuagccugccuccccugcc

SEQ ID NO: 2753524 - RNA, 22 nt, Human
cccccucuggcuccagcuggcc

SEQ ID NO: 2753525 - RNA, 17 nt, Human
cccccugcaaagcccag

SEQ ID NO: 2753526 - RNA, 17 nt, Human
cccccuugccagacaug

SEQ ID NO: 2753527 - RNA, 19 nt, Human
ccccggggaggggcgcucg

SEQ ID NO: 2753528 - RNA, 20 nt, Human
ccccggggaggggcgcucgc

SEQ ID NO: 2753529 - RNA, 21 nt, Human
ccccggggaggggcgcucgcu

SEQ ID NO: 2753530 - RNA, 23 nt, Human
ccccggggaggggcgcucgcuuc

SEQ ID NO: 2753531 - RNA, 16 nt, Human
ccccuaagcccccacu

SEQ ID NO: 2753532 - RNA, 16 nt, Human
ccccuagccugccucc

SEQ ID NO: 2753533 - RNA, 19 nt, Human
ccccuauccuacuuccccu

SEQ ID NO: 2753534 - RNA, 12 nt, Human
ccccucuggcuc

SEQ ID NO: 2753535 - RNA, 18 nt, Human
ccccucuggcuccagcug

SEQ ID NO: 2753536 - RNA, 19 nt, Human
ccccucuggcuccagcugg

SEQ ID NO: 2753537 - RNA, 15 nt, Human
ccccugagcuugcag

SEQ ID NO: 2753538 - RNA, 17 nt, Human
ccccugagcuugcagag

SEQ ID NO: 2753539 - RNA, 24 nt, Human
ccccugagcuugcagagaugaggc

SEQ ID NO: 2753540 - RNA, 19 nt, Human
ccccugcaaagcccagcuu

SEQ ID NO: 2753541 - RNA, 19 nt, Human
ccgcuguuccucgccacgc

SEQ ID NO: 2753542 - RNA, 20 nt, Human
ccgcuguuccucgccacgcu

SEQ ID NO: 2753543 - RNA, 14 nt, Human
ccggacgcugcugc

SEQ ID NO: 2753544 - RNA, 15 nt, Human
ccggacgcugcugcc

SEQ ID NO: 2753545 - RNA, 16 nt, Human
ccggagaaccccagga

SEQ ID NO: 2753546 - RNA, 15 nt, Human
ccggagccuccagcu

SEQ ID NO: 2753547 - RNA, 16 nt, Human
ccggagccuccagcug

SEQ ID NO: 2753548 - RNA, 12 nt, Human
ccggccaccaga

SEQ ID NO: 2753549 - RNA, 16 nt, Human
ccggccgcgcugcgcg

SEQ ID NO: 2753550 - RNA, 17 nt, Human
ccggccgcgcugcgcgc

SEQ ID NO: 2753551 - RNA, 12 nt, Human
ccggccggcgcg

SEQ ID NO: 2753552 - RNA, 13 nt, Human
ccggccggcgcgc

SEQ ID NO: 2753553 - RNA, 14 nt, Human
ccggccggcgcgcu

SEQ ID NO: 2753554 - RNA, 18 nt, Human
ccggccuuugcaccucca

SEQ ID NO: 2753555 - RNA, 21 nt, Human
ccggccuuugcaccuccaugg

SEQ ID NO: 2753556 - RNA, 22 nt, Human
ccgggaaagaagagccggagcc

SEQ ID NO: 2753557 - RNA, 22 nt, Human
ccgggagccugaucaccugccc

SEQ ID NO: 2753558 - RNA, 13 nt, Human
ccgggaggcagag

SEQ ID NO: 2753559 - RNA, 21 nt, Human
ccgggaguggcgcgcgccacc

SEQ ID NO: 2753560 - RNA, 22 nt, Human
ccgggaguggcgcgcgccacca

SEQ ID NO: 2753561 - RNA, 23 nt, Human
ccgggaguggcgcgcgccaccac

SEQ ID NO: 2753562 - RNA, 18 nt, Human
ccgggccgacggagccgg

SEQ ID NO: 2753563 - RNA, 15 nt, Human
ccggggaggggcgcu

SEQ ID NO: 2753564 - RNA, 16 nt, Human
ccggggaggggcgcuc

SEQ ID NO: 2753565 - RNA, 21 nt, Human
ccggggaggggcgcucgcuuc

SEQ ID NO: 2753566 - RNA, 16 nt, Human
ccgguccuugcugcac

SEQ ID NO: 2753567 - RNA, 17 nt, Human
ccgguggagaucccacc

SEQ ID NO: 2753568 - RNA, 14 nt, Human
ccgucccccucugg

SEQ ID NO: 2753569 - RNA, 15 nt, Human
ccgucccccucuggc

SEQ ID NO: 2753570 - RNA, 20 nt, Human
ccgucucccaaagugcuggg

SEQ ID NO: 2753571 - RNA, 15 nt, Human
ccgugggccugagac

SEQ ID NO: 2753572 - RNA, 15 nt, Human
ccgugggguuccucc

SEQ ID NO: 2753573 - RNA, 11 nt, Human
ccgugugccug

SEQ ID NO: 2753574 - RNA, 15 nt, Human
ccgugugccugagcg

SEQ ID NO: 2753575 - RNA, 17 nt, Human
ccguugaacgucacauc

SEQ ID NO: 2753576 - RNA, 18 nt, Human
ccguugaacgucacaucu

SEQ ID NO: 2753577 - RNA, 20 nt, Human
ccuaaauauauuuuaagacg

SEQ ID NO: 2753578 - RNA, 19 nt, Human
ccuaacgaaguauccuuca

SEQ ID NO: 2753579 - RNA, 13 nt, Human
ccuaagcccuccg

SEQ ID NO: 2753580 - RNA, 16 nt, Human
ccuacaccccuccccu

SEQ ID NO: 2753581 - RNA, 20 nt, Human
ccuacacgagauacagaauu

SEQ ID NO: 2753582 - RNA, 21 nt, Human
ccuacaguguacagucuugua

SEQ ID NO: 2753583 - RNA, 16 nt, Human
ccuacaugagguacug

SEQ ID NO: 2753584 - RNA, 16 nt, Human
ccuacccuccacaggc

SEQ ID NO: 2753585 - RNA, 23 nt, Human
ccuacccuggacuugccucugca

SEQ ID NO: 2753586 - RNA, 15 nt, Human
ccuagagcacacugu

SEQ ID NO: 2753587 - RNA, 14 nt, Human
ccuagccagaggcu

SEQ ID NO: 2753588 - RNA, 17 nt, Human
ccuagccgaccucagcc

SEQ ID NO: 2753589 - RNA, 13 nt, Human
ccuagccugccuc

SEQ ID NO: 2753590 - RNA, 17 nt, Human
ccuagcuggcucuguga

SEQ ID NO: 2753591 - RNA, 15 nt, Human
ccuaguccccagccu

SEQ ID NO: 2753592 - RNA, 16 nt, Human
ccuaguccccagccug

SEQ ID NO: 2753593 - RNA, 21 nt, Human
ccuaguccccagccugcuccc

SEQ ID NO: 2753594 - RNA, 18 nt, Human
ccuagucucuacccagua

SEQ ID NO: 2753595 - RNA, 21 nt, Human
ccuagucucuaucauuaaagu

SEQ ID NO: 2753596 - RNA, 17 nt, Human
ccuaguuccuucaugua

SEQ ID NO: 2753597 - RNA, 18 nt, Human
ccuauagucccacuacuu

SEQ ID NO: 2753598 - RNA, 16 nt, Human
ccuauauccugugacu

SEQ ID NO: 2753599 - RNA, 17 nt, Human
ccuauccuacuuccccu

SEQ ID NO: 2753600 - RNA, 16 nt, Human
ccuaucucuccaacca

SEQ ID NO: 2753601 - RNA, 18 nt, Human
ccuaucucuccaaccaga

SEQ ID NO: 2753602 - RNA, 18 nt, Human
ccuauguuucacugugca

SEQ ID NO: 2753603 - RNA, 20 nt, Human
ccuauuagaguauuuuccac

SEQ ID NO: 2753604 - RNA, 18 nt, Human
ccuauuccuccuucccuu

SEQ ID NO: 2753605 - RNA, 19 nt, Human
ccuauuccuccuucccuug

SEQ ID NO: 2753606 - RNA, 16 nt, Human
ccucaaaacuucagac

SEQ ID NO: 2753607 - RNA, 19 nt, Human
ccucaacccccauuucuau

SEQ ID NO: 2753608 - RNA, 14 nt, Human
ccucaaccucccaa

SEQ ID NO: 2753609 - RNA, 18 nt, Human
ccucaaccucccaagcag

SEQ ID NO: 2753610 - RNA, 20 nt, Human
ccucaagcuaugugagcuca

SEQ ID NO: 2753611 - RNA, 16 nt, Human
ccucaaucaguauuca

SEQ ID NO: 2753612 - RNA, 13 nt, Human
ccucacaccaggc

SEQ ID NO: 2753613 - RNA, 18 nt, Human
ccucaccagcccuggcaa

SEQ ID NO: 2753614 - RNA, 17 nt, Human
ccucacugggguccugg

SEQ ID NO: 2753615 - RNA, 19 nt, Human
ccucacuuaaacuuuuauc

SEQ ID NO: 2753616 - RNA, 18 nt, Human
ccucagagacauacaccu

SEQ ID NO: 2753617 - RNA, 19 nt, Human
ccucagaugcacaugagcu

SEQ ID NO: 2753618 - RNA, 21 nt, Human
ccucagaugcacaugagcugg

SEQ ID NO: 2753619 - RNA, 14 nt, Human
ccucagccucccaa

SEQ ID NO: 2753620 - RNA, 16 nt, Human
ccucagccucccaaag

SEQ ID NO: 2753621 - RNA, 15 nt, Human
ccucagccucccaag

SEQ ID NO: 2753622 - RNA, 13 nt, Human
ccucagccucccg

SEQ ID NO: 2753623 - RNA, 14 nt, Human
ccucagccucccga

SEQ ID NO: 2753624 - RNA, 20 nt, Human
ccucagccugugcugcccgu

SEQ ID NO: 2753625 - RNA, 23 nt, Human
ccucagccuuccccuugcccagg

SEQ ID NO: 2753626 - RNA, 14 nt, Human
ccucagcugccucc

SEQ ID NO: 2753627 - RNA, 17 nt, Human
ccucagcugccucccca

SEQ ID NO: 2753628 - RNA, 18 nt, Human
ccucagcugccuccccag

SEQ ID NO: 2753629 - RNA, 15 nt, Human
ccucagucucccucc

SEQ ID NO: 2753630 - RNA, 14 nt, Human
ccucaguucccucu

SEQ ID NO: 2753631 - RNA, 18 nt, Human
ccucaguucccucuugcu

SEQ ID NO: 2753632 - RNA, 15 nt, Human
ccucauccgaggcag

SEQ ID NO: 2753633 - RNA, 14 nt, Human
ccucaucuguaaaa

SEQ ID NO: 2753634 - RNA, 14 nt, Human
ccucaugcugccaa

SEQ ID NO: 2753635 - RNA, 13 nt, Human
ccucauggaauug

SEQ ID NO: 2753636 - RNA, 15 nt, Human
ccucauguccacugg

SEQ ID NO: 2753637 - RNA, 16 nt, Human
ccucauuaucagucca

SEQ ID NO: 2753638 - RNA, 22 nt, Human
ccucauuuuuauaaugucccuu

SEQ ID NO: 2753639 - RNA, 21 nt, Human
ccuccacaccauucaggucuu

SEQ ID NO: 2753640 - RNA, 23 nt, Human
ccuccacauuucccccuagccug

SEQ ID NO: 2753641 - RNA, 13 nt, Human
ccuccaccucccu

SEQ ID NO: 2753642 - RNA, 14 nt, Human
ccuccaccucccug

SEQ ID NO: 2753643 - RNA, 16 nt, Human
ccuccaccucccugca

SEQ ID NO: 2753644 - RNA, 21 nt, Human
ccuccaccucccugcaauaaa

SEQ ID NO: 2753645 - RNA, 17 nt, Human
ccuccaccuucuggguu

SEQ ID NO: 2753646 - RNA, 16 nt, Human
ccuccagagacaacag

SEQ ID NO: 2753647 - RNA, 13 nt, Human
ccuccagcugccc

SEQ ID NO: 2753648 - RNA, 15 nt, Human
ccuccagcugccccg

SEQ ID NO: 2753649 - RNA, 17 nt, Human
ccuccagcugccccggg

SEQ ID NO: 2753650 - RNA, 19 nt, Human
ccuccagggagucucagcu

SEQ ID NO: 2753651 - RNA, 17 nt, Human
ccuccauaucucccucu

SEQ ID NO: 2753652 - RNA, 18 nt, Human
ccuccauaucucccucuu

SEQ ID NO: 2753653 - RNA, 20 nt, Human
ccuccauaucucccucuucc

SEQ ID NO: 2753654 - RNA, 21 nt, Human
ccuccauaucucccucuuccc

SEQ ID NO: 2753655 - RNA, 22 nt, Human
ccuccaugaauaucaguuauuu

SEQ ID NO: 2753656 - RNA, 24 nt, Human
ccuccauggaaacgaagcaccauc

SEQ ID NO: 2753657 - RNA, 14 nt, Human
ccucccaagcaguu

SEQ ID NO: 2753658 - RNA, 13 nt, Human
ccucccacugcca

SEQ ID NO: 2753659 - RNA, 15 nt, Human
ccucccacuucagcc

SEQ ID NO: 2753660 - RNA, 12 nt, Human
ccucccauguuc

SEQ ID NO: 2753661 - RNA, 18 nt, Human
ccucccauguucaagcga

SEQ ID NO: 2753662 - RNA, 21 nt, Human
ccuccccaaaugcuuuccaug

SEQ ID NO: 2753663 - RNA, 15 nt, Human
ccucccccuccucuc

SEQ ID NO: 2753664 - RNA, 13 nt, Human
ccuccccuccucu

SEQ ID NO: 2753665 - RNA, 16 nt, Human
ccuccccugccucacc

SEQ ID NO: 2753666 - RNA, 15 nt, Human
ccucccggccgcgcu

SEQ ID NO: 2753667 - RNA, 20 nt, Human
ccucccggccgcgcugcgcg

SEQ ID NO: 2753668 - RNA, 17 nt, Human
ccucccuccaccucccu

SEQ ID NO: 2753669 - RNA, 21 nt, Human
ccucccuuggggccuaugcag

SEQ ID NO: 2753670 - RNA, 15 nt, Human
ccuccgucaccucag

SEQ ID NO: 2753671 - RNA, 21 nt, Human
ccuccuaacaaguagcacccu

SEQ ID NO: 2753672 - RNA, 22 nt, Human
ccuccuaacaaguagcacccug

SEQ ID NO: 2753673 - RNA, 12 nt, Human
ccuccucggcuu

SEQ ID NO: 2753674 - RNA, 13 nt, Human
ccuccucucccag

SEQ ID NO: 2753675 - RNA, 20 nt, Human
ccuccucucccagugacaac

SEQ ID NO: 2753676 - RNA, 15 nt, Human
ccuccucuguccagg

SEQ ID NO: 2753677 - RNA, 20 nt, Human
ccuccugccuaagugcagcc

SEQ ID NO: 2753678 - RNA, 16 nt, Human
ccuccuguccagccug

SEQ ID NO: 2753679 - RNA, 16 nt, Human
ccuccuuaucaaagga

SEQ ID NO: 2753680 - RNA, 15 nt, Human
ccuccuucccuugcu

SEQ ID NO: 2753681 - RNA, 23 nt, Human
ccuccuuggagacagggcccugu

SEQ ID NO: 2753682 - RNA, 13 nt, Human
ccuccuuuuaaag

SEQ ID NO: 2753683 - RNA, 15 nt, Human
ccuccuuuuuccuuc

SEQ ID NO: 2753684 - RNA, 14 nt, Human
ccucggacggcucc

SEQ ID NO: 2753685 - RNA, 17 nt, Human
ccucggagccucauccg

SEQ ID NO: 2753686 - RNA, 22 nt, Human
ccucgugauccacccgccucag

SEQ ID NO: 2753687 - RNA, 18 nt, Human
ccuguugaagaugcuugu

SEQ ID NO: 2753688 - RNA, 22 nt, Human
ccuguugaagaugcuuguauuu

SEQ ID NO: 2753689 - RNA, 22 nt, Human
ccuguugcugccugcccuauuc

SEQ ID NO: 2753690 - RNA, 18 nt, Human
ccuguuuuuaagcuguuu

SEQ ID NO: 2753691 - RNA, 15 nt, Human
ccuuagaccaccaag

SEQ ID NO: 2753692 - RNA, 18 nt, Human
ccuuagaccaccaagccu

SEQ ID NO: 2753693 - RNA, 22 nt, Human
ccuuagaccaccaagccuugau

SEQ ID NO: 2753694 - RNA, 19 nt, Human
ccuuagcccuuccccucug

SEQ ID NO: 2753695 - RNA, 13 nt, Human
ccuuaggccucug

SEQ ID NO: 2753696 - RNA, 21 nt, Human
ccuuauguuuaauuaaaauca

SEQ ID NO: 2753697 - RNA, 19 nt, Human
ccuucaaguauaauauuaa

SEQ ID NO: 2753698 - RNA, 12 nt, Human
ccuucacuccca

SEQ ID NO: 2753699 - RNA, 14 nt, Human
ccuuccagaaauac

SEQ ID NO: 2753700 - RNA, 11 nt, Human
ccuucccacac

SEQ ID NO: 2753701 - RNA, 16 nt, Human
ccuucccacacugucc

SEQ ID NO: 2753702 - RNA, 19 nt, Human
ccuucccaggaguacaccc

SEQ ID NO: 2753703 - RNA, 20 nt, Human
ccuucccaggaguacacccc

SEQ ID NO: 2753704 - RNA, 16 nt, Human
ccuuccccucugcagc

SEQ ID NO: 2753705 - RNA, 13 nt, Human
ccuuccccuugcc

SEQ ID NO: 2753706 - RNA, 12 nt, Human
ccuucccuugcu

SEQ ID NO: 2753707 - RNA, 17 nt, Human
ccuucccuugcuucuug

SEQ ID NO: 2753708 - RNA, 20 nt, Human
ccuucccuugcuucuuggac

SEQ ID NO: 2753709 - RNA, 15 nt, Human
ccuuccucugagccu

SEQ ID NO: 2753710 - RNA, 18 nt, Human
ccuucggccuccauccug

SEQ ID NO: 2753711 - RNA, 16 nt, Human
ccuucugagccugccu

SEQ ID NO: 2753712 - RNA, 19 nt, Human
ccuucugagccugccuuuc

SEQ ID NO: 2753713 - RNA, 22 nt, Human
ccuucugagccugccuuucucc

SEQ ID NO: 2753714 - RNA, 18 nt, Human
ccuucuuuuuguucuuca

SEQ ID NO: 2753715 - RNA, 20 nt, Human
ccuucuuuuuuuuuuuuugu

SEQ ID NO: 2753716 - RNA, 14 nt, Human
ccuugaugaagaag

SEQ ID NO: 2753717 - RNA, 21 nt, Human
ccuugaugaagaaguugauau

SEQ ID NO: 2753718 - RNA, 22 nt, Human
ccuugauggucccuauuccucc

SEQ ID NO: 2753719 - RNA, 14 nt, Human
ccuugauuuuagcc

SEQ ID NO: 2753720 - RNA, 16 nt, Human
ccuugcaucucacagg

SEQ ID NO: 2753721 - RNA, 12 nt, Human
ccuugccagaca

SEQ ID NO: 2753722 - RNA, 22 nt, Human
ccuugcccagggcucagccugg

SEQ ID NO: 2753723 - RNA, 16 nt, Human
ccuugcugaacucccu

SEQ ID NO: 2753724 - RNA, 18 nt, Human
ccuugggaccccugagcu

SEQ ID NO: 2753725 - RNA, 23 nt, Human
ccuuggggauucuuccaucugau

SEQ ID NO: 2753726 - RNA, 18 nt, Human
ccuuggggccuaugcaga

SEQ ID NO: 2753727 - RNA, 18 nt, Human
ccuuggggcugaugcagu

SEQ ID NO: 2753728 - RNA, 13 nt, Human
ccuuggggguggu

SEQ ID NO: 2753729 - RNA, 15 nt, Human
ccuugguauagcaua

SEQ ID NO: 2753730 - RNA, 17 nt, Human
ccuuggugccuggagcc

SEQ ID NO: 2753731 - RNA, 20 nt, Human
ccuuguacuuuauuuucuau

SEQ ID NO: 2753732 - RNA, 13 nt, Human
ccuugucacuggu

SEQ ID NO: 2753733 - RNA, 14 nt, Human
ccuugucucccagc

SEQ ID NO: 2753734 - RNA, 17 nt, Human
ccuugugcacaaaucag

SEQ ID NO: 2753735 - RNA, 15 nt, Human
ccuuuaaaauuuuuu

SEQ ID NO: 2753736 - RNA, 16 nt, Human
ccuuuauaaucuuuua

SEQ ID NO: 2753737 - RNA, 19 nt, Human
ccuuucauaaagucuugcc

SEQ ID NO: 2753738 - RNA, 20 nt, Human
ccuuucauaaagucuugccu

SEQ ID NO: 2753739 - RNA, 14 nt, Human
ccuuucauuuuuuc

SEQ ID NO: 2753740 - RNA, 16 nt, Human
ccuuucucaucuuguc

SEQ ID NO: 2753741 - RNA, 19 nt, Human
ccuuucucccccccaccca

SEQ ID NO: 2753742 - RNA, 18 nt, Human
ccuuugcaccuccaugga

SEQ ID NO: 2753743 - RNA, 19 nt, Human
ccuuugcugacccucccca

SEQ ID NO: 2753744 - RNA, 18 nt, Human
ccuuuggagauuuuuuaa

SEQ ID NO: 2753745 - RNA, 23 nt, Human
ccuuuguugcuaucaauccaaga

SEQ ID NO: 2753746 - RNA, 14 nt, Human
ccuuuucccaacca

SEQ ID NO: 2753747 - RNA, 16 nt, Human
ccuuuucccaaccaua

SEQ ID NO: 2753748 - RNA, 20 nt, Human
ccuuuuuggacacacaaauu

SEQ ID NO: 2753749 - RNA, 12 nt, Human
ccuuuuuuuaag

SEQ ID NO: 2753750 - RNA, 21 nt, Human
ccuuuuuuugaaaaaaagcuu

SEQ ID NO: 2753751 - RNA, 23 nt, Human
ccuuuuuuugaaaaaaagcuuuu

SEQ ID NO: 2753752 - RNA, 9 nt, Human
cgaaaaaca

SEQ ID NO: 2753753 - RNA, 11 nt, Human
cgaaauguuau

SEQ ID NO: 2753754 - RNA, 20 nt, Human
cgaaauguuauuuuuuaauu

SEQ ID NO: 2753755 - RNA, 22 nt, Human
cgaacugcuggauucaagugau

SEQ ID NO: 2753756 - RNA, 13 nt, Human
cgaaggaaaaggg

SEQ ID NO: 2753757 - RNA, 15 nt, Human
cgaaggaaaagggcu

SEQ ID NO: 2753758 - RNA, 16 nt, Human
cgaaggaaaagggcuu

SEQ ID NO: 2753759 - RNA, 21 nt, Human
cgaagucuuccauagagacuu

SEQ ID NO: 2753760 - RNA, 21 nt, Human
cgacagugagacucugucuca

SEQ ID NO: 2753761 - RNA, 15 nt, Human
cgacaguuuuccuuc

SEQ ID NO: 2753762 - RNA, 12 nt, Human
cgaccucagccu

SEQ ID NO: 2753763 - RNA, 17 nt, Human
cgaccucagccuucccc

SEQ ID NO: 2753764 - RNA, 20 nt, Human
cgaccucagccuuccccuug

SEQ ID NO: 2753765 - RNA, 19 nt, Human
cgaccucucucaaagugcu

SEQ ID NO: 2753766 - RNA, 11 nt, Human
cgacggagccg

SEQ ID NO: 2753767 - RNA, 13 nt, Human
cgacggagccggg

SEQ ID NO: 2753768 - RNA, 15 nt, Human
cgacggagccgggaa

SEQ ID NO: 2753769 - RNA, 12 nt, Human
cgagaaaacaau

SEQ ID NO: 2753770 - RNA, 22 nt, Human
cgagaaaacaauaacgauaaaa

SEQ ID NO: 2753771 - RNA, 20 nt, Human
cgagaaccuaaguuucaguu

SEQ ID NO: 2753772 - RNA, 15 nt, Human
cgagacaagcagccc

SEQ ID NO: 2753773 - RNA, 17 nt, Human
cgagcaggcuacuguca

SEQ ID NO: 2753774 - RNA, 13 nt, Human
cgagccccaggcg

SEQ ID NO: 2753775 - RNA, 14 nt, Human
cgagccccaggcgg

SEQ ID NO: 2753776 - RNA, 14 nt, Human
cgagcgcgcgcgcc

SEQ ID NO: 2753777 - RNA, 16 nt, Human
cgagcguugcuggggg

SEQ ID NO: 2753778 - RNA, 22 nt, Human
cgaggcagggucaggagagggg

SEQ ID NO: 2753779 - RNA, 15 nt, Human
cgaggccccugucuc

SEQ ID NO: 2753780 - RNA, 16 nt, Human
cgagugggggccagcc

SEQ ID NO: 2753781 - RNA, 11 nt, Human
cgauaaaagac

SEQ ID NO: 2753782 - RNA, 14 nt, Human
cgauaaaagacagu

SEQ ID NO: 2753783 - RNA, 20 nt, Human
cgauaaaagacagugaaaga

SEQ ID NO: 2753784 - RNA, 19 nt, Human
cgauaguguuaacuugcug

SEQ ID NO: 2753785 - RNA, 19 nt, Human
cgaucuuugacucuuuugc

SEQ ID NO: 2753786 - RNA, 16 nt, Human
cgauucacccugucca

SEQ ID NO: 2753787 - RNA, 20 nt, Human
cgauucacccuguccaaacu

SEQ ID NO: 2753788 - RNA, 19 nt, Human
cgauucuccugccucagcc

SEQ ID NO: 2753789 - RNA, 21 nt, Human
cgcaaacuuucuuaaaacauu

SEQ ID NO: 2753790 - RNA, 16 nt, Human
cgcaaauucgcaaacu

SEQ ID NO: 2753791 - RNA, 23 nt, Human
cgcaaugugacuuaaugccacua

SEQ ID NO: 2753792 - RNA, 17 nt, Human
cgcagcucaggcuggca

SEQ ID NO: 2753793 - RNA, 19 nt, Human
cgcagcucaggcuggcacc

SEQ ID NO: 2753794 - RNA, 21 nt, Human
cgcaggaccaucccggccggc

SEQ ID NO: 2753795 - RNA, 23 nt, Human
cgcaggaccaucccggccggcgc

SEQ ID NO: 2753796 - RNA, 18 nt, Human
cgcauccuagucucuauc

SEQ ID NO: 2753797 - RNA, 20 nt, Human
cgcauccuagucucuaucau

SEQ ID NO: 2753798 - RNA, 16 nt, Human
cgcaugcggcccagga

SEQ ID NO: 2753799 - RNA, 16 nt, Human
cgcauggaaaaguuuc

SEQ ID NO: 2753800 - RNA, 19 nt, Human
cgccacgcucugggucgcc

SEQ ID NO: 2753801 - RNA, 22 nt, Human
cgccacgcucugggucgccggc

SEQ ID NO: 2753802 - RNA, 13 nt, Human
cgccauucucaag

SEQ ID NO: 2753803 - RNA, 14 nt, Human
cgcccaccgcaggg

SEQ ID NO: 2753804 - RNA, 15 nt, Human
cgcccacuagaccca

SEQ ID NO: 2753805 - RNA, 14 nt, Human
cgcccacuuccucc

SEQ ID NO: 2753806 - RNA, 16 nt, Human
cgcccacuuccucccg

SEQ ID NO: 2753807 - RNA, 23 nt, Human
cgcccacuuccucccggccgcgc

SEQ ID NO: 2753808 - RNA, 21 nt, Human
cgcccagcuaauuuguguauu

SEQ ID NO: 2753809 - RNA, 11 nt, Human
cgcccucacug

SEQ ID NO: 2753810 - RNA, 23 nt, Human
cgcccucacugcaggcuccccuc

SEQ ID NO: 2753811 - RNA, 12 nt, Human
cgcccucuggcu

SEQ ID NO: 2753812 - RNA, 13 nt, Human
cgcccucuggcug

SEQ ID NO: 2753813 - RNA, 16 nt, Human
cgcccucuggcugcug

SEQ ID NO: 2753814 - RNA, 14 nt, Human
cgccgcgcuccucg

SEQ ID NO: 2753815 - RNA, 16 nt, Human
cgccgcgcuccucgga

SEQ ID NO: 2753816 - RNA, 13 nt, Human
cgccucagccucc

SEQ ID NO: 2753817 - RNA, 14 nt, Human
cgccucagccuccc

SEQ ID NO: 2753818 - RNA, 15 nt, Human
cgccucagccuccca

SEQ ID NO: 2753819 - RNA, 16 nt, Human
cgccucagccucccaa

SEQ ID NO: 2753820 - RNA, 17 nt, Human
cgccuccgcuacuucca

SEQ ID NO: 2753821 - RNA, 18 nt, Human
cgccuguaaucccagcac

SEQ ID NO: 2753822 - RNA, 18 nt, Human
cgccuguaaucccagcau

SEQ ID NO: 2753823 - RNA, 13 nt, Human
cgcgagcgcgcgc

SEQ ID NO: 2753824 - RNA, 15 nt, Human
cgcgagcgcgcgcgc

SEQ ID NO: 2753825 - RNA, 14 nt, Human
cgcgaucucagcuc

SEQ ID NO: 2753826 - RNA, 19 nt, Human
cgcgcagcucaggcuggca

SEQ ID NO: 2753827 - RNA, 12 nt, Human
cgcgccaccacg

SEQ ID NO: 2753828 - RNA, 14 nt, Human
cgcgccaccacgcc

SEQ ID NO: 2753829 - RNA, 18 nt, Human
cgcgccaccacgcccagc

SEQ ID NO: 2753830 - RNA, 13 nt, Human
cgcgccgcgcucc

SEQ ID NO: 2753831 - RNA, 16 nt, Human
cgcgccgcgcuccucg

SEQ ID NO: 2753832 - RNA, 14 nt, Human
cgcgcgcuccgcgc

SEQ ID NO: 2753833 - RNA, 16 nt, Human
cuaagcucaucuauuu

SEQ ID NO: 2753834 - RNA, 18 nt, Human
cuaagcuggagugcagug

SEQ ID NO: 2753835 - RNA, 17 nt, Human
cuaagcuucacuguaaa

SEQ ID NO: 2753836 - RNA, 21 nt, Human
cuaagcuucacuguaaaauaa

SEQ ID NO: 2753837 - RNA, 16 nt, Human
cuaagucccugcugcc

SEQ ID NO: 2753838 - RNA, 22 nt, Human
cuaagucccugcugcccuuccc

SEQ ID NO: 2753839 - RNA, 14 nt, Human
cuaagucuuauaua

SEQ ID NO: 2753840 - RNA, 16 nt, Human
cuaaguguaccagaga

SEQ ID NO: 2753841 - RNA, 18 nt, Human
cuaauaucuuaucuuccu

SEQ ID NO: 2753842 - RNA, 15 nt, Human
cuaauguacaauaaa

SEQ ID NO: 2753843 - RNA, 19 nt, Human
cuaauguacaauaaagcaa

SEQ ID NO: 2753844 - RNA, 20 nt, Human
cuaauguacaauaaagcaau

SEQ ID NO: 2753845 - RNA, 20 nt, Human
cuaauguguaagacaaaaag

SEQ ID NO: 2753846 - RNA, 14 nt, Human
cuaauguugaauuu

SEQ ID NO: 2753847 - RNA, 20 nt, Human
cuaauguugaguuauuaaua

SEQ ID NO: 2753848 - RNA, 20 nt, Human
cuaauucaaacuaauagaau

SEQ ID NO: 2753849 - RNA, 14 nt, Human
cuaauuccacagcu

SEQ ID NO: 2753850 - RNA, 17 nt, Human
cuaauuccacagcugcu

SEQ ID NO: 2753851 - RNA, 18 nt, Human
cuaauuuaucuugucucu

SEQ ID NO: 2753852 - RNA, 19 nt, Human
cuaauuuuuaggcugaaag

SEQ ID NO: 2753853 - RNA, 20 nt, Human
cuaauuuuuguauuuuuagu

SEQ ID NO: 2753854 - RNA, 13 nt, Human
cuacaaaaaaaaa

SEQ ID NO: 2753855 - RNA, 14 nt, Human
cuacaaaaaaaaaa

SEQ ID NO: 2753856 - RNA, 16 nt, Human
cuacaaaaacacagca

SEQ ID NO: 2753857 - RNA, 14 nt, Human
cuacaaauacucuu

SEQ ID NO: 2753858 - RNA, 12 nt, Human
cuacaagacaca

SEQ ID NO: 2753859 - RNA, 15 nt, Human
cuacaagacacagug

SEQ ID NO: 2753860 - RNA, 21 nt, Human
cuacacagauguucacccaac

SEQ ID NO: 2753861 - RNA, 15 nt, Human
cuacaccccuccccu

SEQ ID NO: 2753862 - RNA, 23 nt, Human
cuacacgagauacagaauuuuau

SEQ ID NO: 2753863 - RNA, 17 nt, Human
cuacacuccagugagac

SEQ ID NO: 2753864 - RNA, 18 nt, Human
cuacaggccucacacaca

SEQ ID NO: 2753865 - RNA, 15 nt, Human
cuacaggcgugagcc

SEQ ID NO: 2753866 - RNA, 19 nt, Human
cuacagggcucacagaauu

SEQ ID NO: 2753867 - RNA, 18 nt, Human
cuacauaaaauacaaaaa

SEQ ID NO: 2753868 - RNA, 21 nt, Human
cuacauaaaauacaaaaacuu

SEQ ID NO: 2753869 - RNA, 18 nt, Human
cuacauacuauggaauuu

SEQ ID NO: 2753870 - RNA, 17 nt, Human
cuacaugucuagagaac

SEQ ID NO: 2753871 - RNA, 12 nt, Human
cuacauuacuuc

SEQ ID NO: 2753872 - RNA, 12 nt, Human
cuaccaaaaaaa

SEQ ID NO: 2753873 - RNA, 18 nt, Human
cuaccaaaaaaaggaagg

SEQ ID NO: 2753874 - RNA, 19 nt, Human
cuaccaaaaaaaggaagga

SEQ ID NO: 2753875 - RNA, 20 nt, Human
cuaccaaaaaucucaauauu

SEQ ID NO: 2753876 - RNA, 13 nt, Human
cuaccacucagag

SEQ ID NO: 2753877 - RNA, 14 nt, Human
cuaccacucagaga

SEQ ID NO: 2753878 - RNA, 16 nt, Human
cuaccccuuuacaaau

SEQ ID NO: 2753879 - RNA, 14 nt, Human
cuacccgcagaguu

SEQ ID NO: 2753880 - RNA, 20 nt, Human
cuacccucauuucucaucuu

SEQ ID NO: 2753881 - RNA, 21 nt, Human
cuacccuggacuugccucugc

SEQ ID NO: 2753882 - RNA, 13 nt, Human
cuaccugagcuaa

SEQ ID NO: 2753883 - RNA, 18 nt, Human
cuaccugcucagcccugc

SEQ ID NO: 2753884 - RNA, 19 nt, Human
cuaccugcucagcccugca

SEQ ID NO: 2753885 - RNA, 16 nt, Human
cuaccuguaacuugaa

SEQ ID NO: 2753886 - RNA, 16 nt, Human
cuaccuguucgcgcgc

SEQ ID NO: 2753887 - RNA, 17 nt, Human
cuaccuguucgcgcgcc

SEQ ID NO: 2753888 - RNA, 16 nt, Human
cuacgcgcgcuccgcg

SEQ ID NO: 2753889 - RNA, 19 nt, Human
cuacuaaaaauacaaaaau

SEQ ID NO: 2753890 - RNA, 12 nt, Human
cuacuagaaaau

SEQ ID NO: 2753891 - RNA, 16 nt, Human
cuacuagaaaauugug

SEQ ID NO: 2753892 - RNA, 22 nt, Human
cuacuauccaacuuauauuucu

SEQ ID NO: 2753893 - RNA, 18 nt, Human
cuacuccauuaaauauaa

SEQ ID NO: 2753894 - RNA, 24 nt, Human
cuacucuguuccuucacauccugu

SEQ ID NO: 2753895 - RNA, 16 nt, Human
cuacuuccagggcuac

SEQ ID NO: 2753896 - RNA, 20 nt, Human
cuacuuccccuuccuaauuc

SEQ ID NO: 2753897 - RNA, 22 nt, Human
cuacuugggaggcugaggcaag

SEQ ID NO: 2753898 - RNA, 22 nt, Human
cuacuuguggggcuaaggcagg

SEQ ID NO: 2753899 - RNA, 14 nt, Human
cuacuuuaaaaaaa

SEQ ID NO: 2753900 - RNA, 16 nt, Human
cuagaaaacaggcaaa

SEQ ID NO: 2753901 - RNA, 17 nt, Human
cuagaaaacaggcaaau

SEQ ID NO: 2753902 - RNA, 15 nt, Human
cuagaaaauuuaaaa

SEQ ID NO: 2753903 - RNA, 18 nt, Human
cuagaaaauuuaaaacau

SEQ ID NO: 2753904 - RNA, 14 nt, Human
cuagaacagucucu

SEQ ID NO: 2753905 - RNA, 16 nt, Human
cuagaacucccuuuca

SEQ ID NO: 2753906 - RNA, 17 nt, Human
cuagaauacuaauaaaa

SEQ ID NO: 2753907 - RNA, 14 nt, Human
cuagaauucacucc

SEQ ID NO: 2753908 - RNA, 16 nt, Human
cuagaauucacuccac

SEQ ID NO: 2753909 - RNA, 18 nt, Human
cuagaauuucuuuaacuu

SEQ ID NO: 2753910 - RNA, 22 nt, Human
cuagacaaguccagccuggcaa

SEQ ID NO: 2753911 - RNA, 15 nt, Human
cuagagacucaaaga

SEQ ID NO: 2753912 - RNA, 15 nt, Human
cuagaggcuuccuuc

SEQ ID NO: 2753913 - RNA, 20 nt, Human
cuagaggcuuccuucauuuc

SEQ ID NO: 2753914 - RNA, 19 nt, Human
cuagaguuuagcuggaaaa

SEQ ID NO: 2753915 - RNA, 15 nt, Human
cuagauacugaaugu

SEQ ID NO: 2753916 - RNA, 21 nt, Human
cuagauacugaauguaaacaa

SEQ ID NO: 2753917 - RNA, 22 nt, Human
cuagauacugaauguaaacaaa

SEQ ID NO: 2753918 - RNA, 19 nt, Human
cuagcagauacagggauga

SEQ ID NO: 2753919 - RNA, 23 nt, Human
cuagcagauacagggaugaggca

SEQ ID NO: 2753920 - RNA, 21 nt, Human
cuagcaugaagacagagcccc

SEQ ID NO: 2753921 - RNA, 19 nt, Human
cuagcaugucgucaaagcu

SEQ ID NO: 2753922 - RNA, 11 nt, Human
cuagccagagg

SEQ ID NO: 2753923 - RNA, 16 nt, Human
cuagccagaggcucua

SEQ ID NO: 2753924 - RNA, 18 nt, Human
cuagccagaggcucuaau

SEQ ID NO: 2753925 - RNA, 12 nt, Human
cuagccugccuc

SEQ ID NO: 2753926 - RNA, 13 nt, Human
cuagccugccucc

SEQ ID NO: 2753927 - RNA, 14 nt, Human
cuagccugccuccc

SEQ ID NO: 2753928 - RNA, 14 nt, Human
cuagcgcagccaug

SEQ ID NO: 2753929 - RNA, 16 nt, Human
cuaggaaauauuuauu

SEQ ID NO: 2753930 - RNA, 21 nt, Human
cuaggaugggaacaaggaagg

SEQ ID NO: 2753931 - RNA, 22 nt, Human
cuaggaugggaacaaggaagga

SEQ ID NO: 2753932 - RNA, 23 nt, Human
cuaggaugggaacaaggaaggaa

SEQ ID NO: 2753933 - RNA, 16 nt, Human
cuaggcauagcccugc

SEQ ID NO: 2753934 - RNA, 18 nt, Human
cuaggcauagcccugccu

SEQ ID NO: 2753935 - RNA, 16 nt, Human
cuagggcagggacagg

SEQ ID NO: 2753936 - RNA, 19 nt, Human
cuaggguggugcauuuuug

SEQ ID NO: 2753937 - RNA, 20 nt, Human
cuaggguggugcauuuuugu

SEQ ID NO: 2753938 - RNA, 19 nt, Human
cuaguaucaaaagaaagaa

SEQ ID NO: 2753939 - RNA, 21 nt, Human
cuaguaucaaaagaaagaaaa

SEQ ID NO: 2753940 - RNA, 12 nt, Human
cuaguccccagc

SEQ ID NO: 2753941 - RNA, 18 nt, Human
cuaguccccagccugcuc

SEQ ID NO: 2753942 - RNA, 19 nt, Human
cuaguccccagccugcucc

SEQ ID NO: 2753943 - RNA, 22 nt, Human
cuagucucaaacuccugaccuc

SEQ ID NO: 2753944 - RNA, 22 nt, Human
cuagucucuaucauuaaaguuc

SEQ ID NO: 2753945 - RNA, 23 nt, Human
cuagucuguuuucccuccuugga

SEQ ID NO: 2753946 - RNA, 14 nt, Human
cuaguucuguagaa

SEQ ID NO: 2753947 - RNA, 17 nt, Human
cuaguuguaauuuuuuu

SEQ ID NO: 2753948 - RNA, 16 nt, Human
cuaguuuauauagaaa

SEQ ID NO: 2753949 - RNA, 21 nt, Human
cuauaaaacuaggugcugcag

SEQ ID NO: 2753950 - RNA, 12 nt, Human
cuauaacaacaa

SEQ ID NO: 2753951 - RNA, 14 nt, Human
cuauaauguaaaca

SEQ ID NO: 2753952 - RNA, 16 nt, Human
cuauaauguaaacaau

SEQ ID NO: 2753953 - RNA, 18 nt, Human
cuauaauguaaacaauau

SEQ ID NO: 2753954 - RNA, 16 nt, Human
cuauaauguguucauu

SEQ ID NO: 2753955 - RNA, 21 nt, Human
cuauaauuuaaauauaugcua

SEQ ID NO: 2753956 - RNA, 18 nt, Human
cuauagauucuuuauuag

SEQ ID NO: 2753957 - RNA, 18 nt, Human
cuauauacucacuuucua

SEQ ID NO: 2753958 - RNA, 15 nt, Human
cuauauccugugacu

SEQ ID NO: 2753959 - RNA, 16 nt, Human
cuauauuuuuuguuaa

SEQ ID NO: 2753960 - RNA, 21 nt, Human
cuauauuuuuuguuaaaugau

SEQ ID NO: 2753961 - RNA, 17 nt, Human
cuauccuacuuccccuu

SEQ ID NO: 2753962 - RNA, 13 nt, Human
cuaucgcaccacu

SEQ ID NO: 2753963 - RNA, 22 nt, Human
cuaucuaauuuuuauuaauuug

SEQ ID NO: 2753964 - RNA, 17 nt, Human
cuaucucauuuccaagc

SEQ ID NO: 2753965 - RNA, 16 nt, Human
cuaucugggcuguggg

SEQ ID NO: 2753966 - RNA, 13 nt, Human
cuaucuuugagcg

SEQ ID NO: 2753967 - RNA, 15 nt, Human
cuaucuuugagcgcc

SEQ ID NO: 2753968 - RNA, 13 nt, Human
cuaugaaauauua

SEQ ID NO: 2753969 - RNA, 19 nt, Human
cuaugaacucuguuuucuu

SEQ ID NO: 2753970 - RNA, 21 nt, Human
cuaugaaguuuuuuuuauaca

SEQ ID NO: 2753971 - RNA, 15 nt, Human
cuaugaggaauauuu

SEQ ID NO: 2753972 - RNA, 22 nt, Human
cuaugcuuguaacugucuucua

SEQ ID NO: 2753973 - RNA, 14 nt, Human
cuauggaaaaaaag

SEQ ID NO: 2753974 - RNA, 20 nt, Human
cuauguagaauauauuuccu

SEQ ID NO: 2753975 - RNA, 22 nt, Human
cuauguagaauauauuuccuua

SEQ ID NO: 2753976 - RNA, 16 nt, Human
cuauguggaagugggg

SEQ ID NO: 2753977 - RNA, 17 nt, Human
cuauguggaaguggggc

SEQ ID NO: 2753978 - RNA, 15 nt, Human
cuccauacucuguaa

SEQ ID NO: 2753979 - RNA, 14 nt, Human
cuccauaucauuug

SEQ ID NO: 2753980 - RNA, 16 nt, Human
cuccauccugaggcuc

SEQ ID NO: 2753981 - RNA, 17 nt, Human
cuccauccugaggcucc

SEQ ID NO: 2753982 - RNA, 18 nt, Human
cuccauccugaggcucca

SEQ ID NO: 2753983 - RNA, 17 nt, Human
cuccaucucuugaccuc

SEQ ID NO: 2753984 - RNA, 20 nt, Human
cuccaugaauaucaguuauu

SEQ ID NO: 2753985 - RNA, 16 nt, Human
cuccaugggguggggg

SEQ ID NO: 2753986 - RNA, 12 nt, Human
cuccauuuuuag

SEQ ID NO: 2753987 - RNA, 18 nt, Human
cuccauuuuuagugaaau

SEQ ID NO: 2753988 - RNA, 16 nt, Human
cucccaaagugcuggg

SEQ ID NO: 2753989 - RNA, 19 nt, Human
cucccaagcaccugggauu

SEQ ID NO: 2753990 - RNA, 21 nt, Human
cucccaagcaccugggauuac

SEQ ID NO: 2753991 - RNA, 17 nt, Human
cucccaccaccucacca

SEQ ID NO: 2753992 - RNA, 13 nt, Human
cucccacugccaa

SEQ ID NO: 2753993 - RNA, 18 nt, Human
cucccacuucagccuccc

SEQ ID NO: 2753994 - RNA, 19 nt, Human
cucccagcucagggcucuu

SEQ ID NO: 2753995 - RNA, 22 nt, Human
cuccccaaaggcuuugcccugc

SEQ ID NO: 2753996 - RNA, 23 nt, Human
cuccccaaaggcuuugcccugcu

SEQ ID NO: 2753997 - RNA, 18 nt, Human
cuccccaaaugcuuucca

SEQ ID NO: 2753998 - RNA, 18 nt, Human
cuccccccccccgccacc

SEQ ID NO: 2753999 - RNA, 14 nt, Human
cuccccuccucugc

SEQ ID NO: 2754000 - RNA, 16 nt, Human
cuccccuucacuccca

SEQ ID NO: 2754001 - RNA, 13 nt, Human
cuccccuucucug

SEQ ID NO: 2754002 - RNA, 14 nt, Human
cucccggccgcgcu

SEQ ID NO: 2754003 - RNA, 16 nt, Human
cucccuaccuaccaag

SEQ ID NO: 2754004 - RNA, 14 nt, Human
cucccuagccagag

SEQ ID NO: 2754005 - RNA, 13 nt, Human
cucccuaguuccu

SEQ ID NO: 2754006 - RNA, 12 nt, Human
cucccuccaccu

SEQ ID NO: 2754007 - RNA, 20 nt, Human
cucccuccaccucccugcaa

SEQ ID NO: 2754008 - RNA, 14 nt, Human
cucccucuaauuua

SEQ ID NO: 2754009 - RNA, 12 nt, Human
cucccugccccc

SEQ ID NO: 2754010 - RNA, 15 nt, Human
cucccugccccccag

SEQ ID NO: 2754011 - RNA, 20 nt, Human
cucccugccccccagcccuc

SEQ ID NO: 2754012 - RNA, 17 nt, Human
cucccuggaaucuugua

SEQ ID NO: 2754013 - RNA, 18 nt, Human
cucccuggauuuuuacca

SEQ ID NO: 2754014 - RNA, 22 nt, Human
cucccuggauuuuuaccagucu

SEQ ID NO: 2754015 - RNA, 14 nt, Human
cucccuuggggccu

SEQ ID NO: 2754016 - RNA, 13 nt, Human
cucccuuucaaca

SEQ ID NO: 2754017 - RNA, 13 nt, Human
cuccgaggggugg

SEQ ID NO: 2754018 - RNA, 22 nt, Human
cuccgccauucucaagcccugc

SEQ ID NO: 2754019 - RNA, 13 nt, Human
cuccgccucccau

SEQ ID NO: 2754020 - RNA, 18 nt, Human
cuccgcgcagcucaggcu

SEQ ID NO: 2754021 - RNA, 19 nt, Human
cuccgucucccaaagugcu

SEQ ID NO: 2754022 - RNA, 22 nt, Human
cuccgucucccaaagugcuggg

SEQ ID NO: 2754023 - RNA, 17 nt, Human
cuccuaagaaggcaccu

SEQ ID NO: 2754024 - RNA, 11 nt, Human
cuccucaggga

SEQ ID NO: 2754025 - RNA, 13 nt, Human
cuccuccauaucu

SEQ ID NO: 2754026 - RNA, 20 nt, Human
cuccuccauaucucccucuu

SEQ ID NO: 2754027 - RNA, 21 nt, Human
cuccuccauaucucccucuuc

SEQ ID NO: 2754028 - RNA, 17 nt, Human
cuccucucagugggugg

SEQ ID NO: 2754029 - RNA, 12 nt, Human
cuccucucucaa

SEQ ID NO: 2754030 - RNA, 18 nt, Human
cuccucuguccagggccc

SEQ ID NO: 2754031 - RNA, 14 nt, Human
cuccugaccccaag

SEQ ID NO: 2754032 - RNA, 16 nt, Human
cuccugaccucaggca

SEQ ID NO: 2754033 - RNA, 14 nt, Human
cuccugagacacau

SEQ ID NO: 2754034 - RNA, 22 nt, Human
cuccugaggaugugucccaucu

SEQ ID NO: 2754035 - RNA, 22 nt, Human
cuccugccuaagugcagccccg

SEQ ID NO: 2754036 - RNA, 14 nt, Human
cuccugccucagcc

SEQ ID NO: 2754037 - RNA, 17 nt, Human
cuccugggaaugaagca

SEQ ID NO: 2754038 - RNA, 15 nt, Human
cuccugggcagcugc

SEQ ID NO: 2754039 - RNA, 16 nt, Human
cuccugggcagcugcc

SEQ ID NO: 2754040 - RNA, 17 nt, Human
cuccugggcagcugccu

SEQ ID NO: 2754041 - RNA, 21 nt, Human
cuccugggcagcugccucccc

SEQ ID NO: 2754042 - RNA, 15 nt, Human
cuccugguuccuagg

SEQ ID NO: 2754043 - RNA, 17 nt, Human
cuccugucugccagcca

SEQ ID NO: 2754044 - RNA, 20 nt, Human
cuccuguuucacuugguuca

SEQ ID NO: 2754045 - RNA, 17 nt, Human
cuccuuaucaaaggaca

SEQ ID NO: 2754046 - RNA, 13 nt, Human
cuccuuggagaca

SEQ ID NO: 2754047 - RNA, 19 nt, Human
cuccuuggagacagggccc

SEQ ID NO: 2754048 - RNA, 13 nt, Human
cuccuuuuuccuu

SEQ ID NO: 2754049 - RNA, 17 nt, Human
cuccuuuuuccuuccag

SEQ ID NO: 2754050 - RNA, 15 nt, Human
cucgaacugcuggau

SEQ ID NO: 2754051 - RNA, 16 nt, Human
cucgaacugcuggauu

SEQ ID NO: 2754052 - RNA, 11 nt, Human
cucgaaucacu

SEQ ID NO: 2754053 - RNA, 15 nt, Human
cucgagcguugcugg

SEQ ID NO: 2754054 - RNA, 15 nt, Human
cucgcccacuuccuc

SEQ ID NO: 2754055 - RNA, 22 nt, Human
cucgcuuccgcauccuagucuc

SEQ ID NO: 2754056 - RNA, 20 nt, Human
cucggacggcuccggacgcu

SEQ ID NO: 2754057 - RNA, 16 nt, Human
cucggccugcucgccc

SEQ ID NO: 2754058 - RNA, 17 nt, Human
cucgguggacccaggga

SEQ ID NO: 2754059 - RNA, 15 nt, Human
cucguggaacaguua

SEQ ID NO: 2754060 - RNA, 17 nt, Human
cucguggaacaguuacc

SEQ ID NO: 2754061 - RNA, 15 nt, Human
cucgugggacaguca

SEQ ID NO: 2754062 - RNA, 16 nt, Human
cucgugguaggacugu

SEQ ID NO: 2754063 - RNA, 16 nt, Human
cucguuccaguggcgg

SEQ ID NO: 2754064 - RNA, 19 nt, Human
cucguuccaguggcggcac

SEQ ID NO: 2754065 - RNA, 13 nt, Human
cucuaacucagaa

SEQ ID NO: 2754066 - RNA, 13 nt, Human
cucuaagaaagaa

SEQ ID NO: 2754067 - RNA, 15 nt, Human
cucuaauguacaaua

SEQ ID NO: 2754068 - RNA, 21 nt, Human
cucuacauaaaauacaaaaac

SEQ ID NO: 2754069 - RNA, 20 nt, Human
cucuaccaaaaaaaggaagg

SEQ ID NO: 2754070 - RNA, 15 nt, Human
cucuacuaaaaauac

SEQ ID NO: 2754071 - RNA, 18 nt, Human
cucuacuaaaaauacaaa

SEQ ID NO: 2754072 - RNA, 20 nt, Human
cucuacuaaaaauacaaaaa

SEQ ID NO: 2754073 - RNA, 23 nt, Human
cucuacuaaaaauacaaaaaaaa

SEQ ID NO: 2754074 - RNA, 14 nt, Human
cucuaggacauaaa

SEQ ID NO: 2754075 - RNA, 16 nt, Human
cucuaggacauaaauu

SEQ ID NO: 2754076 - RNA, 12 nt, Human
cucuaucauuaa

SEQ ID NO: 2754077 - RNA, 15 nt, Human
cucuaucauuuaaua

SEQ ID NO: 2754078 - RNA, 18 nt, Human
cucuauguucuaagaagu

SEQ ID NO: 2754079 - RNA, 14 nt, Human
cucucaaggagagg

SEQ ID NO: 2754080 - RNA, 19 nt, Human
cucucacuuguuuuauuua

SEQ ID NO: 2754081 - RNA, 20 nt, Human
cucuccaaagcccucccuac

SEQ ID NO: 2754082 - RNA, 19 nt, Human
cucuccaccagguucuuuc

SEQ ID NO: 2754083 - RNA, 20 nt, Human
cucuccaccaucgucuucuu

SEQ ID NO: 2754084 - RNA, 21 nt, Human
cucuccaccaucgucuucuug

SEQ ID NO: 2754085 - RNA, 22 nt, Human
cucuccaggagaccuacccucc

SEQ ID NO: 2754086 - RNA, 13 nt, Human
cucuccccuucuc

SEQ ID NO: 2754087 - RNA, 20 nt, Human
cucuccugggcagcugccuc

SEQ ID NO: 2754088 - RNA, 21 nt, Human
cucuccugggcagcugccucc

SEQ ID NO: 2754089 - RNA, 23 nt, Human
cucuccugggcagcugccucccc

SEQ ID NO: 2754090 - RNA, 14 nt, Human
cucucguaagauuu

SEQ ID NO: 2754091 - RNA, 13 nt, Human
cucucucugaggg

SEQ ID NO: 2754092 - RNA, 22 nt, Human
cucucugcaggcagccugccuu

SEQ ID NO: 2754093 - RNA, 12 nt, Human
cucucuggaagc

SEQ ID NO: 2754094 - RNA, 18 nt, Human
cucucuggaagccccugg

SEQ ID NO: 2754095 - RNA, 14 nt, Human
cucucuggccuucg

SEQ ID NO: 2754096 - RNA, 21 nt, Human
cucucuuauagaauauuuauu

SEQ ID NO: 2754097 - RNA, 22 nt, Human
cucucuuauagaauauuuauua

SEQ ID NO: 2754098 - RNA, 22 nt, Human
cucucuuauugccucacuucag

SEQ ID NO: 2754099 - RNA, 12 nt, Human
cucucuucuuuu

SEQ ID NO: 2754100 - RNA, 12 nt, Human
cucucuuuccuc

SEQ ID NO: 2754101 - RNA, 22 nt, Human
cucugaauuugagauacaaaca

SEQ ID NO: 2754102 - RNA, 14 nt, Human
cucugagagcauca

SEQ ID NO: 2754103 - RNA, 22 nt, Human
cucugagccuugggaccccuga

SEQ ID NO: 2754104 - RNA, 13 nt, Human
cucugaggggugg

SEQ ID NO: 2754105 - RNA, 16 nt, Human
cucugagggguggggg

SEQ ID NO: 2754106 - RNA, 17 nt, Human
cucugauccgagcucag

SEQ ID NO: 2754107 - RNA, 12 nt, Human
cucugcaaacug

SEQ ID NO: 2754108 - RNA, 17 nt, Human
cucugcaaacugccuuc

SEQ ID NO: 2754109 - RNA, 18 nt, Human
cucugcaaacugccuucu

SEQ ID NO: 2754110 - RNA, 19 nt, Human
cucugcaaacugccuucuu

SEQ ID NO: 2754111 - RNA, 17 nt, Human
cucugcaagaagaaauc

SEQ ID NO: 2754112 - RNA, 17 nt, Human
cucugcaaugaccuuca

SEQ ID NO: 2754113 - RNA, 16 nt, Human
cucugcacacccucca

SEQ ID NO: 2754114 - RNA, 20 nt, Human
cucugcagcuuccaggcugg

SEQ ID NO: 2754115 - RNA, 19 nt, Human
cucugcaggcagccugccu

SEQ ID NO: 2754116 - RNA, 20 nt, Human
cucugcaggucccuaauaaa

SEQ ID NO: 2754117 - RNA, 15 nt, Human
cucugcauacucauu

SEQ ID NO: 2754118 - RNA, 19 nt, Human
cucugcauacucauuagga

SEQ ID NO: 2754119 - RNA, 16 nt, Human
cucugcccauccugcc

SEQ ID NO: 2754120 - RNA, 13 nt, Human
cucugcccuuccu

SEQ ID NO: 2754121 - RNA, 19 nt, Human
cucugccucagaaaacaag

SEQ ID NO: 2754122 - RNA, 12 nt, Human
cucugcuugcca

SEQ ID NO: 2754123 - RNA, 14 nt, Human
cucugcuugccauc

SEQ ID NO: 2754124 - RNA, 13 nt, Human
cugcaauuccacu

SEQ ID NO: 2754125 - RNA, 20 nt, Human
cugcacacagcacgggggcc

SEQ ID NO: 2754126 - RNA, 16 nt, Human
cugcaccaugcugcug

SEQ ID NO: 2754127 - RNA, 20 nt, Human
cugcaccaugcugcugggga

SEQ ID NO: 2754128 - RNA, 17 nt, Human
cugcacgaauggaagag

SEQ ID NO: 2754129 - RNA, 13 nt, Human
cugcacuccagcc

SEQ ID NO: 2754130 - RNA, 15 nt, Human
cugcacuccagccug

SEQ ID NO: 2754131 - RNA, 22 nt, Human
cugcacugugggcuuuuauugc

SEQ ID NO: 2754132 - RNA, 14 nt, Human
cugcagacaugaga

SEQ ID NO: 2754133 - RNA, 18 nt, Human
cugcagacaugagagaca

SEQ ID NO: 2754134 - RNA, 21 nt, Human
cugcagacaugagagacagca

SEQ ID NO: 2754135 - RNA, 14 nt, Human
cugcagacucacug

SEQ ID NO: 2754136 - RNA, 15 nt, Human
cugcagacucacugu

SEQ ID NO: 2754137 - RNA, 16 nt, Human
cugcagacucacugug

SEQ ID NO: 2754138 - RNA, 15 nt, Human
cugcagauaaacagu

SEQ ID NO: 2754139 - RNA, 18 nt, Human
cugcagccccugggacca

SEQ ID NO: 2754140 - RNA, 18 nt, Human
cugcagcgaguacuuccc

SEQ ID NO: 2754141 - RNA, 20 nt, Human
cugcagcgaguacuucccgc

SEQ ID NO: 2754142 - RNA, 19 nt, Human
cugcagcucaagggcuggc

SEQ ID NO: 2754143 - RNA, 18 nt, Human
cugcagcucucuuuccuc

SEQ ID NO: 2754144 - RNA, 13 nt, Human
cugcagcuuccag

SEQ ID NO: 2754145 - RNA, 17 nt, Human
cugcaggcagccugccu

SEQ ID NO: 2754146 - RNA, 18 nt, Human
cugcaggcgugaccugac

SEQ ID NO: 2754147 - RNA, 20 nt, Human
cugcaggcuccccuccucgg

SEQ ID NO: 2754148 - RNA, 22 nt, Human
cugcaggcuccccuccucggcu

SEQ ID NO: 2754149 - RNA, 23 nt, Human
cugcaggggccucuguuccuuuc

SEQ ID NO: 2754150 - RNA, 11 nt, Human
cugcagguccc

SEQ ID NO: 2754151 - RNA, 18 nt, Human
cugcauccauucuccuga

SEQ ID NO: 2754152 - RNA, 16 nt, Human
cugcaugcacuucuua

SEQ ID NO: 2754153 - RNA, 18 nt, Human
cugccaagagugaaggga

SEQ ID NO: 2754154 - RNA, 16 nt, Human
cugccaagccaugggu

SEQ ID NO: 2754155 - RNA, 15 nt, Human
cugccacaccucucc

SEQ ID NO: 2754156 - RNA, 13 nt, Human
cugccacccaaac

SEQ ID NO: 2754157 - RNA, 22 nt, Human
cugccagaaucuagagcaaagc

SEQ ID NO: 2754158 - RNA, 17 nt, Human
cugccagcuggccuugu

SEQ ID NO: 2754159 - RNA, 19 nt, Human
cugccaggcacacugagcc

SEQ ID NO: 2754160 - RNA, 20 nt, Human
cugccaggcacacugagcca

SEQ ID NO: 2754161 - RNA, 20 nt, Human
cugcccagaaaccuuuguuu

SEQ ID NO: 2754162 - RNA, 15 nt, Human
cugcccauccugccc

SEQ ID NO: 2754163 - RNA, 14 nt, Human
cugccccccagccc

SEQ ID NO: 2754164 - RNA, 19 nt, Human
cugccccccagcccuccuu

SEQ ID NO: 2754165 - RNA, 21 nt, Human
cugccccggggaggggcgcuc

SEQ ID NO: 2754166 - RNA, 22 nt, Human
cugccccggggaggggcgcucg

SEQ ID NO: 2754167 - RNA, 13 nt, Human
cugccccugagcc

SEQ ID NO: 2754168 - RNA, 12 nt, Human
cugcccgccucg

SEQ ID NO: 2754169 - RNA, 19 nt, Human
cugcccgccucgaccucuc

SEQ ID NO: 2754170 - RNA, 13 nt, Human
cugcccuagagca

SEQ ID NO: 2754171 - RNA, 14 nt, Human
cugcccucccccuc

SEQ ID NO: 2754172 - RNA, 21 nt, Human
cugcccucccccuccucucca

SEQ ID NO: 2754173 - RNA, 23 nt, Human
cugcccucccccuccucuccacc

SEQ ID NO: 2754174 - RNA, 16 nt, Human
cugcccucuccugggc

SEQ ID NO: 2754175 - RNA, 18 nt, Human
cugcccucuccugggcag

SEQ ID NO: 2754176 - RNA, 20 nt, Human
cugcccugcugagucccagg

SEQ ID NO: 2754177 - RNA, 21 nt, Human
cugcccugcugagucccaggc

SEQ ID NO: 2754178 - RNA, 15 nt, Human
cugcccuuccccuuc

SEQ ID NO: 2754179 - RNA, 14 nt, Human
cugccgcaacaguu

SEQ ID NO: 2754180 - RNA, 20 nt, Human
cugccgugggccugagacca

SEQ ID NO: 2754181 - RNA, 16 nt, Human
cugccuaagugcagcc

SEQ ID NO: 2754182 - RNA, 17 nt, Human
cugccuaagugcagccc

SEQ ID NO: 2754183 - RNA, 21 nt, Human
cugccucaagcuaugugagcu

SEQ ID NO: 2754184 - RNA, 13 nt, Human
cugccucaaucag

SEQ ID NO: 2754185 - RNA, 17 nt, Human
cugccucaccagcccug

SEQ ID NO: 2754186 - RNA, 18 nt, Human
cugccucaccagcccugg

SEQ ID NO: 2754187 - RNA, 15 nt, Human
cugccucagccuccc

SEQ ID NO: 2754188 - RNA, 13 nt, Human
cugccuccccucc

SEQ ID NO: 2754189 - RNA, 15 nt, Human
cugccuccccuccuc

SEQ ID NO: 2754190 - RNA, 18 nt, Human
cugccuccccuccucugc

SEQ ID NO: 2754191 - RNA, 19 nt, Human
cugccuccccuccucugcu

SEQ ID NO: 2754192 - RNA, 17 nt, Human
cugccuccccugccuca

SEQ ID NO: 2754193 - RNA, 20 nt, Human
cugccuccccuucacuccca

SEQ ID NO: 2754194 - RNA, 21 nt, Human
cugccuccccuucacucccac

SEQ ID NO: 2754195 - RNA, 15 nt, Human
cugccucuaaaaggc

SEQ ID NO: 2754196 - RNA, 17 nt, Human
cugccucucucauccac

SEQ ID NO: 2754197 - RNA, 13 nt, Human
cugccucucugca

SEQ ID NO: 2754198 - RNA, 15 nt, Human
cugccucucugcagg

SEQ ID NO: 2754199 - RNA, 19 nt, Human
cugccugccccuacccugg

SEQ ID NO: 2754200 - RNA, 15 nt, Human
cugccugcuuuuuau

SEQ ID NO: 2754201 - RNA, 13 nt, Human
cugccuucucaac

SEQ ID NO: 2754202 - RNA, 16 nt, Human
cugccuuggcuuccca

SEQ ID NO: 2754203 - RNA, 16 nt, Human
cugcgcgccgcgcucc

SEQ ID NO: 2754204 - RNA, 20 nt, Human
cugcgcgccgcgcuccucgg

SEQ ID NO: 2754205 - RNA, 14 nt, Human
cugcgcucggccug

SEQ ID NO: 2754206 - RNA, 15 nt, Human
cugcgcucggccugc

SEQ ID NO: 2754207 - RNA, 17 nt, Human
cugcgcucggccugcuc

SEQ ID NO: 2754208 - RNA, 18 nt, Human
cugcgcucggccugcucg

SEQ ID NO: 2754209 - RNA, 19 nt, Human
cugcgcucggccugcucgc

SEQ ID NO: 2754210 - RNA, 21 nt, Human
cugcgcucggccugcucgccc

SEQ ID NO: 2754211 - RNA, 18 nt, Human
cugcgcuguguacaaugu

SEQ ID NO: 2754212 - RNA, 20 nt, Human
cugcuacccucauuucucau

SEQ ID NO: 2754213 - RNA, 13 nt, Human
cugcuaccucacu

SEQ ID NO: 2754214 - RNA, 17 nt, Human
cugcuaccucacugggg

SEQ ID NO: 2754215 - RNA, 14 nt, Human
cugcuaguuuauau

SEQ ID NO: 2754216 - RNA, 22 nt, Human
cugcuaugcuauugaaguuuug

SEQ ID NO: 2754217 - RNA, 18 nt, Human
cugcuauucuccauacuc

SEQ ID NO: 2754218 - RNA, 13 nt, Human
cugcucagcccug

SEQ ID NO: 2754219 - RNA, 14 nt, Human
cugcucagcccugc

SEQ ID NO: 2754220 - RNA, 16 nt, Human
cugcucagcccugcac

SEQ ID NO: 2754221 - RNA, 18 nt, Human
cugcucagcccugcacca

SEQ ID NO: 2754222 - RNA, 14 nt, Human
cugcucagggcugg

SEQ ID NO: 2754223 - RNA, 16 nt, Human
cugcucagggcugguc

SEQ ID NO: 2754224 - RNA, 22 nt, Human
cugcucauaugauguacaugua

SEQ ID NO: 2754225 - RNA, 14 nt, Human
cugcucccuagcca

SEQ ID NO: 2754226 - RNA, 21 nt, Human
cugcucuuccucagcugugug

SEQ ID NO: 2754227 - RNA, 22 nt, Human
cugcugacacagacauccucua

SEQ ID NO: 2754228 - RNA, 16 nt, Human
cugcugagccccaagu

SEQ ID NO: 2754229 - RNA, 16 nt, Human
cugcugagucccaggc

SEQ ID NO: 2754230 - RNA, 18 nt, Human
cugcugagucccaggcug

SEQ ID NO: 2754231 - RNA, 23 nt, Human
cugcugagucccaggcugagccu

SEQ ID NO: 2754232 - RNA, 17 nt, Human
cugcugcccucccccuc

SEQ ID NO: 2754233 - RNA, 22 nt, Human
cugcugcccucccccuccucuc

SEQ ID NO: 2754234 - RNA, 18 nt, Human
cugcugcccuuccccuuc

SEQ ID NO: 2754235 - RNA, 14 nt, Human
cugcugccgugggc

SEQ ID NO: 2754236 - RNA, 14 nt, Human
cugcugccugcuuu

SEQ ID NO: 2754237 - RNA, 22 nt, Human
cugcuggagacauugaggcagg

SEQ ID NO: 2754238 - RNA, 15 nt, Human
cugcuggauguggag

SEQ ID NO: 2754239 - RNA, 19 nt, Human
cugcuggauucaagugauc

SEQ ID NO: 2754240 - RNA, 21 nt, Human
cugcuggauucaagugauccg

SEQ ID NO: 2754241 - RNA, 15 nt, Human
cugcuggggaagaca

SEQ ID NO: 2754242 - RNA, 17 nt, Human
cugcuggggaagacagu

SEQ ID NO: 2754243 - RNA, 20 nt, Human
cugcugucccaaacaugcac

SEQ ID NO: 2754244 - RNA, 11 nt, Human
cugcugugcag

SEQ ID NO: 2754245 - RNA, 23 nt, Human
cugcuguggccaucaaccucugu

SEQ ID NO: 2754246 - RNA, 18 nt, Human
cugcuguuuccuagcgca

SEQ ID NO: 2754247 - RNA, 14 nt, Human
cugcuugaacuagg

SEQ ID NO: 2754248 - RNA, 21 nt, Human
cugcuugccaucccucccucc

SEQ ID NO: 2754249 - RNA, 22 nt, Human
cugcuuggagcagccuaacacg

SEQ ID NO: 2754250 - RNA, 13 nt, Human
cugcuuucaucuu

SEQ ID NO: 2754251 - RNA, 13 nt, Human
cuggaaaacugcu

SEQ ID NO: 2754252 - RNA, 15 nt, Human
cuggaaacacauguu

SEQ ID NO: 2754253 - RNA, 14 nt, Human
cuggaaaucagggu

SEQ ID NO: 2754254 - RNA, 13 nt, Human
cuggaaggcuucc

SEQ ID NO: 2754255 - RNA, 14 nt, Human
cuggaauguaauca

SEQ ID NO: 2754256 - RNA, 18 nt, Human
cuggacaguuuucugcuu

SEQ ID NO: 2754257 - RNA, 15 nt, Human
cuggacucaccuccc

SEQ ID NO: 2754258 - RNA, 17 nt, Human
cuggacucaccuccccc

SEQ ID NO: 2754259 - RNA, 18 nt, Human
cuggacugugugcucagg

SEQ ID NO: 2754260 - RNA, 16 nt, Human
cuggacuugccucugc

SEQ ID NO: 2754261 - RNA, 17 nt, Human
cuggacuuuccagagac

SEQ ID NO: 2754262 - RNA, 20 nt, Human
cuggacuuuccagagaccag

SEQ ID NO: 2754263 - RNA, 22 nt, Human
cuggagacauugaggcaggcac

SEQ ID NO: 2754264 - RNA, 16 nt, Human
cuggagccccaucagc

SEQ ID NO: 2754265 - RNA, 21 nt, Human
cuggagccccaucagcuccag

SEQ ID NO: 2754266 - RNA, 15 nt, Human
cuggagggaagccuu

SEQ ID NO: 2754267 - RNA, 19 nt, Human
cuggagggaccuugucucc

SEQ ID NO: 2754268 - RNA, 22 nt, Human
cuggagggaccuugucucccag

SEQ ID NO: 2754269 - RNA, 21 nt, Human
cugugcaaauauaucugcuau

SEQ ID NO: 2754270 - RNA, 13 nt, Human
cugugcggccugg

SEQ ID NO: 2754271 - RNA, 17 nt, Human
cugugcggccuggucua

SEQ ID NO: 2754272 - RNA, 14 nt, Human
cugugcgugugugu

SEQ ID NO: 2754273 - RNA, 15 nt, Human
cuguggauuuaaugu

SEQ ID NO: 2754274 - RNA, 15 nt, Human
cugugggaaggagac

SEQ ID NO: 2754275 - RNA, 14 nt, Human
cuguguauucauuc

SEQ ID NO: 2754276 - RNA, 21 nt, Human
cuguguauuuaacugccuugu

SEQ ID NO: 2754277 - RNA, 21 nt, Human
cuguguccucaugagggcugg

SEQ ID NO: 2754278 - RNA, 14 nt, Human
cugugugcucagga

SEQ ID NO: 2754279 - RNA, 15 nt, Human
cugugugcucaggag

SEQ ID NO: 2754280 - RNA, 22 nt, Human
cuguguggagagggaaugugaa

SEQ ID NO: 2754281 - RNA, 23 nt, Human
cuguguggagagggaaugugaaa

SEQ ID NO: 2754282 - RNA, 12 nt, Human
cuguuaaaauau

SEQ ID NO: 2754283 - RNA, 22 nt, Human
cuguuagcaugcuggugagcca

SEQ ID NO: 2754284 - RNA, 20 nt, Human
cuguuaugaguggcuuuaau

SEQ ID NO: 2754285 - RNA, 19 nt, Human
cuguucacagccagacugg

SEQ ID NO: 2754286 - RNA, 21 nt, Human
cuguuccuucacauccugugu

SEQ ID NO: 2754287 - RNA, 15 nt, Human
cuguuccuuucucug

SEQ ID NO: 2754288 - RNA, 16 nt, Human
cuguucgcgcgccucc

SEQ ID NO: 2754289 - RNA, 21 nt, Human
cuguugacauucggggugauc

SEQ ID NO: 2754290 - RNA, 21 nt, Human
cuguugccaaggcuggagugc

SEQ ID NO: 2754291 - RNA, 15 nt, Human
cuguugccaggcugg

SEQ ID NO: 2754292 - RNA, 21 nt, Human
cuguugggguggguauaaaag

SEQ ID NO: 2754293 - RNA, 19 nt, Human
cuguugucuuuuccuucug

SEQ ID NO: 2754294 - RNA, 21 nt, Human
cuguuuccucuguauacaaaa

SEQ ID NO: 2754295 - RNA, 14 nt, Human
cuguuucuuccaca

SEQ ID NO: 2754296 - RNA, 18 nt, Human
cuguuuucccuccuugga

SEQ ID NO: 2754297 - RNA, 21 nt, Human
cuguuuucuuucuaaugagau

SEQ ID NO: 2754298 - RNA, 14 nt, Human
cuguuuuuaagcug

SEQ ID NO: 2754299 - RNA, 16 nt, Human
cuguuuuuaagcuguu

SEQ ID NO: 2754300 - RNA, 23 nt, Human
cuuaaaaaugguuuaaaugguca

SEQ ID NO: 2754301 - RNA, 11 nt, Human
cuuaaaacugu

SEQ ID NO: 2754302 - RNA, 20 nt, Human
cuuaaaacuguaaauuuauu

SEQ ID NO: 2754303 - RNA, 16 nt, Human
cuuaaagaauuuucaa

SEQ ID NO: 2754304 - RNA, 17 nt, Human
cuuaaagaauuuucaaa

SEQ ID NO: 2754305 - RNA, 23 nt, Human
cuuaaagaauuuucaaaaucaaa

SEQ ID NO: 2754306 - RNA, 15 nt, Human
cuuaaauaaaccuuu

SEQ ID NO: 2754307 - RNA, 22 nt, Human
cuuaaaucuaguaauuuguaga

SEQ ID NO: 2754308 - RNA, 17 nt, Human
cuuaaccagaucauugu

SEQ ID NO: 2754309 - RNA, 23 nt, Human
cuuaagaagacugcauuauauuu

SEQ ID NO: 2754310 - RNA, 12 nt, Human
cuuaagcuuuca

SEQ ID NO: 2754311 - RNA, 21 nt, Human
cuuaaggaggcugagagccca

SEQ ID NO: 2754312 - RNA, 20 nt, Human
cuuaagguaugguacaagca

SEQ ID NO: 2754313 - RNA, 13 nt, Human
cuuacaugcauua

SEQ ID NO: 2754314 - RNA, 13 nt, Human
cuuaccagauuuu

SEQ ID NO: 2754315 - RNA, 15 nt, Human
cuuacuauuuauugc

SEQ ID NO: 2754316 - RNA, 22 nt, Human
cuuacuauuuauugcugaauga

SEQ ID NO: 2754317 - RNA, 18 nt, Human
cuuacucuguugccaggc

SEQ ID NO: 2754318 - RNA, 15 nt, Human
cuuacugauuuuuaa

SEQ ID NO: 2754319 - RNA, 20 nt, Human
cuuacuggugcuauuuugua

SEQ ID NO: 2754320 - RNA, 14 nt, Human
cuuacuuauuaucu

SEQ ID NO: 2754321 - RNA, 13 nt, Human
cuuacuucuucuc

SEQ ID NO: 2754322 - RNA, 20 nt, Human
cuuagaccaccaagccuuga

SEQ ID NO: 2754323 - RNA, 12 nt, Human
cuuagacccuca

SEQ ID NO: 2754324 - RNA, 20 nt, Human
cuuagacccucaugcugcca

SEQ ID NO: 2754325 - RNA, 13 nt, Human
cuuagauaagaca

SEQ ID NO: 2754326 - RNA, 14 nt, Human
cuuagaugcaguuc

SEQ ID NO: 2754327 - RNA, 16 nt, Human
cuuagcccuuccccuc

SEQ ID NO: 2754328 - RNA, 19 nt, Human
cuuagcuuagaccucagcc

SEQ ID NO: 2754329 - RNA, 22 nt, Human
cuuaggaauaaucuccuguuaa

SEQ ID NO: 2754330 - RNA, 16 nt, Human
cuuaggccucugagaa

SEQ ID NO: 2754331 - RNA, 15 nt, Human
cuuagucacaaagcc

SEQ ID NO: 2754332 - RNA, 13 nt, Human
cuuaguucaaguc

SEQ ID NO: 2754333 - RNA, 16 nt, Human
cuuauaauuuaaaaua

SEQ ID NO: 2754334 - RNA, 16 nt, Human
cuuauagaauauuuau

SEQ ID NO: 2754335 - RNA, 23 nt, Human
cuuauaucuauauuuuacauaaa

SEQ ID NO: 2754336 - RNA, 13 nt, Human
cuuaucaaaggac

SEQ ID NO: 2754337 - RNA, 19 nt, Human
cuuauuaaaacucauuuuu

SEQ ID NO: 2754338 - RNA, 14 nt, Human
cuuauuauuuuuga

SEQ ID NO: 2754339 - RNA, 15 nt, Human
cuuauuauuuuugag

SEQ ID NO: 2754340 - RNA, 14 nt, Human
cuuauugacucaua

SEQ ID NO: 2754341 - RNA, 19 nt, Human
cuuauugucuagugaaacu

SEQ ID NO: 2754342 - RNA, 16 nt, Human
cuuauuucaugaaaau

SEQ ID NO: 2754343 - RNA, 18 nt, Human
cuucaaagcaaagcucuu

SEQ ID NO: 2754344 - RNA, 22 nt, Human
cuucaacaaccggccaccagau

SEQ ID NO: 2754345 - RNA, 16 nt, Human
cuucaacucccugccc

SEQ ID NO: 2754346 - RNA, 17 nt, Human
cuucaacucccugcccc

SEQ ID NO: 2754347 - RNA, 22 nt, Human
cuucaacucccugccccccagc

SEQ ID NO: 2754348 - RNA, 12 nt, Human
cuucaagcucuc

SEQ ID NO: 2754349 - RNA, 15 nt, Human
cuucacacacaggca

SEQ ID NO: 2754350 - RNA, 14 nt, Human
cuucaccaauaagu

SEQ ID NO: 2754351 - RNA, 14 nt, Human
cuucaccuuaggaa

SEQ ID NO: 2754352 - RNA, 17 nt, Human
cuucacuguaaaauaau

SEQ ID NO: 2754353 - RNA, 18 nt, Human
cuucacuguaaaauaaua

SEQ ID NO: 2754354 - RNA, 16 nt, Human
cuucacuuuuuuucuu

SEQ ID NO: 2754355 - RNA, 23 nt, Human
cuucacuuuuuuucuuuucucug

SEQ ID NO: 2754356 - RNA, 23 nt, Human
cuucagacauagaauuaacacau

SEQ ID NO: 2754357 - RNA, 22 nt, Human
cuucagccaggagcugggcaga

SEQ ID NO: 2754358 - RNA, 13 nt, Human
cuucagccuccca

SEQ ID NO: 2754359 - RNA, 15 nt, Human
cuucagccucccaag

SEQ ID NO: 2754360 - RNA, 23 nt, Human
cuucagccugaaagaggaaugaa

SEQ ID NO: 2754361 - RNA, 18 nt, Human
cuucagcgguuuauauaa

SEQ ID NO: 2754362 - RNA, 15 nt, Human
cuucaggauaccaua

SEQ ID NO: 2754363 - RNA, 12 nt, Human
cuucauuuggga

SEQ ID NO: 2754364 - RNA, 13 nt, Human
cuuccaaacagaa

SEQ ID NO: 2754365 - RNA, 15 nt, Human
cuuccaacguggccc

SEQ ID NO: 2754366 - RNA, 15 nt, Human
cuuccaacucaucca

SEQ ID NO: 2754367 - RNA, 14 nt, Human
cuuccacguacugc

SEQ ID NO: 2754368 - RNA, 21 nt, Human
cuuccagauccuggaaaucag

SEQ ID NO: 2754369 - RNA, 21 nt, Human
cuuccaggcuggcgugcagca

SEQ ID NO: 2754370 - RNA, 17 nt, Human
cuuccagggcuacgcgc

SEQ ID NO: 2754371 - RNA, 19 nt, Human
cuuccagggcuacgcgcgc

SEQ ID NO: 2754372 - RNA, 24 nt, Human
cuuccagggcuacgcgcgcuccgc

SEQ ID NO: 2754373 - RNA, 22 nt, Human
cuuccauuccaagccugaccac

SEQ ID NO: 2754374 - RNA, 20 nt, Human
cuucccaaaguccugggauu

SEQ ID NO: 2754375 - RNA, 22 nt, Human
cuucccaaguugugcuugagcc

SEQ ID NO: 2754376 - RNA, 16 nt, Human
cuucccacacugucca

SEQ ID NO: 2754377 - RNA, 16 nt, Human
cuuccccucugcagcu

SEQ ID NO: 2754378 - RNA, 20 nt, Human
cuuccccucugcagcuucca

SEQ ID NO: 2754379 - RNA, 15 nt, Human
cuucccgcuguuccu

SEQ ID NO: 2754380 - RNA, 15 nt, Human
cuucccuugcuucuu

SEQ ID NO: 2754381 - RNA, 23 nt, Human
cuucccuuuuacauacugcuguc

SEQ ID NO: 2754382 - RNA, 17 nt, Human
cuuccuaauuccacagc

SEQ ID NO: 2754383 - RNA, 22 nt, Human
cuuccuaauuccacagcugcuc

SEQ ID NO: 2754384 - RNA, 20 nt, Human
cuuccucccauucaggaugc

SEQ ID NO: 2754385 - RNA, 14 nt, Human
cuuccucccggccg

SEQ ID NO: 2754386 - RNA, 15 nt, Human
cuuccucccggccgc

SEQ ID NO: 2754387 - RNA, 15 nt, Human
cuuccucugagccuu

SEQ ID NO: 2754388 - RNA, 13 nt, Human
cuuccuggcaaua

SEQ ID NO: 2754389 - RNA, 18 nt, Human
cuuccuggcaauagucaa

SEQ ID NO: 2754390 - RNA, 13 nt, Human
cuuccuuccucuc

SEQ ID NO: 2754391 - RNA, 18 nt, Human
cuuccuuccucucugcaa

SEQ ID NO: 2754392 - RNA, 16 nt, Human
cuucggccuccauccu

SEQ ID NO: 2754393 - RNA, 23 nt, Human
cuucggccuccauccugaggcuc

SEQ ID NO: 2754394 - RNA, 21 nt, Human
cuucuaaguaaaaccacagca

SEQ ID NO: 2754395 - RNA, 22 nt, Human
cuucuaaguaaaaccacagcag

SEQ ID NO: 2754396 - RNA, 23 nt, Human
cuucuaaguaaaaccacagcagu

SEQ ID NO: 2754397 - RNA, 14 nt, Human
cuucuaccacccac

SEQ ID NO: 2754398 - RNA, 17 nt, Human
cuucuagguucuaaaaa

SEQ ID NO: 2754399 - RNA, 16 nt, Human
cuucuauugccucuga

SEQ ID NO: 2754400 - RNA, 21 nt, Human
cuucuauugccucugagagca

SEQ ID NO: 2754401 - RNA, 11 nt, Human
cuucuauuuuu

SEQ ID NO: 2754402 - RNA, 13 nt, Human
cuucucaacucca

SEQ ID NO: 2754403 - RNA, 18 nt, Human
cuucucacauuuauauuu

SEQ ID NO: 2754404 - RNA, 19 nt, Human
cuucucacauuuauauuuu

SEQ ID NO: 2754405 - RNA, 21 nt, Human
cuucucaccugugagaccaaa

SEQ ID NO: 2754406 - RNA, 20 nt, Human
cuucuccauccuaccacaau

SEQ ID NO: 2754407 - RNA, 17 nt, Human
cuucucuaaacauuuca

SEQ ID NO: 2754408 - RNA, 17 nt, Human
cuucucucaaggagagg

SEQ ID NO: 2754409 - RNA, 15 nt, Human
cuucucuguucauuu

SEQ ID NO: 2754410 - RNA, 20 nt, Human
cuucucuguucauuuccuca

SEQ ID NO: 2754411 - RNA, 22 nt, Human
cuucucuguucauuuccucaaa

SEQ ID NO: 2754412 - RNA, 12 nt, Human
cuucucuuaaac

SEQ ID NO: 2754413 - RNA, 18 nt, Human
cuuugaagucugauuuuc

SEQ ID NO: 2754414 - RNA, 17 nt, Human
cuuugaauccucucucu

SEQ ID NO: 2754415 - RNA, 16 nt, Human
cuuugacaaagguaaa

SEQ ID NO: 2754416 - RNA, 21 nt, Human
cuuugacaaagguaaaucaga

SEQ ID NO: 2754417 - RNA, 16 nt, Human
cuuugaugauuaauuc

SEQ ID NO: 2754418 - RNA, 17 nt, Human
cuuugaugauuaauuca

SEQ ID NO: 2754419 - RNA, 21 nt, Human
cuuugaugauuaauucaccuu

SEQ ID NO: 2754420 - RNA, 21 nt, Human
cuuugccauguggcagaucua

SEQ ID NO: 2754421 - RNA, 11 nt, Human
cuuugccuuua

SEQ ID NO: 2754422 - RNA, 17 nt, Human
cuuugcugacccucccc

SEQ ID NO: 2754423 - RNA, 16 nt, Human
cuuuggaaaacccaga

SEQ ID NO: 2754424 - RNA, 16 nt, Human
cuuuggaugcacuuua

SEQ ID NO: 2754425 - RNA, 23 nt, Human
cuuuggcaaaugagccggagccc

SEQ ID NO: 2754426 - RNA, 15 nt, Human
cuuuggggagccaac

SEQ ID NO: 2754427 - RNA, 23 nt, Human
cuuuggggagccaacagaagcuu

SEQ ID NO: 2754428 - RNA, 19 nt, Human
cuuugguggagauaaagau

SEQ ID NO: 2754429 - RNA, 16 nt, Human
cuuuguaaugaaaacc

SEQ ID NO: 2754430 - RNA, 12 nt, Human
cuuuguacuuua

SEQ ID NO: 2754431 - RNA, 24 nt, Human
cuuuguauaaaagggacugagaaa

SEQ ID NO: 2754432 - RNA, 14 nt, Human
cuuugugaaaaaaa

SEQ ID NO: 2754433 - RNA, 19 nt, Human
cuuuguggcugaaaggucc

SEQ ID NO: 2754434 - RNA, 24 nt, Human
cuuuguuaaaauagaaugguauca

SEQ ID NO: 2754435 - RNA, 20 nt, Human
cuuuguucuucuuaaaguca

SEQ ID NO: 2754436 - RNA, 19 nt, Human
cuuuuaaaaaaaaauacug

SEQ ID NO: 2754437 - RNA, 18 nt, Human
cuuuuaaaccauuuucuu

SEQ ID NO: 2754438 - RNA, 18 nt, Human
cuuuuaaagaaacaaaaa

SEQ ID NO: 2754439 - RNA, 19 nt, Human
cuuuuaaagaaacaaaaau

SEQ ID NO: 2754440 - RNA, 16 nt, Human
cuuuuaguuuuuaaag

SEQ ID NO: 2754441 - RNA, 15 nt, Human
cuuuuaugugaaaca

SEQ ID NO: 2754442 - RNA, 21 nt, Human
cuuuucaaaauuggacuuaaa

SEQ ID NO: 2754443 - RNA, 21 nt, Human
cuuuuccaaugacauuuuguu

SEQ ID NO: 2754444 - RNA, 22 nt, Human
cuuuuccaaugacauuuuguug

SEQ ID NO: 2754445 - RNA, 15 nt, Human
cuuuucccaacucca

SEQ ID NO: 2754446 - RNA, 16 nt, Human
cuuuucccaacuccag

SEQ ID NO: 2754447 - RNA, 23 nt, Human
cuuuuccuucugagccugccuuu

SEQ ID NO: 2754448 - RNA, 14 nt, Human
cuuuucuauuguug

SEQ ID NO: 2754449 - RNA, 16 nt, Human
cuuuucuauuguugua

SEQ ID NO: 2754450 - RNA, 20 nt, Human
cuuuucugcauguucuaaau

SEQ ID NO: 2754451 - RNA, 12 nt, Human
cuuuucuuuucu

SEQ ID NO: 2754452 - RNA, 19 nt, Human
cuuuuggaagguauuuaau

SEQ ID NO: 2754453 - RNA, 11 nt, Human
cuuuuuauaca

SEQ ID NO: 2754454 - RNA, 20 nt, Human
cuuuuuauacacuuuuuaaa

SEQ ID NO: 2754455 - RNA, 13 nt, Human
cuuuuuauggcac

SEQ ID NO: 2754456 - RNA, 22 nt, Human
cuuuuuccuuccagucuaaaaa

SEQ ID NO: 2754457 - RNA, 18 nt, Human
cuuuuuguggguacugca

SEQ ID NO: 2754458 - RNA, 20 nt, Human
cuuuuuuaguucuucaaaga

SEQ ID NO: 2754459 - RNA, 21 nt, Human
cuuuuuuaucaugugaaauca

SEQ ID NO: 2754460 - RNA, 16 nt, Human
cuuuuuuuaaaaaaua

SEQ ID NO: 2754461 - RNA, 14 nt, Human
cuuuuuuuuaaguu

SEQ ID NO: 2754462 - RNA, 20 nt, Human
cuuuuuuuucuuuuuuuaga

SEQ ID NO: 2754463 - RNA, 17 nt, Human
cuuuuuuuuuuuuuaau

SEQ ID NO: 2754464 - RNA, 18 nt, Human
cuuuuuuuuuuuuuuaaa

SEQ ID NO: 2754465 - RNA, 20 nt, Human
cuuuuuuuuuuuuuuaaaca

SEQ ID NO: 2754466 - RNA, 12 nt, Human
gaaaaaaagcuu

SEQ ID NO: 2754467 - RNA, 13 nt, Human
gaaaaaaagcuuu

SEQ ID NO: 2754468 - RNA, 11 nt, Human
gaaaaaacuga

SEQ ID NO: 2754469 - RNA, 16 nt, Human
gaaaaaaguaaaugug

SEQ ID NO: 2754470 - RNA, 14 nt, Human
gaaaaaauaacaau

SEQ ID NO: 2754471 - RNA, 16 nt, Human
gaaaaacuauuaacaa

SEQ ID NO: 2754472 - RNA, 18 nt, Human
gaaaaacuauuaacaacu

SEQ ID NO: 2754473 - RNA, 14 nt, Human
gaaaaaguggguuu

SEQ ID NO: 2754474 - RNA, 17 nt, Human
gaaaaaugcauguugcc

SEQ ID NO: 2754475 - RNA, 17 nt, Human
gaaaaauuagaugacug

SEQ ID NO: 2754476 - RNA, 13 nt, Human
gaaaacaaggaug

SEQ ID NO: 2754477 - RNA, 17 nt, Human
gaaaacaaggaugaauu

SEQ ID NO: 2754478 - RNA, 20 nt, Human
gaaaacaauaacgauaaaag

SEQ ID NO: 2754479 - RNA, 21 nt, Human
gaaaacaauaacgauaaaaga

SEQ ID NO: 2754480 - RNA, 22 nt, Human
gaaaacaauaacgauaaaagac

SEQ ID NO: 2754481 - RNA, 18 nt, Human
gaaaacauagcaucucag

SEQ ID NO: 2754482 - RNA, 18 nt, Human
gaaaacugcuacuaucug

SEQ ID NO: 2754483 - RNA, 23 nt, Human
gaaaacuuuaugcuaagugaaau

SEQ ID NO: 2754484 - RNA, 20 nt, Human
gaaaagacauaagcaaagac

SEQ ID NO: 2754485 - RNA, 20 nt, Human
gaaaagacuccaaagaaaug

SEQ ID NO: 2754486 - RNA, 17 nt, Human
gaaaagcuauaaaauga

SEQ ID NO: 2754487 - RNA, 19 nt, Human
gaaaaguauguuagugcaa

SEQ ID NO: 2754488 - RNA, 21 nt, Human
gaaaaguauguuagugcaaau

SEQ ID NO: 2754489 - RNA, 19 nt, Human
gaaaauaaaagcacuuauu

SEQ ID NO: 2754490 - RNA, 14 nt, Human
gaaaauaacaauaa

SEQ ID NO: 2754491 - RNA, 20 nt, Human
gaaaauaacaauaaaagaca

SEQ ID NO: 2754492 - RNA, 11 nt, Human
gaaaauaacga

SEQ ID NO: 2754493 - RNA, 20 nt, Human
gaaaauaacgauaaaagaca

SEQ ID NO: 2754494 - RNA, 22 nt, Human
gaaaauaugccugcaaucugag

SEQ ID NO: 2754495 - RNA, 21 nt, Human
gaaaauauggcaauacuugcu

SEQ ID NO: 2754496 - RNA, 19 nt, Human
gaaaauauuuguaucacaa

SEQ ID NO: 2754497 - RNA, 17 nt, Human
gaaaaucaggcuggcca

SEQ ID NO: 2754498 - RNA, 22 nt, Human
gaaaaucuacacuccagugaga

SEQ ID NO: 2754499 - RNA, 19 nt, Human
gaaaaucuuauaauuuaaa

SEQ ID NO: 2754500 - RNA, 22 nt, Human
gaaaaucuuauaauuuaaaaua

SEQ ID NO: 2754501 - RNA, 16 nt, Human
gaaaaugguauuaaag

SEQ ID NO: 2754502 - RNA, 19 nt, Human
gaaaaugucauuguucuug

SEQ ID NO: 2754503 - RNA, 23 nt, Human
gaaaauugugcuggaaauggaca

SEQ ID NO: 2754504 - RNA, 14 nt, Human
gaaaauuuaaaaca

SEQ ID NO: 2754505 - RNA, 23 nt, Human
gaaaauuuaaaacauuacucuga

SEQ ID NO: 2754506 - RNA, 21 nt, Human
gaaacagagaaaauaaaagca

SEQ ID NO: 2754507 - RNA, 19 nt, Human
gaaacauguuucuuuguaa

SEQ ID NO: 2754508 - RNA, 15 nt, Human
gaaacauuacaguua

SEQ ID NO: 2754509 - RNA, 20 nt, Human
gaaacauuugguaaggggaa

SEQ ID NO: 2754510 - RNA, 22 nt, Human
gaaacauuuucucccuggauuu

SEQ ID NO: 2754511 - RNA, 20 nt, Human
gaaaccccuauguggaggcg

SEQ ID NO: 2754512 - RNA, 13 nt, Human
gaaacguauucaa

SEQ ID NO: 2754513 - RNA, 18 nt, Human
gaaacguguauauuuuuu

SEQ ID NO: 2754514 - RNA, 23 nt, Human
gaaacguguauauuuuuuaugaa

SEQ ID NO: 2754515 - RNA, 22 nt, Human
gaaacuaccagcccuacaccau

SEQ ID NO: 2754516 - RNA, 17 nt, Human
gaaagaaaauaacaaua

SEQ ID NO: 2754517 - RNA, 19 nt, Human
gaaagaaaauaacaauaaa

SEQ ID NO: 2754518 - RNA, 20 nt, Human
gaaagaaaauaacgauaaaa

SEQ ID NO: 2754519 - RNA, 17 nt, Human
gaaagaagaagguggga

SEQ ID NO: 2754520 - RNA, 16 nt, Human
gaaagaagagccggag

SEQ ID NO: 2754521 - RNA, 17 nt, Human
gaaagaagagccggagc

SEQ ID NO: 2754522 - RNA, 14 nt, Human
gaaagaagaugaau

SEQ ID NO: 2754523 - RNA, 17 nt, Human
gaaagaagcccaauauu

SEQ ID NO: 2754524 - RNA, 18 nt, Human
gaaagaagcccaauauua

SEQ ID NO: 2754525 - RNA, 16 nt, Human
gaaagacuauucaaac

SEQ ID NO: 2754526 - RNA, 15 nt, Human
gaaagagaacuucca

SEQ ID NO: 2754527 - RNA, 14 nt, Human
gaaagaggaaugaa

SEQ ID NO: 2754528 - RNA, 18 nt, Human
gaaagaggcagcuugaaa

SEQ ID NO: 2754529 - RNA, 14 nt, Human
gaaagcagggacuu

SEQ ID NO: 2754530 - RNA, 23 nt, Human
gaaagcaguugagacaagaaaau

SEQ ID NO: 2754531 - RNA, 14 nt, Human
gaaagcauuugaau

SEQ ID NO: 2754532 - RNA, 23 nt, Human
gaaagccaugugcagccaccagu

SEQ ID NO: 2754533 - RNA, 14 nt, Human
gaaagcuguggcca

SEQ ID NO: 2754534 - RNA, 16 nt, Human
gaaaggaagcugugcg

SEQ ID NO: 2754535 - RNA, 22 nt, Human
gaaaggaaguauaggccaggca

SEQ ID NO: 2754536 - RNA, 19 nt, Human
gaaaggaccaguaugcuug

SEQ ID NO: 2754537 - RNA, 14 nt, Human
gaaaggagaaguua

SEQ ID NO: 2754538 - RNA, 22 nt, Human
gaaaggagaaguuaagcaacau

SEQ ID NO: 2754539 - RNA, 15 nt, Human
gaaaggauaaaguug

SEQ ID NO: 2754540 - RNA, 19 nt, Human
gaaaggccuuuaaaauuuu

SEQ ID NO: 2754541 - RNA, 20 nt, Human
gaaagggauuuucagcccuc

SEQ ID NO: 2754542 - RNA, 21 nt, Human
gaaaggggcaggccagagcua

SEQ ID NO: 2754543 - RNA, 16 nt, Human
gaaagggucucccucu

SEQ ID NO: 2754544 - RNA, 12 nt, Human
gaaagucccaga

SEQ ID NO: 2754545 - RNA, 21 nt, Human
gaaagugacaagcucacagac

SEQ ID NO: 2754546 - RNA, 14 nt, Human
gaaaguugauuuua

SEQ ID NO: 2754547 - RNA, 19 nt, Human
gaaauaaacuauuuguaaa

SEQ ID NO: 2754548 - RNA, 20 nt, Human
gaaauacacuguuaucuuca

SEQ ID NO: 2754549 - RNA, 18 nt, Human
gaaauacguuaggaggac

SEQ ID NO: 2754550 - RNA, 13 nt, Human
gaaauagcccugu

SEQ ID NO: 2754551 - RNA, 20 nt, Human
gaaauagcccuguaacaggc

SEQ ID NO: 2754552 - RNA, 17 nt, Human
gaaauagugauuuccac

SEQ ID NO: 2754553 - RNA, 23 nt, Human
gaaauaugauuuguguauuauaa

SEQ ID NO: 2754554 - RNA, 16 nt, Human
gaaauauuauguuaaa

SEQ ID NO: 2754555 - RNA, 23 nt, Human
gaaauauuauguuaaaacuggga

SEQ ID NO: 2754556 - RNA, 18 nt, Human
gaauugaggacacugaua

SEQ ID NO: 2754557 - RNA, 22 nt, Human
gaauugaggacacugauauggg

SEQ ID NO: 2754558 - RNA, 14 nt, Human
gaauugcucuccca

SEQ ID NO: 2754559 - RNA, 16 nt, Human
gaauugcucucccagc

SEQ ID NO: 2754560 - RNA, 12 nt, Human
gaauuggagcuc

SEQ ID NO: 2754561 - RNA, 13 nt, Human
gaauuggagcucg

SEQ ID NO: 2754562 - RNA, 14 nt, Human
gaauuggagcucgu

SEQ ID NO: 2754563 - RNA, 16 nt, Human
gaauuucuaaaaguuu

SEQ ID NO: 2754564 - RNA, 22 nt, Human
gaauuucuucaacucccugccc

SEQ ID NO: 2754565 - RNA, 16 nt, Human
gaauuugaaacacuuu

SEQ ID NO: 2754566 - RNA, 19 nt, Human
gaauuugagauacaaacau

SEQ ID NO: 2754567 - RNA, 22 nt, Human
gaauuuuucucuaacucagaaa

SEQ ID NO: 2754568 - RNA, 16 nt, Human
gacaaccaugagacca

SEQ ID NO: 2754569 - RNA, 16 nt, Human
gacaacugugacugua

SEQ ID NO: 2754570 - RNA, 14 nt, Human
gacaagaaggaaag

SEQ ID NO: 2754571 - RNA, 13 nt, Human
gacaaggaaaaaa

SEQ ID NO: 2754572 - RNA, 16 nt, Human
gacaaggaaaaaauaa

SEQ ID NO: 2754573 - RNA, 17 nt, Human
gacaaggaaaaaauaac

SEQ ID NO: 2754574 - RNA, 18 nt, Human
gacaaggaaaaaauaaca

SEQ ID NO: 2754575 - RNA, 20 nt, Human
gacaaggaaaaaauaacaau

SEQ ID NO: 2754576 - RNA, 16 nt, Human
gacaaguccagccugg

SEQ ID NO: 2754577 - RNA, 21 nt, Human
gacaauuguuggagagccccu

SEQ ID NO: 2754578 - RNA, 15 nt, Human
gacacaaauaaagga

SEQ ID NO: 2754579 - RNA, 18 nt, Human
gacacacugaagaagcac

SEQ ID NO: 2754580 - RNA, 17 nt, Human
gacacagacauccucua

SEQ ID NO: 2754581 - RNA, 19 nt, Human
gacacaggcuccaaacugg

SEQ ID NO: 2754582 - RNA, 17 nt, Human
gacacaugugcuggcca

SEQ ID NO: 2754583 - RNA, 18 nt, Human
gacacaugugcuggccac

SEQ ID NO: 2754584 - RNA, 22 nt, Human
gacacaugugcuggccaccugc

SEQ ID NO: 2754585 - RNA, 11 nt, Human
gacaccaccac

SEQ ID NO: 2754586 - RNA, 17 nt, Human
gacaccaccacccuugc

SEQ ID NO: 2754587 - RNA, 12 nt, Human
gacacugucucu

SEQ ID NO: 2754588 - RNA, 14 nt, Human
gacagaaaaaacug

SEQ ID NO: 2754589 - RNA, 15 nt, Human
gacagaaaaaacuga

SEQ ID NO: 2754590 - RNA, 21 nt, Human
gacagaaaaaacugagaugua

SEQ ID NO: 2754591 - RNA, 11 nt, Human
gacagaaagca

SEQ ID NO: 2754592 - RNA, 21 nt, Human
gacagaaagcagaacagugau

SEQ ID NO: 2754593 - RNA, 20 nt, Human
gacagagccccacccucaga

SEQ ID NO: 2754594 - RNA, 16 nt, Human
gacagcagcucaggca

SEQ ID NO: 2754595 - RNA, 18 nt, Human
gacagcagcucaggcaca

SEQ ID NO: 2754596 - RNA, 15 nt, Human
gacagcccaggauac

SEQ ID NO: 2754597 - RNA, 21 nt, Human
gacagcuucucauccugcagg

SEQ ID NO: 2754598 - RNA, 22 nt, Human
gacagcuucucauccugcaggc

SEQ ID NO: 2754599 - RNA, 20 nt, Human
gacaggcacuaucuggguuu

SEQ ID NO: 2754600 - RNA, 16 nt, Human
gacagggaaaacugca

SEQ ID NO: 2754601 - RNA, 13 nt, Human
gacagggaggacg

SEQ ID NO: 2754602 - RNA, 14 nt, Human
gacagggaggacgc

SEQ ID NO: 2754603 - RNA, 15 nt, Human
gacagggaggacgcu

SEQ ID NO: 2754604 - RNA, 17 nt, Human
gacagggaggacgcucu

SEQ ID NO: 2754605 - RNA, 18 nt, Human
gacagggaggacgcucuc

SEQ ID NO: 2754606 - RNA, 16 nt, Human
gacaggguuucaccau

SEQ ID NO: 2754607 - RNA, 15 nt, Human
gacaguauggcagcu

SEQ ID NO: 2754608 - RNA, 17 nt, Human
gacagucaccucaugga

SEQ ID NO: 2754609 - RNA, 19 nt, Human
gacagucaccucauggaau

SEQ ID NO: 2754610 - RNA, 21 nt, Human
gacagucaccucauggaauug

SEQ ID NO: 2754611 - RNA, 23 nt, Human
gacagucaccucauggaauugga

SEQ ID NO: 2754612 - RNA, 17 nt, Human
gacagugaaagaaaaua

SEQ ID NO: 2754613 - RNA, 21 nt, Human
gacagugaaagaaaauaacaa

SEQ ID NO: 2754614 - RNA, 21 nt, Human
gacagugaaagaaaauaacga

SEQ ID NO: 2754615 - RNA, 22 nt, Human
gacagugaaagaaaauaacgau

SEQ ID NO: 2754616 - RNA, 14 nt, Human
gacagugagacucu

SEQ ID NO: 2754617 - RNA, 17 nt, Human
gacaguuccugagacca

SEQ ID NO: 2754618 - RNA, 20 nt, Human
gacaguuccugagaccagcc

SEQ ID NO: 2754619 - RNA, 20 nt, Human
gacauaagcaaagacuauga

SEQ ID NO: 2754620 - RNA, 20 nt, Human
gacaugaagcuguuguguga

SEQ ID NO: 2754621 - RNA, 15 nt, Human
gacaugggccccaga

SEQ ID NO: 2754622 - RNA, 17 nt, Human
gacaugggccccagaua

SEQ ID NO: 2754623 - RNA, 18 nt, Human
gacauguuuacaaaccuc

SEQ ID NO: 2754624 - RNA, 23 nt, Human
gacauguuuacaaaccucaagcc

SEQ ID NO: 2754625 - RNA, 17 nt, Human
gacauucuuuaucuuuu

SEQ ID NO: 2754626 - RNA, 16 nt, Human
gacauugaggcaggca

SEQ ID NO: 2754627 - RNA, 18 nt, Human
gacauugaggcaggcacu

SEQ ID NO: 2754628 - RNA, 13 nt, Human
gacauuugcucau

SEQ ID NO: 2754629 - RNA, 16 nt, Human
gacauuugcucaugga

SEQ ID NO: 2754630 - RNA, 18 nt, Human
gacauuuucugccaccca

SEQ ID NO: 2754631 - RNA, 19 nt, Human
gaccaacaucgcagacaca

SEQ ID NO: 2754632 - RNA, 22 nt, Human
gaccaaccuggaguugaaaauc

SEQ ID NO: 2754633 - RNA, 16 nt, Human
gaccaaggcccccggg

SEQ ID NO: 2754634 - RNA, 22 nt, Human
gaccaaggcccccgggccgacg

SEQ ID NO: 2754635 - RNA, 23 nt, Human
gaccaaggcccccgggccgacgg

SEQ ID NO: 2754636 - RNA, 22 nt, Human
gaccaauauuguacaguuuuua

SEQ ID NO: 2754637 - RNA, 20 nt, Human
gaccaccaggaggugcuauc

SEQ ID NO: 2754638 - RNA, 20 nt, Human
gaccacugcagaagacagua

SEQ ID NO: 2754639 - RNA, 15 nt, Human
gaccagagcuacuga

SEQ ID NO: 2754640 - RNA, 18 nt, Human
gaccagcaggcuggccua

SEQ ID NO: 2754641 - RNA, 19 nt, Human
gaccagccaaccugggggc

SEQ ID NO: 2754642 - RNA, 18 nt, Human
gaccauacuaauuauacc

SEQ ID NO: 2754643 - RNA, 20 nt, Human
gaccauacuaauuauacccc

SEQ ID NO: 2754644 - RNA, 12 nt, Human
gaccaucccggc

SEQ ID NO: 2754645 - RNA, 17 nt, Human
gaccaucccggccggcg

SEQ ID NO: 2754646 - RNA, 20 nt, Human
gaccaucccggccggcgcgc

SEQ ID NO: 2754647 - RNA, 11 nt, Human
gacccaaaagg

SEQ ID NO: 2754648 - RNA, 16 nt, Human
gacccaaaaggcagaa

SEQ ID NO: 2754649 - RNA, 18 nt, Human
gacccacuggacucaccu

SEQ ID NO: 2754650 - RNA, 13 nt, Human
gacccacuuaccu

SEQ ID NO: 2754651 - RNA, 24 nt, Human
gacccacuucacacacaggcaacu

SEQ ID NO: 2754652 - RNA, 18 nt, Human
gaccccugagcuugcaga

SEQ ID NO: 2754653 - RNA, 23 nt, Human
gaccccugagcuugcagagauga

SEQ ID NO: 2754654 - RNA, 16 nt, Human
gacccucaugcugcca

SEQ ID NO: 2754655 - RNA, 15 nt, Human
gacccugaugaaaac

SEQ ID NO: 2754656 - RNA, 12 nt, Human
gacccugucucu

SEQ ID NO: 2754657 - RNA, 23 nt, Human
gacccuuauugcuguccuggagg

SEQ ID NO: 2754658 - RNA, 21 nt, Human
gacccuucccuugagcccucu

SEQ ID NO: 2754659 - RNA, 19 nt, Human
gaccggccuuugcaccucc

SEQ ID NO: 2754660 - RNA, 13 nt, Human
gaccuagaauaau

SEQ ID NO: 2754661 - RNA, 14 nt, Human
gaccuagaauaaua

SEQ ID NO: 2754662 - RNA, 20 nt, Human
gaccucagccugugcugccc

SEQ ID NO: 2754663 - RNA, 15 nt, Human
gaccucucucaaagu

SEQ ID NO: 2754664 - RNA, 18 nt, Human
gaccugaguauccccagc

SEQ ID NO: 2754665 - RNA, 20 nt, Human
gaccugccaggcacacugag

SEQ ID NO: 2754666 - RNA, 22 nt, Human
gaccuguaaucauauaauaaau

SEQ ID NO: 2754667 - RNA, 19 nt, Human
gaccuguggccaaguucuu

SEQ ID NO: 2754668 - RNA, 22 nt, Human
gaccuucaacaaccggccacca

SEQ ID NO: 2754669 - RNA, 15 nt, Human
gaccuuccagaaaua

SEQ ID NO: 2754670 - RNA, 12 nt, Human
gaccuuccuuuu

SEQ ID NO: 2754671 - RNA, 17 nt, Human
gacgagaaaacaauaac

SEQ ID NO: 2754672 - RNA, 19 nt, Human
gacgagaaaacaauaacga

SEQ ID NO: 2754673 - RNA, 15 nt, Human
gacgcucucuggccu

SEQ ID NO: 2754674 - RNA, 16 nt, Human
gacgcucucuggccuu

SEQ ID NO: 2754675 - RNA, 18 nt, Human
gacggagccgggaaagaa

SEQ ID NO: 2754676 - RNA, 19 nt, Human
gacggagccgggaaagaag

SEQ ID NO: 2754677 - RNA, 17 nt, Human
gacggcuccggacgcug

SEQ ID NO: 2754678 - RNA, 19 nt, Human
gacgggccacacguggcug

SEQ ID NO: 2754679 - RNA, 20 nt, Human
gacgggguuugccaugcugg

SEQ ID NO: 2754680 - RNA, 21 nt, Human
gacgguuuaaugggcacaggg

SEQ ID NO: 2754681 - RNA, 15 nt, Human
gacgugacuggccug

SEQ ID NO: 2754682 - RNA, 16 nt, Human
gacgugacuggccugc

SEQ ID NO: 2754683 - RNA, 19 nt, Human
gacgugacuggccugcugg

SEQ ID NO: 2754684 - RNA, 20 nt, Human
gacgugacuggccugcugga

SEQ ID NO: 2754685 - RNA, 13 nt, Human
gacuaaaaaacaa

SEQ ID NO: 2754686 - RNA, 18 nt, Human
gacuauuauagaauggaa

SEQ ID NO: 2754687 - RNA, 15 nt, Human
gacuauuuuucagaa

SEQ ID NO: 2754688 - RNA, 16 nt, Human
gacuauuuuucagaau

SEQ ID NO: 2754689 - RNA, 17 nt, Human
gacucaccucccccauc

SEQ ID NO: 2754690 - RNA, 11 nt, Human
gacucacugug

SEQ ID NO: 2754691 - RNA, 15 nt, Human
gacucacugugggaa

SEQ ID NO: 2754692 - RNA, 18 nt, Human
gacucacugugggaagga

SEQ ID NO: 2754693 - RNA, 21 nt, Human
gacucacugugggaaggagac

SEQ ID NO: 2754694 - RNA, 19 nt, Human
gacucagggccccagcacu

SEQ ID NO: 2754695 - RNA, 15 nt, Human
gacucaucaaucaaa

SEQ ID NO: 2754696 - RNA, 19 nt, Human
gacucaucuuucccuccuu

SEQ ID NO: 2754697 - RNA, 15 nt, Human
gacucauuuuaaaaa

SEQ ID NO: 2754698 - RNA, 14 nt, Human
gacucuaagaaaga

SEQ ID NO: 2754699 - RNA, 16 nt, Human
gacucugucuaccugg

SEQ ID NO: 2754700 - RNA, 15 nt, Human
gaggggacauugaac

SEQ ID NO: 2754701 - RNA, 22 nt, Human
gaggggagcaugggaagugacg

SEQ ID NO: 2754702 - RNA, 19 nt, Human
gaggggccucaaaugcacc

SEQ ID NO: 2754703 - RNA, 12 nt, Human
gaggggcgcucg

SEQ ID NO: 2754704 - RNA, 16 nt, Human
gaggggcuggggacuu

SEQ ID NO: 2754705 - RNA, 17 nt, Human
gagggggcgcgugcagg

SEQ ID NO: 2754706 - RNA, 13 nt, Human
gaggggguggggg

SEQ ID NO: 2754707 - RNA, 15 nt, Human
gagggguggaaugcc

SEQ ID NO: 2754708 - RNA, 12 nt, Human
gagggguggggg

SEQ ID NO: 2754709 - RNA, 17 nt, Human
gaggguuagggaggggu

SEQ ID NO: 2754710 - RNA, 19 nt, Human
gaggguuucauugucugug

SEQ ID NO: 2754711 - RNA, 22 nt, Human
gaggguuucauugucugugaag

SEQ ID NO: 2754712 - RNA, 23 nt, Human
gagguaccagccuuggauacucc

SEQ ID NO: 2754713 - RNA, 18 nt, Human
gaggucacagggccuggg

SEQ ID NO: 2754714 - RNA, 21 nt, Human
gaggugagguaccagccuugg

SEQ ID NO: 2754715 - RNA, 16 nt, Human
gagguucgcuuaucaa

SEQ ID NO: 2754716 - RNA, 13 nt, Human
gaguacaccccaa

SEQ ID NO: 2754717 - RNA, 17 nt, Human
gaguacaccccaacagc

SEQ ID NO: 2754718 - RNA, 13 nt, Human
gagucaaugaacu

SEQ ID NO: 2754719 - RNA, 19 nt, Human
gagucacucacauccauuc

SEQ ID NO: 2754720 - RNA, 14 nt, Human
gagucccagagcca

SEQ ID NO: 2754721 - RNA, 18 nt, Human
gagucccaggcugagccu

SEQ ID NO: 2754722 - RNA, 23 nt, Human
gagucuuacucuguugccaggcu

SEQ ID NO: 2754723 - RNA, 22 nt, Human
gagugaacaaauuuacagagac

SEQ ID NO: 2754724 - RNA, 18 nt, Human
gagugacauguuuacaaa

SEQ ID NO: 2754725 - RNA, 19 nt, Human
gagugacuuaguguacaug

SEQ ID NO: 2754726 - RNA, 15 nt, Human
gagugaggggggggu

SEQ ID NO: 2754727 - RNA, 18 nt, Human
gagugagggggggguauu

SEQ ID NO: 2754728 - RNA, 12 nt, Human
gagugcaguggc

SEQ ID NO: 2754729 - RNA, 22 nt, Human
gagugcaguggcaucaucucag

SEQ ID NO: 2754730 - RNA, 16 nt, Human
gagugcaguggcgcga

SEQ ID NO: 2754731 - RNA, 16 nt, Human
gagugcccccaacagc

SEQ ID NO: 2754732 - RNA, 17 nt, Human
gagugccuguaaucaca

SEQ ID NO: 2754733 - RNA, 21 nt, Human
gaguggcauguaugacgugac

SEQ ID NO: 2754734 - RNA, 16 nt, Human
gaguggcuuuaaugaa

SEQ ID NO: 2754735 - RNA, 12 nt, Human
gagugggacagu

SEQ ID NO: 2754736 - RNA, 23 nt, Human
gaguuaauauauagaaggguacc

SEQ ID NO: 2754737 - RNA, 14 nt, Human
gaguugaaaaucuu

SEQ ID NO: 2754738 - RNA, 22 nt, Human
gaguuuaauuuuugaaaacugg

SEQ ID NO: 2754739 - RNA, 22 nt, Human
gaguuuagcuggaaaaguaugu

SEQ ID NO: 2754740 - RNA, 11 nt, Human
gaguuucucua

SEQ ID NO: 2754741 - RNA, 15 nt, Human
gaguuuuucuuuuca

SEQ ID NO: 2754742 - RNA, 12 nt, Human
gauaaaagacag

SEQ ID NO: 2754743 - RNA, 15 nt, Human
gauaaaagacaguga

SEQ ID NO: 2754744 - RNA, 22 nt, Human
gauaaaagacagugaaagaaaa

SEQ ID NO: 2754745 - RNA, 16 nt, Human
gauaaacucagaaauu

SEQ ID NO: 2754746 - RNA, 21 nt, Human
gauaaagcacuguuuggauau

SEQ ID NO: 2754747 - RNA, 19 nt, Human
gauaaagcuuaggucaaag

SEQ ID NO: 2754748 - RNA, 22 nt, Human
gauaagagauguugacucuaaa

SEQ ID NO: 2754749 - RNA, 19 nt, Human
gauaaggcuguucuuuaaa

SEQ ID NO: 2754750 - RNA, 23 nt, Human
gauaaggcuguucuuuaaauguc

SEQ ID NO: 2754751 - RNA, 21 nt, Human
gauaaguaaguuugauuucau

SEQ ID NO: 2754752 - RNA, 20 nt, Human
gauaauaaaauucauuccau

SEQ ID NO: 2754753 - RNA, 14 nt, Human
gauaaugaauacuu

SEQ ID NO: 2754754 - RNA, 20 nt, Human
gauaaugaauacuuuauaaa

SEQ ID NO: 2754755 - RNA, 15 nt, Human
gauaaugugauauua

SEQ ID NO: 2754756 - RNA, 16 nt, Human
gauaauuauaauauac

SEQ ID NO: 2754757 - RNA, 22 nt, Human
gauacaaacauguuccugggau

SEQ ID NO: 2754758 - RNA, 11 nt, Human
gauacagaaaa

SEQ ID NO: 2754759 - RNA, 20 nt, Human
gauacuauuuaauuauuuca

SEQ ID NO: 2754760 - RNA, 18 nt, Human
gauacugugcccagagcc

SEQ ID NO: 2754761 - RNA, 21 nt, Human
gauacuugaaggucuaggugc

SEQ ID NO: 2754762 - RNA, 23 nt, Human
gauagauaggucagugcaaauac

SEQ ID NO: 2754763 - RNA, 21 nt, Human
gauagcagggcauggcuggga

SEQ ID NO: 2754764 - RNA, 18 nt, Human
gauauaagugcuguauaa

SEQ ID NO: 2754765 - RNA, 20 nt, Human
gauauauuccaccaggauau

SEQ ID NO: 2754766 - RNA, 20 nt, Human
gauaucagcccaaaagucaa

SEQ ID NO: 2754767 - RNA, 16 nt, Human
gauauccucccuccag

SEQ ID NO: 2754768 - RNA, 20 nt, Human
gauauccucccuccagauau

SEQ ID NO: 2754769 - RNA, 17 nt, Human
gauaucuucagaaaacc

SEQ ID NO: 2754770 - RNA, 23 nt, Human
gauaugccuuuucccaacuccag

SEQ ID NO: 2754771 - RNA, 23 nt, Human
gauauuaaccaggggccaugaau

SEQ ID NO: 2754772 - RNA, 15 nt, Human
gauauuuuucaugau

SEQ ID NO: 2754773 - RNA, 14 nt, Human
gaucaagccugccu

SEQ ID NO: 2754774 - RNA, 13 nt, Human
gaucauguauuua

SEQ ID NO: 2754775 - RNA, 16 nt, Human
gaucauuugagcccag

SEQ ID NO: 2754776 - RNA, 19 nt, Human
gauccacccgccucagccu

SEQ ID NO: 2754777 - RNA, 22 nt, Human
gauccacccgccucagccuccc

SEQ ID NO: 2754778 - RNA, 15 nt, Human
gauccccaagccugg

SEQ ID NO: 2754779 - RNA, 18 nt, Human
gauccccaagccuggcaa

SEQ ID NO: 2754780 - RNA, 19 nt, Human
gaucccuuuguccacaagu

SEQ ID NO: 2754781 - RNA, 19 nt, Human
gauccgcccaucuccgucu

SEQ ID NO: 2754782 - RNA, 22 nt, Human
gauccucaggcagguaacccca

SEQ ID NO: 2754783 - RNA, 15 nt, Human
gauccugcaauucca

SEQ ID NO: 2754784 - RNA, 17 nt, Human
gauccugcaauuccacu

SEQ ID NO: 2754785 - RNA, 20 nt, Human
gauccuggaaaucaggguua

SEQ ID NO: 2754786 - RNA, 14 nt, Human
gaucuaugccacaa

SEQ ID NO: 2754787 - RNA, 16 nt, Human
gaucucagaaauugua

SEQ ID NO: 2754788 - RNA, 14 nt, Human
gaucucagcucacu

SEQ ID NO: 2754789 - RNA, 16 nt, Human
gaucugcuuggucuug

SEQ ID NO: 2754790 - RNA, 15 nt, Human
gaucuggcucuggac

SEQ ID NO: 2754791 - RNA, 17 nt, Human
gaucuggcucuggacag

SEQ ID NO: 2754792 - RNA, 17 nt, Human
gaucuuuaaaauacaca

SEQ ID NO: 2754793 - RNA, 14 nt, Human
gaucuuucugccuu

SEQ ID NO: 2754794 - RNA, 23 nt, Human
gaugaaaacauagcaucucagga

SEQ ID NO: 2754795 - RNA, 18 nt, Human
gaugaacucuuaaucaaa

SEQ ID NO: 2754796 - RNA, 16 nt, Human
gaugaauguuaaauua

SEQ ID NO: 2754797 - RNA, 16 nt, Human
gaugaauuaaguuuuu

SEQ ID NO: 2754798 - RNA, 22 nt, Human
gaugaauuaaguuuuuuuuuaa

SEQ ID NO: 2754799 - RNA, 20 nt, Human
gaugacaugucccuacaccc

SEQ ID NO: 2754800 - RNA, 12 nt, Human
gaugagagaaca

SEQ ID NO: 2754801 - RNA, 11 nt, Human
gaugagaguac

SEQ ID NO: 2754802 - RNA, 15 nt, Human
gaugagaguacaccc

SEQ ID NO: 2754803 - RNA, 18 nt, Human
gaugagggaaaagaaaaa

SEQ ID NO: 2754804 - RNA, 19 nt, Human
gaugagggaaaagaaaaag

SEQ ID NO: 2754805 - RNA, 13 nt, Human
gaugauccccacg

SEQ ID NO: 2754806 - RNA, 20 nt, Human
gaugauccccacgccacagc

SEQ ID NO: 2754807 - RNA, 21 nt, Human
gaugcacaugagcuggcggga

SEQ ID NO: 2754808 - RNA, 15 nt, Human
gaugcacuuuauauu

SEQ ID NO: 2754809 - RNA, 17 nt, Human
gaugcaguucugaagaa

SEQ ID NO: 2754810 - RNA, 18 nt, Human
gaugcaguucugaagaag

SEQ ID NO: 2754811 - RNA, 22 nt, Human
gaugcaguucugaagaagaugg

SEQ ID NO: 2754812 - RNA, 14 nt, Human
gaugcaguuguugc

SEQ ID NO: 2754813 - RNA, 20 nt, Human
gaugccacuagcccuccucu

SEQ ID NO: 2754814 - RNA, 21 nt, Human
gaugcccacggcuggagcugc

SEQ ID NO: 2754815 - RNA, 13 nt, Human
gaugccccguccc

SEQ ID NO: 2754816 - RNA, 18 nt, Human
gaugccccgucccccucu

SEQ ID NO: 2754817 - RNA, 14 nt, Human
gaugcuacaggauu

SEQ ID NO: 2754818 - RNA, 16 nt, Human
gaugcuagaacucccu

SEQ ID NO: 2754819 - RNA, 12 nt, Human
gaugcugagccc

SEQ ID NO: 2754820 - RNA, 14 nt, Human
gaugcuuguauuuu

SEQ ID NO: 2754821 - RNA, 17 nt, Human
gauggaacuugcugcug

SEQ ID NO: 2754822 - RNA, 15 nt, Human
gauggaguuucucua

SEQ ID NO: 2754823 - RNA, 17 nt, Human
gauggaguuucucuaga

SEQ ID NO: 2754824 - RNA, 19 nt, Human
gauggaguuucucuagaag

SEQ ID NO: 2754825 - RNA, 22 nt, Human
gauggcaagaugugggcaguga

SEQ ID NO: 2754826 - RNA, 13 nt, Human
gauggcaggaggc

SEQ ID NO: 2754827 - RNA, 16 nt, Human
gauggcaggaggcauc

SEQ ID NO: 2754828 - RNA, 21 nt, Human
gauggcuuugaaugcggccca

SEQ ID NO: 2754829 - RNA, 21 nt, Human
gaugggagugcccccaacagc

SEQ ID NO: 2754830 - RNA, 22 nt, Human
gaugggagugcccccaacagca

SEQ ID NO: 2754831 - RNA, 13 nt, Human
gaugggcaaaaaa

SEQ ID NO: 2754832 - RNA, 20 nt, Human
gaugggcuuucccaacagcu

SEQ ID NO: 2754833 - RNA, 17 nt, Human
gauggugguauguuuuc

SEQ ID NO: 2754834 - RNA, 16 nt, Human
gaugguuguacauaua

SEQ ID NO: 2754835 - RNA, 21 nt, Human
gauguaaagugauauuucccc

SEQ ID NO: 2754836 - RNA, 23 nt, Human
gauguacauuuccaaauucacaa

SEQ ID NO: 2754837 - RNA, 19 nt, Human
gauguauguacuucaugcu

SEQ ID NO: 2754838 - RNA, 18 nt, Human
gaugucacuagggcaggg

SEQ ID NO: 2754839 - RNA, 19 nt, Human
gaugucacuagggcaggga

SEQ ID NO: 2754840 - RNA, 16 nt, Human
gaugugggcagugaug

SEQ ID NO: 2754841 - RNA, 16 nt, Human
gauguugaaaaaguuc

SEQ ID NO: 2754842 - RNA, 21 nt, Human
gauguugaaaaaguucugcag

SEQ ID NO: 2754843 - RNA, 23 nt, Human
gauguugaaaaaguucugcagau

SEQ ID NO: 2754844 - RNA, 10 nt, Human
gcagcucucc

SEQ ID NO: 2754845 - RNA, 21 nt, Human
gcagcucuccccuucucugua

SEQ ID NO: 2754846 - RNA, 19 nt, Human
gcagcugcaggggccucug

SEQ ID NO: 2754847 - RNA, 15 nt, Human
gcagcugccuccccu

SEQ ID NO: 2754848 - RNA, 16 nt, Human
gcagcugccuccccuc

SEQ ID NO: 2754849 - RNA, 20 nt, Human
gcagcuuccaggcuggcgug

SEQ ID NO: 2754850 - RNA, 16 nt, Human
gcagcuuuccucaaaa

SEQ ID NO: 2754851 - RNA, 21 nt, Human
gcaggaccaucccggccggcg

SEQ ID NO: 2754852 - RNA, 22 nt, Human
gcaggaccaucccggccggcgc

SEQ ID NO: 2754853 - RNA, 14 nt, Human
gcaggaggcaucca

SEQ ID NO: 2754854 - RNA, 16 nt, Human
gcaggauagaguggga

SEQ ID NO: 2754855 - RNA, 16 nt, Human
gcaggcacagcagcug

SEQ ID NO: 2754856 - RNA, 19 nt, Human
gcaggcacugccaaaacau

SEQ ID NO: 2754857 - RNA, 14 nt, Human
gcaggcagcaggau

SEQ ID NO: 2754858 - RNA, 16 nt, Human
gcaggcagccugccuu

SEQ ID NO: 2754859 - RNA, 20 nt, Human
gcaggcaggaacaaacaggg

SEQ ID NO: 2754860 - RNA, 15 nt, Human
gcaggcaugagucag

SEQ ID NO: 2754861 - RNA, 20 nt, Human
gcaggcaugagucagucuga

SEQ ID NO: 2754862 - RNA, 15 nt, Human
gcaggcgugaccuga

SEQ ID NO: 2754863 - RNA, 14 nt, Human
gcagggacuugaac

SEQ ID NO: 2754864 - RNA, 17 nt, Human
gcaggggugcugggacc

SEQ ID NO: 2754865 - RNA, 19 nt, Human
gcagggugaacugcagcga

SEQ ID NO: 2754866 - RNA, 19 nt, Human
gcagucagaagaccugguc

SEQ ID NO: 2754867 - RNA, 15 nt, Human
gcagugacagcaguc

SEQ ID NO: 2754868 - RNA, 23 nt, Human
gcagugaugucacuagggcaggg

SEQ ID NO: 2754869 - RNA, 17 nt, Human
gcagugccuuucuucuc

SEQ ID NO: 2754870 - RNA, 17 nt, Human
gcagugcuuggcccagg

SEQ ID NO: 2754871 - RNA, 18 nt, Human
gcagugcuuggcccagga

SEQ ID NO: 2754872 - RNA, 19 nt, Human
gcaguggcaucaucucagc

SEQ ID NO: 2754873 - RNA, 19 nt, Human
gcaguggcgcgaucucagc

SEQ ID NO: 2754874 - RNA, 19 nt, Human
gcaguggcgugaucucagc

SEQ ID NO: 2754875 - RNA, 16 nt, Human
gcagugucugcuggag

SEQ ID NO: 2754876 - RNA, 18 nt, Human
gcaguucagagcugcccu

SEQ ID NO: 2754877 - RNA, 14 nt, Human
gcaguucugaagaa

SEQ ID NO: 2754878 - RNA, 16 nt, Human
gcaguucuuuggcuga

SEQ ID NO: 2754879 - RNA, 17 nt, Human
gcaguucuuuggcugaa

SEQ ID NO: 2754880 - RNA, 19 nt, Human
gcaguuguugcccacagcu

SEQ ID NO: 2754881 - RNA, 12 nt, Human
gcaguuuuccau

SEQ ID NO: 2754882 - RNA, 15 nt, Human
gcauaacguauaaaa

SEQ ID NO: 2754883 - RNA, 17 nt, Human
gcauaacguauaaaagc

SEQ ID NO: 2754884 - RNA, 13 nt, Human
gcauauguuucgc

SEQ ID NO: 2754885 - RNA, 13 nt, Human
gcauauuuauaaa

SEQ ID NO: 2754886 - RNA, 14 nt, Human
gcauauuuauaaaa

SEQ ID NO: 2754887 - RNA, 18 nt, Human
gcauauuuauaaaaauaa

SEQ ID NO: 2754888 - RNA, 15 nt, Human
gcaucaauuuuucuu

SEQ ID NO: 2754889 - RNA, 20 nt, Human
gcaucacaugaacuuguaaa

SEQ ID NO: 2754890 - RNA, 22 nt, Human
gcaucagcugcugaaacaacaa

SEQ ID NO: 2754891 - RNA, 15 nt, Human
gcaucccuagaaagc

SEQ ID NO: 2754892 - RNA, 11 nt, Human
gcauccuaguc

SEQ ID NO: 2754893 - RNA, 12 nt, Human
gcauccuagucu

SEQ ID NO: 2754894 - RNA, 22 nt, Human
gcauccuagucucuaucauuaa

SEQ ID NO: 2754895 - RNA, 19 nt, Human
gcauccuuccucacaccag

SEQ ID NO: 2754896 - RNA, 17 nt, Human
gcaucuccucaacucug

SEQ ID NO: 2754897 - RNA, 14 nt, Human
gcaucugccucccc

SEQ ID NO: 2754898 - RNA, 16 nt, Human
gcaucuuacugaaggu

SEQ ID NO: 2754899 - RNA, 21 nt, Human
gcaugaauuuuuuucaucuuc

SEQ ID NO: 2754900 - RNA, 22 nt, Human
gcaugaauuuuuuucaucuucu

SEQ ID NO: 2754901 - RNA, 23 nt, Human
gcaugagucacuacgccuggcug

SEQ ID NO: 2754902 - RNA, 15 nt, Human
gcauggaaaaguuuc

SEQ ID NO: 2754903 - RNA, 14 nt, Human
gcauggaaggcaag

SEQ ID NO: 2754904 - RNA, 16 nt, Human
gcauggagucacagcc

SEQ ID NO: 2754905 - RNA, 21 nt, Human
gcauggccacaucugagcccc

SEQ ID NO: 2754906 - RNA, 19 nt, Human
gcauggguuuuauuauaua

SEQ ID NO: 2754907 - RNA, 21 nt, Human
gcaugguggcgcgcaccugua

SEQ ID NO: 2754908 - RNA, 17 nt, Human
gcaugguuuagaaagcu

SEQ ID NO: 2754909 - RNA, 15 nt, Human
gcauguaugacguga

SEQ ID NO: 2754910 - RNA, 17 nt, Human
gcaugucagacagaacu

SEQ ID NO: 2754911 - RNA, 20 nt, Human
gcauguugcccuguugcugc

SEQ ID NO: 2754912 - RNA, 14 nt, Human
gcauuacugcaugc

SEQ ID NO: 2754913 - RNA, 15 nt, Human
gcauuacugcaugca

SEQ ID NO: 2754914 - RNA, 13 nt, Human
gcauuauaucaaa

SEQ ID NO: 2754915 - RNA, 15 nt, Human
gcauuauaucaaauc

SEQ ID NO: 2754916 - RNA, 13 nt, Human
gcauuauccaucu

SEQ ID NO: 2754917 - RNA, 14 nt, Human
gcauucucugaaga

SEQ ID NO: 2754918 - RNA, 15 nt, Human
gcauucuggauuuua

SEQ ID NO: 2754919 - RNA, 20 nt, Human
gcauuguuggcuguuccugc

SEQ ID NO: 2754920 - RNA, 23 nt, Human
gcauuguuggcuguuccugcagu

SEQ ID NO: 2754921 - RNA, 13 nt, Human
gcauuuaauaugg

SEQ ID NO: 2754922 - RNA, 17 nt, Human
gcauuuuuguaaguuag

SEQ ID NO: 2754923 - RNA, 23 nt, Human
gccaaaaaccaaauuuguauuua

SEQ ID NO: 2754924 - RNA, 18 nt, Human
gccaaaacaucaaccugc

SEQ ID NO: 2754925 - RNA, 16 nt, Human
gccaaacauccuacaa

SEQ ID NO: 2754926 - RNA, 13 nt, Human
gccaaaccaggac

SEQ ID NO: 2754927 - RNA, 20 nt, Human
gccaaauauaaauaaaaaua

SEQ ID NO: 2754928 - RNA, 16 nt, Human
gccaaauguaaaauag

SEQ ID NO: 2754929 - RNA, 22 nt, Human
gccaacccaaaauaagcaggcg

SEQ ID NO: 2754930 - RNA, 19 nt, Human
gccaacggggugaaacccu

SEQ ID NO: 2754931 - RNA, 16 nt, Human
gccaacuaggcagcca

SEQ ID NO: 2754932 - RNA, 23 nt, Human
gccaagagccugagugacagagc

SEQ ID NO: 2754933 - RNA, 16 nt, Human
gccaaggaagaucccu

SEQ ID NO: 2754934 - RNA, 17 nt, Human
gccaaggcuggagugca

SEQ ID NO: 2754935 - RNA, 20 nt, Human
gccaaggcuggagugcagug

SEQ ID NO: 2754936 - RNA, 17 nt, Human
gccaaggguucagagac

SEQ ID NO: 2754937 - RNA, 20 nt, Human
gccaauauccuaauaaaaag

SEQ ID NO: 2754938 - RNA, 22 nt, Human
gccaauauccuaauaaaaaggu

SEQ ID NO: 2754939 - RNA, 15 nt, Human
gccaccaaacccggc

SEQ ID NO: 2754940 - RNA, 17 nt, Human
gccaccacauccagccu

SEQ ID NO: 2754941 - RNA, 18 nt, Human
gccacccugcccagccgu

SEQ ID NO: 2754942 - RNA, 18 nt, Human
gccacgcucugggucgcc

SEQ ID NO: 2754943 - RNA, 21 nt, Human
gccacgcucugggucgccggc

SEQ ID NO: 2754944 - RNA, 22 nt, Human
gccacgcucugggucgccggca

SEQ ID NO: 2754945 - RNA, 23 nt, Human
gccacgcucugggucgccggcau

SEQ ID NO: 2754946 - RNA, 18 nt, Human
gccacggggacucagccc

SEQ ID NO: 2754947 - RNA, 20 nt, Human
gccacggggacucagcccuu

SEQ ID NO: 2754948 - RNA, 18 nt, Human
gccacggugccuccagau

SEQ ID NO: 2754949 - RNA, 15 nt, Human
gccacuaaauugaca

SEQ ID NO: 2754950 - RNA, 13 nt, Human
gccacuagcccuc

SEQ ID NO: 2754951 - RNA, 15 nt, Human
gccagaagucaaggc

SEQ ID NO: 2754952 - RNA, 20 nt, Human
gccagacaucaacagauaaa

SEQ ID NO: 2754953 - RNA, 12 nt, Human
gccagacaugug

SEQ ID NO: 2754954 - RNA, 13 nt, Human
gccagacaugugg

SEQ ID NO: 2754955 - RNA, 19 nt, Human
gccagagcuacccgcagag

SEQ ID NO: 2754956 - RNA, 14 nt, Human
gccagaggcucuaa

SEQ ID NO: 2754957 - RNA, 19 nt, Human
gccagcagccagcucucag

SEQ ID NO: 2754958 - RNA, 19 nt, Human
gccagcaguucagagcugc

SEQ ID NO: 2754959 - RNA, 23 nt, Human
gccagccaacccuuucauuagaa

SEQ ID NO: 2754960 - RNA, 23 nt, Human
gccagccacggggacucagcccu

SEQ ID NO: 2754961 - RNA, 18 nt, Human
gccagcuccgcgccagga

SEQ ID NO: 2754962 - RNA, 14 nt, Human
gccagcucucagcc

SEQ ID NO: 2754963 - RNA, 15 nt, Human
gccagcucucagcca

SEQ ID NO: 2754964 - RNA, 20 nt, Human
gccagcugcccccagagcca

SEQ ID NO: 2754965 - RNA, 14 nt, Human
gccagcuggccuug

SEQ ID NO: 2754966 - RNA, 21 nt, Human
gccaggaaucacuggcuguua

SEQ ID NO: 2754967 - RNA, 16 nt, Human
gccaggauggcgcagg

SEQ ID NO: 2754968 - RNA, 18 nt, Human
gccaggcacacugagcca

SEQ ID NO: 2754969 - RNA, 20 nt, Human
gccaggccccaagcccacug

SEQ ID NO: 2754970 - RNA, 12 nt, Human
gccaggccuggc

SEQ ID NO: 2754971 - RNA, 18 nt, Human
gccaggcuggagugcagu

SEQ ID NO: 2754972 - RNA, 11 nt, Human
gccaggcuggu

SEQ ID NO: 2754973 - RNA, 12 nt, Human
gccagggcaaga

SEQ ID NO: 2754974 - RNA, 15 nt, Human
gccagugucaggagg

SEQ ID NO: 2754975 - RNA, 15 nt, Human
gccaguuguccuccu

SEQ ID NO: 2754976 - RNA, 16 nt, Human
gccaguuguccuccuu

SEQ ID NO: 2754977 - RNA, 17 nt, Human
gccaguuguccuccuuc

SEQ ID NO: 2754978 - RNA, 12 nt, Human
gccauaaaacuu

SEQ ID NO: 2754979 - RNA, 13 nt, Human
gccauauaauuca

SEQ ID NO: 2754980 - RNA, 17 nt, Human
gccaucaccuuagacca

SEQ ID NO: 2754981 - RNA, 12 nt, Human
gccaucccuccc

SEQ ID NO: 2754982 - RNA, 14 nt, Human
gccaucccucccuc

SEQ ID NO: 2754983 - RNA, 16 nt, Human
gccaucccucccucca

SEQ ID NO: 2754984 - RNA, 17 nt, Human
gccaucccucccuccac

SEQ ID NO: 2754985 - RNA, 18 nt, Human
gccaucccucccuccacc

SEQ ID NO: 2754986 - RNA, 19 nt, Human
gccaucccucccuccaccu

SEQ ID NO: 2754987 - RNA, 21 nt, Human
gccaucccucccuccaccucc

SEQ ID NO: 2754988 - RNA, 23 nt, Human
gccaucccucccuccaccucccu

SEQ ID NO: 2754989 - RNA, 20 nt, Human
gccugagcggaccuucccag

SEQ ID NO: 2754990 - RNA, 19 nt, Human
gccugaggugccgccuccu

SEQ ID NO: 2754991 - RNA, 23 nt, Human
gccugaguguugccuaauuuguu

SEQ ID NO: 2754992 - RNA, 21 nt, Human
gccugaucaccugcccugcug

SEQ ID NO: 2754993 - RNA, 21 nt, Human
gccugauuaaaguuaaauaaa

SEQ ID NO: 2754994 - RNA, 18 nt, Human
gccugcaggcaugaguca

SEQ ID NO: 2754995 - RNA, 24 nt, Human
gccugcccugaaagucccagauca

SEQ ID NO: 2754996 - RNA, 11 nt, Human
gccugccuccc

SEQ ID NO: 2754997 - RNA, 14 nt, Human
gccugccuuucucc

SEQ ID NO: 2754998 - RNA, 13 nt, Human
gccugcucccuag

SEQ ID NO: 2754999 - RNA, 18 nt, Human
gccugcucccuagccaga

SEQ ID NO: 2755000 - RNA, 21 nt, Human
gccugcucccuagccagaggc

SEQ ID NO: 2755001 - RNA, 23 nt, Human
gccugcucccuagccagaggcuc

SEQ ID NO: 2755002 - RNA, 23 nt, Human
gccugcucgcccacuuccucccg

SEQ ID NO: 2755003 - RNA, 17 nt, Human
gccugcuggauguggag

SEQ ID NO: 2755004 - RNA, 19 nt, Human
gccugcuuuuuauggccug

SEQ ID NO: 2755005 - RNA, 14 nt, Human
gccuggcuaauuuu

SEQ ID NO: 2755006 - RNA, 13 nt, Human
gccuggcugggag

SEQ ID NO: 2755007 - RNA, 16 nt, Human
gccuggcugggagugg

SEQ ID NO: 2755008 - RNA, 18 nt, Human
gccugggcaacaugguga

SEQ ID NO: 2755009 - RNA, 16 nt, Human
gccuggggagauggag

SEQ ID NO: 2755010 - RNA, 19 nt, Human
gccuggucaacauagugag

SEQ ID NO: 2755011 - RNA, 22 nt, Human
gccugguguguucaagaccagc

SEQ ID NO: 2755012 - RNA, 19 nt, Human
gccuguaaucccagcacuu

SEQ ID NO: 2755013 - RNA, 13 nt, Human
gccuguacccagu

SEQ ID NO: 2755014 - RNA, 14 nt, Human
gccugucccugcag

SEQ ID NO: 2755015 - RNA, 15 nt, Human
gccuuaacuggagcc

SEQ ID NO: 2755016 - RNA, 23 nt, Human
gccuuaacuggagccccaucagc

SEQ ID NO: 2755017 - RNA, 14 nt, Human
gccuuccccuugcc

SEQ ID NO: 2755018 - RNA, 15 nt, Human
gccuuccugccgcaa

SEQ ID NO: 2755019 - RNA, 15 nt, Human
gccuuccuuucuguu

SEQ ID NO: 2755020 - RNA, 14 nt, Human
gccuucggccucca

SEQ ID NO: 2755021 - RNA, 19 nt, Human
gccuucggccuccauccug

SEQ ID NO: 2755022 - RNA, 20 nt, Human
gccuucggccuccauccuga

SEQ ID NO: 2755023 - RNA, 16 nt, Human
gccuucucaacuccaa

SEQ ID NO: 2755024 - RNA, 16 nt, Human
gccuucucucaaggag

SEQ ID NO: 2755025 - RNA, 18 nt, Human
gccuucuucggaaagaag

SEQ ID NO: 2755026 - RNA, 16 nt, Human
gccuugcuccuggcug

SEQ ID NO: 2755027 - RNA, 19 nt, Human
gccuugcugaacucccucu

SEQ ID NO: 2755028 - RNA, 15 nt, Human
gccuugggaccccug

SEQ ID NO: 2755029 - RNA, 16 nt, Human
gccuuucuucucucca

SEQ ID NO: 2755030 - RNA, 23 nt, Human
gccuuuggcuuuuggcuccaccc

SEQ ID NO: 2755031 - RNA, 21 nt, Human
gccuuuguugcuaucaaucca

SEQ ID NO: 2755032 - RNA, 21 nt, Human
gccuuuucccaacuccagaaa

SEQ ID NO: 2755033 - RNA, 21 nt, Human
gcgacaguuuuccuucucauc

SEQ ID NO: 2755034 - RNA, 22 nt, Human
gcgacaguuuuccuucucaucu

SEQ ID NO: 2755035 - RNA, 22 nt, Human
gcgacucuauagacucuaggac

SEQ ID NO: 2755036 - RNA, 12 nt, Human
gcgagccccagg

SEQ ID NO: 2755037 - RNA, 16 nt, Human
gcgagccccaggcggg

SEQ ID NO: 2755038 - RNA, 19 nt, Human
gcgagcgcgcgcgcccucu

SEQ ID NO: 2755039 - RNA, 21 nt, Human
gcgaguacuucccgcuguucc

SEQ ID NO: 2755040 - RNA, 19 nt, Human
gcgagugggggccagccac

SEQ ID NO: 2755041 - RNA, 15 nt, Human
gcgauucuccugccu

SEQ ID NO: 2755042 - RNA, 23 nt, Human
gcgauucuccugccucagccucc

SEQ ID NO: 2755043 - RNA, 14 nt, Human
gcgccaccauggcc

SEQ ID NO: 2755044 - RNA, 14 nt, Human
gcgcccucuggcug

SEQ ID NO: 2755045 - RNA, 17 nt, Human
gcgcccucuggcugcug

SEQ ID NO: 2755046 - RNA, 23 nt, Human
gcgcccucuggcugcugguggcg

SEQ ID NO: 2755047 - RNA, 17 nt, Human
gcgccuccgcuacuucc

SEQ ID NO: 2755048 - RNA, 20 nt, Human
gcgcgcccucuggcugcugg

SEQ ID NO: 2755049 - RNA, 15 nt, Human
gcgcgcgcgcccucu

SEQ ID NO: 2755050 - RNA, 22 nt, Human
gcgcgcucaucccacccgccca

SEQ ID NO: 2755051 - RNA, 16 nt, Human
gcgcgcuccgcgcagc

SEQ ID NO: 2755052 - RNA, 17 nt, Human
gcgcgcuccgcgcagcu

SEQ ID NO: 2755053 - RNA, 22 nt, Human
gcgcggcgggagggcgcggggc

SEQ ID NO: 2755054 - RNA, 13 nt, Human
gcgcuaauuucua

SEQ ID NO: 2755055 - RNA, 17 nt, Human
gcgcucaucccacccgc

SEQ ID NO: 2755056 - RNA, 18 nt, Human
gcgcucaucccacccgcc

SEQ ID NO: 2755057 - RNA, 21 nt, Human
gcgcucaucccacccgcccac

SEQ ID NO: 2755058 - RNA, 16 nt, Human
gcgcuggcugcgcucg

SEQ ID NO: 2755059 - RNA, 18 nt, Human
gcgcuggcugcgcucggc

SEQ ID NO: 2755060 - RNA, 18 nt, Human
gcggaauugcucucccag

SEQ ID NO: 2755061 - RNA, 13 nt, Human
gcggcaucaggcu

SEQ ID NO: 2755062 - RNA, 23 nt, Human
gcggcauuuucuucucacauuua

SEQ ID NO: 2755063 - RNA, 19 nt, Human
gcggccacggugccuccag

SEQ ID NO: 2755064 - RNA, 17 nt, Human
gcggcccugugcggccu

SEQ ID NO: 2755065 - RNA, 19 nt, Human
gcggcccugugcggccugg

SEQ ID NO: 2755066 - RNA, 22 nt, Human
gcggccuggucuaccuguucgc

SEQ ID NO: 2755067 - RNA, 21 nt, Human
gcggcgggagggcgcggggcg

SEQ ID NO: 2755068 - RNA, 13 nt, Human
gcgggacacaggc

SEQ ID NO: 2755069 - RNA, 20 nt, Human
gcggggcggggagcgagccc

SEQ ID NO: 2755070 - RNA, 22 nt, Human
gcggguccgggucgcaggacca

SEQ ID NO: 2755071 - RNA, 14 nt, Human
gcgugagccaccaa

SEQ ID NO: 2755072 - RNA, 12 nt, Human
gcgugcaggcag

SEQ ID NO: 2755073 - RNA, 13 nt, Human
gcgugcaggcagc

SEQ ID NO: 2755074 - RNA, 22 nt, Human
gcuaaaacaagcacuaaacaaa

SEQ ID NO: 2755075 - RNA, 21 nt, Human
gcuaaaguaucuguauugcau

SEQ ID NO: 2755076 - RNA, 19 nt, Human
gcuaacuggguuaaauauu

SEQ ID NO: 2755077 - RNA, 12 nt, Human
gcuaaggcagga

SEQ ID NO: 2755078 - RNA, 21 nt, Human
gcuaaguugcaccaacuuuga

SEQ ID NO: 2755079 - RNA, 15 nt, Human
gcuaauaucuuaucu

SEQ ID NO: 2755080 - RNA, 22 nt, Human
gcuaauuagcauggccacaucu

SEQ ID NO: 2755081 - RNA, 17 nt, Human
gcuaauuauauaauauu

SEQ ID NO: 2755082 - RNA, 19 nt, Human
gcuaauuucuauuugaucu

SEQ ID NO: 2755083 - RNA, 14 nt, Human
gcuaauuuugaaaa

SEQ ID NO: 2755084 - RNA, 19 nt, Human
gcuaauuuugaaaaacugc

SEQ ID NO: 2755085 - RNA, 17 nt, Human
gcuaauuuuuaggcuga

SEQ ID NO: 2755086 - RNA, 19 nt, Human
gcuaauuuuuguauuuuua

SEQ ID NO: 2755087 - RNA, 14 nt, Human
gcuacaaaaacaca

SEQ ID NO: 2755088 - RNA, 15 nt, Human
gcuacaaaaacacag

SEQ ID NO: 2755089 - RNA, 18 nt, Human
gcuacaaaaacacagcaa

SEQ ID NO: 2755090 - RNA, 19 nt, Human
gcuacaaaugcauuucuaa

SEQ ID NO: 2755091 - RNA, 18 nt, Human
gcuacacagaucacagcu

SEQ ID NO: 2755092 - RNA, 21 nt, Human
gcuacaggccccaucuggucc

SEQ ID NO: 2755093 - RNA, 11 nt, Human
gcuacagugag

SEQ ID NO: 2755094 - RNA, 18 nt, Human
gcuacagugagccaagag

SEQ ID NO: 2755095 - RNA, 18 nt, Human
gcuacgcgcgcuccgcgc

SEQ ID NO: 2755096 - RNA, 14 nt, Human
gcuacuaauuuuaa

SEQ ID NO: 2755097 - RNA, 15 nt, Human
gcuacuaauuuuaaa

SEQ ID NO: 2755098 - RNA, 20 nt, Human
gcuacucuguuccuucacau

SEQ ID NO: 2755099 - RNA, 21 nt, Human
gcuacucuguuccuucacauc

SEQ ID NO: 2755100 - RNA, 14 nt, Human
gcuagaauuugaua

SEQ ID NO: 2755101 - RNA, 22 nt, Human
gcuagaauuugauaugugaaca

SEQ ID NO: 2755102 - RNA, 20 nt, Human
gcuaggggggucagccagcc

SEQ ID NO: 2755103 - RNA, 21 nt, Human
gcuaguaauuggaaaggcagc

SEQ ID NO: 2755104 - RNA, 22 nt, Human
gcuaguaauuggaaaggcagcu

SEQ ID NO: 2755105 - RNA, 12 nt, Human
gcuaguaucaaa

SEQ ID NO: 2755106 - RNA, 20 nt, Human
gcuagucauaaccuuaccag

SEQ ID NO: 2755107 - RNA, 18 nt, Human
gcuaucaauccaagaacu

SEQ ID NO: 2755108 - RNA, 12 nt, Human
gcuaucgccauc

SEQ ID NO: 2755109 - RNA, 20 nt, Human
gcuaucgccaucacagcuga

SEQ ID NO: 2755110 - RNA, 20 nt, Human
gcuaucugggcugugggcaa

SEQ ID NO: 2755111 - RNA, 15 nt, Human
gcuaugcuauugaag

SEQ ID NO: 2755112 - RNA, 13 nt, Human
gcuauguuguugc

SEQ ID NO: 2755113 - RNA, 23 nt, Human
gcuauucacaaccacucauucaa

SEQ ID NO: 2755114 - RNA, 12 nt, Human
gcuauucuccau

SEQ ID NO: 2755115 - RNA, 17 nt, Human
gcuauugggguuggggg

SEQ ID NO: 2755116 - RNA, 22 nt, Human
gcuauuugcuguuauuuuaucu

SEQ ID NO: 2755117 - RNA, 19 nt, Human
gcucacacauuacaacagu

SEQ ID NO: 2755118 - RNA, 17 nt, Human
gcucaccagucccuccc

SEQ ID NO: 2755119 - RNA, 20 nt, Human
gcucagauuauaacuguugu

SEQ ID NO: 2755120 - RNA, 13 nt, Human
gcucagcccugca

SEQ ID NO: 2755121 - RNA, 15 nt, Human
gcucagcccugcacc

SEQ ID NO: 2755122 - RNA, 16 nt, Human
gcucagcccugcacca

SEQ ID NO: 2755123 - RNA, 17 nt, Human
gcucagcccugcaccau

SEQ ID NO: 2755124 - RNA, 12 nt, Human
gcucagcccugg

SEQ ID NO: 2755125 - RNA, 13 nt, Human
gcucagcccuggu

SEQ ID NO: 2755126 - RNA, 21 nt, Human
gcucagcccuggugggcagag

SEQ ID NO: 2755127 - RNA, 18 nt, Human
gcucaggagcccugggag

SEQ ID NO: 2755128 - RNA, 17 nt, Human
gcucaggaggucaagau

SEQ ID NO: 2755129 - RNA, 20 nt, Human
gcucaggcuggcaccgcugu

SEQ ID NO: 2755130 - RNA, 14 nt, Human
gcucauggaauugg

SEQ ID NO: 2755131 - RNA, 19 nt, Human
gcucauggaauuggagcuc

SEQ ID NO: 2755132 - RNA, 16 nt, Human
gcucauuguagaaaag

SEQ ID NO: 2755133 - RNA, 23 nt, Human
gcuucauguaacuagaauuucuu

SEQ ID NO: 2755134 - RNA, 14 nt, Human
gcuuccaauuuuug

SEQ ID NO: 2755135 - RNA, 16 nt, Human
gcuuccauuguugucu

SEQ ID NO: 2755136 - RNA, 20 nt, Human
gcuuccgcauccuagucucu

SEQ ID NO: 2755137 - RNA, 15 nt, Human
gcuucucaauuucua

SEQ ID NO: 2755138 - RNA, 22 nt, Human
gcuucucauccugcaggcagcu

SEQ ID NO: 2755139 - RNA, 16 nt, Human
gcuucuccagccucag

SEQ ID NO: 2755140 - RNA, 24 nt, Human
gcuucugggcagacucuggucaag

SEQ ID NO: 2755141 - RNA, 12 nt, Human
gcuucuguuccg

SEQ ID NO: 2755142 - RNA, 13 nt, Human
gcuucuguuccgu

SEQ ID NO: 2755143 - RNA, 15 nt, Human
gcuucuguuuuauaa

SEQ ID NO: 2755144 - RNA, 20 nt, Human
gcuucuuaaaauagccauaa

SEQ ID NO: 2755145 - RNA, 14 nt, Human
gcuugaaaccuuca

SEQ ID NO: 2755146 - RNA, 16 nt, Human
gcuugaacccaggaga

SEQ ID NO: 2755147 - RNA, 20 nt, Human
gcuugcagagaugaggccgc

SEQ ID NO: 2755148 - RNA, 22 nt, Human
gcuugcagagaugaggccgcca

SEQ ID NO: 2755149 - RNA, 20 nt, Human
gcuugcaugcuugcauaaga

SEQ ID NO: 2755150 - RNA, 10 nt, Human
gcuugccauc

SEQ ID NO: 2755151 - RNA, 15 nt, Human
gcuugccaucccucc

SEQ ID NO: 2755152 - RNA, 19 nt, Human
gcuugccaucccucccucc

SEQ ID NO: 2755153 - RNA, 16 nt, Human
gcuugcccuguuaaaa

SEQ ID NO: 2755154 - RNA, 19 nt, Human
gcuuggaaaggaccaguau

SEQ ID NO: 2755155 - RNA, 19 nt, Human
gcuuggcccaggaguuugg

SEQ ID NO: 2755156 - RNA, 20 nt, Human
gcuuguauuuuacuuuucca

SEQ ID NO: 2755157 - RNA, 21 nt, Human
gcuuguccaacccgaggcccg

SEQ ID NO: 2755158 - RNA, 14 nt, Human
gcuuuaacuccugc

SEQ ID NO: 2755159 - RNA, 21 nt, Human
gcuuuaaugaauaaacauuug

SEQ ID NO: 2755160 - RNA, 19 nt, Human
gcuuuagccaagugcaggg

SEQ ID NO: 2755161 - RNA, 18 nt, Human
gcuuuagccuuaaagaua

SEQ ID NO: 2755162 - RNA, 13 nt, Human
gcuuucagagccu

SEQ ID NO: 2755163 - RNA, 12 nt, Human
gcuuucuaucua

SEQ ID NO: 2755164 - RNA, 19 nt, Human
gcuuucucugagggggugg

SEQ ID NO: 2755165 - RNA, 16 nt, Human
gcuuucuuuuuuuucu

SEQ ID NO: 2755166 - RNA, 17 nt, Human
gcuuucuuuuuuuucuu

SEQ ID NO: 2755167 - RNA, 21 nt, Human
gcuuucuuuuuuuucuuuuuu

SEQ ID NO: 2755168 - RNA, 17 nt, Human
gcuuugcccugcugccc

SEQ ID NO: 2755169 - RNA, 14 nt, Human
gcuuuggaagccau

SEQ ID NO: 2755170 - RNA, 23 nt, Human
gcuuuggucuaucuuugagcgcc

SEQ ID NO: 2755171 - RNA, 14 nt, Human
gcuuuguucuucuu

SEQ ID NO: 2755172 - RNA, 15 nt, Human
gcuuuucaaaauugg

SEQ ID NO: 2755173 - RNA, 21 nt, Human
gcuuuucccuuuuuuuaagua

SEQ ID NO: 2755174 - RNA, 16 nt, Human
gcuuuucuuuucuuug

SEQ ID NO: 2755175 - RNA, 18 nt, Human
gcuuuucuuuucuuuguu

SEQ ID NO: 2755176 - RNA, 21 nt, Human
gcuuuucuuuucuuuguuucu

SEQ ID NO: 2755177 - RNA, 16 nt, Human
gcuuuuucucucccac

SEQ ID NO: 2755178 - RNA, 13 nt, Human
gcuuuuuuugaau

SEQ ID NO: 2755179 - RNA, 12 nt, Human
ggaaaaaacugu

SEQ ID NO: 2755180 - RNA, 13 nt, Human
ggaaaaaauaaca

SEQ ID NO: 2755181 - RNA, 13 nt, Human
ggaaaagaaaaag

SEQ ID NO: 2755182 - RNA, 14 nt, Human
ggaaaagaaaaaga

SEQ ID NO: 2755183 - RNA, 21 nt, Human
ggaaaauggacaucaaaauca

SEQ ID NO: 2755184 - RNA, 20 nt, Human
ggaaacccagcucacaggag

SEQ ID NO: 2755185 - RNA, 18 nt, Human
ggaaacgaagcaccauca

SEQ ID NO: 2755186 - RNA, 15 nt, Human
ggaaagaagaaggug

SEQ ID NO: 2755187 - RNA, 23 nt, Human
ggaaagaagaaggugggaggaug

SEQ ID NO: 2755188 - RNA, 14 nt, Human
ggaaagaagagccg

SEQ ID NO: 2755189 - RNA, 12 nt, Human
ggaaagaaguug

SEQ ID NO: 2755190 - RNA, 18 nt, Human
ggaaagaauaaccaacac

SEQ ID NO: 2755191 - RNA, 21 nt, Human
ggaaagaauaaccaacacccu

SEQ ID NO: 2755192 - RNA, 20 nt, Human
ggaaaggaccaguaugcuug

SEQ ID NO: 2755193 - RNA, 21 nt, Human
ggaaaggaccaguaugcuugg

SEQ ID NO: 2755194 - RNA, 20 nt, Human
ggaaaguuuucuccacugga

SEQ ID NO: 2755195 - RNA, 12 nt, Human
ggaaaucaaaua

SEQ ID NO: 2755196 - RNA, 20 nt, Human
ggaaaucaaauaugcaaagc

SEQ ID NO: 2755197 - RNA, 15 nt, Human
ggaaaugaaagaaag

SEQ ID NO: 2755198 - RNA, 22 nt, Human
ggaaaugauguuucauaagaau

SEQ ID NO: 2755199 - RNA, 11 nt, Human
ggaaaugcucc

SEQ ID NO: 2755200 - RNA, 12 nt, Human
ggaaauggacac

SEQ ID NO: 2755201 - RNA, 15 nt, Human
ggaacaaggaaggaa

SEQ ID NO: 2755202 - RNA, 16 nt, Human
ggaacaaggaaggaaa

SEQ ID NO: 2755203 - RNA, 16 nt, Human
ggaacaguuaccucug

SEQ ID NO: 2755204 - RNA, 23 nt, Human
ggaacuccagagaugagugucug

SEQ ID NO: 2755205 - RNA, 15 nt, Human
ggaacugucucucau

SEQ ID NO: 2755206 - RNA, 13 nt, Human
ggaagacaguggc

SEQ ID NO: 2755207 - RNA, 19 nt, Human
ggaagaccucauuuugaag

SEQ ID NO: 2755208 - RNA, 18 nt, Human
ggaagagacagcccagga

SEQ ID NO: 2755209 - RNA, 20 nt, Human
ggaaggcugaggcaggagga

SEQ ID NO: 2755210 - RNA, 17 nt, Human
ggaaggggaaggauagg

SEQ ID NO: 2755211 - RNA, 13 nt, Human
ggaaguagaggag

SEQ ID NO: 2755212 - RNA, 21 nt, Human
ggaagugcuaauuuugaaaaa

SEQ ID NO: 2755213 - RNA, 20 nt, Human
ggaauaauccuaaacauaug

SEQ ID NO: 2755214 - RNA, 20 nt, Human
ggaauguguaagucuuuaau

SEQ ID NO: 2755215 - RNA, 15 nt, Human
ggaauugaggacacu

SEQ ID NO: 2755216 - RNA, 19 nt, Human
ggaauuucuucaacucccu

SEQ ID NO: 2755217 - RNA, 15 nt, Human
ggaauuuucuuccaa

SEQ ID NO: 2755218 - RNA, 13 nt, Human
ggacaaaaggaau

SEQ ID NO: 2755219 - RNA, 10 nt, Human
ggacacacaa

SEQ ID NO: 2755220 - RNA, 14 nt, Human
ggacacauaucaaa

SEQ ID NO: 2755221 - RNA, 13 nt, Human
ggacagggaggac

SEQ ID NO: 2755222 - RNA, 13 nt, Human
ggacaguaaaauc

SEQ ID NO: 2755223 - RNA, 17 nt, Human
ggacagucaccucaugg

SEQ ID NO: 2755224 - RNA, 18 nt, Human
ggacagucaccucaugga

SEQ ID NO: 2755225 - RNA, 15 nt, Human
ggacaguuccugaga

SEQ ID NO: 2755226 - RNA, 14 nt, Human
ggacaguuuucugc

SEQ ID NO: 2755227 - RNA, 15 nt, Human
ggacauuugcucaug

SEQ ID NO: 2755228 - RNA, 17 nt, Human
ggacauuugcucaugga

SEQ ID NO: 2755229 - RNA, 14 nt, Human
ggaccaucccggcc

SEQ ID NO: 2755230 - RNA, 15 nt, Human
ggaccaucccggccg

SEQ ID NO: 2755231 - RNA, 18 nt, Human
ggaccaucccggccggcg

SEQ ID NO: 2755232 - RNA, 18 nt, Human
ggacccagggaugacaug

SEQ ID NO: 2755233 - RNA, 14 nt, Human
ggaccugacuauug

SEQ ID NO: 2755234 - RNA, 13 nt, Human
ggaccuucccagc

SEQ ID NO: 2755235 - RNA, 21 nt, Human
ggacgagaaaacaauaacgau

SEQ ID NO: 2755236 - RNA, 12 nt, Human
ggacgagaauga

SEQ ID NO: 2755237 - RNA, 22 nt, Human
ggacgcucucuggccuucggcc

SEQ ID NO: 2755238 - RNA, 23 nt, Human
ggacgcucucuggccuucggccu

SEQ ID NO: 2755239 - RNA, 23 nt, Human
ggacggcuccggacgcugcugcc

SEQ ID NO: 2755240 - RNA, 12 nt, Human
ggacuaaaagau

SEQ ID NO: 2755241 - RNA, 18 nt, Human
ggacuaaguguaccagag

SEQ ID NO: 2755242 - RNA, 19 nt, Human
ggacucaccucccccaucu

SEQ ID NO: 2755243 - RNA, 21 nt, Human
ggacugugugcucaggagccc

SEQ ID NO: 2755244 - RNA, 18 nt, Human
ggacuucuugaaaucaau

SEQ ID NO: 2755245 - RNA, 11 nt, Human
ggacuugaacc

SEQ ID NO: 2755246 - RNA, 16 nt, Human
ggacuugccucugcac

SEQ ID NO: 2755247 - RNA, 13 nt, Human
ggagaaaugaaaa

SEQ ID NO: 2755248 - RNA, 15 nt, Human
ggagaaccccaggac

SEQ ID NO: 2755249 - RNA, 20 nt, Human
ggagaagagcuguucacagc

SEQ ID NO: 2755250 - RNA, 17 nt, Human
ggagacaaaacuagaga

SEQ ID NO: 2755251 - RNA, 15 nt, Human
ggagacaccaccacc

SEQ ID NO: 2755252 - RNA, 15 nt, Human
ggagagaagauagca

SEQ ID NO: 2755253 - RNA, 19 nt, Human
ggagagccccucacacagc

SEQ ID NO: 2755254 - RNA, 20 nt, Human
ggagaggagugugaagcaag

SEQ ID NO: 2755255 - RNA, 14 nt, Human
ggagauacagugga

SEQ ID NO: 2755256 - RNA, 21 nt, Human
ggagaugggguuucaccaugu

SEQ ID NO: 2755257 - RNA, 17 nt, Human
ggagaugguggaugauc

SEQ ID NO: 2755258 - RNA, 20 nt, Human
ggagauuuuuuaauccuuuu

SEQ ID NO: 2755259 - RNA, 16 nt, Human
ggagcaguagcuggag

SEQ ID NO: 2755260 - RNA, 19 nt, Human
ggagcaguagcuggaggga

SEQ ID NO: 2755261 - RNA, 22 nt, Human
ggagcaucuccucaacucugag

SEQ ID NO: 2755262 - RNA, 13 nt, Human
ggagccagggcug

SEQ ID NO: 2755263 - RNA, 19 nt, Human
ggagcccugggaggcucug

SEQ ID NO: 2755264 - RNA, 18 nt, Human
ggagccgggaaagaagag

SEQ ID NO: 2755265 - RNA, 13 nt, Human
ggagccuccagcu

SEQ ID NO: 2755266 - RNA, 16 nt, Human
ggagccuccagcugcc

SEQ ID NO: 2755267 - RNA, 18 nt, Human
ggagccugaucaccugcc

SEQ ID NO: 2755268 - RNA, 19 nt, Human
ggagccugaucaccugccc

SEQ ID NO: 2755269 - RNA, 20 nt, Human
ggagccugaucaccugcccu

SEQ ID NO: 2755270 - RNA, 19 nt, Human
ggagcgagccccaggcggg

SEQ ID NO: 2755271 - RNA, 19 nt, Human
ggagcgagugggggccagc

SEQ ID NO: 2755272 - RNA, 21 nt, Human
ggagcgagugggggccagcca

SEQ ID NO: 2755273 - RNA, 13 nt, Human
ggagcucaggaag

SEQ ID NO: 2755274 - RNA, 12 nt, Human
ggagcucgugga

SEQ ID NO: 2755275 - RNA, 17 nt, Human
ggagcucguggaacagu

SEQ ID NO: 2755276 - RNA, 12 nt, Human
ggagcucguggg

SEQ ID NO: 2755277 - RNA, 22 nt, Human
ggagcugccucucucauccacu

SEQ ID NO: 2755278 - RNA, 19 nt, Human
ggagcuggaaacacauguu

SEQ ID NO: 2755279 - RNA, 15 nt, Human
ggcgugagccaccaa

SEQ ID NO: 2755280 - RNA, 14 nt, Human
ggcgugaucucagc

SEQ ID NO: 2755281 - RNA, 14 nt, Human
ggcuaaagcccaga

SEQ ID NO: 2755282 - RNA, 22 nt, Human
ggcuaagcuucacuguaaaaua

SEQ ID NO: 2755283 - RNA, 23 nt, Human
ggcuaagcuucacuguaaaauaa

SEQ ID NO: 2755284 - RNA, 20 nt, Human
ggcuaauaucuuaucuuccu

SEQ ID NO: 2755285 - RNA, 16 nt, Human
ggcuacgcgcgcuccg

SEQ ID NO: 2755286 - RNA, 15 nt, Human
ggcuacuccauguug

SEQ ID NO: 2755287 - RNA, 16 nt, Human
ggcuagaaccaccugc

SEQ ID NO: 2755288 - RNA, 20 nt, Human
ggcuagacuagucucaaacu

SEQ ID NO: 2755289 - RNA, 17 nt, Human
ggcuaguaucaaaagaa

SEQ ID NO: 2755290 - RNA, 13 nt, Human
ggcucacagaauu

SEQ ID NO: 2755291 - RNA, 21 nt, Human
ggcucacgccuguaaucccag

SEQ ID NO: 2755292 - RNA, 17 nt, Human
ggcucagccuggugggc

SEQ ID NO: 2755293 - RNA, 20 nt, Human
ggcucagccuggugggccuc

SEQ ID NO: 2755294 - RNA, 21 nt, Human
ggcucagccuggugggccucc

SEQ ID NO: 2755295 - RNA, 14 nt, Human
ggcuccacuugguc

SEQ ID NO: 2755296 - RNA, 19 nt, Human
ggcuccacuuggucuguga

SEQ ID NO: 2755297 - RNA, 21 nt, Human
ggcuccacuuggucugugaga

SEQ ID NO: 2755298 - RNA, 14 nt, Human
ggcuccccuccucg

SEQ ID NO: 2755299 - RNA, 17 nt, Human
ggcuccggacgcugcug

SEQ ID NO: 2755300 - RNA, 13 nt, Human
ggcuccucaggga

SEQ ID NO: 2755301 - RNA, 17 nt, Human
ggcuccucagggacuca

SEQ ID NO: 2755302 - RNA, 13 nt, Human
ggcuccugagaca

SEQ ID NO: 2755303 - RNA, 15 nt, Human
ggcucuaauguacaa

SEQ ID NO: 2755304 - RNA, 18 nt, Human
ggcucuggacaggcacua

SEQ ID NO: 2755305 - RNA, 13 nt, Human
ggcugaaaggaag

SEQ ID NO: 2755306 - RNA, 15 nt, Human
ggcugagcaaucuga

SEQ ID NO: 2755307 - RNA, 16 nt, Human
ggcugagccucagucu

SEQ ID NO: 2755308 - RNA, 16 nt, Human
ggcugaggcaggagga

SEQ ID NO: 2755309 - RNA, 21 nt, Human
ggcugcaguuuugcuaucugg

SEQ ID NO: 2755310 - RNA, 17 nt, Human
ggcugcgcucggccugc

SEQ ID NO: 2755311 - RNA, 18 nt, Human
ggcugcgcucggccugcu

SEQ ID NO: 2755312 - RNA, 21 nt, Human
ggcugcgcucggccugcucgc

SEQ ID NO: 2755313 - RNA, 23 nt, Human
ggcugcgcucggccugcucgccc

SEQ ID NO: 2755314 - RNA, 16 nt, Human
ggcugcucagggcugg

SEQ ID NO: 2755315 - RNA, 19 nt, Human
ggcugcugguggcgcuggc

SEQ ID NO: 2755316 - RNA, 17 nt, Human
ggcuggagcugccucuc

SEQ ID NO: 2755317 - RNA, 17 nt, Human
ggcuggagugcaguggc

SEQ ID NO: 2755318 - RNA, 13 nt, Human
ggcuggcaccgcu

SEQ ID NO: 2755319 - RNA, 14 nt, Human
ggcuggcaccgcug

SEQ ID NO: 2755320 - RNA, 17 nt, Human
ggcuggcaccgcuguac

SEQ ID NO: 2755321 - RNA, 14 nt, Human
ggcugggaguggca

SEQ ID NO: 2755322 - RNA, 15 nt, Human
ggcugggaguggcau

SEQ ID NO: 2755323 - RNA, 14 nt, Human
ggcuggggacuugu

SEQ ID NO: 2755324 - RNA, 22 nt, Human
ggcugggucgcccuggacugug

SEQ ID NO: 2755325 - RNA, 12 nt, Human
ggcuggucucaa

SEQ ID NO: 2755326 - RNA, 15 nt, Human
ggcuggucucaaacu

SEQ ID NO: 2755327 - RNA, 20 nt, Human
ggcuggucucgaacugcugg

SEQ ID NO: 2755328 - RNA, 13 nt, Human
ggcuguacacugc

SEQ ID NO: 2755329 - RNA, 13 nt, Human
ggcuuacacccac

SEQ ID NO: 2755330 - RNA, 20 nt, Human
ggcuuagacccucaugcugc

SEQ ID NO: 2755331 - RNA, 17 nt, Human
ggcuucccaaaguccug

SEQ ID NO: 2755332 - RNA, 16 nt, Human
ggcuugccugcaggca

SEQ ID NO: 2755333 - RNA, 19 nt, Human
ggcuuuagggaccugcugu

SEQ ID NO: 2755334 - RNA, 17 nt, Human
ggcuuugaaugcggccc

SEQ ID NO: 2755335 - RNA, 16 nt, Human
ggcuuugcccugcugc

SEQ ID NO: 2755336 - RNA, 17 nt, Human
ggcuuuuggcuccaccc

SEQ ID NO: 2755337 - RNA, 22 nt, Human
ggcuuuuuauacacuuuuuaaa

SEQ ID NO: 2755338 - RNA, 21 nt, Human
gggaaaaauguaggagacugu

SEQ ID NO: 2755339 - RNA, 23 nt, Human
gggaaacaaaaggauaaugaaua

SEQ ID NO: 2755340 - RNA, 10 nt, Human
gggaaacugc

SEQ ID NO: 2755341 - RNA, 12 nt, Human
gggaaagaagag

SEQ ID NO: 2755342 - RNA, 15 nt, Human
gggaaagaagagccg

SEQ ID NO: 2755343 - RNA, 23 nt, Human
gggaaagaagagccggagccucc

SEQ ID NO: 2755344 - RNA, 14 nt, Human
gggaaagccucugg

SEQ ID NO: 2755345 - RNA, 17 nt, Human
gggaaauccacacugag

SEQ ID NO: 2755346 - RNA, 14 nt, Human
gggaagacaagaag

SEQ ID NO: 2755347 - RNA, 21 nt, Human
gggaagacuguggcugcuagc

SEQ ID NO: 2755348 - RNA, 12 nt, Human
gggaaugaagca

SEQ ID NO: 2755349 - RNA, 20 nt, Human
gggaauucagacaagcugca

SEQ ID NO: 2755350 - RNA, 21 nt, Human
gggaauucagacaagcugcau

SEQ ID NO: 2755351 - RNA, 13 nt, Human
gggacagggagga

SEQ ID NO: 2755352 - RNA, 15 nt, Human
gggacagggaggacg

SEQ ID NO: 2755353 - RNA, 22 nt, Human
gggacaguuccugagaccagcc

SEQ ID NO: 2755354 - RNA, 17 nt, Human
gggacccugucucuaca

SEQ ID NO: 2755355 - RNA, 14 nt, Human
gggaccugggccau

SEQ ID NO: 2755356 - RNA, 18 nt, Human
gggaccuugucucccagc

SEQ ID NO: 2755357 - RNA, 18 nt, Human
gggacucaucauuuccau

SEQ ID NO: 2755358 - RNA, 18 nt, Human
gggagaaccuagggugau

SEQ ID NO: 2755359 - RNA, 21 nt, Human
gggagaaucacuugaacccgg

SEQ ID NO: 2755360 - RNA, 20 nt, Human
gggagagaagauagcagggc

SEQ ID NO: 2755361 - RNA, 12 nt, Human
gggagccagggc

SEQ ID NO: 2755362 - RNA, 14 nt, Human
gggagccagggcug

SEQ ID NO: 2755363 - RNA, 20 nt, Human
gggagccccaauucgauccc

SEQ ID NO: 2755364 - RNA, 22 nt, Human
gggagcgagugggggccagcca

SEQ ID NO: 2755365 - RNA, 14 nt, Human
gggagcuuuuguag

SEQ ID NO: 2755366 - RNA, 12 nt, Human
gggaggggacau

SEQ ID NO: 2755367 - RNA, 13 nt, Human
gggaggggcgcuc

SEQ ID NO: 2755368 - RNA, 22 nt, Human
gggagucucagcuucacccuga

SEQ ID NO: 2755369 - RNA, 12 nt, Human
gggaguggcgcg

SEQ ID NO: 2755370 - RNA, 17 nt, Human
gggaguggcgcgcgcca

SEQ ID NO: 2755371 - RNA, 21 nt, Human
gggaguggcgcgcgccaccac

SEQ ID NO: 2755372 - RNA, 20 nt, Human
gggaucacugaugacuuuuu

SEQ ID NO: 2755373 - RNA, 15 nt, Human
gggauuagggagaga

SEQ ID NO: 2755374 - RNA, 17 nt, Human
gggauuguaaaauggug

SEQ ID NO: 2755375 - RNA, 20 nt, Human
gggcaagagagcgagacccu

SEQ ID NO: 2755376 - RNA, 13 nt, Human
gggcagaucacuu

SEQ ID NO: 2755377 - RNA, 13 nt, Human
gggcagcugccuc

SEQ ID NO: 2755378 - RNA, 22 nt, Human
gggcagcugccuccccuccucu

SEQ ID NO: 2755379 - RNA, 17 nt, Human
gggcagugcuuggccca

SEQ ID NO: 2755380 - RNA, 18 nt, Human
gggcagugcuuggcccag

SEQ ID NO: 2755381 - RNA, 22 nt, Human
gggcagugcuuggcccaggagu

SEQ ID NO: 2755382 - RNA, 14 nt, Human
gggcaguguucccu

SEQ ID NO: 2755383 - RNA, 18 nt, Human
gggcauggguuuuauuau

SEQ ID NO: 2755384 - RNA, 18 nt, Human
gggccaaaaguauccaag

SEQ ID NO: 2755385 - RNA, 17 nt, Human
gggccacacguggcugg

SEQ ID NO: 2755386 - RNA, 13 nt, Human
gggccaggcuggg

SEQ ID NO: 2755387 - RNA, 20 nt, Human
gggcccaggaucguuuuuuc

SEQ ID NO: 2755388 - RNA, 18 nt, Human
gggcccaguaccuagcug

SEQ ID NO: 2755389 - RNA, 23 nt, Human
gggccccucuguaucuagccugg

SEQ ID NO: 2755390 - RNA, 19 nt, Human
gggccccugccucucugca

SEQ ID NO: 2755391 - RNA, 19 nt, Human
gggccgacggagccgggaa

SEQ ID NO: 2755392 - RNA, 22 nt, Human
gggccuccucuguccagggccc

SEQ ID NO: 2755393 - RNA, 16 nt, Human
gggccucggagccuca

SEQ ID NO: 2755394 - RNA, 22 nt, Human
gggccugagaccaaggcccccg

SEQ ID NO: 2755395 - RNA, 13 nt, Human
gggccuggcuggg

SEQ ID NO: 2755396 - RNA, 23 nt, Human
gggcgcucgcuuccgcauccuag

SEQ ID NO: 2755397 - RNA, 11 nt, Human
gggcggcggcc

SEQ ID NO: 2755398 - RNA, 13 nt, Human
gggcggcggcccu

SEQ ID NO: 2755399 - RNA, 13 nt, Human
gggcggggagcga

SEQ ID NO: 2755400 - RNA, 13 nt, Human
gggcucagccugg

SEQ ID NO: 2755401 - RNA, 19 nt, Human
gggcugccuucuggccuug

SEQ ID NO: 2755402 - RNA, 23 nt, Human
gggcugccuucuggccuuguaag

SEQ ID NO: 2755403 - RNA, 14 nt, Human
gggcuggaugcucu

SEQ ID NO: 2755404 - RNA, 15 nt, Human
gggcuugaggacuug

SEQ ID NO: 2755405 - RNA, 15 nt, Human
gggcuuuaacuccug

SEQ ID NO: 2755406 - RNA, 22 nt, Human
ggggacacauguauuuggugau

SEQ ID NO: 2755407 - RNA, 14 nt, Human
ggggagauggagga

SEQ ID NO: 2755408 - RNA, 16 nt, Human
ggggagcgagccccag

SEQ ID NO: 2755409 - RNA, 10 nt, Human
ggggaggggc

SEQ ID NO: 2755410 - RNA, 14 nt, Human
ggggauuguacacg

SEQ ID NO: 2755411 - RNA, 21 nt, Human
ggggcagugcuuggcccagga

SEQ ID NO: 2755412 - RNA, 15 nt, Human
ggggcauggaaggca

SEQ ID NO: 2755413 - RNA, 22 nt, Human
ggggcauggaaggcaagauugu

SEQ ID NO: 2755414 - RNA, 11 nt, Human
ggggccaggcu

SEQ ID NO: 2755415 - RNA, 15 nt, Human
ggggccaggcugggu

SEQ ID NO: 2755416 - RNA, 16 nt, Human
ggggccaugaaucacc

SEQ ID NO: 2755417 - RNA, 15 nt, Human
ggggcccaugaaaga

SEQ ID NO: 2755418 - RNA, 18 nt, Human
ggggccucggagccucau

SEQ ID NO: 2755419 - RNA, 18 nt, Human
ggggcgcgugcaggcagc

SEQ ID NO: 2755420 - RNA, 17 nt, Human
ggggcgcucgcuuccgc

SEQ ID NO: 2755421 - RNA, 12 nt, Human
ggggcggcggcc

SEQ ID NO: 2755422 - RNA, 13 nt, Human
ggggcucugggau

SEQ ID NO: 2755423 - RNA, 16 nt, Human
ggggcugaugcaguug

SEQ ID NO: 2755424 - RNA, 20 nt, Human
ggggcuucagucuuuuccau

SEQ ID NO: 2755425 - RNA, 22 nt, Human
gucucuaccaaaaaaaggaagg

SEQ ID NO: 2755426 - RNA, 21 nt, Human
gucucuacccaguagaugcca

SEQ ID NO: 2755427 - RNA, 14 nt, Human
gucucuacuaaaaa

SEQ ID NO: 2755428 - RNA, 16 nt, Human
gucucuacuaaaaaua

SEQ ID NO: 2755429 - RNA, 22 nt, Human
gucucuacuaaaaauacaaaaa

SEQ ID NO: 2755430 - RNA, 15 nt, Human
gucucuaucauuaaa

SEQ ID NO: 2755431 - RNA, 18 nt, Human
gucugagacagaaucuca

SEQ ID NO: 2755432 - RNA, 15 nt, Human
gucugccagccagca

SEQ ID NO: 2755433 - RNA, 21 nt, Human
gucugcuacccucauuucuca

SEQ ID NO: 2755434 - RNA, 14 nt, Human
gucugcuggagaca

SEQ ID NO: 2755435 - RNA, 13 nt, Human
gucuggagggaag

SEQ ID NO: 2755436 - RNA, 13 nt, Human
gucuguaaaaucu

SEQ ID NO: 2755437 - RNA, 20 nt, Human
gucuguaaaaucuuucuuuc

SEQ ID NO: 2755438 - RNA, 18 nt, Human
gucugugagaugcuagaa

SEQ ID NO: 2755439 - RNA, 14 nt, Human
gucuuaauuaaaag

SEQ ID NO: 2755440 - RNA, 15 nt, Human
gucuuaauuaaaaga

SEQ ID NO: 2755441 - RNA, 12 nt, Human
gucuucagccua

SEQ ID NO: 2755442 - RNA, 23 nt, Human
gucuucagccuagccgaccucag

SEQ ID NO: 2755443 - RNA, 16 nt, Human
gucuucaggggccaca

SEQ ID NO: 2755444 - RNA, 14 nt, Human
gucuucaucaaacg

SEQ ID NO: 2755445 - RNA, 22 nt, Human
gucuuccucccuguguauucau

SEQ ID NO: 2755446 - RNA, 10 nt, Human
gucuuccucu

SEQ ID NO: 2755447 - RNA, 15 nt, Human
gucuuccucugucuc

SEQ ID NO: 2755448 - RNA, 14 nt, Human
gucuucuuugccca

SEQ ID NO: 2755449 - RNA, 18 nt, Human
gucuuguuuacucagaau

SEQ ID NO: 2755450 - RNA, 13 nt, Human
gucuuucuuuccg

SEQ ID NO: 2755451 - RNA, 21 nt, Human
gucuuugccaaguucuccacu

SEQ ID NO: 2755452 - RNA, 13 nt, Human
gucuuuuccuucu

SEQ ID NO: 2755453 - RNA, 12 nt, Human
gucuuuuuucua

SEQ ID NO: 2755454 - RNA, 18 nt, Human
gucuuuuuucuaaaguaa

SEQ ID NO: 2755455 - RNA, 20 nt, Human
gugaaaccccuauguggagg

SEQ ID NO: 2755456 - RNA, 12 nt, Human
gugaaacccugu

SEQ ID NO: 2755457 - RNA, 13 nt, Human
gugaaagaaaaua

SEQ ID NO: 2755458 - RNA, 19 nt, Human
gugaaagaaaauaacgaua

SEQ ID NO: 2755459 - RNA, 22 nt, Human
gugaacaaauuuacagagacag

SEQ ID NO: 2755460 - RNA, 15 nt, Human
gugaacuugguuuua

SEQ ID NO: 2755461 - RNA, 17 nt, Human
gugaagcaaaauuuuuu

SEQ ID NO: 2755462 - RNA, 15 nt, Human
gugaagcaaggagcu

SEQ ID NO: 2755463 - RNA, 13 nt, Human
gugacaagcucac

SEQ ID NO: 2755464 - RNA, 23 nt, Human
gugaccaaccuuuucccaaccau

SEQ ID NO: 2755465 - RNA, 15 nt, Human
gugaccacugcagaa

SEQ ID NO: 2755466 - RNA, 17 nt, Human
gugaccugccaggcaca

SEQ ID NO: 2755467 - RNA, 15 nt, Human
gugacuauuauauuu

SEQ ID NO: 2755468 - RNA, 17 nt, Human
gugacuguacccaaaug

SEQ ID NO: 2755469 - RNA, 22 nt, Human
gugagaaccggagaaccccagg

SEQ ID NO: 2755470 - RNA, 19 nt, Human
gugagagaguggcuggggc

SEQ ID NO: 2755471 - RNA, 21 nt, Human
gugagaucggugcguucuccu

SEQ ID NO: 2755472 - RNA, 20 nt, Human
gugagaugcuagaacucccu

SEQ ID NO: 2755473 - RNA, 13 nt, Human
gugagcaucaucu

SEQ ID NO: 2755474 - RNA, 18 nt, Human
gugagccacggugcccgg

SEQ ID NO: 2755475 - RNA, 14 nt, Human
gugagcuacaaaug

SEQ ID NO: 2755476 - RNA, 18 nt, Human
gugauaucccccagccuc

SEQ ID NO: 2755477 - RNA, 22 nt, Human
gugauccacccgccucagccuc

SEQ ID NO: 2755478 - RNA, 22 nt, Human
gugauccgcccaucuccgucuc

SEQ ID NO: 2755479 - RNA, 16 nt, Human
gugaucucagcucacu

SEQ ID NO: 2755480 - RNA, 15 nt, Human
gugaucugcccgccu

SEQ ID NO: 2755481 - RNA, 22 nt, Human
gugauuacccucugggucucag

SEQ ID NO: 2755482 - RNA, 19 nt, Human
gugauucacccugauuuua

SEQ ID NO: 2755483 - RNA, 21 nt, Human
gugauucacccugauuuuaca

SEQ ID NO: 2755484 - RNA, 18 nt, Human
gugauuccgcagugagag

SEQ ID NO: 2755485 - RNA, 22 nt, Human
gugauuuuauuagaaguuucau

SEQ ID NO: 2755486 - RNA, 19 nt, Human
gugcaauaaaauguauuug

SEQ ID NO: 2755487 - RNA, 14 nt, Human
gugcacaaaucaga

SEQ ID NO: 2755488 - RNA, 13 nt, Human
gugcagccaccag

SEQ ID NO: 2755489 - RNA, 15 nt, Human
gugcaggcagcagga

SEQ ID NO: 2755490 - RNA, 19 nt, Human
gugcaguggcgugaucuca

SEQ ID NO: 2755491 - RNA, 14 nt, Human
gugcauauuuauaa

SEQ ID NO: 2755492 - RNA, 19 nt, Human
gugcauauuuauaaaaaua

SEQ ID NO: 2755493 - RNA, 16 nt, Human
gugcauauuuuauuau

SEQ ID NO: 2755494 - RNA, 13 nt, Human
gugcauucuggau

SEQ ID NO: 2755495 - RNA, 13 nt, Human
gugcauugugcuu

SEQ ID NO: 2755496 - RNA, 15 nt, Human
gugccgccuccuugu

SEQ ID NO: 2755497 - RNA, 14 nt, Human
gugccgcucucucu

SEQ ID NO: 2755498 - RNA, 14 nt, Human
gugccgcugucucu

SEQ ID NO: 2755499 - RNA, 22 nt, Human
gugccucaccccuugccauaau

SEQ ID NO: 2755500 - RNA, 21 nt, Human
gugccugagcggaccuuccca

SEQ ID NO: 2755501 - RNA, 17 nt, Human
gugccuguaaucacagc

SEQ ID NO: 2755502 - RNA, 12 nt, Human
gugccuuucuuc

SEQ ID NO: 2755503 - RNA, 13 nt, Human
gugccuuucuucu

SEQ ID NO: 2755504 - RNA, 11 nt, Human
gugcggccagc

SEQ ID NO: 2755505 - RNA, 22 nt, Human
gugcuaauuuugaaaaacugcu

SEQ ID NO: 2755506 - RNA, 21 nt, Human
gugcucuauuaccauuaugga

SEQ ID NO: 2755507 - RNA, 13 nt, Human
gugcugcagcccc

SEQ ID NO: 2755508 - RNA, 16 nt, Human
gugcugcagccccugg

SEQ ID NO: 2755509 - RNA, 23 nt, Human
gugcugggaauuacaggcgugag

SEQ ID NO: 2755510 - RNA, 21 nt, Human
gugcuuaucccauagccagga

SEQ ID NO: 2755511 - RNA, 14 nt, Human
gugcuucuccagcc

SEQ ID NO: 2755512 - RNA, 13 nt, Human
gugcuucuuucuu

SEQ ID NO: 2755513 - RNA, 15 nt, Human
gugcuugagccagga

SEQ ID NO: 2755514 - RNA, 13 nt, Human
guggaaaaacaga

SEQ ID NO: 2755515 - RNA, 12 nt, Human
guggaagugggg

SEQ ID NO: 2755516 - RNA, 19 nt, Human
guggaauuuaaaucacuca

SEQ ID NO: 2755517 - RNA, 14 nt, Human
guggacuaaaagau

SEQ ID NO: 2755518 - RNA, 21 nt, Human
guggagaugggguuucaccau

SEQ ID NO: 2755519 - RNA, 23 nt, Human
guggagaugggguuucaccaugu

SEQ ID NO: 2755520 - RNA, 19 nt, Human
guggauuuaauguggaaau

SEQ ID NO: 2755521 - RNA, 18 nt, Human
guggcauguaugacguga

SEQ ID NO: 2755522 - RNA, 16 nt, Human
guggcauuuucacuuu

SEQ ID NO: 2755523 - RNA, 19 nt, Human
guggccaagccaaccgugg

SEQ ID NO: 2755524 - RNA, 15 nt, Human
guggcgcgcaccugu

SEQ ID NO: 2755525 - RNA, 13 nt, Human
guggcgcuggcug

SEQ ID NO: 2755526 - RNA, 22 nt, Human
guggcgcuggcugcgcucggcc

SEQ ID NO: 2755527 - RNA, 23 nt, Human
guggcgcuggcugcgcucggccu

SEQ ID NO: 2755528 - RNA, 17 nt, Human
guggcucugugugcucu

SEQ ID NO: 2755529 - RNA, 14 nt, Human
guggcuggcggccu

SEQ ID NO: 2755530 - RNA, 18 nt, Human
guggcuggguuuacacgc

SEQ ID NO: 2755531 - RNA, 22 nt, Human
gugggacagucaccucauggaa

SEQ ID NO: 2755532 - RNA, 18 nt, Human
gugggacccugucucuac

SEQ ID NO: 2755533 - RNA, 15 nt, Human
gugggaccugggcca

SEQ ID NO: 2755534 - RNA, 17 nt, Human
gugggagccagggcugu

SEQ ID NO: 2755535 - RNA, 17 nt, Human
gugggauacuauuuaau

SEQ ID NO: 2755536 - RNA, 21 nt, Human
gugggauacuauuuaauuauu

SEQ ID NO: 2755537 - RNA, 19 nt, Human
gugggcagagagguaggga

SEQ ID NO: 2755538 - RNA, 15 nt, Human
gugggccuccucugu

SEQ ID NO: 2755539 - RNA, 21 nt, Human
guggggaugaacuuuuuguuu

SEQ ID NO: 2755540 - RNA, 17 nt, Human
guggggcuaaggcagga

SEQ ID NO: 2755541 - RNA, 17 nt, Human
guggggggggugcuggg

SEQ ID NO: 2755542 - RNA, 15 nt, Human
guggguggggcagug

SEQ ID NO: 2755543 - RNA, 13 nt, Human
gugggugggguga

SEQ ID NO: 2755544 - RNA, 13 nt, Human
gugguuagaaaag

SEQ ID NO: 2755545 - RNA, 19 nt, Human
guguaaaaccuggagaugg

SEQ ID NO: 2755546 - RNA, 23 nt, Human
guguacagaauucugcuaccuca

SEQ ID NO: 2755547 - RNA, 12 nt, Human
guguacauucuu

SEQ ID NO: 2755548 - RNA, 15 nt, Human
guguagggaguugug

SEQ ID NO: 2755549 - RNA, 17 nt, Human
guguauguguaucucac

SEQ ID NO: 2755550 - RNA, 21 nt, Human
guguauuauaauucaaaggca

SEQ ID NO: 2755551 - RNA, 17 nt, Human
gugucaggaggaaggcu

SEQ ID NO: 2755552 - RNA, 23 nt, Human
gugucccaucuagggaaggcugg

SEQ ID NO: 2755553 - RNA, 16 nt, Human
gugucccauuccccca

SEQ ID NO: 2755554 - RNA, 17 nt, Human
guguccccuauccuacu

SEQ ID NO: 2755555 - RNA, 19 nt, Human
gugucuggcacuugggaca

SEQ ID NO: 2755556 - RNA, 16 nt, Human
gugugagccaccacau

SEQ ID NO: 2755557 - RNA, 14 nt, Human
gugugcaucaggcu

SEQ ID NO: 2755558 - RNA, 20 nt, Human
guguggaaggugaucuggcu

SEQ ID NO: 2755559 - RNA, 14 nt, Human
gugugggcaauguu

SEQ ID NO: 2755560 - RNA, 13 nt, Human
guguguguuuuaa

SEQ ID NO: 2755561 - RNA, 19 nt, Human
guguuaaaaauguucuauu

SEQ ID NO: 2755562 - RNA, 14 nt, Human
guguucauaaauaa

SEQ ID NO: 2755563 - RNA, 20 nt, Human
guguucauaaauaaaguuug

SEQ ID NO: 2755564 - RNA, 15 nt, Human
guguugcagugucug

SEQ ID NO: 2755565 - RNA, 23 nt, Human
guguugcagugucugcuggagac

SEQ ID NO: 2755566 - RNA, 14 nt, Human
guguuggagaagaa

SEQ ID NO: 2755567 - RNA, 23 nt, Human
guguuuauaauuuuaaauguuuu

SEQ ID NO: 2755568 - RNA, 17 nt, Human
guuaaaagaugaaaaua

SEQ ID NO: 2755569 - RNA, 16 nt, Human
guuaacaccuuuaaag

SEQ ID NO: 2755570 - RNA, 18 nt, Human
guuaaugcugaaaaauca

SEQ ID NO: 2755571 - RNA, 15 nt, Human
guuaauuuugcuaac

SEQ ID NO: 2755572 - RNA, 16 nt, Human
guuacacauuuuucag

SEQ ID NO: 2755573 - RNA, 16 nt, Human
guuacauuauuaucaa

SEQ ID NO: 2755574 - RNA, 15 nt, Human
guuacuacaugcacu

SEQ ID NO: 2755575 - RNA, 13 nt, Human
guuacucugaagg

SEQ ID NO: 2755576 - RNA, 14 nt, Human
guuacucugaaggg

SEQ ID NO: 2755577 - RNA, 21 nt, Human
guuacucugaagggcaucaug

SEQ ID NO: 2755578 - RNA, 15 nt, Human
guuagagaauuuccu

SEQ ID NO: 2755579 - RNA, 19 nt, Human
guuagagauuuuuaaauaa

SEQ ID NO: 2755580 - RNA, 22 nt, Human
guuagccguggugauuuagcag

SEQ ID NO: 2755581 - RNA, 18 nt, Human
guuaguauuguccagguc

SEQ ID NO: 2755582 - RNA, 12 nt, Human
guuagucauuug

SEQ ID NO: 2755583 - RNA, 15 nt, Human
guuauaaaaauauau

SEQ ID NO: 2755584 - RNA, 23 nt, Human
guuaugaguggcuuuaaugaaua

SEQ ID NO: 2755585 - RNA, 19 nt, Human
guuaugauuaaguaaugau

SEQ ID NO: 2755586 - RNA, 22 nt, Human
guuaugccgcuagauacaugcu

SEQ ID NO: 2755587 - RNA, 15 nt, Human
guuauguagaaaaaa

SEQ ID NO: 2755588 - RNA, 21 nt, Human
guuauguagaaaaaaguaaau

SEQ ID NO: 2755589 - RNA, 15 nt, Human
guuauguauauuuua

SEQ ID NO: 2755590 - RNA, 19 nt, Human
guuauuauauuuacaaaug

SEQ ID NO: 2755591 - RNA, 20 nt, Human
guuauuuauaacaaccuaaa

SEQ ID NO: 2755592 - RNA, 13 nt, Human
guuauuuuuaaac

SEQ ID NO: 2755593 - RNA, 21 nt, Human
guuauuuuuaauuugguuuuc

SEQ ID NO: 2755594 - RNA, 16 nt, Human
guuauuuuuacauucu

SEQ ID NO: 2755595 - RNA, 21 nt, Human
guucaaaacuuauuggaaugu

SEQ ID NO: 2755596 - RNA, 16 nt, Human
guucaagugcuucucc

SEQ ID NO: 2755597 - RNA, 22 nt, Human
guucaagugcuucuccagccuc

SEQ ID NO: 2755598 - RNA, 11 nt, Human
guucacaaugg

SEQ ID NO: 2755599 - RNA, 17 nt, Human
guucacagaucuuucug

SEQ ID NO: 2755600 - RNA, 19 nt, Human
guucacauuuuuguauuuu

SEQ ID NO: 2755601 - RNA, 16 nt, Human
guucacccaaccacau

SEQ ID NO: 2755602 - RNA, 21 nt, Human
guucaccugggcugaggcauc

SEQ ID NO: 2755603 - RNA, 15 nt, Human
guucagagcugcccu

SEQ ID NO: 2755604 - RNA, 14 nt, Human
guucaguaccacau

SEQ ID NO: 2755605 - RNA, 16 nt, Human
guucauaaauaaaguu

SEQ ID NO: 2755606 - RNA, 18 nt, Human
guucccaccaggcugcuc

SEQ ID NO: 2755607 - RNA, 19 nt, Human
guucccaccaggcugcuca

SEQ ID NO: 2755608 - RNA, 16 nt, Human
guuccuaaccagccug

SEQ ID NO: 2755609 - RNA, 17 nt, Human
guuccugagaccagcca

SEQ ID NO: 2755610 - RNA, 13 nt, Human
guuccugcaugcc

SEQ ID NO: 2755611 - RNA, 16 nt, Human
guuccuuccucugagc

SEQ ID NO: 2755612 - RNA, 17 nt, Human
guucgcgcgccuccgcu

SEQ ID NO: 2755613 - RNA, 17 nt, Human
guucuaaauaaaaagca

SEQ ID NO: 2755614 - RNA, 18 nt, Human
guucucauaacucuguga

SEQ ID NO: 2755615 - RNA, 23 nt, Human
guucucuaauauguaaaauuaca

SEQ ID NO: 2755616 - RNA, 13 nt, Human
guucucuccacca

SEQ ID NO: 2755617 - RNA, 12 nt, Human
guucugaagaag

SEQ ID NO: 2755618 - RNA, 18 nt, Human
guucugacucuuggcaca

SEQ ID NO: 2755619 - RNA, 14 nt, Human
guucugcagauaaa

SEQ ID NO: 2755620 - RNA, 15 nt, Human
guucugcagauaaac

SEQ ID NO: 2755621 - RNA, 22 nt, Human
guucuuaagacgugauuuugcu

SEQ ID NO: 2755622 - RNA, 18 nt, Human
guugaagaugcuuguauu

SEQ ID NO: 2755623 - RNA, 16 nt, Human
guugagacaagaaaau

SEQ ID NO: 2755624 - RNA, 20 nt, Human
guugagccaccaagcuggug

SEQ ID NO: 2755625 - RNA, 17 nt, Human
guugauagcaagugaau

SEQ ID NO: 2755626 - RNA, 13 nt, Human
guugauggaaaua

SEQ ID NO: 2755627 - RNA, 17 nt, Human
guugauuuaaggccagg

SEQ ID NO: 2755628 - RNA, 15 nt, Human
guugcauuaaaaaug

SEQ ID NO: 2755629 - RNA, 14 nt, Human
guugccaaggcugg

SEQ ID NO: 2755630 - RNA, 18 nt, Human
guugccaaggcuggagug

SEQ ID NO: 2755631 - RNA, 19 nt, Human
guugccaguuguccuccuu

SEQ ID NO: 2755632 - RNA, 13 nt, Human
guugcuccccauc

SEQ ID NO: 2755633 - RNA, 17 nt, Human
guugcugggggggauug

SEQ ID NO: 2755634 - RNA, 13 nt, Human
guuggagcagggg

SEQ ID NO: 2755635 - RNA, 14 nt, Human
guuggagugcagug

SEQ ID NO: 2755636 - RNA, 15 nt, Human
guuggagugcagugg

SEQ ID NO: 2755637 - RNA, 16 nt, Human
guuggcuguuccugca

SEQ ID NO: 2755638 - RNA, 15 nt, Human
guugggacuacaggc

SEQ ID NO: 2755639 - RNA, 14 nt, Human
guuggugaacuugg

SEQ ID NO: 2755640 - RNA, 18 nt, Human
guuguaauauuucuucaa

SEQ ID NO: 2755641 - RNA, 21 nt, Human
guuguaauuuuuuugugggaa

SEQ ID NO: 2755642 - RNA, 17 nt, Human
guuguauaugucuuuua

SEQ ID NO: 2755643 - RNA, 12 nt, Human
guuguauuauuu

SEQ ID NO: 2755644 - RNA, 13 nt, Human
guuguguguggaa

SEQ ID NO: 2755645 - RNA, 14 nt, Human
guuguucucuucuu

SEQ ID NO: 2755646 - RNA, 19 nt, Human
guuguucucuucuuuaaag

SEQ ID NO: 2755647 - RNA, 15 nt, Human
guuuaaauuaguuag

SEQ ID NO: 2755648 - RNA, 17 nt, Human
guuuaauuaaaaucagu

SEQ ID NO: 2755649 - RNA, 17 nt, Human
guuuaauucugaaagca

SEQ ID NO: 2755650 - RNA, 15 nt, Human
guuuauaaacauugu

SEQ ID NO: 2755651 - RNA, 15 nt, Human
guuuaucguauuuga

SEQ ID NO: 2755652 - RNA, 15 nt, Human
guuuaugauuccacc

SEQ ID NO: 2755653 - RNA, 18 nt, Human
guuuaugcauacaguaau

SEQ ID NO: 2755654 - RNA, 20 nt, Human
guuuaugcauacaguaauuu

SEQ ID NO: 2755655 - RNA, 18 nt, Human
guuuaugguuguauuauu

SEQ ID NO: 2755656 - RNA, 16 nt, Human
guuuauuucacuugau

SEQ ID NO: 2755657 - RNA, 22 nt, Human
guuucaccauguuagccaggcu

SEQ ID NO: 2755658 - RNA, 14 nt, Human
guuucacugugcaa

SEQ ID NO: 2755659 - RNA, 18 nt, Human
guuucauaagaauucugu

SEQ ID NO: 2755660 - RNA, 17 nt, Human
guuuccuagcgcagcca

SEQ ID NO: 2755661 - RNA, 18 nt, Human
guuuccuagcgcagccau

SEQ ID NO: 2755662 - RNA, 17 nt, Human
guuucuagagaugguuu

SEQ ID NO: 2755663 - RNA, 15 nt, Human
guuucuuccuuuuuu

SEQ ID NO: 2755664 - RNA, 12 nt, Human
guuucuuucuuu

SEQ ID NO: 2755665 - RNA, 19 nt, Human
guuucuuuguaaugaaaac

SEQ ID NO: 2755666 - RNA, 14 nt, Human
guuugaaagcuuua

SEQ ID NO: 2755667 - RNA, 21 nt, Human
guuugacaagguucuucccuu

SEQ ID NO: 2755668 - RNA, 20 nt, Human
guuugacgggaaacaaaacu

SEQ ID NO: 2755669 - RNA, 13 nt, Human
guuugauuucauu

SEQ ID NO: 2755670 - RNA, 21 nt, Human
guuugccaugcuggccaggcu

SEQ ID NO: 2755671 - RNA, 19 nt, Human
guuuggacaaaauggaaua

SEQ ID NO: 2755672 - RNA, 21 nt, Human
guuuguuuauuuguuuuucca

SEQ ID NO: 2755673 - RNA, 20 nt, Human
guuuuaaucuguauuucccc

SEQ ID NO: 2755674 - RNA, 16 nt, Human
guuuuaauuagugaac

SEQ ID NO: 2755675 - RNA, 15 nt, Human
guuuuagugauuuua

SEQ ID NO: 2755676 - RNA, 11 nt, Human
guuuuaucauu

SEQ ID NO: 2755677 - RNA, 15 nt, Human
guuuuauuauauaua

SEQ ID NO: 2755678 - RNA, 18 nt, Human
guuuuauuguuuaaaauc

SEQ ID NO: 2755679 - RNA, 22 nt, Human
guuuucauuaucucaaaacugc

SEQ ID NO: 2755680 - RNA, 13 nt, Human
guuuucccaucuc

SEQ ID NO: 2755681 - RNA, 20 nt, Human
guuuugcaagccagauuuuc

SEQ ID NO: 2755682 - RNA, 12 nt, Human
guuuugugaaga

SEQ ID NO: 2755683 - RNA, 12 nt, Human
guuuuuaaaaaa

SEQ ID NO: 2755684 - RNA, 21 nt, Human
guuuuuaacaugucaaucugu

SEQ ID NO: 2755685 - RNA, 12 nt, Human
guuuuucacauu

SEQ ID NO: 2755686 - RNA, 15 nt, Human
guuuuucuuuucauu

SEQ ID NO: 2755687 - RNA, 12 nt, Human
guuuuugugaaa

SEQ ID NO: 2755688 - RNA, 16 nt, Human
guuuuuuccuagucug

SEQ ID NO: 2755689 - RNA, 16 nt, Human
guuuuuuuuuaaaaaa

SEQ ID NO: 2755690 - RNA, 19 nt, Human
guuuuuuuuuaaaaaagaa

SEQ ID NO: 2755691 - RNA, 17 nt, Human
uaaaaaaaaaaaaaaag

SEQ ID NO: 2755692 - RNA, 14 nt, Human
uaaaaaaaaaccug

SEQ ID NO: 2755693 - RNA, 21 nt, Human
uaaaaagcgcuaauuucuauu

SEQ ID NO: 2755694 - RNA, 17 nt, Human
uaaaaauacaaaaaaaa

SEQ ID NO: 2755695 - RNA, 18 nt, Human
uaaaaauccuacuuucau

SEQ ID NO: 2755696 - RNA, 22 nt, Human
uaaaaauguucuauuuuaauua

SEQ ID NO: 2755697 - RNA, 12 nt, Human
uaaaaauuaaaa

SEQ ID NO: 2755698 - RNA, 19 nt, Human
uaaaaauuaauucuuuauc

SEQ ID NO: 2755699 - RNA, 15 nt, Human
uaaaacaagcacuaa

SEQ ID NO: 2755700 - RNA, 16 nt, Human
uaaaacaagcacuaaa

SEQ ID NO: 2755701 - RNA, 22 nt, Human
uaaaacaagcacuaaacaaaga

SEQ ID NO: 2755702 - RNA, 13 nt, Human
uaaaacagggcca

SEQ ID NO: 2755703 - RNA, 14 nt, Human
uaaaaccacagcag

SEQ ID NO: 2755704 - RNA, 23 nt, Human
uaaaacuugaaguagguagcaac

SEQ ID NO: 2755705 - RNA, 20 nt, Human
uaaaagaaacccugcaccca

SEQ ID NO: 2755706 - RNA, 20 nt, Human
uaaaagaaugauuaugaauu

SEQ ID NO: 2755707 - RNA, 14 nt, Human
uaaaagacaaggaa

SEQ ID NO: 2755708 - RNA, 16 nt, Human
uaaaagacaaggaaaa

SEQ ID NO: 2755709 - RNA, 18 nt, Human
uaaaagacaaggaaaaaa

SEQ ID NO: 2755710 - RNA, 18 nt, Human
uaaaagacagugaaagaa

SEQ ID NO: 2755711 - RNA, 21 nt, Human
uaaaagacagugaaagaaaau

SEQ ID NO: 2755712 - RNA, 23 nt, Human
uaaaagacagugaaagaaaauaa

SEQ ID NO: 2755713 - RNA, 15 nt, Human
uaaaaggaaagaaaa

SEQ ID NO: 2755714 - RNA, 15 nt, Human
uaaaaggaaaugcuc

SEQ ID NO: 2755715 - RNA, 17 nt, Human
uaaaaggccugucccug

SEQ ID NO: 2755716 - RNA, 15 nt, Human
uaaaaguagaauaaa

SEQ ID NO: 2755717 - RNA, 22 nt, Human
uaagacucgggauuaguacaca

SEQ ID NO: 2755718 - RNA, 22 nt, Human
uaagagaacaagcaaauauaaa

SEQ ID NO: 2755719 - RNA, 21 nt, Human
uaagagagaaugagagacaca

SEQ ID NO: 2755720 - RNA, 23 nt, Human
uaagagcucaggaugagggaaaa

SEQ ID NO: 2755721 - RNA, 12 nt, Human
uaagauaaauua

SEQ ID NO: 2755722 - RNA, 16 nt, Human
uaagauaaauuauaag

SEQ ID NO: 2755723 - RNA, 15 nt, Human
uaagauaauuauaau

SEQ ID NO: 2755724 - RNA, 16 nt, Human
uaagauaccaaaacca

SEQ ID NO: 2755725 - RNA, 19 nt, Human
uaagauaugggacauuuuu

SEQ ID NO: 2755726 - RNA, 14 nt, Human
uaagauauuaacug

SEQ ID NO: 2755727 - RNA, 22 nt, Human
uaagauauuuuucaugauuuug

SEQ ID NO: 2755728 - RNA, 19 nt, Human
uaagauuuuguuuuuaaac

SEQ ID NO: 2755729 - RNA, 20 nt, Human
uaagauuuuguuuuuaaacu

SEQ ID NO: 2755730 - RNA, 13 nt, Human
uaagcaaacuuac

SEQ ID NO: 2755731 - RNA, 22 nt, Human
uaagcaccuuuagaauauuaaa

SEQ ID NO: 2755732 - RNA, 17 nt, Human
uaagccccagcaagcaa

SEQ ID NO: 2755733 - RNA, 19 nt, Human
uaagccccagcaagcaauc

SEQ ID NO: 2755734 - RNA, 21 nt, Human
uaagcccuccgccauucucaa

SEQ ID NO: 2755735 - RNA, 22 nt, Human
uaagcccuccgccauucucaag

SEQ ID NO: 2755736 - RNA, 13 nt, Human
uaagcuagaaaaa

SEQ ID NO: 2755737 - RNA, 14 nt, Human
uaagcugaaaauau

SEQ ID NO: 2755738 - RNA, 14 nt, Human
uaagcuguuuuuau

SEQ ID NO: 2755739 - RNA, 13 nt, Human
uaagcuucacugu

SEQ ID NO: 2755740 - RNA, 16 nt, Human
uaagcuucacuguaaa

SEQ ID NO: 2755741 - RNA, 18 nt, Human
uaagcuucacuguaaaau

SEQ ID NO: 2755742 - RNA, 20 nt, Human
uaagcuucacuguaaaauaa

SEQ ID NO: 2755743 - RNA, 13 nt, Human
uaaggaauuuuau

SEQ ID NO: 2755744 - RNA, 16 nt, Human
uaaggcauaagaaaac

SEQ ID NO: 2755745 - RNA, 14 nt, Human
uaaggccaugauuu

SEQ ID NO: 2755746 - RNA, 13 nt, Human
uaaggcuucucuu

SEQ ID NO: 2755747 - RNA, 18 nt, Human
uaaggcuucucuuaaaca

SEQ ID NO: 2755748 - RNA, 23 nt, Human
uaagggaaacugccagcaacgca

SEQ ID NO: 2755749 - RNA, 16 nt, Human
uaagguugaacacuuu

SEQ ID NO: 2755750 - RNA, 15 nt, Human
uaaguaaggaauuuu

SEQ ID NO: 2755751 - RNA, 15 nt, Human
uaaguaaugauaacu

SEQ ID NO: 2755752 - RNA, 21 nt, Human
uaaguauucuguguuaaaaau

SEQ ID NO: 2755753 - RNA, 13 nt, Human
uaaguauuuauaa

SEQ ID NO: 2755754 - RNA, 15 nt, Human
uaaguauuuauauau

SEQ ID NO: 2755755 - RNA, 15 nt, Human
uaagucccugcugcc

SEQ ID NO: 2755756 - RNA, 20 nt, Human
uaagugaaauaagccagaca

SEQ ID NO: 2755757 - RNA, 15 nt, Human
uaaguuaacaccuuu

SEQ ID NO: 2755758 - RNA, 17 nt, Human
uaaguugcugaugaacu

SEQ ID NO: 2755759 - RNA, 13 nt, Human
uaaguuguuaaua

SEQ ID NO: 2755760 - RNA, 21 nt, Human
uaaguuuaugcauacaguaau

SEQ ID NO: 2755761 - RNA, 13 nt, Human
uaaguuucuggga

SEQ ID NO: 2755762 - RNA, 23 nt, Human
uaaguuuuuuuuuaaaaaagaaa

SEQ ID NO: 2755763 - RNA, 21 nt, Human
uaauaaaaagccucuuucuuu

SEQ ID NO: 2755764 - RNA, 14 nt, Human
uaauaaaauucauu

SEQ ID NO: 2755765 - RNA, 13 nt, Human
uaauaaacauucu

SEQ ID NO: 2755766 - RNA, 12 nt, Human
uaauaaauguac

SEQ ID NO: 2755767 - RNA, 20 nt, Human
uaauaaauguacauuaauua

SEQ ID NO: 2755768 - RNA, 17 nt, Human
uaauaaauguauauugu

SEQ ID NO: 2755769 - RNA, 21 nt, Human
uaauaaguacuguguacagaa

SEQ ID NO: 2755770 - RNA, 20 nt, Human
uaauaaguugcauagguuua

SEQ ID NO: 2755771 - RNA, 12 nt, Human
uaauaauauauu

SEQ ID NO: 2755772 - RNA, 14 nt, Human
uaauaauguuucaa

SEQ ID NO: 2755773 - RNA, 18 nt, Human
uaauaauuuuuuaauuga

SEQ ID NO: 2755774 - RNA, 19 nt, Human
uaauaauuuuuuaauugau

SEQ ID NO: 2755775 - RNA, 19 nt, Human
uaauacagggcauuuuggu

SEQ ID NO: 2755776 - RNA, 14 nt, Human
uaauaccuaagccu

SEQ ID NO: 2755777 - RNA, 16 nt, Human
uaauacuagucuuaua

SEQ ID NO: 2755778 - RNA, 19 nt, Human
uaauacuugcuuuggaaaa

SEQ ID NO: 2755779 - RNA, 15 nt, Human
uaauagaacucaguu

SEQ ID NO: 2755780 - RNA, 22 nt, Human
uaauaggcguaacuaauuuuaa

SEQ ID NO: 2755781 - RNA, 23 nt, Human
uaauaggcguaacuaauuuuaac

SEQ ID NO: 2755782 - RNA, 18 nt, Human
uaauagguuuggacaaaa

SEQ ID NO: 2755783 - RNA, 15 nt, Human
uaauauacuauauuu

SEQ ID NO: 2755784 - RNA, 20 nt, Human
uaauaucuuaucuuccuaua

SEQ ID NO: 2755785 - RNA, 22 nt, Human
uaauaucuuaucuuccuauaau

SEQ ID NO: 2755786 - RNA, 16 nt, Human
uaauaugguguacauu

SEQ ID NO: 2755787 - RNA, 14 nt, Human
uaauauuccucagu

SEQ ID NO: 2755788 - RNA, 15 nt, Human
uaauauugcaaggca

SEQ ID NO: 2755789 - RNA, 17 nt, Human
uaauauuucuucaaaua

SEQ ID NO: 2755790 - RNA, 22 nt, Human
uaauauuucuucaaauaaaucu

SEQ ID NO: 2755791 - RNA, 14 nt, Human
uaauauuuuuaaua

SEQ ID NO: 2755792 - RNA, 17 nt, Human
uaaucaagccuaaaauu

SEQ ID NO: 2755793 - RNA, 17 nt, Human
uaaucaccaaggcugau

SEQ ID NO: 2755794 - RNA, 23 nt, Human
uaaucauauaauaaauguacauu

SEQ ID NO: 2755795 - RNA, 15 nt, Human
uaaucauuauuacuu

SEQ ID NO: 2755796 - RNA, 14 nt, Human
uaaucauucuuauu

SEQ ID NO: 2755797 - RNA, 17 nt, Human
uaaucccgauucacccu

SEQ ID NO: 2755798 - RNA, 14 nt, Human
uaauccuaaacaua

SEQ ID NO: 2755799 - RNA, 21 nt, Human
uaauccucaguuuuugugaaa

SEQ ID NO: 2755800 - RNA, 16 nt, Human
uaauccuuuuuuauuc

SEQ ID NO: 2755801 - RNA, 16 nt, Human
uaaucugccucccucu

SEQ ID NO: 2755802 - RNA, 15 nt, Human
uaaucuguauuuccc

SEQ ID NO: 2755803 - RNA, 13 nt, Human
uaaucuuuuucua

SEQ ID NO: 2755804 - RNA, 16 nt, Human
uaaugaaaaugaauau

SEQ ID NO: 2755805 - RNA, 19 nt, Human
uaaugaaguguuuagcaua

SEQ ID NO: 2755806 - RNA, 14 nt, Human
uaaugaauaaacau

SEQ ID NO: 2755807 - RNA, 18 nt, Human
uaaugaauacuuuauaaa

SEQ ID NO: 2755808 - RNA, 16 nt, Human
uaauggugccuucauu

SEQ ID NO: 2755809 - RNA, 16 nt, Human
uaaugguggccugggg

SEQ ID NO: 2755810 - RNA, 13 nt, Human
uaauguacaauaa

SEQ ID NO: 2755811 - RNA, 14 nt, Human
uaaugucugcagcu

SEQ ID NO: 2755812 - RNA, 15 nt, Human
uaauguuacauuauu

SEQ ID NO: 2755813 - RNA, 17 nt, Human
uaauguugaauuuugau

SEQ ID NO: 2755814 - RNA, 15 nt, Human
uaauguuucaaacau

SEQ ID NO: 2755815 - RNA, 18 nt, Human
uaauuagcauggccacau

SEQ ID NO: 2755816 - RNA, 21 nt, Human
uaauuauaauauacuauauuu

SEQ ID NO: 2755817 - RNA, 20 nt, Human
uaauuaucuaguuuaauuaa

SEQ ID NO: 2755818 - RNA, 16 nt, Human
uaauuauuaagauaug

SEQ ID NO: 2755819 - RNA, 14 nt, Human
uaauuauuauucuu

SEQ ID NO: 2755820 - RNA, 18 nt, Human
uaauuauuauucuucaua

SEQ ID NO: 2755821 - RNA, 18 nt, Human
uaauuauuucacuuuaga

SEQ ID NO: 2755822 - RNA, 12 nt, Human
uaauucauguug

SEQ ID NO: 2755823 - RNA, 12 nt, Human
uaauuccacagc

SEQ ID NO: 2755824 - RNA, 17 nt, Human
uaauuccacagcugcuc

SEQ ID NO: 2755825 - RNA, 19 nt, Human
uaauuccacagcugcucaa

SEQ ID NO: 2755826 - RNA, 21 nt, Human
uaauuccuucagcacuuuaga

SEQ ID NO: 2755827 - RNA, 20 nt, Human
uaauucugguagcuaaauau

SEQ ID NO: 2755828 - RNA, 22 nt, Human
uaauucugguagcuaaauauau

SEQ ID NO: 2755829 - RNA, 11 nt, Human
uaauuggaaag

SEQ ID NO: 2755830 - RNA, 14 nt, Human
uaauuggaaaggca

SEQ ID NO: 2755831 - RNA, 14 nt, Human
uaauuucaugaaaa

SEQ ID NO: 2755832 - RNA, 14 nt, Human
uaauuugguuuuca

SEQ ID NO: 2755833 - RNA, 17 nt, Human
uaauuugguuuucacau

SEQ ID NO: 2755834 - RNA, 21 nt, Human
uaauuuguaguguuggagaag

SEQ ID NO: 2755835 - RNA, 14 nt, Human
uaauuuuaaaaugu

SEQ ID NO: 2755836 - RNA, 14 nt, Human
uaauuuuaaauguu

SEQ ID NO: 2755837 - RNA, 18 nt, Human
uaauuuuaacucuauaau

SEQ ID NO: 2755838 - RNA, 13 nt, Human
uaauuuuaaguaa

SEQ ID NO: 2755839 - RNA, 18 nt, Human
uaauuuuagacauucuuu

SEQ ID NO: 2755840 - RNA, 13 nt, Human
uaauuuugaaaaa

SEQ ID NO: 2755841 - RNA, 18 nt, Human
uaauuuugaauaaauaaa

SEQ ID NO: 2755842 - RNA, 17 nt, Human
uaauuuugcuaacuggg

SEQ ID NO: 2755843 - RNA, 13 nt, Human
uaauuuuuauauu

SEQ ID NO: 2755844 - RNA, 17 nt, Human
uaauuuuuauauuugaa

SEQ ID NO: 2755845 - RNA, 21 nt, Human
uaauuuuuauauuugaaauau

SEQ ID NO: 2755846 - RNA, 18 nt, Human
uaauuuuuguauuuuuag

SEQ ID NO: 2755847 - RNA, 13 nt, Human
uacaaaaacuuag

SEQ ID NO: 2755848 - RNA, 19 nt, Human
uacaaaaauuagccgggca

SEQ ID NO: 2755849 - RNA, 23 nt, Human
uacaaaaccacuggaaaguuuau

SEQ ID NO: 2755850 - RNA, 23 nt, Human
uacaaacauguuccugggaucac

SEQ ID NO: 2755851 - RNA, 20 nt, Human
uacaaagggggaggcuaaag

SEQ ID NO: 2755852 - RNA, 18 nt, Human
uacaaauauuuugcuagu

SEQ ID NO: 2755853 - RNA, 17 nt, Human
uacaaaugcauuucuaa

SEQ ID NO: 2755854 - RNA, 23 nt, Human
uacaaaugggaaacaaaaggaua

SEQ ID NO: 2755855 - RNA, 17 nt, Human
uacaaccuccgccuccc

SEQ ID NO: 2755856 - RNA, 18 nt, Human
uacaaccuccgccuccca

SEQ ID NO: 2755857 - RNA, 14 nt, Human
uacaagcauucugu

SEQ ID NO: 2755858 - RNA, 24 nt, Human
uacaauaaagcaaugugguaguuc

SEQ ID NO: 2755859 - RNA, 18 nt, Human
uacaauaauucuaugaga

SEQ ID NO: 2755860 - RNA, 19 nt, Human
uacaauuauuuuuacaguu

SEQ ID NO: 2755861 - RNA, 12 nt, Human
uacaauugaaau

SEQ ID NO: 2755862 - RNA, 20 nt, Human
uagaaaaguuauguagaaaa

SEQ ID NO: 2755863 - RNA, 21 nt, Human
uagaaaaguuauguagaaaaa

SEQ ID NO: 2755864 - RNA, 14 nt, Human
uagaaacugacaca

SEQ ID NO: 2755865 - RNA, 20 nt, Human
uagaaagcauuugaaugcau

SEQ ID NO: 2755866 - RNA, 16 nt, Human
uagaaagccaugugca

SEQ ID NO: 2755867 - RNA, 16 nt, Human
uagaaaguugauuuua

SEQ ID NO: 2755868 - RNA, 19 nt, Human
uagaaaugguuguauuaga

SEQ ID NO: 2755869 - RNA, 11 nt, Human
uagaaauuuau

SEQ ID NO: 2755870 - RNA, 13 nt, Human
uagaacucccuuu

SEQ ID NO: 2755871 - RNA, 18 nt, Human
uagaacucccuuucaaca

SEQ ID NO: 2755872 - RNA, 15 nt, Human
uagaaggauguacau

SEQ ID NO: 2755873 - RNA, 18 nt, Human
uagaaggguaccuugaac

SEQ ID NO: 2755874 - RNA, 23 nt, Human
uagaagucacauuccugaacagg

SEQ ID NO: 2755875 - RNA, 18 nt, Human
uagaauaaaauuuuuaau

SEQ ID NO: 2755876 - RNA, 16 nt, Human
uagaauaaggaacaac

SEQ ID NO: 2755877 - RNA, 13 nt, Human
uagaauaauacua

SEQ ID NO: 2755878 - RNA, 18 nt, Human
uagaauaccacaggaacc

SEQ ID NO: 2755879 - RNA, 12 nt, Human
uagaauacuaau

SEQ ID NO: 2755880 - RNA, 13 nt, Human
uagaauacuaaua

SEQ ID NO: 2755881 - RNA, 17 nt, Human
uagaauauauuuccuua

SEQ ID NO: 2755882 - RNA, 18 nt, Human
uagaauauauuuccuuau

SEQ ID NO: 2755883 - RNA, 15 nt, Human
uagaauauuaaaaau

SEQ ID NO: 2755884 - RNA, 21 nt, Human
uagaauuauaacuggaaagaa

SEQ ID NO: 2755885 - RNA, 22 nt, Human
uagaauugugcaaccaucacca

SEQ ID NO: 2755886 - RNA, 12 nt, Human
uagaauuucuuu

SEQ ID NO: 2755887 - RNA, 22 nt, Human
uagacacacaugaaguccaagc

SEQ ID NO: 2755888 - RNA, 23 nt, Human
uagacacacaugaaguccaagca

SEQ ID NO: 2755889 - RNA, 15 nt, Human
uagacacugaucugg

SEQ ID NO: 2755890 - RNA, 14 nt, Human
uagacccucaugcu

SEQ ID NO: 2755891 - RNA, 21 nt, Human
uagaccuaaaauaaaaugaag

SEQ ID NO: 2755892 - RNA, 15 nt, Human
uagaccucagccugu

SEQ ID NO: 2755893 - RNA, 22 nt, Human
uagagaaguucaauauaagcuu

SEQ ID NO: 2755894 - RNA, 16 nt, Human
uagagaauuuccuuac

SEQ ID NO: 2755895 - RNA, 21 nt, Human
uagagacggguuucaccaugu

SEQ ID NO: 2755896 - RNA, 19 nt, Human
uagagauuuuuaaauaaag

SEQ ID NO: 2755897 - RNA, 17 nt, Human
uagaggcuuccuucauu

SEQ ID NO: 2755898 - RNA, 16 nt, Human
uagagugggacaguuc

SEQ ID NO: 2755899 - RNA, 17 nt, Human
uagagugggacaguucc

SEQ ID NO: 2755900 - RNA, 21 nt, Human
uagaguuuaccuuauguuuaa

SEQ ID NO: 2755901 - RNA, 13 nt, Human
uagauaaacucag

SEQ ID NO: 2755902 - RNA, 20 nt, Human
uagauaaacucagaaauuua

SEQ ID NO: 2755903 - RNA, 21 nt, Human
uagauaaacucagaaauuuaa

SEQ ID NO: 2755904 - RNA, 22 nt, Human
uagauaaagcacuguuuggaua

SEQ ID NO: 2755905 - RNA, 13 nt, Human
uagauaauacagu

SEQ ID NO: 2755906 - RNA, 15 nt, Human
uagauaggccauggg

SEQ ID NO: 2755907 - RNA, 24 nt, Human
uagauauuaccaguuuuccuaagu

SEQ ID NO: 2755908 - RNA, 20 nt, Human
uagaugcaguucugaagaag

SEQ ID NO: 2755909 - RNA, 17 nt, Human
uagauguauagguugau

SEQ ID NO: 2755910 - RNA, 20 nt, Human
uagauuccucuggauuuugu

SEQ ID NO: 2755911 - RNA, 16 nt, Human
uagcaaagaguuaaua

SEQ ID NO: 2755912 - RNA, 18 nt, Human
uagcaacguggcuuuuuu

SEQ ID NO: 2755913 - RNA, 19 nt, Human
uagcaagugaauuuuucuc

SEQ ID NO: 2755914 - RNA, 21 nt, Human
uagcagacaguguuuucuggg

SEQ ID NO: 2755915 - RNA, 22 nt, Human
uagcagacaguguuuucuggga

SEQ ID NO: 2755916 - RNA, 21 nt, Human
uagcagagggaucaagcaguu

SEQ ID NO: 2755917 - RNA, 23 nt, Human
uagcagauacagggaugaggcag

SEQ ID NO: 2755918 - RNA, 22 nt, Human
uagcaggaagcugugagagcag

SEQ ID NO: 2755919 - RNA, 23 nt, Human
uagcauaguaccucugcuauuug

SEQ ID NO: 2755920 - RNA, 14 nt, Human
uagcauauguuuuu

SEQ ID NO: 2755921 - RNA, 13 nt, Human
uagcauggccaca

SEQ ID NO: 2755922 - RNA, 12 nt, Human
uagcauuucucc

SEQ ID NO: 2755923 - RNA, 20 nt, Human
uagcauuuguguugaagagg

SEQ ID NO: 2755924 - RNA, 19 nt, Human
uagccaagugcagggccug

SEQ ID NO: 2755925 - RNA, 20 nt, Human
uagccaccgagauccuuauc

SEQ ID NO: 2755926 - RNA, 13 nt, Human
uagccagaggcuc

SEQ ID NO: 2755927 - RNA, 16 nt, Human
uagccagaggcucuaa

SEQ ID NO: 2755928 - RNA, 18 nt, Human
uagccagguaccuucuca

SEQ ID NO: 2755929 - RNA, 14 nt, Human
uagccagugaaaaa

SEQ ID NO: 2755930 - RNA, 16 nt, Human
uagccccucuccugga

SEQ ID NO: 2755931 - RNA, 14 nt, Human
uagccgaccucagc

SEQ ID NO: 2755932 - RNA, 20 nt, Human
uagccugccuccccugccuc

SEQ ID NO: 2755933 - RNA, 16 nt, Human
uagcuaaaucccuccc

SEQ ID NO: 2755934 - RNA, 15 nt, Human
uagcuaaguuuuguu

SEQ ID NO: 2755935 - RNA, 12 nt, Human
uagcuccuccuu

SEQ ID NO: 2755936 - RNA, 20 nt, Human
uagcuccuccuuuuuccuuc

SEQ ID NO: 2755937 - RNA, 14 nt, Human
uagcugacccagcc

SEQ ID NO: 2755938 - RNA, 19 nt, Human
uagcuggaaaaguauguua

SEQ ID NO: 2755939 - RNA, 14 nt, Human
uagcuggcucugug

SEQ ID NO: 2755940 - RNA, 16 nt, Human
uagcuuagaccucagc

SEQ ID NO: 2755941 - RNA, 20 nt, Human
uagcuuuacuguuuguuaug

SEQ ID NO: 2755942 - RNA, 19 nt, Human
uagcuuuauuuuuuaagua

SEQ ID NO: 2755943 - RNA, 15 nt, Human
uaggaaauauuuauu

SEQ ID NO: 2755944 - RNA, 18 nt, Human
uaggaaauauuuuaaugu

SEQ ID NO: 2755945 - RNA, 20 nt, Human
uaggaauugacccacaagaa

SEQ ID NO: 2755946 - RNA, 13 nt, Human
uaggacccuuccc

SEQ ID NO: 2755947 - RNA, 13 nt, Human
uaggacugaauua

SEQ ID NO: 2755948 - RNA, 17 nt, Human
uaggagagguugucugu

SEQ ID NO: 2755949 - RNA, 22 nt, Human
uaggagagguugucuguggcca

SEQ ID NO: 2755950 - RNA, 17 nt, Human
uaggaugggaacaagga

SEQ ID NO: 2755951 - RNA, 18 nt, Human
uaggaugggaacaaggaa

SEQ ID NO: 2755952 - RNA, 16 nt, Human
uaggauguugaaaaag

SEQ ID NO: 2755953 - RNA, 20 nt, Human
uaggauguugagcagcaucu

SEQ ID NO: 2755954 - RNA, 14 nt, Human
uaggcauagcccug

SEQ ID NO: 2755955 - RNA, 16 nt, Human
uaggcaugcgccacca

SEQ ID NO: 2755956 - RNA, 14 nt, Human
uaggcauuaaauuu

SEQ ID NO: 2755957 - RNA, 20 nt, Human
uaggccaugggacagggagg

SEQ ID NO: 2755958 - RNA, 13 nt, Human
uagggacccccaa

SEQ ID NO: 2755959 - RNA, 12 nt, Human
uagggaccugcu

SEQ ID NO: 2755960 - RNA, 14 nt, Human
uagggaccugcugu

SEQ ID NO: 2755961 - RNA, 20 nt, Human
uagggacuucugucuucaca

SEQ ID NO: 2755962 - RNA, 15 nt, Human
uagggcguggaaagg

SEQ ID NO: 2755963 - RNA, 19 nt, Human
uaggggggucagccagccc

SEQ ID NO: 2755964 - RNA, 15 nt, Human
uaggguccaccagga

SEQ ID NO: 2755965 - RNA, 17 nt, Human
uaggguccaccaggagu

SEQ ID NO: 2755966 - RNA, 13 nt, Human
uagggugauauua

SEQ ID NO: 2755967 - RNA, 15 nt, Human
uagggugauauuaac

SEQ ID NO: 2755968 - RNA, 20 nt, Human
uagguaacuguaugugugug

SEQ ID NO: 2755969 - RNA, 18 nt, Human
uaggugacuauuauauuu

SEQ ID NO: 2755970 - RNA, 19 nt, Human
uaggugacuauuauauuuc

SEQ ID NO: 2755971 - RNA, 21 nt, Human
uaggugacuauuauauuucca

SEQ ID NO: 2755972 - RNA, 23 nt, Human
uaggugcuacaaaaacacagcaa

SEQ ID NO: 2755973 - RNA, 14 nt, Human
uagguuuaauaauu

SEQ ID NO: 2755974 - RNA, 23 nt, Human
uagguuucugaguuccugcaugc

SEQ ID NO: 2755975 - RNA, 21 nt, Human
uaguaagagauuccugagcca

SEQ ID NO: 2755976 - RNA, 23 nt, Human
uaguagagacggguuucaccaug

SEQ ID NO: 2755977 - RNA, 14 nt, Human
uaguaucaaaagaa

SEQ ID NO: 2755978 - RNA, 16 nt, Human
uaguaucaaaagaaag

SEQ ID NO: 2755979 - RNA, 13 nt, Human
uaguauuucuaug

SEQ ID NO: 2755980 - RNA, 21 nt, Human
uaguauuucuaugaaauauua

SEQ ID NO: 2755981 - RNA, 23 nt, Human
uagucacuaguuguaauuuuuuu

SEQ ID NO: 2755982 - RNA, 23 nt, Human
uagucauucugccugcccugaaa

SEQ ID NO: 2755983 - RNA, 11 nt, Human
uaguccccagc

SEQ ID NO: 2755984 - RNA, 15 nt, Human
uaguccccagccugc

SEQ ID NO: 2755985 - RNA, 16 nt, Human
uagucucuacccagua

SEQ ID NO: 2755986 - RNA, 20 nt, Human
uagucucuaucauuaaaguu

SEQ ID NO: 2755987 - RNA, 18 nt, Human
uagucuuacgauguuuag

SEQ ID NO: 2755988 - RNA, 18 nt, Human
uagugaaauauuauuuua

SEQ ID NO: 2755989 - RNA, 18 nt, Human
uagugaaguaugcacuaa

SEQ ID NO: 2755990 - RNA, 19 nt, Human
uagugagcagucaggaaag

SEQ ID NO: 2755991 - RNA, 11 nt, Human
uagugauuuua

SEQ ID NO: 2755992 - RNA, 13 nt, Human
uagugauuuuaau

SEQ ID NO: 2755993 - RNA, 17 nt, Human
uaguuagccaauauuuu

SEQ ID NO: 2755994 - RNA, 21 nt, Human
uaguuagccaauauuuuucuu

SEQ ID NO: 2755995 - RNA, 16 nt, Human
uaguuauaaaaauaua

SEQ ID NO: 2755996 - RNA, 20 nt, Human
uaguuauaaaaauauauagc

SEQ ID NO: 2755997 - RNA, 15 nt, Human
uaguucaaguccugc

SEQ ID NO: 2755998 - RNA, 16 nt, Human
uaguugcaacuuugua

SEQ ID NO: 2755999 - RNA, 14 nt, Human
uaguuucccuugca

SEQ ID NO: 2756000 - RNA, 20 nt, Human
uauaaaagacugaccaauau

SEQ ID NO: 2756001 - RNA, 15 nt, Human
uauaaagcaagauaa

SEQ ID NO: 2756002 - RNA, 11 nt, Human
uauaaaggauu

SEQ ID NO: 2756003 - RNA, 13 nt, Human
uauaaauaaaaau

SEQ ID NO: 2756004 - RNA, 14 nt, Human
uauaaauaaaaaua

SEQ ID NO: 2756005 - RNA, 15 nt, Human
uauaaauaaaaauaa

SEQ ID NO: 2756006 - RNA, 20 nt, Human
uauaaauaaaaauaauccuc

SEQ ID NO: 2756007 - RNA, 15 nt, Human
uaugugaaauaaaag

SEQ ID NO: 2756008 - RNA, 20 nt, Human
uaugugaaauaaaaguagaa

SEQ ID NO: 2756009 - RNA, 18 nt, Human
uaugugauguggcaaauc

SEQ ID NO: 2756010 - RNA, 9 nt, Human
uaugugcaa

SEQ ID NO: 2756011 - RNA, 11 nt, Human
uaugugcaaua

SEQ ID NO: 2756012 - RNA, 17 nt, Human
uaugugcaucuuauuuc

SEQ ID NO: 2756013 - RNA, 20 nt, Human
uaugugccagauuuaugcau

SEQ ID NO: 2756014 - RNA, 17 nt, Human
uauguguguuuuaaaau

SEQ ID NO: 2756015 - RNA, 20 nt, Human
uauguuaaacuagcauaucu

SEQ ID NO: 2756016 - RNA, 16 nt, Human
uauguuagugcaaauu

SEQ ID NO: 2756017 - RNA, 14 nt, Human
uauguuauuauuaa

SEQ ID NO: 2756018 - RNA, 15 nt, Human
uauguuuaacguuuu

SEQ ID NO: 2756019 - RNA, 12 nt, Human
uauguuucacug

SEQ ID NO: 2756020 - RNA, 18 nt, Human
uauuaagaaaaucuauuu

SEQ ID NO: 2756021 - RNA, 14 nt, Human
uauuaauaaacauu

SEQ ID NO: 2756022 - RNA, 19 nt, Human
uauuaauauauauuaucuu

SEQ ID NO: 2756023 - RNA, 14 nt, Human
uauuacaaauauuu

SEQ ID NO: 2756024 - RNA, 21 nt, Human
uauuacaaauccaaugaaaug

SEQ ID NO: 2756025 - RNA, 21 nt, Human
uauuacuguaagaaaauauca

SEQ ID NO: 2756026 - RNA, 15 nt, Human
uauuagccacaaaau

SEQ ID NO: 2756027 - RNA, 15 nt, Human
uauuauaauucaaag

SEQ ID NO: 2756028 - RNA, 19 nt, Human
uauuauaauucaaaggcau

SEQ ID NO: 2756029 - RNA, 19 nt, Human
uauuauaauuuuuuucaau

SEQ ID NO: 2756030 - RNA, 15 nt, Human
uauuaucaugcaaau

SEQ ID NO: 2756031 - RNA, 14 nt, Human
uauuauccccauuu

SEQ ID NO: 2756032 - RNA, 20 nt, Human
uauuaucuuuucauacauuu

SEQ ID NO: 2756033 - RNA, 17 nt, Human
uauuaugaagcuuuuau

SEQ ID NO: 2756034 - RNA, 18 nt, Human
uauuaugcauuauaucaa

SEQ ID NO: 2756035 - RNA, 13 nt, Human
uauuauggaggca

SEQ ID NO: 2756036 - RNA, 16 nt, Human
uauuauggaggcagga

SEQ ID NO: 2756037 - RNA, 13 nt, Human
uauuauguuaaaa

SEQ ID NO: 2756038 - RNA, 11 nt, Human
uauuauuuaua

SEQ ID NO: 2756039 - RNA, 15 nt, Human
uauuauuuauauaug

SEQ ID NO: 2756040 - RNA, 16 nt, Human
uauuauuuauauaugu

SEQ ID NO: 2756041 - RNA, 20 nt, Human
uauuauuuuauagcuacuaa

SEQ ID NO: 2756042 - RNA, 21 nt, Human
uauuauuuuauagcuacuaau

SEQ ID NO: 2756043 - RNA, 12 nt, Human
uauuauuuuuua

SEQ ID NO: 2756044 - RNA, 17 nt, Human
uauuauuuuuuaaaaaa

SEQ ID NO: 2756045 - RNA, 12 nt, Human
uauucacaagac

SEQ ID NO: 2756046 - RNA, 20 nt, Human
uauucacaagacccaaaagg

SEQ ID NO: 2756047 - RNA, 17 nt, Human
uauucauaagauuuaaa

SEQ ID NO: 2756048 - RNA, 15 nt, Human
uauucauauuuucuu

SEQ ID NO: 2756049 - RNA, 16 nt, Human
uauucauauuuucuuu

SEQ ID NO: 2756050 - RNA, 13 nt, Human
uauucauucucau

SEQ ID NO: 2756051 - RNA, 15 nt, Human
uauuccuagaaacug

SEQ ID NO: 2756052 - RNA, 18 nt, Human
uauuccucaguucaucca

SEQ ID NO: 2756053 - RNA, 16 nt, Human
uauuccuccuucccuu

SEQ ID NO: 2756054 - RNA, 22 nt, Human
uauuccuguggauguaaaguga

SEQ ID NO: 2756055 - RNA, 22 nt, Human
uauuccuuuuucucuccucucc

SEQ ID NO: 2756056 - RNA, 13 nt, Human
uauucuccauacu

SEQ ID NO: 2756057 - RNA, 14 nt, Human
uauucuguguuaaa

SEQ ID NO: 2756058 - RNA, 17 nt, Human
uauucuguguuaaaaau

SEQ ID NO: 2756059 - RNA, 16 nt, Human
uauugaggcuuuaaaa

SEQ ID NO: 2756060 - RNA, 17 nt, Human
uauugcugaaugacuac

SEQ ID NO: 2756061 - RNA, 16 nt, Human
uauugggguugggggg

SEQ ID NO: 2756062 - RNA, 20 nt, Human
uauuguagcauccuggaaua

SEQ ID NO: 2756063 - RNA, 21 nt, Human
uauuguagcauccuggaauau

SEQ ID NO: 2756064 - RNA, 15 nt, Human
uauugucuagugaaa

SEQ ID NO: 2756065 - RNA, 13 nt, Human
uauuguuugcuaa

SEQ ID NO: 2756066 - RNA, 16 nt, Human
uauuguuugcuaagca

SEQ ID NO: 2756067 - RNA, 15 nt, Human
uauuuaaauauuaaa

SEQ ID NO: 2756068 - RNA, 19 nt, Human
uauuuaaccucuaaauucu

SEQ ID NO: 2756069 - RNA, 16 nt, Human
uauuuaacuauucaua

SEQ ID NO: 2756070 - RNA, 22 nt, Human
uauuuaagagaacaagcaaaua

SEQ ID NO: 2756071 - RNA, 18 nt, Human
uauuuaagguauauaaau

SEQ ID NO: 2756072 - RNA, 17 nt, Human
uauuuaauucauguugc

SEQ ID NO: 2756073 - RNA, 22 nt, Human
uauuuacggaacucaaauacgu

SEQ ID NO: 2756074 - RNA, 17 nt, Human
uauuuauaaaaauaaaa

SEQ ID NO: 2756075 - RNA, 23 nt, Human
uauuuauaaaaauaaaaaacacu

SEQ ID NO: 2756076 - RNA, 24 nt, Human
uauuuauaaauauauuuaagauaa

SEQ ID NO: 2756077 - RNA, 12 nt, Human
uauuuauauaaa

SEQ ID NO: 2756078 - RNA, 13 nt, Human
uauuuauauauuu

SEQ ID NO: 2756079 - RNA, 13 nt, Human
uauuuauuaauau

SEQ ID NO: 2756080 - RNA, 15 nt, Human
uauuuauuaauauuu

SEQ ID NO: 2756081 - RNA, 16 nt, Human
uauuuauuaauauuua

SEQ ID NO: 2756082 - RNA, 20 nt, Human
uauuuauuacuguaagaaaa

SEQ ID NO: 2756083 - RNA, 14 nt, Human
uauuuauucaauaa

SEQ ID NO: 2756084 - RNA, 19 nt, Human
uauuuauucauauuuucuu

SEQ ID NO: 2756085 - RNA, 19 nt, Human
uauuuauugcugaaugacu

SEQ ID NO: 2756086 - RNA, 15 nt, Human
uauuucacuuuagaa

SEQ ID NO: 2756087 - RNA, 19 nt, Human
uauuucagauaaucacaau

SEQ ID NO: 2756088 - RNA, 12 nt, Human
uauuucauuucu

SEQ ID NO: 2756089 - RNA, 13 nt, Human
uauuucauuucuu

SEQ ID NO: 2756090 - RNA, 15 nt, Human
uauuucauuucuuug

SEQ ID NO: 2756091 - RNA, 15 nt, Human
uauuuccauauuaaa

SEQ ID NO: 2756092 - RNA, 16 nt, Human
uauuuccauauuaaaa

SEQ ID NO: 2756093 - RNA, 21 nt, Human
uauuuccccaugguuuuaauc

SEQ ID NO: 2756094 - RNA, 21 nt, Human
uauuucuaugaaauauuaugu

SEQ ID NO: 2756095 - RNA, 22 nt, Human
uauuucuaugaaauauuauguu

SEQ ID NO: 2756096 - RNA, 23 nt, Human
uauuucucucuuuuuagagaaau

SEQ ID NO: 2756097 - RNA, 18 nt, Human
uauuucuguuaaaauaua

SEQ ID NO: 2756098 - RNA, 14 nt, Human
uauuugaaauauug

SEQ ID NO: 2756099 - RNA, 16 nt, Human
uauuugaaucuugucu

SEQ ID NO: 2756100 - RNA, 14 nt, Human
uauuugaauuuuaa

SEQ ID NO: 2756101 - RNA, 21 nt, Human
uauuugaucugauaucagucc

SEQ ID NO: 2756102 - RNA, 16 nt, Human
uauuugcaagacauag

SEQ ID NO: 2756103 - RNA, 14 nt, Human
uauuugcuguuauu

SEQ ID NO: 2756104 - RNA, 18 nt, Human
uauuuggugauuacauuu

SEQ ID NO: 2756105 - RNA, 22 nt, Human
uauuuggugauuacauuuuaaa

SEQ ID NO: 2756106 - RNA, 19 nt, Human
uauuuguacaccaauauuc

SEQ ID NO: 2756107 - RNA, 17 nt, Human
uauuuguacauuuuuuu

SEQ ID NO: 2756108 - RNA, 16 nt, Human
uauuuuaaaauaaauu

SEQ ID NO: 2756109 - RNA, 14 nt, Human
uauuuuaaauauuu

SEQ ID NO: 2756110 - RNA, 20 nt, Human
uauuuuaaauauuuuuucuu

SEQ ID NO: 2756111 - RNA, 18 nt, Human
uauuuuaauaauguuuca

SEQ ID NO: 2756112 - RNA, 19 nt, Human
uauuuuaauaauguuucaa

SEQ ID NO: 2756113 - RNA, 13 nt, Human
uauuuuaaucacc

SEQ ID NO: 2756114 - RNA, 12 nt, Human
uauuuuaauguu

SEQ ID NO: 2756115 - RNA, 16 nt, Human
uauuuuaauguuucuu

SEQ ID NO: 2756116 - RNA, 18 nt, Human
uauuuuacauaaauuuag

SEQ ID NO: 2756117 - RNA, 16 nt, Human
uauuuuacuuuuccau

SEQ ID NO: 2756118 - RNA, 21 nt, Human
uauuuuauagcuacuaauuuu

SEQ ID NO: 2756119 - RNA, 15 nt, Human
uauuuucaugcuguu

SEQ ID NO: 2756120 - RNA, 14 nt, Human
uauuuucuacacau

SEQ ID NO: 2756121 - RNA, 18 nt, Human
uauuuucuauaauuuaaa

SEQ ID NO: 2756122 - RNA, 22 nt, Human
uauuuugccaagggcauaaauu

SEQ ID NO: 2756123 - RNA, 16 nt, Human
uauuuugcuaacuggu

SEQ ID NO: 2756124 - RNA, 20 nt, Human
uauuuuguguucaguacaau

SEQ ID NO: 2756125 - RNA, 16 nt, Human
uauuuuguuuaaauua

SEQ ID NO: 2756126 - RNA, 14 nt, Human
uauuuuuaccuuuu

SEQ ID NO: 2756127 - RNA, 21 nt, Human
uauuuuuccauuuuuuucuaa

SEQ ID NO: 2756128 - RNA, 15 nt, Human
uauuuuugugauuuu

SEQ ID NO: 2756129 - RNA, 20 nt, Human
uauuuuuuaaaaaaauucca

SEQ ID NO: 2756130 - RNA, 14 nt, Human
uauuuuuuaugaaa

SEQ ID NO: 2756131 - RNA, 16 nt, Human
uauuuuuuguuaaaug

SEQ ID NO: 2756132 - RNA, 17 nt, Human
uauuuuuuucugaaauu

SEQ ID NO: 2756133 - RNA, 13 nt, Human
uauuuuuuuucuu

SEQ ID NO: 2756134 - RNA, 12 nt, Human
ucaaaacugcac

SEQ ID NO: 2756135 - RNA, 13 nt, Human
ucaaaacuucaga

SEQ ID NO: 2756136 - RNA, 15 nt, Human
ucaaaagacuuuuuc

SEQ ID NO: 2756137 - RNA, 17 nt, Human
ucaaaagacuuuuuccu

SEQ ID NO: 2756138 - RNA, 18 nt, Human
ucaaaagacuuuuuccuu

SEQ ID NO: 2756139 - RNA, 15 nt, Human
ucaaaagagucuuaa

SEQ ID NO: 2756140 - RNA, 16 nt, Human
ucaaaagguauuuauu

SEQ ID NO: 2756141 - RNA, 21 nt, Human
ucaaaauaccaugccauuuaa

SEQ ID NO: 2756142 - RNA, 13 nt, Human
ucaaaaucaacuu

SEQ ID NO: 2756143 - RNA, 22 nt, Human
ucaaaauuacccuaaacauccu

SEQ ID NO: 2756144 - RNA, 21 nt, Human
ucaaaauuggacuuaaaaucu

SEQ ID NO: 2756145 - RNA, 23 nt, Human
ucaaacagucucaggaaaucaaa

SEQ ID NO: 2756146 - RNA, 18 nt, Human
ucaaacauauauaacaau

SEQ ID NO: 2756147 - RNA, 16 nt, Human
ucaaacccauucccuc

SEQ ID NO: 2756148 - RNA, 16 nt, Human
ucaaacugaagccaga

SEQ ID NO: 2756149 - RNA, 19 nt, Human
ucaaacugagauccuuccu

SEQ ID NO: 2756150 - RNA, 16 nt, Human
ucaaagccaaguuuau

SEQ ID NO: 2756151 - RNA, 20 nt, Human
ucaaaggacaccauuuuggc

SEQ ID NO: 2756152 - RNA, 19 nt, Human
ucaaaggcauuucuuuucu

SEQ ID NO: 2756153 - RNA, 17 nt, Human
ucaggauacuauauuuu

SEQ ID NO: 2756154 - RNA, 16 nt, Human
ucaggaugagggaaaa

SEQ ID NO: 2756155 - RNA, 22 nt, Human
ucaggaugagggaaaagaaaaa

SEQ ID NO: 2756156 - RNA, 16 nt, Human
ucaggcacacuucuuc

SEQ ID NO: 2756157 - RNA, 18 nt, Human
ucaggcagguaaccccag

SEQ ID NO: 2756158 - RNA, 17 nt, Human
ucagggagguggcuggg

SEQ ID NO: 2756159 - RNA, 21 nt, Human
ucagggcuggucuuuuaggac

SEQ ID NO: 2756160 - RNA, 17 nt, Human
ucaggucuuucuuuccg

SEQ ID NO: 2756161 - RNA, 16 nt, Human
ucaggugacccugaug

SEQ ID NO: 2756162 - RNA, 20 nt, Human
ucaggugacccugaugaaaa

SEQ ID NO: 2756163 - RNA, 16 nt, Human
ucaguagucagacugg

SEQ ID NO: 2756164 - RNA, 15 nt, Human
ucaguauucauauuu

SEQ ID NO: 2756165 - RNA, 15 nt, Human
ucagucauaacuaaa

SEQ ID NO: 2756166 - RNA, 15 nt, Human
ucaguccucuuucaa

SEQ ID NO: 2756167 - RNA, 14 nt, Human
ucagucucccuccc

SEQ ID NO: 2756168 - RNA, 15 nt, Human
ucagucucccucccu

SEQ ID NO: 2756169 - RNA, 16 nt, Human
ucagucucccucccuu

SEQ ID NO: 2756170 - RNA, 13 nt, Human
ucagucuuuucca

SEQ ID NO: 2756171 - RNA, 16 nt, Human
ucagugcugccgauaa

SEQ ID NO: 2756172 - RNA, 16 nt, Human
ucaguguccucaucug

SEQ ID NO: 2756173 - RNA, 15 nt, Human
ucaguuacucugaag

SEQ ID NO: 2756174 - RNA, 19 nt, Human
ucaguuauuauauuuacaa

SEQ ID NO: 2756175 - RNA, 21 nt, Human
ucaguuccagccuucucucaa

SEQ ID NO: 2756176 - RNA, 16 nt, Human
ucauaaagcaggcaga

SEQ ID NO: 2756177 - RNA, 14 nt, Human
ucauaaauaaaguu

SEQ ID NO: 2756178 - RNA, 19 nt, Human
ucauaacaauuuuaggagg

SEQ ID NO: 2756179 - RNA, 15 nt, Human
ucauaagaauucugu

SEQ ID NO: 2756180 - RNA, 15 nt, Human
ucauaauaaguugca

SEQ ID NO: 2756181 - RNA, 17 nt, Human
ucauaaugguuuuuaac

SEQ ID NO: 2756182 - RNA, 19 nt, Human
ucauaccguguaccucagu

SEQ ID NO: 2756183 - RNA, 17 nt, Human
ucauagagacuugggaa

SEQ ID NO: 2756184 - RNA, 16 nt, Human
ucauagcagauuuuaa

SEQ ID NO: 2756185 - RNA, 23 nt, Human
ucauauaauaaauguacauuaau

SEQ ID NO: 2756186 - RNA, 21 nt, Human
ucauauaaucuuacaaugaaa

SEQ ID NO: 2756187 - RNA, 12 nt, Human
ucauauuuucau

SEQ ID NO: 2756188 - RNA, 16 nt, Human
ucaucaaucaaauaag

SEQ ID NO: 2756189 - RNA, 16 nt, Human
ucaucaaugaaugaau

SEQ ID NO: 2756190 - RNA, 13 nt, Human
ucaucauaaaaua

SEQ ID NO: 2756191 - RNA, 14 nt, Human
ucaucauaaaauaa

SEQ ID NO: 2756192 - RNA, 21 nt, Human
ucaucauuuccauuuacccuu

SEQ ID NO: 2756193 - RNA, 13 nt, Human
ucaucccacccgc

SEQ ID NO: 2756194 - RNA, 14 nt, Human
ucauccucaggccu

SEQ ID NO: 2756195 - RNA, 13 nt, Human
ucauccugcaggc

SEQ ID NO: 2756196 - RNA, 17 nt, Human
ucauccugcaggcagcu

SEQ ID NO: 2756197 - RNA, 14 nt, Human
ucauccuuuucauu

SEQ ID NO: 2756198 - RNA, 15 nt, Human
ucaucuaagccuucu

SEQ ID NO: 2756199 - RNA, 22 nt, Human
ucaucucacauuuucccuuccc

SEQ ID NO: 2756200 - RNA, 13 nt, Human
ucaucucagcuca

SEQ ID NO: 2756201 - RNA, 15 nt, Human
ucaucucagcucacu

SEQ ID NO: 2756202 - RNA, 20 nt, Human
ucaucugugauucccuccug

SEQ ID NO: 2756203 - RNA, 18 nt, Human
ucaugaagauauuuuucc

SEQ ID NO: 2756204 - RNA, 19 nt, Human
ucaugaagauauuuuucca

SEQ ID NO: 2756205 - RNA, 20 nt, Human
ucaugaagauauuuuuccau

SEQ ID NO: 2756206 - RNA, 19 nt, Human
ucaugaauuaguuuuauau

SEQ ID NO: 2756207 - RNA, 17 nt, Human
ucaugaauucugucauu

SEQ ID NO: 2756208 - RNA, 13 nt, Human
ucaugagggcugg

SEQ ID NO: 2756209 - RNA, 13 nt, Human
ucaugauuuugaa

SEQ ID NO: 2756210 - RNA, 21 nt, Human
ucaugccccuguacuccagcc

SEQ ID NO: 2756211 - RNA, 15 nt, Human
ucaugcuaauuauau

SEQ ID NO: 2756212 - RNA, 18 nt, Human
ucaugcuaauuauauaau

SEQ ID NO: 2756213 - RNA, 12 nt, Human
ucaugcugccaa

SEQ ID NO: 2756214 - RNA, 21 nt, Human
ucaugcugucuacacuaagag

SEQ ID NO: 2756215 - RNA, 20 nt, Human
ucaugcuuaaggccaugauu

SEQ ID NO: 2756216 - RNA, 11 nt, Human
ucauggaauug

SEQ ID NO: 2756217 - RNA, 15 nt, Human
ucauggaauuggagc

SEQ ID NO: 2756218 - RNA, 23 nt, Human
ucauggcuaucuguggguaguau

SEQ ID NO: 2756219 - RNA, 19 nt, Human
ucauguaagcugaaaauau

SEQ ID NO: 2756220 - RNA, 22 nt, Human
ucauguauuuuaaaauaaauua

SEQ ID NO: 2756221 - RNA, 13 nt, Human
ucauuaaaguucu

SEQ ID NO: 2756222 - RNA, 22 nt, Human
ucauuaaaguucuagugaccga

SEQ ID NO: 2756223 - RNA, 21 nt, Human
ucauuagccugaguagaaagg

SEQ ID NO: 2756224 - RNA, 16 nt, Human
ucauuaggauggcuag

SEQ ID NO: 2756225 - RNA, 12 nt, Human
ucauucaaaagu

SEQ ID NO: 2756226 - RNA, 22 nt, Human
ucauucaagucagcucuucucc

SEQ ID NO: 2756227 - RNA, 20 nt, Human
ucauucacucaacaaacaua

SEQ ID NO: 2756228 - RNA, 21 nt, Human
ucauucacucaacaaacauaa

SEQ ID NO: 2756229 - RNA, 20 nt, Human
ucauucagauaugauucaaa

SEQ ID NO: 2756230 - RNA, 21 nt, Human
ucauucagauaugauucaaau

SEQ ID NO: 2756231 - RNA, 13 nt, Human
ucauucugccugc

SEQ ID NO: 2756232 - RNA, 15 nt, Human
ucauucugccugccc

SEQ ID NO: 2756233 - RNA, 22 nt, Human
ucauugcaaccuccaccuucug

SEQ ID NO: 2756234 - RNA, 19 nt, Human
ucauugcucagaaauguca

SEQ ID NO: 2756235 - RNA, 14 nt, Human
ucauuguagaaaag

SEQ ID NO: 2756236 - RNA, 13 nt, Human
ucauuuaaaauau

SEQ ID NO: 2756237 - RNA, 15 nt, Human
ucauuuaaaauauuu

SEQ ID NO: 2756238 - RNA, 16 nt, Human
ucauuuaauaaaugug

SEQ ID NO: 2756239 - RNA, 18 nt, Human
ucauuuaauaaaugugcc

SEQ ID NO: 2756240 - RNA, 13 nt, Human
ucauuuccaagca

SEQ ID NO: 2756241 - RNA, 16 nt, Human
ucauuucucaucuuuu

SEQ ID NO: 2756242 - RNA, 17 nt, Human
ucauuuuaacaucugag

SEQ ID NO: 2756243 - RNA, 12 nt, Human
ucauuuuaauua

SEQ ID NO: 2756244 - RNA, 22 nt, Human
ucauuuuagggguagcauuugu

SEQ ID NO: 2756245 - RNA, 21 nt, Human
ucauuuuuuccagucuuccuc

SEQ ID NO: 2756246 - RNA, 16 nt, Human
ucauuuuuucuucucc

SEQ ID NO: 2756247 - RNA, 23 nt, Human
ucauuuuuucuucuccuaaaacu

SEQ ID NO: 2756248 - RNA, 14 nt, Human
uccaaacagaacua

SEQ ID NO: 2756249 - RNA, 20 nt, Human
uccaaacguuaagaauuguu

SEQ ID NO: 2756250 - RNA, 14 nt, Human
uccaaacugacucu

SEQ ID NO: 2756251 - RNA, 22 nt, Human
uccaaacugacucuuaagaaga

SEQ ID NO: 2756252 - RNA, 23 nt, Human
uccaaacugacucuuaagaagac

SEQ ID NO: 2756253 - RNA, 22 nt, Human
uccaaacuggagcuugaaauag

SEQ ID NO: 2756254 - RNA, 18 nt, Human
uccaaagcccucccuacc

SEQ ID NO: 2756255 - RNA, 22 nt, Human
uccaaagcugaauacauucugc

SEQ ID NO: 2756256 - RNA, 17 nt, Human
uccaaaggcuccugaga

SEQ ID NO: 2756257 - RNA, 20 nt, Human
uccaaaggcuccugagacac

SEQ ID NO: 2756258 - RNA, 13 nt, Human
uccaacaauaaga

SEQ ID NO: 2756259 - RNA, 22 nt, Human
uccaaccagauugucagcuccu

SEQ ID NO: 2756260 - RNA, 14 nt, Human
uccaacguggccca

SEQ ID NO: 2756261 - RNA, 23 nt, Human
uccaacuaucucauuuccaagca

SEQ ID NO: 2756262 - RNA, 13 nt, Human
uccaacucaucca

SEQ ID NO: 2756263 - RNA, 14 nt, Human
uccaacucauccac

SEQ ID NO: 2756264 - RNA, 19 nt, Human
uccaagagccuuuuuuuga

SEQ ID NO: 2756265 - RNA, 21 nt, Human
uccaagcaggaagaaggaaaa

SEQ ID NO: 2756266 - RNA, 19 nt, Human
uccaauacucagguuaaug

SEQ ID NO: 2756267 - RNA, 15 nt, Human
uccaaugacauuuug

SEQ ID NO: 2756268 - RNA, 22 nt, Human
uccaauuagcuccuccuuuuuc

SEQ ID NO: 2756269 - RNA, 14 nt, Human
uccacaacacacag

SEQ ID NO: 2756270 - RNA, 15 nt, Human
uccacaaguaaaagg

SEQ ID NO: 2756271 - RNA, 19 nt, Human
uccacaaguaaaaggaaau

SEQ ID NO: 2756272 - RNA, 23 nt, Human
uccacaaguaaaaggaaaugcuc

SEQ ID NO: 2756273 - RNA, 23 nt, Human
uccacaaugaugaugauuucagc

SEQ ID NO: 2756274 - RNA, 12 nt, Human
uccacagaagcu

SEQ ID NO: 2756275 - RNA, 12 nt, Human
uccacagcugcu

SEQ ID NO: 2756276 - RNA, 19 nt, Human
uccacagcugcucaauaaa

SEQ ID NO: 2756277 - RNA, 22 nt, Human
uccacaggcacagguccccaga

SEQ ID NO: 2756278 - RNA, 17 nt, Human
uccacagugacuccacu

SEQ ID NO: 2756279 - RNA, 19 nt, Human
uccacauccugugggaccu

SEQ ID NO: 2756280 - RNA, 15 nt, Human
uccacauuucccccu

SEQ ID NO: 2756281 - RNA, 16 nt, Human
uccacauuucccccua

SEQ ID NO: 2756282 - RNA, 21 nt, Human
uccaccaggauauccucccuc

SEQ ID NO: 2756283 - RNA, 22 nt, Human
uccacccgccucagccucccaa

SEQ ID NO: 2756284 - RNA, 14 nt, Human
uccaccucccugca

SEQ ID NO: 2756285 - RNA, 19 nt, Human
uccaccucccugcaauaaa

SEQ ID NO: 2756286 - RNA, 23 nt, Human
uccaccucccugcaauaaaaugg

SEQ ID NO: 2756287 - RNA, 13 nt, Human
uccacuacugcua

SEQ ID NO: 2756288 - RNA, 17 nt, Human
uccacuggaaaacugcu

SEQ ID NO: 2756289 - RNA, 15 nt, Human
uccacuuauaggaau

SEQ ID NO: 2756290 - RNA, 20 nt, Human
uccacuuggacaugggcccc

SEQ ID NO: 2756291 - RNA, 16 nt, Human
uccacuuuccaauaaa

SEQ ID NO: 2756292 - RNA, 14 nt, Human
uccagaaagaaaac

SEQ ID NO: 2756293 - RNA, 19 nt, Human
uccagaaagugacaagcuc

SEQ ID NO: 2756294 - RNA, 18 nt, Human
uccagaaauaaugaaaua

SEQ ID NO: 2756295 - RNA, 19 nt, Human
uccagaaauaaugaaauaa

SEQ ID NO: 2756296 - RNA, 22 nt, Human
uccagagacugcuccagaguug

SEQ ID NO: 2756297 - RNA, 18 nt, Human
uccagauacacccaaagu

SEQ ID NO: 2756298 - RNA, 20 nt, Human
uccuaacaggaauuuucauu

SEQ ID NO: 2756299 - RNA, 19 nt, Human
uccuaagcuggagugcagu

SEQ ID NO: 2756300 - RNA, 17 nt, Human
uccuaagucccugcugc

SEQ ID NO: 2756301 - RNA, 15 nt, Human
uccuaagugauugua

SEQ ID NO: 2756302 - RNA, 18 nt, Human
uccuaauuccacagcugc

SEQ ID NO: 2756303 - RNA, 14 nt, Human
uccuaccacaaugc

SEQ ID NO: 2756304 - RNA, 13 nt, Human
uccuacuuccccu

SEQ ID NO: 2756305 - RNA, 14 nt, Human
uccuagucucuauc

SEQ ID NO: 2756306 - RNA, 14 nt, Human
uccuaguucuguag

SEQ ID NO: 2756307 - RNA, 18 nt, Human
uccuaguucuguagaaau

SEQ ID NO: 2756308 - RNA, 13 nt, Human
uccuauguuucac

SEQ ID NO: 2756309 - RNA, 19 nt, Human
uccuauuuuuggaagagga

SEQ ID NO: 2756310 - RNA, 23 nt, Human
uccucaaaaagauuuccccauuu

SEQ ID NO: 2756311 - RNA, 20 nt, Human
uccucaaaacuucagacaua

SEQ ID NO: 2756312 - RNA, 19 nt, Human
uccucaacguugcucccca

SEQ ID NO: 2756313 - RNA, 16 nt, Human
uccucacaccaggcuu

SEQ ID NO: 2756314 - RNA, 17 nt, Human
uccucacuuugaagagu

SEQ ID NO: 2756315 - RNA, 14 nt, Human
uccucagcacccca

SEQ ID NO: 2756316 - RNA, 16 nt, Human
uccucagggacucagg

SEQ ID NO: 2756317 - RNA, 17 nt, Human
uccucagggacucaggu

SEQ ID NO: 2756318 - RNA, 20 nt, Human
uccucaugagggcuggaugc

SEQ ID NO: 2756319 - RNA, 20 nt, Human
uccuccaugaauaucaguua

SEQ ID NO: 2756320 - RNA, 20 nt, Human
uccucccacuucagccuccc

SEQ ID NO: 2756321 - RNA, 13 nt, Human
uccucccggccgc

SEQ ID NO: 2756322 - RNA, 21 nt, Human
uccucccggccgcgcugcgcg

SEQ ID NO: 2756323 - RNA, 19 nt, Human
uccucccuguguauucauu

SEQ ID NO: 2756324 - RNA, 20 nt, Human
uccuccuuuuuccuuccagu

SEQ ID NO: 2756325 - RNA, 18 nt, Human
uccucgccacgcucuggg

SEQ ID NO: 2756326 - RNA, 16 nt, Human
uccucuaugccagcag

SEQ ID NO: 2756327 - RNA, 13 nt, Human
uccucuccaccau

SEQ ID NO: 2756328 - RNA, 14 nt, Human
uccucuccaccauc

SEQ ID NO: 2756329 - RNA, 13 nt, Human
uccucucccagug

SEQ ID NO: 2756330 - RNA, 9 nt, Human
uccucugcu

SEQ ID NO: 2756331 - RNA, 14 nt, Human
uccucugcuugcca

SEQ ID NO: 2756332 - RNA, 21 nt, Human
uccucugcuugccaucccucc

SEQ ID NO: 2756333 - RNA, 16 nt, Human
uccucugugucuucaa

SEQ ID NO: 2756334 - RNA, 22 nt, Human
uccucuuuaauggguaaacagc

SEQ ID NO: 2756335 - RNA, 11 nt, Human
uccucuuucaa

SEQ ID NO: 2756336 - RNA, 19 nt, Human
uccugaaggcauccccagg

SEQ ID NO: 2756337 - RNA, 22 nt, Human
uccugaccuaugaaacagagaa

SEQ ID NO: 2756338 - RNA, 14 nt, Human
uccugaccucaggc

SEQ ID NO: 2756339 - RNA, 13 nt, Human
uccugagaccagc

SEQ ID NO: 2756340 - RNA, 16 nt, Human
uccugaggcuccacuu

SEQ ID NO: 2756341 - RNA, 19 nt, Human
uccugaggcuccacuuggu

SEQ ID NO: 2756342 - RNA, 18 nt, Human
uccugcaagcagaggugg

SEQ ID NO: 2756343 - RNA, 17 nt, Human
uccugccccugagccca

SEQ ID NO: 2756344 - RNA, 19 nt, Human
uccugccucagccucccga

SEQ ID NO: 2756345 - RNA, 17 nt, Human
uccugccugcaauauuu

SEQ ID NO: 2756346 - RNA, 18 nt, Human
uccugccugcaauauuug

SEQ ID NO: 2756347 - RNA, 17 nt, Human
uccuggaggggcugggg

SEQ ID NO: 2756348 - RNA, 16 nt, Human
uccugggaacaucaca

SEQ ID NO: 2756349 - RNA, 13 nt, Human
uccugggcagcug

SEQ ID NO: 2756350 - RNA, 21 nt, Human
uccugggcagcugccuccccu

SEQ ID NO: 2756351 - RNA, 16 nt, Human
uccuguaauggaagca

SEQ ID NO: 2756352 - RNA, 15 nt, Human
uccuguacuuuuucc

SEQ ID NO: 2756353 - RNA, 19 nt, Human
uccugucggagcccugucu

SEQ ID NO: 2756354 - RNA, 19 nt, Human
uccugugggaccugggcca

SEQ ID NO: 2756355 - RNA, 18 nt, Human
uccuguuaauauggugua

SEQ ID NO: 2756356 - RNA, 17 nt, Human
uccuguucuuaagacgu

SEQ ID NO: 2756357 - RNA, 14 nt, Human
uccuuaggccucug

SEQ ID NO: 2756358 - RNA, 16 nt, Human
uccuuauauuauggag

SEQ ID NO: 2756359 - RNA, 12 nt, Human
uccuuauauuua

SEQ ID NO: 2756360 - RNA, 14 nt, Human
uccuuauauuuacu

SEQ ID NO: 2756361 - RNA, 23 nt, Human
uccuuaucacugacacaaaaagu

SEQ ID NO: 2756362 - RNA, 14 nt, Human
uccuucacauccug

SEQ ID NO: 2756363 - RNA, 21 nt, Human
uccuucagccugaaagaggaa

SEQ ID NO: 2756364 - RNA, 17 nt, Human
uccuuccagucuaaaaa

SEQ ID NO: 2756365 - RNA, 15 nt, Human
uccuucccuugcuuc

SEQ ID NO: 2756366 - RNA, 16 nt, Human
uccuucccuugcuucu

SEQ ID NO: 2756367 - RNA, 15 nt, Human
uccuucccuuucauu

SEQ ID NO: 2756368 - RNA, 15 nt, Human
uccuuccucucugca

SEQ ID NO: 2756369 - RNA, 12 nt, Human
uccuuccuuuug

SEQ ID NO: 2756370 - RNA, 18 nt, Human
uccuucugagccugccuu

SEQ ID NO: 2756371 - RNA, 21 nt, Human
uccuucugagccugccuuucu

SEQ ID NO: 2756372 - RNA, 14 nt, Human
uccuugaagauuua

SEQ ID NO: 2756373 - RNA, 12 nt, Human
uccuugauuuua

SEQ ID NO: 2756374 - RNA, 15 nt, Human
uccuugcaucaauuu

SEQ ID NO: 2756375 - RNA, 13 nt, Human
uccuuggagacag

SEQ ID NO: 2756376 - RNA, 17 nt, Human
uccuuggugccuggagc

SEQ ID NO: 2756377 - RNA, 15 nt, Human
uccuuguauuuaaau

SEQ ID NO: 2756378 - RNA, 13 nt, Human
uccuugucuuuuu

SEQ ID NO: 2756379 - RNA, 18 nt, Human
uccuuucucaucuugucc

SEQ ID NO: 2756380 - RNA, 17 nt, Human
uccuuuucauugccaug

SEQ ID NO: 2756381 - RNA, 15 nt, Human
uccuuuuuccuucca

SEQ ID NO: 2756382 - RNA, 19 nt, Human
uccuuuuuuauuccauaag

SEQ ID NO: 2756383 - RNA, 14 nt, Human
ucgaacugcuggau

SEQ ID NO: 2756384 - RNA, 22 nt, Human
ucgaaggggaggcacacuuucu

SEQ ID NO: 2756385 - RNA, 20 nt, Human
ucgacuugccaaauuuagau

SEQ ID NO: 2756386 - RNA, 17 nt, Human
ucgagcguugcuggggg

SEQ ID NO: 2756387 - RNA, 15 nt, Human
ucgaggcuacaguga

SEQ ID NO: 2756388 - RNA, 17 nt, Human
ucgcagacacaugugcu

SEQ ID NO: 2756389 - RNA, 19 nt, Human
ucgcagacacaugugcugg

SEQ ID NO: 2756390 - RNA, 20 nt, Human
ucgcaggaccaucccggccg

SEQ ID NO: 2756391 - RNA, 21 nt, Human
ucgcaggaccaucccggccgg

SEQ ID NO: 2756392 - RNA, 23 nt, Human
ucgccacgcucugggucgccggc

SEQ ID NO: 2756393 - RNA, 19 nt, Human
ucgcccacuuccucccggc

SEQ ID NO: 2756394 - RNA, 21 nt, Human
ucgcccacuuccucccggccg

SEQ ID NO: 2756395 - RNA, 22 nt, Human
ucgcccacuuccucccggccgc

SEQ ID NO: 2756396 - RNA, 23 nt, Human
ucgcugauauauguguuuuucac

SEQ ID NO: 2756397 - RNA, 15 nt, Human
ucgcuuaucaacuaa

SEQ ID NO: 2756398 - RNA, 16 nt, Human
ucgcuuccgcauccua

SEQ ID NO: 2756399 - RNA, 19 nt, Human
ucgcuuccgcauccuaguc

SEQ ID NO: 2756400 - RNA, 14 nt, Human
ucggagcccugucu

SEQ ID NO: 2756401 - RNA, 15 nt, Human
ucggccuccauccug

SEQ ID NO: 2756402 - RNA, 20 nt, Human
ucggccuccauccugaggcu

SEQ ID NO: 2756403 - RNA, 23 nt, Human
ucggccuccauccugaggcucca

SEQ ID NO: 2756404 - RNA, 16 nt, Human
ucggccugcucgccca

SEQ ID NO: 2756405 - RNA, 18 nt, Human
ucggcuuccuuccucucu

SEQ ID NO: 2756406 - RNA, 17 nt, Human
ucgggauuaguacacac

SEQ ID NO: 2756407 - RNA, 20 nt, Human
ucggguuuuauuguuuaaaa

SEQ ID NO: 2756408 - RNA, 21 nt, Human
ucggugagcuacaaaugcauu

SEQ ID NO: 2756409 - RNA, 17 nt, Human
ucggugcguucuccuga

SEQ ID NO: 2756410 - RNA, 20 nt, Human
ucgucuucuuggccauggga

SEQ ID NO: 2756411 - RNA, 18 nt, Human
ucguguccgacucuucug

SEQ ID NO: 2756412 - RNA, 20 nt, Human
ucgugucuggcguugugggg

SEQ ID NO: 2756413 - RNA, 23 nt, Human
ucuaaaaaaggaauccucugugu

SEQ ID NO: 2756414 - RNA, 16 nt, Human
ucuaaaaguuuaaguu

SEQ ID NO: 2756415 - RNA, 16 nt, Human
ucuaaaugucaaucag

SEQ ID NO: 2756416 - RNA, 16 nt, Human
ucuaaauucuuucauu

SEQ ID NO: 2756417 - RNA, 21 nt, Human
ucuaacaaauuccaaauucuc

SEQ ID NO: 2756418 - RNA, 13 nt, Human
ucuaacucagaaa

SEQ ID NO: 2756419 - RNA, 22 nt, Human
ucuaagaaacauuuauauugau

SEQ ID NO: 2756420 - RNA, 23 nt, Human
ucuaagaaacauuuauauugaua

SEQ ID NO: 2756421 - RNA, 20 nt, Human
ucuaagaaagaacacgcucu

SEQ ID NO: 2756422 - RNA, 13 nt, Human
ucuaagaagugaa

SEQ ID NO: 2756423 - RNA, 15 nt, Human
ucuaagugccuccaa

SEQ ID NO: 2756424 - RNA, 14 nt, Human
ucuaaguguuucau

SEQ ID NO: 2756425 - RNA, 17 nt, Human
ucuaaugagauauuaaa

SEQ ID NO: 2756426 - RNA, 18 nt, Human
ucuaauguacaauaaagc

SEQ ID NO: 2756427 - RNA, 17 nt, Human
ucuaauguugaguuauu

SEQ ID NO: 2756428 - RNA, 12 nt, Human
ucuaauuuaucu

SEQ ID NO: 2756429 - RNA, 16 nt, Human
ucuaauuuuuauuaau

SEQ ID NO: 2756430 - RNA, 12 nt, Human
ucuacaaaaaaa

SEQ ID NO: 2756431 - RNA, 23 nt, Human
ucuaccaaaaaucucaauauuuc

SEQ ID NO: 2756432 - RNA, 13 nt, Human
ucuaccacccacc

SEQ ID NO: 2756433 - RNA, 15 nt, Human
ucuaccacccaccag

SEQ ID NO: 2756434 - RNA, 18 nt, Human
ucuaccuggucucuccuu

SEQ ID NO: 2756435 - RNA, 22 nt, Human
ucuacuccauuaaauauaaagc

SEQ ID NO: 2756436 - RNA, 16 nt, Human
ucuacuggcugccaga

SEQ ID NO: 2756437 - RNA, 14 nt, Human
ucuacuuuuaaguu

SEQ ID NO: 2756438 - RNA, 18 nt, Human
ucuagaauacuaauaaaa

SEQ ID NO: 2756439 - RNA, 19 nt, Human
ucuagaauacuaauaaaau

SEQ ID NO: 2756440 - RNA, 13 nt, Human
ucuagagcaaagc

SEQ ID NO: 2756441 - RNA, 18 nt, Human
ucuagagcaaagccaucc

SEQ ID NO: 2756442 - RNA, 21 nt, Human
ucuagcaaauguuaugcauaa

SEQ ID NO: 2756443 - RNA, 18 nt, Human
ucugcuaccucacugggg

SEQ ID NO: 2756444 - RNA, 22 nt, Human
ucugcuaugcuauugaaguuuu

SEQ ID NO: 2756445 - RNA, 16 nt, Human
ucugcuugccaucccu

SEQ ID NO: 2756446 - RNA, 20 nt, Human
ucugcuugccaucccucccu

SEQ ID NO: 2756447 - RNA, 16 nt, Human
ucugcuuuaauuucau

SEQ ID NO: 2756448 - RNA, 18 nt, Human
ucugcuuucucgggaauu

SEQ ID NO: 2756449 - RNA, 23 nt, Human
ucuggacccguucaacuuuuccu

SEQ ID NO: 2756450 - RNA, 22 nt, Human
ucuggagcgcuucaguucagcu

SEQ ID NO: 2756451 - RNA, 14 nt, Human
ucuggagggaagcc

SEQ ID NO: 2756452 - RNA, 17 nt, Human
ucuggaggucucugaac

SEQ ID NO: 2756453 - RNA, 19 nt, Human
ucuggcaccaggaaucccc

SEQ ID NO: 2756454 - RNA, 13 nt, Human
ucuggccuucggc

SEQ ID NO: 2756455 - RNA, 17 nt, Human
ucuggcguuguggggau

SEQ ID NO: 2756456 - RNA, 17 nt, Human
ucuggcugcugguggcg

SEQ ID NO: 2756457 - RNA, 16 nt, Human
ucuggcuuuggaagcc

SEQ ID NO: 2756458 - RNA, 17 nt, Human
ucugggauagcugaccc

SEQ ID NO: 2756459 - RNA, 13 nt, Human
ucugggauccccc

SEQ ID NO: 2756460 - RNA, 20 nt, Human
ucugggcugugggcaagccu

SEQ ID NO: 2756461 - RNA, 14 nt, Human
ucuggggcauuauc

SEQ ID NO: 2756462 - RNA, 18 nt, Human
ucugggucucaguguccu

SEQ ID NO: 2756463 - RNA, 17 nt, Human
ucugguagcuaaauaua

SEQ ID NO: 2756464 - RNA, 22 nt, Human
ucugguagcuaaauauauauuu

SEQ ID NO: 2756465 - RNA, 18 nt, Human
ucugguugggcagccaga

SEQ ID NO: 2756466 - RNA, 17 nt, Human
ucuguaaaaucuuucuu

SEQ ID NO: 2756467 - RNA, 20 nt, Human
ucuguaaugccuuuucucac

SEQ ID NO: 2756468 - RNA, 22 nt, Human
ucuguauacaaaacccuuucug

SEQ ID NO: 2756469 - RNA, 16 nt, Human
ucuguauugcauuaaa

SEQ ID NO: 2756470 - RNA, 22 nt, Human
ucuguauuuccccaacauguaa

SEQ ID NO: 2756471 - RNA, 17 nt, Human
ucugucucaaaaaauaa

SEQ ID NO: 2756472 - RNA, 15 nt, Human
ucugucucaguccau

SEQ ID NO: 2756473 - RNA, 17 nt, Human
ucugucuucacaacaga

SEQ ID NO: 2756474 - RNA, 14 nt, Human
ucugugacccacuu

SEQ ID NO: 2756475 - RNA, 16 nt, Human
ucugugagaugcuaga

SEQ ID NO: 2756476 - RNA, 14 nt, Human
ucugugaucuugcu

SEQ ID NO: 2756477 - RNA, 16 nt, Human
ucuguuccuucacauc

SEQ ID NO: 2756478 - RNA, 16 nt, Human
ucuguucuuccaucac

SEQ ID NO: 2756479 - RNA, 16 nt, Human
ucuguugauggaaaua

SEQ ID NO: 2756480 - RNA, 12 nt, Human
ucuuaaagaauu

SEQ ID NO: 2756481 - RNA, 21 nt, Human
ucuuaaagaauuuucaaaauc

SEQ ID NO: 2756482 - RNA, 12 nt, Human
ucuuaagaagac

SEQ ID NO: 2756483 - RNA, 20 nt, Human
ucuuaauuaaaagaauauuu

SEQ ID NO: 2756484 - RNA, 15 nt, Human
ucuuacaaugaaaag

SEQ ID NO: 2756485 - RNA, 18 nt, Human
ucuuacucuguugccagg

SEQ ID NO: 2756486 - RNA, 13 nt, Human
ucuuagaugcagu

SEQ ID NO: 2756487 - RNA, 23 nt, Human
ucuuagaugcaguucugaagaag

SEQ ID NO: 2756488 - RNA, 13 nt, Human
ucuuauaauuuaa

SEQ ID NO: 2756489 - RNA, 16 nt, Human
ucuuauaauuuaaaau

SEQ ID NO: 2756490 - RNA, 15 nt, Human
ucuuauagaauauuu

SEQ ID NO: 2756491 - RNA, 15 nt, Human
ucuuaucuaaucaug

SEQ ID NO: 2756492 - RNA, 21 nt, Human
ucuuaucuuccuauaauuuua

SEQ ID NO: 2756493 - RNA, 22 nt, Human
ucuuauuauuuuugagacagag

SEQ ID NO: 2756494 - RNA, 18 nt, Human
ucuuauuuauucauauuu

SEQ ID NO: 2756495 - RNA, 13 nt, Human
ucuucaacucccu

SEQ ID NO: 2756496 - RNA, 16 nt, Human
ucuucaacucccugcc

SEQ ID NO: 2756497 - RNA, 15 nt, Human
ucuucacuugucauu

SEQ ID NO: 2756498 - RNA, 16 nt, Human
ucuucagcagagaagu

SEQ ID NO: 2756499 - RNA, 20 nt, Human
ucuucagcagagaaguuuuc

SEQ ID NO: 2756500 - RNA, 23 nt, Human
ucuucauguuucaggagagaguu

SEQ ID NO: 2756501 - RNA, 21 nt, Human
ucuucccaauugcuuuaccuu

SEQ ID NO: 2756502 - RNA, 20 nt, Human
ucuuccuauaauuuuagaca

SEQ ID NO: 2756503 - RNA, 17 nt, Human
ucuucguauucccauua

SEQ ID NO: 2756504 - RNA, 15 nt, Human
ucuucuaccacccac

SEQ ID NO: 2756505 - RNA, 18 nt, Human
ucuucuagguucuaaaaa

SEQ ID NO: 2756506 - RNA, 22 nt, Human
ucuucuauugccucugagagca

SEQ ID NO: 2756507 - RNA, 15 nt, Human
ucuucuccauccuac

SEQ ID NO: 2756508 - RNA, 20 nt, Human
ucuucuccuaaaacuuuaaa

SEQ ID NO: 2756509 - RNA, 20 nt, Human
ucuucuggguuccuuccucu

SEQ ID NO: 2756510 - RNA, 15 nt, Human
ucuucuuacuggugc

SEQ ID NO: 2756511 - RNA, 23 nt, Human
ucuucuuccaacguggcccagag

SEQ ID NO: 2756512 - RNA, 19 nt, Human
ucuucuuggucuuauuuau

SEQ ID NO: 2756513 - RNA, 21 nt, Human
ucuucuuugcccacaaugcuu

SEQ ID NO: 2756514 - RNA, 18 nt, Human
ucuucuuuuaaaccauuu

SEQ ID NO: 2756515 - RNA, 14 nt, Human
ucuugaaaaaugca

SEQ ID NO: 2756516 - RNA, 16 nt, Human
ucuugaaaaaugcaug

SEQ ID NO: 2756517 - RNA, 20 nt, Human
ucuugaaaaaugcauguugc

SEQ ID NO: 2756518 - RNA, 18 nt, Human
ucuugaagggcaggugcu

SEQ ID NO: 2756519 - RNA, 18 nt, Human
ucuugaaucucugaauuu

SEQ ID NO: 2756520 - RNA, 20 nt, Human
ucuugaaucucugaauuuga

SEQ ID NO: 2756521 - RNA, 13 nt, Human
ucuugaccucgug

SEQ ID NO: 2756522 - RNA, 22 nt, Human
ucuugaggcacagaaacuccug

SEQ ID NO: 2756523 - RNA, 20 nt, Human
ucuugcagggguagccugag

SEQ ID NO: 2756524 - RNA, 14 nt, Human
ucuugucucugggc

SEQ ID NO: 2756525 - RNA, 15 nt, Human
ucuuguuuuuccacu

SEQ ID NO: 2756526 - RNA, 12 nt, Human
ucuuuaaaauac

SEQ ID NO: 2756527 - RNA, 13 nt, Human
ucuuuaaaauaca

SEQ ID NO: 2756528 - RNA, 15 nt, Human
ucuuuaauuuuacau

SEQ ID NO: 2756529 - RNA, 15 nt, Human
ucuuuacugcacuca

SEQ ID NO: 2756530 - RNA, 17 nt, Human
ucuuuacuuuccccuug

SEQ ID NO: 2756531 - RNA, 18 nt, Human
ucuuuaggcauuaaauuu

SEQ ID NO: 2756532 - RNA, 19 nt, Human
ucuuuaggcauuaaauuuu

SEQ ID NO: 2756533 - RNA, 13 nt, Human
ucuuuaguuuuug

SEQ ID NO: 2756534 - RNA, 17 nt, Human
ucuuuaucuuuuuagua

SEQ ID NO: 2756535 - RNA, 14 nt, Human
ucuuuauucagccc

SEQ ID NO: 2756536 - RNA, 12 nt, Human
ucuuucaaaauu

SEQ ID NO: 2756537 - RNA, 19 nt, Human
ucuuucaaagugucuugaa

SEQ ID NO: 2756538 - RNA, 17 nt, Human
ucuuucacauuuaaaua

SEQ ID NO: 2756539 - RNA, 17 nt, Human
ucuuucacuaucuguaa

SEQ ID NO: 2756540 - RNA, 12 nt, Human
ucuuucaugaag

SEQ ID NO: 2756541 - RNA, 15 nt, Human
ucuuuccacagaagc

SEQ ID NO: 2756542 - RNA, 23 nt, Human
ucuuucuaaugagauauuaaacc

SEQ ID NO: 2756543 - RNA, 17 nt, Human
ucuuucuuuauuuugag

SEQ ID NO: 2756544 - RNA, 15 nt, Human
ucuuucuuuuuuaaa

SEQ ID NO: 2756545 - RNA, 21 nt, Human
ucuuugccuuuauaaucuuuu

SEQ ID NO: 2756546 - RNA, 16 nt, Human
ucuuuggcugaaagga

SEQ ID NO: 2756547 - RNA, 18 nt, Human
ucuuugguggagauaaag

SEQ ID NO: 2756548 - RNA, 20 nt, Human
ucuuuguaaugaaaaccaca

SEQ ID NO: 2756549 - RNA, 19 nt, Human
ucuuuguucuucuaccacc

SEQ ID NO: 2756550 - RNA, 21 nt, Human
ucuuuuaggacccuucccuug

SEQ ID NO: 2756551 - RNA, 14 nt, Human
ucuuuuauuuugcc

SEQ ID NO: 2756552 - RNA, 15 nt, Human
ucuuuucauacauuu

SEQ ID NO: 2756553 - RNA, 18 nt, Human
ucuuuuuucuaaaguaaa

SEQ ID NO: 2756554 - RNA, 15 nt, Human
ucuuuuuuucuugaa

SEQ ID NO: 2756555 - RNA, 21 nt, Human
ucuuuuuuugugguuagaaaa

SEQ ID NO: 2756556 - RNA, 17 nt, Human
ugaaaaaaaauuuuaua

SEQ ID NO: 2756557 - RNA, 23 nt, Human
ugaaaaacuauuaacaacuuguc

SEQ ID NO: 2756558 - RNA, 19 nt, Human
ugaaaaaguucugcagaua

SEQ ID NO: 2756559 - RNA, 17 nt, Human
ugaaaacaauucuuauu

SEQ ID NO: 2756560 - RNA, 15 nt, Human
ugaaaaccacauugg

SEQ ID NO: 2756561 - RNA, 16 nt, Human
ugaaaacuggcuacug

SEQ ID NO: 2756562 - RNA, 18 nt, Human
ugaaaagacuccaaagaa

SEQ ID NO: 2756563 - RNA, 17 nt, Human
ugaaaagauuaugaucu

SEQ ID NO: 2756564 - RNA, 22 nt, Human
ugaaaauaagacggauuuauuu

SEQ ID NO: 2756565 - RNA, 18 nt, Human
ugaaaaucuacacuccag

SEQ ID NO: 2756566 - RNA, 13 nt, Human
ugaaaaucuuaua

SEQ ID NO: 2756567 - RNA, 17 nt, Human
ugaaaaucuuauaauuu

SEQ ID NO: 2756568 - RNA, 14 nt, Human
ugaaacaacaaaua

SEQ ID NO: 2756569 - RNA, 19 nt, Human
ugaaacauuacaguuagag

SEQ ID NO: 2756570 - RNA, 22 nt, Human
ugaaaccaugaagagauuuuuc

SEQ ID NO: 2756571 - RNA, 22 nt, Human
ugaaaccccgucucuacuaaaa

SEQ ID NO: 2756572 - RNA, 20 nt, Human
ugaaaccccuauguggaggc

SEQ ID NO: 2756573 - RNA, 15 nt, Human
ugaaacccugucucu

SEQ ID NO: 2756574 - RNA, 15 nt, Human
ugaaacucauagaca

SEQ ID NO: 2756575 - RNA, 16 nt, Human
ugaaacugagauguga

SEQ ID NO: 2756576 - RNA, 22 nt, Human
ugaaacugagaugugaacacau

SEQ ID NO: 2756577 - RNA, 13 nt, Human
ugaaagaaaauaa

SEQ ID NO: 2756578 - RNA, 14 nt, Human
ugaaagaaaauaac

SEQ ID NO: 2756579 - RNA, 15 nt, Human
ugaaagaaaauaaca

SEQ ID NO: 2756580 - RNA, 19 nt, Human
ugaaagaggaaugaaguac

SEQ ID NO: 2756581 - RNA, 21 nt, Human
ugaaagaggcagcuugaaacu

SEQ ID NO: 2756582 - RNA, 22 nt, Human
ugaaagcagggacuugaaccca

SEQ ID NO: 2756583 - RNA, 13 nt, Human
ugaaagcguaaag

SEQ ID NO: 2756584 - RNA, 14 nt, Human
ugaaagcuuuauuu

SEQ ID NO: 2756585 - RNA, 19 nt, Human
ugaaaggaagcugugcgug

SEQ ID NO: 2756586 - RNA, 15 nt, Human
ugaaagguacuucaa

SEQ ID NO: 2756587 - RNA, 14 nt, Human
ugaaagucccagau

SEQ ID NO: 2756588 - RNA, 16 nt, Human
ugagcagucaggaaag

SEQ ID NO: 2756589 - RNA, 20 nt, Human
ugagcagugcuugaaugaag

SEQ ID NO: 2756590 - RNA, 18 nt, Human
ugagccaccaagcuggug

SEQ ID NO: 2756591 - RNA, 16 nt, Human
ugagccacccugccca

SEQ ID NO: 2756592 - RNA, 19 nt, Human
ugagccaggaggccugcua

SEQ ID NO: 2756593 - RNA, 11 nt, Human
ugagcccaugg

SEQ ID NO: 2756594 - RNA, 18 nt, Human
ugagccugccuuucuccc

SEQ ID NO: 2756595 - RNA, 12 nt, Human
ugagccuuggga

SEQ ID NO: 2756596 - RNA, 13 nt, Human
ugagcgacaguga

SEQ ID NO: 2756597 - RNA, 16 nt, Human
ugagcgacagugagac

SEQ ID NO: 2756598 - RNA, 15 nt, Human
ugagcgcccacuaga

SEQ ID NO: 2756599 - RNA, 20 nt, Human
ugagcgcccacuagacccac

SEQ ID NO: 2756600 - RNA, 20 nt, Human
ugagcgcucagcuucaagaa

SEQ ID NO: 2756601 - RNA, 13 nt, Human
ugagcggaccuuc

SEQ ID NO: 2756602 - RNA, 15 nt, Human
ugagcggaccuuccc

SEQ ID NO: 2756603 - RNA, 19 nt, Human
ugagcggaccuucccagcu

SEQ ID NO: 2756604 - RNA, 16 nt, Human
ugagcuacaaaugcau

SEQ ID NO: 2756605 - RNA, 14 nt, Human
ugagcuaggggggu

SEQ ID NO: 2756606 - RNA, 18 nt, Human
ugagcuaggggggucagc

SEQ ID NO: 2756607 - RNA, 21 nt, Human
ugagcuaggggggucagccag

SEQ ID NO: 2756608 - RNA, 14 nt, Human
ugagcucagcccug

SEQ ID NO: 2756609 - RNA, 16 nt, Human
ugagcucaggagguca

SEQ ID NO: 2756610 - RNA, 15 nt, Human
ugagcucgguggacc

SEQ ID NO: 2756611 - RNA, 14 nt, Human
ugagcugaagguga

SEQ ID NO: 2756612 - RNA, 14 nt, Human
ugagcuugcagaga

SEQ ID NO: 2756613 - RNA, 21 nt, Human
ugaggagcuggaaacacaugu

SEQ ID NO: 2756614 - RNA, 18 nt, Human
ugaggagcuguugaggua

SEQ ID NO: 2756615 - RNA, 19 nt, Human
ugaggcacaugucagcaag

SEQ ID NO: 2756616 - RNA, 17 nt, Human
ugaggcagacagcagcu

SEQ ID NO: 2756617 - RNA, 14 nt, Human
ugaggcaggaggau

SEQ ID NO: 2756618 - RNA, 18 nt, Human
ugaggcaggcacugccaa

SEQ ID NO: 2756619 - RNA, 19 nt, Human
ugaggccagggagcgagug

SEQ ID NO: 2756620 - RNA, 20 nt, Human
ugaggcuccacuuggucugu

SEQ ID NO: 2756621 - RNA, 16 nt, Human
ugaggcuucuggggcu

SEQ ID NO: 2756622 - RNA, 17 nt, Human
ugaggcuucuggggcuu

SEQ ID NO: 2756623 - RNA, 21 nt, Human
ugagggcuugaggacuugggc

SEQ ID NO: 2756624 - RNA, 22 nt, Human
ugagggggugggggugccgcug

SEQ ID NO: 2756625 - RNA, 21 nt, Human
ugaggggugggggugccgcug

SEQ ID NO: 2756626 - RNA, 23 nt, Human
ugagggugggggugcucucucug

SEQ ID NO: 2756627 - RNA, 15 nt, Human
ugagguaaaagcauc

SEQ ID NO: 2756628 - RNA, 15 nt, Human
ugagguaaccucauu

SEQ ID NO: 2756629 - RNA, 14 nt, Human
ugaggucaggaguu

SEQ ID NO: 2756630 - RNA, 14 nt, Human
ugagguugugugug

SEQ ID NO: 2756631 - RNA, 19 nt, Human
ugagucacuacgccuggcu

SEQ ID NO: 2756632 - RNA, 23 nt, Human
ugagucagucugaugagaacucu

SEQ ID NO: 2756633 - RNA, 20 nt, Human
ugagucccaggcugagccuc

SEQ ID NO: 2756634 - RNA, 16 nt, Human
ugaguccuccugucca

SEQ ID NO: 2756635 - RNA, 20 nt, Human
ugaguccuccuguccagccu

SEQ ID NO: 2756636 - RNA, 16 nt, Human
ugaguuuaaauuguaa

SEQ ID NO: 2756637 - RNA, 13 nt, Human
ugaguuucuuuuu

SEQ ID NO: 2756638 - RNA, 22 nt, Human
ugaguuuuucuuuucauuuacc

SEQ ID NO: 2756639 - RNA, 22 nt, Human
ugauaaauggcuuccuggcaau

SEQ ID NO: 2756640 - RNA, 15 nt, Human
ugauaagaucuuuua

SEQ ID NO: 2756641 - RNA, 13 nt, Human
ugauaauaaaauu

SEQ ID NO: 2756642 - RNA, 19 nt, Human
ugauaccugggauacugug

SEQ ID NO: 2756643 - RNA, 15 nt, Human
ugauacuugaaaauu

SEQ ID NO: 2756644 - RNA, 13 nt, Human
ugauagcuuuauu

SEQ ID NO: 2756645 - RNA, 20 nt, Human
ugauaugggucuugauaaau

SEQ ID NO: 2756646 - RNA, 15 nt, Human
ugauaugugaacagu

SEQ ID NO: 2756647 - RNA, 21 nt, Human
ugauauuggacaguaaaaucc

SEQ ID NO: 2756648 - RNA, 22 nt, Human
ugauauuggacaguaaaaucca

SEQ ID NO: 2756649 - RNA, 16 nt, Human
ugaucaaauugugcag

SEQ ID NO: 2756650 - RNA, 17 nt, Human
ugaucaccugcccugcu

SEQ ID NO: 2756651 - RNA, 18 nt, Human
ugaucagcuuauugucua

SEQ ID NO: 2756652 - RNA, 19 nt, Human
ugaucaguaugaaaauguc

SEQ ID NO: 2756653 - RNA, 16 nt, Human
ugauccacccgccuca

SEQ ID NO: 2756654 - RNA, 20 nt, Human
ugauccacccgccucagccu

SEQ ID NO: 2756655 - RNA, 15 nt, Human
ugauccagaaagaaa

SEQ ID NO: 2756656 - RNA, 10 nt, Human
ugauccccac

SEQ ID NO: 2756657 - RNA, 15 nt, Human
ugauccccacgccac

SEQ ID NO: 2756658 - RNA, 12 nt, Human
ugauccugcaau

SEQ ID NO: 2756659 - RNA, 15 nt, Human
ugaucucagaaauug

SEQ ID NO: 2756660 - RNA, 13 nt, Human
ugaucuuuaaaau

SEQ ID NO: 2756661 - RNA, 12 nt, Human
ugaugaaaacau

SEQ ID NO: 2756662 - RNA, 13 nt, Human
ugaugaagaaguu

SEQ ID NO: 2756663 - RNA, 14 nt, Human
ugaugaucuuuaaa

SEQ ID NO: 2756664 - RNA, 16 nt, Human
ugaugaucuuuaaaau

SEQ ID NO: 2756665 - RNA, 17 nt, Human
ugaugcuuugagaacau

SEQ ID NO: 2756666 - RNA, 19 nt, Human
ugauggaguuucucuagaa

SEQ ID NO: 2756667 - RNA, 16 nt, Human
ugaugggcaaaaaacc

SEQ ID NO: 2756668 - RNA, 23 nt, Human
ugauggguuucuccagagggaau

SEQ ID NO: 2756669 - RNA, 21 nt, Human
ugauggucccuauuccuccuu

SEQ ID NO: 2756670 - RNA, 19 nt, Human
ugauggugguauguuuuca

SEQ ID NO: 2756671 - RNA, 12 nt, Human
ugauguuguguu

SEQ ID NO: 2756672 - RNA, 13 nt, Human
ugauguuuagaaa

SEQ ID NO: 2756673 - RNA, 23 nt, Human
ugauguuucauaagaauucuguu

SEQ ID NO: 2756674 - RNA, 13 nt, Human
ugauuaaguaaug

SEQ ID NO: 2756675 - RNA, 22 nt, Human
ugauuaaguaaugauaacugga

SEQ ID NO: 2756676 - RNA, 19 nt, Human
ugauuacaaggcuuuaucu

SEQ ID NO: 2756677 - RNA, 20 nt, Human
ugauuauaugucacuuugcu

SEQ ID NO: 2756678 - RNA, 15 nt, Human
ugauuauuauuuuag

SEQ ID NO: 2756679 - RNA, 19 nt, Human
ugauuauuuucuacacaua

SEQ ID NO: 2756680 - RNA, 12 nt, Human
ugauucaaaugu

SEQ ID NO: 2756681 - RNA, 15 nt, Human
ugauucaaaugucua

SEQ ID NO: 2756682 - RNA, 20 nt, Human
ugauucacccugauuuuaca

SEQ ID NO: 2756683 - RNA, 16 nt, Human
ugauuccaucuugccc

SEQ ID NO: 2756684 - RNA, 18 nt, Human
ugauuccuugauggagau

SEQ ID NO: 2756685 - RNA, 22 nt, Human
ugauugugggauacuauuuaau

SEQ ID NO: 2756686 - RNA, 17 nt, Human
ugauuuccacagugacu

SEQ ID NO: 2756687 - RNA, 20 nt, Human
ugauuucugagcauuuaaua

SEQ ID NO: 2756688 - RNA, 15 nt, Human
ugauuuuaauaauau

SEQ ID NO: 2756689 - RNA, 20 nt, Human
ugauuuuacaauugaaauga

SEQ ID NO: 2756690 - RNA, 17 nt, Human
ugauuuuauaugcuauu

SEQ ID NO: 2756691 - RNA, 11 nt, Human
ugauuuucauu

SEQ ID NO: 2756692 - RNA, 16 nt, Human
ugauuuugugauugau

SEQ ID NO: 2756693 - RNA, 19 nt, Human
ugauuuuuguaguuuuagu

SEQ ID NO: 2756694 - RNA, 20 nt, Human
ugcaaagcacugacuucuaa

SEQ ID NO: 2756695 - RNA, 17 nt, Human
ugcaaaguuuaauggug

SEQ ID NO: 2756696 - RNA, 17 nt, Human
ugcaaauacucuggucc

SEQ ID NO: 2756697 - RNA, 17 nt, Human
ugcaaauauaucugcua

SEQ ID NO: 2756698 - RNA, 13 nt, Human
ugcaacaaaauuc

SEQ ID NO: 2756699 - RNA, 15 nt, Human
ugcaaccuccaccuu

SEQ ID NO: 2756700 - RNA, 13 nt, Human
ugcaaccucugcc

SEQ ID NO: 2756701 - RNA, 16 nt, Human
ugcaaccucugccucc

SEQ ID NO: 2756702 - RNA, 19 nt, Human
ugcaaccucugccucccag

SEQ ID NO: 2756703 - RNA, 18 nt, Human
ugcaagaagaaaucauga

SEQ ID NO: 2756704 - RNA, 17 nt, Human
ugcaagacauagaauag

SEQ ID NO: 2756705 - RNA, 13 nt, Human
ugcaagaguuuaa

SEQ ID NO: 2756706 - RNA, 22 nt, Human
ugcaauaaaauggguuuuacug

SEQ ID NO: 2756707 - RNA, 20 nt, Human
ugcaauaaaauguauuuguu

SEQ ID NO: 2756708 - RNA, 23 nt, Human
ugcaauauuugaauuuuaaaucu

SEQ ID NO: 2756709 - RNA, 13 nt, Human
ugcacaaaccaau

SEQ ID NO: 2756710 - RNA, 12 nt, Human
ugcacauaucca

SEQ ID NO: 2756711 - RNA, 21 nt, Human
ugcacauauccaggcaccagg

SEQ ID NO: 2756712 - RNA, 16 nt, Human
ugcacaucaaaauaug

SEQ ID NO: 2756713 - RNA, 19 nt, Human
ugcaccaacuuugaagucu

SEQ ID NO: 2756714 - RNA, 14 nt, Human
ugcaccaugcugcu

SEQ ID NO: 2756715 - RNA, 15 nt, Human
ugcaccaugcugcug

SEQ ID NO: 2756716 - RNA, 14 nt, Human
ugcaccuccaugga

SEQ ID NO: 2756717 - RNA, 18 nt, Human
ugcaccugugccgucccc

SEQ ID NO: 2756718 - RNA, 15 nt, Human
ugcacgaauggaaga

SEQ ID NO: 2756719 - RNA, 22 nt, Human
ugcacgcacacugucugccccc

SEQ ID NO: 2756720 - RNA, 17 nt, Human
ugcacuaaucaauacuu

SEQ ID NO: 2756721 - RNA, 19 nt, Human
ugcacuccagccugagcga

SEQ ID NO: 2756722 - RNA, 19 nt, Human
ugcacugucaagaugauga

SEQ ID NO: 2756723 - RNA, 17 nt, Human
ugcacuuggcugcauaa

SEQ ID NO: 2756724 - RNA, 14 nt, Human
ugcagaagacagua

SEQ ID NO: 2756725 - RNA, 20 nt, Human
ugcagacucacugugggaag

SEQ ID NO: 2756726 - RNA, 12 nt, Human
ugcagagacagg

SEQ ID NO: 2756727 - RNA, 23 nt, Human
ugcagagguccacaacacacaga

SEQ ID NO: 2756728 - RNA, 15 nt, Human
ugcagauaaacagua

SEQ ID NO: 2756729 - RNA, 17 nt, Human
ugcagauaaacaguagu

SEQ ID NO: 2756730 - RNA, 21 nt, Human
ugcagcauuuacuaugcacaa

SEQ ID NO: 2756731 - RNA, 14 nt, Human
ugcagccaccaguc

SEQ ID NO: 2756732 - RNA, 15 nt, Human
ugcagccaccagucc

SEQ ID NO: 2756733 - RNA, 20 nt, Human
ugcagccaccaguccauugg

SEQ ID NO: 2756734 - RNA, 20 nt, Human
ugcuacaaaaacacagcaag

SEQ ID NO: 2756735 - RNA, 20 nt, Human
ugcuacagggcucacagaau

SEQ ID NO: 2756736 - RNA, 19 nt, Human
ugcuagaacagucucuuga

SEQ ID NO: 2756737 - RNA, 21 nt, Human
ugcuagaacucccuuucaaca

SEQ ID NO: 2756738 - RNA, 20 nt, Human
ugcuaggguuaggagguccu

SEQ ID NO: 2756739 - RNA, 15 nt, Human
ugcuaguaauuggaa

SEQ ID NO: 2756740 - RNA, 18 nt, Human
ugcuaguggauuuuacau

SEQ ID NO: 2756741 - RNA, 12 nt, Human
ugcuaucgccau

SEQ ID NO: 2756742 - RNA, 12 nt, Human
ugcuauguuuug

SEQ ID NO: 2756743 - RNA, 22 nt, Human
ugcuauucuccauacucuguaa

SEQ ID NO: 2756744 - RNA, 16 nt, Human
ugcuauugaaguuuug

SEQ ID NO: 2756745 - RNA, 19 nt, Human
ugcuauugggguugggggg

SEQ ID NO: 2756746 - RNA, 20 nt, Human
ugcuauugggguuggggggg

SEQ ID NO: 2756747 - RNA, 14 nt, Human
ugcuauuugcuguu

SEQ ID NO: 2756748 - RNA, 19 nt, Human
ugcuauuugcuguuauuuu

SEQ ID NO: 2756749 - RNA, 21 nt, Human
ugcucaauaaaguacaagagc

SEQ ID NO: 2756750 - RNA, 15 nt, Human
ugcucagaaauguca

SEQ ID NO: 2756751 - RNA, 23 nt, Human
ugcucagaaaugucauguggcua

SEQ ID NO: 2756752 - RNA, 19 nt, Human
ugcucagcccugcaccaug

SEQ ID NO: 2756753 - RNA, 23 nt, Human
ugcucagcccugcaccaugcugc

SEQ ID NO: 2756754 - RNA, 12 nt, Human
ugcucagcuucu

SEQ ID NO: 2756755 - RNA, 17 nt, Human
ugcucaggagcccuggg

SEQ ID NO: 2756756 - RNA, 20 nt, Human
ugcucaggagcccugggagg

SEQ ID NO: 2756757 - RNA, 23 nt, Human
ugcucagggacucaucuuucccu

SEQ ID NO: 2756758 - RNA, 12 nt, Human
ugcucagggcug

SEQ ID NO: 2756759 - RNA, 19 nt, Human
ugcucagggcuggucuuuu

SEQ ID NO: 2756760 - RNA, 12 nt, Human
ugcucauggaau

SEQ ID NO: 2756761 - RNA, 13 nt, Human
ugcucauuuuuuc

SEQ ID NO: 2756762 - RNA, 17 nt, Human
ugcucauuuuuucuucu

SEQ ID NO: 2756763 - RNA, 16 nt, Human
ugcuccuggcuggggc

SEQ ID NO: 2756764 - RNA, 15 nt, Human
ugcucgcccacuucc

SEQ ID NO: 2756765 - RNA, 16 nt, Human
ugcucgcccacuuccu

SEQ ID NO: 2756766 - RNA, 19 nt, Human
ugcucgcccacuuccuccc

SEQ ID NO: 2756767 - RNA, 17 nt, Human
ugcucuaugugcuugua

SEQ ID NO: 2756768 - RNA, 20 nt, Human
ugcucucggugcuuccaacu

SEQ ID NO: 2756769 - RNA, 12 nt, Human
ugcucucucuga

SEQ ID NO: 2756770 - RNA, 14 nt, Human
ugcucucucugagg

SEQ ID NO: 2756771 - RNA, 12 nt, Human
ugcucugauuua

SEQ ID NO: 2756772 - RNA, 16 nt, Human
ugcucuggacuugccu

SEQ ID NO: 2756773 - RNA, 17 nt, Human
ugcucuggacuugccuc

SEQ ID NO: 2756774 - RNA, 15 nt, Human
ugcucugucuucuuu

SEQ ID NO: 2756775 - RNA, 23 nt, Human
ugcucuguugagccuuccuuucu

SEQ ID NO: 2756776 - RNA, 14 nt, Human
ugcucuuccucagc

SEQ ID NO: 2756777 - RNA, 13 nt, Human
ugcucuugaugcc

SEQ ID NO: 2756778 - RNA, 16 nt, Human
ugcugaacucccucuc

SEQ ID NO: 2756779 - RNA, 23 nt, Human
ugcugacacagacauccucuaug

SEQ ID NO: 2756780 - RNA, 21 nt, Human
ugcugagccccaaguggaacg

SEQ ID NO: 2756781 - RNA, 14 nt, Human
ugcugcagccccug

SEQ ID NO: 2756782 - RNA, 20 nt, Human
ugcugcccuuccccuuccca

SEQ ID NO: 2756783 - RNA, 12 nt, Human
ugcugcugggga

SEQ ID NO: 2756784 - RNA, 13 nt, Human
ugcugcuggggaa

SEQ ID NO: 2756785 - RNA, 17 nt, Human
ugcugcuggggaagaca

SEQ ID NO: 2756786 - RNA, 17 nt, Human
ugcuggaaauggacaca

SEQ ID NO: 2756787 - RNA, 17 nt, Human
ugcuggagacauugagg

SEQ ID NO: 2756788 - RNA, 22 nt, Human
ugcuggagacauugaggcaggc

SEQ ID NO: 2756789 - RNA, 20 nt, Human
ugcuggauucaagugauccg

SEQ ID NO: 2756790 - RNA, 23 nt, Human
ugcuggauucaagugauccgccc

SEQ ID NO: 2756791 - RNA, 14 nt, Human
ugcuggggaagaca

SEQ ID NO: 2756792 - RNA, 18 nt, Human
ugcuggggaagacagugg

SEQ ID NO: 2756793 - RNA, 22 nt, Human
ugcugguggcgcuggcugcgcu

SEQ ID NO: 2756794 - RNA, 15 nt, Human
ugcugguuuuucagu

SEQ ID NO: 2756795 - RNA, 15 nt, Human
ugcuguauaaaauca

SEQ ID NO: 2756796 - RNA, 16 nt, Human
ugcuguauuuuaaaag

SEQ ID NO: 2756797 - RNA, 21 nt, Human
ugcugucauaaugguuuuuaa

SEQ ID NO: 2756798 - RNA, 14 nt, Human
ugcuguccuggagg

SEQ ID NO: 2756799 - RNA, 16 nt, Human
ugcugugcagucccug

SEQ ID NO: 2756800 - RNA, 18 nt, Human
ugcugugcagucccugca

SEQ ID NO: 2756801 - RNA, 16 nt, Human
ugcuguucaugaaaga

SEQ ID NO: 2756802 - RNA, 20 nt, Human
ugcuuaaggccaugauuuua

SEQ ID NO: 2756803 - RNA, 15 nt, Human
ugcuucuccagccuc

SEQ ID NO: 2756804 - RNA, 19 nt, Human
ugcuucuccagccucagcc

SEQ ID NO: 2756805 - RNA, 20 nt, Human
ugcuucuccagccucagccu

SEQ ID NO: 2756806 - RNA, 14 nt, Human
ugcuugauuguaug

SEQ ID NO: 2756807 - RNA, 11 nt, Human
ugcuugccauc

SEQ ID NO: 2756808 - RNA, 19 nt, Human
ugcuugccaucccucccuc

SEQ ID NO: 2756809 - RNA, 22 nt, Human
ugcuugccaucccucccuccac

SEQ ID NO: 2756810 - RNA, 19 nt, Human
ugcuugucccuguggaagu

SEQ ID NO: 2756811 - RNA, 14 nt, Human
ugcuuguuagcaaa

SEQ ID NO: 2756812 - RNA, 18 nt, Human
ugcuuguuagcaaaaugg

SEQ ID NO: 2756813 - RNA, 19 nt, Human
ugcuuguuagcaaaaugga

SEQ ID NO: 2756814 - RNA, 20 nt, Human
ugcuuguuggauuuuugucu

SEQ ID NO: 2756815 - RNA, 11 nt, Human
ugcuuucuucu

SEQ ID NO: 2756816 - RNA, 13 nt, Human
ugcuuucuucucc

SEQ ID NO: 2756817 - RNA, 16 nt, Human
ugcuuugaaaaugcug

SEQ ID NO: 2756818 - RNA, 16 nt, Human
ugcuuuggaaaaccca

SEQ ID NO: 2756819 - RNA, 19 nt, Human
ugcuuuuaaaaaaaaauac

SEQ ID NO: 2756820 - RNA, 12 nt, Human
ugcuuuuaaaau

SEQ ID NO: 2756821 - RNA, 15 nt, Human
ugcuuuuaaaaucca

SEQ ID NO: 2756822 - RNA, 15 nt, Human
ugcuuuuccccaagu

SEQ ID NO: 2756823 - RNA, 12 nt, Human
ugcuuuuuaugg

SEQ ID NO: 2756824 - RNA, 19 nt, Human
ugcuuuuuauggccuguga

SEQ ID NO: 2756825 - RNA, 12 nt, Human
uggaaaacugcu

SEQ ID NO: 2756826 - RNA, 12 nt, Human
uggaaaaugaau

SEQ ID NO: 2756827 - RNA, 16 nt, Human
uggaaagaaguugggg

SEQ ID NO: 2756828 - RNA, 15 nt, Human
uggaaagcagccugg

SEQ ID NO: 2756829 - RNA, 15 nt, Human
uggaaauaaaagauu

SEQ ID NO: 2756830 - RNA, 23 nt, Human
uggaaaucaggguuaguauuguc

SEQ ID NO: 2756831 - RNA, 20 nt, Human
uggaacagauuucaaaaaaa

SEQ ID NO: 2756832 - RNA, 17 nt, Human
uggaacauaaaauacaa

SEQ ID NO: 2756833 - RNA, 22 nt, Human
uggaagccagaucuaugccaca

SEQ ID NO: 2756834 - RNA, 16 nt, Human
uggaaggcaagauugu

SEQ ID NO: 2756835 - RNA, 19 nt, Human
uggaaguaaauguuguuuu

SEQ ID NO: 2756836 - RNA, 18 nt, Human
uggaaugccgcugucucu

SEQ ID NO: 2756837 - RNA, 14 nt, Human
uggaauuggagcuc

SEQ ID NO: 2756838 - RNA, 17 nt, Human
uggaauuggagcucgug

SEQ ID NO: 2756839 - RNA, 18 nt, Human
uggacacacaaauuaucu

SEQ ID NO: 2756840 - RNA, 14 nt, Human
uggacaguuuucug

SEQ ID NO: 2756841 - RNA, 13 nt, Human
uggacaucaaaau

SEQ ID NO: 2756842 - RNA, 17 nt, Human
uggacaucaaaaucaac

SEQ ID NO: 2756843 - RNA, 14 nt, Human
uggaccucaccaag

SEQ ID NO: 2756844 - RNA, 18 nt, Human
uggaccucaccaagcugc

SEQ ID NO: 2756845 - RNA, 13 nt, Human
uggacgagaaaac

SEQ ID NO: 2756846 - RNA, 15 nt, Human
uggacgagaaaacaa

SEQ ID NO: 2756847 - RNA, 18 nt, Human
uggacgagaaaacaauaa

SEQ ID NO: 2756848 - RNA, 20 nt, Human
uggacgagaaaacaauaacg

SEQ ID NO: 2756849 - RNA, 22 nt, Human
uggacgagaaaacaauaacgau

SEQ ID NO: 2756850 - RNA, 23 nt, Human
uggacgagaaaacaauaacgaua

SEQ ID NO: 2756851 - RNA, 22 nt, Human
uggacuaaaagauauaagugcu

SEQ ID NO: 2756852 - RNA, 14 nt, Human
uggacucaccuccc

SEQ ID NO: 2756853 - RNA, 15 nt, Human
uggacucaccucccc

SEQ ID NO: 2756854 - RNA, 18 nt, Human
uggacucauuuuaaaaaa

SEQ ID NO: 2756855 - RNA, 21 nt, Human
uggacugugugcucaggagcc

SEQ ID NO: 2756856 - RNA, 16 nt, Human
uggacuguuuuuaaaa

SEQ ID NO: 2756857 - RNA, 13 nt, Human
uggacuuccauuu

SEQ ID NO: 2756858 - RNA, 17 nt, Human
uggacuuccauuuggaa

SEQ ID NO: 2756859 - RNA, 18 nt, Human
uggacuucugccagcaua

SEQ ID NO: 2756860 - RNA, 18 nt, Human
uggacuugccuccagaga

SEQ ID NO: 2756861 - RNA, 18 nt, Human
uggagaaaggacccucaa

SEQ ID NO: 2756862 - RNA, 20 nt, Human
uggagaaaggacccucaaga

SEQ ID NO: 2756863 - RNA, 13 nt, Human
uggagacaccacc

SEQ ID NO: 2756864 - RNA, 14 nt, Human
uggagacaccacca

SEQ ID NO: 2756865 - RNA, 15 nt, Human
uggagacaccaccac

SEQ ID NO: 2756866 - RNA, 16 nt, Human
uggagacaccaccacc

SEQ ID NO: 2756867 - RNA, 15 nt, Human
uggagacaucuggaa

SEQ ID NO: 2756868 - RNA, 16 nt, Human
uggagacauugaggca

SEQ ID NO: 2756869 - RNA, 22 nt, Human
uggagacauugaggcaggcacu

SEQ ID NO: 2756870 - RNA, 15 nt, Human
uggagaucaccagug

SEQ ID NO: 2756871 - RNA, 22 nt, Human
uggagaucaccaguguguggcu

SEQ ID NO: 2756872 - RNA, 19 nt, Human
uggagcaggggugcuggga

SEQ ID NO: 2756873 - RNA, 15 nt, Human
uggagcuagaauuug

SEQ ID NO: 2756874 - RNA, 16 nt, Human
uggagcucgugggaca

SEQ ID NO: 2756875 - RNA, 19 nt, Human
uggagcugccucucucauc

SEQ ID NO: 2756876 - RNA, 13 nt, Human
uggaggccugucc

SEQ ID NO: 2756877 - RNA, 23 nt, Human
uggaggcggaauugcucucccag

SEQ ID NO: 2756878 - RNA, 23 nt, Human
uggagggaagccuuggggcugau

SEQ ID NO: 2756879 - RNA, 23 nt, Human
uggugagccaagcaguuugaaau

SEQ ID NO: 2756880 - RNA, 17 nt, Human
uggugauuccgcaguga

SEQ ID NO: 2756881 - RNA, 14 nt, Human
uggugccucaguuu

SEQ ID NO: 2756882 - RNA, 18 nt, Human
uggugcuuccaaauauug

SEQ ID NO: 2756883 - RNA, 23 nt, Human
ugguggcaggaaaauggacauca

SEQ ID NO: 2756884 - RNA, 14 nt, Human
ugguggccuggggc

SEQ ID NO: 2756885 - RNA, 18 nt, Human
ugguguacauucuuccug

SEQ ID NO: 2756886 - RNA, 18 nt, Human
uggugugcuggcuuaaaa

SEQ ID NO: 2756887 - RNA, 22 nt, Human
uggugugcuggcuuaaaaugua

SEQ ID NO: 2756888 - RNA, 17 nt, Human
ugguguuugguuucuuc

SEQ ID NO: 2756889 - RNA, 18 nt, Human
ugguucuaauagaacuca

SEQ ID NO: 2756890 - RNA, 22 nt, Human
ugguucuucuuggucucagugu

SEQ ID NO: 2756891 - RNA, 20 nt, Human
ugguuguauuauuuuuuaaa

SEQ ID NO: 2756892 - RNA, 15 nt, Human
ugguuuagaaagcuu

SEQ ID NO: 2756893 - RNA, 16 nt, Human
ugguuucccuucuuuu

SEQ ID NO: 2756894 - RNA, 17 nt, Human
ugguuucccuucuuuuu

SEQ ID NO: 2756895 - RNA, 20 nt, Human
uguaaaaccuggagauggug

SEQ ID NO: 2756896 - RNA, 12 nt, Human
uguaaaauggug

SEQ ID NO: 2756897 - RNA, 21 nt, Human
uguaaaauggugugaccacug

SEQ ID NO: 2756898 - RNA, 18 nt, Human
uguaaaauuacacuuuga

SEQ ID NO: 2756899 - RNA, 17 nt, Human
uguaaaggaauuuaaaa

SEQ ID NO: 2756900 - RNA, 18 nt, Human
uguaaaggaauuuaaaaa

SEQ ID NO: 2756901 - RNA, 20 nt, Human
uguaaaggaauuuaaaaauc

SEQ ID NO: 2756902 - RNA, 19 nt, Human
uguaaagguccuggcaaag

SEQ ID NO: 2756903 - RNA, 17 nt, Human
uguaaagugauauuucc

SEQ ID NO: 2756904 - RNA, 12 nt, Human
uguaaauagaaa

SEQ ID NO: 2756905 - RNA, 18 nt, Human
uguaaaugugcuuuuaaa

SEQ ID NO: 2756906 - RNA, 21 nt, Human
uguaaaugugcuuuuaaaaaa

SEQ ID NO: 2756907 - RNA, 17 nt, Human
uguaacaguugcauuga

SEQ ID NO: 2756908 - RNA, 14 nt, Human
uguaacugcauuga

SEQ ID NO: 2756909 - RNA, 13 nt, Human
uguaacuuaugaa

SEQ ID NO: 2756910 - RNA, 20 nt, Human
uguaagaaaauaucacuugu

SEQ ID NO: 2756911 - RNA, 18 nt, Human
uguaagaacaacuaccug

SEQ ID NO: 2756912 - RNA, 20 nt, Human
uguaaguuagguaacuguau

SEQ ID NO: 2756913 - RNA, 14 nt, Human
uguaaguuuaugca

SEQ ID NO: 2756914 - RNA, 19 nt, Human
uguaauaggcguaacuaau

SEQ ID NO: 2756915 - RNA, 20 nt, Human
uguaauaggcguaacuaauu

SEQ ID NO: 2756916 - RNA, 21 nt, Human
uguaauaggcguaacuaauuu

SEQ ID NO: 2756917 - RNA, 23 nt, Human
uguaaucccagcacuuugggagg

SEQ ID NO: 2756918 - RNA, 17 nt, Human
uguaaugaaaaugaaua

SEQ ID NO: 2756919 - RNA, 21 nt, Human
uguaaugguggccuggggcuu

SEQ ID NO: 2756920 - RNA, 15 nt, Human
uguaauguuaauauu

SEQ ID NO: 2756921 - RNA, 18 nt, Human
uguaauguuaauauugau

SEQ ID NO: 2756922 - RNA, 14 nt, Human
uguacaauaaagca

SEQ ID NO: 2756923 - RNA, 15 nt, Human
uguacaauaaagcaa

SEQ ID NO: 2756924 - RNA, 11 nt, Human
uguacaaugug

SEQ ID NO: 2756925 - RNA, 12 nt, Human
uguacacaacaa

SEQ ID NO: 2756926 - RNA, 23 nt, Human
uguacaguuauuuaugccucugu

SEQ ID NO: 2756927 - RNA, 13 nt, Human
uguacaguuuuua

SEQ ID NO: 2756928 - RNA, 15 nt, Human
uguacaguuuuuauu

SEQ ID NO: 2756929 - RNA, 16 nt, Human
uguacaguuuuuauug

SEQ ID NO: 2756930 - RNA, 16 nt, Human
uguacauguacugauu

SEQ ID NO: 2756931 - RNA, 13 nt, Human
uguacauucuucc

SEQ ID NO: 2756932 - RNA, 17 nt, Human
uguacccaguagaugcc

SEQ ID NO: 2756933 - RNA, 20 nt, Human
uguacccaguagaugccacc

SEQ ID NO: 2756934 - RNA, 22 nt, Human
uguaccucucuuauagaauauu

SEQ ID NO: 2756935 - RNA, 14 nt, Human
uguacuaugcuguu

SEQ ID NO: 2756936 - RNA, 12 nt, Human
uguacuugcucu

SEQ ID NO: 2756937 - RNA, 13 nt, Human
uguacuugcucuu

SEQ ID NO: 2756938 - RNA, 13 nt, Human
uguacuuuuucca

SEQ ID NO: 2756939 - RNA, 20 nt, Human
uguagaaaaaaguaaaugug

SEQ ID NO: 2756940 - RNA, 23 nt, Human
uguagaaaagggaacugaacauu

SEQ ID NO: 2756941 - RNA, 20 nt, Human
uguagaagauggcacuuaua

SEQ ID NO: 2756942 - RNA, 23 nt, Human
uguagauaaacucagaaauuuaa

SEQ ID NO: 2756943 - RNA, 17 nt, Human
uguagcauccucuuuaa

SEQ ID NO: 2756944 - RNA, 22 nt, Human
uguagcauuacagugggugccc

SEQ ID NO: 2756945 - RNA, 15 nt, Human
uguagcuacaggaca

SEQ ID NO: 2756946 - RNA, 21 nt, Human
uguaggcauguagcuacagga

SEQ ID NO: 2756947 - RNA, 23 nt, Human
uguagucccaaagaggcuacugu

SEQ ID NO: 2756948 - RNA, 16 nt, Human
uguaguccuguaaugg

SEQ ID NO: 2756949 - RNA, 22 nt, Human
uguagugaaucacguaaagcua

SEQ ID NO: 2756950 - RNA, 19 nt, Human
uguauaccuuguaauuuga

SEQ ID NO: 2756951 - RNA, 19 nt, Human
uguauacugugugcuaaaa

SEQ ID NO: 2756952 - RNA, 18 nt, Human
uguauagaccuaaaauaa

SEQ ID NO: 2756953 - RNA, 12 nt, Human
uguaucuagccu

SEQ ID NO: 2756954 - RNA, 15 nt, Human
uguaucuaugcauuu

SEQ ID NO: 2756955 - RNA, 15 nt, Human
uguaugauuccuuga

SEQ ID NO: 2756956 - RNA, 17 nt, Human
uguauggguguugguga

SEQ ID NO: 2756957 - RNA, 20 nt, Human
uguauguacuucaugcuguc

SEQ ID NO: 2756958 - RNA, 17 nt, Human
uguauuacaaauauuuu

SEQ ID NO: 2756959 - RNA, 20 nt, Human
uguauuacaaauccaaugaa

SEQ ID NO: 2756960 - RNA, 14 nt, Human
uguauuauuauucc

SEQ ID NO: 2756961 - RNA, 22 nt, Human
uguauuauuauucccauucuac

SEQ ID NO: 2756962 - RNA, 15 nt, Human
uguauuccuuuuucu

SEQ ID NO: 2756963 - RNA, 14 nt, Human
uguauuuaaauauu

SEQ ID NO: 2756964 - RNA, 20 nt, Human
uguauuuguuuguauuuugu

SEQ ID NO: 2756965 - RNA, 20 nt, Human
ugucaauaaaauccauacau

SEQ ID NO: 2756966 - RNA, 12 nt, Human
ugucaaugcagc

SEQ ID NO: 2756967 - RNA, 14 nt, Human
ugucacaggacagc

SEQ ID NO: 2756968 - RNA, 14 nt, Human
ugucacccagguug

SEQ ID NO: 2756969 - RNA, 22 nt, Human
ugucacccagguuggagugcag

SEQ ID NO: 2756970 - RNA, 23 nt, Human
ugucacccagguuggagugcagu

SEQ ID NO: 2756971 - RNA, 16 nt, Human
ugucacuuugcuacag

SEQ ID NO: 2756972 - RNA, 16 nt, Human
ugucauacagauuugc

SEQ ID NO: 2756973 - RNA, 22 nt, Human
ugucauaugcucugauuuaucu

SEQ ID NO: 2756974 - RNA, 14 nt, Human
ugucauuucauuuc

SEQ ID NO: 2756975 - RNA, 18 nt, Human
ugucauuugcuggagcuc

SEQ ID NO: 2756976 - RNA, 23 nt, Human
uguccaaacugccuaagcccucc

SEQ ID NO: 2756977 - RNA, 13 nt, Human
uguccacaaguaa

SEQ ID NO: 2756978 - RNA, 12 nt, Human
uguccagccccg

SEQ ID NO: 2756979 - RNA, 19 nt, Human
uguccauucuuccucccau

SEQ ID NO: 2756980 - RNA, 16 nt, Human
uguccccuauccuacu

SEQ ID NO: 2756981 - RNA, 23 nt, Human
ugucccuacaccccuccccugcc

SEQ ID NO: 2756982 - RNA, 12 nt, Human
uguccucuuuuu

SEQ ID NO: 2756983 - RNA, 17 nt, Human
uguccugaccugucuca

SEQ ID NO: 2756984 - RNA, 17 nt, Human
ugucucaaaaaauaaaa

SEQ ID NO: 2756985 - RNA, 12 nt, Human
ugucucagagca

SEQ ID NO: 2756986 - RNA, 17 nt, Human
ugucuccucucucugua

SEQ ID NO: 2756987 - RNA, 15 nt, Human
ugucucuacaaaaaa

SEQ ID NO: 2756988 - RNA, 17 nt, Human
ugucucuacuaaaaaua

SEQ ID NO: 2756989 - RNA, 21 nt, Human
ugucugccacaccucuccaaa

SEQ ID NO: 2756990 - RNA, 19 nt, Human
ugucugccagccagcagcc

SEQ ID NO: 2756991 - RNA, 19 nt, Human
ugucuggcacuugggacaa

SEQ ID NO: 2756992 - RNA, 14 nt, Human
ugucuguuuccucu

SEQ ID NO: 2756993 - RNA, 14 nt, Human
ugucuuaauuaaaa

SEQ ID NO: 2756994 - RNA, 16 nt, Human
ugucuuaauuaaaaga

SEQ ID NO: 2756995 - RNA, 23 nt, Human
ugucuucaggggccacaccaacc

SEQ ID NO: 2756996 - RNA, 24 nt, Human
ugucuugaauuguaggugacuauu

SEQ ID NO: 2756997 - RNA, 14 nt, Human
ugucuuuuccuucu

SEQ ID NO: 2756998 - RNA, 16 nt, Human
ugucuuuuccuucuga

SEQ ID NO: 2756999 - RNA, 14 nt, Human
ugugaaaagcucca

SEQ ID NO: 2757000 - RNA, 11 nt, Human
ugugaaaucau

SEQ ID NO: 2757001 - RNA, 16 nt, Human
ugugaaaucauucauu

SEQ ID NO: 2757002 - RNA, 15 nt, Human
ugugaaauuuacauc

SEQ ID NO: 2757003 - RNA, 11 nt, Human
ugugaagaggu

SEQ ID NO: 2757004 - RNA, 17 nt, Human
ugugaccacugcagaag

SEQ ID NO: 2757005 - RNA, 18 nt, Human
ugugaccacugcagaaga

SEQ ID NO: 2757006 - RNA, 15 nt, Human
ugugaccucuccccu

SEQ ID NO: 2757007 - RNA, 13 nt, Human
ugugacuuuccua

SEQ ID NO: 2757008 - RNA, 12 nt, Human
ugugagccacca

SEQ ID NO: 2757009 - RNA, 21 nt, Human
ugugagccaccacauccagcc

SEQ ID NO: 2757010 - RNA, 12 nt, Human
ugugagccaccc

SEQ ID NO: 2757011 - RNA, 22 nt, Human
ugugagccacccugcccagccg

SEQ ID NO: 2757012 - RNA, 16 nt, Human
ugugaggagcuggaaa

SEQ ID NO: 2757013 - RNA, 18 nt, Human
ugugauacaauaaagaau

SEQ ID NO: 2757014 - RNA, 21 nt, Human
ugugaucagaccauaauguua

SEQ ID NO: 2757015 - RNA, 14 nt, Human
ugugaucuugcucu

SEQ ID NO: 2757016 - RNA, 19 nt, Human
ugugaugcaaauaaauauc

SEQ ID NO: 2757017 - RNA, 21 nt, Human
ugugauguggcaaaucucuau

SEQ ID NO: 2757018 - RNA, 21 nt, Human
ugugauuacccucugggucuc

SEQ ID NO: 2757019 - RNA, 24 nt, Human
ugugauuaucaauuaccacaccau

SEQ ID NO: 2757020 - RNA, 14 nt, Human
ugugcaauauguga

SEQ ID NO: 2757021 - RNA, 17 nt, Human
ugugcaauaugugaugu

SEQ ID NO: 2757022 - RNA, 14 nt, Human
ugugcagccaccag

SEQ ID NO: 2757023 - RNA, 17 nt, Human
ugugcagccaccagucc

SEQ ID NO: 2757024 - RNA, 17 nt, Human
uuaaacugguaggaaac

SEQ ID NO: 2757025 - RNA, 16 nt, Human
uuaaagcuuauuaaaa

SEQ ID NO: 2757026 - RNA, 16 nt, Human
uuaaaguaaaggcaaa

SEQ ID NO: 2757027 - RNA, 18 nt, Human
uuaaaguaacccuacaaa

SEQ ID NO: 2757028 - RNA, 17 nt, Human
uuaaagucaagauuucc

SEQ ID NO: 2757029 - RNA, 14 nt, Human
uuaaaguuaaauaa

SEQ ID NO: 2757030 - RNA, 14 nt, Human
uuaaauaaauugua

SEQ ID NO: 2757031 - RNA, 15 nt, Human
uuaaauauaaagcaa

SEQ ID NO: 2757032 - RNA, 16 nt, Human
uuaaauauaauaugca

SEQ ID NO: 2757033 - RNA, 21 nt, Human
uuaaaucuaaaucuauuuauu

SEQ ID NO: 2757034 - RNA, 19 nt, Human
uuaaauggaaguaaauguu

SEQ ID NO: 2757035 - RNA, 17 nt, Human
uuaaauggagaaaggac

SEQ ID NO: 2757036 - RNA, 14 nt, Human
uuaaauggucaauu

SEQ ID NO: 2757037 - RNA, 17 nt, Human
uuaaauggucaauuuug

SEQ ID NO: 2757038 - RNA, 20 nt, Human
uuaaauggucaauuuuguua

SEQ ID NO: 2757039 - RNA, 17 nt, Human
uuaaauguuuuuuuuua

SEQ ID NO: 2757040 - RNA, 19 nt, Human
uuaaauguuuuuuuuuaaa

SEQ ID NO: 2757041 - RNA, 21 nt, Human
uuaaauguuuuuuuuuaaaga

SEQ ID NO: 2757042 - RNA, 13 nt, Human
uuaaauuguaaua

SEQ ID NO: 2757043 - RNA, 20 nt, Human
uuaacacaugauccugcaau

SEQ ID NO: 2757044 - RNA, 17 nt, Human
uuaacagguaugaacca

SEQ ID NO: 2757045 - RNA, 15 nt, Human
uuaacauuauuuaua

SEQ ID NO: 2757046 - RNA, 16 nt, Human
uuaacauuauuuauau

SEQ ID NO: 2757047 - RNA, 22 nt, Human
uuaaccaggggccaugaaucac

SEQ ID NO: 2757048 - RNA, 14 nt, Human
uuaaccucuaaauu

SEQ ID NO: 2757049 - RNA, 17 nt, Human
uuaacguuuucauuaaa

SEQ ID NO: 2757050 - RNA, 20 nt, Human
uuaacguuuucauuaaaauu

SEQ ID NO: 2757051 - RNA, 14 nt, Human
uuaacuuccuugga

SEQ ID NO: 2757052 - RNA, 22 nt, Human
uuaacuugaaggaguccuugca

SEQ ID NO: 2757053 - RNA, 19 nt, Human
uuaagaaaaucuauuuugu

SEQ ID NO: 2757054 - RNA, 21 nt, Human
uuaagaaccauugauuuaaug

SEQ ID NO: 2757055 - RNA, 15 nt, Human
uuaagagaacaagca

SEQ ID NO: 2757056 - RNA, 20 nt, Human
uuaagagaacaagcaaauau

SEQ ID NO: 2757057 - RNA, 19 nt, Human
uuaagauaugggacauuuu

SEQ ID NO: 2757058 - RNA, 22 nt, Human
uuaagcacuuuaacacaguguc

SEQ ID NO: 2757059 - RNA, 17 nt, Human
uuaaggcuucucuuaaa

SEQ ID NO: 2757060 - RNA, 20 nt, Human
uuaaguaaggaauuuuauuu

SEQ ID NO: 2757061 - RNA, 20 nt, Human
uuaaguaauuucagaagaaa

SEQ ID NO: 2757062 - RNA, 14 nt, Human
uuaaguauuuuauu

SEQ ID NO: 2757063 - RNA, 15 nt, Human
uuaaguauuuuauua

SEQ ID NO: 2757064 - RNA, 14 nt, Human
uuaaguguaacugg

SEQ ID NO: 2757065 - RNA, 19 nt, Human
uuaaguuuuuuuuuaaaaa

SEQ ID NO: 2757066 - RNA, 18 nt, Human
uuaauaaaaguacauguu

SEQ ID NO: 2757067 - RNA, 21 nt, Human
uuaauaaacacucuugaaaaa

SEQ ID NO: 2757068 - RNA, 17 nt, Human
uuaauaaauuucaccaa

SEQ ID NO: 2757069 - RNA, 16 nt, Human
uuaauaauuuuuaauu

SEQ ID NO: 2757070 - RNA, 17 nt, Human
uuaauaauuuuuaauua

SEQ ID NO: 2757071 - RNA, 16 nt, Human
uuaauaccacagcuuu

SEQ ID NO: 2757072 - RNA, 21 nt, Human
uuaauauauauuaucuuuuca

SEQ ID NO: 2757073 - RNA, 19 nt, Human
uuaauauauguauuauuua

SEQ ID NO: 2757074 - RNA, 22 nt, Human
uuaauauguuauuauuaaauag

SEQ ID NO: 2757075 - RNA, 17 nt, Human
uuaauauugauuuauua

SEQ ID NO: 2757076 - RNA, 15 nt, Human
uuaauauuuaacauu

SEQ ID NO: 2757077 - RNA, 17 nt, Human
uuaaucaccaaggcuga

SEQ ID NO: 2757078 - RNA, 16 nt, Human
uuaaucugccucccuc

SEQ ID NO: 2757079 - RNA, 17 nt, Human
uuaaucugccucccucu

SEQ ID NO: 2757080 - RNA, 12 nt, Human
uuaaucuguauu

SEQ ID NO: 2757081 - RNA, 17 nt, Human
uuaaucuguauuucccc

SEQ ID NO: 2757082 - RNA, 20 nt, Human
uuaaugccacuaaauugaca

SEQ ID NO: 2757083 - RNA, 21 nt, Human
uuaauggaaauguuuacagau

SEQ ID NO: 2757084 - RNA, 22 nt, Human
uuaauggaauauguaaauagaa

SEQ ID NO: 2757085 - RNA, 22 nt, Human
uuaauguggaaaugauguuuca

SEQ ID NO: 2757086 - RNA, 12 nt, Human
uuaauuaaaaga

SEQ ID NO: 2757087 - RNA, 13 nt, Human
uuaauuaaaagaa

SEQ ID NO: 2757088 - RNA, 20 nt, Human
uuaauuaaaaucaguauuug

SEQ ID NO: 2757089 - RNA, 20 nt, Human
uuaauuaucuaguuuaauua

SEQ ID NO: 2757090 - RNA, 14 nt, Human
uuaauuauuauucu

SEQ ID NO: 2757091 - RNA, 20 nt, Human
uuaauugacuuauuuauaua

SEQ ID NO: 2757092 - RNA, 21 nt, Human
uuaauugacuuauuuauauaa

SEQ ID NO: 2757093 - RNA, 14 nt, Human
uuaauuucaugaaa

SEQ ID NO: 2757094 - RNA, 22 nt, Human
uuaauuugacuagaaaauuuaa

SEQ ID NO: 2757095 - RNA, 21 nt, Human
uuaauuugaguacuuauggcc

SEQ ID NO: 2757096 - RNA, 15 nt, Human
uuaauuuguaguguu

SEQ ID NO: 2757097 - RNA, 14 nt, Human
uuaauuuuugaaaa

SEQ ID NO: 2757098 - RNA, 15 nt, Human
uuacaaauauuuugc

SEQ ID NO: 2757099 - RNA, 20 nt, Human
uuacaaauccaaugaaauga

SEQ ID NO: 2757100 - RNA, 19 nt, Human
uuacaaaugggaaacaaaa

SEQ ID NO: 2757101 - RNA, 13 nt, Human
uuacaaggcuuua

SEQ ID NO: 2757102 - RNA, 13 nt, Human
uuacaauugaaau

SEQ ID NO: 2757103 - RNA, 22 nt, Human
uuacacuuugaacuacuagaaa

SEQ ID NO: 2757104 - RNA, 16 nt, Human
uuacagagaaaagaca

SEQ ID NO: 2757105 - RNA, 15 nt, Human
uuacagagacagaaa

SEQ ID NO: 2757106 - RNA, 16 nt, Human
uuacagagacagaaag

SEQ ID NO: 2757107 - RNA, 17 nt, Human
uuacagagacagaaagc

SEQ ID NO: 2757108 - RNA, 21 nt, Human
uuacaguuagagauuuuuaaa

SEQ ID NO: 2757109 - RNA, 16 nt, Human
uuacaucuuucacauu

SEQ ID NO: 2757110 - RNA, 22 nt, Human
uuacauguuuucuuugcuuuaa

SEQ ID NO: 2757111 - RNA, 18 nt, Human
uuacauuuguauaaaaua

SEQ ID NO: 2757112 - RNA, 21 nt, Human
uuacauuuguauaaaauaauu

SEQ ID NO: 2757113 - RNA, 16 nt, Human
uuaccagaaagcaguu

SEQ ID NO: 2757114 - RNA, 18 nt, Human
uuacccaguaacucaucu

SEQ ID NO: 2757115 - RNA, 16 nt, Human
uuacccccugggagcc

SEQ ID NO: 2757116 - RNA, 15 nt, Human
uuacccuucuuuucu

SEQ ID NO: 2757117 - RNA, 14 nt, Human
uuaccuugcaucuc

SEQ ID NO: 2757118 - RNA, 23 nt, Human
uuacgaaauacguuaggaggaca

SEQ ID NO: 2757119 - RNA, 14 nt, Human
uuacucuugauugu

SEQ ID NO: 2757120 - RNA, 18 nt, Human
uuacuguaagaaaauauc

SEQ ID NO: 2757121 - RNA, 19 nt, Human
uuacugucuuuuuucuaaa

SEQ ID NO: 2757122 - RNA, 14 nt, Human
uuagaaaaguuaug

SEQ ID NO: 2757123 - RNA, 13 nt, Human
uuagaaacacaac

SEQ ID NO: 2757124 - RNA, 21 nt, Human
uuagaaauguaauuauguucu

SEQ ID NO: 2757125 - RNA, 15 nt, Human
uuagaauaugccuug

SEQ ID NO: 2757126 - RNA, 13 nt, Human
uuagaauauuaaa

SEQ ID NO: 2757127 - RNA, 14 nt, Human
uuagaauauuaaaa

SEQ ID NO: 2757128 - RNA, 15 nt, Human
uuagaauauuaaaaa

SEQ ID NO: 2757129 - RNA, 15 nt, Human
uuagacccucaugcu

SEQ ID NO: 2757130 - RNA, 16 nt, Human
uuagagaauuuccuua

SEQ ID NO: 2757131 - RNA, 18 nt, Human
uuagagauuuuuaaauaa

SEQ ID NO: 2757132 - RNA, 14 nt, Human
uuagagcaucucau

SEQ ID NO: 2757133 - RNA, 21 nt, Human
uuagauaaggcuguucuuuaa

SEQ ID NO: 2757134 - RNA, 22 nt, Human
uuagauaaggcuguucuuuaaa

SEQ ID NO: 2757135 - RNA, 17 nt, Human
uuagauagaugaagaag

SEQ ID NO: 2757136 - RNA, 20 nt, Human
uuagaugacugaauuucuau

SEQ ID NO: 2757137 - RNA, 21 nt, Human
uuagaugcaguucugaagaag

SEQ ID NO: 2757138 - RNA, 17 nt, Human
uuagaugggcauggugg

SEQ ID NO: 2757139 - RNA, 18 nt, Human
uuagcaaccccaauacag

SEQ ID NO: 2757140 - RNA, 20 nt, Human
uuagcauaguaccucugcua

SEQ ID NO: 2757141 - RNA, 23 nt, Human
uuagcauggccacaucugagccc

SEQ ID NO: 2757142 - RNA, 21 nt, Human
uuagccuucucuguucauuuc

SEQ ID NO: 2757143 - RNA, 19 nt, Human
uuagcuccuccuuuuuccu

SEQ ID NO: 2757144 - RNA, 21 nt, Human
uuagcuccuccuuuuuccuuc

SEQ ID NO: 2757145 - RNA, 15 nt, Human
uuagcuggaaaagua

SEQ ID NO: 2757146 - RNA, 19 nt, Human
uuaggccaugggacaggga

SEQ ID NO: 2757147 - RNA, 13 nt, Human
uuaggcuauucac

SEQ ID NO: 2757148 - RNA, 14 nt, Human
uuagggguagcauu

SEQ ID NO: 2757149 - RNA, 12 nt, Human
uuaggucucaau

SEQ ID NO: 2757150 - RNA, 18 nt, Human
uuaguaaucauauuguua

SEQ ID NO: 2757151 - RNA, 15 nt, Human
uuaguauuauuguug

SEQ ID NO: 2757152 - RNA, 15 nt, Human
uuagugaaauauuau

SEQ ID NO: 2757153 - RNA, 15 nt, Human
uuaguguucauaaau

SEQ ID NO: 2757154 - RNA, 21 nt, Human
uuaguugcaacuuuguauaaa

SEQ ID NO: 2757155 - RNA, 11 nt, Human
uuaguuucucc

SEQ ID NO: 2757156 - RNA, 15 nt, Human
uuaguuuuuaaagua

SEQ ID NO: 2757157 - RNA, 17 nt, Human
uuauaaaaauaaaaaac

SEQ ID NO: 2757158 - RNA, 11 nt, Human
uuauaaacauu

SEQ ID NO: 2757159 - RNA, 16 nt, Human
uuauaacuggaaagaa

SEQ ID NO: 2757160 - RNA, 14 nt, Human
uuauaaguuacaua

SEQ ID NO: 2757161 - RNA, 13 nt, Human
uuauaauauacua

SEQ ID NO: 2757162 - RNA, 21 nt, Human
uuauaauauacuauauuuaug

SEQ ID NO: 2757163 - RNA, 22 nt, Human
uuauaaucuuuuauacaguguc

SEQ ID NO: 2757164 - RNA, 12 nt, Human
uuauaauuuaaa

SEQ ID NO: 2757165 - RNA, 15 nt, Human
uuauaauuuaaaaua

SEQ ID NO: 2757166 - RNA, 16 nt, Human
uuauaauuuaaaauau

SEQ ID NO: 2757167 - RNA, 18 nt, Human
uuauaauuuaaaauaugc

SEQ ID NO: 2757168 - RNA, 14 nt, Human
uuauacccccugca

SEQ ID NO: 2757169 - RNA, 20 nt, Human
uucauugacuaucaaacuga

SEQ ID NO: 2757170 - RNA, 19 nt, Human
uucauugcucagaaauguc

SEQ ID NO: 2757171 - RNA, 15 nt, Human
uucauuuaaaauauu

SEQ ID NO: 2757172 - RNA, 20 nt, Human
uucauuuaaaauauuuuuau

SEQ ID NO: 2757173 - RNA, 23 nt, Human
uuccaagccucauguccacuggu

SEQ ID NO: 2757174 - RNA, 17 nt, Human
uuccaagugauugaaac

SEQ ID NO: 2757175 - RNA, 22 nt, Human
uuccaauuagcuccuccuuuuu

SEQ ID NO: 2757176 - RNA, 15 nt, Human
uuccacagugacucc

SEQ ID NO: 2757177 - RNA, 20 nt, Human
uuccaccaggauauccuccc

SEQ ID NO: 2757178 - RNA, 17 nt, Human
uuccaccuacaugaggu

SEQ ID NO: 2757179 - RNA, 15 nt, Human
uuccacuagggucca

SEQ ID NO: 2757180 - RNA, 19 nt, Human
uuccacuaggguccaccag

SEQ ID NO: 2757181 - RNA, 19 nt, Human
uuccacuuauaggaauuga

SEQ ID NO: 2757182 - RNA, 22 nt, Human
uuccagccaggccccaagccca

SEQ ID NO: 2757183 - RNA, 19 nt, Human
uuccagggcuacgcgcgcu

SEQ ID NO: 2757184 - RNA, 20 nt, Human
uuccauaagaagucguuuuu

SEQ ID NO: 2757185 - RNA, 18 nt, Human
uuccauagagacuuugug

SEQ ID NO: 2757186 - RNA, 17 nt, Human
uuccauauaaauauuag

SEQ ID NO: 2757187 - RNA, 16 nt, Human
uuccauauuaaaauca

SEQ ID NO: 2757188 - RNA, 13 nt, Human
uuccaugaacuuc

SEQ ID NO: 2757189 - RNA, 20 nt, Human
uucccaaccauacaaaaauu

SEQ ID NO: 2757190 - RNA, 16 nt, Human
uucccaacuccagaaa

SEQ ID NO: 2757191 - RNA, 18 nt, Human
uucccaaguugugcuuga

SEQ ID NO: 2757192 - RNA, 22 nt, Human
uucccagcuagaauucacucca

SEQ ID NO: 2757193 - RNA, 20 nt, Human
uucccaggaguacaccccaa

SEQ ID NO: 2757194 - RNA, 18 nt, Human
uucccccuagccugccuc

SEQ ID NO: 2757195 - RNA, 13 nt, Human
uuccccuaaccuc

SEQ ID NO: 2757196 - RNA, 22 nt, Human
uuccccuuccuaauuccacagc

SEQ ID NO: 2757197 - RNA, 17 nt, Human
uuccccuugcccagggc

SEQ ID NO: 2757198 - RNA, 15 nt, Human
uuccccuugccuaaa

SEQ ID NO: 2757199 - RNA, 17 nt, Human
uucccgaaggaaaaggg

SEQ ID NO: 2757200 - RNA, 14 nt, Human
uucccgcuguuccu

SEQ ID NO: 2757201 - RNA, 23 nt, Human
uucccguggaacguuuuuccugu

SEQ ID NO: 2757202 - RNA, 10 nt, Human
uucccugccu

SEQ ID NO: 2757203 - RNA, 18 nt, Human
uucccuguuucuuccaca

SEQ ID NO: 2757204 - RNA, 17 nt, Human
uucccuugaugaagaag

SEQ ID NO: 2757205 - RNA, 14 nt, Human
uuccgcauccuagu

SEQ ID NO: 2757206 - RNA, 14 nt, Human
uuccggggaaggau

SEQ ID NO: 2757207 - RNA, 20 nt, Human
uuccuaaccagccuggucaa

SEQ ID NO: 2757208 - RNA, 18 nt, Human
uuccuaauaaagcuucug

SEQ ID NO: 2757209 - RNA, 22 nt, Human
uuccuagcgcagccaugugauu

SEQ ID NO: 2757210 - RNA, 15 nt, Human
uuccuagguauaauu

SEQ ID NO: 2757211 - RNA, 12 nt, Human
uuccucaaaacu

SEQ ID NO: 2757212 - RNA, 14 nt, Human
uuccucagacucua

SEQ ID NO: 2757213 - RNA, 21 nt, Human
uuccuccacaccauucagguc

SEQ ID NO: 2757214 - RNA, 23 nt, Human
uuccucccuguguauucauucuc

SEQ ID NO: 2757215 - RNA, 19 nt, Human
uuccucccuucucuucaca

SEQ ID NO: 2757216 - RNA, 14 nt, Human
uuccucugagccuu

SEQ ID NO: 2757217 - RNA, 20 nt, Human
uuccugaccuaugaaacaga

SEQ ID NO: 2757218 - RNA, 21 nt, Human
uuccugacugcuaguuuauau

SEQ ID NO: 2757219 - RNA, 14 nt, Human
uuccugagccagug

SEQ ID NO: 2757220 - RNA, 22 nt, Human
uuccugauuauuuucuacacau

SEQ ID NO: 2757221 - RNA, 21 nt, Human
uuccuggacaguuuucugcuu

SEQ ID NO: 2757222 - RNA, 21 nt, Human
uuccuguggauguaaagugau

SEQ ID NO: 2757223 - RNA, 22 nt, Human
uuccuguggauguaaagugaua

SEQ ID NO: 2757224 - RNA, 20 nt, Human
uuccuguucuuaagacguga

SEQ ID NO: 2757225 - RNA, 17 nt, Human
uuccuuagcuuagaccu

SEQ ID NO: 2757226 - RNA, 20 nt, Human
uuccuuagcuuagaccucag

SEQ ID NO: 2757227 - RNA, 21 nt, Human
uuccuuauauuauggaggcag

SEQ ID NO: 2757228 - RNA, 13 nt, Human
uuccuuauauuua

SEQ ID NO: 2757229 - RNA, 16 nt, Human
uuccuuaucacugaca

SEQ ID NO: 2757230 - RNA, 13 nt, Human
uuccuucauuucc

SEQ ID NO: 2757231 - RNA, 14 nt, Human
uuccuucugagccu

SEQ ID NO: 2757232 - RNA, 18 nt, Human
uuccuuggacucauuuua

SEQ ID NO: 2757233 - RNA, 16 nt, Human
uuccuuuuacuuuucu

SEQ ID NO: 2757234 - RNA, 12 nt, Human
uucgcgcgccuc

SEQ ID NO: 2757235 - RNA, 21 nt, Human
uucgcugauauauguguuuuu

SEQ ID NO: 2757236 - RNA, 15 nt, Human
uucggccuccauccu

SEQ ID NO: 2757237 - RNA, 16 nt, Human
uucggccuccauccug

SEQ ID NO: 2757238 - RNA, 20 nt, Human
uucggccuccauccugaggc

SEQ ID NO: 2757239 - RNA, 23 nt, Human
uucuaaaaguuuaaguucuauga

SEQ ID NO: 2757240 - RNA, 19 nt, Human
uucuaaauaaaaagcauua

SEQ ID NO: 2757241 - RNA, 21 nt, Human
uucuaaauaaaaagcauuauu

SEQ ID NO: 2757242 - RNA, 12 nt, Human
uucuaaaugaau

SEQ ID NO: 2757243 - RNA, 20 nt, Human
uucuaagaucuaacaagaua

SEQ ID NO: 2757244 - RNA, 16 nt, Human
uucuaaguaaaaccac

SEQ ID NO: 2757245 - RNA, 22 nt, Human
uucuaauagaacucaguuuuaa

SEQ ID NO: 2757246 - RNA, 16 nt, Human
uucuaauaguuuuauu

SEQ ID NO: 2757247 - RNA, 18 nt, Human
uucuaauuggcaugaagg

SEQ ID NO: 2757248 - RNA, 12 nt, Human
uucuacuggcug

SEQ ID NO: 2757249 - RNA, 18 nt, Human
uucuagcaugaagacaga

SEQ ID NO: 2757250 - RNA, 18 nt, Human
uucuagcuguugagcugu

SEQ ID NO: 2757251 - RNA, 20 nt, Human
uucuaggacugaauuaugaa

SEQ ID NO: 2757252 - RNA, 13 nt, Human
uucuaggccgggc

SEQ ID NO: 2757253 - RNA, 16 nt, Human
uucuagucuauuuguu

SEQ ID NO: 2757254 - RNA, 13 nt, Human
uucuagugaccga

SEQ ID NO: 2757255 - RNA, 16 nt, Human
uucuauaauuuaaaua

SEQ ID NO: 2757256 - RNA, 14 nt, Human
uucuaugaaauauu

SEQ ID NO: 2757257 - RNA, 22 nt, Human
uucuaugcuuguaacugucuuc

SEQ ID NO: 2757258 - RNA, 16 nt, Human
uucuauucuagccugc

SEQ ID NO: 2757259 - RNA, 18 nt, Human
uucuauuugaucugauau

SEQ ID NO: 2757260 - RNA, 16 nt, Human
uucucaacuccaaacu

SEQ ID NO: 2757261 - RNA, 13 nt, Human
uucucaagcccug

SEQ ID NO: 2757262 - RNA, 19 nt, Human
uucucaauuucuacaaaau

SEQ ID NO: 2757263 - RNA, 17 nt, Human
uucucacacacauacau

SEQ ID NO: 2757264 - RNA, 13 nt, Human
uucucaucuuuuu

SEQ ID NO: 2757265 - RNA, 19 nt, Human
uucucaucuuuuuacuaaa

SEQ ID NO: 2757266 - RNA, 21 nt, Human
uucuccagccucagccuccca

SEQ ID NO: 2757267 - RNA, 22 nt, Human
uucuccagccucagccucccaa

SEQ ID NO: 2757268 - RNA, 14 nt, Human
uucuccauacucug

SEQ ID NO: 2757269 - RNA, 18 nt, Human
uucuccauacucuguaac

SEQ ID NO: 2757270 - RNA, 16 nt, Human
uucuccauccuaccac

SEQ ID NO: 2757271 - RNA, 17 nt, Human
uucuccauccuaccaca

SEQ ID NO: 2757272 - RNA, 13 nt, Human
uucuccugccuca

SEQ ID NO: 2757273 - RNA, 18 nt, Human
uucucuaggaaauauuua

SEQ ID NO: 2757274 - RNA, 14 nt, Human
uucucuccaccagg

SEQ ID NO: 2757275 - RNA, 20 nt, Human
uucucucgugaguauauuga

SEQ ID NO: 2757276 - RNA, 11 nt, Human
uucucugaggg

SEQ ID NO: 2757277 - RNA, 14 nt, Human
uucucugagggggu

SEQ ID NO: 2757278 - RNA, 14 nt, Human
uucucuguauuccu

SEQ ID NO: 2757279 - RNA, 11 nt, Human
uucugaagaag

SEQ ID NO: 2757280 - RNA, 12 nt, Human
uucugaagaaga

SEQ ID NO: 2757281 - RNA, 19 nt, Human
uucugaauauguccuuuuu

SEQ ID NO: 2757282 - RNA, 17 nt, Human
uucugaauuauuuucuc

SEQ ID NO: 2757283 - RNA, 16 nt, Human
uucugacacuaaaaca

SEQ ID NO: 2757284 - RNA, 15 nt, Human
uucugagaaagacua

SEQ ID NO: 2757285 - RNA, 14 nt, Human
uucugagcaccuac

SEQ ID NO: 2757286 - RNA, 17 nt, Human
uucugagcauuuaauau

SEQ ID NO: 2757287 - RNA, 23 nt, Human
uucugagccugccuuucuccccc

SEQ ID NO: 2757288 - RNA, 15 nt, Human
uucugcacacagcac

SEQ ID NO: 2757289 - RNA, 13 nt, Human
uucugcagauaaa

SEQ ID NO: 2757290 - RNA, 22 nt, Human
uucugccccugcugacacagac

SEQ ID NO: 2757291 - RNA, 21 nt, Human
uucugcgcuguguacaaugug

SEQ ID NO: 2757292 - RNA, 18 nt, Human
uucuggguucaagcgauu

SEQ ID NO: 2757293 - RNA, 20 nt, Human
uucuguaaucuucagaccua

SEQ ID NO: 2757294 - RNA, 14 nt, Human
uucugucaacuugu

SEQ ID NO: 2757295 - RNA, 15 nt, Human
uucugucuucacaac

SEQ ID NO: 2757296 - RNA, 13 nt, Human
uucuuaaaucuag

SEQ ID NO: 2757297 - RNA, 20 nt, Human
uucuuagaaauuuauuuccu

SEQ ID NO: 2757298 - RNA, 17 nt, Human
uucuuauuucauuucuu

SEQ ID NO: 2757299 - RNA, 19 nt, Human
uucuucaaauaaaucucuc

SEQ ID NO: 2757300 - RNA, 22 nt, Human
uucuuccacagugccuaauaau

SEQ ID NO: 2757301 - RNA, 23 nt, Human
uucuuccacagugccuaauaaua

SEQ ID NO: 2757302 - RNA, 15 nt, Human
uucuucggaaagaag

SEQ ID NO: 2757303 - RNA, 17 nt, Human
uucuucggaaagaagaa

SEQ ID NO: 2757304 - RNA, 15 nt, Human
uucuucucacauuua

SEQ ID NO: 2757305 - RNA, 15 nt, Human
uucuucucuccagug

SEQ ID NO: 2757306 - RNA, 21 nt, Human
uucuuggucucagugucaaug

SEQ ID NO: 2757307 - RNA, 12 nt, Human
uucuuguauuuu

SEQ ID NO: 2757308 - RNA, 15 nt, Human
uucuuguauuuuucc

SEQ ID NO: 2757309 - RNA, 21 nt, Human
uucuuuaacuuaauugcuaug

SEQ ID NO: 2757310 - RNA, 21 nt, Human
uucuuuccacagaagcuccag

SEQ ID NO: 2757311 - RNA, 13 nt, Human
uucuuucuuuauu

SEQ ID NO: 2757312 - RNA, 15 nt, Human
uucuuugagugucuu

SEQ ID NO: 2757313 - RNA, 21 nt, Human
uucuuugcccacaaugcuuug

SEQ ID NO: 2757314 - RNA, 11 nt, Human
uuguuuuucca

SEQ ID NO: 2757315 - RNA, 12 nt, Human
uuguuuuuccac

SEQ ID NO: 2757316 - RNA, 13 nt, Human
uuguuuuuccuug

SEQ ID NO: 2757317 - RNA, 21 nt, Human
uuguuuuuccuuguauuuaaa

SEQ ID NO: 2757318 - RNA, 13 nt, Human
uuuaaaaaaaaac

SEQ ID NO: 2757319 - RNA, 13 nt, Human
uuuaaaaaagaaa

SEQ ID NO: 2757320 - RNA, 13 nt, Human
uuuaaaaaauaua

SEQ ID NO: 2757321 - RNA, 20 nt, Human
uuuaaaaagcgcuaauuucu

SEQ ID NO: 2757322 - RNA, 13 nt, Human
uuuaaaaauccua

SEQ ID NO: 2757323 - RNA, 14 nt, Human
uuuaaaaguuuuuu

SEQ ID NO: 2757324 - RNA, 14 nt, Human
uuuaaaaugagaaa

SEQ ID NO: 2757325 - RNA, 19 nt, Human
uuuaaacaucagcaaaaaa

SEQ ID NO: 2757326 - RNA, 17 nt, Human
uuuaaagcuuauuaaaa

SEQ ID NO: 2757327 - RNA, 14 nt, Human
uuuaaauagcuuuu

SEQ ID NO: 2757328 - RNA, 20 nt, Human
uuuaaauagcuuuuuucucu

SEQ ID NO: 2757329 - RNA, 18 nt, Human
uuuaaauauuuuuucuuu

SEQ ID NO: 2757330 - RNA, 20 nt, Human
uuuaaaucacucaaauuguu

SEQ ID NO: 2757331 - RNA, 13 nt, Human
uuuaaaugaagaa

SEQ ID NO: 2757332 - RNA, 15 nt, Human
uuuaaauguuuuuuu

SEQ ID NO: 2757333 - RNA, 22 nt, Human
uuuaaauuaguuagccaauauu

SEQ ID NO: 2757334 - RNA, 16 nt, Human
uuuaacacagugucug

SEQ ID NO: 2757335 - RNA, 13 nt, Human
uuuaacaccuuuu

SEQ ID NO: 2757336 - RNA, 19 nt, Human
uuuaacaucugagaaaagc

SEQ ID NO: 2757337 - RNA, 15 nt, Human
uuuaacguuuucauu

SEQ ID NO: 2757338 - RNA, 17 nt, Human
uuuaacuagaauuuauu

SEQ ID NO: 2757339 - RNA, 13 nt, Human
uuuaacuccugcu

SEQ ID NO: 2757340 - RNA, 15 nt, Human
uuuaacucuauaaug

SEQ ID NO: 2757341 - RNA, 23 nt, Human
uuuaagagaacaagcaaauauaa

SEQ ID NO: 2757342 - RNA, 13 nt, Human
uuuaagauaaauu

SEQ ID NO: 2757343 - RNA, 17 nt, Human
uuuaagauaauuauaau

SEQ ID NO: 2757344 - RNA, 15 nt, Human
uuuaaggauucugag

SEQ ID NO: 2757345 - RNA, 16 nt, Human
uuuaaggauucugaga

SEQ ID NO: 2757346 - RNA, 18 nt, Human
uuuaaggccaggcauggu

SEQ ID NO: 2757347 - RNA, 21 nt, Human
uuuaaguaaggaauuuuauuu

SEQ ID NO: 2757348 - RNA, 15 nt, Human
uuuaaguaauuucag

SEQ ID NO: 2757349 - RNA, 22 nt, Human
uuuaaguuacacauuuuucaga

SEQ ID NO: 2757350 - RNA, 13 nt, Human
uuuaauaaaugua

SEQ ID NO: 2757351 - RNA, 22 nt, Human
uuuaauaauguuucaaacauau

SEQ ID NO: 2757352 - RNA, 15 nt, Human
uuuaauaauuuuuaa

SEQ ID NO: 2757353 - RNA, 14 nt, Human
uuuaauauauacua

SEQ ID NO: 2757354 - RNA, 21 nt, Human
uuuaauccccaguaaaauugc

SEQ ID NO: 2757355 - RNA, 15 nt, Human
uuuaaucuuuaauuu

SEQ ID NO: 2757356 - RNA, 23 nt, Human
uuuaaugccgauaucuucagaaa

SEQ ID NO: 2757357 - RNA, 20 nt, Human
uuuaauggugccuucauuug

SEQ ID NO: 2757358 - RNA, 20 nt, Human
uuuaauuagccagugaaaaa

SEQ ID NO: 2757359 - RNA, 14 nt, Human
uuuaauuauauggc

SEQ ID NO: 2757360 - RNA, 22 nt, Human
uuuaauuauuauucuucauaac

SEQ ID NO: 2757361 - RNA, 15 nt, Human
uuuaauuucaugaaa

SEQ ID NO: 2757362 - RNA, 20 nt, Human
uuuaauuucugcaaauguaa

SEQ ID NO: 2757363 - RNA, 21 nt, Human
uuuaauuuuacauuuccuaaa

SEQ ID NO: 2757364 - RNA, 20 nt, Human
uuuaauuuugaauaaauaaa

SEQ ID NO: 2757365 - RNA, 18 nt, Human
uuuacaaauagaauuuga

SEQ ID NO: 2757366 - RNA, 14 nt, Human
uuuacaacaaacac

SEQ ID NO: 2757367 - RNA, 16 nt, Human
uuuacaauugaaauga

SEQ ID NO: 2757368 - RNA, 21 nt, Human
uuuacacacauuaaaauguua

SEQ ID NO: 2757369 - RNA, 22 nt, Human
uuuacacacauuaaaauguuag

SEQ ID NO: 2757370 - RNA, 23 nt, Human
uuuacacauguaucuaugcauuu

SEQ ID NO: 2757371 - RNA, 14 nt, Human
uuuacagagacaga

SEQ ID NO: 2757372 - RNA, 21 nt, Human
uuuacagauccccaagccugg

SEQ ID NO: 2757373 - RNA, 18 nt, Human
uuuacauuuccuaaauau

SEQ ID NO: 2757374 - RNA, 19 nt, Human
uuuacauuuccuaaauaua

SEQ ID NO: 2757375 - RNA, 15 nt, Human
uuuaccuuuuuccuu

SEQ ID NO: 2757376 - RNA, 19 nt, Human
uuuacgcucauuguagaaa

SEQ ID NO: 2757377 - RNA, 17 nt, Human
uuuacuuuguuauuuuu

SEQ ID NO: 2757378 - RNA, 19 nt, Human
uuuagaaacacaacuauau

SEQ ID NO: 2757379 - RNA, 21 nt, Human
uuuagaauauuaaaaauuaau

SEQ ID NO: 2757380 - RNA, 21 nt, Human
uuuagcaaagauaucucaucu

SEQ ID NO: 2757381 - RNA, 17 nt, Human
uuuagcaggaagcugug

SEQ ID NO: 2757382 - RNA, 20 nt, Human
uuuagcuggaaaaguauguu

SEQ ID NO: 2757383 - RNA, 18 nt, Human
uuuaggagcaugagugcc

SEQ ID NO: 2757384 - RNA, 20 nt, Human
uuuaguaagagauuccugag

SEQ ID NO: 2757385 - RNA, 23 nt, Human
uuuaguaagagauuccugagcca

SEQ ID NO: 2757386 - RNA, 13 nt, Human
uuuagugaaauau

SEQ ID NO: 2757387 - RNA, 14 nt, Human
uuuagugauuuuaa

SEQ ID NO: 2757388 - RNA, 13 nt, Human
uuuaguggagaug

SEQ ID NO: 2757389 - RNA, 21 nt, Human
uuuaguguucauaaauaaagu

SEQ ID NO: 2757390 - RNA, 13 nt, Human
uuuauaaaaauaa

SEQ ID NO: 2757391 - RNA, 12 nt, Human
uuuauaaauaua

SEQ ID NO: 2757392 - RNA, 20 nt, Human
uuuauaacucaucauaaaau

SEQ ID NO: 2757393 - RNA, 22 nt, Human
uuuauaagaaauaggaaauauu

SEQ ID NO: 2757394 - RNA, 15 nt, Human
uuuauaaucaagccu

SEQ ID NO: 2757395 - RNA, 14 nt, Human
uuuauaauuccuau

SEQ ID NO: 2757396 - RNA, 20 nt, Human
uuuauaauuuuaaauguuuu

SEQ ID NO: 2757397 - RNA, 13 nt, Human
uuuauagugucuu

SEQ ID NO: 2757398 - RNA, 14 nt, Human
uuuauauaagcuug

SEQ ID NO: 2757399 - RNA, 21 nt, Human
uuuauauaagcuuguauuccu

SEQ ID NO: 2757400 - RNA, 18 nt, Human
uuuauauaugugaaauaa

SEQ ID NO: 2757401 - RNA, 23 nt, Human
uuuauaugcuucuguuuuauaau

SEQ ID NO: 2757402 - RNA, 13 nt, Human
uuuauauuauuuu

SEQ ID NO: 2757403 - RNA, 23 nt, Human
uuuauauuucuguuaaaauauau

SEQ ID NO: 2757404 - RNA, 15 nt, Human
uuuauauuugaaaua

SEQ ID NO: 2757405 - RNA, 14 nt, Human
uuuaucacuguugc

SEQ ID NO: 2757406 - RNA, 12 nt, Human
uuuaucauguga

SEQ ID NO: 2757407 - RNA, 20 nt, Human
uuuaugaaacauuacaguua

SEQ ID NO: 2757408 - RNA, 19 nt, Human
uuuaugcauacaguaauuu

SEQ ID NO: 2757409 - RNA, 15 nt, Human
uuuaugcauauuauu

SEQ ID NO: 2757410 - RNA, 12 nt, Human
uuuauggagaua

SEQ ID NO: 2757411 - RNA, 19 nt, Human
uuuauggagauauaauucu

SEQ ID NO: 2757412 - RNA, 18 nt, Human
uuuauggcacuaguauuu

SEQ ID NO: 2757413 - RNA, 14 nt, Human
uuuauguaguuuuu

SEQ ID NO: 2757414 - RNA, 18 nt, Human
uuuauguuuaauucugaa

SEQ ID NO: 2757415 - RNA, 17 nt, Human
uuuauuacaucuuucac

SEQ ID NO: 2757416 - RNA, 23 nt, Human
uuuauuaugcauuauaucaaauc

SEQ ID NO: 2757417 - RNA, 22 nt, Human
uuuauugaggcuuuaaaacuua

SEQ ID NO: 2757418 - RNA, 18 nt, Human
uuuauuuaacuauucaua

SEQ ID NO: 2757419 - RNA, 17 nt, Human
uuuauuucuuaaaucua

SEQ ID NO: 2757420 - RNA, 15 nt, Human
uuucaaaaaaaaacc

SEQ ID NO: 2757421 - RNA, 17 nt, Human
uuucaaaacucauuucc

SEQ ID NO: 2757422 - RNA, 21 nt, Human
uuucaaaaucaaauuccagaa

SEQ ID NO: 2757423 - RNA, 20 nt, Human
uuucaaacauauauaacaau

SEQ ID NO: 2757424 - RNA, 20 nt, Human
uuucaaauuugaugaaauca

SEQ ID NO: 2757425 - RNA, 14 nt, Human
uuucaauauuuauu

SEQ ID NO: 2757426 - RNA, 18 nt, Human
uuucaauuaccuucuauu

SEQ ID NO: 2757427 - RNA, 14 nt, Human
uuucacaagugaaa

SEQ ID NO: 2757428 - RNA, 16 nt, Human
uuucacauuuaaauaa

SEQ ID NO: 2757429 - RNA, 17 nt, Human
uuucacauuuaaauaaa

SEQ ID NO: 2757430 - RNA, 18 nt, Human
uuucaccauguuggccag

SEQ ID NO: 2757431 - RNA, 20 nt, Human
uuucaccauguuggccaggc

SEQ ID NO: 2757432 - RNA, 16 nt, Human
uuucacuaucuguaau

SEQ ID NO: 2757433 - RNA, 18 nt, Human
uuucacuguguuggccag

SEQ ID NO: 2757434 - RNA, 20 nt, Human
uuucacuucaaaacaguauu

SEQ ID NO: 2757435 - RNA, 20 nt, Human
uuucagaagaaauucugcaa

SEQ ID NO: 2757436 - RNA, 18 nt, Human
uuucagagccuccuuucu

SEQ ID NO: 2757437 - RNA, 17 nt, Human
uuucagauaaucacaau

SEQ ID NO: 2757438 - RNA, 12 nt, Human
uuucagcccuca

SEQ ID NO: 2757439 - RNA, 18 nt, Human
uuucaguuauuauauuua

SEQ ID NO: 2757440 - RNA, 17 nt, Human
uuucauaagaauucugu

SEQ ID NO: 2757441 - RNA, 15 nt, Human
uuucauagcuaaaaa

SEQ ID NO: 2757442 - RNA, 14 nt, Human
uuucauauuuuuca

SEQ ID NO: 2757443 - RNA, 16 nt, Human
uuucauccuuuucauu

SEQ ID NO: 2757444 - RNA, 19 nt, Human
uuucaugcuguucaugaaa

SEQ ID NO: 2757445 - RNA, 20 nt, Human
uuucauuaucucaaaacugc

SEQ ID NO: 2757446 - RNA, 21 nt, Human
uuucauuguucuauaacaaca

SEQ ID NO: 2757447 - RNA, 20 nt, Human
uuuccaauuagcuccuccuu

SEQ ID NO: 2757448 - RNA, 15 nt, Human
uuuccacaaugauga

SEQ ID NO: 2757449 - RNA, 16 nt, Human
uuuccacuacugcuac

SEQ ID NO: 2757450 - RNA, 21 nt, Human
uuuccauugguuuaccuguga

SEQ ID NO: 2757451 - RNA, 19 nt, Human
uuuccauuuacccuucuuu

SEQ ID NO: 2757452 - RNA, 21 nt, Human
uuucccaaauugaaucacugc

SEQ ID NO: 2757453 - RNA, 22 nt, Human
uuucccaaauugaaucacugcu

SEQ ID NO: 2757454 - RNA, 23 nt, Human
uuucccaucucagguguguugca

SEQ ID NO: 2757455 - RNA, 18 nt, Human
uuuccccaacauguaaua

SEQ ID NO: 2757456 - RNA, 23 nt, Human
uuucccccuagccugccuccccu

SEQ ID NO: 2757457 - RNA, 18 nt, Human
uuuccccuugguucucau

SEQ ID NO: 2757458 - RNA, 22 nt, Human
uuuucauuaucucaaaacugca

SEQ ID NO: 2757459 - RNA, 14 nt, Human
uuuucauuauuccu

SEQ ID NO: 2757460 - RNA, 17 nt, Human
uuuuccacuacugcuac

SEQ ID NO: 2757461 - RNA, 17 nt, Human
uuuucccagggcaagca

SEQ ID NO: 2757462 - RNA, 16 nt, Human
uuuucccccacaaacc

SEQ ID NO: 2757463 - RNA, 13 nt, Human
uuuuccuaaguga

SEQ ID NO: 2757464 - RNA, 16 nt, Human
uuuuccugaaaacccu

SEQ ID NO: 2757465 - RNA, 17 nt, Human
uuuuccugaaaacccuu

SEQ ID NO: 2757466 - RNA, 21 nt, Human
uuuucgaugguacauauuucu

SEQ ID NO: 2757467 - RNA, 24 nt, Human
uuuucgaugguacauauuucuuug

SEQ ID NO: 2757468 - RNA, 21 nt, Human
uuuucuaauaguuuuauuaau

SEQ ID NO: 2757469 - RNA, 19 nt, Human
uuuucuacacauacaugua

SEQ ID NO: 2757470 - RNA, 16 nt, Human
uuuucucuaggaaaua

SEQ ID NO: 2757471 - RNA, 18 nt, Human
uuuucucuccucucccca

SEQ ID NO: 2757472 - RNA, 13 nt, Human
uuuugaaaaaaag

SEQ ID NO: 2757473 - RNA, 12 nt, Human
uuuugaaaccaa

SEQ ID NO: 2757474 - RNA, 21 nt, Human
uuuugaaaccaugaagagauu

SEQ ID NO: 2757475 - RNA, 13 nt, Human
uuuugaaucauca

SEQ ID NO: 2757476 - RNA, 16 nt, Human
uuuugaugaacaaaau

SEQ ID NO: 2757477 - RNA, 17 nt, Human
uuuugaugaacaaaauu

SEQ ID NO: 2757478 - RNA, 20 nt, Human
uuuugcauccuacauuaauu

SEQ ID NO: 2757479 - RNA, 14 nt, Human
uuuugcuaauuuuu

SEQ ID NO: 2757480 - RNA, 20 nt, Human
uuuuggugguuuuagugauu

SEQ ID NO: 2757481 - RNA, 23 nt, Human
uuuuguagaauaaggaacaacgu

SEQ ID NO: 2757482 - RNA, 15 nt, Human
uuuuguauuuuguuu

SEQ ID NO: 2757483 - RNA, 14 nt, Human
uuuugucucugcaa

SEQ ID NO: 2757484 - RNA, 18 nt, Human
uuuugugaagcaaaauuu

SEQ ID NO: 2757485 - RNA, 11 nt, Human
uuuuguucaua

SEQ ID NO: 2757486 - RNA, 10 nt, Human
uuuuuaaaaa

SEQ ID NO: 2757487 - RNA, 15 nt, Human
uuuuuaaacaaaaaa

SEQ ID NO: 2757488 - RNA, 12 nt, Human
uuuuuaaauaua

SEQ ID NO: 2757489 - RNA, 18 nt, Human
uuuuuaacaccuuuuacu

SEQ ID NO: 2757490 - RNA, 22 nt, Human
uuuuuaauaaauuucaccaagu

SEQ ID NO: 2757491 - RNA, 20 nt, Human
uuuuuaauguguauuacaaa

SEQ ID NO: 2757492 - RNA, 18 nt, Human
uuuuuaauuauuauuuau

SEQ ID NO: 2757493 - RNA, 15 nt, Human
uuuuuaccagucuca

SEQ ID NO: 2757494 - RNA, 18 nt, Human
uuuuuagacucaucaauc

SEQ ID NO: 2757495 - RNA, 15 nt, Human
uuuuuaguucuucaa

SEQ ID NO: 2757496 - RNA, 20 nt, Human
uuuuuauacgauaaauaacu

SEQ ID NO: 2757497 - RNA, 13 nt, Human
uuuuuauauccac

SEQ ID NO: 2757498 - RNA, 19 nt, Human
uuuuuaucaugugaaauca

SEQ ID NO: 2757499 - RNA, 17 nt, Human
uuuuuccagacacuuuu

SEQ ID NO: 2757500 - RNA, 14 nt, Human
uuuuuccauuuuuu

SEQ ID NO: 2757501 - RNA, 19 nt, Human
uuuuucuaaaguaaaaaca

SEQ ID NO: 2757502 - RNA, 17 nt, Human
uuuuugaaaaaaagcuu

SEQ ID NO: 2757503 - RNA, 20 nt, Human
uuuuugggagagacuuguuu

SEQ ID NO: 2757504 - RNA, 21 nt, Human
uuuuugugaaaagcuccauuu

SEQ ID NO: 2757505 - RNA, 17 nt, Human
uuuuuguuucauauuga

SEQ ID NO: 2757506 - RNA, 13 nt, Human
uuuuuuaaagacu

SEQ ID NO: 2757507 - RNA, 21 nt, Human
uuuuuuaauaaauuucaccaa

SEQ ID NO: 2757508 - RNA, 20 nt, Human
uuuuuuauaaucaagccuaa

SEQ ID NO: 2757509 - RNA, 19 nt, Human
uuuuuuaugaaacauuaca

SEQ ID NO: 2757510 - RNA, 14 nt, Human
uuuuuucuaaagua

SEQ ID NO: 2757511 - RNA, 23 nt, Human
uuuuuucuuaccuuauugcacug

SEQ ID NO: 2757512 - RNA, 21 nt, Human
uuuuuuuaaacaaaaaaagca

SEQ ID NO: 2757513 - RNA, 11 nt, Human
uuuuuuuguuu

SEQ ID NO: 2757514 - RNA, 12 nt, Human
uuuuuuuuaaaa

SEQ ID NO: 2757515 - RNA, 13 nt, Human
uuuuuuuuaaaga

SEQ ID NO: 2757516 - RNA, 13 nt, Human
uuuuuuuucccuu

SEQ ID NO: 2757517 - RNA, 13 nt, Human
uuuuuuuuuuucu

SEQ ID NO: 2757518 - RNA, 11 nt, Human
aaaaaaaauua

SEQ ID NO: 2757519 - RNA, 12 nt, Human
aaaaaaacguau

SEQ ID NO: 2757520 - RNA, 11 nt, Human
aaaaaaaggaa

SEQ ID NO: 2757521 - RNA, 22 nt, Human
aaaaaacacugggagaaaugaa

SEQ ID NO: 2757522 - RNA, 18 nt, Human
aaaaaaggaauccucugu

SEQ ID NO: 2757523 - RNA, 15 nt, Human
aaaaaaguacuuaaa

SEQ ID NO: 2757524 - RNA, 15 nt, Human
aaaaaauaacaauga

SEQ ID NO: 2757525 - RNA, 16 nt, Human
aaaaacaaacaaacaa

SEQ ID NO: 2757526 - RNA, 23 nt, Human
aaaaacagaccgggguucccgug

SEQ ID NO: 2757527 - RNA, 20 nt, Human
aaaaaccugagccccaaaag

SEQ ID NO: 2757528 - RNA, 15 nt, Human
aaaaacguauugcau

SEQ ID NO: 2757529 - RNA, 20 nt, Human
aaaaacguauugcauuuaau

SEQ ID NO: 2757530 - RNA, 21 nt, Human
aaaaacguauugcauuuaauu

SEQ ID NO: 2757531 - RNA, 17 nt, Human
aaaaacugcucauauga

SEQ ID NO: 2757532 - RNA, 21 nt, Human
aaaaacuuaaguagauaagga

SEQ ID NO: 2757533 - RNA, 14 nt, Human
aaaaagaucccaaa

SEQ ID NO: 2757534 - RNA, 17 nt, Human
aaaaagcauuguaacuu

SEQ ID NO: 2757535 - RNA, 17 nt, Human
aaaaagcgcuaauuucu

SEQ ID NO: 2757536 - RNA, 14 nt, Human
aaaaaggaaggaag

SEQ ID NO: 2757537 - RNA, 19 nt, Human
aaaaaguaaaugugauuua

SEQ ID NO: 2757538 - RNA, 21 nt, Human
aaaaaguucugcagauaaaca

SEQ ID NO: 2757539 - RNA, 22 nt, Human
aaaaaguucugcagauaaacag

SEQ ID NO: 2757540 - RNA, 14 nt, Human
aaaaauaaaaauaa

SEQ ID NO: 2757541 - RNA, 18 nt, Human
aaaaauaaaaauaaaaau

SEQ ID NO: 2757542 - RNA, 15 nt, Human
aaaaauaacaaugaa

SEQ ID NO: 2757543 - RNA, 12 nt, Human
aaacccuuucau

SEQ ID NO: 2757544 - RNA, 16 nt, Human
aaaccuauacucacuu

SEQ ID NO: 2757545 - RNA, 13 nt, Human
aaaccuccuucca

SEQ ID NO: 2757546 - RNA, 23 nt, Human
aaaccuuuguuugcaucugaaaa

SEQ ID NO: 2757547 - RNA, 16 nt, Human
aaaccuuuuauauuua

SEQ ID NO: 2757548 - RNA, 19 nt, Human
aaaccuuuuuggacacaca

SEQ ID NO: 2757549 - RNA, 24 nt, Human
aaacguauucaaacaauuugaaua

SEQ ID NO: 2757550 - RNA, 15 nt, Human
aaacguuucucaaau

SEQ ID NO: 2757551 - RNA, 20 nt, Human
aaacuaaggcccucuugaau

SEQ ID NO: 2757552 - RNA, 18 nt, Human
aaacuagagacucaaaga

SEQ ID NO: 2757553 - RNA, 23 nt, Human
aaacuaggugcauauuuauaaaa

SEQ ID NO: 2757554 - RNA, 16 nt, Human
aaacuaggugcugcag

SEQ ID NO: 2757555 - RNA, 17 nt, Human
aaacucaauaaguuuau

SEQ ID NO: 2757556 - RNA, 11 nt, Human
aaacucagagg

SEQ ID NO: 2757557 - RNA, 23 nt, Human
aaacucagggagcauuuauaaau

SEQ ID NO: 2757558 - RNA, 12 nt, Human
aaacuccacauc

SEQ ID NO: 2757559 - RNA, 14 nt, Human
aaacugaaacaaaa

SEQ ID NO: 2757560 - RNA, 15 nt, Human
aaacugaaacaaaau

SEQ ID NO: 2757561 - RNA, 17 nt, Human
aaacugagauccuuccu

SEQ ID NO: 2757562 - RNA, 22 nt, Human
aaacugauuuaucuauuuaaau

SEQ ID NO: 2757563 - RNA, 18 nt, Human
aaacugccuaagcccucc

SEQ ID NO: 2757564 - RNA, 22 nt, Human
aaacuggaaauaaaagauugua

SEQ ID NO: 2757565 - RNA, 15 nt, Human
aaacuuguauuaugu

SEQ ID NO: 2757566 - RNA, 15 nt, Human
aaacuuuaaaacuug

SEQ ID NO: 2757567 - RNA, 23 nt, Human
aaacuuuaugcuaagugaaauaa

SEQ ID NO: 2757568 - RNA, 16 nt, Human
aaacuuugauuuuaua

SEQ ID NO: 2757569 - RNA, 23 nt, Human
aaacuuugauuuuauaugcuauu

SEQ ID NO: 2757570 - RNA, 14 nt, Human
aaacuuuuccaaug

SEQ ID NO: 2757571 - RNA, 22 nt, Human
aaacuuuuggaagguauuuaau

SEQ ID NO: 2757572 - RNA, 21 nt, Human
aaagaaaacuuguauuaugug

SEQ ID NO: 2757573 - RNA, 15 nt, Human
aaagaaaauaacgau

SEQ ID NO: 2757574 - RNA, 16 nt, Human
aaagaaaauaacgaua

SEQ ID NO: 2757575 - RNA, 21 nt, Human
aaagaaaauaacgauaaaaga

SEQ ID NO: 2757576 - RNA, 10 nt, Human
aaagaaaauc

SEQ ID NO: 2757577 - RNA, 18 nt, Human
aaagaaaaucaggcuggc

SEQ ID NO: 2757578 - RNA, 11 nt, Human
aaagaaacaaa

SEQ ID NO: 2757579 - RNA, 17 nt, Human
aaagaaacauuugguaa

SEQ ID NO: 2757580 - RNA, 13 nt, Human
aaagaaaggagau

SEQ ID NO: 2757581 - RNA, 20 nt, Human
aaagaaaggagauacagugg

SEQ ID NO: 2757582 - RNA, 19 nt, Human
aaagaaauguaagggaaac

SEQ ID NO: 2757583 - RNA, 14 nt, Human
aaagaaauuaugug

SEQ ID NO: 2757584 - RNA, 15 nt, Human
aaagaaauuaugugc

SEQ ID NO: 2757585 - RNA, 19 nt, Human
aaagaagacaacauuaaaa

SEQ ID NO: 2757586 - RNA, 15 nt, Human
aaagaagagaacugc

SEQ ID NO: 2757587 - RNA, 15 nt, Human
aaagaagagccggag

SEQ ID NO: 2757588 - RNA, 12 nt, Human
aaagaauauuuu

SEQ ID NO: 2757589 - RNA, 15 nt, Human
aaagaauauuuuaac

SEQ ID NO: 2757590 - RNA, 21 nt, Human
aaagaauauuuuaacuuccuu

SEQ ID NO: 2757591 - RNA, 20 nt, Human
aaagaaugauuaugaauuac

SEQ ID NO: 2757592 - RNA, 15 nt, Human
aaagaauuauuuugu

SEQ ID NO: 2757593 - RNA, 14 nt, Human
aaagaauuuuaaaa

SEQ ID NO: 2757594 - RNA, 16 nt, Human
aaagacaaggaaaaaa

SEQ ID NO: 2757595 - RNA, 24 nt, Human
aaagacagcuucucauccugcagg

SEQ ID NO: 2757596 - RNA, 20 nt, Human
aaagacagugaaagaaaaua

SEQ ID NO: 2757597 - RNA, 22 nt, Human
aaagacagugaaagaaaauaac

SEQ ID NO: 2757598 - RNA, 14 nt, Human
aaagaccauuuuuc

SEQ ID NO: 2757599 - RNA, 15 nt, Human
aaagacuccaaagaa

SEQ ID NO: 2757600 - RNA, 22 nt, Human
aaagacuccaaagaaauguaag

SEQ ID NO: 2757601 - RNA, 13 nt, Human
aaagacuuuuaug

SEQ ID NO: 2757602 - RNA, 23 nt, Human
aaagacuuuuaugauacuugaaa

SEQ ID NO: 2757603 - RNA, 15 nt, Human
aaagagaacuuccag

SEQ ID NO: 2757604 - RNA, 18 nt, Human
aaagagggagugcauuua

SEQ ID NO: 2757605 - RNA, 20 nt, Human
aaagagugaaggauuuaugu

SEQ ID NO: 2757606 - RNA, 22 nt, Human
aaagagugaaggauuuauguuu

SEQ ID NO: 2757607 - RNA, 19 nt, Human
aaagauacccaaaggucaa

SEQ ID NO: 2757608 - RNA, 16 nt, Human
aaagauaucucaucuc

SEQ ID NO: 2757609 - RNA, 20 nt, Human
aaagauaucucaucucuucu

SEQ ID NO: 2757610 - RNA, 16 nt, Human
aaagaucugcaacuac

SEQ ID NO: 2757611 - RNA, 23 nt, Human
aaagaugaucaguaugaaaaugu

SEQ ID NO: 2757612 - RNA, 11 nt, Human
aaagauucaau

SEQ ID NO: 2757613 - RNA, 13 nt, Human
aaagcaaagcucu

SEQ ID NO: 2757614 - RNA, 12 nt, Human
aaagcaauaaua

SEQ ID NO: 2757615 - RNA, 22 nt, Human
aaagcacgaaauguuauuuuuu

SEQ ID NO: 2757616 - RNA, 17 nt, Human
aaagcagggacuugaac

SEQ ID NO: 2757617 - RNA, 16 nt, Human
aaagcaguggacacca

SEQ ID NO: 2757618 - RNA, 19 nt, Human
aaagcaguugagacaagaa

SEQ ID NO: 2757619 - RNA, 22 nt, Human
aaagcaguugagacaagaaaau

SEQ ID NO: 2757620 - RNA, 19 nt, Human
aaagcauuauuauuugcug

SEQ ID NO: 2757621 - RNA, 15 nt, Human
aaagcauuguaaaug

SEQ ID NO: 2757622 - RNA, 16 nt, Human
aaagcauuguaacuua

SEQ ID NO: 2757623 - RNA, 22 nt, Human
aaagcauuugaaugcauuuugu

SEQ ID NO: 2757624 - RNA, 17 nt, Human
aaagccaaaaaccaaau

SEQ ID NO: 2757625 - RNA, 20 nt, Human
aaagcccucccuaccuacca

SEQ ID NO: 2757626 - RNA, 15 nt, Human
aaagcguaaagagga

SEQ ID NO: 2757627 - RNA, 17 nt, Human
aaagcuccauuuuuagu

SEQ ID NO: 2757628 - RNA, 22 nt, Human
aaagcuccauuuuuagugaaau

SEQ ID NO: 2757629 - RNA, 23 nt, Human
aaagcuccauuuuuagugaaaua

SEQ ID NO: 2757630 - RNA, 15 nt, Human
aaagcugaguguuuc

SEQ ID NO: 2757631 - RNA, 13 nt, Human
aaagcugccggca

SEQ ID NO: 2757632 - RNA, 18 nt, Human
aaagcuguuauuuaauua

SEQ ID NO: 2757633 - RNA, 14 nt, Human
aaagcuuauuaaaa

SEQ ID NO: 2757634 - RNA, 20 nt, Human
aaagcuuugugcagauucuu

SEQ ID NO: 2757635 - RNA, 22 nt, Human
aaagcuuugugcagauucuuua

SEQ ID NO: 2757636 - RNA, 13 nt, Human
aaaggaagcaggg

SEQ ID NO: 2757637 - RNA, 11 nt, Human
aaaggaaggaa

SEQ ID NO: 2757638 - RNA, 13 nt, Human
aaaggaaggaagg

SEQ ID NO: 2757639 - RNA, 17 nt, Human
aaaggaaggaagggaca

SEQ ID NO: 2757640 - RNA, 19 nt, Human
aaaggaaggaagggacaca

SEQ ID NO: 2757641 - RNA, 23 nt, Human
aaaggaccaguaugcuuggacug

SEQ ID NO: 2757642 - RNA, 19 nt, Human
aaaggagcaagucagaaua

SEQ ID NO: 2757643 - RNA, 18 nt, Human
aaaggcauuucuuuucug

SEQ ID NO: 2757644 - RNA, 16 nt, Human
aaaggccugucccugc

SEQ ID NO: 2757645 - RNA, 14 nt, Human
aaaggccuuuaaaa

SEQ ID NO: 2757646 - RNA, 15 nt, Human
aaagggacugagaaa

SEQ ID NO: 2757647 - RNA, 22 nt, Human
aaagggacugagaaauuuauaa

SEQ ID NO: 2757648 - RNA, 16 nt, Human
aaagggcuguuauaau

SEQ ID NO: 2757649 - RNA, 20 nt, Human
aaagguucaugcaaacuuua

SEQ ID NO: 2757650 - RNA, 13 nt, Human
aaaguaaaaacaa

SEQ ID NO: 2757651 - RNA, 22 nt, Human
aaaguaaaaacaaagaaauuau

SEQ ID NO: 2757652 - RNA, 18 nt, Human
aaaguaacccuacaaaac

SEQ ID NO: 2757653 - RNA, 21 nt, Human
aaaguaccaggugaacaaagu

SEQ ID NO: 2757654 - RNA, 13 nt, Human
aaaguacuuaaaa

SEQ ID NO: 2757655 - RNA, 16 nt, Human
aaaguacuuaaaacug

SEQ ID NO: 2757656 - RNA, 14 nt, Human
aaaguauaaauaaa

SEQ ID NO: 2757657 - RNA, 16 nt, Human
aaaguauaaauaaaau

SEQ ID NO: 2757658 - RNA, 19 nt, Human
aaaguaugugcauauuuua

SEQ ID NO: 2757659 - RNA, 20 nt, Human
aaaguaugugcauauuuuau

SEQ ID NO: 2757660 - RNA, 20 nt, Human
aaaguauguuagugcaaauu

SEQ ID NO: 2757661 - RNA, 14 nt, Human
aaaguauuuaauua

SEQ ID NO: 2757662 - RNA, 19 nt, Human
aaaguccugggauuacagg

SEQ ID NO: 2757663 - RNA, 18 nt, Human
aaagucuugccuugcuga

SEQ ID NO: 2757664 - RNA, 12 nt, Human
aaagugacaagc

SEQ ID NO: 2757665 - RNA, 11 nt, Human
aaagugcuggg

SEQ ID NO: 2757666 - RNA, 15 nt, Human
aaagugcugggauua

SEQ ID NO: 2757667 - RNA, 13 nt, Human
aaaguguuugaaa

SEQ ID NO: 2757668 - RNA, 16 nt, Human
aaaguguuugaaagcu

SEQ ID NO: 2757669 - RNA, 15 nt, Human
aaaguuaagaaucuu

SEQ ID NO: 2757670 - RNA, 13 nt, Human
aaaguucuaguga

SEQ ID NO: 2757671 - RNA, 16 nt, Human
aaaguucuagugaccg

SEQ ID NO: 2757672 - RNA, 14 nt, Human
aaaguucugcagau

SEQ ID NO: 2757673 - RNA, 17 nt, Human
aaaguucugcagauaaa

SEQ ID NO: 2757674 - RNA, 16 nt, Human
aaaguugaauuuuaca

SEQ ID NO: 2757675 - RNA, 13 nt, Human
aaaguugauuuua

SEQ ID NO: 2757676 - RNA, 22 nt, Human
aaaguuuaauggugccuucauu

SEQ ID NO: 2757677 - RNA, 16 nt, Human
aaaguuuguugaaaca

SEQ ID NO: 2757678 - RNA, 12 nt, Human
aaauaaaaaaca

SEQ ID NO: 2757679 - RNA, 15 nt, Human
aaauaaaaaacacug

SEQ ID NO: 2757680 - RNA, 13 nt, Human
aaauaaaaauaaa

SEQ ID NO: 2757681 - RNA, 14 nt, Human
aaauaaaagcacuu

SEQ ID NO: 2757682 - RNA, 11 nt, Human
aaauaaaccuu

SEQ ID NO: 2757683 - RNA, 13 nt, Human
aaauaaagaauuu

SEQ ID NO: 2757684 - RNA, 17 nt, Human
aaauaaagaauuuuaaa

SEQ ID NO: 2757685 - RNA, 21 nt, Human
aaauaaagcuugcaacaaaau

SEQ ID NO: 2757686 - RNA, 13 nt, Human
aaauaaaggaaac

SEQ ID NO: 2757687 - RNA, 13 nt, Human
aaauaaaguauau

SEQ ID NO: 2757688 - RNA, 22 nt, Human
aaauaaaguguuugaaagcuuu

SEQ ID NO: 2757689 - RNA, 20 nt, Human
auaucaguccucuuucaaag

SEQ ID NO: 2757690 - RNA, 17 nt, Human
auaucaguuauuuuuaa

SEQ ID NO: 2757691 - RNA, 19 nt, Human
auaucaguuauuuuuaaac

SEQ ID NO: 2757692 - RNA, 16 nt, Human
auauccaaagcugaau

SEQ ID NO: 2757693 - RNA, 22 nt, Human
auauccacuaaaaucaaacaau

SEQ ID NO: 2757694 - RNA, 13 nt, Human
auauccucccucc

SEQ ID NO: 2757695 - RNA, 13 nt, Human
auaucuaauauau

SEQ ID NO: 2757696 - RNA, 15 nt, Human
auaucuauauuuuac

SEQ ID NO: 2757697 - RNA, 16 nt, Human
auaucuauauuuuaca

SEQ ID NO: 2757698 - RNA, 15 nt, Human
auaucuauuaauaua

SEQ ID NO: 2757699 - RNA, 16 nt, Human
auaucuauuaauauau

SEQ ID NO: 2757700 - RNA, 15 nt, Human
auaucuuaucuuccu

SEQ ID NO: 2757701 - RNA, 13 nt, Human
auaucuucagaaa

SEQ ID NO: 2757702 - RNA, 17 nt, Human
auaucuucagaaaaccu

SEQ ID NO: 2757703 - RNA, 23 nt, Human
auaucuuguuuuggugguuuuag

SEQ ID NO: 2757704 - RNA, 14 nt, Human
auaucuuuuuuuua

SEQ ID NO: 2757705 - RNA, 17 nt, Human
auaucuuuuuuuuaaua

SEQ ID NO: 2757706 - RNA, 22 nt, Human
auaucuuuuuuuuaauaaacca

SEQ ID NO: 2757707 - RNA, 23 nt, Human
auaucuuuuuuuuaauaaaccau

SEQ ID NO: 2757708 - RNA, 23 nt, Human
auaugacuggccacacaggaucu

SEQ ID NO: 2757709 - RNA, 15 nt, Human
auaugauucaaaugu

SEQ ID NO: 2757710 - RNA, 20 nt, Human
auaugauuuguguauuauaa

SEQ ID NO: 2757711 - RNA, 19 nt, Human
auaugcauuauaaauaaau

SEQ ID NO: 2757712 - RNA, 16 nt, Human
auaugcuauuuauuaa

SEQ ID NO: 2757713 - RNA, 21 nt, Human
auaugcucuaaacauguuuau

SEQ ID NO: 2757714 - RNA, 19 nt, Human
auauggcuugaguuuaaau

SEQ ID NO: 2757715 - RNA, 18 nt, Human
auauggggaaaaaacugu

SEQ ID NO: 2757716 - RNA, 16 nt, Human
auauggggaauauauu

SEQ ID NO: 2757717 - RNA, 15 nt, Human
auaugggucuugaua

SEQ ID NO: 2757718 - RNA, 16 nt, Human
auauguaccauguaca

SEQ ID NO: 2757719 - RNA, 19 nt, Human
auauguaccauguacauga

SEQ ID NO: 2757720 - RNA, 13 nt, Human
auaauauuuuuaa

SEQ ID NO: 2757721 - RNA, 20 nt, Human
auaaucaagccuaaaauugu

SEQ ID NO: 2757722 - RNA, 15 nt, Human
auaaucagagauaaa

SEQ ID NO: 2757723 - RNA, 15 nt, Human
auaaucauuauuacu

SEQ ID NO: 2757724 - RNA, 15 nt, Human
auaauccuaaacaua

SEQ ID NO: 2757725 - RNA, 16 nt, Human
auaauccuaaacauau

SEQ ID NO: 2757726 - RNA, 14 nt, Human
auaauccucaguuu

SEQ ID NO: 2757727 - RNA, 21 nt, Human
auaauccucaguuuuugugaa

SEQ ID NO: 2757728 - RNA, 16 nt, Human
auaaucuuacaaugaa

SEQ ID NO: 2757729 - RNA, 16 nt, Human
auaaucuuucacaggg

SEQ ID NO: 2757730 - RNA, 19 nt, Human
auaaugaaauaacuaggcg

SEQ ID NO: 2757731 - RNA, 16 nt, Human
auaaugaauacuuuau

SEQ ID NO: 2757732 - RNA, 15 nt, Human
auaaugguuuuuaac

SEQ ID NO: 2757733 - RNA, 21 nt, Human
auaaugguuuuuaacaccuuu

SEQ ID NO: 2757734 - RNA, 22 nt, Human
auaauguaagacaaauauguuc

SEQ ID NO: 2757735 - RNA, 14 nt, Human
auaaugugauauua

SEQ ID NO: 2757736 - RNA, 15 nt, Human
auaaugugauauuau

SEQ ID NO: 2757737 - RNA, 16 nt, Human
auaaugugauauuaua

SEQ ID NO: 2757738 - RNA, 23 nt, Human
auaauguguucauucuggaauaa

SEQ ID NO: 2757739 - RNA, 23 nt, Human
auaauguuacauuauuaucaaca

SEQ ID NO: 2757740 - RNA, 13 nt, Human
auaauuauaauau

SEQ ID NO: 2757741 - RNA, 14 nt, Human
auaauuauaauaua

SEQ ID NO: 2757742 - RNA, 16 nt, Human
auaauuauaauauacu

SEQ ID NO: 2757743 - RNA, 11 nt, Human
auaauuuaaau

SEQ ID NO: 2757744 - RNA, 16 nt, Human
auaauuuaaauauaug

SEQ ID NO: 2757745 - RNA, 17 nt, Human
auaauuuaaauauaugc

SEQ ID NO: 2757746 - RNA, 18 nt, Human
auaauuuaaauauaugcu

SEQ ID NO: 2757747 - RNA, 13 nt, Human
auaauuuuagaca

SEQ ID NO: 2757748 - RNA, 15 nt, Human
auaauuuugugaagc

SEQ ID NO: 2757749 - RNA, 17 nt, Human
auaauuuugugaagcaa

SEQ ID NO: 2757750 - RNA, 13 nt, Human
auaauuuuuaauu

SEQ ID NO: 2757751 - RNA, 14 nt, Human
auaauuuuuauauu

SEQ ID NO: 2757752 - RNA, 21 nt, Human
auaauuuuuauauuugaaaua

SEQ ID NO: 2757753 - RNA, 13 nt, Human
auaauuuuuuaau

SEQ ID NO: 2757754 - RNA, 21 nt, Human
auaauuuuuuucaauauuuau

SEQ ID NO: 2757755 - RNA, 18 nt, Human
auacaaaaauuccuuuuc

SEQ ID NO: 2757756 - RNA, 13 nt, Human
auacaaaacccuu

SEQ ID NO: 2757757 - RNA, 18 nt, Human
auacaaaacccuuucugc

SEQ ID NO: 2757758 - RNA, 22 nt, Human
auacaaaacccuuucugccccu

SEQ ID NO: 2757759 - RNA, 17 nt, Human
agguuaaacuaaggccc

SEQ ID NO: 2757760 - RNA, 18 nt, Human
agguuaaacuaaggcccu

SEQ ID NO: 2757761 - RNA, 17 nt, Human
agguucaugcaaacuuu

SEQ ID NO: 2757762 - RNA, 14 nt, Human
agguucuucccuuu

SEQ ID NO: 2757763 - RNA, 22 nt, Human
agguucuuucuuuaaagcagga

SEQ ID NO: 2757764 - RNA, 16 nt, Human
agguugcagugagccg

SEQ ID NO: 2757765 - RNA, 20 nt, Human
agguuguguguggaagguga

SEQ ID NO: 2757766 - RNA, 17 nt, Human
agguuuuaaagcuucca

SEQ ID NO: 2757767 - RNA, 22 nt, Human
aguaaacucaauaaguuuauuu

SEQ ID NO: 2757768 - RNA, 13 nt, Human
aguaacucaucug

SEQ ID NO: 2757769 - RNA, 19 nt, Human
aguaacucauuuguuaaaa

SEQ ID NO: 2757770 - RNA, 15 nt, Human
aguaaggaauuuuau

SEQ ID NO: 2757771 - RNA, 12 nt, Human
aguaaugauaac

SEQ ID NO: 2757772 - RNA, 12 nt, Human
aguaauuggaaa

SEQ ID NO: 2757773 - RNA, 17 nt, Human
aguaauuucagaagaaa

SEQ ID NO: 2757774 - RNA, 18 nt, Human
aguaauuucagaagaaau

SEQ ID NO: 2757775 - RNA, 19 nt, Human
aguaauuucagaagaaauu

SEQ ID NO: 2757776 - RNA, 22 nt, Human
aguaauuucgucuguuuauaaa

SEQ ID NO: 2757777 - RNA, 17 nt, Human
aguacaccccaacagca

SEQ ID NO: 2757778 - RNA, 15 nt, Human
aguacagacuuuuuu

SEQ ID NO: 2757779 - RNA, 23 nt, Human
aguacucauacauguuacaacac

SEQ ID NO: 2757780 - RNA, 16 nt, Human
aguacuguguacagaa

SEQ ID NO: 2757781 - RNA, 14 nt, Human
aguacuucccgcug

SEQ ID NO: 2757782 - RNA, 22 nt, Human
aguacuucuugauaccugggau

SEQ ID NO: 2757783 - RNA, 14 nt, Human
aguacuuugugcau

SEQ ID NO: 2757784 - RNA, 18 nt, Human
aguagagacaggguuuca

SEQ ID NO: 2757785 - RNA, 12 nt, Human
aguagaugccac

SEQ ID NO: 2757786 - RNA, 18 nt, Human
aguagcugcccuuucuca

SEQ ID NO: 2757787 - RNA, 13 nt, Human
aguagcuggaggg

SEQ ID NO: 2757788 - RNA, 14 nt, Human
aguauaggccaggc

SEQ ID NO: 2757789 - RNA, 15 nt, Human
aguauaggccaggca

SEQ ID NO: 2757790 - RNA, 18 nt, Human
aguauauauaucauagca

SEQ ID NO: 2757791 - RNA, 15 nt, Human
aguauccucuugcca

SEQ ID NO: 2757792 - RNA, 22 nt, Human
aguauccuucagccugaaagag

SEQ ID NO: 2757793 - RNA, 20 nt, Human
aguaucugaggcacauguca

SEQ ID NO: 2757794 - RNA, 16 nt, Human
aguaucuuuuuauuca

SEQ ID NO: 2757795 - RNA, 13 nt, Human
aguaugaaaaugu

SEQ ID NO: 2757796 - RNA, 20 nt, Human
aguaugcacuaaucaauacu

SEQ ID NO: 2757797 - RNA, 21 nt, Human
aguaugcacuaaucaauacuu

SEQ ID NO: 2757798 - RNA, 15 nt, Human
aguaugugcauauuu

SEQ ID NO: 2757799 - RNA, 22 nt, Human
aguauguuagugcaaauuguca

SEQ ID NO: 2757800 - RNA, 22 nt, Human
aguauuauuguugcauuaaaaa

SEQ ID NO: 2757801 - RNA, 19 nt, Human
aguauuccagaccugaaga

SEQ ID NO: 2757802 - RNA, 16 nt, Human
aguauucccuuuugcu

SEQ ID NO: 2757803 - RNA, 15 nt, Human
aguauugacuuguau

SEQ ID NO: 2757804 - RNA, 15 nt, Human
aguauuuauauauuu

SEQ ID NO: 2757805 - RNA, 17 nt, Human
aguauuucuaugaaaua

SEQ ID NO: 2757806 - RNA, 18 nt, Human
aguauuucuaugaaauau

SEQ ID NO: 2757807 - RNA, 19 nt, Human
aguauuucuaugaaauauu

SEQ ID NO: 2757808 - RNA, 18 nt, Human
aguauuuuguuucagugc

SEQ ID NO: 2757809 - RNA, 19 nt, Human
agucaaauugugugaaagg

SEQ ID NO: 2757810 - RNA, 17 nt, Human
agucaacuccuuucuca

SEQ ID NO: 2757811 - RNA, 16 nt, Human
agucaagauuuccaua

SEQ ID NO: 2757812 - RNA, 22 nt, Human
agucaaucuuaucauauuucaa

SEQ ID NO: 2757813 - RNA, 19 nt, Human
aguuguaauuuuuuugugg

SEQ ID NO: 2757814 - RNA, 20 nt, Human
aguuguaccgcaaugugacu

SEQ ID NO: 2757815 - RNA, 16 nt, Human
aguuguuaauaaaagu

SEQ ID NO: 2757816 - RNA, 18 nt, Human
aguuguugcccacagcug

SEQ ID NO: 2757817 - RNA, 21 nt, Human
aguuguugcccacagcuguau

SEQ ID NO: 2757818 - RNA, 16 nt, Human
aguuuaauugacuuau

SEQ ID NO: 2757819 - RNA, 15 nt, Human
aguuuagcuggaaaa

SEQ ID NO: 2757820 - RNA, 15 nt, Human
aguuuauauagaaau

SEQ ID NO: 2757821 - RNA, 17 nt, Human
aguuuauauagaaaugu

SEQ ID NO: 2757822 - RNA, 18 nt, Human
aguuuaugcauacaguaa

SEQ ID NO: 2757823 - RNA, 20 nt, Human
aguuuaugcauacaguaauu

SEQ ID NO: 2757824 - RNA, 21 nt, Human
aguuucaguugauuuuacaau

SEQ ID NO: 2757825 - RNA, 18 nt, Human
aguuucauccuuuucauu

SEQ ID NO: 2757826 - RNA, 17 nt, Human
aguuucccuugcauggu

SEQ ID NO: 2757827 - RNA, 19 nt, Human
aguuucugaguuuuaccaa

SEQ ID NO: 2757828 - RNA, 15 nt, Human
aguuugaauguuaaa

SEQ ID NO: 2757829 - RNA, 17 nt, Human
aguuuguccuuagucac

SEQ ID NO: 2757830 - RNA, 16 nt, Human
aguuuguugaaacaca

SEQ ID NO: 2757831 - RNA, 13 nt, Human
aguuuuauaugcu

SEQ ID NO: 2757832 - RNA, 22 nt, Human
aguuuuauaugcuucuguuuua

SEQ ID NO: 2757833 - RNA, 12 nt, Human
aguuuuccuucu

SEQ ID NO: 2757834 - RNA, 13 nt, Human
aguuuuuaaagua

SEQ ID NO: 2757835 - RNA, 18 nt, Human
aguuuuugcuaauuuuua

SEQ ID NO: 2757836 - RNA, 14 nt, Human
auaaaaacaaaguu

SEQ ID NO: 2757837 - RNA, 13 nt, Human
auaaaaauaaaaa

SEQ ID NO: 2757838 - RNA, 19 nt, Human
auaaaaauggguguuauuu

SEQ ID NO: 2757839 - RNA, 22 nt, Human
auaaaaauggguguuauuuuua

SEQ ID NO: 2757840 - RNA, 23 nt, Human
auaaaacaccuuguacuuuauuu

SEQ ID NO: 2757841 - RNA, 13 nt, Human
auaaaagacagug

SEQ ID NO: 2757842 - RNA, 19 nt, Human
auaaaagacagugaaagaa

SEQ ID NO: 2757843 - RNA, 20 nt, Human
auaaaagacagugaaagaaa

SEQ ID NO: 2757844 - RNA, 20 nt, Human
auaaaagggacugagaaauu

SEQ ID NO: 2757845 - RNA, 19 nt, Human
auaaaauaaaguauauaua

SEQ ID NO: 2757846 - RNA, 14 nt, Human
auaaaauaauuuuu

SEQ ID NO: 2757847 - RNA, 17 nt, Human
auaaaauaauuuuuaua

SEQ ID NO: 2757848 - RNA, 19 nt, Human
auaaaauaauuuuuauauu

SEQ ID NO: 2757849 - RNA, 17 nt, Human
auaaaaugaauacaauu

SEQ ID NO: 2757850 - RNA, 18 nt, Human
auaaaaugaauacaauua

SEQ ID NO: 2757851 - RNA, 15 nt, Human
auaaacacucuugaa

SEQ ID NO: 2757852 - RNA, 18 nt, Human
auaaacacucuugaaaaa

SEQ ID NO: 2757853 - RNA, 17 nt, Human
auaaacauuuguagcau

SEQ ID NO: 2757854 - RNA, 13 nt, Human
auaaacucagaaa

SEQ ID NO: 2757855 - RNA, 20 nt, Human
auaaacugauuuaucuauuu

SEQ ID NO: 2757856 - RNA, 15 nt, Human
auaaagaauuuuaaa

SEQ ID NO: 2757857 - RNA, 16 nt, Human
auaaagaauuuuaaaa

SEQ ID NO: 2757858 - RNA, 14 nt, Human
auaaagcaagauaa

SEQ ID NO: 2757859 - RNA, 15 nt, Human
auaaagcaauguggu

SEQ ID NO: 2757860 - RNA, 22 nt, Human
auaaagcuugcaacaaaauucu

SEQ ID NO: 2757861 - RNA, 11 nt, Human
auaaaggaaac

SEQ ID NO: 2757862 - RNA, 20 nt, Human
auaaagguucaugcaaacuu

SEQ ID NO: 2757863 - RNA, 18 nt, Human
auaaaguauauauagaau

SEQ ID NO: 2757864 - RNA, 19 nt, Human
auaaaguauauauagaauc

SEQ ID NO: 2757865 - RNA, 20 nt, Human
auaaaguauauauagaaucu

SEQ ID NO: 2757866 - RNA, 22 nt, Human
auaaaguaugugcauauuuuau

SEQ ID NO: 2757867 - RNA, 13 nt, Human
auaaagugcuuug

SEQ ID NO: 2757868 - RNA, 15 nt, Human
auaaaguguuugaaa

SEQ ID NO: 2757869 - RNA, 19 nt, Human
auaaaguguuugaaagcuu

SEQ ID NO: 2757870 - RNA, 16 nt, Human
auaaauaaaaacaaag

SEQ ID NO: 2757871 - RNA, 20 nt, Human
auaaauaaaaacaaaguuga

SEQ ID NO: 2757872 - RNA, 14 nt, Human
auaaauaaaaauaa

SEQ ID NO: 2757873 - RNA, 16 nt, Human
auaaauaaaguuuguu

SEQ ID NO: 2757874 - RNA, 14 nt, Human
auaaauauauuuaa

SEQ ID NO: 2757875 - RNA, 15 nt, Human
auaaauauauuuaag

SEQ ID NO: 2757876 - RNA, 16 nt, Human
auaaaucuaucaaaau

SEQ ID NO: 2757877 - RNA, 20 nt, Human
auaaaucuaucaaaauuacc

SEQ ID NO: 2757878 - RNA, 18 nt, Human
auaaauggacaaaugcuu

SEQ ID NO: 2757879 - RNA, 18 nt, Human
auaaauggcuuccuggca

SEQ ID NO: 2757880 - RNA, 20 nt, Human
auaaauggcuuccuggcaau

SEQ ID NO: 2757881 - RNA, 18 nt, Human
auaaauguaucuuauuca

SEQ ID NO: 2757882 - RNA, 20 nt, Human
auaaauguugacaugggaca

SEQ ID NO: 2757883 - RNA, 18 nt, Human
auaaauuauuauuuaaac

SEQ ID NO: 2757884 - RNA, 19 nt, Human
auaaauuauuauuuaaaca

SEQ ID NO: 2757885 - RNA, 20 nt, Human
auaaauuauuguuuuucuuu

SEQ ID NO: 2757886 - RNA, 13 nt, Human
auaaauuuaucau

SEQ ID NO: 2757887 - RNA, 13 nt, Human
auaaauuuuccca

SEQ ID NO: 2757888 - RNA, 18 nt, Human
auaacaacaacaacaaaa

SEQ ID NO: 2757889 - RNA, 11 nt, Human
auaacaaugaa

SEQ ID NO: 2757890 - RNA, 13 nt, Human
auaacgauaaaag

SEQ ID NO: 2757891 - RNA, 10 nt, Human
auaacucauc

SEQ ID NO: 2757892 - RNA, 20 nt, Human
auaacucaucauaaaauaaa

SEQ ID NO: 2757893 - RNA, 21 nt, Human
auaacucugugaucuugcucu

SEQ ID NO: 2757894 - RNA, 16 nt, Human
auaacuggaaacuuca

SEQ ID NO: 2757895 - RNA, 23 nt, Human
auaacuggaaacuucagcgguuu

SEQ ID NO: 2757896 - RNA, 15 nt, Human
auaacuggaaagaag

SEQ ID NO: 2757897 - RNA, 13 nt, Human
auaagaauucugu

SEQ ID NO: 2757898 - RNA, 14 nt, Human
auaagauauuuuuc

SEQ ID NO: 2757899 - RNA, 23 nt, Human
auaagauauuuuucaugauuuug

SEQ ID NO: 2757900 - RNA, 15 nt, Human
auaagaucuuuuauu

SEQ ID NO: 2757901 - RNA, 13 nt, Human
auaagauuuaaau

SEQ ID NO: 2757902 - RNA, 17 nt, Human
auaagauuuaaauuauu

SEQ ID NO: 2757903 - RNA, 20 nt, Human
auaagcugccauauauuuug

SEQ ID NO: 2757904 - RNA, 12 nt, Human
auaagcuuuucu

SEQ ID NO: 2757905 - RNA, 14 nt, Human
auaagcuuuucuuu

SEQ ID NO: 2757906 - RNA, 21 nt, Human
auaagcuuuucuuuucuuugu

SEQ ID NO: 2757907 - RNA, 11 nt, Human
auaaggaacaa

SEQ ID NO: 2757908 - RNA, 14 nt, Human
auaaggaugauaaa

SEQ ID NO: 2757909 - RNA, 19 nt, Human
auaaggaugauaaaagcac

SEQ ID NO: 2757910 - RNA, 17 nt, Human
auaagggaggaaaaaaa

SEQ ID NO: 2757911 - RNA, 21 nt, Human
auaaguugcauagguuuaaua

SEQ ID NO: 2757912 - RNA, 15 nt, Human
auaauaaaauucauu

SEQ ID NO: 2757913 - RNA, 18 nt, Human
auaauauuaauaauaccu

SEQ ID NO: 2757914 - RNA, 12 nt, Human
auaauauuuuua

SEQ ID NO: 2757915 - RNA, 20 nt, Human
agcuaucguaaaauuaagaa

SEQ ID NO: 2757916 - RNA, 12 nt, Human
agcuaugaaggc

SEQ ID NO: 2757917 - RNA, 16 nt, Human
agcucaagggcuggca

SEQ ID NO: 2757918 - RNA, 14 nt, Human
agcucaccaguccc

SEQ ID NO: 2757919 - RNA, 17 nt, Human
agcucacuacaaccucc

SEQ ID NO: 2757920 - RNA, 20 nt, Human
agcucacuacaaccuccgcc

SEQ ID NO: 2757921 - RNA, 22 nt, Human
agcucacuacaaccuccgccuc

SEQ ID NO: 2757922 - RNA, 12 nt, Human
agcucacugcaa

SEQ ID NO: 2757923 - RNA, 17 nt, Human
agcucacugcaaccucc

SEQ ID NO: 2757924 - RNA, 17 nt, Human
agcucacugcaaccucu

SEQ ID NO: 2757925 - RNA, 20 nt, Human
agcucacugcaaccucugcc

SEQ ID NO: 2757926 - RNA, 14 nt, Human
agcucagcccuggu

SEQ ID NO: 2757927 - RNA, 14 nt, Human
agcucaggcuggca

SEQ ID NO: 2757928 - RNA, 20 nt, Human
agcucaggcuggcaccgcug

SEQ ID NO: 2757929 - RNA, 18 nt, Human
agcucagggcucuuuccu

SEQ ID NO: 2757930 - RNA, 19 nt, Human
agcucaugaguaacugauu

SEQ ID NO: 2757931 - RNA, 15 nt, Human
agcuccagcugcucu

SEQ ID NO: 2757932 - RNA, 16 nt, Human
agcuccagugauaaga

SEQ ID NO: 2757933 - RNA, 16 nt, Human
agcuccgcgccaggau

SEQ ID NO: 2757934 - RNA, 11 nt, Human
agcuccuccuu

SEQ ID NO: 2757935 - RNA, 18 nt, Human
agcucguggaacaguuac

SEQ ID NO: 2757936 - RNA, 13 nt, Human
agcucgugggaca

SEQ ID NO: 2757937 - RNA, 15 nt, Human
agcucgugggacagu

SEQ ID NO: 2757938 - RNA, 19 nt, Human
agcucgugggacagucacc

SEQ ID NO: 2757939 - RNA, 19 nt, Human
agcucuaaaugucaaucag

SEQ ID NO: 2757940 - RNA, 18 nt, Human
agcucuaucaccaaggag

SEQ ID NO: 2757941 - RNA, 13 nt, Human
agcucuaucccaa

SEQ ID NO: 2757942 - RNA, 17 nt, Human
agcucuaucccaaccuc

SEQ ID NO: 2757943 - RNA, 22 nt, Human
agcucuaucccaaccucuccca

SEQ ID NO: 2757944 - RNA, 15 nt, Human
agcucuccccuucuc

SEQ ID NO: 2757945 - RNA, 20 nt, Human
agcucugaagaacucucugg

SEQ ID NO: 2757946 - RNA, 17 nt, Human
agcucugcccauccugc

SEQ ID NO: 2757947 - RNA, 19 nt, Human
agcucugcccauccugccc

SEQ ID NO: 2757948 - RNA, 14 nt, Human
agcugaacuuguug

SEQ ID NO: 2757949 - RNA, 14 nt, Human
agcugcaggggccu

SEQ ID NO: 2757950 - RNA, 16 nt, Human
agcugcauuucagaaa

SEQ ID NO: 2757951 - RNA, 20 nt, Human
agcugcccccagagccacag

SEQ ID NO: 2757952 - RNA, 21 nt, Human
agcugcccccagagccacagu

SEQ ID NO: 2757953 - RNA, 15 nt, Human
agcugccccggggag

SEQ ID NO: 2757954 - RNA, 22 nt, Human
agcugccccggggaggggcgcu

SEQ ID NO: 2757955 - RNA, 20 nt, Human
agcugcccucuccugggcag

SEQ ID NO: 2757956 - RNA, 21 nt, Human
agcugcccuuucucagggcag

SEQ ID NO: 2757957 - RNA, 18 nt, Human
agcugccuccccagcucu

SEQ ID NO: 2757958 - RNA, 14 nt, Human
agcugccuccccuc

SEQ ID NO: 2757959 - RNA, 17 nt, Human
agcugccuccccuccuc

SEQ ID NO: 2757960 - RNA, 18 nt, Human
agcugccuccccuccucu

SEQ ID NO: 2757961 - RNA, 18 nt, Human
agcugcucaauaaaguac

SEQ ID NO: 2757962 - RNA, 17 nt, Human
agcuggaaacacauguu

SEQ ID NO: 2757963 - RNA, 22 nt, Human
agcuggaccucaccaagcugcu

SEQ ID NO: 2757964 - RNA, 21 nt, Human
agcuggaggcacccaugccau

SEQ ID NO: 2757965 - RNA, 21 nt, Human
agcuggccuugugaggagcug

SEQ ID NO: 2757966 - RNA, 18 nt, Human
agcugggcagaaggccaa

SEQ ID NO: 2757967 - RNA, 15 nt, Human
agcuggggccaggcu

SEQ ID NO: 2757968 - RNA, 19 nt, Human
agcuggggccaggcugggu

SEQ ID NO: 2757969 - RNA, 15 nt, Human
agcugguggcucugu

SEQ ID NO: 2757970 - RNA, 15 nt, Human
agcugugaccucucc

SEQ ID NO: 2757971 - RNA, 14 nt, Human
agcuguugagcugu

SEQ ID NO: 2757972 - RNA, 12 nt, Human
agcuguugugug

SEQ ID NO: 2757973 - RNA, 14 nt, Human
agcuuaaacagcug

SEQ ID NO: 2757974 - RNA, 14 nt, Human
agcuuagaccucag

SEQ ID NO: 2757975 - RNA, 18 nt, Human
agcuuagaccucagccug

SEQ ID NO: 2757976 - RNA, 20 nt, Human
agcuuauuaaaacucauuuu

SEQ ID NO: 2757977 - RNA, 20 nt, Human
agcuuauugucuagugaaac

SEQ ID NO: 2757978 - RNA, 22 nt, Human
agcuucaagaaauuacuggaag

SEQ ID NO: 2757979 - RNA, 13 nt, Human
agcuucacccuga

SEQ ID NO: 2757980 - RNA, 18 nt, Human
agcuucacuguaaaauaa

SEQ ID NO: 2757981 - RNA, 18 nt, Human
agcuucagccaggagcug

SEQ ID NO: 2757982 - RNA, 18 nt, Human
agcuucucaauuucuaca

SEQ ID NO: 2757983 - RNA, 18 nt, Human
agcuucucauccugcagg

SEQ ID NO: 2757984 - RNA, 19 nt, Human
agcuucucauccugcaggc

SEQ ID NO: 2757985 - RNA, 20 nt, Human
agcuucucauccugcaggca

SEQ ID NO: 2757986 - RNA, 13 nt, Human
agcuucuguuccg

SEQ ID NO: 2757987 - RNA, 13 nt, Human
agcuugaaacuga

SEQ ID NO: 2757988 - RNA, 20 nt, Human
agcuugaaacugagauguga

SEQ ID NO: 2757989 - RNA, 14 nt, Human
agcuugaaauagug

SEQ ID NO: 2757990 - RNA, 19 nt, Human
agcuugaaauagugucuga

SEQ ID NO: 2757991 - RNA, 12 nt, Human
agcuugcaacaa

SEQ ID NO: 2757992 - RNA, 20 nt, Human
agcuugcaacaaaauucucu

SEQ ID NO: 2757993 - RNA, 18 nt, Human
agcuugcaugcuugcaua

SEQ ID NO: 2757994 - RNA, 19 nt, Human
agcuugcccuggugccuca

SEQ ID NO: 2757995 - RNA, 17 nt, Human
agcuugcccuguuaaaa

SEQ ID NO: 2757996 - RNA, 22 nt, Human
agcuugcccuguuaaaagauga

SEQ ID NO: 2757997 - RNA, 15 nt, Human
agcuuuaaaggccag

SEQ ID NO: 2757998 - RNA, 18 nt, Human
agcuuugaggaaaauggg

SEQ ID NO: 2757999 - RNA, 20 nt, Human
agcuuuuuucucugauacag

SEQ ID NO: 2758000 - RNA, 18 nt, Human
aggaaaaaauaacaauga

SEQ ID NO: 2758001 - RNA, 10 nt, Human
aggaaaaggg

SEQ ID NO: 2758002 - RNA, 17 nt, Human
aggaaaauacuauucug

SEQ ID NO: 2758003 - RNA, 19 nt, Human
aggaaaauggacaucaaaa

SEQ ID NO: 2758004 - RNA, 12 nt, Human
aggaaacuaggu

SEQ ID NO: 2758005 - RNA, 13 nt, Human
aggaaagagagca

SEQ ID NO: 2758006 - RNA, 14 nt, Human
aggaaagaugugaa

SEQ ID NO: 2758007 - RNA, 22 nt, Human
aggaaaucaaauaugcaaagca

SEQ ID NO: 2758008 - RNA, 15 nt, Human
aggaacuggugucuu

SEQ ID NO: 2758009 - RNA, 19 nt, Human
aggaacuggugucuucagg

SEQ ID NO: 2758010 - RNA, 13 nt, Human
aggaagaucccuu

SEQ ID NO: 2758011 - RNA, 21 nt, Human
aggaagaucccuuuguccaca

SEQ ID NO: 2758012 - RNA, 15 nt, Human
aggaaggcuuacacc

SEQ ID NO: 2758013 - RNA, 16 nt, Human
aggaaguauaggccag

SEQ ID NO: 2758014 - RNA, 18 nt, Human
aggaaguauaggccaggc

SEQ ID NO: 2758015 - RNA, 21 nt, Human
aggaaguauaggccaggcaca

SEQ ID NO: 2758016 - RNA, 17 nt, Human
aggaauacauaaaguau

SEQ ID NO: 2758017 - RNA, 13 nt, Human
aggaauccucugu

SEQ ID NO: 2758018 - RNA, 20 nt, Human
aggaaugaaguacucauaca

SEQ ID NO: 2758019 - RNA, 13 nt, Human
aggaauugaccca

SEQ ID NO: 2758020 - RNA, 14 nt, Human
aggaauugacccac

SEQ ID NO: 2758021 - RNA, 19 nt, Human
aggaauugacccacaagaa

SEQ ID NO: 2758022 - RNA, 16 nt, Human
aggaauuuaaaaaucc

SEQ ID NO: 2758023 - RNA, 20 nt, Human
aggacaaaaggaauguguaa

SEQ ID NO: 2758024 - RNA, 22 nt, Human
aggacaccauuuuggcaagcuc

SEQ ID NO: 2758025 - RNA, 15 nt, Human
aggacagcccuucuu

SEQ ID NO: 2758026 - RNA, 21 nt, Human
aggacagcccuucuuuccaca

SEQ ID NO: 2758027 - RNA, 13 nt, Human
aggacccuucccu

SEQ ID NO: 2758028 - RNA, 16 nt, Human
aggacgcucucuggcc

SEQ ID NO: 2758029 - RNA, 14 nt, Human
aggacugaauuaug

SEQ ID NO: 2758030 - RNA, 16 nt, Human
aggacugaauuaugaa

SEQ ID NO: 2758031 - RNA, 20 nt, Human
aggagacaaaacuagagacu

SEQ ID NO: 2758032 - RNA, 14 nt, Human
aggagaccuacccu

SEQ ID NO: 2758033 - RNA, 18 nt, Human
aggagaccuacccuccac

SEQ ID NO: 2758034 - RNA, 17 nt, Human
aggagaggcaaagaaag

SEQ ID NO: 2758035 - RNA, 20 nt, Human
aggagaggcaaagaaaggag

SEQ ID NO: 2758036 - RNA, 15 nt, Human
aggagauggaaguug

SEQ ID NO: 2758037 - RNA, 15 nt, Human
aggagcucccaggag

SEQ ID NO: 2758038 - RNA, 23 nt, Human
aggagcugggcagaaggccaaga

SEQ ID NO: 2758039 - RNA, 16 nt, Human
aggaggacaaaaggaa

SEQ ID NO: 2758040 - RNA, 16 nt, Human
aggaggaucacuugag

SEQ ID NO: 2758041 - RNA, 19 nt, Human
aggagguccuuaggccucu

SEQ ID NO: 2758042 - RNA, 16 nt, Human
aggaguacaccccaac

SEQ ID NO: 2758043 - RNA, 21 nt, Human
aggaguacaccccaacagcac

SEQ ID NO: 2758044 - RNA, 10 nt, Human
aggauaaagu

SEQ ID NO: 2758045 - RNA, 13 nt, Human
aggauaagaggga

SEQ ID NO: 2758046 - RNA, 20 nt, Human
aggauauucucacagcucca

SEQ ID NO: 2758047 - RNA, 20 nt, Human
aggaugaggaaagcauguau

SEQ ID NO: 2758048 - RNA, 17 nt, Human
aggaugagggaaaagaa

SEQ ID NO: 2758049 - RNA, 20 nt, Human
aggaugagggaaaagaaaaa

SEQ ID NO: 2758050 - RNA, 22 nt, Human
aggaugccccgucccccucugg

SEQ ID NO: 2758051 - RNA, 11 nt, Human
aggauggagcc

SEQ ID NO: 2758052 - RNA, 21 nt, Human
aggauggcaggaggcauccaa

SEQ ID NO: 2758053 - RNA, 22 nt, Human
aggauggcuuugaaugcggccc

SEQ ID NO: 2758054 - RNA, 23 nt, Human
aggaugguucccuugaugaagaa

SEQ ID NO: 2758055 - RNA, 17 nt, Human
aggauguggggaaguua

SEQ ID NO: 2758056 - RNA, 14 nt, Human
aggauguugaaaaa

SEQ ID NO: 2758057 - RNA, 17 nt, Human
aggauuaaugucaauuc

SEQ ID NO: 2758058 - RNA, 13 nt, Human
aggauuugaaauu

SEQ ID NO: 2758059 - RNA, 14 nt, Human
aggauuugggcucu

SEQ ID NO: 2758060 - RNA, 20 nt, Human
aggauuuuaagggaagggga

SEQ ID NO: 2758061 - RNA, 21 nt, Human
aggcaacugaggcagacagca

SEQ ID NO: 2758062 - RNA, 12 nt, Human
aggcaagagaau

SEQ ID NO: 2758063 - RNA, 14 nt, Human
aggcaagagaauug

SEQ ID NO: 2758064 - RNA, 17 nt, Human
aggcacagaaacuccug

SEQ ID NO: 2758065 - RNA, 19 nt, Human
aggcacagcagcugcaggg

SEQ ID NO: 2758066 - RNA, 22 nt, Human
aggcaccaggacuagggcugga

SEQ ID NO: 2758067 - RNA, 20 nt, Human
aggcacccccagaaugaccu

SEQ ID NO: 2758068 - RNA, 23 nt, Human
aggcacccccagaaugaccuggc

SEQ ID NO: 2758069 - RNA, 14 nt, Human
aggcaccucucugg

SEQ ID NO: 2758070 - RNA, 15 nt, Human
aggcaccucucuggg

SEQ ID NO: 2758071 - RNA, 21 nt, Human
aggcaccugucccagaaaaag

SEQ ID NO: 2758072 - RNA, 22 nt, Human
aggcacugccaaaacaucaacc

SEQ ID NO: 2758073 - RNA, 22 nt, Human
aggcagaagcaacccaaauguu

SEQ ID NO: 2758074 - RNA, 15 nt, Human
aggcagacagcagcu

SEQ ID NO: 2758075 - RNA, 15 nt, Human
aggcagauguuccua

SEQ ID NO: 2758076 - RNA, 21 nt, Human
aggcagcaggauagaguggga

SEQ ID NO: 2758077 - RNA, 14 nt, Human
aggcagcuugaaac

SEQ ID NO: 2758078 - RNA, 22 nt, Human
aggcaggaacaaacagggcugc

SEQ ID NO: 2758079 - RNA, 11 nt, Human
aggcaggagga

SEQ ID NO: 2758080 - RNA, 14 nt, Human
aggcaggaggauca

SEQ ID NO: 2758081 - RNA, 20 nt, Human
aggcagggucaggagagggg

SEQ ID NO: 2758082 - RNA, 13 nt, Human
aggcauccccagg

SEQ ID NO: 2758083 - RNA, 22 nt, Human
aggcauccccaggcccugcucu

SEQ ID NO: 2758084 - RNA, 17 nt, Human
aggcaugagucagucug

SEQ ID NO: 2758085 - RNA, 12 nt, Human
aggccaagaggc

SEQ ID NO: 2758086 - RNA, 16 nt, Human
aggccaugggacaggg

SEQ ID NO: 2758087 - RNA, 22 nt, Human
aggcccccgggccgacggagcc

SEQ ID NO: 2758088 - RNA, 10 nt, Human
aggccgggcg

SEQ ID NO: 2758089 - RNA, 16 nt, Human
aggccucacacacaau

SEQ ID NO: 2758090 - RNA, 13 nt, Human
aggccuggugugu

SEQ ID NO: 2758091 - RNA, 14 nt, Human
aggccuuuaaaauu

SEQ ID NO: 2758092 - RNA, 15 nt, Human
aggccuuucccuaag

SEQ ID NO: 2758093 - RNA, 19 nt, Human
aggcgaucacaacgugcau

SEQ ID NO: 2758094 - RNA, 18 nt, Human
aggcggauugagaaggag

SEQ ID NO: 2758095 - RNA, 14 nt, Human
aggcgggaaggagg

SEQ ID NO: 2758096 - RNA, 20 nt, Human
aggcggguccgggucgcagg

SEQ ID NO: 2758097 - RNA, 15 nt, Human
aggcgugagccacca

SEQ ID NO: 2758098 - RNA, 21 nt, Human
aggcuaaagcccagagacagc

SEQ ID NO: 2758099 - RNA, 18 nt, Human
aggcuacagaacuaaaaa

SEQ ID NO: 2758100 - RNA, 17 nt, Human
aggcuagaaccaccugc

SEQ ID NO: 2758101 - RNA, 13 nt, Human
aggcuagauguau

SEQ ID NO: 2758102 - RNA, 14 nt, Human
aggcucaaaacagg

SEQ ID NO: 2758103 - RNA, 14 nt, Human
aggcuccacuuggu

SEQ ID NO: 2758104 - RNA, 20 nt, Human
aggcuccacuuggucuguga

SEQ ID NO: 2758105 - RNA, 22 nt, Human
aggcuccccuccucggcuuccu

SEQ ID NO: 2758106 - RNA, 13 nt, Human
aggcucuaaugua

SEQ ID NO: 2758107 - RNA, 18 nt, Human
aggcucuaauguacaaua

SEQ ID NO: 2758108 - RNA, 19 nt, Human
aggcucuaauguacaauaa

SEQ ID NO: 2758109 - RNA, 22 nt, Human
aggcucuaauguacaauaaagc

SEQ ID NO: 2758110 - RNA, 21 nt, Human
aggcugagagcccaaacugcu

SEQ ID NO: 2758111 - RNA, 23 nt, Human
aggcugaggcaggaggaucacuu

SEQ ID NO: 2758112 - RNA, 18 nt, Human
aggcugaugggcaaaaaa

SEQ ID NO: 2758113 - RNA, 15 nt, Human
aggcugauuaaacca

SEQ ID NO: 2758114 - RNA, 16 nt, Human
aggcugcucagggcug

SEQ ID NO: 2758115 - RNA, 17 nt, Human
aggcuggagugcagugg

SEQ ID NO: 2758116 - RNA, 21 nt, Human
aggcuggagugcaguggcgca

SEQ ID NO: 2758117 - RNA, 17 nt, Human
aggcuggcgugcagcau

SEQ ID NO: 2758118 - RNA, 19 nt, Human
aggcuggcgugcagcauca

SEQ ID NO: 2758119 - RNA, 17 nt, Human
aggcugggucgcccugg

SEQ ID NO: 2758120 - RNA, 13 nt, Human
aggcuggucucga

SEQ ID NO: 2758121 - RNA, 23 nt, Human
aggcuggucucgaacugcuggau

SEQ ID NO: 2758122 - RNA, 19 nt, Human
aggcuguugucuuuuccuu

SEQ ID NO: 2758123 - RNA, 20 nt, Human
aggcuguugucuuuuccuuc

SEQ ID NO: 2758124 - RNA, 23 nt, Human
aggcuuacacccacaguggaaag

SEQ ID NO: 2758125 - RNA, 22 nt, Human
aggcuuagacccucaugcugcc

SEQ ID NO: 2758126 - RNA, 18 nt, Human
aggcuugaaucaaagaac

SEQ ID NO: 2758127 - RNA, 15 nt, Human
aggcuugccugcagg

SEQ ID NO: 2758128 - RNA, 16 nt, Human
aggcuugccugcaggc

SEQ ID NO: 2758129 - RNA, 17 nt, Human
aggcuugccugcaggca

SEQ ID NO: 2758130 - RNA, 20 nt, Human
aggcuuucuuuuuuuucuuu

SEQ ID NO: 2758131 - RNA, 20 nt, Human
aggcuuugcccugcugcccu

SEQ ID NO: 2758132 - RNA, 21 nt, Human
aggcuuuuuuaucaugugaaa

SEQ ID NO: 2758133 - RNA, 14 nt, Human
agggaaacugccag

SEQ ID NO: 2758134 - RNA, 19 nt, Human
agggaaacugccagcaacg

SEQ ID NO: 2758135 - RNA, 15 nt, Human
agggaagagguggcc

SEQ ID NO: 2758136 - RNA, 17 nt, Human
agggaagggggaacaug

SEQ ID NO: 2758137 - RNA, 23 nt, Human
agggaagggggaacaugagccuu

SEQ ID NO: 2758138 - RNA, 19 nt, Human
agggaauugcagaguacug

SEQ ID NO: 2758139 - RNA, 12 nt, Human
agggacccccaa

SEQ ID NO: 2758140 - RNA, 15 nt, Human
agggacucagguggc

SEQ ID NO: 2758141 - RNA, 23 nt, Human
agggacuucugucuucacaacag

SEQ ID NO: 2758142 - RNA, 13 nt, Human
agggaggacgcuc

SEQ ID NO: 2758143 - RNA, 15 nt, Human
agggaggacgcucuc

SEQ ID NO: 2758144 - RNA, 16 nt, Human
agggaggacgcucucu

SEQ ID NO: 2758145 - RNA, 21 nt, Human
agggaggacgcucucuggccu

SEQ ID NO: 2758146 - RNA, 13 nt, Human
agggagggaaggg

SEQ ID NO: 2758147 - RNA, 16 nt, Human
agggagggaaggggga

SEQ ID NO: 2758148 - RNA, 14 nt, Human
agggagguggcugg

SEQ ID NO: 2758149 - RNA, 17 nt, Human
agggagucucagcuuca

SEQ ID NO: 2758150 - RNA, 22 nt, Human
agggagucucagcuucacccug

SEQ ID NO: 2758151 - RNA, 14 nt, Human
agggauccugccug

SEQ ID NO: 2758152 - RNA, 14 nt, Human
agggauggcaagau

SEQ ID NO: 2758153 - RNA, 19 nt, Human
agggauuuucagcccucag

SEQ ID NO: 2758154 - RNA, 21 nt, Human
agggauuuucagcccucagaa

SEQ ID NO: 2758155 - RNA, 12 nt, Human
agggcaagagag

SEQ ID NO: 2758156 - RNA, 14 nt, Human
agggcaagagagcg

SEQ ID NO: 2758157 - RNA, 20 nt, Human
agggcagaugaugcuuugag

SEQ ID NO: 2758158 - RNA, 21 nt, Human
agggcagaugaugcuuugaga

SEQ ID NO: 2758159 - RNA, 16 nt, Human
agggcaguguucccug

SEQ ID NO: 2758160 - RNA, 14 nt, Human
agggccccagcacu

SEQ ID NO: 2758161 - RNA, 17 nt, Human
agggccuggcugggagu

SEQ ID NO: 2758162 - RNA, 18 nt, Human
agggccuggggagaugga

SEQ ID NO: 2758163 - RNA, 23 nt, Human
agggcgcggggcggggagcgagc

SEQ ID NO: 2758164 - RNA, 14 nt, Human
agggcuaauaucuu

SEQ ID NO: 2758165 - RNA, 18 nt, Human
agggcuacgcgcgcuccg

SEQ ID NO: 2758166 - RNA, 17 nt, Human
agggcuauuuuuucccc

SEQ ID NO: 2758167 - RNA, 14 nt, Human
agggcuugaggacu

SEQ ID NO: 2758168 - RNA, 22 nt, Human
agggcuuggacucaagcaagau

SEQ ID NO: 2758169 - RNA, 14 nt, Human
aggggaccagagag

SEQ ID NO: 2758170 - RNA, 12 nt, Human
aggggcgcucgc

SEQ ID NO: 2758171 - RNA, 17 nt, Human
aggggcgcucgcuuccg

SEQ ID NO: 2758172 - RNA, 13 nt, Human
agggggaacauga

SEQ ID NO: 2758173 - RNA, 19 nt, Human
aggggggucagccagcccu

SEQ ID NO: 2758174 - RNA, 14 nt, Human
agggggugggggug

SEQ ID NO: 2758175 - RNA, 19 nt, Human
agggucaggagaggggcag

SEQ ID NO: 2758176 - RNA, 19 nt, Human
aggguccugucgaagggga

SEQ ID NO: 2758177 - RNA, 22 nt, Human
aggguccuuugggaaaggagaa

SEQ ID NO: 2758178 - RNA, 21 nt, Human
agggugauauuaaccaggggc

SEQ ID NO: 2758179 - RNA, 18 nt, Human
agggugggggugcucucu

SEQ ID NO: 2758180 - RNA, 19 nt, Human
agggugggggugcucucuc

SEQ ID NO: 2758181 - RNA, 20 nt, Human
agggugggggugcucucucu

SEQ ID NO: 2758182 - RNA, 21 nt, Human
agggugggggugcucucucug

SEQ ID NO: 2758183 - RNA, 18 nt, Human
aggguucagagacucagg

SEQ ID NO: 2758184 - RNA, 17 nt, Human
aggguuggagcaggggu

SEQ ID NO: 2758185 - RNA, 14 nt, Human
aggguuuggaagcc

SEQ ID NO: 2758186 - RNA, 15 nt, Human
aggguuuggaagcca

SEQ ID NO: 2758187 - RNA, 14 nt, Human
agguaaaacagggc

SEQ ID NO: 2758188 - RNA, 21 nt, Human
agguaaaaucuacaguacacc

SEQ ID NO: 2758189 - RNA, 13 nt, Human
agguaaaucagac

SEQ ID NO: 2758190 - RNA, 23 nt, Human
agguaaccccagauucaugcacu

SEQ ID NO: 2758191 - RNA, 13 nt, Human
agguaccuucuca

SEQ ID NO: 2758192 - RNA, 13 nt, Human
agguagacaguau

SEQ ID NO: 2758193 - RNA, 19 nt, Human
agguagacaguauauaacu

SEQ ID NO: 2758194 - RNA, 16 nt, Human
agguauccaaaaaugu

SEQ ID NO: 2758195 - RNA, 18 nt, Human
agguauuuauugagcacc

SEQ ID NO: 2758196 - RNA, 12 nt, Human
agguauuuuaau

SEQ ID NO: 2758197 - RNA, 23 nt, Human
agguauuuuaaucaccaaggcug

SEQ ID NO: 2758198 - RNA, 17 nt, Human
aggucacacaaccuguc

SEQ ID NO: 2758199 - RNA, 19 nt, Human
aggucacacaaccuguccc

SEQ ID NO: 2758200 - RNA, 17 nt, Human
agguccacaacacacag

SEQ ID NO: 2758201 - RNA, 18 nt, Human
agguccacaacacacaga

SEQ ID NO: 2758202 - RNA, 23 nt, Human
agguccuuaggccucugagaagc

SEQ ID NO: 2758203 - RNA, 18 nt, Human
aggucuaccaaaaaucuc

SEQ ID NO: 2758204 - RNA, 20 nt, Human
aggucuaccaaaaaucucaa

SEQ ID NO: 2758205 - RNA, 15 nt, Human
aggucuaggugcuuu

SEQ ID NO: 2758206 - RNA, 15 nt, Human
aggucucaauaccug

SEQ ID NO: 2758207 - RNA, 21 nt, Human
aggucuuucuuuccgaggccc

SEQ ID NO: 2758208 - RNA, 23 nt, Human
aggucuuucuuuccgaggccccu

SEQ ID NO: 2758209 - RNA, 20 nt, Human
aggugacuauuauauuucca

SEQ ID NO: 2758210 - RNA, 16 nt, Human
aggugagcaucaucuu

SEQ ID NO: 2758211 - RNA, 22 nt, Human
aggugcuacaaaaacacagcaa

SEQ ID NO: 2758212 - RNA, 18 nt, Human
aggugcuaucgcaccacu

SEQ ID NO: 2758213 - RNA, 19 nt, Human
aggugcuaucgcaccacug

SEQ ID NO: 2758214 - RNA, 15 nt, Human
agguguguugcagug

SEQ ID NO: 2758215 - RNA, 15 nt, Human
agcauuacagugggu

SEQ ID NO: 2758216 - RNA, 13 nt, Human
agcauucugucuu

SEQ ID NO: 2758217 - RNA, 18 nt, Human
agcauuguuggcuguucc

SEQ ID NO: 2758218 - RNA, 20 nt, Human
agcauuguuggcuguuccug

SEQ ID NO: 2758219 - RNA, 22 nt, Human
agcauuguuggcuguuccugca

SEQ ID NO: 2758220 - RNA, 15 nt, Human
agcauuuagauguau

SEQ ID NO: 2758221 - RNA, 21 nt, Human
agcauuuguguugaagagguu

SEQ ID NO: 2758222 - RNA, 22 nt, Human
agcauuuuacuacuuuaaaaaa

SEQ ID NO: 2758223 - RNA, 20 nt, Human
agccaaaagauuggauacgc

SEQ ID NO: 2758224 - RNA, 22 nt, Human
agccaaacauccuacaagacac

SEQ ID NO: 2758225 - RNA, 23 nt, Human
agccaaacauccuacaagacaca

SEQ ID NO: 2758226 - RNA, 18 nt, Human
agccaaauguaaaauagu

SEQ ID NO: 2758227 - RNA, 16 nt, Human
agccaacuauggccug

SEQ ID NO: 2758228 - RNA, 13 nt, Human
agccaagugcagg

SEQ ID NO: 2758229 - RNA, 18 nt, Human
agccaccacauccagccu

SEQ ID NO: 2758230 - RNA, 19 nt, Human
agccaccacauccagccua

SEQ ID NO: 2758231 - RNA, 23 nt, Human
agccaccaguccauugggcaggc

SEQ ID NO: 2758232 - RNA, 19 nt, Human
agccacggggacucagccc

SEQ ID NO: 2758233 - RNA, 16 nt, Human
agccagacaucaacag

SEQ ID NO: 2758234 - RNA, 18 nt, Human
agccagaucuaugccaca

SEQ ID NO: 2758235 - RNA, 20 nt, Human
agccagauuuuccugaaaac

SEQ ID NO: 2758236 - RNA, 13 nt, Human
agccagcagccag

SEQ ID NO: 2758237 - RNA, 12 nt, Human
agccagcaguuc

SEQ ID NO: 2758238 - RNA, 20 nt, Human
agccagcaguucagagcugc

SEQ ID NO: 2758239 - RNA, 16 nt, Human
agccagcccucuucug

SEQ ID NO: 2758240 - RNA, 15 nt, Human
agccagcucucagcc

SEQ ID NO: 2758241 - RNA, 14 nt, Human
agccaggacccagg

SEQ ID NO: 2758242 - RNA, 16 nt, Human
agccaggaggccugcu

SEQ ID NO: 2758243 - RNA, 15 nt, Human
agccagggcugucuu

SEQ ID NO: 2758244 - RNA, 11 nt, Human
agccagguacc

SEQ ID NO: 2758245 - RNA, 15 nt, Human
agccagguucugacu

SEQ ID NO: 2758246 - RNA, 21 nt, Human
agccagguucugacucuuggc

SEQ ID NO: 2758247 - RNA, 12 nt, Human
agccagugaaaa

SEQ ID NO: 2758248 - RNA, 20 nt, Human
agccaucaccuuagaccacc

SEQ ID NO: 2758249 - RNA, 22 nt, Human
agccaugggagacacugaugua

SEQ ID NO: 2758250 - RNA, 21 nt, Human
agccaugugauuccaucuugc

SEQ ID NO: 2758251 - RNA, 14 nt, Human
agcccaaaagucaa

SEQ ID NO: 2758252 - RNA, 20 nt, Human
agcccaaagugguauagaaa

SEQ ID NO: 2758253 - RNA, 23 nt, Human
agcccaaagugguauagaaaugc

SEQ ID NO: 2758254 - RNA, 17 nt, Human
agcccaagauaucagcc

SEQ ID NO: 2758255 - RNA, 12 nt, Human
agcccaauauua

SEQ ID NO: 2758256 - RNA, 21 nt, Human
agcccagcuugaaaccuucac

SEQ ID NO: 2758257 - RNA, 23 nt, Human
agcccaggaauuggaaagcagcc

SEQ ID NO: 2758258 - RNA, 16 nt, Human
agcccaucauaauaua

SEQ ID NO: 2758259 - RNA, 20 nt, Human
agcccaucauaauauaaaac

SEQ ID NO: 2758260 - RNA, 13 nt, Human
agccccaucagcu

SEQ ID NO: 2758261 - RNA, 19 nt, Human
agccccaucuccucagcac

SEQ ID NO: 2758262 - RNA, 15 nt, Human
agccccgggaguggc

SEQ ID NO: 2758263 - RNA, 17 nt, Human
agccccucacacagccc

SEQ ID NO: 2758264 - RNA, 17 nt, Human
agccccucuccuggaag

SEQ ID NO: 2758265 - RNA, 15 nt, Human
agccccugggaccag

SEQ ID NO: 2758266 - RNA, 13 nt, Human
agccccugggccc

SEQ ID NO: 2758267 - RNA, 17 nt, Human
agccccuugggcagguc

SEQ ID NO: 2758268 - RNA, 19 nt, Human
agcccuccuuaucaaagga

SEQ ID NO: 2758269 - RNA, 23 nt, Human
agcccuccuuaucaaaggacacc

SEQ ID NO: 2758270 - RNA, 20 nt, Human
agcccucuucugacacuaaa

SEQ ID NO: 2758271 - RNA, 18 nt, Human
agcccugcaccaugcugc

SEQ ID NO: 2758272 - RNA, 21 nt, Human
agcccugcaccaugcugcugg

SEQ ID NO: 2758273 - RNA, 18 nt, Human
agcccugcagucacagcu

SEQ ID NO: 2758274 - RNA, 16 nt, Human
agcccugccucaagcu

SEQ ID NO: 2758275 - RNA, 22 nt, Human
agcccuggcaacugcuaaucua

SEQ ID NO: 2758276 - RNA, 21 nt, Human
agcccugggauagugcugucu

SEQ ID NO: 2758277 - RNA, 20 nt, Human
agcccuggugggcagagagg

SEQ ID NO: 2758278 - RNA, 18 nt, Human
agcccugucuccucucuc

SEQ ID NO: 2758279 - RNA, 22 nt, Human
agcccugucuccucucucugua

SEQ ID NO: 2758280 - RNA, 17 nt, Human
agcccuuccccucugca

SEQ ID NO: 2758281 - RNA, 21 nt, Human
agcccuuccccucugcagcuu

SEQ ID NO: 2758282 - RNA, 21 nt, Human
agcccuucuuuccacagaagc

SEQ ID NO: 2758283 - RNA, 16 nt, Human
agccgagccucaagau

SEQ ID NO: 2758284 - RNA, 21 nt, Human
agccgcuccugucugccagcc

SEQ ID NO: 2758285 - RNA, 17 nt, Human
agccggagccuccagcu

SEQ ID NO: 2758286 - RNA, 13 nt, Human
agccgggaaagaa

SEQ ID NO: 2758287 - RNA, 15 nt, Human
agccgggaaagaaga

SEQ ID NO: 2758288 - RNA, 17 nt, Human
agccgggaaagaagagc

SEQ ID NO: 2758289 - RNA, 21 nt, Human
agccgggaaagaagagccgga

SEQ ID NO: 2758290 - RNA, 15 nt, Human
agccgggcauggugg

SEQ ID NO: 2758291 - RNA, 20 nt, Human
agccgguccuugcugcaccu

SEQ ID NO: 2758292 - RNA, 21 nt, Human
agccgguccuugcugcaccug

SEQ ID NO: 2758293 - RNA, 21 nt, Human
agccgucaaaagagucuuaau

SEQ ID NO: 2758294 - RNA, 21 nt, Human
agccuaacacggugcucauuu

SEQ ID NO: 2758295 - RNA, 18 nt, Human
agccuaagggauccugcc

SEQ ID NO: 2758296 - RNA, 21 nt, Human
agccuaagggauccugccugc

SEQ ID NO: 2758297 - RNA, 21 nt, Human
agccuagccgaccucagccuu

SEQ ID NO: 2758298 - RNA, 20 nt, Human
agccuaguugaucagcuuau

SEQ ID NO: 2758299 - RNA, 15 nt, Human
agccucaagaugaag

SEQ ID NO: 2758300 - RNA, 14 nt, Human
agccucaagucuua

SEQ ID NO: 2758301 - RNA, 14 nt, Human
agccucagccuccc

SEQ ID NO: 2758302 - RNA, 15 nt, Human
agccucagucucccu

SEQ ID NO: 2758303 - RNA, 16 nt, Human
agccuccagcugcccc

SEQ ID NO: 2758304 - RNA, 17 nt, Human
agccuccagcugccccg

SEQ ID NO: 2758305 - RNA, 21 nt, Human
agccucuuagaugcaguucug

SEQ ID NO: 2758306 - RNA, 15 nt, Human
agccugaaagaggaa

SEQ ID NO: 2758307 - RNA, 19 nt, Human
agccugaggugccgccucc

SEQ ID NO: 2758308 - RNA, 22 nt, Human
agccugaguagaaaggccuuua

SEQ ID NO: 2758309 - RNA, 14 nt, Human
agccugaucaccug

SEQ ID NO: 2758310 - RNA, 14 nt, Human
agccugcagacuca

SEQ ID NO: 2758311 - RNA, 16 nt, Human
agccugcagacucacu

SEQ ID NO: 2758312 - RNA, 18 nt, Human
agccugcagacucacugu

SEQ ID NO: 2758313 - RNA, 12 nt, Human
agccugccuccc

SEQ ID NO: 2758314 - RNA, 14 nt, Human
agccugccuccccu

SEQ ID NO: 2758315 - RNA, 23 nt, Human
agccugccuccccugccucacca

SEQ ID NO: 2758316 - RNA, 18 nt, Human
agccugcucccuagccag

SEQ ID NO: 2758317 - RNA, 18 nt, Human
agccuggaaccaagguua

SEQ ID NO: 2758318 - RNA, 17 nt, Human
agccugggcaacauggu

SEQ ID NO: 2758319 - RNA, 18 nt, Human
agccuggguguaaaaccu

SEQ ID NO: 2758320 - RNA, 22 nt, Human
agccuuacaaagggaaagccuc

SEQ ID NO: 2758321 - RNA, 15 nt, Human
agccuuccccuugcc

SEQ ID NO: 2758322 - RNA, 21 nt, Human
agccuuccccuugcccagggc

SEQ ID NO: 2758323 - RNA, 19 nt, Human
agccuucucucaaggagag

SEQ ID NO: 2758324 - RNA, 20 nt, Human
agccuucucucaaggagagg

SEQ ID NO: 2758325 - RNA, 21 nt, Human
agccuucucuguucauuuccu

SEQ ID NO: 2758326 - RNA, 18 nt, Human
agccuugauugguguugc

SEQ ID NO: 2758327 - RNA, 13 nt, Human
agccuugcuccug

SEQ ID NO: 2758328 - RNA, 19 nt, Human
agccuugcuccuggcuggg

SEQ ID NO: 2758329 - RNA, 21 nt, Human
agccuuggauacuccaugggg

SEQ ID NO: 2758330 - RNA, 18 nt, Human
agccuuggggauucuucc

SEQ ID NO: 2758331 - RNA, 20 nt, Human
agccuuuuuuugaaaaaaag

SEQ ID NO: 2758332 - RNA, 16 nt, Human
agcgacagugagacuc

SEQ ID NO: 2758333 - RNA, 17 nt, Human
agcgacagugagacucu

SEQ ID NO: 2758334 - RNA, 18 nt, Human
agcgaguacuucccgcug

SEQ ID NO: 2758335 - RNA, 15 nt, Human
agcgauuaauaacag

SEQ ID NO: 2758336 - RNA, 22 nt, Human
agcgcgcgcgcccucuggcugc

SEQ ID NO: 2758337 - RNA, 16 nt, Human
agcgcuaauuucuauu

SEQ ID NO: 2758338 - RNA, 16 nt, Human
agcggaccuucccagc

SEQ ID NO: 2758339 - RNA, 22 nt, Human
agcggccacggugccuccagau

SEQ ID NO: 2758340 - RNA, 13 nt, Human
agcgguuuauaua

SEQ ID NO: 2758341 - RNA, 14 nt, Human
agcguuaauguaaa

SEQ ID NO: 2758342 - RNA, 21 nt, Human
agcuaaaauuagaugaacuca

SEQ ID NO: 2758343 - RNA, 12 nt, Human
agcuaaaguauc

SEQ ID NO: 2758344 - RNA, 23 nt, Human
agcuaaaguaucuguauugcauu

SEQ ID NO: 2758345 - RNA, 15 nt, Human
agcuaaauauauauu

SEQ ID NO: 2758346 - RNA, 17 nt, Human
agcuaaauauauauuuu

SEQ ID NO: 2758347 - RNA, 21 nt, Human
agcuaauuuuuguauuuuuag

SEQ ID NO: 2758348 - RNA, 18 nt, Human
agcuacaggacauuuuua

SEQ ID NO: 2758349 - RNA, 19 nt, Human
agcuacaggacauuuuuaa

SEQ ID NO: 2758350 - RNA, 12 nt, Human
agcuacaggccc

SEQ ID NO: 2758351 - RNA, 17 nt, Human
agcuacaggccccaucu

SEQ ID NO: 2758352 - RNA, 18 nt, Human
agcuacuaauuuuaaaau

SEQ ID NO: 2758353 - RNA, 19 nt, Human
agcuacuaauuuuaaaaug

SEQ ID NO: 2758354 - RNA, 20 nt, Human
agcuacuaauuuuaaaaugu

SEQ ID NO: 2758355 - RNA, 17 nt, Human
agcuacuuauuguagca

SEQ ID NO: 2758356 - RNA, 21 nt, Human
agcuacuuauuguagcauccu

SEQ ID NO: 2758357 - RNA, 18 nt, Human
agcuacuugggaggcuga

SEQ ID NO: 2758358 - RNA, 14 nt, Human
agcuagaaaaauua

SEQ ID NO: 2758359 - RNA, 13 nt, Human
agcuagaaaugau

SEQ ID NO: 2758360 - RNA, 13 nt, Human
agcuagaauuuga

SEQ ID NO: 2758361 - RNA, 23 nt, Human
agcuaggggggucagccagcccu

SEQ ID NO: 2758362 - RNA, 12 nt, Human
agcuauaaaaug

SEQ ID NO: 2758363 - RNA, 18 nt, Human
agcuauaaaaugaauaca

SEQ ID NO: 2758364 - RNA, 19 nt, Human
acuuuuuuuuuuuuuuaaa

SEQ ID NO: 2758365 - RNA, 12 nt, Human
agaaaaauuaga

SEQ ID NO: 2758366 - RNA, 15 nt, Human
agaaaacaauaacga

SEQ ID NO: 2758367 - RNA, 18 nt, Human
agaaaacaauaacgauaa

SEQ ID NO: 2758368 - RNA, 18 nt, Human
agaaaacuaagaaauaug

SEQ ID NO: 2758369 - RNA, 21 nt, Human
agaaaagcuauaaaaugaaua

SEQ ID NO: 2758370 - RNA, 23 nt, Human
agaaaagggaacugaacauucca

SEQ ID NO: 2758371 - RNA, 20 nt, Human
agaaaaguugaauuuuacau

SEQ ID NO: 2758372 - RNA, 20 nt, Human
agaaaauaaaucuaucaaaa

SEQ ID NO: 2758373 - RNA, 14 nt, Human
agaaaauaacgaua

SEQ ID NO: 2758374 - RNA, 19 nt, Human
agaaaauaacgauaaaaga

SEQ ID NO: 2758375 - RNA, 14 nt, Human
agaaaaucaggcug

SEQ ID NO: 2758376 - RNA, 19 nt, Human
agaaaaucaggcuggccaa

SEQ ID NO: 2758377 - RNA, 19 nt, Human
agaaaauugugcuggaaau

SEQ ID NO: 2758378 - RNA, 13 nt, Human
agaaaauuuaaaa

SEQ ID NO: 2758379 - RNA, 23 nt, Human
agaaacacaacuauauuguuugc

SEQ ID NO: 2758380 - RNA, 18 nt, Human
agaaacagcuucucaauu

SEQ ID NO: 2758381 - RNA, 17 nt, Human
agaaacaucaguuacuc

SEQ ID NO: 2758382 - RNA, 12 nt, Human
agaaacauuuau

SEQ ID NO: 2758383 - RNA, 12 nt, Human
agaaacauuugg

SEQ ID NO: 2758384 - RNA, 13 nt, Human
agaaacauuuggu

SEQ ID NO: 2758385 - RNA, 24 nt, Human
agaaacccugcacccauuagcagu

SEQ ID NO: 2758386 - RNA, 23 nt, Human
agaaaccuuuguuugcaucugaa

SEQ ID NO: 2758387 - RNA, 18 nt, Human
agaaagccaugugcagcc

SEQ ID NO: 2758388 - RNA, 14 nt, Human
agaaaggauaaagu

SEQ ID NO: 2758389 - RNA, 14 nt, Human
agaaauaaugaaau

SEQ ID NO: 2758390 - RNA, 16 nt, Human
agaaauaaugaaauaa

SEQ ID NO: 2758391 - RNA, 18 nt, Human
agaaauaugcacaauagc

SEQ ID NO: 2758392 - RNA, 13 nt, Human
agaaaugaaagca

SEQ ID NO: 2758393 - RNA, 17 nt, Human
agaaaugaaagcaggga

SEQ ID NO: 2758394 - RNA, 19 nt, Human
agaaauucugcaagcuuuu

SEQ ID NO: 2758395 - RNA, 15 nt, Human
agaaauuguaucuua

SEQ ID NO: 2758396 - RNA, 14 nt, Human
agaaauuuauaaac

SEQ ID NO: 2758397 - RNA, 17 nt, Human
agaaauuuauaaacuuu

SEQ ID NO: 2758398 - RNA, 15 nt, Human
agaaauuuauuuccu

SEQ ID NO: 2758399 - RNA, 21 nt, Human
agaaauuugccaauuuacuuu

SEQ ID NO: 2758400 - RNA, 15 nt, Human
agaacaacuaccuga

SEQ ID NO: 2758401 - RNA, 15 nt, Human
agaacaagcaaauau

SEQ ID NO: 2758402 - RNA, 13 nt, Human
agaaccaccugcc

SEQ ID NO: 2758403 - RNA, 22 nt, Human
agaaccaccugccuauauuuuu

SEQ ID NO: 2758404 - RNA, 19 nt, Human
agaaccccaggacgcccuc

SEQ ID NO: 2758405 - RNA, 19 nt, Human
agaaccuagggugauauua

SEQ ID NO: 2758406 - RNA, 16 nt, Human
agaacucccuuucaac

SEQ ID NO: 2758407 - RNA, 17 nt, Human
agaacucccuuucaaca

SEQ ID NO: 2758408 - RNA, 16 nt, Human
agaacucucuggaagc

SEQ ID NO: 2758409 - RNA, 16 nt, Human
agaacucugagcagug

SEQ ID NO: 2758410 - RNA, 16 nt, Human
agaacuuaaggaugga

SEQ ID NO: 2758411 - RNA, 18 nt, Human
agaacuuggaaauaguga

SEQ ID NO: 2758412 - RNA, 13 nt, Human
aaucaauacuuug

SEQ ID NO: 2758413 - RNA, 21 nt, Human
aaucaauacuuugaacacaaa

SEQ ID NO: 2758414 - RNA, 15 nt, Human
aaucacaaacucauc

SEQ ID NO: 2758415 - RNA, 22 nt, Human
aaucacaaacucauccauuaau

SEQ ID NO: 2758416 - RNA, 14 nt, Human
aaucacaauaauuu

SEQ ID NO: 2758417 - RNA, 22 nt, Human
aaucacaauacaucccuuaccu

SEQ ID NO: 2758418 - RNA, 21 nt, Human
aaucaccaaggcugauuaaac

SEQ ID NO: 2758419 - RNA, 22 nt, Human
aaucaccaaggcugauuaaacc

SEQ ID NO: 2758420 - RNA, 14 nt, Human
aaucacucauuuau

SEQ ID NO: 2758421 - RNA, 19 nt, Human
aaucacucauuuauuucca

SEQ ID NO: 2758422 - RNA, 16 nt, Human
aaucacuggcuguuaa

SEQ ID NO: 2758423 - RNA, 15 nt, Human
aaucacuugaacccg

SEQ ID NO: 2758424 - RNA, 15 nt, Human
aaucagagauaaagc

SEQ ID NO: 2758425 - RNA, 19 nt, Human
aaucagagauaaagcuuag

SEQ ID NO: 2758426 - RNA, 16 nt, Human
aaucagaguuuucaug

SEQ ID NO: 2758427 - RNA, 15 nt, Human
aaucagccaauuaug

SEQ ID NO: 2758428 - RNA, 19 nt, Human
aaucauaagauauuuuuca

SEQ ID NO: 2758429 - RNA, 13 nt, Human
aaucauauaauaa

SEQ ID NO: 2758430 - RNA, 18 nt, Human
aaucauauaauaaaugua

SEQ ID NO: 2758431 - RNA, 18 nt, Human
aaucauaugggauacugc

SEQ ID NO: 2758432 - RNA, 15 nt, Human
aaucaugaagauauu

SEQ ID NO: 2758433 - RNA, 20 nt, Human
aaucaugaagauauuuuucc

SEQ ID NO: 2758434 - RNA, 15 nt, Human
aaucaugcugagaga

SEQ ID NO: 2758435 - RNA, 19 nt, Human
aaucauucauuuucugggu

SEQ ID NO: 2758436 - RNA, 21 nt, Human
aaucauucuuauuucaugaaa

SEQ ID NO: 2758437 - RNA, 16 nt, Human
aaucauuuuaauuauu

SEQ ID NO: 2758438 - RNA, 18 nt, Human
aauccacacugagcugag

SEQ ID NO: 2758439 - RNA, 22 nt, Human
aauccacuuuaucuugaauaau

SEQ ID NO: 2758440 - RNA, 13 nt, Human
aauccagaaauaa

SEQ ID NO: 2758441 - RNA, 20 nt, Human
aaucccagcacuuugggagg

SEQ ID NO: 2758442 - RNA, 18 nt, Human
aauccccaacaugcacug

SEQ ID NO: 2758443 - RNA, 21 nt, Human
aaucccgauucacccugucca

SEQ ID NO: 2758444 - RNA, 21 nt, Human
aauccuacuuucauaauaagu

SEQ ID NO: 2758445 - RNA, 20 nt, Human
aauccuagguaggguuuaau

SEQ ID NO: 2758446 - RNA, 20 nt, Human
aauccucccacuucagccuc

SEQ ID NO: 2758447 - RNA, 23 nt, Human
aauccucucucuguguuacccag

SEQ ID NO: 2758448 - RNA, 12 nt, Human
aauccucugugu

SEQ ID NO: 2758449 - RNA, 23 nt, Human
aauccuggggaacauagaacuca

SEQ ID NO: 2758450 - RNA, 19 nt, Human
aauccuucuauucuagccu

SEQ ID NO: 2758451 - RNA, 13 nt, Human
aauccuugaagau

SEQ ID NO: 2758452 - RNA, 17 nt, Human
aauccuugaagauuuac

SEQ ID NO: 2758453 - RNA, 22 nt, Human
aaucguguccccuauccuacuu

SEQ ID NO: 2758454 - RNA, 15 nt, Human
aaucuaaaucuauuu

SEQ ID NO: 2758455 - RNA, 15 nt, Human
aaucucaauauuuca

SEQ ID NO: 2758456 - RNA, 20 nt, Human
aaucucuauuaggaaauauu

SEQ ID NO: 2758457 - RNA, 16 nt, Human
aaucucucuucuuuuc

SEQ ID NO: 2758458 - RNA, 24 nt, Human
aaucugaggccuccucucucaguu

SEQ ID NO: 2758459 - RNA, 22 nt, Human
aaucugcacugugggcuuuuau

SEQ ID NO: 2758460 - RNA, 19 nt, Human
aaucuuauaauuuaaaaua

SEQ ID NO: 2758461 - RNA, 14 nt, Human
aaucuuguaaauau

SEQ ID NO: 2758462 - RNA, 19 nt, Human
aaucuugucauguguauaa

SEQ ID NO: 2758463 - RNA, 20 nt, Human
aaucuuuauaguucuacucc

SEQ ID NO: 2758464 - RNA, 20 nt, Human
aaucuuucacaggggacagg

SEQ ID NO: 2758465 - RNA, 20 nt, Human
aaucuuucuuucuuagaaau

SEQ ID NO: 2758466 - RNA, 21 nt, Human
aaucuuugacaauugggagcu

SEQ ID NO: 2758467 - RNA, 14 nt, Human
aaugaaaaaauaua

SEQ ID NO: 2758468 - RNA, 18 nt, Human
aaugaaaaaauauauauc

SEQ ID NO: 2758469 - RNA, 22 nt, Human
aaugaaauggugaaaugcagag

SEQ ID NO: 2758470 - RNA, 14 nt, Human
aaugaacacuuaua

SEQ ID NO: 2758471 - RNA, 17 nt, Human
aaugaagauacugaaau

SEQ ID NO: 2758472 - RNA, 18 nt, Human
aaugaaguacucauacau

SEQ ID NO: 2758473 - RNA, 22 nt, Human
aaugaaguuugaauguuaaaua

SEQ ID NO: 2758474 - RNA, 14 nt, Human
aaugaauaaacauu

SEQ ID NO: 2758475 - RNA, 20 nt, Human
aaugaauacuuuauaaagga

SEQ ID NO: 2758476 - RNA, 13 nt, Human
aaugaauggcuaa

SEQ ID NO: 2758477 - RNA, 15 nt, Human
aaugaauggcuaagc

SEQ ID NO: 2758478 - RNA, 21 nt, Human
aaugaauggcuaagcaaaaug

SEQ ID NO: 2758479 - RNA, 21 nt, Human
aaugacuaaaaaacaaagaag

SEQ ID NO: 2758480 - RNA, 11 nt, Human
aaugagaaauc

SEQ ID NO: 2758481 - RNA, 17 nt, Human
aaugagcugaaggugaa

SEQ ID NO: 2758482 - RNA, 15 nt, Human
aaugauaacuggaaa

SEQ ID NO: 2758483 - RNA, 20 nt, Human
aaugauguuucauaagaauu

SEQ ID NO: 2758484 - RNA, 14 nt, Human
aaugauuaugaauu

SEQ ID NO: 2758485 - RNA, 20 nt, Human
aaugauuuagugaucaaauu

SEQ ID NO: 2758486 - RNA, 23 nt, Human
aaugauuuuacggagauauccca

SEQ ID NO: 2758487 - RNA, 21 nt, Human
aaugcauugccuguaacaaug

SEQ ID NO: 2758488 - RNA, 23 nt, Human
aaugcauugccuguaacaaugua

SEQ ID NO: 2758489 - RNA, 18 nt, Human
aaugccacuaaauugaca

SEQ ID NO: 2758490 - RNA, 12 nt, Human
aaugccgcuguc

SEQ ID NO: 2758491 - RNA, 13 nt, Human
aaugccgcugucu

SEQ ID NO: 2758492 - RNA, 21 nt, Human
aaugccgcugucucugagggg

SEQ ID NO: 2758493 - RNA, 13 nt, Human
aaugcggcccaac

SEQ ID NO: 2758494 - RNA, 23 nt, Human
aaugcuccuccagggagucucag

SEQ ID NO: 2758495 - RNA, 20 nt, Human
aaugcugaaaaaucauccaa

SEQ ID NO: 2758496 - RNA, 23 nt, Human
aaugcuuaugaaacuaagauuug

SEQ ID NO: 2758497 - RNA, 12 nt, Human
aauggaauacuc

SEQ ID NO: 2758498 - RNA, 21 nt, Human
aauggaauauguaaauagaaa

SEQ ID NO: 2758499 - RNA, 22 nt, Human
aauggacacagucuaacaaauu

SEQ ID NO: 2758500 - RNA, 16 nt, Human
aauggacaucaaaauc

SEQ ID NO: 2758501 - RNA, 16 nt, Human
aaugguaucaauaaau

SEQ ID NO: 2758502 - RNA, 14 nt, Human
aauguaaacaauau

SEQ ID NO: 2758503 - RNA, 13 nt, Human
aauguaagggaaa

SEQ ID NO: 2758504 - RNA, 13 nt, Human
aauguacaauaaa

SEQ ID NO: 2758505 - RNA, 18 nt, Human
aauguacaauaaagcaau

SEQ ID NO: 2758506 - RNA, 19 nt, Human
aauguacaauaaagcaaug

SEQ ID NO: 2758507 - RNA, 22 nt, Human
aauguagcagcucauaaaugaa

SEQ ID NO: 2758508 - RNA, 14 nt, Human
aauguaucuuauuc

SEQ ID NO: 2758509 - RNA, 21 nt, Human
aaugugacuuaaugccacuaa

SEQ ID NO: 2758510 - RNA, 20 nt, Human
aaugugauuuacgcucauug

SEQ ID NO: 2758511 - RNA, 15 nt, Human
aauguguaagaacaa

SEQ ID NO: 2758512 - RNA, 12 nt, Human
aauguguucauu

SEQ ID NO: 2758513 - RNA, 18 nt, Human
aauguguucauucuggaa

SEQ ID NO: 2758514 - RNA, 13 nt, Human
aauguuacauuau

SEQ ID NO: 2758515 - RNA, 15 nt, Human
aauguuacauuauua

SEQ ID NO: 2758516 - RNA, 19 nt, Human
aauguuacauuauuaucaa

SEQ ID NO: 2758517 - RNA, 21 nt, Human
aauguuauuuuuuaauuauua

SEQ ID NO: 2758518 - RNA, 22 nt, Human
aauguuauuuuuuaauuauuau

SEQ ID NO: 2758519 - RNA, 16 nt, Human
aauguucaucauguau

SEQ ID NO: 2758520 - RNA, 21 nt, Human
aauguugacaugggacauuug

SEQ ID NO: 2758521 - RNA, 18 nt, Human
aauguugaguuauuaaua

SEQ ID NO: 2758522 - RNA, 13 nt, Human
aauguuucaaaca

SEQ ID NO: 2758523 - RNA, 15 nt, Human
aauguuuguccuugg

SEQ ID NO: 2758524 - RNA, 23 nt, Human
aauuaaaaccucuuugugucccu

SEQ ID NO: 2758525 - RNA, 18 nt, Human
aauuaaaagaauauuuua

SEQ ID NO: 2758526 - RNA, 18 nt, Human
aauuaaagcuguuauuua

SEQ ID NO: 2758527 - RNA, 20 nt, Human
aauuaacacaugauccugca

SEQ ID NO: 2758528 - RNA, 18 nt, Human
aauuaacaugaauauuua

SEQ ID NO: 2758529 - RNA, 17 nt, Human
aauuaagucugugagau

SEQ ID NO: 2758530 - RNA, 20 nt, Human
aauuaaguuuuuuuuuaaaa

SEQ ID NO: 2758531 - RNA, 21 nt, Human
aauuaaguuuuuuuuuaaaaa

SEQ ID NO: 2758532 - RNA, 19 nt, Human
aauuaauggaauauguaaa

SEQ ID NO: 2758533 - RNA, 13 nt, Human
aauuaccacacca

SEQ ID NO: 2758534 - RNA, 20 nt, Human
aauuaccuugagccaguaau

SEQ ID NO: 2758535 - RNA, 22 nt, Human
aauuacuaugucauuugcugga

SEQ ID NO: 2758536 - RNA, 20 nt, Human
aauuacuggaaggcuuccac

SEQ ID NO: 2758537 - RNA, 14 nt, Human
aauuagaaauguaa

SEQ ID NO: 2758538 - RNA, 13 nt, Human
aauuagaugaacu

SEQ ID NO: 2758539 - RNA, 18 nt, Human
aauuagugcuuuuugugu

SEQ ID NO: 2758540 - RNA, 16 nt, Human
aauuaguuuuauaugc

SEQ ID NO: 2758541 - RNA, 14 nt, Human
aauuauaauauacu

SEQ ID NO: 2758542 - RNA, 18 nt, Human
aauuauauaauauuuuua

SEQ ID NO: 2758543 - RNA, 19 nt, Human
aauuauauaauauuuuuaa

SEQ ID NO: 2758544 - RNA, 15 nt, Human
aauuauaucaauuuc

SEQ ID NO: 2758545 - RNA, 18 nt, Human
aauuauaucaauuuccuc

SEQ ID NO: 2758546 - RNA, 20 nt, Human
aauuauaucaauuuccucau

SEQ ID NO: 2758547 - RNA, 12 nt, Human
aauuauguuaaa

SEQ ID NO: 2758548 - RNA, 15 nt, Human
aauuauguuaaacua

SEQ ID NO: 2758549 - RNA, 20 nt, Human
aauuauguuugcauguucac

SEQ ID NO: 2758550 - RNA, 14 nt, Human
aauuauuaagauau

SEQ ID NO: 2758551 - RNA, 15 nt, Human
aauuauuaagauaug

SEQ ID NO: 2758552 - RNA, 12 nt, Human
aauuauuauuua

SEQ ID NO: 2758553 - RNA, 13 nt, Human
aauuauuuucucu

SEQ ID NO: 2758554 - RNA, 14 nt, Human
aauuauuuugugau

SEQ ID NO: 2758555 - RNA, 20 nt, Human
aauuauuuuuguucauauaa

SEQ ID NO: 2758556 - RNA, 18 nt, Human
aauucaaacuaauagaau

SEQ ID NO: 2758557 - RNA, 18 nt, Human
aauucacaaguuguguuu

SEQ ID NO: 2758558 - RNA, 17 nt, Human
acccuggaaaaugaauc

SEQ ID NO: 2758559 - RNA, 13 nt, Human
acccuggacuugc

SEQ ID NO: 2758560 - RNA, 19 nt, Human
acccugucucuacaaaaaa

SEQ ID NO: 2758561 - RNA, 13 nt, Human
acccuugccaugu

SEQ ID NO: 2758562 - RNA, 23 nt, Human
accgcaggauuugggcucuugga

SEQ ID NO: 2758563 - RNA, 15 nt, Human
accgcgcccagccuu

SEQ ID NO: 2758564 - RNA, 15 nt, Human
accgcuaucauucca

SEQ ID NO: 2758565 - RNA, 22 nt, Human
accgcuguacgcgagcgcgcgc

SEQ ID NO: 2758566 - RNA, 20 nt, Human
accggagaaccccaggacgc

SEQ ID NO: 2758567 - RNA, 16 nt, Human
accuaaaauaaaauga

SEQ ID NO: 2758568 - RNA, 17 nt, Human
accuaaaauaaaaugaa

SEQ ID NO: 2758569 - RNA, 19 nt, Human
accuaaauuugguucuagg

SEQ ID NO: 2758570 - RNA, 20 nt, Human
accuacacgagauacagaau

SEQ ID NO: 2758571 - RNA, 14 nt, Human
accuaccaagauau

SEQ ID NO: 2758572 - RNA, 13 nt, Human
accuagaauaaua

SEQ ID NO: 2758573 - RNA, 15 nt, Human
accuaguccccagcc

SEQ ID NO: 2758574 - RNA, 20 nt, Human
accuaguccccagccugcuc

SEQ ID NO: 2758575 - RNA, 17 nt, Human
accuauuagaguauuuu

SEQ ID NO: 2758576 - RNA, 23 nt, Human
accucaagugaucugcccgccuc

SEQ ID NO: 2758577 - RNA, 17 nt, Human
accucagcugccucccc

SEQ ID NO: 2758578 - RNA, 19 nt, Human
accucagcugccuccccag

SEQ ID NO: 2758579 - RNA, 22 nt, Human
accucagcugccuccccagcuc

SEQ ID NO: 2758580 - RNA, 14 nt, Human
accucaguucccuc

SEQ ID NO: 2758581 - RNA, 21 nt, Human
accucaguucccucuugcuca

SEQ ID NO: 2758582 - RNA, 17 nt, Human
accucauggaauuggag

SEQ ID NO: 2758583 - RNA, 20 nt, Human
accucauggaauuggagcuc

SEQ ID NO: 2758584 - RNA, 23 nt, Human
accuccauggaaacgaagcacca

SEQ ID NO: 2758585 - RNA, 18 nt, Human
accucccucuaauuuauc

SEQ ID NO: 2758586 - RNA, 19 nt, Human
accuccuggguucaagcga

SEQ ID NO: 2758587 - RNA, 21 nt, Human
accucgugauccacccgccuc

SEQ ID NO: 2758588 - RNA, 16 nt, Human
accucugccucagaaa

SEQ ID NO: 2758589 - RNA, 20 nt, Human
accucugccucagaaaacaa

SEQ ID NO: 2758590 - RNA, 14 nt, Human
accucugccuccca

SEQ ID NO: 2758591 - RNA, 18 nt, Human
accucugccucccagguu

SEQ ID NO: 2758592 - RNA, 15 nt, Human
accugacagcccaag

SEQ ID NO: 2758593 - RNA, 21 nt, Human
accugacagcccaaggguggg

SEQ ID NO: 2758594 - RNA, 10 nt, Human
accugagccc

SEQ ID NO: 2758595 - RNA, 20 nt, Human
accugauuucugagcauuua

SEQ ID NO: 2758596 - RNA, 14 nt, Human
accugcccugcuga

SEQ ID NO: 2758597 - RNA, 17 nt, Human
accugcucagcccugca

SEQ ID NO: 2758598 - RNA, 18 nt, Human
accugcucagcccugcac

SEQ ID NO: 2758599 - RNA, 17 nt, Human
accugcugagccccaag

SEQ ID NO: 2758600 - RNA, 24 nt, Human
accugcuguuuccuagcgcagcca

SEQ ID NO: 2758601 - RNA, 19 nt, Human
accuggagaugguggauga

SEQ ID NO: 2758602 - RNA, 14 nt, Human
accugggcauucuu

SEQ ID NO: 2758603 - RNA, 14 nt, Human
accugggccauagu

SEQ ID NO: 2758604 - RNA, 14 nt, Human
accugggcugaggc

SEQ ID NO: 2758605 - RNA, 15 nt, Human
accugggcugaggca

SEQ ID NO: 2758606 - RNA, 13 nt, Human
accuggucucucc

SEQ ID NO: 2758607 - RNA, 14 nt, Human
accuggucucuccu

SEQ ID NO: 2758608 - RNA, 17 nt, Human
accuggucucuccuugu

SEQ ID NO: 2758609 - RNA, 15 nt, Human
accuguaaucauaua

SEQ ID NO: 2758610 - RNA, 18 nt, Human
accuguaaucauauaaua

SEQ ID NO: 2758611 - RNA, 23 nt, Human
accuguaaucauauaauaaaugu

SEQ ID NO: 2758612 - RNA, 14 nt, Human
accugucaucucac

SEQ ID NO: 2758613 - RNA, 17 nt, Human
accugucaucucacauu

SEQ ID NO: 2758614 - RNA, 19 nt, Human
accugucccagaaaaagca

SEQ ID NO: 2758615 - RNA, 20 nt, Human
accugucccagaaaaagcau

SEQ ID NO: 2758616 - RNA, 14 nt, Human
accuguuauaauaa

SEQ ID NO: 2758617 - RNA, 16 nt, Human
accuguucgcgcgccu

SEQ ID NO: 2758618 - RNA, 16 nt, Human
accuguuuuuaagcug

SEQ ID NO: 2758619 - RNA, 12 nt, Human
accuuacuucuu

SEQ ID NO: 2758620 - RNA, 14 nt, Human
accuuauguuuaau

SEQ ID NO: 2758621 - RNA, 20 nt, Human
accuucccagcuagaauuca

SEQ ID NO: 2758622 - RNA, 22 nt, Human
accuuguaauuugaaauauuuu

SEQ ID NO: 2758623 - RNA, 16 nt, Human
accuugucucccagcu

SEQ ID NO: 2758624 - RNA, 23 nt, Human
accuuuguagccacuucacuuuu

SEQ ID NO: 2758625 - RNA, 17 nt, Human
accuuuuacucuucuua

SEQ ID NO: 2758626 - RNA, 13 nt, Human
accuuuuauauuu

SEQ ID NO: 2758627 - RNA, 12 nt, Human
accuuuucccaa

SEQ ID NO: 2758628 - RNA, 20 nt, Human
accuuuugcuguggcaaaug

SEQ ID NO: 2758629 - RNA, 13 nt, Human
accuuuuuucuua

SEQ ID NO: 2758630 - RNA, 19 nt, Human
acgaaauacguuaggagga

SEQ ID NO: 2758631 - RNA, 15 nt, Human
acgaaauguuauuuu

SEQ ID NO: 2758632 - RNA, 12 nt, Human
acgagaaaacaa

SEQ ID NO: 2758633 - RNA, 16 nt, Human
acgagaaauagaaaug

SEQ ID NO: 2758634 - RNA, 23 nt, Human
acgaggauugggaaaaaguaauu

SEQ ID NO: 2758635 - RNA, 18 nt, Human
acgauaaaagacagugaa

SEQ ID NO: 2758636 - RNA, 19 nt, Human
acgaugggcuuucccaaca

SEQ ID NO: 2758637 - RNA, 22 nt, Human
acgaugggcuuucccaacagcu

SEQ ID NO: 2758638 - RNA, 20 nt, Human
acgcagccugcagacucacu

SEQ ID NO: 2758639 - RNA, 16 nt, Human
acgcaggcacagcagc

SEQ ID NO: 2758640 - RNA, 17 nt, Human
acgcaucagacagaugg

SEQ ID NO: 2758641 - RNA, 22 nt, Human
acgcaucagacagauggaaaag

SEQ ID NO: 2758642 - RNA, 14 nt, Human
acgcauggaaaagu

SEQ ID NO: 2758643 - RNA, 19 nt, Human
acgcccucacugcaggcuc

SEQ ID NO: 2758644 - RNA, 19 nt, Human
acgcccucgagguugcucu

SEQ ID NO: 2758645 - RNA, 19 nt, Human
acgccuggcuaauuuuugu

SEQ ID NO: 2758646 - RNA, 18 nt, Human
acgcgcgcuccgcgcagc

SEQ ID NO: 2758647 - RNA, 16 nt, Human
acgcucauuguagaaa

SEQ ID NO: 2758648 - RNA, 13 nt, Human
acgcucucuggcc

SEQ ID NO: 2758649 - RNA, 15 nt, Human
acgcucucuggccuu

SEQ ID NO: 2758650 - RNA, 19 nt, Human
acgcucucuggccuucggc

SEQ ID NO: 2758651 - RNA, 22 nt, Human
acgcucucuggccuucggccuc

SEQ ID NO: 2758652 - RNA, 16 nt, Human
acggagccgggaaaga

SEQ ID NO: 2758653 - RNA, 19 nt, Human
acggagccgggaaagaaga

SEQ ID NO: 2758654 - RNA, 16 nt, Human
acggauuuauuuuucc

SEQ ID NO: 2758655 - RNA, 21 nt, Human
acggcuccggacgcugcugcc

SEQ ID NO: 2758656 - RNA, 16 nt, Human
acggcuggagcugccu

SEQ ID NO: 2758657 - RNA, 22 nt, Human
acggcuggagcugccucucuca

SEQ ID NO: 2758658 - RNA, 15 nt, Human
acgggaaacaaaacu

SEQ ID NO: 2758659 - RNA, 21 nt, Human
acgggaccuauuagaguauuu

SEQ ID NO: 2758660 - RNA, 16 nt, Human
acgggggccaaggaug

SEQ ID NO: 2758661 - RNA, 13 nt, Human
acggggugaaacc

SEQ ID NO: 2758662 - RNA, 16 nt, Human
acggguuucaccaugu

SEQ ID NO: 2758663 - RNA, 23 nt, Human
acguaaucguguccccuauccua

SEQ ID NO: 2758664 - RNA, 21 nt, Human
acguaggaacgguaaauuucu

SEQ ID NO: 2758665 - RNA, 20 nt, Human
acguauugcauuuaauuuau

SEQ ID NO: 2758666 - RNA, 17 nt, Human
acgucaugugcaccuuu

SEQ ID NO: 2758667 - RNA, 13 nt, Human
acgucuuaaauau

SEQ ID NO: 2758668 - RNA, 18 nt, Human
acgugacuggccugcugg

SEQ ID NO: 2758669 - RNA, 21 nt, Human
acgugacuggccugcuggaug

SEQ ID NO: 2758670 - RNA, 22 nt, Human
acguuaagaauuguuaaaggcu

SEQ ID NO: 2758671 - RNA, 22 nt, Human
acguuccccuggguucacagau

SEQ ID NO: 2758672 - RNA, 20 nt, Human
acuaaaaaggcauguaauug

SEQ ID NO: 2758673 - RNA, 11 nt, Human
acuaaaaauac

SEQ ID NO: 2758674 - RNA, 17 nt, Human
acuaaaaauuaaaaccu

SEQ ID NO: 2758675 - RNA, 13 nt, Human
acuaaacucagag

SEQ ID NO: 2758676 - RNA, 16 nt, Human
acuaaagcaguggaca

SEQ ID NO: 2758677 - RNA, 13 nt, Human
acugccuucucaa

SEQ ID NO: 2758678 - RNA, 18 nt, Human
acugccuuuggcagaguu

SEQ ID NO: 2758679 - RNA, 23 nt, Human
acugcuaguuuauauagaaaugu

SEQ ID NO: 2758680 - RNA, 22 nt, Human
acugcugaugauuuagagugcu

SEQ ID NO: 2758681 - RNA, 15 nt, Human
acugcuggauucaag

SEQ ID NO: 2758682 - RNA, 19 nt, Human
acugcuggauucaagugau

SEQ ID NO: 2758683 - RNA, 23 nt, Human
acugcuugaacuaggcugagcaa

SEQ ID NO: 2758684 - RNA, 14 nt, Human
acuggaaggaccau

SEQ ID NO: 2758685 - RNA, 19 nt, Human
acuggacucaccuccccca

SEQ ID NO: 2758686 - RNA, 22 nt, Human
acuggacugacgacuugagugc

SEQ ID NO: 2758687 - RNA, 23 nt, Human
acuggacugguucaaauguuguu

SEQ ID NO: 2758688 - RNA, 17 nt, Human
acuggagccccaucagc

SEQ ID NO: 2758689 - RNA, 23 nt, Human
acuggcaagaccugauuucugag

SEQ ID NO: 2758690 - RNA, 22 nt, Human
acuggcaguuuuccauugguuu

SEQ ID NO: 2758691 - RNA, 13 nt, Human
acuggccugcugg

SEQ ID NO: 2758692 - RNA, 22 nt, Human
acuggccugcuggauguggagg

SEQ ID NO: 2758693 - RNA, 16 nt, Human
acuggcuacugcucug

SEQ ID NO: 2758694 - RNA, 15 nt, Human
acuggcucccuggaa

SEQ ID NO: 2758695 - RNA, 21 nt, Human
acuggcucccuggaagagauc

SEQ ID NO: 2758696 - RNA, 23 nt, Human
acuggcucccuggaagagaucaa

SEQ ID NO: 2758697 - RNA, 18 nt, Human
acuggggccucccugguc

SEQ ID NO: 2758698 - RNA, 14 nt, Human
acugggggagggga

SEQ ID NO: 2758699 - RNA, 17 nt, Human
acugggguggguggggc

SEQ ID NO: 2758700 - RNA, 21 nt, Human
acugggguguguggcagagcc

SEQ ID NO: 2758701 - RNA, 19 nt, Human
acugguagaggaugaggaa

SEQ ID NO: 2758702 - RNA, 17 nt, Human
acuggugcuauuuugua

SEQ ID NO: 2758703 - RNA, 13 nt, Human
acugguucuucuu

SEQ ID NO: 2758704 - RNA, 13 nt, Human
acuguaaaauaau

SEQ ID NO: 2758705 - RNA, 22 nt, Human
acuguaaaauaauaacugggaa

SEQ ID NO: 2758706 - RNA, 17 nt, Human
acuguaaagcuuugugc

SEQ ID NO: 2758707 - RNA, 13 nt, Human
acuguaaauuuau

SEQ ID NO: 2758708 - RNA, 18 nt, Human
acuguaaggcaaucaugg

SEQ ID NO: 2758709 - RNA, 22 nt, Human
acuguacccaaauggaaaguaa

SEQ ID NO: 2758710 - RNA, 21 nt, Human
acuguagaaaagggaacugaa

SEQ ID NO: 2758711 - RNA, 21 nt, Human
acuguagggugcugcgcagca

SEQ ID NO: 2758712 - RNA, 16 nt, Human
acuguauguccuuggu

SEQ ID NO: 2758713 - RNA, 22 nt, Human
acugucacauaaugcucauacu

SEQ ID NO: 2758714 - RNA, 13 nt, Human
aauucacauugua

SEQ ID NO: 2758715 - RNA, 15 nt, Human
aauucacuccacuug

SEQ ID NO: 2758716 - RNA, 16 nt, Human
aauucauccucacuca

SEQ ID NO: 2758717 - RNA, 21 nt, Human
aauucauguugccuugcauaa

SEQ ID NO: 2758718 - RNA, 23 nt, Human
aauucauuaaucugccucccucu

SEQ ID NO: 2758719 - RNA, 18 nt, Human
aauuccaagugauugaaa

SEQ ID NO: 2758720 - RNA, 19 nt, Human
aauuccacuuauaggaauu

SEQ ID NO: 2758721 - RNA, 15 nt, Human
aauuccaggaaaauc

SEQ ID NO: 2758722 - RNA, 22 nt, Human
aauuccuaccucuucaccugac

SEQ ID NO: 2758723 - RNA, 14 nt, Human
aauuccucugggaa

SEQ ID NO: 2758724 - RNA, 21 nt, Human
aauuccugacugcuaguuuau

SEQ ID NO: 2758725 - RNA, 19 nt, Human
aauucuaaaugaauguuua

SEQ ID NO: 2758726 - RNA, 20 nt, Human
aauucuaaaugaauguuuac

SEQ ID NO: 2758727 - RNA, 13 nt, Human
aauucugaaagca

SEQ ID NO: 2758728 - RNA, 19 nt, Human
aauucugguagcuaaauau

SEQ ID NO: 2758729 - RNA, 20 nt, Human
aauucuugccaaauauaaau

SEQ ID NO: 2758730 - RNA, 14 nt, Human
aauugaauuuccau

SEQ ID NO: 2758731 - RNA, 22 nt, Human
aauugacccacaagaaaugaaa

SEQ ID NO: 2758732 - RNA, 13 nt, Human
aauugacuuauuu

SEQ ID NO: 2758733 - RNA, 22 nt, Human
aauugagcuggaccucaccaag

SEQ ID NO: 2758734 - RNA, 15 nt, Human
aauugauuuugaacc

SEQ ID NO: 2758735 - RNA, 23 nt, Human
aauugauuuugaaccugaugaaa

SEQ ID NO: 2758736 - RNA, 12 nt, Human
aauugcagagua

SEQ ID NO: 2758737 - RNA, 14 nt, Human
aauugcagaguacu

SEQ ID NO: 2758738 - RNA, 16 nt, Human
aauugcauuuuacuuu

SEQ ID NO: 2758739 - RNA, 22 nt, Human
aauugccugacgaacuccuuga

SEQ ID NO: 2758740 - RNA, 23 nt, Human
aauugccugacgaacuccuugau

SEQ ID NO: 2758741 - RNA, 19 nt, Human
aauuggagcucguggaaca

SEQ ID NO: 2758742 - RNA, 17 nt, Human
aauugggagcugccaag

SEQ ID NO: 2758743 - RNA, 20 nt, Human
aauuguaacuaaaguuagaa

SEQ ID NO: 2758744 - RNA, 19 nt, Human
aauuguaagcaugcacaaa

SEQ ID NO: 2758745 - RNA, 18 nt, Human
aauuguaggugacuauua

SEQ ID NO: 2758746 - RNA, 20 nt, Human
aauuguaggugacuauuaua

SEQ ID NO: 2758747 - RNA, 22 nt, Human
aauuguaggugacuauuauauu

SEQ ID NO: 2758748 - RNA, 15 nt, Human
aauuguauuacaaau

SEQ ID NO: 2758749 - RNA, 19 nt, Human
aauuguggggaugaugaaa

SEQ ID NO: 2758750 - RNA, 21 nt, Human
aauuguggggaugaugaaaua

SEQ ID NO: 2758751 - RNA, 19 nt, Human
aauuguuuuuauggaggcu

SEQ ID NO: 2758752 - RNA, 22 nt, Human
aauuuaaaaaaaaaccugagcc

SEQ ID NO: 2758753 - RNA, 15 nt, Human
aauuuaaaaauccua

SEQ ID NO: 2758754 - RNA, 12 nt, Human
aauuuaaaccua

SEQ ID NO: 2758755 - RNA, 11 nt, Human
aauuuaaauag

SEQ ID NO: 2758756 - RNA, 17 nt, Human
aauuuaaauagcuuuuu

SEQ ID NO: 2758757 - RNA, 12 nt, Human
aauuuaaauaua

SEQ ID NO: 2758758 - RNA, 16 nt, Human
aauuuaaaucacucaa

SEQ ID NO: 2758759 - RNA, 21 nt, Human
aauuuacagagacagaaagca

SEQ ID NO: 2758760 - RNA, 15 nt, Human
aauuuaucauuuagu

SEQ ID NO: 2758761 - RNA, 20 nt, Human
aauuuaugaguuuuugauag

SEQ ID NO: 2758762 - RNA, 16 nt, Human
aauuuauuaugagacu

SEQ ID NO: 2758763 - RNA, 13 nt, Human
aauuuauucaauu

SEQ ID NO: 2758764 - RNA, 16 nt, Human
aauuucagaagaaauu

SEQ ID NO: 2758765 - RNA, 21 nt, Human
aauuucagaagaaauucugca

SEQ ID NO: 2758766 - RNA, 17 nt, Human
aauuucaugaaaagauu

SEQ ID NO: 2758767 - RNA, 23 nt, Human
aauuuccaugaguuacacuggau

SEQ ID NO: 2758768 - RNA, 19 nt, Human
aauuucgucuguuuauaaa

SEQ ID NO: 2758769 - RNA, 21 nt, Human
aauuucucccagucauuuaau

SEQ ID NO: 2758770 - RNA, 19 nt, Human
aauuucuguucuuccauca

SEQ ID NO: 2758771 - RNA, 16 nt, Human
aauuugacuagaaaau

SEQ ID NO: 2758772 - RNA, 21 nt, Human
aauuugacuagaaaauuuaaa

SEQ ID NO: 2758773 - RNA, 13 nt, Human
aauuugaugaaau

SEQ ID NO: 2758774 - RNA, 17 nt, Human
aauuugguucuaggccg

SEQ ID NO: 2758775 - RNA, 17 nt, Human
aauuuguagauuccucu

SEQ ID NO: 2758776 - RNA, 12 nt, Human
aauuugugaagg

SEQ ID NO: 2758777 - RNA, 19 nt, Human
aauuugugaagguggaaau

SEQ ID NO: 2758778 - RNA, 21 nt, Human
aauuugugcccccaaccauuu

SEQ ID NO: 2758779 - RNA, 22 nt, Human
aauuuuacauuuccuaaauaua

SEQ ID NO: 2758780 - RNA, 22 nt, Human
aauuuuagacauucuuuaucuu

SEQ ID NO: 2758781 - RNA, 23 nt, Human
aauuuucauuguucuauaacaac

SEQ ID NO: 2758782 - RNA, 16 nt, Human
aauuuucccaaaacug

SEQ ID NO: 2758783 - RNA, 22 nt, Human
aauuuucuagaauacuaauaaa

SEQ ID NO: 2758784 - RNA, 19 nt, Human
aauuuucuuccaaacagaa

SEQ ID NO: 2758785 - RNA, 19 nt, Human
aauuuucuuccauuucauu

SEQ ID NO: 2758786 - RNA, 14 nt, Human
aauuuugaaaaacu

SEQ ID NO: 2758787 - RNA, 16 nt, Human
aauuuugaaaaacugc

SEQ ID NO: 2758788 - RNA, 10 nt, Human
aauuuugcua

SEQ ID NO: 2758789 - RNA, 20 nt, Human
aauuuugugaagcaaaauuu

SEQ ID NO: 2758790 - RNA, 12 nt, Human
aauuuuguuaug

SEQ ID NO: 2758791 - RNA, 19 nt, Human
aauuuuguuauguauauuu

SEQ ID NO: 2758792 - RNA, 16 nt, Human
aauuuuuaauuauaug

SEQ ID NO: 2758793 - RNA, 17 nt, Human
aauuuuuaauuauaugg

SEQ ID NO: 2758794 - RNA, 20 nt, Human
aauuuuuucucuaggaaaua

SEQ ID NO: 2758795 - RNA, 23 nt, Human
acaaaaaaaaaaccauauauaua

SEQ ID NO: 2758796 - RNA, 14 nt, Human
acaaaaaaagcauu

SEQ ID NO: 2758797 - RNA, 15 nt, Human
acaaaacccuuucug

SEQ ID NO: 2758798 - RNA, 23 nt, Human
acaaaacccuuucugccccugcu

SEQ ID NO: 2758799 - RNA, 16 nt, Human
acaaaaggaaugugua

SEQ ID NO: 2758800 - RNA, 17 nt, Human
acaaaaggaauguguaa

SEQ ID NO: 2758801 - RNA, 18 nt, Human
acaaaaggauaaugaaua

SEQ ID NO: 2758802 - RNA, 23 nt, Human
acaaaaguauauucaaaaauuau

SEQ ID NO: 2758803 - RNA, 18 nt, Human
acaaaaucuuaaaugcca

SEQ ID NO: 2758804 - RNA, 18 nt, Human
acaaacaaacaaaaaaaa

SEQ ID NO: 2758805 - RNA, 12 nt, Human
acaaacagggcu

SEQ ID NO: 2758806 - RNA, 19 nt, Human
acaaacccaagggcagggg

SEQ ID NO: 2758807 - RNA, 13 nt, Human
acaaagaaauuau

SEQ ID NO: 2758808 - RNA, 16 nt, Human
acaaagaagacaacau

SEQ ID NO: 2758809 - RNA, 21 nt, Human
acaaagacaucgauugauaug

SEQ ID NO: 2758810 - RNA, 18 nt, Human
acaaaggcuuauuaauuu

SEQ ID NO: 2758811 - RNA, 16 nt, Human
acaaagggggaggcua

SEQ ID NO: 2758812 - RNA, 15 nt, Human
acaaauccaaugaaa

SEQ ID NO: 2758813 - RNA, 18 nt, Human
acaaauccaaugaaauga

SEQ ID NO: 2758814 - RNA, 21 nt, Human
acaaaucuuaacuugaaggag

SEQ ID NO: 2758815 - RNA, 18 nt, Human
acaaaugcauuucuaaag

SEQ ID NO: 2758816 - RNA, 15 nt, Human
acaaaugggaaacaa

SEQ ID NO: 2758817 - RNA, 17 nt, Human
acaaaugggaaacaaaa

SEQ ID NO: 2758818 - RNA, 18 nt, Human
acaaaugggaaacaaaag

SEQ ID NO: 2758819 - RNA, 20 nt, Human
acaaaugggaaacaaaagga

SEQ ID NO: 2758820 - RNA, 13 nt, Human
acaaauuguagaa

SEQ ID NO: 2758821 - RNA, 23 nt, Human
acaacaaaagcgauuauuauuuu

SEQ ID NO: 2758822 - RNA, 22 nt, Human
acaacacggacgaaccuugaaa

SEQ ID NO: 2758823 - RNA, 15 nt, Human
acaacagguaaaaca

SEQ ID NO: 2758824 - RNA, 20 nt, Human
acaacagguaaaacagggcc

SEQ ID NO: 2758825 - RNA, 13 nt, Human
acaacauuaaaac

SEQ ID NO: 2758826 - RNA, 18 nt, Human
acaaccaaagacuacaua

SEQ ID NO: 2758827 - RNA, 14 nt, Human
acaaccuccgccuc

SEQ ID NO: 2758828 - RNA, 13 nt, Human
acaaccuguccca

SEQ ID NO: 2758829 - RNA, 15 nt, Human
acaaccugucccagc

SEQ ID NO: 2758830 - RNA, 14 nt, Human
acaacuauauuguu

SEQ ID NO: 2758831 - RNA, 19 nt, Human
acaacucgaaucacucauu

SEQ ID NO: 2758832 - RNA, 14 nt, Human
acaagaaaauaaga

SEQ ID NO: 2758833 - RNA, 21 nt, Human
acaagaaggaaagauuuuguu

SEQ ID NO: 2758834 - RNA, 12 nt, Human
acaagacacagu

SEQ ID NO: 2758835 - RNA, 20 nt, Human
acaagacacagugaccauac

SEQ ID NO: 2758836 - RNA, 20 nt, Human
acaagacccaaaaggcagaa

SEQ ID NO: 2758837 - RNA, 13 nt, Human
acaagagcuuaac

SEQ ID NO: 2758838 - RNA, 20 nt, Human
acaagcaaauauaaacagca

SEQ ID NO: 2758839 - RNA, 23 nt, Human
acaagcaaugccugcccauugga

SEQ ID NO: 2758840 - RNA, 22 nt, Human
acaagcaugagucacuacgccu

SEQ ID NO: 2758841 - RNA, 18 nt, Human
acaagccuccuuuuaaag

SEQ ID NO: 2758842 - RNA, 22 nt, Human
acaagcuuuuuuuuuuuuucuu

SEQ ID NO: 2758843 - RNA, 15 nt, Human
acaaggaaaaaauaa

SEQ ID NO: 2758844 - RNA, 12 nt, Human
acaaggaaggaa

SEQ ID NO: 2758845 - RNA, 21 nt, Human
acaaggaaggaaagaugugaa

SEQ ID NO: 2758846 - RNA, 16 nt, Human
acaaggaugaauuaag

SEQ ID NO: 2758847 - RNA, 19 nt, Human
acaaggcuuuaucucaggg

SEQ ID NO: 2758848 - RNA, 19 nt, Human
acaagggcuggagucugca

SEQ ID NO: 2758849 - RNA, 23 nt, Human
acaagguucuucccuuuuacaua

SEQ ID NO: 2758850 - RNA, 17 nt, Human
acaaguccagccuggca

SEQ ID NO: 2758851 - RNA, 13 nt, Human
acaauaaaagaca

SEQ ID NO: 2758852 - RNA, 13 nt, Human
acaauaaagcaau

SEQ ID NO: 2758853 - RNA, 14 nt, Human
acaauaaagcaaug

SEQ ID NO: 2758854 - RNA, 15 nt, Human
acaauaaagcaaugu

SEQ ID NO: 2758855 - RNA, 13 nt, Human
acaauaacgauaa

SEQ ID NO: 2758856 - RNA, 22 nt, Human
acaauaacgauaaaagacagug

SEQ ID NO: 2758857 - RNA, 15 nt, Human
acaauaauucuauga

SEQ ID NO: 2758858 - RNA, 14 nt, Human
acaauacaucccuu

SEQ ID NO: 2758859 - RNA, 15 nt, Human
acaauagaauuauaa

SEQ ID NO: 2758860 - RNA, 22 nt, Human
acaauggcuaagauaccaaaac

SEQ ID NO: 2758861 - RNA, 22 nt, Human
acaauguaauaaaaagccucuu

SEQ ID NO: 2758862 - RNA, 21 nt, Human
acaauuauuuuuacaguucuc

SEQ ID NO: 2758863 - RNA, 13 nt, Human
acaauucuucuuc

SEQ ID NO: 2758864 - RNA, 17 nt, Human
acaauugggagcugcca

SEQ ID NO: 2758865 - RNA, 18 nt, Human
acaauugggagcugccaa

SEQ ID NO: 2758866 - RNA, 18 nt, Human
acaauuguuggagagccc

SEQ ID NO: 2758867 - RNA, 20 nt, Human
acacaacaauccuucuauuc

SEQ ID NO: 2758868 - RNA, 16 nt, Human
acacaaccugucccag

SEQ ID NO: 2758869 - RNA, 17 nt, Human
acacaaccugucccagc

SEQ ID NO: 2758870 - RNA, 23 nt, Human
acacacaugaaguccaagcauuu

SEQ ID NO: 2758871 - RNA, 14 nt, Human
acacagacauccuc

SEQ ID NO: 2758872 - RNA, 20 nt, Human
acacagauuugagcucagcc

SEQ ID NO: 2758873 - RNA, 12 nt, Human
acacagcccugg

SEQ ID NO: 2758874 - RNA, 16 nt, Human
acacagugaccauacu

SEQ ID NO: 2758875 - RNA, 14 nt, Human
acacagugucuggc

SEQ ID NO: 2758876 - RNA, 22 nt, Human
acacagugucuggcacuuggga

SEQ ID NO: 2758877 - RNA, 19 nt, Human
acacaguuccugggaacau

SEQ ID NO: 2758878 - RNA, 22 nt, Human
acacauacauguaaaauauguc

SEQ ID NO: 2758879 - RNA, 13 nt, Human
acacaucaggaaa

SEQ ID NO: 2758880 - RNA, 21 nt, Human
acacaucaggaaagagagcac

SEQ ID NO: 2758881 - RNA, 22 nt, Human
acacauguaucuaugcauuuuc

SEQ ID NO: 2758882 - RNA, 17 nt, Human
acacaugugcuggccac

SEQ ID NO: 2758883 - RNA, 13 nt, Human
acacauguucccc

SEQ ID NO: 2758884 - RNA, 16 nt, Human
acaccaaccuucugag

SEQ ID NO: 2758885 - RNA, 12 nt, Human
acaccaccaccc

SEQ ID NO: 2758886 - RNA, 22 nt, Human
acaccagagauaauaugagaau

SEQ ID NO: 2758887 - RNA, 22 nt, Human
acaccaggcuugccugcaggca

SEQ ID NO: 2758888 - RNA, 14 nt, Human
acaccaucucccau

SEQ ID NO: 2758889 - RNA, 21 nt, Human
acacccagucuguuccccaug

SEQ ID NO: 2758890 - RNA, 14 nt, Human
acaccccaacagca

SEQ ID NO: 2758891 - RNA, 15 nt, Human
acaccccaacagcac

SEQ ID NO: 2758892 - RNA, 20 nt, Human
acaccccaacagcacccucu

SEQ ID NO: 2758893 - RNA, 17 nt, Human
acaccuaugucauuuca

SEQ ID NO: 2758894 - RNA, 18 nt, Human
acaccucuccaaagcccu

SEQ ID NO: 2758895 - RNA, 20 nt, Human
acaccuuaucuauguagaau

SEQ ID NO: 2758896 - RNA, 16 nt, Human
acaccuuguacuuuau

SEQ ID NO: 2758897 - RNA, 13 nt, Human
acaccuuuuacuc

SEQ ID NO: 2758898 - RNA, 12 nt, Human
acacuaaaacac

SEQ ID NO: 2758899 - RNA, 21 nt, Human
acacuaaaacaccucagcugc

SEQ ID NO: 2758900 - RNA, 17 nt, Human
acacuaagagagaauga

SEQ ID NO: 2758901 - RNA, 16 nt, Human
acacucagauccuccu

SEQ ID NO: 2758902 - RNA, 15 nt, Human
acacucuugaaaaau

SEQ ID NO: 2758903 - RNA, 13 nt, Human
acacucuuguaau

SEQ ID NO: 2758904 - RNA, 12 nt, Human
acacugaagaag

SEQ ID NO: 2758905 - RNA, 20 nt, Human
acacugagccagcagccugg

SEQ ID NO: 2758906 - RNA, 18 nt, Human
acacugauguaugaggaa

SEQ ID NO: 2758907 - RNA, 19 nt, Human
acacugggagaaaugaaaa

SEQ ID NO: 2758908 - RNA, 18 nt, Human
acacuguccauucuuccu

SEQ ID NO: 2758909 - RNA, 22 nt, Human
acacuguccauucuuccuccca

SEQ ID NO: 2758910 - RNA, 21 nt, Human
acacugucucuaccaaaaaaa

SEQ ID NO: 2758911 - RNA, 17 nt, Human
acacuguuaucuucacu

SEQ ID NO: 2758912 - RNA, 18 nt, Human
acacuguuaucuucacuu

SEQ ID NO: 2758913 - RNA, 20 nt, Human
acacuguuaucuucacuuuu

SEQ ID NO: 2758914 - RNA, 16 nt, Human
acacuuaaaaaugguu

SEQ ID NO: 2758915 - RNA, 21 nt, Human
acacuuugaacuacuagaaaa

SEQ ID NO: 2758916 - RNA, 22 nt, Human
acagaaaaguugaauuuuacau

SEQ ID NO: 2758917 - RNA, 20 nt, Human
acagaacuaaaaauuaaaac

SEQ ID NO: 2758918 - RNA, 15 nt, Human
acagaagagugacau

SEQ ID NO: 2758919 - RNA, 17 nt, Human
acagaagugcuuucuuc

SEQ ID NO: 2758920 - RNA, 21 nt, Human
acagacauccucuaugccagc

SEQ ID NO: 2758921 - RNA, 18 nt, Human
acagaccuaggauuucau

SEQ ID NO: 2758922 - RNA, 15 nt, Human
acagagacagaaagc

SEQ ID NO: 2758923 - RNA, 18 nt, Human
acagagacagaaagcaga

SEQ ID NO: 2758924 - RNA, 20 nt, Human
acagaucacagcuucagcca

SEQ ID NO: 2758925 - RNA, 22 nt, Human
acagaucacagcuucagccagg

SEQ ID NO: 2758926 - RNA, 16 nt, Human
acagauccccaagccu

SEQ ID NO: 2758927 - RNA, 16 nt, Human
acagauggaaaaggga

SEQ ID NO: 2758928 - RNA, 20 nt, Human
acagcaagggugaugggaaa

SEQ ID NO: 2758929 - RNA, 12 nt, Human
acagcacccucu

SEQ ID NO: 2758930 - RNA, 21 nt, Human
acagcacccucuccagaugag

SEQ ID NO: 2758931 - RNA, 20 nt, Human
acagcacgggggccaaggau

SEQ ID NO: 2758932 - RNA, 22 nt, Human
acagcacgggggccaaggaugc

SEQ ID NO: 2758933 - RNA, 23 nt, Human
acagcacgggggccaaggaugcc

SEQ ID NO: 2758934 - RNA, 18 nt, Human
acagcagcucaggcacac

SEQ ID NO: 2758935 - RNA, 18 nt, Human
acagcaguugaaaagacu

SEQ ID NO: 2758936 - RNA, 12 nt, Human
acagccacuugg

SEQ ID NO: 2758937 - RNA, 16 nt, Human
acagcccaaggguggg

SEQ ID NO: 2758938 - RNA, 13 nt, Human
acagcccuucuuu

SEQ ID NO: 2758939 - RNA, 21 nt, Human
acagcccuucuuuccacagaa

SEQ ID NO: 2758940 - RNA, 14 nt, Human
acagcuacacagau

SEQ ID NO: 2758941 - RNA, 20 nt, Human
acagcuacuugggaggcuga

SEQ ID NO: 2758942 - RNA, 22 nt, Human
acagcucagaaguuucuucuuu

SEQ ID NO: 2758943 - RNA, 18 nt, Human
acagcuucagccaggagc

SEQ ID NO: 2758944 - RNA, 20 nt, Human
acagcuucucauccugcagg

SEQ ID NO: 2758945 - RNA, 22 nt, Human
acagcuugaucaaaggcacaca

SEQ ID NO: 2758946 - RNA, 21 nt, Human
acaggacagcccuucuuucca

SEQ ID NO: 2758947 - RNA, 23 nt, Human
acaggacagcccuucuuuccaca

SEQ ID NO: 2758948 - RNA, 16 nt, Human
acaggauggcaggagg

SEQ ID NO: 2758949 - RNA, 18 nt, Human
acaggauggcaggaggca

SEQ ID NO: 2758950 - RNA, 18 nt, Human
acaggaugguucccuuga

SEQ ID NO: 2758951 - RNA, 18 nt, Human
acaggcaaauuccugacu

SEQ ID NO: 2758952 - RNA, 14 nt, Human
acaggccucacaca

SEQ ID NO: 2758953 - RNA, 16 nt, Human
acaggccucacacaca

SEQ ID NO: 2758954 - RNA, 16 nt, Human
acaggcuugaaucaaa

SEQ ID NO: 2758955 - RNA, 12 nt, Human
acagggacccac

SEQ ID NO: 2758956 - RNA, 22 nt, Human
acagggaggacgcucucuggcc

SEQ ID NO: 2758957 - RNA, 15 nt, Human
acagggagugcacau

SEQ ID NO: 2758958 - RNA, 23 nt, Human
acagggaugaggcagaccugacu

SEQ ID NO: 2758959 - RNA, 17 nt, Human
acagggcucacagaauu

SEQ ID NO: 2758960 - RNA, 16 nt, Human
acagguaaaacagggc

SEQ ID NO: 2758961 - RNA, 12 nt, Human
acaguaaaaucc

SEQ ID NO: 2758962 - RNA, 14 nt, Human
acaguauauaacua

SEQ ID NO: 2758963 - RNA, 18 nt, Human
acagucuaacaaauucca

SEQ ID NO: 2758964 - RNA, 12 nt, Human
acagugaaagaa

SEQ ID NO: 2758965 - RNA, 18 nt, Human
acagugaaagaaaauaac

SEQ ID NO: 2758966 - RNA, 22 nt, Human
acagugaaagaaaauaacaaua

SEQ ID NO: 2758967 - RNA, 20 nt, Human
acaguggaaagacagcuucu

SEQ ID NO: 2758968 - RNA, 15 nt, Human
acagugggagccagg

SEQ ID NO: 2758969 - RNA, 18 nt, Human
acagugucuuacagagaa

SEQ ID NO: 2758970 - RNA, 23 nt, Human
acaguguuuucugggauaaguaa

SEQ ID NO: 2758971 - RNA, 15 nt, Human
acaguucauauguac

SEQ ID NO: 2758972 - RNA, 22 nt, Human
acaguucggugagcuacaaaug

SEQ ID NO: 2758973 - RNA, 12 nt, Human
acaguuuuccuu

SEQ ID NO: 2758974 - RNA, 13 nt, Human
acaguuuuccuuc

SEQ ID NO: 2758975 - RNA, 19 nt, Human
acaguuuuccuucucaucu

SEQ ID NO: 2758976 - RNA, 18 nt, Human
acaguuuucugagaaaga

SEQ ID NO: 2758977 - RNA, 19 nt, Human
acaguuuuuauugcuuguu

SEQ ID NO: 2758978 - RNA, 13 nt, Human
acauaaaauacaa

SEQ ID NO: 2758979 - RNA, 19 nt, Human
acauacauuucucauaccu

SEQ ID NO: 2758980 - RNA, 23 nt, Human
acauacuauggaauuucucccag

SEQ ID NO: 2758981 - RNA, 17 nt, Human
acauagugagacacugu

SEQ ID NO: 2758982 - RNA, 21 nt, Human
acauagugaggagcuuugaaa

SEQ ID NO: 2758983 - RNA, 14 nt, Human
acauauauaacaau

SEQ ID NO: 2758984 - RNA, 13 nt, Human
acauauauauaua

SEQ ID NO: 2758985 - RNA, 19 nt, Human
acauauauauauagcagcu

SEQ ID NO: 2758986 - RNA, 15 nt, Human
acauaucgauuuuua

SEQ ID NO: 2758987 - RNA, 22 nt, Human
acauauugucacugacacacac

SEQ ID NO: 2758988 - RNA, 13 nt, Human
acaucaacagaua

SEQ ID NO: 2758989 - RNA, 22 nt, Human
acaucaaccugccagcuggccu

SEQ ID NO: 2758990 - RNA, 12 nt, Human
acaucagcuugc

SEQ ID NO: 2758991 - RNA, 16 nt, Human
acaucaggaaagagag

SEQ ID NO: 2758992 - RNA, 14 nt, Human
acauccauucuucc

SEQ ID NO: 2758993 - RNA, 17 nt, Human
acauccauucuucccuu

SEQ ID NO: 2758994 - RNA, 22 nt, Human
acauccuacaagacacagugac

SEQ ID NO: 2758995 - RNA, 15 nt, Human
accccuccccugccc

SEQ ID NO: 2758996 - RNA, 12 nt, Human
accccugagcuu

SEQ ID NO: 2758997 - RNA, 13 nt, Human
accccugagcuug

SEQ ID NO: 2758998 - RNA, 17 nt, Human
accccugagcuugcaga

SEQ ID NO: 2758999 - RNA, 19 nt, Human
accccugagcuugcagaga

SEQ ID NO: 2759000 - RNA, 15 nt, Human
accccuucauccucu

SEQ ID NO: 2759001 - RNA, 16 nt, Human
accccuuuacaaauag

SEQ ID NO: 2759002 - RNA, 18 nt, Human
acccgccucagccuccca

SEQ ID NO: 2759003 - RNA, 13 nt, Human
acccggccugauu

SEQ ID NO: 2759004 - RNA, 15 nt, Human
acccggccugauuaa

SEQ ID NO: 2759005 - RNA, 19 nt, Human
acccgggaggcagagguug

SEQ ID NO: 2759006 - RNA, 21 nt, Human
acccuaaacauccuaagcuca

SEQ ID NO: 2759007 - RNA, 20 nt, Human
acccuacaaaaccacuggaa

SEQ ID NO: 2759008 - RNA, 12 nt, Human
acccuauauuuu

SEQ ID NO: 2759009 - RNA, 15 nt, Human
acccucacuuaaacu

SEQ ID NO: 2759010 - RNA, 13 nt, Human
acccucagaugca

SEQ ID NO: 2759011 - RNA, 11 nt, Human
acccucccacu

SEQ ID NO: 2759012 - RNA, 15 nt, Human
acccucccacugcca

SEQ ID NO: 2759013 - RNA, 13 nt, Human
acccucuccagau

SEQ ID NO: 2759014 - RNA, 18 nt, Human
acccucuccagaugagag

SEQ ID NO: 2759015 - RNA, 13 nt, Human
acccucugggucu

SEQ ID NO: 2759016 - RNA, 14 nt, Human
acccugaggugagc

SEQ ID NO: 2759017 - RNA, 18 nt, Human
acccugaggugagcauca

SEQ ID NO: 2759018 - RNA, 22 nt, Human
acccugaggugagcaucaucuu

SEQ ID NO: 2759019 - RNA, 22 nt, Human
aaaugugcuuuuaaaaaaaaau

SEQ ID NO: 2759020 - RNA, 22 nt, Human
aaauguugacaugggacauuug

SEQ ID NO: 2759021 - RNA, 19 nt, Human
aaauguuuacagaucccca

SEQ ID NO: 2759022 - RNA, 19 nt, Human
aaauuaaaaccucuuugug

SEQ ID NO: 2759023 - RNA, 20 nt, Human
aaauuaaggcauaagaaaac

SEQ ID NO: 2759024 - RNA, 23 nt, Human
aaauuaaggcuucucuuaaacac

SEQ ID NO: 2759025 - RNA, 19 nt, Human
aaauuagaggucuccaaaa

SEQ ID NO: 2759026 - RNA, 14 nt, Human
aaauuauauuuuga

SEQ ID NO: 2759027 - RNA, 15 nt, Human
aaauuauauuuugaa

SEQ ID NO: 2759028 - RNA, 13 nt, Human
aaauuauuauuua

SEQ ID NO: 2759029 - RNA, 17 nt, Human
aaauuauuauuuaaaca

SEQ ID NO: 2759030 - RNA, 18 nt, Human
aaauuauuauuuaaacau

SEQ ID NO: 2759031 - RNA, 20 nt, Human
aaauuauuuuuguucauaua

SEQ ID NO: 2759032 - RNA, 14 nt, Human
aaauuccagaauga

SEQ ID NO: 2759033 - RNA, 13 nt, Human
aaauucgcaaacu

SEQ ID NO: 2759034 - RNA, 18 nt, Human
aaauucgcaaacuuucuu

SEQ ID NO: 2759035 - RNA, 16 nt, Human
aaauucucacagaaga

SEQ ID NO: 2759036 - RNA, 23 nt, Human
aaauucucacagaagaaggaaau

SEQ ID NO: 2759037 - RNA, 16 nt, Human
aaauucugucucugga

SEQ ID NO: 2759038 - RNA, 14 nt, Human
aaauugaaucacug

SEQ ID NO: 2759039 - RNA, 16 nt, Human
aaauugaauuuccaug

SEQ ID NO: 2759040 - RNA, 14 nt, Human
aaauugagcuaggg

SEQ ID NO: 2759041 - RNA, 14 nt, Human
aaauuggacuuaaa

SEQ ID NO: 2759042 - RNA, 15 nt, Human
aaauuguaagcaugc

SEQ ID NO: 2759043 - RNA, 20 nt, Human
aaauuguaagcaugcacaaa

SEQ ID NO: 2759044 - RNA, 22 nt, Human
aaauuguauagaccuaaaauaa

SEQ ID NO: 2759045 - RNA, 17 nt, Human
aaauuguauuacaaauc

SEQ ID NO: 2759046 - RNA, 13 nt, Human
aaauugucacagg

SEQ ID NO: 2759047 - RNA, 16 nt, Human
aaauugugcuggaaau

SEQ ID NO: 2759048 - RNA, 21 nt, Human
aaauugugcuggaaauggaca

SEQ ID NO: 2759049 - RNA, 12 nt, Human
aaauuuaaaaca

SEQ ID NO: 2759050 - RNA, 17 nt, Human
aaauuuacagagacaga

SEQ ID NO: 2759051 - RNA, 23 nt, Human
aaauuuacagagacagaaagcag

SEQ ID NO: 2759052 - RNA, 16 nt, Human
aagugcuuucuucucc

SEQ ID NO: 2759053 - RNA, 14 nt, Human
aagugugacucauu

SEQ ID NO: 2759054 - RNA, 20 nt, Human
aaguguguguuuuucauaaa

SEQ ID NO: 2759055 - RNA, 16 nt, Human
aaguguuugaaagcuu

SEQ ID NO: 2759056 - RNA, 22 nt, Human
aaguuacacauuuuucagauau

SEQ ID NO: 2759057 - RNA, 18 nt, Human
aaguuagaaaguugauuu

SEQ ID NO: 2759058 - RNA, 22 nt, Human
aaguuagaaaguugauuuuaag

SEQ ID NO: 2759059 - RNA, 15 nt, Human
aaguuauguagaaaa

SEQ ID NO: 2759060 - RNA, 20 nt, Human
aaguuauguagaaaaaagua

SEQ ID NO: 2759061 - RNA, 20 nt, Human
aaguucaaaacuuauuggaa

SEQ ID NO: 2759062 - RNA, 23 nt, Human
aaguucaauauaagcuuuucuuu

SEQ ID NO: 2759063 - RNA, 12 nt, Human
aaguucuaguga

SEQ ID NO: 2759064 - RNA, 13 nt, Human
aaguucuagugac

SEQ ID NO: 2759065 - RNA, 21 nt, Human
aaguucugcagauaaacagua

SEQ ID NO: 2759066 - RNA, 20 nt, Human
aaguugauaugccuuuuccc

SEQ ID NO: 2759067 - RNA, 22 nt, Human
aaguugauaugccuuuucccaa

SEQ ID NO: 2759068 - RNA, 16 nt, Human
aaguugauuaagaaag

SEQ ID NO: 2759069 - RNA, 18 nt, Human
aaguugauuaagaaagga

SEQ ID NO: 2759070 - RNA, 16 nt, Human
aaguuggcuggugucc

SEQ ID NO: 2759071 - RNA, 15 nt, Human
aaguuggugacagau

SEQ ID NO: 2759072 - RNA, 22 nt, Human
aaguuguagguaauauugcaag

SEQ ID NO: 2759073 - RNA, 20 nt, Human
aaguuguuaauaaaaguaca

SEQ ID NO: 2759074 - RNA, 19 nt, Human
aaguuguuucauugacuau

SEQ ID NO: 2759075 - RNA, 23 nt, Human
aaguuuaauugacuuauuuauau

SEQ ID NO: 2759076 - RNA, 21 nt, Human
aaguuuaugguuguauuauuu

SEQ ID NO: 2759077 - RNA, 17 nt, Human
aaguuuguugaaacaca

SEQ ID NO: 2759078 - RNA, 14 nt, Human
aauaaaaauaaauu

SEQ ID NO: 2759079 - RNA, 15 nt, Human
aauaaaauacauacu

SEQ ID NO: 2759080 - RNA, 12 nt, Human
aauaaaauccau

SEQ ID NO: 2759081 - RNA, 14 nt, Human
aauaaaauggguuu

SEQ ID NO: 2759082 - RNA, 13 nt, Human
aauaaaauuuuua

SEQ ID NO: 2759083 - RNA, 14 nt, Human
aauaaaauuuuuaa

SEQ ID NO: 2759084 - RNA, 20 nt, Human
aauaaacacucuugaaaaau

SEQ ID NO: 2759085 - RNA, 23 nt, Human
aauaaacauucuaucuauuccug

SEQ ID NO: 2759086 - RNA, 13 nt, Human
aauaaaccuuuuu

SEQ ID NO: 2759087 - RNA, 23 nt, Human
aauaaaccuuuuuggacacacaa

SEQ ID NO: 2759088 - RNA, 18 nt, Human
aauaaacuauuuguaaag

SEQ ID NO: 2759089 - RNA, 20 nt, Human
aauaaacucauuucuagcag

SEQ ID NO: 2759090 - RNA, 16 nt, Human
aauaaagaauuuuaaa

SEQ ID NO: 2759091 - RNA, 15 nt, Human
aauaaagcaaugugg

SEQ ID NO: 2759092 - RNA, 12 nt, Human
aauaaaguacaa

SEQ ID NO: 2759093 - RNA, 15 nt, Human
aauaaaguacaagag

SEQ ID NO: 2759094 - RNA, 21 nt, Human
aauaaaguauauauagaaucu

SEQ ID NO: 2759095 - RNA, 17 nt, Human
aauaaaguguuugaaag

SEQ ID NO: 2759096 - RNA, 12 nt, Human
aauaaauaaaua

SEQ ID NO: 2759097 - RNA, 15 nt, Human
aauaaauaaauaaaa

SEQ ID NO: 2759098 - RNA, 17 nt, Human
aauaaauaccaaaaaau

SEQ ID NO: 2759099 - RNA, 13 nt, Human
aauaaauguacau

SEQ ID NO: 2759100 - RNA, 19 nt, Human
aauaaauguaucuuauuca

SEQ ID NO: 2759101 - RNA, 20 nt, Human
aauaaaugugccuucauuuu

SEQ ID NO: 2759102 - RNA, 15 nt, Human
aauaaauuucaccaa

SEQ ID NO: 2759103 - RNA, 17 nt, Human
aauaacaauaaaagaca

SEQ ID NO: 2759104 - RNA, 15 nt, Human
aauaacauggugugc

SEQ ID NO: 2759105 - RNA, 22 nt, Human
aauaagacggauuuauuuuucc

SEQ ID NO: 2759106 - RNA, 15 nt, Human
aauaaguacugugua

SEQ ID NO: 2759107 - RNA, 17 nt, Human
aauaaguauuuauaaua

SEQ ID NO: 2759108 - RNA, 22 nt, Human
aauaauccuaaacauaugaauu

SEQ ID NO: 2759109 - RNA, 21 nt, Human
aauaauccucaguuuuuguga

SEQ ID NO: 2759110 - RNA, 17 nt, Human
aauaauguaagacaaau

SEQ ID NO: 2759111 - RNA, 14 nt, Human
aauaauguuucaaa

SEQ ID NO: 2759112 - RNA, 21 nt, Human
aauaauguuucaaacauauau

SEQ ID NO: 2759113 - RNA, 15 nt, Human
aauaauuuuuauauu

SEQ ID NO: 2759114 - RNA, 23 nt, Human
aauaauuuuuauauuugaaauau

SEQ ID NO: 2759115 - RNA, 20 nt, Human
aauaauuuuucacuucaaaa

SEQ ID NO: 2759116 - RNA, 22 nt, Human
aauaauuuuucacuucaaaaca

SEQ ID NO: 2759117 - RNA, 14 nt, Human
aauacacuguuauc

SEQ ID NO: 2759118 - RNA, 16 nt, Human
aauacacuguuaucuu

SEQ ID NO: 2759119 - RNA, 14 nt, Human
aauacauacuauag

SEQ ID NO: 2759120 - RNA, 18 nt, Human
aauaccacagcuuuuuac

SEQ ID NO: 2759121 - RNA, 14 nt, Human
aauacuaauaaaau

SEQ ID NO: 2759122 - RNA, 14 nt, Human
aauacucuuaggaa

SEQ ID NO: 2759123 - RNA, 20 nt, Human
aauacucuuaggaagagaaa

SEQ ID NO: 2759124 - RNA, 19 nt, Human
aauacucuuauaucuauau

SEQ ID NO: 2759125 - RNA, 20 nt, Human
aauacucuuauaucuauauu

SEQ ID NO: 2759126 - RNA, 19 nt, Human
aauacugauguuccuagug

SEQ ID NO: 2759127 - RNA, 22 nt, Human
aauacugauguuccuagugaaa

SEQ ID NO: 2759128 - RNA, 14 nt, Human
aauacuguggaacu

SEQ ID NO: 2759129 - RNA, 12 nt, Human
aauacuuuauaa

SEQ ID NO: 2759130 - RNA, 15 nt, Human
aauacuuuauaaagg

SEQ ID NO: 2759131 - RNA, 16 nt, Human
aauagaaauggggaac

SEQ ID NO: 2759132 - RNA, 18 nt, Human
aauagagaaauaugauuu

SEQ ID NO: 2759133 - RNA, 21 nt, Human
aauagauugggcacuguggaa

SEQ ID NO: 2759134 - RNA, 23 nt, Human
aauagcagacaguguuuucuggg

SEQ ID NO: 2759135 - RNA, 23 nt, Human
aauagcaguugaaacaagaagcc

SEQ ID NO: 2759136 - RNA, 21 nt, Human
aauaggcugaugggcaaaaaa

SEQ ID NO: 2759137 - RNA, 18 nt, Human
aauagguuuggacaaaau

SEQ ID NO: 2759138 - RNA, 15 nt, Human
aauagugauuuccac

SEQ ID NO: 2759139 - RNA, 22 nt, Human
aauaguguuggaaaaugugcaa

SEQ ID NO: 2759140 - RNA, 22 nt, Human
aauaguucaaagccaaguuuau

SEQ ID NO: 2759141 - RNA, 14 nt, Human
aauaguuuaugauu

SEQ ID NO: 2759142 - RNA, 16 nt, Human
aauaguuuuauuaaua

SEQ ID NO: 2759143 - RNA, 14 nt, Human
aauauaaacagcaa

SEQ ID NO: 2759144 - RNA, 14 nt, Human
aauauaaagcaaga

SEQ ID NO: 2759145 - RNA, 14 nt, Human
aauauaaauaaaaa

SEQ ID NO: 2759146 - RNA, 16 nt, Human
aauauaaauaaaaaua

SEQ ID NO: 2759147 - RNA, 15 nt, Human
aauauaaauuuauca

SEQ ID NO: 2759148 - RNA, 15 nt, Human
aauauaauaugcaca

SEQ ID NO: 2759149 - RNA, 12 nt, Human
aauauaaugaag

SEQ ID NO: 2759150 - RNA, 15 nt, Human
aauauauaucaaaua

SEQ ID NO: 2759151 - RNA, 16 nt, Human
aauauauaugaauaaa

SEQ ID NO: 2759152 - RNA, 17 nt, Human
aauauauauuaucuuuu

SEQ ID NO: 2759153 - RNA, 21 nt, Human
aauauauauuaucuuuucaua

SEQ ID NO: 2759154 - RNA, 17 nt, Human
aauauaucugcuauucu

SEQ ID NO: 2759155 - RNA, 14 nt, Human
aauauaugaggcua

SEQ ID NO: 2759156 - RNA, 19 nt, Human
aauauauuuuaaauauuuu

SEQ ID NO: 2759157 - RNA, 15 nt, Human
aauaucacuugucaa

SEQ ID NO: 2759158 - RNA, 21 nt, Human
aauaucacuugucaauaaaau

SEQ ID NO: 2759159 - RNA, 11 nt, Human
aauaucuauua

SEQ ID NO: 2759160 - RNA, 16 nt, Human
aauaucuauuaauaua

SEQ ID NO: 2759161 - RNA, 19 nt, Human
aauaucuccgucaacucau

SEQ ID NO: 2759162 - RNA, 22 nt, Human
aauaucuccgucaacucauauu

SEQ ID NO: 2759163 - RNA, 13 nt, Human
aauaucucuucuc

SEQ ID NO: 2759164 - RNA, 16 nt, Human
aauaucuuaucuuccu

SEQ ID NO: 2759165 - RNA, 16 nt, Human
aauaucuucacuuguc

SEQ ID NO: 2759166 - RNA, 16 nt, Human
aauaugcacaauagca

SEQ ID NO: 2759167 - RNA, 22 nt, Human
aauaugccccauucaacaucua

SEQ ID NO: 2759168 - RNA, 16 nt, Human
aauauguaaaauuaca

SEQ ID NO: 2759169 - RNA, 16 nt, Human
aauauguccuuuuuaa

SEQ ID NO: 2759170 - RNA, 23 nt, Human
aauaugugauguggcaaaucucu

SEQ ID NO: 2759171 - RNA, 20 nt, Human
aauauguuagagaauuuccu

SEQ ID NO: 2759172 - RNA, 13 nt, Human
aauauguuauuau

SEQ ID NO: 2759173 - RNA, 19 nt, Human
aauauuauguuaaaacugg

SEQ ID NO: 2759174 - RNA, 14 nt, Human
aauauuauuuuaua

SEQ ID NO: 2759175 - RNA, 13 nt, Human
aauauucauagca

SEQ ID NO: 2759176 - RNA, 12 nt, Human
aauauuccucag

SEQ ID NO: 2759177 - RNA, 19 nt, Human
aauauuccuuaagauauua

SEQ ID NO: 2759178 - RNA, 18 nt, Human
aauauugauuuauuaaua

SEQ ID NO: 2759179 - RNA, 17 nt, Human
aauauugcaaggcaaag

SEQ ID NO: 2759180 - RNA, 23 nt, Human
aauauugcaaggcaaagacuauu

SEQ ID NO: 2759181 - RNA, 13 nt, Human
aauauuuaacauu

SEQ ID NO: 2759182 - RNA, 14 nt, Human
aauauuuauuuuaa

SEQ ID NO: 2759183 - RNA, 18 nt, Human
aauauuuauuuuaauaau

SEQ ID NO: 2759184 - RNA, 23 nt, Human
aauauuuauuuuaauaauguuuc

SEQ ID NO: 2759185 - RNA, 12 nt, Human
aauauuucagau

SEQ ID NO: 2759186 - RNA, 13 nt, Human
aauauuucagaua

SEQ ID NO: 2759187 - RNA, 17 nt, Human
aauauuugaauuuuaaa

SEQ ID NO: 2759188 - RNA, 19 nt, Human
aauauuuuaacuuccuugg

SEQ ID NO: 2759189 - RNA, 18 nt, Human
aauauuuuaauguuucuu

SEQ ID NO: 2759190 - RNA, 20 nt, Human
aauauuuucuuuguuaaaau

SEQ ID NO: 2759191 - RNA, 23 nt, Human
gccaacugggguggguggggcag

SEQ ID NO: 2759192 - RNA, 16 nt, Human
gccaagaggcuguucc

SEQ ID NO: 2759193 - RNA, 16 nt, Human
gccaaggaugccccgu

SEQ ID NO: 2759194 - RNA, 12 nt, Human
gccaaggcugga

SEQ ID NO: 2759195 - RNA, 15 nt, Human
gccaauauuuuucuu

SEQ ID NO: 2759196 - RNA, 13 nt, Human
gccacaagaaccc

SEQ ID NO: 2759197 - RNA, 22 nt, Human
gccacaccucuccaaagcccuc

SEQ ID NO: 2759198 - RNA, 15 nt, Human
gccacaguuccccua

SEQ ID NO: 2759199 - RNA, 16 nt, Human
gccaccaaacccggcc

SEQ ID NO: 2759200 - RNA, 15 nt, Human
gccaccaagcuggug

SEQ ID NO: 2759201 - RNA, 21 nt, Human
gccaccaagcugguggcucug

SEQ ID NO: 2759202 - RNA, 14 nt, Human
gccaccacauccag

SEQ ID NO: 2759203 - RNA, 15 nt, Human
gccaccacgcccagc

SEQ ID NO: 2759204 - RNA, 16 nt, Human
gccaccacgcccagcu

SEQ ID NO: 2759205 - RNA, 16 nt, Human
gccaccauggccagcu

SEQ ID NO: 2759206 - RNA, 15 nt, Human
gccacccucccacug

SEQ ID NO: 2759207 - RNA, 14 nt, Human
gccaccugacucuu

SEQ ID NO: 2759208 - RNA, 19 nt, Human
gccacgcucugggucgccg

SEQ ID NO: 2759209 - RNA, 20 nt, Human
gccacgcucugggucgccgg

SEQ ID NO: 2759210 - RNA, 23 nt, Human
gccacuaaauugacacuuaaaaa

SEQ ID NO: 2759211 - RNA, 14 nt, Human
gccacuagcccucc

SEQ ID NO: 2759212 - RNA, 16 nt, Human
gccacuagcccuccuc

SEQ ID NO: 2759213 - RNA, 16 nt, Human
gccacuggacugacga

SEQ ID NO: 2759214 - RNA, 13 nt, Human
gccacuucacuuu

SEQ ID NO: 2759215 - RNA, 14 nt, Human
gccagaccagcagg

SEQ ID NO: 2759216 - RNA, 18 nt, Human
gccagacuggcacaguuu

SEQ ID NO: 2759217 - RNA, 10 nt, Human
gccagaggcu

SEQ ID NO: 2759218 - RNA, 17 nt, Human
gccagaggcucuaaugu

SEQ ID NO: 2759219 - RNA, 19 nt, Human
gccagaggcucuaauguac

SEQ ID NO: 2759220 - RNA, 14 nt, Human
gccagcaguucaga

SEQ ID NO: 2759221 - RNA, 16 nt, Human
gccagcaguucagagc

SEQ ID NO: 2759222 - RNA, 18 nt, Human
gccagcaguucagagcug

SEQ ID NO: 2759223 - RNA, 22 nt, Human
gccagcaguucagagcugcccu

SEQ ID NO: 2759224 - RNA, 19 nt, Human
gccagcaucugccuccccu

SEQ ID NO: 2759225 - RNA, 20 nt, Human
gccagcaucugccuccccuu

SEQ ID NO: 2759226 - RNA, 21 nt, Human
gccagccacggggacucagcc

SEQ ID NO: 2759227 - RNA, 15 nt, Human
gccagcccucuucug

SEQ ID NO: 2759228 - RNA, 18 nt, Human
gccagcccucuucugaca

SEQ ID NO: 2759229 - RNA, 20 nt, Human
gccagcccucuucugacacu

SEQ ID NO: 2759230 - RNA, 13 nt, Human
gccagcuaauuuu

SEQ ID NO: 2759231 - RNA, 13 nt, Human
gccagcucucagc

SEQ ID NO: 2759232 - RNA, 14 nt, Human
gccaggacccagga

SEQ ID NO: 2759233 - RNA, 15 nt, Human
gccaggagcugggca

SEQ ID NO: 2759234 - RNA, 19 nt, Human
gccaggauggcgcaggaac

SEQ ID NO: 2759235 - RNA, 20 nt, Human
gccaggauggcgcaggaacu

SEQ ID NO: 2759236 - RNA, 14 nt, Human
gccaggcacagugg

SEQ ID NO: 2759237 - RNA, 14 nt, Human
gccaggcauggugg

SEQ ID NO: 2759238 - RNA, 15 nt, Human
gccaggcccagagca

SEQ ID NO: 2759239 - RNA, 13 nt, Human
gccaggcuggagu

SEQ ID NO: 2759240 - RNA, 19 nt, Human
gccaggcuggagugcagug

SEQ ID NO: 2759241 - RNA, 13 nt, Human
gccaggcuggguc

SEQ ID NO: 2759242 - RNA, 20 nt, Human
gccaggcugggucgcccugg

SEQ ID NO: 2759243 - RNA, 17 nt, Human
gccaggcuggucucaaa

SEQ ID NO: 2759244 - RNA, 14 nt, Human
gccagggcaagaga

SEQ ID NO: 2759245 - RNA, 23 nt, Human
gccagguaccuucucaccuguga

SEQ ID NO: 2759246 - RNA, 13 nt, Human
gccaguuguccuc

SEQ ID NO: 2759247 - RNA, 18 nt, Human
gccauagucauucugccu

SEQ ID NO: 2759248 - RNA, 19 nt, Human
gccauagucauucugccug

SEQ ID NO: 2759249 - RNA, 21 nt, Human
gccauagucauucugccugcc

SEQ ID NO: 2759250 - RNA, 22 nt, Human
gccauagucauucugccugccc

SEQ ID NO: 2759251 - RNA, 15 nt, Human
gccaucccucccucc

SEQ ID NO: 2759252 - RNA, 22 nt, Human
gccaucccucccuccaccuccc

SEQ ID NO: 2759253 - RNA, 15 nt, Human
gccaucucaaccucu

SEQ ID NO: 2759254 - RNA, 13 nt, Human
gccaugcuggcca

SEQ ID NO: 2759255 - RNA, 14 nt, Human
gccaugcuggccag

SEQ ID NO: 2759256 - RNA, 17 nt, Human
gccaugcuggccaggcu

SEQ ID NO: 2759257 - RNA, 18 nt, Human
gccaugcuggccaggcug

SEQ ID NO: 2759258 - RNA, 23 nt, Human
gccaugcuggccaggcuggucuc

SEQ ID NO: 2759259 - RNA, 20 nt, Human
gccauggagguuaagcacuu

SEQ ID NO: 2759260 - RNA, 16 nt, Human
gccaugugcuaguaau

SEQ ID NO: 2759261 - RNA, 14 nt, Human
gccauuacccccag

SEQ ID NO: 2759262 - RNA, 20 nt, Human
gccauuguaguccuguaaug

SEQ ID NO: 2759263 - RNA, 20 nt, Human
gccauuuaaagcuuauuaaa

SEQ ID NO: 2759264 - RNA, 11 nt, Human
gcccaaacugc

SEQ ID NO: 2759265 - RNA, 23 nt, Human
gcccaacuguuauagguuguugg

SEQ ID NO: 2759266 - RNA, 21 nt, Human
gcccaagggugggugggguga

SEQ ID NO: 2759267 - RNA, 17 nt, Human
gcccaaggguggugaga

SEQ ID NO: 2759268 - RNA, 21 nt, Human
gcccacaccagggccuggcug

SEQ ID NO: 2759269 - RNA, 13 nt, Human
gcccacggcugga

SEQ ID NO: 2759270 - RNA, 22 nt, Human
gcccacggcuggagcugccucu

SEQ ID NO: 2759271 - RNA, 23 nt, Human
gcccacggcuggagcugccucuc

SEQ ID NO: 2759272 - RNA, 15 nt, Human
gcccacuagacccac

SEQ ID NO: 2759273 - RNA, 20 nt, Human
gcccacucugcaagaagaaa

SEQ ID NO: 2759274 - RNA, 15 nt, Human
gcccacuguacuugc

SEQ ID NO: 2759275 - RNA, 18 nt, Human
gcccacuuccucccggcc

SEQ ID NO: 2759276 - RNA, 22 nt, Human
gcccacuuccucccggccgcgc

SEQ ID NO: 2759277 - RNA, 15 nt, Human
gcccagcggcaucag

SEQ ID NO: 2759278 - RNA, 15 nt, Human
gcccagcuugaaacc

SEQ ID NO: 2759279 - RNA, 24 nt, Human
gcccaggaauuggaaagcagccug

SEQ ID NO: 2759280 - RNA, 21 nt, Human
gcccaggaccccauggcagug

SEQ ID NO: 2759281 - RNA, 18 nt, Human
gcccaggaguuuggccag

SEQ ID NO: 2759282 - RNA, 20 nt, Human
gcccaggaguuuggccagaa

SEQ ID NO: 2759283 - RNA, 16 nt, Human
gcccagggcucagccu

SEQ ID NO: 2759284 - RNA, 20 nt, Human
gcccagggcucagccuggug

SEQ ID NO: 2759285 - RNA, 18 nt, Human
gcccauaccccuggccaa

SEQ ID NO: 2759286 - RNA, 16 nt, Human
gcccauccugccccug

SEQ ID NO: 2759287 - RNA, 17 nt, Human
gcccauccugccccuga

SEQ ID NO: 2759288 - RNA, 20 nt, Human
gcccauccugccccugagcc

SEQ ID NO: 2759289 - RNA, 19 nt, Human
gcccaugcuggagugcagu

SEQ ID NO: 2759290 - RNA, 24 nt, Human
gccccaaguggaacgagacaagca

SEQ ID NO: 2759291 - RNA, 16 nt, Human
gccccaguuguuucua

SEQ ID NO: 2759292 - RNA, 19 nt, Human
gccccaucagcuccagcug

SEQ ID NO: 2759293 - RNA, 16 nt, Human
gccccaucuccucagc

SEQ ID NO: 2759294 - RNA, 20 nt, Human
gccccaucuccucagcaccc

SEQ ID NO: 2759295 - RNA, 14 nt, Human
gccccaucuggucc

SEQ ID NO: 2759296 - RNA, 15 nt, Human
gccccaucugguccu

SEQ ID NO: 2759297 - RNA, 15 nt, Human
gccccauucaacauc

SEQ ID NO: 2759298 - RNA, 13 nt, Human
gcccccaacagca

SEQ ID NO: 2759299 - RNA, 23 nt, Human
gcccccacuugccauaaaacuua

SEQ ID NO: 2759300 - RNA, 17 nt, Human
gccccccagcccuccuu

SEQ ID NO: 2759301 - RNA, 12 nt, Human
gcccccgggccg

SEQ ID NO: 2759302 - RNA, 13 nt, Human
gcccccgggccga

SEQ ID NO: 2759303 - RNA, 20 nt, Human
gcccccuaauccccuucucc

SEQ ID NO: 2759304 - RNA, 14 nt, Human
gccccgggaguggc

SEQ ID NO: 2759305 - RNA, 19 nt, Human
gccccggggaggggcgcuc

SEQ ID NO: 2759306 - RNA, 21 nt, Human
gccccggggaggggcgcucgc

SEQ ID NO: 2759307 - RNA, 22 nt, Human
gccccggggaggggcgcucgcu

SEQ ID NO: 2759308 - RNA, 16 nt, Human
gccccgucccccucug

SEQ ID NO: 2759309 - RNA, 19 nt, Human
gccccgucccccucuggcu

SEQ ID NO: 2759310 - RNA, 21 nt, Human
gccccgucccccucuggcucc

SEQ ID NO: 2759311 - RNA, 18 nt, Human
gccccgugggguuccucc

SEQ ID NO: 2759312 - RNA, 19 nt, Human
gccccuacccuggacuugc

SEQ ID NO: 2759313 - RNA, 14 nt, Human
gccccucuccugga

SEQ ID NO: 2759314 - RNA, 23 nt, Human
gccccucuguaucuagccuggaa

SEQ ID NO: 2759315 - RNA, 12 nt, Human
gccccugagccc

SEQ ID NO: 2759316 - RNA, 15 nt, Human
gccccugagcccaug

SEQ ID NO: 2759317 - RNA, 15 nt, Human
gccccugcacuccag

SEQ ID NO: 2759318 - RNA, 23 nt, Human
gccccugcacuccagccugagcg

SEQ ID NO: 2759319 - RNA, 15 nt, Human
gccccugggaccagg

SEQ ID NO: 2759320 - RNA, 19 nt, Human
gccccuggucagucugccc

SEQ ID NO: 2759321 - RNA, 21 nt, Human
gccccuuugcugacccucccc

SEQ ID NO: 2759322 - RNA, 22 nt, Human
gccccuuugcugacccucccca

SEQ ID NO: 2759323 - RNA, 23 nt, Human
gccccuuugcugacccuccccaa

SEQ ID NO: 2759324 - RNA, 23 nt, Human
gcccuacugggagaggggccuca

SEQ ID NO: 2759325 - RNA, 17 nt, Human
gcccucagaaucgcucc

SEQ ID NO: 2759326 - RNA, 12 nt, Human
gcccucccccuc

SEQ ID NO: 2759327 - RNA, 13 nt, Human
gcccucuccuggg

SEQ ID NO: 2759328 - RNA, 16 nt, Human
gcccugaaagucccag

SEQ ID NO: 2759329 - RNA, 23 nt, Human
gcccugagcucgguggacccagg

SEQ ID NO: 2759330 - RNA, 19 nt, Human
gcccugcaccaugcugcug

SEQ ID NO: 2759331 - RNA, 20 nt, Human
gcccugcaccaugcugcugg

SEQ ID NO: 2759332 - RNA, 12 nt, Human
gcccugcugagu

SEQ ID NO: 2759333 - RNA, 16 nt, Human
gcccugcugaguccca

SEQ ID NO: 2759334 - RNA, 21 nt, Human
gcccugcugagucccaggcug

SEQ ID NO: 2759335 - RNA, 14 nt, Human
gcccugcugcccuc

SEQ ID NO: 2759336 - RNA, 16 nt, Human
gcccuggacugugugc

SEQ ID NO: 2759337 - RNA, 17 nt, Human
gcccugggaggcucugg

SEQ ID NO: 2759338 - RNA, 19 nt, Human
gcccugggaggcucuggag

SEQ ID NO: 2759339 - RNA, 15 nt, Human
gcccuguaacaggcu

SEQ ID NO: 2759340 - RNA, 14 nt, Human
gcccugugcggccu

SEQ ID NO: 2759341 - RNA, 16 nt, Human
gaugaucauguauuua

SEQ ID NO: 2759342 - RNA, 16 nt, Human
gaugauccccacgcca

SEQ ID NO: 2759343 - RNA, 14 nt, Human
gaugaucuuuaaaa

SEQ ID NO: 2759344 - RNA, 16 nt, Human
gaugaucuuuaaaaua

SEQ ID NO: 2759345 - RNA, 18 nt, Human
gaugaucuuuaaaauaca

SEQ ID NO: 2759346 - RNA, 17 nt, Human
gaugaugaucuuuaaaa

SEQ ID NO: 2759347 - RNA, 13 nt, Human
gaugauguuucgu

SEQ ID NO: 2759348 - RNA, 17 nt, Human
gaugauuucagcaggga

SEQ ID NO: 2759349 - RNA, 19 nt, Human
gaugauuucagcagggaug

SEQ ID NO: 2759350 - RNA, 22 nt, Human
gaugcaguuguugcccacagcu

SEQ ID NO: 2759351 - RNA, 13 nt, Human
gaugcccacggcu

SEQ ID NO: 2759352 - RNA, 20 nt, Human
gaugcccacggcuggagcug

SEQ ID NO: 2759353 - RNA, 15 nt, Human
gaugccuggcggggu

SEQ ID NO: 2759354 - RNA, 19 nt, Human
gaugcuacucuaguauucc

SEQ ID NO: 2759355 - RNA, 15 nt, Human
gaugcuuugagaaca

SEQ ID NO: 2759356 - RNA, 16 nt, Human
gaugcuuugagaacau

SEQ ID NO: 2759357 - RNA, 23 nt, Human
gauggaaaagggagauucagacu

SEQ ID NO: 2759358 - RNA, 22 nt, Human
gauggaaguugcagugagcuga

SEQ ID NO: 2759359 - RNA, 20 nt, Human
gauggcaggaggcauccaaa

SEQ ID NO: 2759360 - RNA, 23 nt, Human
gauggcuaguaucaaaagaaaga

SEQ ID NO: 2759361 - RNA, 17 nt, Human
gaugggaacaaggaagg

SEQ ID NO: 2759362 - RNA, 22 nt, Human
gaugggaacaaggaaggaaaga

SEQ ID NO: 2759363 - RNA, 23 nt, Human
gaugggagugcccccaacagcac

SEQ ID NO: 2759364 - RNA, 16 nt, Human
gaugggcaaaaaacca

SEQ ID NO: 2759365 - RNA, 18 nt, Human
gauggguuugacaagguu

SEQ ID NO: 2759366 - RNA, 23 nt, Human
gauggguuugacaagguucuucc

SEQ ID NO: 2759367 - RNA, 18 nt, Human
gaugguucccuugaugaa

SEQ ID NO: 2759368 - RNA, 22 nt, Human
gaugguucccuugaugaagaag

SEQ ID NO: 2759369 - RNA, 16 nt, Human
gauguaaaaucuuguc

SEQ ID NO: 2759370 - RNA, 20 nt, Human
gauguagauaaacucagaaa

SEQ ID NO: 2759371 - RNA, 15 nt, Human
gauguauguacuuca

SEQ ID NO: 2759372 - RNA, 16 nt, Human
gauguggagggggcgc

SEQ ID NO: 2759373 - RNA, 14 nt, Human
gaugugggcaguga

SEQ ID NO: 2759374 - RNA, 21 nt, Human
gauguggggaaguuaggaacu

SEQ ID NO: 2759375 - RNA, 14 nt, Human
gauguugaaaaagu

SEQ ID NO: 2759376 - RNA, 16 nt, Human
gauguugacucuaaag

SEQ ID NO: 2759377 - RNA, 20 nt, Human
gauguuguguuuuuaacaug

SEQ ID NO: 2759378 - RNA, 14 nt, Human
gauguuucauaaga

SEQ ID NO: 2759379 - RNA, 17 nt, Human
gauuaaugucaauucuu

SEQ ID NO: 2759380 - RNA, 18 nt, Human
gauuacauuuuaaacaca

SEQ ID NO: 2759381 - RNA, 15 nt, Human
gauuaccagggacug

SEQ ID NO: 2759382 - RNA, 13 nt, Human
gauuacugccuau

SEQ ID NO: 2759383 - RNA, 14 nt, Human
gauuacugccuauu

SEQ ID NO: 2759384 - RNA, 20 nt, Human
gauuauauauauuuuuuucu

SEQ ID NO: 2759385 - RNA, 21 nt, Human
gauuauauauauuuuuuucug

SEQ ID NO: 2759386 - RNA, 11 nt, Human
gauuaucaauu

SEQ ID NO: 2759387 - RNA, 21 nt, Human
gauuaugaauuacauuuguau

SEQ ID NO: 2759388 - RNA, 13 nt, Human
gauuauuuucuac

SEQ ID NO: 2759389 - RNA, 21 nt, Human
gauuauuuucuacacauacau

SEQ ID NO: 2759390 - RNA, 14 nt, Human
gauucacccugucc

SEQ ID NO: 2759391 - RNA, 18 nt, Human
gauucauuuuucuuucug

SEQ ID NO: 2759392 - RNA, 14 nt, Human
gauucccagccagc

SEQ ID NO: 2759393 - RNA, 21 nt, Human
gauucucuugccucaaccucc

SEQ ID NO: 2759394 - RNA, 19 nt, Human
gauucuuccaucugauugu

SEQ ID NO: 2759395 - RNA, 14 nt, Human
gauugagaaggagc

SEQ ID NO: 2759396 - RNA, 20 nt, Human
gauugagaaggagcucccag

SEQ ID NO: 2759397 - RNA, 19 nt, Human
gauugauagaguguuauca

SEQ ID NO: 2759398 - RNA, 13 nt, Human
gauuguaaaaugg

SEQ ID NO: 2759399 - RNA, 17 nt, Human
gauugucugaaauuuuc

SEQ ID NO: 2759400 - RNA, 20 nt, Human
gauugugccccugcacucca

SEQ ID NO: 2759401 - RNA, 13 nt, Human
gauuuaaauuauu

SEQ ID NO: 2759402 - RNA, 23 nt, Human
gauuuccacagugacuccacucu

SEQ ID NO: 2759403 - RNA, 18 nt, Human
gauuuccauauaaauauu

SEQ ID NO: 2759404 - RNA, 14 nt, Human
gauuuccccauuua

SEQ ID NO: 2759405 - RNA, 19 nt, Human
gauuuuacaauugaaauga

SEQ ID NO: 2759406 - RNA, 21 nt, Human
gauuuuacacacauuaaaaug

SEQ ID NO: 2759407 - RNA, 16 nt, Human
gauuuuauaugcuauu

SEQ ID NO: 2759408 - RNA, 21 nt, Human
gauuuuauuagaaguuucauc

SEQ ID NO: 2759409 - RNA, 17 nt, Human
gauuuugaaccugauga

SEQ ID NO: 2759410 - RNA, 17 nt, Human
gauuuugcaguucuuug

SEQ ID NO: 2759411 - RNA, 23 nt, Human
gauuuuguuuuuaaacuggaaau

SEQ ID NO: 2759412 - RNA, 19 nt, Human
gauuuuuaaauaaagaauu

SEQ ID NO: 2759413 - RNA, 20 nt, Human
gauuuuugucuuguguuucu

SEQ ID NO: 2759414 - RNA, 15 nt, Human
gcaaaaaaguacuua

SEQ ID NO: 2759415 - RNA, 21 nt, Human
gcaaaauuuuuucucuaggaa

SEQ ID NO: 2759416 - RNA, 21 nt, Human
gcaaacccuuucauaaagucu

SEQ ID NO: 2759417 - RNA, 14 nt, Human
gcaaacguuucuca

SEQ ID NO: 2759418 - RNA, 20 nt, Human
gcaaacuuuauuuuguguuu

SEQ ID NO: 2759419 - RNA, 12 nt, Human
gcaaagaaagga

SEQ ID NO: 2759420 - RNA, 12 nt, Human
gcaaagcccagc

SEQ ID NO: 2759421 - RNA, 14 nt, Human
gcaaagcccagcuu

SEQ ID NO: 2759422 - RNA, 16 nt, Human
gcaaagcccagcuuga

SEQ ID NO: 2759423 - RNA, 18 nt, Human
gcaaagcccagcuugaaa

SEQ ID NO: 2759424 - RNA, 16 nt, Human
gcaaagcucggugcuc

SEQ ID NO: 2759425 - RNA, 20 nt, Human
gcaaauaucuugaaaggggu

SEQ ID NO: 2759426 - RNA, 20 nt, Human
gcaaaucucuauuaggaaau

SEQ ID NO: 2759427 - RNA, 15 nt, Human
gcaaauuccaauaca

SEQ ID NO: 2759428 - RNA, 16 nt, Human
gcaaauuccaauacau

SEQ ID NO: 2759429 - RNA, 16 nt, Human
gcaaauugucacagga

SEQ ID NO: 2759430 - RNA, 17 nt, Human
gcaaauugucacaggac

SEQ ID NO: 2759431 - RNA, 21 nt, Human
gcaaauuuucuuccauuucau

SEQ ID NO: 2759432 - RNA, 12 nt, Human
gcaacaugguga

SEQ ID NO: 2759433 - RNA, 15 nt, Human
gcaacccaaauguuc

SEQ ID NO: 2759434 - RNA, 15 nt, Human
gcaaccuccaccuuc

SEQ ID NO: 2759435 - RNA, 21 nt, Human
gcaacugaggcagacagcagc

SEQ ID NO: 2759436 - RNA, 23 nt, Human
gcaacuuguguuccuaacaggaa

SEQ ID NO: 2759437 - RNA, 14 nt, Human
gcaacuuuguauaa

SEQ ID NO: 2759438 - RNA, 16 nt, Human
gcaacuuuguauaaaa

SEQ ID NO: 2759439 - RNA, 18 nt, Human
gcaagacauagaauagug

SEQ ID NO: 2759440 - RNA, 15 nt, Human
gcaagaccccaucuc

SEQ ID NO: 2759441 - RNA, 18 nt, Human
gcaagacccugaagaccc

SEQ ID NO: 2759442 - RNA, 14 nt, Human
gcaagauaauaaaa

SEQ ID NO: 2759443 - RNA, 17 nt, Human
gcaagcucuaucaccaa

SEQ ID NO: 2759444 - RNA, 18 nt, Human
gcaagcucuaucaccaag

SEQ ID NO: 2759445 - RNA, 16 nt, Human
gcaagcuuuucaaaau

SEQ ID NO: 2759446 - RNA, 14 nt, Human
gcaaguauuagaau

SEQ ID NO: 2759447 - RNA, 13 nt, Human
gcaaguccuuccc

SEQ ID NO: 2759448 - RNA, 22 nt, Human
gcaaguccuucccuuucauuuu

SEQ ID NO: 2759449 - RNA, 12 nt, Human
gcaaguuagaac

SEQ ID NO: 2759450 - RNA, 18 nt, Human
gcaaguuagaacuagcca

SEQ ID NO: 2759451 - RNA, 14 nt, Human
gcaauaaaaugggu

SEQ ID NO: 2759452 - RNA, 23 nt, Human
gcaauaugugauguggcaaaucu

SEQ ID NO: 2759453 - RNA, 16 nt, Human
gcaauccucccacuuc

SEQ ID NO: 2759454 - RNA, 16 nt, Human
gcaaugaccuucaaca

SEQ ID NO: 2759455 - RNA, 19 nt, Human
gcaauguaagacucgggau

SEQ ID NO: 2759456 - RNA, 13 nt, Human
gcaaugugguagu

SEQ ID NO: 2759457 - RNA, 17 nt, Human
gcaauuaauuccuucag

SEQ ID NO: 2759458 - RNA, 23 nt, Human
gcaauuaauuccuucagcacuuu

SEQ ID NO: 2759459 - RNA, 17 nt, Human
gcacacagcacgggggc

SEQ ID NO: 2759460 - RNA, 19 nt, Human
gcacacagcacgggggcca

SEQ ID NO: 2759461 - RNA, 21 nt, Human
gcacacagcacgggggccaag

SEQ ID NO: 2759462 - RNA, 16 nt, Human
gcacacugagccagca

SEQ ID NO: 2759463 - RNA, 18 nt, Human
gcacacugagccagcagc

SEQ ID NO: 2759464 - RNA, 19 nt, Human
gcacacugagccagcagcc

SEQ ID NO: 2759465 - RNA, 21 nt, Human
gcacagaacuuaaggauggag

SEQ ID NO: 2759466 - RNA, 20 nt, Human
gcacaguuuucugagaaaga

SEQ ID NO: 2759467 - RNA, 23 nt, Human
gcacaguuuucugagaaagacua

SEQ ID NO: 2759468 - RNA, 14 nt, Human
gcacauauccaggc

SEQ ID NO: 2759469 - RNA, 16 nt, Human
gcacauauccaggcac

SEQ ID NO: 2759470 - RNA, 21 nt, Human
gcacauauccaggcaccagga

SEQ ID NO: 2759471 - RNA, 13 nt, Human
gcacauuccccuu

SEQ ID NO: 2759472 - RNA, 17 nt, Human
gcaccaaucaugaauua

SEQ ID NO: 2759473 - RNA, 17 nt, Human
gcaccacuguguauuua

SEQ ID NO: 2759474 - RNA, 19 nt, Human
gcaccacuguguauuuaac

SEQ ID NO: 2759475 - RNA, 13 nt, Human
gcaccaggacgcc

SEQ ID NO: 2759476 - RNA, 14 nt, Human
gcaccaggacgccc

SEQ ID NO: 2759477 - RNA, 16 nt, Human
gcaccaggacgcccuc

SEQ ID NO: 2759478 - RNA, 18 nt, Human
gcaccaugcugcugggga

SEQ ID NO: 2759479 - RNA, 16 nt, Human
gcaccaugucaagggu

SEQ ID NO: 2759480 - RNA, 21 nt, Human
gcaccuacuuacaugcauuac

SEQ ID NO: 2759481 - RNA, 19 nt, Human
gcaccugcaggcgugaccu

SEQ ID NO: 2759482 - RNA, 17 nt, Human
gcaccuguaaucccagc

SEQ ID NO: 2759483 - RNA, 17 nt, Human
gcaccugugccgucccc

SEQ ID NO: 2759484 - RNA, 21 nt, Human
gcaccuuuagaauauuaaaaa

SEQ ID NO: 2759485 - RNA, 13 nt, Human
gcacgggccauau

SEQ ID NO: 2759486 - RNA, 17 nt, Human
gcacgggggccaaggau

SEQ ID NO: 2759487 - RNA, 15 nt, Human
gcacuaaucaauacu

SEQ ID NO: 2759488 - RNA, 12 nt, Human
gcacuagaggaa

SEQ ID NO: 2759489 - RNA, 19 nt, Human
gcacuaguauuucuaugaa

SEQ ID NO: 2759490 - RNA, 22 nt, Human
gcacuaguauuucuaugaaaua

SEQ ID NO: 2759491 - RNA, 13 nt, Human
gcacucagauuua

SEQ ID NO: 2759492 - RNA, 14 nt, Human
gcacuccagccuga

SEQ ID NO: 2759493 - RNA, 18 nt, Human
gcacuccagccugagcga

SEQ ID NO: 2759494 - RNA, 13 nt, Human
gcacugugggacu

SEQ ID NO: 2759495 - RNA, 21 nt, Human
gcacuuauuuauuguuguugg

SEQ ID NO: 2759496 - RNA, 20 nt, Human
gcacuuccuugcuuaaggua

SEQ ID NO: 2759497 - RNA, 17 nt, Human
gcacuucuuacaauaau

SEQ ID NO: 2759498 - RNA, 18 nt, Human
gcacuuggguaucuucuu

SEQ ID NO: 2759499 - RNA, 16 nt, Human
gcacuuuaaacauuua

SEQ ID NO: 2759500 - RNA, 13 nt, Human
gcagaacagccgc

SEQ ID NO: 2759501 - RNA, 13 nt, Human
gcagaacagugau

SEQ ID NO: 2759502 - RNA, 14 nt, Human
gcagaacagugauu

SEQ ID NO: 2759503 - RNA, 19 nt, Human
gcagaacagugauuaccag

SEQ ID NO: 2759504 - RNA, 13 nt, Human
gcagaagacagua

SEQ ID NO: 2759505 - RNA, 20 nt, Human
gcagaagacaguauggcagc

SEQ ID NO: 2759506 - RNA, 17 nt, Human
gcagaagcaacccaaau

SEQ ID NO: 2759507 - RNA, 21 nt, Human
gcagaagcaacccaaauguuc

SEQ ID NO: 2759508 - RNA, 14 nt, Human
gcagacucacugug

SEQ ID NO: 2759509 - RNA, 17 nt, Human
gcagacucacuguggga

SEQ ID NO: 2759510 - RNA, 18 nt, Human
gcagacucacugugggaa

SEQ ID NO: 2759511 - RNA, 19 nt, Human
gcagacucacugugggaag

SEQ ID NO: 2759512 - RNA, 20 nt, Human
gcagacucacugugggaagg

SEQ ID NO: 2759513 - RNA, 14 nt, Human
gcagagaaguuuuc

SEQ ID NO: 2759514 - RNA, 22 nt, Human
gcagagagguagggauggggcu

SEQ ID NO: 2759515 - RNA, 13 nt, Human
gcagagccaggac

SEQ ID NO: 2759516 - RNA, 15 nt, Human
gcagagccaggaccc

SEQ ID NO: 2759517 - RNA, 21 nt, Human
gcagagccaggacccaggagg

SEQ ID NO: 2759518 - RNA, 13 nt, Human
gcagagggaucaa

SEQ ID NO: 2759519 - RNA, 16 nt, Human
gcagagggaucaagca

SEQ ID NO: 2759520 - RNA, 21 nt, Human
gcagagguccacaacacacag

SEQ ID NO: 2759521 - RNA, 15 nt, Human
gcagagguugcagug

SEQ ID NO: 2759522 - RNA, 18 nt, Human
gcagagguugcagugagc

SEQ ID NO: 2759523 - RNA, 19 nt, Human
gcagagguugcagugagcc

SEQ ID NO: 2759524 - RNA, 14 nt, Human
gcagaucacuugag

SEQ ID NO: 2759525 - RNA, 22 nt, Human
gcagaugaugcuuugagaacau

SEQ ID NO: 2759526 - RNA, 14 nt, Human
gcagauucucccuu

SEQ ID NO: 2759527 - RNA, 23 nt, Human
gcagauuucuuuccauugugggc

SEQ ID NO: 2759528 - RNA, 13 nt, Human
gcagcaguaguag

SEQ ID NO: 2759529 - RNA, 17 nt, Human
gcagcauuguuggcugu

SEQ ID NO: 2759530 - RNA, 19 nt, Human
gcagcauuguuggcuguuc

SEQ ID NO: 2759531 - RNA, 13 nt, Human
gcagccaccaguc

SEQ ID NO: 2759532 - RNA, 18 nt, Human
gcagccagccaacccuuu

SEQ ID NO: 2759533 - RNA, 22 nt, Human
gcagccaugugauuacccucug

SEQ ID NO: 2759534 - RNA, 23 nt, Human
gcagccaugugauuacccucugg

SEQ ID NO: 2759535 - RNA, 22 nt, Human
gcagcccccauuguggucacag

SEQ ID NO: 2759536 - RNA, 18 nt, Human
gcagcccuuagcccuucc

SEQ ID NO: 2759537 - RNA, 23 nt, Human
gcagccugcagacucacuguggg

SEQ ID NO: 2759538 - RNA, 11 nt, Human
gcagccugccu

SEQ ID NO: 2759539 - RNA, 22 nt, Human
gcagcgaguacuucccgcuguu

SEQ ID NO: 2759540 - RNA, 23 nt, Human
gcagcucaggcacacuucuucuu

SEQ ID NO: 2759541 - RNA, 14 nt, Human
gcagcucaggcugg

SEQ ID NO: 2759542 - RNA, 15 nt, Human
gcagcucuccccuuc

SEQ ID NO: 2759543 - RNA, 15 nt, Human
gcagcucucuuuccu

SEQ ID NO: 2759544 - RNA, 20 nt, Human
gcagcugccuccccuccucu

SEQ ID NO: 2759545 - RNA, 18 nt, Human
gcagcuuccaggcuggcg

SEQ ID NO: 2759546 - RNA, 20 nt, Human
gcagcuuuagccaagugcag

SEQ ID NO: 2759547 - RNA, 22 nt, Human
gcagcuuuagccaagugcaggg

SEQ ID NO: 2759548 - RNA, 14 nt, Human
gcagcuuuccucaa

SEQ ID NO: 2759549 - RNA, 20 nt, Human
gcagcuuuccucaaaacuuc

SEQ ID NO: 2759550 - RNA, 17 nt, Human
gcaggaacaaacagggc

SEQ ID NO: 2759551 - RNA, 15 nt, Human
gcaggaagcugugag

SEQ ID NO: 2759552 - RNA, 17 nt, Human
gcaggaccaucccggcc

SEQ ID NO: 2759553 - RNA, 18 nt, Human
gcaggaggaucacuugag

SEQ ID NO: 2759554 - RNA, 23 nt, Human
gcaggaggaucacuuuaggccug

SEQ ID NO: 2759555 - RNA, 18 nt, Human
gcaggauagagugggaca

SEQ ID NO: 2759556 - RNA, 16 nt, Human
gcaggauuugggcucu

SEQ ID NO: 2759557 - RNA, 22 nt, Human
gcaggauuuuaaucuuuuucua

SEQ ID NO: 2759558 - RNA, 16 nt, Human
gcaggcagaacucauc

SEQ ID NO: 2759559 - RNA, 16 nt, Human
gcaggcagauguuccu

SEQ ID NO: 2759560 - RNA, 13 nt, Human
gcaggcagcagga

SEQ ID NO: 2759561 - RNA, 13 nt, Human
gcaggccagagcu

SEQ ID NO: 2759562 - RNA, 14 nt, Human
gcaggccagagcua

SEQ ID NO: 2759563 - RNA, 13 nt, Human
gcaggcgugaccu

SEQ ID NO: 2759564 - RNA, 17 nt, Human
gcaggcuccccuccucg

SEQ ID NO: 2759565 - RNA, 13 nt, Human
gcaggcuggccua

SEQ ID NO: 2759566 - RNA, 16 nt, Human
gcagggcauggcuggg

SEQ ID NO: 2759567 - RNA, 17 nt, Human
gcagggcauggcuggga

SEQ ID NO: 2759568 - RNA, 22 nt, Human
gcaggggugcugggaccugggg

SEQ ID NO: 2759569 - RNA, 15 nt, Human
gcagggucaggagag

SEQ ID NO: 2759570 - RNA, 18 nt, Human
gcagggugaacugcagcg

SEQ ID NO: 2759571 - RNA, 19 nt, Human
gcaggucacacaaccuguc

SEQ ID NO: 2759572 - RNA, 20 nt, Human
gcaggucccuaauaaagcug

SEQ ID NO: 2759573 - RNA, 15 nt, Human
gcaggucugaagcuc

SEQ ID NO: 2759574 - RNA, 23 nt, Human
gcaguagaaugggggcagcaccu

SEQ ID NO: 2759575 - RNA, 18 nt, Human
gcaguagcagcagcaucu

SEQ ID NO: 2759576 - RNA, 13 nt, Human
gcagucaggaaag

SEQ ID NO: 2759577 - RNA, 13 nt, Human
gcagucagggaca

SEQ ID NO: 2759578 - RNA, 14 nt, Human
gcagucccuccaca

SEQ ID NO: 2759579 - RNA, 15 nt, Human
gcagugagccgagau

SEQ ID NO: 2759580 - RNA, 14 nt, Human
gcagugccuuucuu

SEQ ID NO: 2759581 - RNA, 14 nt, Human
gcagugcuuggccc

SEQ ID NO: 2759582 - RNA, 19 nt, Human
gcagugcuuggcccaggag

SEQ ID NO: 2759583 - RNA, 18 nt, Human
gcagugucugcuggagac

SEQ ID NO: 2759584 - RNA, 16 nt, Human
gcaguguucccugggg

SEQ ID NO: 2759585 - RNA, 12 nt, Human
gcaguucagagc

SEQ ID NO: 2759586 - RNA, 13 nt, Human
gcaguucagagcu

SEQ ID NO: 2759587 - RNA, 14 nt, Human
gcaguucagagcug

SEQ ID NO: 2759588 - RNA, 15 nt, Human
gcaguucagagcugc

SEQ ID NO: 2759589 - RNA, 12 nt, Human
gcaguugaaaag

SEQ ID NO: 2759590 - RNA, 16 nt, Human
gcaguugaaaagacuc

SEQ ID NO: 2759591 - RNA, 22 nt, Human
gcaguuugguuucuagcaugaa

SEQ ID NO: 2759592 - RNA, 20 nt, Human
gcauaaauuauuguuuuucu

SEQ ID NO: 2759593 - RNA, 21 nt, Human
gcauaaauuauuguuuuucuu

SEQ ID NO: 2759594 - RNA, 22 nt, Human
gcauaauacuugcuuuggaaaa

SEQ ID NO: 2759595 - RNA, 13 nt, Human
gcauacaguaauu

SEQ ID NO: 2759596 - RNA, 22 nt, Human
gcauacucauuaggauggcuag

SEQ ID NO: 2759597 - RNA, 17 nt, Human
gcauagaaguaaaaaca

SEQ ID NO: 2759598 - RNA, 18 nt, Human
gcauagguuuaauaauuu

SEQ ID NO: 2759599 - RNA, 18 nt, Human
gcauauacuuuaauaaau

SEQ ID NO: 2759600 - RNA, 21 nt, Human
gcauauugauaauaaaauuca

SEQ ID NO: 2759601 - RNA, 21 nt, Human
gcaucacaugaacuuguaaag

SEQ ID NO: 2759602 - RNA, 14 nt, Human
gcaucaucucagcu

SEQ ID NO: 2759603 - RNA, 16 nt, Human
gcaucccuagaaagcc

SEQ ID NO: 2759604 - RNA, 16 nt, Human
gcauccuagucucuau

SEQ ID NO: 2759605 - RNA, 21 nt, Human
gcaucgugucuggcguugugg

SEQ ID NO: 2759606 - RNA, 19 nt, Human
gcaucuagaggcuuccuuc

SEQ ID NO: 2759607 - RNA, 20 nt, Human
gcaucuagaggcuuccuuca

SEQ ID NO: 2759608 - RNA, 20 nt, Human
gcaucucacagguagacagu

SEQ ID NO: 2759609 - RNA, 18 nt, Human
gcaucuccucaacucuga

SEQ ID NO: 2759610 - RNA, 16 nt, Human
gcaucucugaacauuu

SEQ ID NO: 2759611 - RNA, 16 nt, Human
gcaugaagacagagcc

SEQ ID NO: 2759612 - RNA, 22 nt, Human
gcaugcggcccaggauggcuuu

SEQ ID NO: 2759613 - RNA, 18 nt, Human
gcauggaaggcaagauug

SEQ ID NO: 2759614 - RNA, 18 nt, Human
gcauggccacaucugagc

SEQ ID NO: 2759615 - RNA, 19 nt, Human
gcauggccacaucugagcc

SEQ ID NO: 2759616 - RNA, 14 nt, Human
gcaugggaagugac

SEQ ID NO: 2759617 - RNA, 19 nt, Human
gcaugggccuagcccacug

SEQ ID NO: 2759618 - RNA, 11 nt, Human
gcaugguuuag

SEQ ID NO: 2759619 - RNA, 16 nt, Human
gcauguucuaaauaaa

SEQ ID NO: 2759620 - RNA, 13 nt, Human
gcauuacugcaug

SEQ ID NO: 2759621 - RNA, 17 nt, Human
gcauuacugcaugcacu

SEQ ID NO: 2759622 - RNA, 15 nt, Human
gcauuauaaauaaau

SEQ ID NO: 2759623 - RNA, 20 nt, Human
gcauuauccaucuuucacua

SEQ ID NO: 2759624 - RNA, 14 nt, Human
gcauuccaacuauc

SEQ ID NO: 2759625 - RNA, 11 nt, Human
gcauuguccuc

SEQ ID NO: 2759626 - RNA, 12 nt, Human
gcauuguccucu

SEQ ID NO: 2759627 - RNA, 18 nt, Human
gcauuguuggcuguuccu

SEQ ID NO: 2759628 - RNA, 14 nt, Human
gcauuuaauaugga

SEQ ID NO: 2759629 - RNA, 14 nt, Human
gcauuuaauuuauu

SEQ ID NO: 2759630 - RNA, 19 nt, Human
gcauuuaggccaugggaca

SEQ ID NO: 2759631 - RNA, 18 nt, Human
gcauuuaugagcucuuca

SEQ ID NO: 2759632 - RNA, 21 nt, Human
gcauuuaugagcucuucaugu

SEQ ID NO: 2759633 - RNA, 17 nt, Human
gccaaaaguauccaagg

SEQ ID NO: 2759634 - RNA, 15 nt, Human
gccaaacauccuaca

SEQ ID NO: 2759635 - RNA, 15 nt, Human
gccaaagaacuugga

SEQ ID NO: 2759636 - RNA, 21 nt, Human
gccaaauauaaauaaaaauaa

SEQ ID NO: 2759637 - RNA, 22 nt, Human
gccaaauauaaauaaaaauaau

SEQ ID NO: 2759638 - RNA, 11 nt, Human
gccaaaucaaa

SEQ ID NO: 2759639 - RNA, 17 nt, Human
gccaaaucaaaagacuu

SEQ ID NO: 2759640 - RNA, 15 nt, Human
gccaaccugggggcu

SEQ ID NO: 2759641 - RNA, 15 nt, Human
gccaacuauggccug

SEQ ID NO: 2759642 - RNA, 14 nt, Human
gaaaaaugcauguu

SEQ ID NO: 2759643 - RNA, 15 nt, Human
gaaaacaaggaugaa

SEQ ID NO: 2759644 - RNA, 14 nt, Human
gaaaacaauaacga

SEQ ID NO: 2759645 - RNA, 17 nt, Human
gaaaacaauaacgauaa

SEQ ID NO: 2759646 - RNA, 23 nt, Human
gaaaacaauaacgauaaaagaca

SEQ ID NO: 2759647 - RNA, 20 nt, Human
gaaaacccagauaaagguuc

SEQ ID NO: 2759648 - RNA, 21 nt, Human
gaaaacccuugccaugugcua

SEQ ID NO: 2759649 - RNA, 12 nt, Human
gaaaagaaaaag

SEQ ID NO: 2759650 - RNA, 20 nt, Human
gaaaaguuauguagaaaaaa

SEQ ID NO: 2759651 - RNA, 15 nt, Human
gaaaaguuucccagu

SEQ ID NO: 2759652 - RNA, 16 nt, Human
gaaaauaaaucuauca

SEQ ID NO: 2759653 - RNA, 12 nt, Human
gaaaauaacaau

SEQ ID NO: 2759654 - RNA, 17 nt, Human
gaaaauaacaauaaaag

SEQ ID NO: 2759655 - RNA, 18 nt, Human
gaaaauaacaauaaaaga

SEQ ID NO: 2759656 - RNA, 16 nt, Human
gaaaauaacgauaaaa

SEQ ID NO: 2759657 - RNA, 17 nt, Human
gaaaauaacgauaaaag

SEQ ID NO: 2759658 - RNA, 18 nt, Human
gaaaauaacgauaaaaga

SEQ ID NO: 2759659 - RNA, 19 nt, Human
gaaaauaacgauaaaagac

SEQ ID NO: 2759660 - RNA, 16 nt, Human
gaaaauacuauucuga

SEQ ID NO: 2759661 - RNA, 18 nt, Human
gaaaauaucacuugucaa

SEQ ID NO: 2759662 - RNA, 13 nt, Human
gaaaauaugccug

SEQ ID NO: 2759663 - RNA, 23 nt, Human
gaaaaucuuauaauuuaaaauau

SEQ ID NO: 2759664 - RNA, 22 nt, Human
gaaaaugaauaucuauuaauau

SEQ ID NO: 2759665 - RNA, 16 nt, Human
gaaaaugaaucccucu

SEQ ID NO: 2759666 - RNA, 15 nt, Human
gaaaauggacaucaa

SEQ ID NO: 2759667 - RNA, 23 nt, Human
gaaaaugucauuguucuugugaa

SEQ ID NO: 2759668 - RNA, 22 nt, Human
gaaaauguguauuuuauuacau

SEQ ID NO: 2759669 - RNA, 19 nt, Human
gaaaauguucccuucaagu

SEQ ID NO: 2759670 - RNA, 17 nt, Human
gaaacaaaaaucaaacu

SEQ ID NO: 2759671 - RNA, 18 nt, Human
gaaacaaaaggauaauga

SEQ ID NO: 2759672 - RNA, 14 nt, Human
gaaacaacaaauag

SEQ ID NO: 2759673 - RNA, 20 nt, Human
gaaacaagucagucauucag

SEQ ID NO: 2759674 - RNA, 14 nt, Human
gaaacacaacuaua

SEQ ID NO: 2759675 - RNA, 14 nt, Human
gaaacauuacaguu

SEQ ID NO: 2759676 - RNA, 16 nt, Human
gaaacauuugguaagg

SEQ ID NO: 2759677 - RNA, 14 nt, Human
gaaacccugucucu

SEQ ID NO: 2759678 - RNA, 14 nt, Human
gaaacgaagcacca

SEQ ID NO: 2759679 - RNA, 20 nt, Human
gaaacgaggauugggaaaaa

SEQ ID NO: 2759680 - RNA, 16 nt, Human
gaaacuaggugcauau

SEQ ID NO: 2759681 - RNA, 16 nt, Human
gaaacugacacaugcu

SEQ ID NO: 2759682 - RNA, 18 nt, Human
gaaacugccagcaacgca

SEQ ID NO: 2759683 - RNA, 20 nt, Human
gaaacugcccacucugcaag

SEQ ID NO: 2759684 - RNA, 15 nt, Human
gaaagaaaacuugua

SEQ ID NO: 2759685 - RNA, 15 nt, Human
gaaagaaaauaacga

SEQ ID NO: 2759686 - RNA, 17 nt, Human
gaaagaaaauaacgaua

SEQ ID NO: 2759687 - RNA, 18 nt, Human
gaaagaaaauaacgauaa

SEQ ID NO: 2759688 - RNA, 16 nt, Human
gaaagaacacgcucuc

SEQ ID NO: 2759689 - RNA, 14 nt, Human
gaaagaagagccgg

SEQ ID NO: 2759690 - RNA, 19 nt, Human
gaaagaugugaauaggcug

SEQ ID NO: 2759691 - RNA, 22 nt, Human
gaaagauuacuuuuucuuuaug

SEQ ID NO: 2759692 - RNA, 14 nt, Human
gaaagcagaacagu

SEQ ID NO: 2759693 - RNA, 15 nt, Human
gaaagcagccuggcc

SEQ ID NO: 2759694 - RNA, 21 nt, Human
gaaagcagggacuugaaccca

SEQ ID NO: 2759695 - RNA, 20 nt, Human
gaaagcaucauuauuugcag

SEQ ID NO: 2759696 - RNA, 22 nt, Human
gaaagcaucauuauuugcagag

SEQ ID NO: 2759697 - RNA, 20 nt, Human
gaaagcauuugaaugcauuu

SEQ ID NO: 2759698 - RNA, 17 nt, Human
gaaagccaugugcagcc

SEQ ID NO: 2759699 - RNA, 18 nt, Human
gaaaggccagcaaauucg

SEQ ID NO: 2759700 - RNA, 17 nt, Human
gaaaggccuuuaaaauu

SEQ ID NO: 2759701 - RNA, 21 nt, Human
gaaagggauuuucagcccuca

SEQ ID NO: 2759702 - RNA, 23 nt, Human
gaaagggauuuucagcccucaga

SEQ ID NO: 2759703 - RNA, 15 nt, Human
gaaagugaaguaggc

SEQ ID NO: 2759704 - RNA, 14 nt, Human
gaaaguuuucucca

SEQ ID NO: 2759705 - RNA, 19 nt, Human
gaaauaaaaguagaauaaa

SEQ ID NO: 2759706 - RNA, 22 nt, Human
gaaauaagccagacaucaacag

SEQ ID NO: 2759707 - RNA, 21 nt, Human
gaaauagcccuguaacaggcu

SEQ ID NO: 2759708 - RNA, 15 nt, Human
gaaauaguucaaagc

SEQ ID NO: 2759709 - RNA, 17 nt, Human
gaaauauuuauuuuaau

SEQ ID NO: 2759710 - RNA, 23 nt, Human
gaaauauuuucuuuguuaaaaua

SEQ ID NO: 2759711 - RNA, 20 nt, Human
gaaaucaaauaugcaaagca

SEQ ID NO: 2759712 - RNA, 20 nt, Human
gaaaucaggguuaguauugu

SEQ ID NO: 2759713 - RNA, 16 nt, Human
gaaaucaugaagauau

SEQ ID NO: 2759714 - RNA, 18 nt, Human
gaaaucaugaagauauuu

SEQ ID NO: 2759715 - RNA, 14 nt, Human
gaaaugaaagcagg

SEQ ID NO: 2759716 - RNA, 21 nt, Human
gaaaugaguuuuucuuuucau

SEQ ID NO: 2759717 - RNA, 18 nt, Human
gaaauggacacagucuaa

SEQ ID NO: 2759718 - RNA, 18 nt, Human
gaaauggugaaaugcaga

SEQ ID NO: 2759719 - RNA, 24 nt, Human
gaaauguaagggaaacugccagca

SEQ ID NO: 2759720 - RNA, 21 nt, Human
gaaauguuuacagauccccaa

SEQ ID NO: 2759721 - RNA, 23 nt, Human
gaaauugaaaaugguauuaaaga

SEQ ID NO: 2759722 - RNA, 22 nt, Human
gaaauugagcuggaccucacca

SEQ ID NO: 2759723 - RNA, 21 nt, Human
gaaauugauuuugaaccugau

SEQ ID NO: 2759724 - RNA, 22 nt, Human
gaaauuguaacuaaaguuagaa

SEQ ID NO: 2759725 - RNA, 15 nt, Human
gaaauuguauuacaa

SEQ ID NO: 2759726 - RNA, 18 nt, Human
gaaauuguauuacaaauc

SEQ ID NO: 2759727 - RNA, 13 nt, Human
gaaauuuauaaac

SEQ ID NO: 2759728 - RNA, 14 nt, Human
gaacaaacagggcu

SEQ ID NO: 2759729 - RNA, 23 nt, Human
gaacaaaguuuaccagaaagcag

SEQ ID NO: 2759730 - RNA, 13 nt, Human
cuccagccucagc

SEQ ID NO: 2759731 - RNA, 15 nt, Human
cuccagccucagccu

SEQ ID NO: 2759732 - RNA, 17 nt, Human
cuccagccucagccucc

SEQ ID NO: 2759733 - RNA, 18 nt, Human
cuccagccucagccuccc

SEQ ID NO: 2759734 - RNA, 20 nt, Human
cuccagccucagccucccaa

SEQ ID NO: 2759735 - RNA, 18 nt, Human
aucauuucaaaacucauu

SEQ ID NO: 2759736 - RNA, 12 nt, Human
aucauuuccauu

SEQ ID NO: 2759737 - RNA, 20 nt, Human
aucauuucugcaucagcugc

SEQ ID NO: 2759738 - RNA, 13 nt, Human
auccaaagcugaa

SEQ ID NO: 2759739 - RNA, 19 nt, Human
auccaaagcugaauacauu

SEQ ID NO: 2759740 - RNA, 21 nt, Human
auccaacuuauauuucugcuu

SEQ ID NO: 2759741 - RNA, 11 nt, Human
auccaaugaaa

SEQ ID NO: 2759742 - RNA, 16 nt, Human
auccaaugaaaugagu

SEQ ID NO: 2759743 - RNA, 16 nt, Human
auccacccgccucagc

SEQ ID NO: 2759744 - RNA, 16 nt, Human
auccaccugccuuggc

SEQ ID NO: 2759745 - RNA, 19 nt, Human
auccacguccugucuguuu

SEQ ID NO: 2759746 - RNA, 22 nt, Human
auccacuuuaucuugaauaaug

SEQ ID NO: 2759747 - RNA, 14 nt, Human
auccacuuuccaau

SEQ ID NO: 2759748 - RNA, 12 nt, Human
auccagaaagaa

SEQ ID NO: 2759749 - RNA, 20 nt, Human
auccagaaagaaaacuugua

SEQ ID NO: 2759750 - RNA, 14 nt, Human
auccagaaauaaug

SEQ ID NO: 2759751 - RNA, 17 nt, Human
auccaggcaccaggacu

SEQ ID NO: 2759752 - RNA, 13 nt, Human
auccaucuuucac

SEQ ID NO: 2759753 - RNA, 13 nt, Human
auccauucuuccc

SEQ ID NO: 2759754 - RNA, 17 nt, Human
auccauucuucccuuga

SEQ ID NO: 2759755 - RNA, 18 nt, Human
auccauucuucccuugau

SEQ ID NO: 2759756 - RNA, 22 nt, Human
aucccagcuacuugggaggcug

SEQ ID NO: 2759757 - RNA, 15 nt, Human
aucccauagccagga

SEQ ID NO: 2759758 - RNA, 18 nt, Human
auccccaagccuggcaag

SEQ ID NO: 2759759 - RNA, 21 nt, Human
cuuugaaaaaguauaaauaaa

SEQ ID NO: 2759760 - RNA, 20 nt, Human
cuuugaaugcggcccaacgc

SEQ ID NO: 2759761 - RNA, 19 nt, Human
cuuugacaaagguaaauca

SEQ ID NO: 2759762 - RNA, 20 nt, Human
cuuugacaaccaugagacca

SEQ ID NO: 2759763 - RNA, 18 nt, Human
cuuugagcgcccacuaga

SEQ ID NO: 2759764 - RNA, 22 nt, Human
cuuugagugucuuaauuaaaag

SEQ ID NO: 2759765 - RNA, 15 nt, Human
cuuugaugauuaauu

SEQ ID NO: 2759766 - RNA, 20 nt, Human
cuuugcccugcugcccuccc

SEQ ID NO: 2759767 - RNA, 23 nt, Human
cuuugcccugcugcccucccccu

SEQ ID NO: 2759768 - RNA, 17 nt, Human
cuuugcuucauucaagu

SEQ ID NO: 2759769 - RNA, 18 nt, Human
cuuugcuucauucaaguc

SEQ ID NO: 2759770 - RNA, 18 nt, Human
cuuuggagauuuuuuaau

SEQ ID NO: 2759771 - RNA, 13 nt, Human
cuuuggcagaguu

SEQ ID NO: 2759772 - RNA, 17 nt, Human
cuuugggaggcugaggc

SEQ ID NO: 2759773 - RNA, 13 nt, Human
cuuuguauaaaag

SEQ ID NO: 2759774 - RNA, 22 nt, Human
cuuugugcagauucuuuacccc

SEQ ID NO: 2759775 - RNA, 12 nt, Human
cuuuuaaaaaaa

SEQ ID NO: 2759776 - RNA, 14 nt, Human
cuuuuaaaauccac

SEQ ID NO: 2759777 - RNA, 14 nt, Human
cuuuuaaagaaaca

SEQ ID NO: 2759778 - RNA, 21 nt, Human
cuuuuaaguugcugaugaacu

SEQ ID NO: 2759779 - RNA, 20 nt, Human
cuuuuacuuuucuucuauug

SEQ ID NO: 2759780 - RNA, 17 nt, Human
cuuuuaggacccuuccc

SEQ ID NO: 2759781 - RNA, 20 nt, Human
cuuuuaggacccuucccuug

SEQ ID NO: 2759782 - RNA, 14 nt, Human
cuuuuaguuuuuaa

SEQ ID NO: 2759783 - RNA, 18 nt, Human
cuuuuaugauacuugaaa

SEQ ID NO: 2759784 - RNA, 18 nt, Human
cuuuuaugugaaacaugu

SEQ ID NO: 2759785 - RNA, 21 nt, Human
cuuuuauguuaaugcucugga

SEQ ID NO: 2759786 - RNA, 11 nt, Human
cuuuucccaac

SEQ ID NO: 2759787 - RNA, 18 nt, Human
cuuuucccaacuccagaa

SEQ ID NO: 2759788 - RNA, 12 nt, Human
cuuuuccuucug

SEQ ID NO: 2759789 - RNA, 22 nt, Human
cuuuuccuucugagccugccuu

SEQ ID NO: 2759790 - RNA, 14 nt, Human
cuuuuccuuugaau

SEQ ID NO: 2759791 - RNA, 19 nt, Human
cuuuucuucuauugccucu

SEQ ID NO: 2759792 - RNA, 20 nt, Human
cuuuugcugccucuaaaagg

SEQ ID NO: 2759793 - RNA, 15 nt, Human
cuuuuggcuccaccc

SEQ ID NO: 2759794 - RNA, 21 nt, Human
cuuuuguagaagucacauucc

SEQ ID NO: 2759795 - RNA, 14 nt, Human
cuuuuuaaugagau

SEQ ID NO: 2759796 - RNA, 15 nt, Human
cuuuuuaauguguau

SEQ ID NO: 2759797 - RNA, 22 nt, Human
cuuuuuaauuucugcaaaugua

SEQ ID NO: 2759798 - RNA, 15 nt, Human
cuuuuuccuuccagu

SEQ ID NO: 2759799 - RNA, 18 nt, Human
cuuuuuuaaaugaagaaa

SEQ ID NO: 2759800 - RNA, 22 nt, Human
cuuuuuuaucaugugaaaucau

SEQ ID NO: 2759801 - RNA, 15 nt, Human
cuuuuuuugaaucau

SEQ ID NO: 2759802 - RNA, 23 nt, Human
cuuuuuuuuauacgauaaauaac

SEQ ID NO: 2759803 - RNA, 20 nt, Human
cuuuuuuuuuuuauaaucaa

SEQ ID NO: 2759804 - RNA, 17 nt, Human
cuuuuuuuuuuuuucuu

SEQ ID NO: 2759805 - RNA, 19 nt, Human
cuuuuuuuuuuuuuuaaac

SEQ ID NO: 2759806 - RNA, 14 nt, Human
gaaaaaaagcuuuu

SEQ ID NO: 2759807 - RNA, 20 nt, Human
gaaaaaaagcuuuuuuugaa

SEQ ID NO: 2759808 - RNA, 21 nt, Human
gaaaaaaagcuuuuuuugaau

SEQ ID NO: 2759809 - RNA, 13 nt, Human
gaaaaaaguaaau

SEQ ID NO: 2759810 - RNA, 16 nt, Human
gaaaaaauaacaauga

SEQ ID NO: 2759811 - RNA, 23 nt, Human
gaaaaaguucugcagauaaacag

SEQ ID NO: 2759812 - RNA, 18 nt, Human
cugauaugggucuugaua

SEQ ID NO: 2759813 - RNA, 21 nt, Human
cugauaugggucuugauaaau

SEQ ID NO: 2759814 - RNA, 22 nt, Human
cugauaugggucuugauaaaug

SEQ ID NO: 2759815 - RNA, 16 nt, Human
cugaucaccugcccug

SEQ ID NO: 2759816 - RNA, 17 nt, Human
cugaucaccugcccugc

SEQ ID NO: 2759817 - RNA, 20 nt, Human
cugaucaccugcccugcuga

SEQ ID NO: 2759818 - RNA, 17 nt, Human
cugaugaauguuaaauu

SEQ ID NO: 2759819 - RNA, 19 nt, Human
cugaugagaacucugagca

SEQ ID NO: 2759820 - RNA, 12 nt, Human
cugaugcaguug

SEQ ID NO: 2759821 - RNA, 16 nt, Human
cugauggguuucucca

SEQ ID NO: 2759822 - RNA, 17 nt, Human
cugauggguuucuccag

SEQ ID NO: 2759823 - RNA, 20 nt, Human
cugauguuguguuuuuaaca

SEQ ID NO: 2759824 - RNA, 16 nt, Human
cugauuauuuucuaca

SEQ ID NO: 2759825 - RNA, 12 nt, Human
cugauuuuccug

SEQ ID NO: 2759826 - RNA, 22 nt, Human
cugauuuuuaaguuauuuuuac

SEQ ID NO: 2759827 - RNA, 23 nt, Human
cugauuuuuaaguuauuuuuaca

SEQ ID NO: 2759828 - RNA, 15 nt, Human
cugcaaacugccuuc

SEQ ID NO: 2759829 - RNA, 16 nt, Human
cugcaaacugccuucu

SEQ ID NO: 2759830 - RNA, 22 nt, Human
cugcaaacugccuucuucggaa

SEQ ID NO: 2759831 - RNA, 19 nt, Human
cugcaaagcccagcuugaa

SEQ ID NO: 2759832 - RNA, 12 nt, Human
cugcaaauguaa

SEQ ID NO: 2759833 - RNA, 22 nt, Human
cugcaaauguaauugauuuauu

SEQ ID NO: 2759834 - RNA, 16 nt, Human
cugcaaccuccaccuc

SEQ ID NO: 2759835 - RNA, 17 nt, Human
cugcaaccucugccucc

SEQ ID NO: 2759836 - RNA, 19 nt, Human
cugcaaccucugccuccca

SEQ ID NO: 2759837 - RNA, 18 nt, Human
cugcaauaaaauggguuu

SEQ ID NO: 2759838 - RNA, 23 nt, Human
cugcaauaaaauggguuuuacug

SEQ ID NO: 2759839 - RNA, 23 nt, Human
cugcaaucugagccagugcuuua

SEQ ID NO: 2759840 - RNA, 12 nt, Human
cugcaccaugcu

SEQ ID NO: 2759841 - RNA, 22 nt, Human
cugcacccauuagcagucccuc

SEQ ID NO: 2759842 - RNA, 23 nt, Human
cugcacgaauggaagaggcaccu

SEQ ID NO: 2759843 - RNA, 16 nt, Human
cugcacuccagccuga

SEQ ID NO: 2759844 - RNA, 17 nt, Human
cugcacuccagccugag

SEQ ID NO: 2759845 - RNA, 20 nt, Human
cugcacuccagccugagcga

SEQ ID NO: 2759846 - RNA, 22 nt, Human
cugcacuguaaaaugugggauu

SEQ ID NO: 2759847 - RNA, 12 nt, Human
cugcacugucaa

SEQ ID NO: 2759848 - RNA, 18 nt, Human
cugcacugucaagaugau

SEQ ID NO: 2759849 - RNA, 11 nt, Human
cugcagcucaa

SEQ ID NO: 2759850 - RNA, 11 nt, Human
cugcagcuucc

SEQ ID NO: 2759851 - RNA, 20 nt, Human
cugcaggcagccugccuuua

SEQ ID NO: 2759852 - RNA, 17 nt, Human
cugcaggcgugaccuga

SEQ ID NO: 2759853 - RNA, 15 nt, Human
cugcaggcuccccuc

SEQ ID NO: 2759854 - RNA, 14 nt, Human
cugcaggucccuaa

SEQ ID NO: 2759855 - RNA, 23 nt, Human
cugcaggucccuaauaaagcugu

SEQ ID NO: 2759856 - RNA, 13 nt, Human
cugcauaaaugug

SEQ ID NO: 2759857 - RNA, 13 nt, Human
cugcauacucauu

SEQ ID NO: 2759858 - RNA, 17 nt, Human
cugcauauguuucgcug

SEQ ID NO: 2759859 - RNA, 21 nt, Human
cugcaugcacuucuuacaaua

SEQ ID NO: 2759860 - RNA, 18 nt, Human
cugcauguucuaaauaaa

SEQ ID NO: 2759861 - RNA, 19 nt, Human
cugccaaaacaucaaccug

SEQ ID NO: 2759862 - RNA, 22 nt, Human
cugccaaaacaucaaccugcca

SEQ ID NO: 2759863 - RNA, 16 nt, Human
cugccacaccucucca

SEQ ID NO: 2759864 - RNA, 19 nt, Human
cugccagaaucuagagcaa

SEQ ID NO: 2759865 - RNA, 18 nt, Human
cugccagccagcagccag

SEQ ID NO: 2759866 - RNA, 14 nt, Human
cugccagcuggccu

SEQ ID NO: 2759867 - RNA, 15 nt, Human
cugccagcuggccuu

SEQ ID NO: 2759868 - RNA, 17 nt, Human
cugccaggcacacugag

SEQ ID NO: 2759869 - RNA, 13 nt, Human
cugccauauauuu

SEQ ID NO: 2759870 - RNA, 16 nt, Human
cugccaucuuggacuu

SEQ ID NO: 2759871 - RNA, 14 nt, Human
cugcccauccugcc

SEQ ID NO: 2759872 - RNA, 16 nt, Human
cugccccccagcccuc

SEQ ID NO: 2759873 - RNA, 16 nt, Human
cugccccggggagggg

SEQ ID NO: 2759874 - RNA, 20 nt, Human
cugccccggggaggggcgcu

SEQ ID NO: 2759875 - RNA, 17 nt, Human
cugcccgccucgaccuc

SEQ ID NO: 2759876 - RNA, 16 nt, Human
cugcccuagagcacac

SEQ ID NO: 2759877 - RNA, 17 nt, Human
cugcccucccccuccuc

SEQ ID NO: 2759878 - RNA, 18 nt, Human
cugcccucccccuccucu

SEQ ID NO: 2759879 - RNA, 15 nt, Human
cugcccucuccuggg

SEQ ID NO: 2759880 - RNA, 17 nt, Human
cugcccucuccugggca

SEQ ID NO: 2759881 - RNA, 19 nt, Human
cugcccucuccugggcagc

SEQ ID NO: 2759882 - RNA, 22 nt, Human
cugcccucuccugggcagcugc

SEQ ID NO: 2759883 - RNA, 23 nt, Human
cugcccucuccugggcagcugcc

SEQ ID NO: 2759884 - RNA, 12 nt, Human
cugcccuucccc

SEQ ID NO: 2759885 - RNA, 18 nt, Human
cugcccuuccccuuccca

SEQ ID NO: 2759886 - RNA, 16 nt, Human
cugcccuuccugcagg

SEQ ID NO: 2759887 - RNA, 17 nt, Human
cugccggcacagaacuu

SEQ ID NO: 2759888 - RNA, 15 nt, Human
cugccgugggccuga

SEQ ID NO: 2759889 - RNA, 14 nt, Human
cugccuaagcccuc

SEQ ID NO: 2759890 - RNA, 18 nt, Human
cugccuaagugcagcccc

SEQ ID NO: 2759891 - RNA, 14 nt, Human
cugccuauauuuuu

SEQ ID NO: 2759892 - RNA, 17 nt, Human
cugccucagaaaacaag

SEQ ID NO: 2759893 - RNA, 14 nt, Human
cugccucagccucc

SEQ ID NO: 2759894 - RNA, 17 nt, Human
cugccucagccucccga

SEQ ID NO: 2759895 - RNA, 13 nt, Human
cugccuccccagc

SEQ ID NO: 2759896 - RNA, 22 nt, Human
cugccuccccagcucuauccca

SEQ ID NO: 2759897 - RNA, 16 nt, Human
cugccuccccuccucu

SEQ ID NO: 2759898 - RNA, 15 nt, Human
cugccuccccugccu

SEQ ID NO: 2759899 - RNA, 13 nt, Human
cugccuccccuuc

SEQ ID NO: 2759900 - RNA, 14 nt, Human
cugccucccucucg

SEQ ID NO: 2759901 - RNA, 18 nt, Human
cugccucuaaaaggccug

SEQ ID NO: 2759902 - RNA, 23 nt, Human
cugccucucucauccacuuucca

SEQ ID NO: 2759903 - RNA, 23 nt, Human
cugccucucugcaggucccuaau

SEQ ID NO: 2759904 - RNA, 13 nt, Human
cugccucuuaaau

SEQ ID NO: 2759905 - RNA, 15 nt, Human
cugccuucuggccuu

SEQ ID NO: 2759906 - RNA, 18 nt, Human
cugccuuuauuguguuug

SEQ ID NO: 2759907 - RNA, 15 nt, Human
cugccuuucuccccc

SEQ ID NO: 2759908 - RNA, 17 nt, Human
cugccuuuggcagaguu

SEQ ID NO: 2759909 - RNA, 14 nt, Human
cugccuuuggcuuu

SEQ ID NO: 2759910 - RNA, 13 nt, Human
cugcgcgccgcgc

SEQ ID NO: 2759911 - RNA, 19 nt, Human
cugcgcgccgcgcuccucg

SEQ ID NO: 2759912 - RNA, 13 nt, Human
cugcuacuaucug

SEQ ID NO: 2759913 - RNA, 15 nt, Human
cugcuacuaucuguu

SEQ ID NO: 2759914 - RNA, 19 nt, Human
cugcuagagugacucacua

SEQ ID NO: 2759915 - RNA, 22 nt, Human
cugcuagaguucugucuggacu

SEQ ID NO: 2759916 - RNA, 14 nt, Human
cugcuauucuccau

SEQ ID NO: 2759917 - RNA, 18 nt, Human
cugcucaauaaaguacaa

SEQ ID NO: 2759918 - RNA, 21 nt, Human
cugcucaauaaaguacaagag

SEQ ID NO: 2759919 - RNA, 22 nt, Human
cugcucaauaaaguacaagagc

SEQ ID NO: 2759920 - RNA, 21 nt, Human
cugcucagcccugcaccaugc

SEQ ID NO: 2759921 - RNA, 13 nt, Human
cugcucagggcug

SEQ ID NO: 2759922 - RNA, 14 nt, Human
cugcucauaugaug

SEQ ID NO: 2759923 - RNA, 13 nt, Human
cugcucccuagcc

SEQ ID NO: 2759924 - RNA, 19 nt, Human
cugcucccuagccagaggc

SEQ ID NO: 2759925 - RNA, 21 nt, Human
cugcucccuagccagaggcuc

SEQ ID NO: 2759926 - RNA, 20 nt, Human
cugcucgcccacuuccuccc

SEQ ID NO: 2759927 - RNA, 22 nt, Human
cugcucgcccacuuccucccgg

SEQ ID NO: 2759928 - RNA, 16 nt, Human
cugcucucaguucacu

SEQ ID NO: 2759929 - RNA, 11 nt, Human
cugcucucucc

SEQ ID NO: 2759930 - RNA, 17 nt, Human
cugcucucuccgagggg

SEQ ID NO: 2759931 - RNA, 14 nt, Human
cugcucugucuucu

SEQ ID NO: 2759932 - RNA, 17 nt, Human
cugcugaaacaacaaau

SEQ ID NO: 2759933 - RNA, 20 nt, Human
cugcugacacagacauccuc

SEQ ID NO: 2759934 - RNA, 22 nt, Human
cugcugagccccaaguggaacg

SEQ ID NO: 2759935 - RNA, 14 nt, Human
cugcugagucccag

SEQ ID NO: 2759936 - RNA, 22 nt, Human
cugcugagucccaggcugagcc

SEQ ID NO: 2759937 - RNA, 24 nt, Human
cugcugagucccaggcugagccuc

SEQ ID NO: 2759938 - RNA, 17 nt, Human
cugcugagugcaccacu

SEQ ID NO: 2759939 - RNA, 14 nt, Human
cugcugcccucccc

SEQ ID NO: 2759940 - RNA, 20 nt, Human
cugcugcccuuccccuuccc

SEQ ID NO: 2759941 - RNA, 13 nt, Human
cugcugcugugca

SEQ ID NO: 2759942 - RNA, 19 nt, Human
cugcuggauguggaggggg

SEQ ID NO: 2759943 - RNA, 16 nt, Human
cugcuggauucaagug

SEQ ID NO: 2759944 - RNA, 21 nt, Human
cugcuggcaguggaacuaaga

SEQ ID NO: 2759945 - RNA, 14 nt, Human
cugcuggggaagac

SEQ ID NO: 2759946 - RNA, 19 nt, Human
cugcuggggaagacagugg

SEQ ID NO: 2759947 - RNA, 21 nt, Human
cugcuggggaagacaguggcc

SEQ ID NO: 2759948 - RNA, 14 nt, Human
cugcugguggcgcu

SEQ ID NO: 2759949 - RNA, 18 nt, Human
cugcugguggcgcuggcu

SEQ ID NO: 2759950 - RNA, 21 nt, Human
cugcuuauccguuagccgugg

SEQ ID NO: 2759951 - RNA, 21 nt, Human
cugcuugaacuaggcugagca

SEQ ID NO: 2759952 - RNA, 19 nt, Human
cugcuugccaucccucccu

SEQ ID NO: 2759953 - RNA, 22 nt, Human
cugcuugccaucccucccucca

SEQ ID NO: 2759954 - RNA, 16 nt, Human
cugcuuggagcagccu

SEQ ID NO: 2759955 - RNA, 14 nt, Human
cuggaaacacaugu

SEQ ID NO: 2759956 - RNA, 21 nt, Human
cuggaaacacauguuccccuu

SEQ ID NO: 2759957 - RNA, 14 nt, Human
cuccagccugagcg

SEQ ID NO: 2759958 - RNA, 18 nt, Human
cuccagccugagcgacag

SEQ ID NO: 2759959 - RNA, 22 nt, Human
cuccagccugagcgacagugag

SEQ ID NO: 2759960 - RNA, 12 nt, Human
cuccagccuggg

SEQ ID NO: 2759961 - RNA, 17 nt, Human
cuccagccugggugaca

SEQ ID NO: 2759962 - RNA, 22 nt, Human
cuccagcugcucugucuucuuu

SEQ ID NO: 2759963 - RNA, 19 nt, Human
cuccagcuggccgggagcc

SEQ ID NO: 2759964 - RNA, 21 nt, Human
cuccagggagucucagcuuca

SEQ ID NO: 2759965 - RNA, 15 nt, Human
cuccagguagagggu

SEQ ID NO: 2759966 - RNA, 16 nt, Human
cuccauaucucccucu

SEQ ID NO: 2759967 - RNA, 19 nt, Human
cuccauaucucccucuucc

SEQ ID NO: 2759968 - RNA, 12 nt, Human
cuccauccugag

SEQ ID NO: 2759969 - RNA, 15 nt, Human
cuccauccugaggcu

SEQ ID NO: 2759970 - RNA, 22 nt, Human
cuccauccugaggcuccacuug

SEQ ID NO: 2759971 - RNA, 21 nt, Human
cuccaucucuugaccucguga

SEQ ID NO: 2759972 - RNA, 21 nt, Human
cuccauggaaacgaagcacca

SEQ ID NO: 2759973 - RNA, 23 nt, Human
cuccauucccguggaacguuuuu

SEQ ID NO: 2759974 - RNA, 19 nt, Human
cucccaaagugcugggauu

SEQ ID NO: 2759975 - RNA, 17 nt, Human
cucccaacuauaaaacu

SEQ ID NO: 2759976 - RNA, 13 nt, Human
cucccaccaccuc

SEQ ID NO: 2759977 - RNA, 19 nt, Human
cucccaccaccucaccagu

SEQ ID NO: 2759978 - RNA, 22 nt, Human
cucccacuagacaaguccagcc

SEQ ID NO: 2759979 - RNA, 16 nt, Human
cucccacuucagccuc

SEQ ID NO: 2759980 - RNA, 19 nt, Human
cucccacuucagccuccca

SEQ ID NO: 2759981 - RNA, 20 nt, Human
cucccacuucagccucccaa

SEQ ID NO: 2759982 - RNA, 13 nt, Human
cucccagcucagg

SEQ ID NO: 2759983 - RNA, 15 nt, Human
cucccagcucagggc

SEQ ID NO: 2759984 - RNA, 21 nt, Human
cucccaggaggggcuucuggg

SEQ ID NO: 2759985 - RNA, 19 nt, Human
cucccagucauuuaauaaa

SEQ ID NO: 2759986 - RNA, 13 nt, Human
cuccccagcucua

SEQ ID NO: 2759987 - RNA, 21 nt, Human
cuccccagcucuaucccaacc

SEQ ID NO: 2759988 - RNA, 16 nt, Human
cuccccuccucggcuu

SEQ ID NO: 2759989 - RNA, 19 nt, Human
cuccccugcacuguaaaau

SEQ ID NO: 2759990 - RNA, 17 nt, Human
cuccccugccucaccag

SEQ ID NO: 2759991 - RNA, 17 nt, Human
cuccccuucacucccac

SEQ ID NO: 2759992 - RNA, 18 nt, Human
cuccccuucacucccacc

SEQ ID NO: 2759993 - RNA, 17 nt, Human
cucccggccgcgcugcg

SEQ ID NO: 2759994 - RNA, 13 nt, Human
cucccuaccuacc

SEQ ID NO: 2759995 - RNA, 13 nt, Human
cucccuagccaga

SEQ ID NO: 2759996 - RNA, 17 nt, Human
cucccuaguuccuucau

SEQ ID NO: 2759997 - RNA, 15 nt, Human
cucccuccaccuccc

SEQ ID NO: 2759998 - RNA, 21 nt, Human
cucccuccaccucccugcaau

SEQ ID NO: 2759999 - RNA, 12 nt, Human
cucccuccagau

SEQ ID NO: 2760000 - RNA, 14 nt, Human
cucccucccuuggg

SEQ ID NO: 2760001 - RNA, 14 nt, Human
cucccugcccccca

SEQ ID NO: 2760002 - RNA, 14 nt, Human
cucccuugcucugc

SEQ ID NO: 2760003 - RNA, 15 nt, Human
cucccuuggggccua

SEQ ID NO: 2760004 - RNA, 18 nt, Human
cucccuuggggccuaugc

SEQ ID NO: 2760005 - RNA, 22 nt, Human
cucccuuggggccuaugcagag

SEQ ID NO: 2760006 - RNA, 14 nt, Human
cuccgcgcagcuca

SEQ ID NO: 2760007 - RNA, 19 nt, Human
cuccgcuacuuccagggcu

SEQ ID NO: 2760008 - RNA, 18 nt, Human
cuccgucaacucauauuu

SEQ ID NO: 2760009 - RNA, 22 nt, Human
cuccuaggaaaauacuauucug

SEQ ID NO: 2760010 - RNA, 15 nt, Human
cuccucaacucugag

SEQ ID NO: 2760011 - RNA, 22 nt, Human
cuccuccagggagucucagcuu

SEQ ID NO: 2760012 - RNA, 22 nt, Human
cuccuccauaucucccucuucc

SEQ ID NO: 2760013 - RNA, 14 nt, Human
cuccuccuuuuucc

SEQ ID NO: 2760014 - RNA, 15 nt, Human
cuccuccuuuuuccu

SEQ ID NO: 2760015 - RNA, 19 nt, Human
cuccucggacggcuccgga

SEQ ID NO: 2760016 - RNA, 13 nt, Human
cuccucggcuucc

SEQ ID NO: 2760017 - RNA, 15 nt, Human
cuccucuccaccauc

SEQ ID NO: 2760018 - RNA, 16 nt, Human
cuccucugcuugccau

SEQ ID NO: 2760019 - RNA, 17 nt, Human
cuccucuguccagggcc

SEQ ID NO: 2760020 - RNA, 12 nt, Human
cuccugaccuca

SEQ ID NO: 2760021 - RNA, 21 nt, Human
cuccugccuaagugcagcccc

SEQ ID NO: 2760022 - RNA, 15 nt, Human
cuccugccucagccu

SEQ ID NO: 2760023 - RNA, 19 nt, Human
cuccugggcagcugccucc

SEQ ID NO: 2760024 - RNA, 22 nt, Human
cuccugggcagcugccuccccu

SEQ ID NO: 2760025 - RNA, 19 nt, Human
cuccuggguucaagcgauu

SEQ ID NO: 2760026 - RNA, 17 nt, Human
cuccuguacuuuuucca

SEQ ID NO: 2760027 - RNA, 23 nt, Human
cuccuguacuuuuuccagacacu

SEQ ID NO: 2760028 - RNA, 15 nt, Human
cuccuguccagccug

SEQ ID NO: 2760029 - RNA, 13 nt, Human
cuccugucugcca

SEQ ID NO: 2760030 - RNA, 16 nt, Human
cuccugucugccagcc

SEQ ID NO: 2760031 - RNA, 13 nt, Human
cuccuguuaauau

SEQ ID NO: 2760032 - RNA, 12 nt, Human
cuccuguuucac

SEQ ID NO: 2760033 - RNA, 20 nt, Human
cuccuuccaggggagguuca

SEQ ID NO: 2760034 - RNA, 20 nt, Human
cuccuuccggggaaggauuu

SEQ ID NO: 2760035 - RNA, 14 nt, Human
cuccuugucuuuuu

SEQ ID NO: 2760036 - RNA, 15 nt, Human
cuccuuguucugaua

SEQ ID NO: 2760037 - RNA, 14 nt, Human
cuccuuucucaucu

SEQ ID NO: 2760038 - RNA, 13 nt, Human
cucgaacugcugg

SEQ ID NO: 2760039 - RNA, 16 nt, Human
cucgagcguugcuggg

SEQ ID NO: 2760040 - RNA, 18 nt, Human
cucgaggagguaaugaau

SEQ ID NO: 2760041 - RNA, 13 nt, Human
cucgccacgcucu

SEQ ID NO: 2760042 - RNA, 16 nt, Human
cucgccacgcucuggg

SEQ ID NO: 2760043 - RNA, 14 nt, Human
cucgcccacuuccu

SEQ ID NO: 2760044 - RNA, 20 nt, Human
cucgcccacuuccucccggc

SEQ ID NO: 2760045 - RNA, 21 nt, Human
cucgcccacuuccucccggcc

SEQ ID NO: 2760046 - RNA, 22 nt, Human
cucgcccacuuccucccggccg

SEQ ID NO: 2760047 - RNA, 13 nt, Human
cucgcuguugcug

SEQ ID NO: 2760048 - RNA, 20 nt, Human
cucgcuuccgcauccuaguc

SEQ ID NO: 2760049 - RNA, 19 nt, Human
cucggccugcucgcccacu

SEQ ID NO: 2760050 - RNA, 16 nt, Human
cucggugcucccuuug

SEQ ID NO: 2760051 - RNA, 13 nt, Human
cucgguggaccca

SEQ ID NO: 2760052 - RNA, 19 nt, Human
cucgugauccacccgccuc

SEQ ID NO: 2760053 - RNA, 13 nt, Human
cucgugggacagu

SEQ ID NO: 2760054 - RNA, 17 nt, Human
cucgugggacagucacc

SEQ ID NO: 2760055 - RNA, 19 nt, Human
cucuaaauucuuucauuuu

SEQ ID NO: 2760056 - RNA, 12 nt, Human
cucuaacucaga

SEQ ID NO: 2760057 - RNA, 16 nt, Human
cucuaagaaagaacac

SEQ ID NO: 2760058 - RNA, 13 nt, Human
cucuaauguacaa

SEQ ID NO: 2760059 - RNA, 14 nt, Human
cucuaauguacaau

SEQ ID NO: 2760060 - RNA, 16 nt, Human
cucuaauguacaauaa

SEQ ID NO: 2760061 - RNA, 22 nt, Human
cucuaauguacaauaaagcaau

SEQ ID NO: 2760062 - RNA, 15 nt, Human
cucuacaaaaaaaaa

SEQ ID NO: 2760063 - RNA, 22 nt, Human
cucuacauaaaauacaaaaacu

SEQ ID NO: 2760064 - RNA, 13 nt, Human
cucuacuaaaaau

SEQ ID NO: 2760065 - RNA, 17 nt, Human
cucuaggaaauauuuau

SEQ ID NO: 2760066 - RNA, 21 nt, Human
cucuaggaaauauuuauuuua

SEQ ID NO: 2760067 - RNA, 17 nt, Human
cucuaggacauaaauua

SEQ ID NO: 2760068 - RNA, 16 nt, Human
cucuaucaccaaggag

SEQ ID NO: 2760069 - RNA, 21 nt, Human
cucuaucccaaccucucccaa

SEQ ID NO: 2760070 - RNA, 16 nt, Human
cucuaugccagcagcc

SEQ ID NO: 2760071 - RNA, 15 nt, Human
cucuaugguguggca

SEQ ID NO: 2760072 - RNA, 21 nt, Human
cucuaugguguggcaaagccu

SEQ ID NO: 2760073 - RNA, 22 nt, Human
cucucaaacuggggccucccug

SEQ ID NO: 2760074 - RNA, 13 nt, Human
cucucaaagugcu

SEQ ID NO: 2760075 - RNA, 16 nt, Human
cucucaaagugcuggc

SEQ ID NO: 2760076 - RNA, 18 nt, Human
cucucagugggugguagc

SEQ ID NO: 2760077 - RNA, 17 nt, Human
cucucauccacuuucca

SEQ ID NO: 2760078 - RNA, 14 nt, Human
cucucaugaaccuc

SEQ ID NO: 2760079 - RNA, 18 nt, Human
cucuccaaagcccucccu

SEQ ID NO: 2760080 - RNA, 22 nt, Human
cucuccaaccagauugucagcu

SEQ ID NO: 2760081 - RNA, 13 nt, Human
cucuccaccaggu

SEQ ID NO: 2760082 - RNA, 17 nt, Human
cucuccaccagguucuu

SEQ ID NO: 2760083 - RNA, 21 nt, Human
cucuccaccagguucuuucuu

SEQ ID NO: 2760084 - RNA, 22 nt, Human
cucuccagaugagaguacaccc

SEQ ID NO: 2760085 - RNA, 16 nt, Human
cucucccaacuauaaa

SEQ ID NO: 2760086 - RNA, 16 nt, Human
cucuccugggcagcug

SEQ ID NO: 2760087 - RNA, 19 nt, Human
cucuccugggcagcugccu

SEQ ID NO: 2760088 - RNA, 22 nt, Human
cucuccugggcagcugccuccc

SEQ ID NO: 2760089 - RNA, 13 nt, Human
cucucucaaacug

SEQ ID NO: 2760090 - RNA, 16 nt, Human
cucucucauccacuuu

SEQ ID NO: 2760091 - RNA, 9 nt, Human
cucucucug

SEQ ID NO: 2760092 - RNA, 14 nt, Human
cucucugagggggu

SEQ ID NO: 2760093 - RNA, 23 nt, Human
cucucuggccuucggccuccauc

SEQ ID NO: 2760094 - RNA, 23 nt, Human
cucucuuaaggaggcugagagcc

SEQ ID NO: 2760095 - RNA, 18 nt, Human
cucucuuauagaauauuu

SEQ ID NO: 2760096 - RNA, 16 nt, Human
cucucuuccucccugg

SEQ ID NO: 2760097 - RNA, 23 nt, Human
cucugaauuugagauacaaacau

SEQ ID NO: 2760098 - RNA, 19 nt, Human
cucugagaagcucugaaga

SEQ ID NO: 2760099 - RNA, 23 nt, Human
cucugagaagcucugaagaacuc

SEQ ID NO: 2760100 - RNA, 13 nt, Human
cucugagccuugg

SEQ ID NO: 2760101 - RNA, 14 nt, Human
cucugagccuuggg

SEQ ID NO: 2760102 - RNA, 17 nt, Human
cucugaggggguggggg

SEQ ID NO: 2760103 - RNA, 20 nt, Human
cucugcaaacugccuucuuc

SEQ ID NO: 2760104 - RNA, 21 nt, Human
cucugcaaacugccuucuucg

SEQ ID NO: 2760105 - RNA, 19 nt, Human
cucugcaagaagaaaucau

SEQ ID NO: 2760106 - RNA, 20 nt, Human
cucugcacacccuccagaga

SEQ ID NO: 2760107 - RNA, 22 nt, Human
ccuugguucucauaacucugug

SEQ ID NO: 2760108 - RNA, 14 nt, Human
ccuuguaauuugaa

SEQ ID NO: 2760109 - RNA, 16 nt, Human
ccuugucucccagcuc

SEQ ID NO: 2760110 - RNA, 12 nt, Human
ccuuuaaaauuu

SEQ ID NO: 2760111 - RNA, 21 nt, Human
ccuuuacauccagauagguua

SEQ ID NO: 2760112 - RNA, 17 nt, Human
ccuuuacuugaccuccu

SEQ ID NO: 2760113 - RNA, 16 nt, Human
ccuuuagaauauuaaa

SEQ ID NO: 2760114 - RNA, 22 nt, Human
ccuuucauaaagucuugccuug

SEQ ID NO: 2760115 - RNA, 13 nt, Human
ccuuucauuuuuu

SEQ ID NO: 2760116 - RNA, 17 nt, Human
ccuuucugccccugcug

SEQ ID NO: 2760117 - RNA, 18 nt, Human
ccuuucugccccugcuga

SEQ ID NO: 2760118 - RNA, 18 nt, Human
ccuuucuucucuccagug

SEQ ID NO: 2760119 - RNA, 19 nt, Human
ccuuucuucucuccagugc

SEQ ID NO: 2760120 - RNA, 15 nt, Human
ccuuucuuuuuuuaa

SEQ ID NO: 2760121 - RNA, 13 nt, Human
ccuuugcaccucc

SEQ ID NO: 2760122 - RNA, 17 nt, Human
ccuuugcugacccuccc

SEQ ID NO: 2760123 - RNA, 20 nt, Human
ccuuugcugacccuccccaa

SEQ ID NO: 2760124 - RNA, 16 nt, Human
ccuuuggagauuuuuu

SEQ ID NO: 2760125 - RNA, 17 nt, Human
ccuuuggagauuuuuua

SEQ ID NO: 2760126 - RNA, 13 nt, Human
ccuuugggaaagg

SEQ ID NO: 2760127 - RNA, 12 nt, Human
ccuuuucccaac

SEQ ID NO: 2760128 - RNA, 12 nt, Human
ccuuuuuccuuc

SEQ ID NO: 2760129 - RNA, 13 nt, Human
ccuuuuuuugaaa

SEQ ID NO: 2760130 - RNA, 17 nt, Human
cgaaagcaucauuauuu

SEQ ID NO: 2760131 - RNA, 23 nt, Human
cgaaauacguuaggaggacaaaa

SEQ ID NO: 2760132 - RNA, 15 nt, Human
cggagccuccagcug

SEQ ID NO: 2760133 - RNA, 16 nt, Human
cggagccuccagcugc

SEQ ID NO: 2760134 - RNA, 20 nt, Human
cggagccuccagcugccccg

SEQ ID NO: 2760135 - RNA, 22 nt, Human
cggagccuccagcugccccggg

SEQ ID NO: 2760136 - RNA, 22 nt, Human
cggaggucgaggcuacagugag

SEQ ID NO: 2760137 - RNA, 13 nt, Human
cggauugagaagg

SEQ ID NO: 2760138 - RNA, 23 nt, Human
cggauugagaaggagcucccagg

SEQ ID NO: 2760139 - RNA, 16 nt, Human
cggauuuauuuuucca

SEQ ID NO: 2760140 - RNA, 21 nt, Human
cggcaagggaacaaguacuuc

SEQ ID NO: 2760141 - RNA, 14 nt, Human
cggcccaggauggc

SEQ ID NO: 2760142 - RNA, 17 nt, Human
cggcccugugcggccug

SEQ ID NO: 2760143 - RNA, 21 nt, Human
cggcccugugcggccuggucu

SEQ ID NO: 2760144 - RNA, 13 nt, Human
cggccgcgcugcg

SEQ ID NO: 2760145 - RNA, 17 nt, Human
cggccgcgcugcgcgcc

SEQ ID NO: 2760146 - RNA, 19 nt, Human
cggccgcgcugcgcgccgc

SEQ ID NO: 2760147 - RNA, 12 nt, Human
cggccggcgcgc

SEQ ID NO: 2760148 - RNA, 14 nt, Human
cggccggcgcgcuc

SEQ ID NO: 2760149 - RNA, 15 nt, Human
cggccggcgcgcuca

SEQ ID NO: 2760150 - RNA, 15 nt, Human
cggccuccauccuga

SEQ ID NO: 2760151 - RNA, 16 nt, Human
cggccuccauccugag

SEQ ID NO: 2760152 - RNA, 19 nt, Human
cggccuccauccugaggcu

SEQ ID NO: 2760153 - RNA, 21 nt, Human
cggccugauuaaaguuaaaua

SEQ ID NO: 2760154 - RNA, 13 nt, Human
cggccugcucgcc

SEQ ID NO: 2760155 - RNA, 16 nt, Human
cggcggcccugugcgg

SEQ ID NO: 2760156 - RNA, 20 nt, Human
cggcggcccugugcggccug

SEQ ID NO: 2760157 - RNA, 16 nt, Human
cggcgggagggcgcgg

SEQ ID NO: 2760158 - RNA, 17 nt, Human
cggcgggagggcgcggg

SEQ ID NO: 2760159 - RNA, 21 nt, Human
cggcuccggacgcugcugccg

SEQ ID NO: 2760160 - RNA, 14 nt, Human
cggcuccucaggga

SEQ ID NO: 2760161 - RNA, 18 nt, Human
cggcuggagcugccucuc

SEQ ID NO: 2760162 - RNA, 19 nt, Human
cggcuuccuuccucucugc

SEQ ID NO: 2760163 - RNA, 16 nt, Human
cgggaaagaagagccg

SEQ ID NO: 2760164 - RNA, 22 nt, Human
cgggacacaggcuccaaacugg

SEQ ID NO: 2760165 - RNA, 14 nt, Human
cgggaccagcucac

SEQ ID NO: 2760166 - RNA, 20 nt, Human
cgggagccugaucaccugcc

SEQ ID NO: 2760167 - RNA, 13 nt, Human
cgggaggcagagg

SEQ ID NO: 2760168 - RNA, 20 nt, Human
cgggaggcagagguugcagu

SEQ ID NO: 2760169 - RNA, 13 nt, Human
cgggagggcgcgg

SEQ ID NO: 2760170 - RNA, 21 nt, Human
cgggaguggcgcgcgccacca

SEQ ID NO: 2760171 - RNA, 13 nt, Human
cgggcaugguggc

SEQ ID NO: 2760172 - RNA, 12 nt, Human
cgggccgacgga

SEQ ID NO: 2760173 - RNA, 15 nt, Human
cgggccgacggagcc

SEQ ID NO: 2760174 - RNA, 16 nt, Human
cgggccgacggagccg

SEQ ID NO: 2760175 - RNA, 17 nt, Human
cgggccgacggagccgg

SEQ ID NO: 2760176 - RNA, 12 nt, Human
cggggagcgagc

SEQ ID NO: 2760177 - RNA, 14 nt, Human
cggggagcgagccc

SEQ ID NO: 2760178 - RNA, 22 nt, Human
cggggagcgagccccaggcggg

SEQ ID NO: 2760179 - RNA, 14 nt, Human
cggggaggggcgcu

SEQ ID NO: 2760180 - RNA, 14 nt, Human
cggggugggaaaga

SEQ ID NO: 2760181 - RNA, 21 nt, Human
cgggguuugccaugcuggcca

SEQ ID NO: 2760182 - RNA, 15 nt, Human
cggguccgggucgca

SEQ ID NO: 2760183 - RNA, 22 nt, Human
cgggucgcaggaccaucccggc

SEQ ID NO: 2760184 - RNA, 16 nt, Human
cggguuucaccauguu

SEQ ID NO: 2760185 - RNA, 20 nt, Human
cggugagcuacaaaugcauu

SEQ ID NO: 2760186 - RNA, 13 nt, Human
cguaacuaauuuu

SEQ ID NO: 2760187 - RNA, 17 nt, Human
cguaaucguguccccua

SEQ ID NO: 2760188 - RNA, 18 nt, Human
cguaaugcauugccugua

SEQ ID NO: 2760189 - RNA, 15 nt, Human
cguacugcagccucc

SEQ ID NO: 2760190 - RNA, 17 nt, Human
cguauaaaagccuguuu

SEQ ID NO: 2760191 - RNA, 16 nt, Human
cguauugcauuuaauu

SEQ ID NO: 2760192 - RNA, 17 nt, Human
cgucaacucauauuuuc

SEQ ID NO: 2760193 - RNA, 20 nt, Human
cgucaccccuguuucuggca

SEQ ID NO: 2760194 - RNA, 16 nt, Human
cguccaucucuuguuu

SEQ ID NO: 2760195 - RNA, 14 nt, Human
cgucccccucuggc

SEQ ID NO: 2760196 - RNA, 18 nt, Human
cguccugucggagcccug

SEQ ID NO: 2760197 - RNA, 20 nt, Human
cguccugucggagcccuguc

SEQ ID NO: 2760198 - RNA, 19 nt, Human
cgucucccaaagugcuggg

SEQ ID NO: 2760199 - RNA, 22 nt, Human
cgucucccaaagugcugggaau

SEQ ID NO: 2760200 - RNA, 13 nt, Human
cgugacuggccug

SEQ ID NO: 2760201 - RNA, 13 nt, Human
cgugagccaccaa

SEQ ID NO: 2760202 - RNA, 14 nt, Human
cgugagccaccaaa

SEQ ID NO: 2760203 - RNA, 14 nt, Human
cgugagccaccaug

SEQ ID NO: 2760204 - RNA, 15 nt, Human
cgugagccaccaugc

SEQ ID NO: 2760205 - RNA, 16 nt, Human
cgugauccacccgccu

SEQ ID NO: 2760206 - RNA, 14 nt, Human
cgugaucucagcuc

SEQ ID NO: 2760207 - RNA, 21 nt, Human
cguggaaaggggcaggccaga

SEQ ID NO: 2760208 - RNA, 16 nt, Human
cguggacuuacuauuu

SEQ ID NO: 2760209 - RNA, 16 nt, Human
cgugggacagucaccu

SEQ ID NO: 2760210 - RNA, 15 nt, Human
cguggguugcacugg

SEQ ID NO: 2760211 - RNA, 14 nt, Human
cguguccccuaucc

SEQ ID NO: 2760212 - RNA, 22 nt, Human
cguguccgacucuucugagcac

SEQ ID NO: 2760213 - RNA, 16 nt, Human
cguuagugcuagugga

SEQ ID NO: 2760214 - RNA, 13 nt, Human
cguuauaaucauu

SEQ ID NO: 2760215 - RNA, 14 nt, Human
cguuauaaucauuu

SEQ ID NO: 2760216 - RNA, 17 nt, Human
cguucacauguguggua

SEQ ID NO: 2760217 - RNA, 15 nt, Human
cguucacauuuuugu

SEQ ID NO: 2760218 - RNA, 16 nt, Human
cguugaacgucacauc

SEQ ID NO: 2760219 - RNA, 23 nt, Human
cguugacccucacaggagcaucu

SEQ ID NO: 2760220 - RNA, 23 nt, Human
cguugagccaccaagcugguggc

SEQ ID NO: 2760221 - RNA, 17 nt, Human
cuaaaaauugugaucag

SEQ ID NO: 2760222 - RNA, 22 nt, Human
cuaaaacaagcacuaaacaaag

SEQ ID NO: 2760223 - RNA, 13 nt, Human
cuaaacauccuaa

SEQ ID NO: 2760224 - RNA, 12 nt, Human
cuaaacauuuca

SEQ ID NO: 2760225 - RNA, 13 nt, Human
cuaaacucagagg

SEQ ID NO: 2760226 - RNA, 18 nt, Human
cuaaagaaggugugggcc

SEQ ID NO: 2760227 - RNA, 14 nt, Human
cuaaagcaguggac

SEQ ID NO: 2760228 - RNA, 15 nt, Human
cuaaagcccagagac

SEQ ID NO: 2760229 - RNA, 22 nt, Human
cuaaaguaaaaacaaagaaauu

SEQ ID NO: 2760230 - RNA, 22 nt, Human
cuaaauaaagcuugcaacaaaa

SEQ ID NO: 2760231 - RNA, 23 nt, Human
cuaaauaaagcuugcaacaaaau

SEQ ID NO: 2760232 - RNA, 21 nt, Human
cuaaaucuauuuauuaauauu

SEQ ID NO: 2760233 - RNA, 14 nt, Human
cuaaaugucaauca

SEQ ID NO: 2760234 - RNA, 21 nt, Human
cuaaauugacacuuaaaaaug

SEQ ID NO: 2760235 - RNA, 21 nt, Human
cuaacaaauuccaaauucuca

SEQ ID NO: 2760236 - RNA, 10 nt, Human
cuaacaccca

SEQ ID NO: 2760237 - RNA, 23 nt, Human
cuaacacggugcucauuuuuucu

SEQ ID NO: 2760238 - RNA, 17 nt, Human
cuaacaggaauuuucau

SEQ ID NO: 2760239 - RNA, 16 nt, Human
cuaacugguuaaacau

SEQ ID NO: 2760240 - RNA, 19 nt, Human
cuaagaaacauuuauauug

SEQ ID NO: 2760241 - RNA, 11 nt, Human
cuaagaaagaa

SEQ ID NO: 2760242 - RNA, 21 nt, Human
cuaagaaagcccuuaggaaga

SEQ ID NO: 2760243 - RNA, 13 nt, Human
cuaagaaauaugc

SEQ ID NO: 2760244 - RNA, 12 nt, Human
cuaagaagugaa

SEQ ID NO: 2760245 - RNA, 16 nt, Human
cuaagagagaaugaga

SEQ ID NO: 2760246 - RNA, 21 nt, Human
cuaagauuuguaauauuucuc

SEQ ID NO: 2760247 - RNA, 15 nt, Human
cuaagcaaaauguga

SEQ ID NO: 2760248 - RNA, 19 nt, Human
cuaagcauuccaacuaucu

SEQ ID NO: 2760249 - RNA, 17 nt, Human
cuaagccagcugccccc

SEQ ID NO: 2760250 - RNA, 21 nt, Human
cuaagccuuccugccgcaaca

SEQ ID NO: 2760251 - RNA, 19 nt, Human
cuaagcuucacuguaaaau

SEQ ID NO: 2760252 - RNA, 22 nt, Human
cuaagcuucacuguaaaauaau

SEQ ID NO: 2760253 - RNA, 15 nt, Human
cuaaggcaggaggau

SEQ ID NO: 2760254 - RNA, 17 nt, Human
cuaaggcaggaggauca

SEQ ID NO: 2760255 - RNA, 22 nt, Human
cuaaguaaaaccacagcaguug

SEQ ID NO: 2760256 - RNA, 16 nt, Human
cuaagucuuauauauu

SEQ ID NO: 2760257 - RNA, 15 nt, Human
cuaagugcagccccg

SEQ ID NO: 2760258 - RNA, 23 nt, Human
cuaaguugcaccaacuuugaagu

SEQ ID NO: 2760259 - RNA, 16 nt, Human
cuaauaaaaaggugac

SEQ ID NO: 2760260 - RNA, 15 nt, Human
cuaauauauaugaau

SEQ ID NO: 2760261 - RNA, 17 nt, Human
cuaauaucuuaucuucc

SEQ ID NO: 2760262 - RNA, 14 nt, Human
cuaauauguaaaau

SEQ ID NO: 2760263 - RNA, 15 nt, Human
cuaauauguaaaauu

SEQ ID NO: 2760264 - RNA, 18 nt, Human
cuaauguacaauaaagca

SEQ ID NO: 2760265 - RNA, 22 nt, Human
cuaauguacaauaaagcaaugu

SEQ ID NO: 2760266 - RNA, 18 nt, Human
cuaauguguaagacaaaa

SEQ ID NO: 2760267 - RNA, 18 nt, Human
ccugaaggcauccccagg

SEQ ID NO: 2760268 - RNA, 19 nt, Human
ccugaaggcauccccaggc

SEQ ID NO: 2760269 - RNA, 23 nt, Human
ccugacagcccaagggugggugg

SEQ ID NO: 2760270 - RNA, 23 nt, Human
ccugacucucuuaaggaggcuga

SEQ ID NO: 2760271 - RNA, 17 nt, Human
ccugacucuugcagggg

SEQ ID NO: 2760272 - RNA, 16 nt, Human
ccugacugccaagcca

SEQ ID NO: 2760273 - RNA, 15 nt, Human
ccugagacaaaugga

SEQ ID NO: 2760274 - RNA, 13 nt, Human
ccugagcaggauu

SEQ ID NO: 2760275 - RNA, 9 nt, Human
ccugagccc

SEQ ID NO: 2760276 - RNA, 10 nt, Human
ccugagcccc

SEQ ID NO: 2760277 - RNA, 18 nt, Human
ccugagcggaccuuccca

SEQ ID NO: 2760278 - RNA, 19 nt, Human
ccugagcggaccuucccag

SEQ ID NO: 2760279 - RNA, 20 nt, Human
ccugagcggaccuucccagc

SEQ ID NO: 2760280 - RNA, 21 nt, Human
ccugagcggaccuucccagcu

SEQ ID NO: 2760281 - RNA, 13 nt, Human
ccugagcuugcag

SEQ ID NO: 2760282 - RNA, 17 nt, Human
ccugagcuugcagagau

SEQ ID NO: 2760283 - RNA, 12 nt, Human
ccugcaaagccc

SEQ ID NO: 2760284 - RNA, 15 nt, Human
ccugcaaagcccagc

SEQ ID NO: 2760285 - RNA, 18 nt, Human
ccugcaaagcccagcuug

SEQ ID NO: 2760286 - RNA, 12 nt, Human
ccugcaagcaga

SEQ ID NO: 2760287 - RNA, 14 nt, Human
ccugcaagcagagg

SEQ ID NO: 2760288 - RNA, 16 nt, Human
ccugcaauaaaauggg

SEQ ID NO: 2760289 - RNA, 17 nt, Human
ccugcaauaaaaugggu

SEQ ID NO: 2760290 - RNA, 21 nt, Human
ccugcaauaaaauggguuuua

SEQ ID NO: 2760291 - RNA, 15 nt, Human
ccugcaccaugcugc

SEQ ID NO: 2760292 - RNA, 23 nt, Human
ccugcacuccagccugagcgaca

SEQ ID NO: 2760293 - RNA, 14 nt, Human
ccugcacuguaaaa

SEQ ID NO: 2760294 - RNA, 18 nt, Human
ccugcagacaugagagac

SEQ ID NO: 2760295 - RNA, 13 nt, Human
ccugcagacucac

SEQ ID NO: 2760296 - RNA, 22 nt, Human
ccugcagacucacugugggaag

SEQ ID NO: 2760297 - RNA, 23 nt, Human
ccugcagacucacugugggaagg

SEQ ID NO: 2760298 - RNA, 17 nt, Human
ccugcaggcaugaguca

SEQ ID NO: 2760299 - RNA, 12 nt, Human
ccugcaggcgug

SEQ ID NO: 2760300 - RNA, 14 nt, Human
ccugcaggcgugac

SEQ ID NO: 2760301 - RNA, 15 nt, Human
ccugcaggcgugacc

SEQ ID NO: 2760302 - RNA, 14 nt, Human
ccugccagcuggcc

SEQ ID NO: 2760303 - RNA, 14 nt, Human
ccugccccccagcc

SEQ ID NO: 2760304 - RNA, 15 nt, Human
ccugccccccagccc

SEQ ID NO: 2760305 - RNA, 17 nt, Human
ccugccccccagcccuc

SEQ ID NO: 2760306 - RNA, 14 nt, Human
ccugccccugagcc

SEQ ID NO: 2760307 - RNA, 15 nt, Human
ccugccccugagccc

SEQ ID NO: 2760308 - RNA, 16 nt, Human
ccugccccugagccca

SEQ ID NO: 2760309 - RNA, 18 nt, Human
ccugccuaagugcagccc

SEQ ID NO: 2760310 - RNA, 22 nt, Human
ccugccucaagcuaugugagcu

SEQ ID NO: 2760311 - RNA, 17 nt, Human
ccugccucagccucccg

SEQ ID NO: 2760312 - RNA, 16 nt, Human
ccugccuccccugccu

SEQ ID NO: 2760313 - RNA, 18 nt, Human
ccugccugcaauauuuga

SEQ ID NO: 2760314 - RNA, 21 nt, Human
ccugccugccccuacccugga

SEQ ID NO: 2760315 - RNA, 20 nt, Human
ccugccuuggcuucccaaag

SEQ ID NO: 2760316 - RNA, 14 nt, Human
ccugccuuucuccc

SEQ ID NO: 2760317 - RNA, 23 nt, Human
ccugcuagaacagucucuugagg

SEQ ID NO: 2760318 - RNA, 15 nt, Human
ccugcucagcccugc

SEQ ID NO: 2760319 - RNA, 18 nt, Human
ccugcucagcccugcacc

SEQ ID NO: 2760320 - RNA, 21 nt, Human
ccugcucagcccugcaccaug

SEQ ID NO: 2760321 - RNA, 17 nt, Human
ccugcucgcccacuucc

SEQ ID NO: 2760322 - RNA, 14 nt, Human
ccugcucuuccuca

SEQ ID NO: 2760323 - RNA, 15 nt, Human
ccugcugcccucccc

SEQ ID NO: 2760324 - RNA, 18 nt, Human
ccugcugcccucccccuc

SEQ ID NO: 2760325 - RNA, 22 nt, Human
ccugcugcccuuccccuuccca

SEQ ID NO: 2760326 - RNA, 18 nt, Human
ccugcuggauguggaggg

SEQ ID NO: 2760327 - RNA, 20 nt, Human
ccuggaaaucaggguuagua

SEQ ID NO: 2760328 - RNA, 17 nt, Human
ccuggaacugucucuca

SEQ ID NO: 2760329 - RNA, 13 nt, Human
ccuggacuugccu

SEQ ID NO: 2760330 - RNA, 14 nt, Human
ccuggacuugccuc

SEQ ID NO: 2760331 - RNA, 15 nt, Human
ccuggacuugccucu

SEQ ID NO: 2760332 - RNA, 21 nt, Human
ccuggaucucacaagcacuuu

SEQ ID NO: 2760333 - RNA, 21 nt, Human
ccuggcaaggguucaccuggg

SEQ ID NO: 2760334 - RNA, 16 nt, Human
ccuggcuaauuuuugu

SEQ ID NO: 2760335 - RNA, 15 nt, Human
ccuggcucucccagc

SEQ ID NO: 2760336 - RNA, 24 nt, Human
ccuggcucucccagccagguucug

SEQ ID NO: 2760337 - RNA, 18 nt, Human
ccuggcugcugcugugca

SEQ ID NO: 2760338 - RNA, 19 nt, Human
ccuggcugcugcugugcag

SEQ ID NO: 2760339 - RNA, 23 nt, Human
ccugggaccaggcacccccagaa

SEQ ID NO: 2760340 - RNA, 17 nt, Human
ccugggcaacaugguga

SEQ ID NO: 2760341 - RNA, 16 nt, Human
ccuggucaacauggug

SEQ ID NO: 2760342 - RNA, 19 nt, Human
ccuggucagucugcccuug

SEQ ID NO: 2760343 - RNA, 19 nt, Human
ccuggucgucgucuugacu

SEQ ID NO: 2760344 - RNA, 12 nt, Human
ccuggugccuca

SEQ ID NO: 2760345 - RNA, 19 nt, Human
ccuguaaucauauaauaaa

SEQ ID NO: 2760346 - RNA, 17 nt, Human
ccuguaaucccagcacu

SEQ ID NO: 2760347 - RNA, 22 nt, Human
ccuguaaucccagcaugcugag

SEQ ID NO: 2760348 - RNA, 18 nt, Human
ccuguaaucccagcuacu

SEQ ID NO: 2760349 - RNA, 13 nt, Human
ccuguacccagua

SEQ ID NO: 2760350 - RNA, 14 nt, Human
ccuguacccaguag

SEQ ID NO: 2760351 - RNA, 15 nt, Human
ccuguacuccagccu

SEQ ID NO: 2760352 - RNA, 16 nt, Human
ccuguacuccagccug

SEQ ID NO: 2760353 - RNA, 18 nt, Human
ccuguacuccagccuggg

SEQ ID NO: 2760354 - RNA, 16 nt, Human
ccugucaucucacauu

SEQ ID NO: 2760355 - RNA, 12 nt, Human
ccugucccagcg

SEQ ID NO: 2760356 - RNA, 21 nt, Human
ccugucccugcagacaugaga

SEQ ID NO: 2760357 - RNA, 21 nt, Human
ccugucgaaggggaggcacac

SEQ ID NO: 2760358 - RNA, 17 nt, Human
ccugucgguuuauucac

SEQ ID NO: 2760359 - RNA, 15 nt, Human
ccugucugccagcca

SEQ ID NO: 2760360 - RNA, 18 nt, Human
ccugucuguuuccucugu

SEQ ID NO: 2760361 - RNA, 17 nt, Human
ccugugccguccccaga

SEQ ID NO: 2760362 - RNA, 14 nt, Human
ccugugcggccugg

SEQ ID NO: 2760363 - RNA, 19 nt, Human
ccuguggccaaguucuuag

SEQ ID NO: 2760364 - RNA, 17 nt, Human
ccugugggaccugggcc

SEQ ID NO: 2760365 - RNA, 12 nt, Human
ccuguuaaaaga

SEQ ID NO: 2760366 - RNA, 16 nt, Human
ccuguuaaaagaugaa

SEQ ID NO: 2760367 - RNA, 14 nt, Human
ccuguucgcgcgcc

SEQ ID NO: 2760368 - RNA, 18 nt, Human
ccuguucgcgcgccuccg

SEQ ID NO: 2760369 - RNA, 20 nt, Human
ccuguucgcgcgccuccgcu

SEQ ID NO: 2760370 - RNA, 11 nt, Human
ccuuaaagaua

SEQ ID NO: 2760371 - RNA, 18 nt, Human
ccuuaaagauacuugaag

SEQ ID NO: 2760372 - RNA, 17 nt, Human
ccuuaacuggagcccca

SEQ ID NO: 2760373 - RNA, 21 nt, Human
ccuuacaaagggaaagccucu

SEQ ID NO: 2760374 - RNA, 15 nt, Human
ccuuaccugggaaag

SEQ ID NO: 2760375 - RNA, 18 nt, Human
ccuuagcuuagaccucag

SEQ ID NO: 2760376 - RNA, 20 nt, Human
ccuuagcuuagaccucagcc

SEQ ID NO: 2760377 - RNA, 13 nt, Human
ccuuaggaauaau

SEQ ID NO: 2760378 - RNA, 17 nt, Human
ccuuaggccucugagaa

SEQ ID NO: 2760379 - RNA, 14 nt, Human
ccuuaucaaaggac

SEQ ID NO: 2760380 - RNA, 21 nt, Human
ccuucacauccuguguuucua

SEQ ID NO: 2760381 - RNA, 12 nt, Human
ccuucagccuga

SEQ ID NO: 2760382 - RNA, 23 nt, Human
ccuucauccucugagugugacca

SEQ ID NO: 2760383 - RNA, 23 nt, Human
ccuucauugccuuaacuggagcc

SEQ ID NO: 2760384 - RNA, 14 nt, Human
ccuucauuuccucc

SEQ ID NO: 2760385 - RNA, 11 nt, Human
ccuucauuuuu

SEQ ID NO: 2760386 - RNA, 15 nt, Human
ccuuccagugucucg

SEQ ID NO: 2760387 - RNA, 19 nt, Human
ccuucccagcuagaauuca

SEQ ID NO: 2760388 - RNA, 21 nt, Human
ccuucccaggaguacacccca

SEQ ID NO: 2760389 - RNA, 21 nt, Human
ccuuccccucugcagcuucca

SEQ ID NO: 2760390 - RNA, 22 nt, Human
ccuuccccucugcagcuuccag

SEQ ID NO: 2760391 - RNA, 13 nt, Human
ccuuccccuuccc

SEQ ID NO: 2760392 - RNA, 15 nt, Human
ccuuccccuugccca

SEQ ID NO: 2760393 - RNA, 18 nt, Human
ccuuccuaauuccacagc

SEQ ID NO: 2760394 - RNA, 22 nt, Human
ccuuccuaauuccacagcugcu

SEQ ID NO: 2760395 - RNA, 14 nt, Human
ccuuccucugagcc

SEQ ID NO: 2760396 - RNA, 19 nt, Human
ccuucggccuccauccuga

SEQ ID NO: 2760397 - RNA, 23 nt, Human
ccuucggccuccauccugaggcu

SEQ ID NO: 2760398 - RNA, 16 nt, Human
ccuucuaaccugaacu

SEQ ID NO: 2760399 - RNA, 13 nt, Human
ccuucucaccugu

SEQ ID NO: 2760400 - RNA, 20 nt, Human
ccuucucaccugugagacca

SEQ ID NO: 2760401 - RNA, 17 nt, Human
ccuucucucaaggagag

SEQ ID NO: 2760402 - RNA, 21 nt, Human
ccuucucuguucauuuccuca

SEQ ID NO: 2760403 - RNA, 17 nt, Human
ccuucugagccugccuu

SEQ ID NO: 2760404 - RNA, 16 nt, Human
ccuucuggguucaagc

SEQ ID NO: 2760405 - RNA, 11 nt, Human
ccuucuuuuuu

SEQ ID NO: 2760406 - RNA, 13 nt, Human
ccuugagcccucu

SEQ ID NO: 2760407 - RNA, 22 nt, Human
ccuugauuuuagccuucucugu

SEQ ID NO: 2760408 - RNA, 19 nt, Human
ccuugcagcucuccccuuc

SEQ ID NO: 2760409 - RNA, 14 nt, Human
ccuugcaugguuua

SEQ ID NO: 2760410 - RNA, 22 nt, Human
ccuugccauaauuacuauguca

SEQ ID NO: 2760411 - RNA, 15 nt, Human
ccuugccaugugcua

SEQ ID NO: 2760412 - RNA, 21 nt, Human
ccuugcccagggcucagccug

SEQ ID NO: 2760413 - RNA, 19 nt, Human
ccuuggacucauuuuaaaa

SEQ ID NO: 2760414 - RNA, 14 nt, Human
ccuuggcugacaug

SEQ ID NO: 2760415 - RNA, 23 nt, Human
ccuugggcaggucacacaaccug

SEQ ID NO: 2760416 - RNA, 17 nt, Human
ccuuggggcugaugcag

SEQ ID NO: 2760417 - RNA, 15 nt, Human
ccgguccuugcugca

SEQ ID NO: 2760418 - RNA, 15 nt, Human
ccgucaccucagaga

SEQ ID NO: 2760419 - RNA, 17 nt, Human
ccgucuucagccuagcc

SEQ ID NO: 2760420 - RNA, 23 nt, Human
ccguguguagguagaucuggucu

SEQ ID NO: 2760421 - RNA, 16 nt, Human
ccguucacauuuuugu

SEQ ID NO: 2760422 - RNA, 17 nt, Human
ccguuuacuuguuucag

SEQ ID NO: 2760423 - RNA, 17 nt, Human
ccuaaaacuuuaaaacu

SEQ ID NO: 2760424 - RNA, 16 nt, Human
ccuaaaauaaaaugaa

SEQ ID NO: 2760425 - RNA, 23 nt, Human
ccuaacacggugcucauuuuuuc

SEQ ID NO: 2760426 - RNA, 13 nt, Human
ccuaaccagccug

SEQ ID NO: 2760427 - RNA, 14 nt, Human
ccuaaccagccugg

SEQ ID NO: 2760428 - RNA, 23 nt, Human
ccuaaccucauuccccaaccacu

SEQ ID NO: 2760429 - RNA, 18 nt, Human
ccuaacugcuacaaauac

SEQ ID NO: 2760430 - RNA, 14 nt, Human
ccuaacuuacauuc

SEQ ID NO: 2760431 - RNA, 12 nt, Human
ccuaagcccucc

SEQ ID NO: 2760432 - RNA, 18 nt, Human
ccuaagcuggagugcagu

SEQ ID NO: 2760433 - RNA, 18 nt, Human
ccuaagggauccugccug

SEQ ID NO: 2760434 - RNA, 23 nt, Human
ccuaagggauccugccugccccu

SEQ ID NO: 2760435 - RNA, 18 nt, Human
ccuaagucccugcugccc

SEQ ID NO: 2760436 - RNA, 20 nt, Human
ccuaagucccugcugcccuu

SEQ ID NO: 2760437 - RNA, 16 nt, Human
ccuaagugcagccccg

SEQ ID NO: 2760438 - RNA, 16 nt, Human
ccuaaguuucaguuga

SEQ ID NO: 2760439 - RNA, 16 nt, Human
ccuaauaaagcugugu

SEQ ID NO: 2760440 - RNA, 21 nt, Human
ccuaauuuguuuucccuucuu

SEQ ID NO: 2760441 - RNA, 13 nt, Human
ccuaauuuugaga

SEQ ID NO: 2760442 - RNA, 13 nt, Human
ccuacaccauucc

SEQ ID NO: 2760443 - RNA, 17 nt, Human
ccuacuuccccuuccua

SEQ ID NO: 2760444 - RNA, 16 nt, Human
ccuacuuucauaauaa

SEQ ID NO: 2760445 - RNA, 19 nt, Human
ccuagccagaggcucuaau

SEQ ID NO: 2760446 - RNA, 22 nt, Human
ccuagccagaggcucuaaugua

SEQ ID NO: 2760447 - RNA, 15 nt, Human
ccuagccgaccucag

SEQ ID NO: 2760448 - RNA, 16 nt, Human
ccuagccugccucccc

SEQ ID NO: 2760449 - RNA, 17 nt, Human
ccuaggagaggagugug

SEQ ID NO: 2760450 - RNA, 12 nt, Human
ccuaguccccag

SEQ ID NO: 2760451 - RNA, 13 nt, Human
ccuaguccccagc

SEQ ID NO: 2760452 - RNA, 17 nt, Human
ccuaguccccagccugc

SEQ ID NO: 2760453 - RNA, 20 nt, Human
ccuaguccccagccugcucc

SEQ ID NO: 2760454 - RNA, 16 nt, Human
ccuagucucuacccag

SEQ ID NO: 2760455 - RNA, 16 nt, Human
ccuagucucuaucauu

SEQ ID NO: 2760456 - RNA, 17 nt, Human
ccacccucccacugcca

SEQ ID NO: 2760457 - RNA, 14 nt, Human
ccacccuugccaug

SEQ ID NO: 2760458 - RNA, 14 nt, Human
ccaccgcgcccagc

SEQ ID NO: 2760459 - RNA, 17 nt, Human
ccaccucccugcaauaa

SEQ ID NO: 2760460 - RNA, 20 nt, Human
ccaccucgcagguucaagca

SEQ ID NO: 2760461 - RNA, 13 nt, Human
ccaccugccuaua

SEQ ID NO: 2760462 - RNA, 19 nt, Human
ccaccugccuauauuuuuu

SEQ ID NO: 2760463 - RNA, 20 nt, Human
ccaccuucuggguucaagcg

SEQ ID NO: 2760464 - RNA, 19 nt, Human
ccacgcucugggucgccgg

SEQ ID NO: 2760465 - RNA, 17 nt, Human
ccacuaaaaucaaacaa

SEQ ID NO: 2760466 - RNA, 14 nt, Human
ccacuagcccuccu

SEQ ID NO: 2760467 - RNA, 18 nt, Human
ccacuagcccuccucucc

SEQ ID NO: 2760468 - RNA, 14 nt, Human
ccacucagagaaac

SEQ ID NO: 2760469 - RNA, 18 nt, Human
ccacucauaauucuucac

SEQ ID NO: 2760470 - RNA, 21 nt, Human
ccacucugagucccagagcca

SEQ ID NO: 2760471 - RNA, 17 nt, Human
ccacugcagaagacagu

SEQ ID NO: 2760472 - RNA, 17 nt, Human
ccacugccaaagaacuu

SEQ ID NO: 2760473 - RNA, 17 nt, Human
ccacuggacucaccucc

SEQ ID NO: 2760474 - RNA, 16 nt, Human
ccacuuauaggaauug

SEQ ID NO: 2760475 - RNA, 19 nt, Human
ccacuucaagugaccacca

SEQ ID NO: 2760476 - RNA, 13 nt, Human
ccacuucacuuuu

SEQ ID NO: 2760477 - RNA, 14 nt, Human
ccacuucagccucc

SEQ ID NO: 2760478 - RNA, 23 nt, Human
ccacuucauucuugaaagcugug

SEQ ID NO: 2760479 - RNA, 19 nt, Human
ccacuuggacaugggcccc

SEQ ID NO: 2760480 - RNA, 23 nt, Human
ccacuuggacaugggccccagau

SEQ ID NO: 2760481 - RNA, 16 nt, Human
ccacuuuaucuugaau

SEQ ID NO: 2760482 - RNA, 23 nt, Human
ccacuuuauuucuuuuuguuccc

SEQ ID NO: 2760483 - RNA, 14 nt, Human
ccagaaagcaguug

SEQ ID NO: 2760484 - RNA, 17 nt, Human
ccagaaagugacaagcu

SEQ ID NO: 2760485 - RNA, 15 nt, Human
ccagaaugaccuggc

SEQ ID NO: 2760486 - RNA, 15 nt, Human
ccagaccagcaggcu

SEQ ID NO: 2760487 - RNA, 14 nt, Human
ccagagaagccaaa

SEQ ID NO: 2760488 - RNA, 16 nt, Human
ccagagaagccaaaag

SEQ ID NO: 2760489 - RNA, 20 nt, Human
ccagagcaagacccugaaga

SEQ ID NO: 2760490 - RNA, 13 nt, Human
ccagagcuacagg

SEQ ID NO: 2760491 - RNA, 17 nt, Human
ccagagcuacaggcccc

SEQ ID NO: 2760492 - RNA, 11 nt, Human
ccagauauacu

SEQ ID NO: 2760493 - RNA, 13 nt, Human
ccagaucaagccu

SEQ ID NO: 2760494 - RNA, 16 nt, Human
ccagaucaagccugcc

SEQ ID NO: 2760495 - RNA, 17 nt, Human
ccagaucaagccugccu

SEQ ID NO: 2760496 - RNA, 15 nt, Human
ccagaucauugugaa

SEQ ID NO: 2760497 - RNA, 19 nt, Human
ccagaucauugugaaauua

SEQ ID NO: 2760498 - RNA, 16 nt, Human
ccagauccuggaaauc

SEQ ID NO: 2760499 - RNA, 20 nt, Human
ccagaugagaguacacccca

SEQ ID NO: 2760500 - RNA, 18 nt, Human
ccagauuuuuacacaugu

SEQ ID NO: 2760501 - RNA, 22 nt, Human
ccagcaaauucgcugcaaccug

SEQ ID NO: 2760502 - RNA, 13 nt, Human
ccagcacagccuc

SEQ ID NO: 2760503 - RNA, 18 nt, Human
ccagcacuaaagcagugg

SEQ ID NO: 2760504 - RNA, 20 nt, Human
ccagcacuuugggaggcuga

SEQ ID NO: 2760505 - RNA, 23 nt, Human
ccagcacuuugggaggcugaggc

SEQ ID NO: 2760506 - RNA, 14 nt, Human
ccagcagccagcca

SEQ ID NO: 2760507 - RNA, 23 nt, Human
ccagcagccagccaacccuuuca

SEQ ID NO: 2760508 - RNA, 20 nt, Human
ccagcagccuggcucuccca

SEQ ID NO: 2760509 - RNA, 17 nt, Human
ccagcaguucagagcug

SEQ ID NO: 2760510 - RNA, 22 nt, Human
ccagcaguucagagcugcccuc

SEQ ID NO: 2760511 - RNA, 23 nt, Human
ccagcaguucagagcugcccucu

SEQ ID NO: 2760512 - RNA, 15 nt, Human
ccagccagcacagcc

SEQ ID NO: 2760513 - RNA, 14 nt, Human
ccagccagcagcca

SEQ ID NO: 2760514 - RNA, 14 nt, Human
ccagccagcaguuc

SEQ ID NO: 2760515 - RNA, 19 nt, Human
ccagccagggcaagagagc

SEQ ID NO: 2760516 - RNA, 18 nt, Human
ccagccccguagacgugc

SEQ ID NO: 2760517 - RNA, 13 nt, Human
ccagcccuccuua

SEQ ID NO: 2760518 - RNA, 12 nt, Human
ccagccucagcc

SEQ ID NO: 2760519 - RNA, 16 nt, Human
ccagccucagccuccc

SEQ ID NO: 2760520 - RNA, 17 nt, Human
ccagccucagccuccca

SEQ ID NO: 2760521 - RNA, 14 nt, Human
ccagccugcucccu

SEQ ID NO: 2760522 - RNA, 15 nt, Human
ccagccugcucccua

SEQ ID NO: 2760523 - RNA, 17 nt, Human
ccagccugcucccuagc

SEQ ID NO: 2760524 - RNA, 19 nt, Human
ccagccugcucccuagcca

SEQ ID NO: 2760525 - RNA, 23 nt, Human
ccagccugggugacagagcaaga

SEQ ID NO: 2760526 - RNA, 15 nt, Human
ccagcuaauuuuugu

SEQ ID NO: 2760527 - RNA, 20 nt, Human
ccagcuacuugggaggcuga

SEQ ID NO: 2760528 - RNA, 23 nt, Human
ccagcuacuugggaggcugaggc

SEQ ID NO: 2760529 - RNA, 14 nt, Human
ccagcuagaauuca

SEQ ID NO: 2760530 - RNA, 14 nt, Human
ccagcucagggcuc

SEQ ID NO: 2760531 - RNA, 12 nt, Human
ccagcucugcau

SEQ ID NO: 2760532 - RNA, 16 nt, Human
ccagcugcccccagag

SEQ ID NO: 2760533 - RNA, 16 nt, Human
ccagcuggggccaggc

SEQ ID NO: 2760534 - RNA, 14 nt, Human
ccagcuuaguucaa

SEQ ID NO: 2760535 - RNA, 12 nt, Human
ccagcuuugagg

SEQ ID NO: 2760536 - RNA, 12 nt, Human
ccaggacgcccu

SEQ ID NO: 2760537 - RNA, 16 nt, Human
ccaggacgcccucacu

SEQ ID NO: 2760538 - RNA, 23 nt, Human
ccaggagauggaaguugcaguga

SEQ ID NO: 2760539 - RNA, 14 nt, Human
ccaggagcugggca

SEQ ID NO: 2760540 - RNA, 23 nt, Human
ccaggagcugggcagaaggccaa

SEQ ID NO: 2760541 - RNA, 23 nt, Human
ccaggaggugcuaucgcaccacu

SEQ ID NO: 2760542 - RNA, 16 nt, Human
ccaggaguacacccca

SEQ ID NO: 2760543 - RNA, 23 nt, Human
ccaggaguacaccccaacagcac

SEQ ID NO: 2760544 - RNA, 16 nt, Human
ccaggaguuuggccag

SEQ ID NO: 2760545 - RNA, 18 nt, Human
ccaggaguuuggccagaa

SEQ ID NO: 2760546 - RNA, 19 nt, Human
ccaggaguuuggccagaag

SEQ ID NO: 2760547 - RNA, 18 nt, Human
ccaggaucguuuuuuccc

SEQ ID NO: 2760548 - RNA, 20 nt, Human
ccaggcacacugagccagca

SEQ ID NO: 2760549 - RNA, 14 nt, Human
ccaggcaccaggac

SEQ ID NO: 2760550 - RNA, 22 nt, Human
ccaggcaccaggacuagggcug

SEQ ID NO: 2760551 - RNA, 19 nt, Human
ccaggcacccccagaauga

SEQ ID NO: 2760552 - RNA, 20 nt, Human
ccaggcauccuccacaauag

SEQ ID NO: 2760553 - RNA, 21 nt, Human
ccaggccccaagcccacuggg

SEQ ID NO: 2760554 - RNA, 15 nt, Human
ccaggcggguccggg

SEQ ID NO: 2760555 - RNA, 19 nt, Human
ccaggcggguccgggucgc

SEQ ID NO: 2760556 - RNA, 12 nt, Human
ccaggcugagcc

SEQ ID NO: 2760557 - RNA, 13 nt, Human
ccaggcugagccu

SEQ ID NO: 2760558 - RNA, 18 nt, Human
ccaggcuggagugcagug

SEQ ID NO: 2760559 - RNA, 21 nt, Human
ccaggcuggcgugcagcauca

SEQ ID NO: 2760560 - RNA, 20 nt, Human
ccaggcugggucgcccugga

SEQ ID NO: 2760561 - RNA, 22 nt, Human
ccaggcuuuuuuaucaugugaa

SEQ ID NO: 2760562 - RNA, 17 nt, Human
ccagggcuacgcgcgcu

SEQ ID NO: 2760563 - RNA, 20 nt, Human
ccagggcuacgcgcgcuccg

SEQ ID NO: 2760564 - RNA, 21 nt, Human
ccagggcuacgcgcgcuccgc

SEQ ID NO: 2760565 - RNA, 23 nt, Human
ccagggcuacgcgcgcuccgcgc

SEQ ID NO: 2760566 - RNA, 14 nt, Human
ccagggcucagccu

SEQ ID NO: 2760567 - RNA, 23 nt, Human
ccagguaccuucucaccugugag

SEQ ID NO: 2760568 - RNA, 19 nt, Human
ccagguauucguuaucuaa

SEQ ID NO: 2760569 - RNA, 20 nt, Human
ccaggugguaagcaccagga

SEQ ID NO: 2760570 - RNA, 14 nt, Human
ccagguucuuucuu

SEQ ID NO: 2760571 - RNA, 22 nt, Human
ccagguucuuucuuuaaagcag

SEQ ID NO: 2760572 - RNA, 13 nt, Human
ccaguagaugcca

SEQ ID NO: 2760573 - RNA, 16 nt, Human
ccaguagaugccaccc

SEQ ID NO: 2760574 - RNA, 21 nt, Human
ccaguagaugccacuagcccu

SEQ ID NO: 2760575 - RNA, 23 nt, Human
ccaguagaugccacuagcccucc

SEQ ID NO: 2760576 - RNA, 16 nt, Human
ccaguaugcuuggacu

SEQ ID NO: 2760577 - RNA, 18 nt, Human
ccagucaggccuaucuaa

SEQ ID NO: 2760578 - RNA, 16 nt, Human
ccagucauuuaauaaa

SEQ ID NO: 2760579 - RNA, 21 nt, Human
ccaguccauugggcaggcaga

SEQ ID NO: 2760580 - RNA, 12 nt, Human
ccagucccuccc

SEQ ID NO: 2760581 - RNA, 16 nt, Human
ccagucccuccccaaa

SEQ ID NO: 2760582 - RNA, 14 nt, Human
ccagugaccaaccu

SEQ ID NO: 2760583 - RNA, 20 nt, Human
ccagugagacagcucugcau

SEQ ID NO: 2760584 - RNA, 15 nt, Human
ccaguuguuucuacu

SEQ ID NO: 2760585 - RNA, 12 nt, Human
ccaguuuuccua

SEQ ID NO: 2760586 - RNA, 20 nt, Human
ccauaauguuacauuauuau

SEQ ID NO: 2760587 - RNA, 21 nt, Human
ccauaccccuggccaaggaag

SEQ ID NO: 2760588 - RNA, 14 nt, Human
ccauacucuguaac

SEQ ID NO: 2760589 - RNA, 17 nt, Human
ccauagucauucugccu

SEQ ID NO: 2760590 - RNA, 22 nt, Human
ccauagucauucugccugcccu

SEQ ID NO: 2760591 - RNA, 17 nt, Human
ccauauacagcucagaa

SEQ ID NO: 2760592 - RNA, 16 nt, Human
ccaucaccuuagacca

SEQ ID NO: 2760593 - RNA, 19 nt, Human
ccaucagcuccagcugcuc

SEQ ID NO: 2760594 - RNA, 17 nt, Human
ccaucaguuccagccuu

SEQ ID NO: 2760595 - RNA, 12 nt, Human
ccaucccggccg

SEQ ID NO: 2760596 - RNA, 14 nt, Human
ccaucccggccggc

SEQ ID NO: 2760597 - RNA, 15 nt, Human
ccaucccggccggcg

SEQ ID NO: 2760598 - RNA, 12 nt, Human
ccaucccucccu

SEQ ID NO: 2760599 - RNA, 12 nt, Human
ccauccugaggc

SEQ ID NO: 2760600 - RNA, 18 nt, Human
ccauccugaggcuccacu

SEQ ID NO: 2760601 - RNA, 18 nt, Human
ccauccugccccugagcc

SEQ ID NO: 2760602 - RNA, 19 nt, Human
ccauccugccccugagccc

SEQ ID NO: 2760603 - RNA, 18 nt, Human
ccaucucaaccucuuccc

SEQ ID NO: 2760604 - RNA, 15 nt, Human
ccaucucaggugugu

SEQ ID NO: 2760605 - RNA, 19 nt, Human
ccaucucuuguuuaaauuc

SEQ ID NO: 2760606 - RNA, 12 nt, Human
cauucucugaag

SEQ ID NO: 2760607 - RNA, 17 nt, Human
cauucugcuuucaucuu

SEQ ID NO: 2760608 - RNA, 24 nt, Human
cauucuggaauaauccuaaacaua

SEQ ID NO: 2760609 - RNA, 13 nt, Human
cauucuucccuug

SEQ ID NO: 2760610 - RNA, 19 nt, Human
cauucuuccugauuauuuu

SEQ ID NO: 2760611 - RNA, 20 nt, Human
cauugcagaggggcccauga

SEQ ID NO: 2760612 - RNA, 14 nt, Human
cauugccuguaaca

SEQ ID NO: 2760613 - RNA, 21 nt, Human
cauugccuuaacuggagcccc

SEQ ID NO: 2760614 - RNA, 15 nt, Human
cauuguaaaugugcu

SEQ ID NO: 2760615 - RNA, 23 nt, Human
cauuguaaaugugcuuuuaaaaa

SEQ ID NO: 2760616 - RNA, 22 nt, Human
cauugucugugaagugagaccu

SEQ ID NO: 2760617 - RNA, 14 nt, Human
cauugugaaauuau

SEQ ID NO: 2760618 - RNA, 20 nt, Human
cauuguggucacaggaagua

SEQ ID NO: 2760619 - RNA, 12 nt, Human
cauuguuauaua

SEQ ID NO: 2760620 - RNA, 20 nt, Human
cauuguuggcuguuccugca

SEQ ID NO: 2760621 - RNA, 19 nt, Human
cauuguugucugcaacucu

SEQ ID NO: 2760622 - RNA, 19 nt, Human
cauuguuugucugucuuca

SEQ ID NO: 2760623 - RNA, 19 nt, Human
cauuuaaagcuuauuaaaa

SEQ ID NO: 2760624 - RNA, 22 nt, Human
cauuuaaagcuuauuaaaacuc

SEQ ID NO: 2760625 - RNA, 13 nt, Human
cauuuaaauaaag

SEQ ID NO: 2760626 - RNA, 22 nt, Human
cauuuaaauaaaguguuugaaa

SEQ ID NO: 2760627 - RNA, 12 nt, Human
cauuuaauaugg

SEQ ID NO: 2760628 - RNA, 17 nt, Human
cauuuacuaugcacaac

SEQ ID NO: 2760629 - RNA, 14 nt, Human
cauuuacuuuuaaa

SEQ ID NO: 2760630 - RNA, 15 nt, Human
cauuuacuuuuaaac

SEQ ID NO: 2760631 - RNA, 14 nt, Human
cauuuaggccaugg

SEQ ID NO: 2760632 - RNA, 14 nt, Human
cauuuaguuauaaa

SEQ ID NO: 2760633 - RNA, 13 nt, Human
cauuuaucuuugu

SEQ ID NO: 2760634 - RNA, 14 nt, Human
cauuuauguuccuu

SEQ ID NO: 2760635 - RNA, 19 nt, Human
cauuucaaaagguauuuau

SEQ ID NO: 2760636 - RNA, 14 nt, Human
cauuuccaaauuca

SEQ ID NO: 2760637 - RNA, 18 nt, Human
cauuuccauuuacccuuc

SEQ ID NO: 2760638 - RNA, 17 nt, Human
cauuucccccuagccug

SEQ ID NO: 2760639 - RNA, 22 nt, Human
cauuucccccuagccugccucc

SEQ ID NO: 2760640 - RNA, 13 nt, Human
cauuuccuaaaua

SEQ ID NO: 2760641 - RNA, 18 nt, Human
cauuuccuauguaacugc

SEQ ID NO: 2760642 - RNA, 18 nt, Human
cauuuccucaaaaagauu

SEQ ID NO: 2760643 - RNA, 22 nt, Human
cauuuccucagacucuaagaaa

SEQ ID NO: 2760644 - RNA, 13 nt, Human
cauuucuaaagcc

SEQ ID NO: 2760645 - RNA, 13 nt, Human
cauuucuauuuau

SEQ ID NO: 2760646 - RNA, 16 nt, Human
cauuucuauuuauuua

SEQ ID NO: 2760647 - RNA, 18 nt, Human
cauuucucaucuuuuuac

SEQ ID NO: 2760648 - RNA, 11 nt, Human
cauuucucugg

SEQ ID NO: 2760649 - RNA, 18 nt, Human
cauuugaaugcauuuugu

SEQ ID NO: 2760650 - RNA, 21 nt, Human
cauuugaaugcauuuuguuug

SEQ ID NO: 2760651 - RNA, 19 nt, Human
cauuuggauccugugugga

SEQ ID NO: 2760652 - RNA, 19 nt, Human
cauuugggaugcuacucua

SEQ ID NO: 2760653 - RNA, 11 nt, Human
cauuugguaag

SEQ ID NO: 2760654 - RNA, 18 nt, Human
cauuuguagcauccucuu

SEQ ID NO: 2760655 - RNA, 14 nt, Human
cauuuguauaaaau

SEQ ID NO: 2760656 - RNA, 17 nt, Human
cauuuguauaaaauaau

SEQ ID NO: 2760657 - RNA, 12 nt, Human
cauuuuaaaaaa

SEQ ID NO: 2760658 - RNA, 13 nt, Human
cauuuuaaaaaau

SEQ ID NO: 2760659 - RNA, 14 nt, Human
cauuuuaauuauua

SEQ ID NO: 2760660 - RNA, 16 nt, Human
cauuuuacuacuuuaa

SEQ ID NO: 2760661 - RNA, 22 nt, Human
cauuuuacuguacagacagaaa

SEQ ID NO: 2760662 - RNA, 14 nt, Human
cauuuuacuuuaau

SEQ ID NO: 2760663 - RNA, 14 nt, Human
cauuuucaaaaugg

SEQ ID NO: 2760664 - RNA, 20 nt, Human
cauuuucuggguguuuucuu

SEQ ID NO: 2760665 - RNA, 21 nt, Human
cauuuucuucucacauuuaua

SEQ ID NO: 2760666 - RNA, 22 nt, Human
cauuuuguuugguauuguauuu

SEQ ID NO: 2760667 - RNA, 23 nt, Human
cauuuuuuuuuucaauaaaacuu

SEQ ID NO: 2760668 - RNA, 17 nt, Human
ccaaaaaucucaauauu

SEQ ID NO: 2760669 - RNA, 20 nt, Human
ccaaaaauguguaagaacaa

SEQ ID NO: 2760670 - RNA, 13 nt, Human
ccaaaagguauuu

SEQ ID NO: 2760671 - RNA, 15 nt, Human
ccaaaauauaaucag

SEQ ID NO: 2760672 - RNA, 21 nt, Human
ccaaacauccuacaagacaca

SEQ ID NO: 2760673 - RNA, 22 nt, Human
ccaaacauccuacaagacacag

SEQ ID NO: 2760674 - RNA, 17 nt, Human
ccaaacugccuaagccc

SEQ ID NO: 2760675 - RNA, 18 nt, Human
ccaaacugccuaagcccu

SEQ ID NO: 2760676 - RNA, 12 nt, Human
ccaaagcccucc

SEQ ID NO: 2760677 - RNA, 14 nt, Human
ccaaagcccucccu

SEQ ID NO: 2760678 - RNA, 18 nt, Human
ccaaaggcuccugagaca

SEQ ID NO: 2760679 - RNA, 22 nt, Human
ccaaaggcuccugagacacaug

SEQ ID NO: 2760680 - RNA, 16 nt, Human
ccaaaggcuuugcccu

SEQ ID NO: 2760681 - RNA, 18 nt, Human
ccaaaguccugggauuac

SEQ ID NO: 2760682 - RNA, 13 nt, Human
ccaaagugcuggg

SEQ ID NO: 2760683 - RNA, 19 nt, Human
ccaaagugcugggauuaac

SEQ ID NO: 2760684 - RNA, 18 nt, Human
ccaaagugguauagaaau

SEQ ID NO: 2760685 - RNA, 21 nt, Human
ccaaagugugacucauuaaau

SEQ ID NO: 2760686 - RNA, 14 nt, Human
ccaaauauaaauaa

SEQ ID NO: 2760687 - RNA, 23 nt, Human
ccaaauauaaauaaaaauaaucc

SEQ ID NO: 2760688 - RNA, 22 nt, Human
ccaaauguucaucaaugaauga

SEQ ID NO: 2760689 - RNA, 16 nt, Human
ccaaauugagcuaggg

SEQ ID NO: 2760690 - RNA, 18 nt, Human
ccaacaaagcaauaauag

SEQ ID NO: 2760691 - RNA, 17 nt, Human
ccaacacaauucuucuu

SEQ ID NO: 2760692 - RNA, 16 nt, Human
ccaacacgagcaggcu

SEQ ID NO: 2760693 - RNA, 18 nt, Human
ccaacagcacccucucca

SEQ ID NO: 2760694 - RNA, 19 nt, Human
ccaacagcacccucuccag

SEQ ID NO: 2760695 - RNA, 18 nt, Human
ccaaccuggaguugaaaa

SEQ ID NO: 2760696 - RNA, 18 nt, Human
ccaaccuucugaggagcu

SEQ ID NO: 2760697 - RNA, 16 nt, Human
ccaacggcaagggaac

SEQ ID NO: 2760698 - RNA, 14 nt, Human
ccaacguggcccag

SEQ ID NO: 2760699 - RNA, 24 nt, Human
ccaacucauccacguccugucugu

SEQ ID NO: 2760700 - RNA, 15 nt, Human
ccaacuccagaaagu

SEQ ID NO: 2760701 - RNA, 17 nt, Human
ccaacuuauauuucugc

SEQ ID NO: 2760702 - RNA, 21 nt, Human
ccaagaagauaaucuccaaag

SEQ ID NO: 2760703 - RNA, 11 nt, Human
ccaagcaguug

SEQ ID NO: 2760704 - RNA, 16 nt, Human
ccaagcauuuagaugu

SEQ ID NO: 2760705 - RNA, 18 nt, Human
ccaagcugguggcucugu

SEQ ID NO: 2760706 - RNA, 23 nt, Human
ccaaggaccggccuuugcaccuc

SEQ ID NO: 2760707 - RNA, 21 nt, Human
ccaaggaugccccgucccccu

SEQ ID NO: 2760708 - RNA, 19 nt, Human
ccaaggcccccgggccgac

SEQ ID NO: 2760709 - RNA, 11 nt, Human
ccaaggcugga

SEQ ID NO: 2760710 - RNA, 13 nt, Human
ccaagugauugaa

SEQ ID NO: 2760711 - RNA, 17 nt, Human
ccaagugauugaaaccu

SEQ ID NO: 2760712 - RNA, 20 nt, Human
ccaaguuauccaccugccuu

SEQ ID NO: 2760713 - RNA, 22 nt, Human
ccaaguugugcuugagccagga

SEQ ID NO: 2760714 - RNA, 18 nt, Human
ccaaguuuauauacaauu

SEQ ID NO: 2760715 - RNA, 16 nt, Human
ccaauaaauaugaugu

SEQ ID NO: 2760716 - RNA, 23 nt, Human
ccaauaaauaugauguuauggug

SEQ ID NO: 2760717 - RNA, 17 nt, Human
ccaauauuauaauuuuu

SEQ ID NO: 2760718 - RNA, 17 nt, Human
ccaaucaguagccagca

SEQ ID NO: 2760719 - RNA, 16 nt, Human
ccaaucaugaauuagu

SEQ ID NO: 2760720 - RNA, 12 nt, Human
ccaaucauuuua

SEQ ID NO: 2760721 - RNA, 21 nt, Human
ccaaucauuuuaauuauuauu

SEQ ID NO: 2760722 - RNA, 14 nt, Human
ccaaugaaaugagu

SEQ ID NO: 2760723 - RNA, 16 nt, Human
ccaauuagcuccuccu

SEQ ID NO: 2760724 - RNA, 11 nt, Human
ccaauuuuugg

SEQ ID NO: 2760725 - RNA, 11 nt, Human
ccacaaaccca

SEQ ID NO: 2760726 - RNA, 21 nt, Human
ccacaaacccaagggcagggg

SEQ ID NO: 2760727 - RNA, 15 nt, Human
ccacaagaaaugaaa

SEQ ID NO: 2760728 - RNA, 12 nt, Human
ccacaagaaccc

SEQ ID NO: 2760729 - RNA, 16 nt, Human
ccacaagaacccccuu

SEQ ID NO: 2760730 - RNA, 12 nt, Human
ccacaagacugc

SEQ ID NO: 2760731 - RNA, 23 nt, Human
ccacaaguaaaaggaaaugcucc

SEQ ID NO: 2760732 - RNA, 17 nt, Human
ccacaauuaauuuuaga

SEQ ID NO: 2760733 - RNA, 18 nt, Human
ccacacaugggaucaagu

SEQ ID NO: 2760734 - RNA, 23 nt, Human
ccacaccaaccuucugaggagcu

SEQ ID NO: 2760735 - RNA, 22 nt, Human
ccacacuguccauucuuccucc

SEQ ID NO: 2760736 - RNA, 14 nt, Human
ccacagaagcucca

SEQ ID NO: 2760737 - RNA, 22 nt, Human
ccacagaagugcuuucuucucc

SEQ ID NO: 2760738 - RNA, 15 nt, Human
ccacagcuguaugau

SEQ ID NO: 2760739 - RNA, 22 nt, Human
ccacagcuguaugauucccagc

SEQ ID NO: 2760740 - RNA, 15 nt, Human
ccacaggaaccacaa

SEQ ID NO: 2760741 - RNA, 13 nt, Human
ccacauccagccu

SEQ ID NO: 2760742 - RNA, 16 nt, Human
ccacaucccacucaca

SEQ ID NO: 2760743 - RNA, 11 nt, Human
ccacaucugag

SEQ ID NO: 2760744 - RNA, 15 nt, Human
ccacaucugagagau

SEQ ID NO: 2760745 - RNA, 19 nt, Human
ccacaucugagagaugaca

SEQ ID NO: 2760746 - RNA, 14 nt, Human
ccacaucugagccc

SEQ ID NO: 2760747 - RNA, 20 nt, Human
ccacauggcuucaccugucc

SEQ ID NO: 2760748 - RNA, 20 nt, Human
ccacaugggugaacacucaa

SEQ ID NO: 2760749 - RNA, 17 nt, Human
ccacauuucccccuagc

SEQ ID NO: 2760750 - RNA, 23 nt, Human
ccacauuucccccuagccugccu

SEQ ID NO: 2760751 - RNA, 16 nt, Human
ccaccagguucuuucu

SEQ ID NO: 2760752 - RNA, 15 nt, Human
ccaccauggccagcu

SEQ ID NO: 2760753 - RNA, 15 nt, Human
ccacccgcccaccgc

SEQ ID NO: 2760754 - RNA, 21 nt, Human
ccacccucagaugcacaugag

SEQ ID NO: 2760755 - RNA, 12 nt, Human
ccacccucccac

SEQ ID NO: 2760756 - RNA, 19 nt, Human
cauccaaaggcuccugaga

SEQ ID NO: 2760757 - RNA, 19 nt, Human
cauccauggugugcuggcu

SEQ ID NO: 2760758 - RNA, 14 nt, Human
cauccauuaaugua

SEQ ID NO: 2760759 - RNA, 16 nt, Human
cauccauucuccugag

SEQ ID NO: 2760760 - RNA, 14 nt, Human
cauccauucuuccc

SEQ ID NO: 2760761 - RNA, 21 nt, Human
caucccacccgcccaccgcag

SEQ ID NO: 2760762 - RNA, 16 nt, Human
caucccacucacaaca

SEQ ID NO: 2760763 - RNA, 23 nt, Human
caucccacucacaacagcugccu

SEQ ID NO: 2760764 - RNA, 13 nt, Human
cauccccaggccc

SEQ ID NO: 2760765 - RNA, 19 nt, Human
cauccccaggcccugcucu

SEQ ID NO: 2760766 - RNA, 19 nt, Human
caucccuagucucuaccca

SEQ ID NO: 2760767 - RNA, 21 nt, Human
caucccuagucucuacccagu

SEQ ID NO: 2760768 - RNA, 22 nt, Human
caucccuagucucuacccagua

SEQ ID NO: 2760769 - RNA, 13 nt, Human
caucccucccucc

SEQ ID NO: 2760770 - RNA, 17 nt, Human
caucccucccuccaccu

SEQ ID NO: 2760771 - RNA, 16 nt, Human
caucccuccugggaau

SEQ ID NO: 2760772 - RNA, 13 nt, Human
cauccgaggcagg

SEQ ID NO: 2760773 - RNA, 19 nt, Human
cauccuaagacagaggaac

SEQ ID NO: 2760774 - RNA, 16 nt, Human
cauccuacaagacaca

SEQ ID NO: 2760775 - RNA, 17 nt, Human
cauccuagucucuauca

SEQ ID NO: 2760776 - RNA, 13 nt, Human
cauccugaggcuc

SEQ ID NO: 2760777 - RNA, 22 nt, Human
cauccugaggcuccacuugguc

SEQ ID NO: 2760778 - RNA, 13 nt, Human
cauccugcaggca

SEQ ID NO: 2760779 - RNA, 19 nt, Human
cauccugccccugagccca

SEQ ID NO: 2760780 - RNA, 22 nt, Human
cauccugccccugagcccaugg

SEQ ID NO: 2760781 - RNA, 19 nt, Human
cauccuuccucacaccagg

SEQ ID NO: 2760782 - RNA, 19 nt, Human
cauccuuuucauugccaug

SEQ ID NO: 2760783 - RNA, 22 nt, Human
caucgcaauguaagacucggga

SEQ ID NO: 2760784 - RNA, 22 nt, Human
caucgucuucuuggccauggga

SEQ ID NO: 2760785 - RNA, 21 nt, Human
caucuagcaugucgucaaagc

SEQ ID NO: 2760786 - RNA, 13 nt, Human
caucucaaaaaaa

SEQ ID NO: 2760787 - RNA, 15 nt, Human
caucucaaaaaaaaa

SEQ ID NO: 2760788 - RNA, 15 nt, Human
caucucacauuuucc

SEQ ID NO: 2760789 - RNA, 21 nt, Human
caucucacauuuucccuuccc

SEQ ID NO: 2760790 - RNA, 13 nt, Human
caucucagcucac

SEQ ID NO: 2760791 - RNA, 14 nt, Human
caucucaggugugu

SEQ ID NO: 2760792 - RNA, 21 nt, Human
caucucagguguguugcagug

SEQ ID NO: 2760793 - RNA, 19 nt, Human
caucuccucaacucugagu

SEQ ID NO: 2760794 - RNA, 21 nt, Human
caucucuggccuguacccagu

SEQ ID NO: 2760795 - RNA, 23 nt, Human
caucucuucuggguuccuuccuc

SEQ ID NO: 2760796 - RNA, 15 nt, Human
caucugaaaauugau

SEQ ID NO: 2760797 - RNA, 13 nt, Human
caucugagaaaag

SEQ ID NO: 2760798 - RNA, 16 nt, Human
caucugaugagaacaa

SEQ ID NO: 2760799 - RNA, 14 nt, Human
caucugucaccaag

SEQ ID NO: 2760800 - RNA, 12 nt, Human
caucuucucugg

SEQ ID NO: 2760801 - RNA, 12 nt, Human
caucuuucacau

SEQ ID NO: 2760802 - RNA, 14 nt, Human
caucuuucccuccu

SEQ ID NO: 2760803 - RNA, 23 nt, Human
caugaaaacaauucuuauugacu

SEQ ID NO: 2760804 - RNA, 21 nt, Human
caugaacuuguaaaggaauuu

SEQ ID NO: 2760805 - RNA, 21 nt, Human
caugaagagauuuuucaugau

SEQ ID NO: 2760806 - RNA, 22 nt, Human
caugaagagauuuuucaugauu

SEQ ID NO: 2760807 - RNA, 18 nt, Human
caugaagauguagaggag

SEQ ID NO: 2760808 - RNA, 18 nt, Human
caugaaggggcggcggcc

SEQ ID NO: 2760809 - RNA, 17 nt, Human
caugaauuaguuuuaua

SEQ ID NO: 2760810 - RNA, 19 nt, Human
caugagagacagcaggucu

SEQ ID NO: 2760811 - RNA, 13 nt, Human
caugagggcugga

SEQ ID NO: 2760812 - RNA, 17 nt, Human
caugagggcuggaugcu

SEQ ID NO: 2760813 - RNA, 17 nt, Human
caugaguaacugauuug

SEQ ID NO: 2760814 - RNA, 19 nt, Human
caugaguaacugauuugua

SEQ ID NO: 2760815 - RNA, 14 nt, Human
caugagucagucug

SEQ ID NO: 2760816 - RNA, 12 nt, Human
caugauccugca

SEQ ID NO: 2760817 - RNA, 18 nt, Human
caugauccugcaauucca

SEQ ID NO: 2760818 - RNA, 20 nt, Human
caugauccugcaauuccacu

SEQ ID NO: 2760819 - RNA, 19 nt, Human
caugauguuuagaaacaca

SEQ ID NO: 2760820 - RNA, 20 nt, Human
caugauguuuagaaacacaa

SEQ ID NO: 2760821 - RNA, 21 nt, Human
caugauguuuagaaacacaac

SEQ ID NO: 2760822 - RNA, 18 nt, Human
caugcacuuggcugcaua

SEQ ID NO: 2760823 - RNA, 19 nt, Human
caugcacuuggcugcauaa

SEQ ID NO: 2760824 - RNA, 17 nt, Human
caugcauuacugcaugc

SEQ ID NO: 2760825 - RNA, 22 nt, Human
caugccaucucaaccucuuccc

SEQ ID NO: 2760826 - RNA, 14 nt, Human
caugccauuuaaag

SEQ ID NO: 2760827 - RNA, 23 nt, Human
caugccauuuaaagcuuauuaaa

SEQ ID NO: 2760828 - RNA, 15 nt, Human
caugcuaauuauaua

SEQ ID NO: 2760829 - RNA, 17 nt, Human
caugcugaacaucacag

SEQ ID NO: 2760830 - RNA, 16 nt, Human
caugcugagagagcug

SEQ ID NO: 2760831 - RNA, 21 nt, Human
caugcugagagagcuggaggc

SEQ ID NO: 2760832 - RNA, 12 nt, Human
caugcugauaaa

SEQ ID NO: 2760833 - RNA, 14 nt, Human
caugcugauaaacu

SEQ ID NO: 2760834 - RNA, 13 nt, Human
caugcugccaaua

SEQ ID NO: 2760835 - RNA, 19 nt, Human
caugcugccaauauccuaa

SEQ ID NO: 2760836 - RNA, 14 nt, Human
caugcugcugggga

SEQ ID NO: 2760837 - RNA, 19 nt, Human
caugcugcuggggaagaca

SEQ ID NO: 2760838 - RNA, 15 nt, Human
caugcugucuacacu

SEQ ID NO: 2760839 - RNA, 23 nt, Human
caugcugucuacacuaagagaga

SEQ ID NO: 2760840 - RNA, 20 nt, Human
cauggaaacgaagcaccauc

SEQ ID NO: 2760841 - RNA, 19 nt, Human
cauggaauuggagcucgug

SEQ ID NO: 2760842 - RNA, 17 nt, Human
cauggagguuaagcacu

SEQ ID NO: 2760843 - RNA, 22 nt, Human
cauggaucugguagggggaaaa

SEQ ID NO: 2760844 - RNA, 18 nt, Human
cauggcacucuauguucu

SEQ ID NO: 2760845 - RNA, 14 nt, Human
cauggccacaucug

SEQ ID NO: 2760846 - RNA, 18 nt, Human
cauggccacaucugagcc

SEQ ID NO: 2760847 - RNA, 12 nt, Human
caugggaaguga

SEQ ID NO: 2760848 - RNA, 13 nt, Human
caugggacaggga

SEQ ID NO: 2760849 - RNA, 15 nt, Human
caugggacagggagg

SEQ ID NO: 2760850 - RNA, 20 nt, Human
caugggacagggaggacgcu

SEQ ID NO: 2760851 - RNA, 12 nt, Human
caugggaggccu

SEQ ID NO: 2760852 - RNA, 14 nt, Human
caugggcacugugg

SEQ ID NO: 2760853 - RNA, 23 nt, Human
cauggugaaaccuggucucuaca

SEQ ID NO: 2760854 - RNA, 13 nt, Human
caugguggugugu

SEQ ID NO: 2760855 - RNA, 16 nt, Human
caugguuuuaaucugu

SEQ ID NO: 2760856 - RNA, 22 nt, Human
cauguacauccauggugugcug

SEQ ID NO: 2760857 - RNA, 14 nt, Human
cauguauuuuaaaa

SEQ ID NO: 2760858 - RNA, 16 nt, Human
caugucuagagaacac

SEQ ID NO: 2760859 - RNA, 21 nt, Human
caugugaaaucauucauuuuc

SEQ ID NO: 2760860 - RNA, 20 nt, Human
caugugauuccaucuugccc

SEQ ID NO: 2760861 - RNA, 15 nt, Human
caugugcuggccacc

SEQ ID NO: 2760862 - RNA, 16 nt, Human
cauguggcccaacaca

SEQ ID NO: 2760863 - RNA, 14 nt, Human
caugugugguacau

SEQ ID NO: 2760864 - RNA, 15 nt, Human
cauguuagccaggcu

SEQ ID NO: 2760865 - RNA, 11 nt, Human
cauguucacuu

SEQ ID NO: 2760866 - RNA, 21 nt, Human
cauguucacuuccaagagccu

SEQ ID NO: 2760867 - RNA, 15 nt, Human
cauguuccugggauc

SEQ ID NO: 2760868 - RNA, 13 nt, Human
cauguuggccagg

SEQ ID NO: 2760869 - RNA, 15 nt, Human
cauguuggccaggcu

SEQ ID NO: 2760870 - RNA, 16 nt, Human
cauguuucaggagaga

SEQ ID NO: 2760871 - RNA, 19 nt, Human
cauguuucaggagagaguu

SEQ ID NO: 2760872 - RNA, 17 nt, Human
cauuaaaaaugcauaua

SEQ ID NO: 2760873 - RNA, 19 nt, Human
cauuaaaaaugcauauacu

SEQ ID NO: 2760874 - RNA, 23 nt, Human
cauuaaaaaugcauauacuuuaa

SEQ ID NO: 2760875 - RNA, 22 nt, Human
cauuaaaacaauauuguuucua

SEQ ID NO: 2760876 - RNA, 20 nt, Human
cauuaaaauuuuuuuuguaa

SEQ ID NO: 2760877 - RNA, 17 nt, Human
cauuaaaguucuaguga

SEQ ID NO: 2760878 - RNA, 17 nt, Human
cauuaaauauaaagcaa

SEQ ID NO: 2760879 - RNA, 15 nt, Human
cauuaaauuuuagca

SEQ ID NO: 2760880 - RNA, 16 nt, Human
cauuaaauuuuagcaa

SEQ ID NO: 2760881 - RNA, 16 nt, Human
cauuagaacuucaagc

SEQ ID NO: 2760882 - RNA, 19 nt, Human
cauuagcauuugucaacaa

SEQ ID NO: 2760883 - RNA, 14 nt, Human
cauuauaaauaaau

SEQ ID NO: 2760884 - RNA, 12 nt, Human
cauuauaucaaa

SEQ ID NO: 2760885 - RNA, 15 nt, Human
cauuauaucaaaucu

SEQ ID NO: 2760886 - RNA, 23 nt, Human
cauuauaucaaaucuaccacugu

SEQ ID NO: 2760887 - RNA, 18 nt, Human
cauuauauuuauuacugu

SEQ ID NO: 2760888 - RNA, 16 nt, Human
cauuauccaucuuuca

SEQ ID NO: 2760889 - RNA, 16 nt, Human
cauuauggauaaagau

SEQ ID NO: 2760890 - RNA, 18 nt, Human
cauuauuggacuuccauu

SEQ ID NO: 2760891 - RNA, 17 nt, Human
cauucaaaaguugaaau

SEQ ID NO: 2760892 - RNA, 21 nt, Human
cauucaaauguauuacagugg

SEQ ID NO: 2760893 - RNA, 10 nt, Human
cauucaaguc

SEQ ID NO: 2760894 - RNA, 20 nt, Human
cauucaagucagcucuucuc

SEQ ID NO: 2760895 - RNA, 17 nt, Human
cauucacaucgcagauu

SEQ ID NO: 2760896 - RNA, 18 nt, Human
cauucagggcuauuuuuu

SEQ ID NO: 2760897 - RNA, 15 nt, Human
cauuccaagccucau

SEQ ID NO: 2760898 - RNA, 12 nt, Human
cauucccucucc

SEQ ID NO: 2760899 - RNA, 18 nt, Human
cauucccucuccaggaga

SEQ ID NO: 2760900 - RNA, 19 nt, Human
cauuccucaugaauguaaa

SEQ ID NO: 2760901 - RNA, 12 nt, Human
cauuccucugcc

SEQ ID NO: 2760902 - RNA, 18 nt, Human
cauuccucugcccuuccu

SEQ ID NO: 2760903 - RNA, 21 nt, Human
cauucucaagcccugcaguca

SEQ ID NO: 2760904 - RNA, 16 nt, Human
cauucucucuccugua

SEQ ID NO: 2760905 - RNA, 23 nt, Human
cauucucucuccuguacuuuuuc

SEQ ID NO: 2760906 - RNA, 19 nt, Human
caggugguaagcaccagga

SEQ ID NO: 2760907 - RNA, 21 nt, Human
caggugguaagcaccaggacg

SEQ ID NO: 2760908 - RNA, 15 nt, Human
caggugugagccacg

SEQ ID NO: 2760909 - RNA, 17 nt, Human
cagguuggagugcagug

SEQ ID NO: 2760910 - RNA, 23 nt, Human
caguaaagaacaucccuccuggg

SEQ ID NO: 2760911 - RNA, 14 nt, Human
caguaacggaacag

SEQ ID NO: 2760912 - RNA, 21 nt, Human
caguagcagcagcaucucuga

SEQ ID NO: 2760913 - RNA, 23 nt, Human
caguaguggugacugugggcucc

SEQ ID NO: 2760914 - RNA, 20 nt, Human
caguauauaacuaacaacca

SEQ ID NO: 2760915 - RNA, 13 nt, Human
caguauccaguac

SEQ ID NO: 2760916 - RNA, 21 nt, Human
caguaugaaaaugucauuguu

SEQ ID NO: 2760917 - RNA, 16 nt, Human
caguaugcuuggacug

SEQ ID NO: 2760918 - RNA, 22 nt, Human
caguauggcagcuuuccucaaa

SEQ ID NO: 2760919 - RNA, 17 nt, Human
caguauucccuuuugcu

SEQ ID NO: 2760920 - RNA, 18 nt, Human
caguauucccuuuugcug

SEQ ID NO: 2760921 - RNA, 19 nt, Human
caguauuguuccuuuugug

SEQ ID NO: 2760922 - RNA, 16 nt, Human
cagucaccucauggaa

SEQ ID NO: 2760923 - RNA, 19 nt, Human
cagucaccucauggaauug

SEQ ID NO: 2760924 - RNA, 23 nt, Human
cagucaggaaagagaacuuccag

SEQ ID NO: 2760925 - RNA, 17 nt, Human
cagucauucagauauga

SEQ ID NO: 2760926 - RNA, 15 nt, Human
cagucauuuaauaaa

SEQ ID NO: 2760927 - RNA, 19 nt, Human
caguccauugggcaggcag

SEQ ID NO: 2760928 - RNA, 20 nt, Human
caguccauugggcaggcaga

SEQ ID NO: 2760929 - RNA, 20 nt, Human
cagucccuccccaaaugcuu

SEQ ID NO: 2760930 - RNA, 22 nt, Human
cagucccugcagcucucuuucc

SEQ ID NO: 2760931 - RNA, 16 nt, Human
cagucucccucccuug

SEQ ID NO: 2760932 - RNA, 17 nt, Human
cagucucccucccuugg

SEQ ID NO: 2760933 - RNA, 14 nt, Human
cagucugacuguuu

SEQ ID NO: 2760934 - RNA, 17 nt, Human
cagucugacuguuucca

SEQ ID NO: 2760935 - RNA, 19 nt, Human
cagucugacuguuuccauc

SEQ ID NO: 2760936 - RNA, 14 nt, Human
cagucuguucccca

SEQ ID NO: 2760937 - RNA, 12 nt, Human
cagugaaagaaa

SEQ ID NO: 2760938 - RNA, 14 nt, Human
cagugaaagaaaau

SEQ ID NO: 2760939 - RNA, 18 nt, Human
cagugaaagaaaauaaca

SEQ ID NO: 2760940 - RNA, 20 nt, Human
cagugaaagaaaauaacaau

SEQ ID NO: 2760941 - RNA, 21 nt, Human
cagugaaagaaaauaacaaua

SEQ ID NO: 2760942 - RNA, 22 nt, Human
cagugaaagaaaauaacaauaa

SEQ ID NO: 2760943 - RNA, 23 nt, Human
cagugaaagaaaauaacaauaaa

SEQ ID NO: 2760944 - RNA, 23 nt, Human
cagugaaagaaaauaacgauaaa

SEQ ID NO: 2760945 - RNA, 18 nt, Human
cagugaccaaccuuuucc

SEQ ID NO: 2760946 - RNA, 21 nt, Human
cagugagacagcucugcauac

SEQ ID NO: 2760947 - RNA, 17 nt, Human
cagugagccaaauguaa

SEQ ID NO: 2760948 - RNA, 23 nt, Human
cagugaucaaguuauuuuuaauu

SEQ ID NO: 2760949 - RNA, 16 nt, Human
cagugauuaccaggga

SEQ ID NO: 2760950 - RNA, 20 nt, Human
cagugcaaauacucuggucc

SEQ ID NO: 2760951 - RNA, 20 nt, Human
cagugccgacagcucuccaa

SEQ ID NO: 2760952 - RNA, 20 nt, Human
cagugccuuucuucucucca

SEQ ID NO: 2760953 - RNA, 17 nt, Human
cagugcuuggcccagga

SEQ ID NO: 2760954 - RNA, 17 nt, Human
caguggcgcgaucucag

SEQ ID NO: 2760955 - RNA, 17 nt, Human
caguggcgugaucucag

SEQ ID NO: 2760956 - RNA, 16 nt, Human
cagugggagccagggc

SEQ ID NO: 2760957 - RNA, 17 nt, Human
cagugggggcagagcca

SEQ ID NO: 2760958 - RNA, 19 nt, Human
cagugggugguagcagagg

SEQ ID NO: 2760959 - RNA, 17 nt, Human
cagugucaaugcagccc

SEQ ID NO: 2760960 - RNA, 14 nt, Human
cagugucaggagga

SEQ ID NO: 2760961 - RNA, 15 nt, Human
cagugucaggaggaa

SEQ ID NO: 2760962 - RNA, 22 nt, Human
caguguccucaucuguaaaaug

SEQ ID NO: 2760963 - RNA, 15 nt, Human
cagugucugcuggag

SEQ ID NO: 2760964 - RNA, 18 nt, Human
cagugucugcuggagaca

SEQ ID NO: 2760965 - RNA, 15 nt, Human
cagugucuggcacuu

SEQ ID NO: 2760966 - RNA, 22 nt, Human
cagugucuggcacuugggacaa

SEQ ID NO: 2760967 - RNA, 20 nt, Human
caguguguggcuuucagagc

SEQ ID NO: 2760968 - RNA, 11 nt, Human
caguguucccu

SEQ ID NO: 2760969 - RNA, 23 nt, Human
caguuacucugaagggcaucaug

SEQ ID NO: 2760970 - RNA, 18 nt, Human
caguuagagauuuuuaaa

SEQ ID NO: 2760971 - RNA, 19 nt, Human
caguuagagauuuuuaaau

SEQ ID NO: 2760972 - RNA, 20 nt, Human
caguuagagauuuuuaaaua

SEQ ID NO: 2760973 - RNA, 23 nt, Human
caguuagagauuuuuaaauaaag

SEQ ID NO: 2760974 - RNA, 13 nt, Human
caguuauuauauu

SEQ ID NO: 2760975 - RNA, 15 nt, Human
caguuauuauauuua

SEQ ID NO: 2760976 - RNA, 15 nt, Human
caguuauuuuuaaac

SEQ ID NO: 2760977 - RNA, 11 nt, Human
caguucagagc

SEQ ID NO: 2760978 - RNA, 20 nt, Human
caguucagagcugcccucuc

SEQ ID NO: 2760979 - RNA, 23 nt, Human
caguucauauguaccauguacau

SEQ ID NO: 2760980 - RNA, 21 nt, Human
caguuccugagaccagccaac

SEQ ID NO: 2760981 - RNA, 15 nt, Human
caguucugaagaaga

SEQ ID NO: 2760982 - RNA, 17 nt, Human
caguucuuuggcugaaa

SEQ ID NO: 2760983 - RNA, 12 nt, Human
caguugaaaaga

SEQ ID NO: 2760984 - RNA, 14 nt, Human
caguugaaaagacu

SEQ ID NO: 2760985 - RNA, 20 nt, Human
caguugagacaagaaaauaa

SEQ ID NO: 2760986 - RNA, 20 nt, Human
caguugcauugacugucaca

SEQ ID NO: 2760987 - RNA, 22 nt, Human
caguugggacuacaggcgugag

SEQ ID NO: 2760988 - RNA, 12 nt, Human
caguuguugccc

SEQ ID NO: 2760989 - RNA, 18 nt, Human
caguuguugcccacagcu

SEQ ID NO: 2760990 - RNA, 16 nt, Human
caguuugguuucuagc

SEQ ID NO: 2760991 - RNA, 19 nt, Human
cauaaaauacaaaaacuua

SEQ ID NO: 2760992 - RNA, 12 nt, Human
cauaaaguaugu

SEQ ID NO: 2760993 - RNA, 19 nt, Human
cauaaccuuaccagauuuu

SEQ ID NO: 2760994 - RNA, 19 nt, Human
cauaagaaaacuaagaaau

SEQ ID NO: 2760995 - RNA, 20 nt, Human
cauaagaagucguuuuuagg

SEQ ID NO: 2760996 - RNA, 17 nt, Human
cauaaugguuuuuaaca

SEQ ID NO: 2760997 - RNA, 15 nt, Human
cauaauuauuauuug

SEQ ID NO: 2760998 - RNA, 20 nt, Human
cauacaaaaauuccuuuucc

SEQ ID NO: 2760999 - RNA, 21 nt, Human
cauacaaaaauuccuuuuccc

SEQ ID NO: 2761000 - RNA, 17 nt, Human
cauacacucucaaagca

SEQ ID NO: 2761001 - RNA, 16 nt, Human
cauacaugcauacacu

SEQ ID NO: 2761002 - RNA, 13 nt, Human
cauacauguaaaa

SEQ ID NO: 2761003 - RNA, 16 nt, Human
cauacauguaaaauau

SEQ ID NO: 2761004 - RNA, 13 nt, Human
cauacauuugugu

SEQ ID NO: 2761005 - RNA, 13 nt, Human
cauaccuucccca

SEQ ID NO: 2761006 - RNA, 21 nt, Human
cauacuauagauucuuuauua

SEQ ID NO: 2761007 - RNA, 22 nt, Human
cauacuauuuaagagaacaagc

SEQ ID NO: 2761008 - RNA, 16 nt, Human
cauacuucuuaggguu

SEQ ID NO: 2761009 - RNA, 17 nt, Human
cauacuucuuaggguua

SEQ ID NO: 2761010 - RNA, 21 nt, Human
cauagaacucaugacggaaga

SEQ ID NO: 2761011 - RNA, 16 nt, Human
cauagaaguaaaaaca

SEQ ID NO: 2761012 - RNA, 16 nt, Human
cauagaauaaaauuuu

SEQ ID NO: 2761013 - RNA, 22 nt, Human
cauagaauaaaauuuuuaaucu

SEQ ID NO: 2761014 - RNA, 20 nt, Human
cauagaauaguguuggaaaa

SEQ ID NO: 2761015 - RNA, 20 nt, Human
cauagauucccugagcagga

SEQ ID NO: 2761016 - RNA, 13 nt, Human
cauagcccugccu

SEQ ID NO: 2761017 - RNA, 17 nt, Human
cauagguuuaauaauuu

SEQ ID NO: 2761018 - RNA, 14 nt, Human
cauagguuuuuagu

SEQ ID NO: 2761019 - RNA, 17 nt, Human
cauaguaccucugcuau

SEQ ID NO: 2761020 - RNA, 16 nt, Human
cauagucauucugccu

SEQ ID NO: 2761021 - RNA, 20 nt, Human
cauagugggacccugucucu

SEQ ID NO: 2761022 - RNA, 18 nt, Human
cauauaauaaauguacau

SEQ ID NO: 2761023 - RNA, 17 nt, Human
cauauaauacaaaggcu

SEQ ID NO: 2761024 - RNA, 12 nt, Human
cauauaauguug

SEQ ID NO: 2761025 - RNA, 19 nt, Human
cauaucucccucuucccua

SEQ ID NO: 2761026 - RNA, 19 nt, Human
cauaucugccuuuauugug

SEQ ID NO: 2761027 - RNA, 24 nt, Human
cauaugaaaaggcuaagcuucacu

SEQ ID NO: 2761028 - RNA, 19 nt, Human
cauauguuuuuguaaguuu

SEQ ID NO: 2761029 - RNA, 11 nt, Human
cauauuaaaau

SEQ ID NO: 2761030 - RNA, 19 nt, Human
cauauuaaaaucacaaacu

SEQ ID NO: 2761031 - RNA, 16 nt, Human
cauauugauaauaaaa

SEQ ID NO: 2761032 - RNA, 17 nt, Human
cauauuuauagccaggu

SEQ ID NO: 2761033 - RNA, 15 nt, Human
caucaaccucuguau

SEQ ID NO: 2761034 - RNA, 19 nt, Human
caucaaggguacacugccu

SEQ ID NO: 2761035 - RNA, 14 nt, Human
caucaaugaaugaa

SEQ ID NO: 2761036 - RNA, 15 nt, Human
caucaaugaaugaau

SEQ ID NO: 2761037 - RNA, 22 nt, Human
caucacagcuuauuuccucauu

SEQ ID NO: 2761038 - RNA, 14 nt, Human
caucacaugaacuu

SEQ ID NO: 2761039 - RNA, 16 nt, Human
caucacauuccucugc

SEQ ID NO: 2761040 - RNA, 15 nt, Human
caucaccuuagacca

SEQ ID NO: 2761041 - RNA, 17 nt, Human
caucagcaucccuagaa

SEQ ID NO: 2761042 - RNA, 23 nt, Human
caucagcuugcccuguuaaaaga

SEQ ID NO: 2761043 - RNA, 18 nt, Human
caucaggccuagaggccu

SEQ ID NO: 2761044 - RNA, 13 nt, Human
caucaggcuuucu

SEQ ID NO: 2761045 - RNA, 17 nt, Human
caucaggcuuucuuuuu

SEQ ID NO: 2761046 - RNA, 23 nt, Human
caucaggcuuucuuuuuuuucuu

SEQ ID NO: 2761047 - RNA, 15 nt, Human
caucaguuacucuga

SEQ ID NO: 2761048 - RNA, 15 nt, Human
caucauaaaauaaag

SEQ ID NO: 2761049 - RNA, 21 nt, Human
caucauaaaauaaaguauaua

SEQ ID NO: 2761050 - RNA, 13 nt, Human
caucaucucagcu

SEQ ID NO: 2761051 - RNA, 15 nt, Human
caucaucucagcuca

SEQ ID NO: 2761052 - RNA, 21 nt, Human
caucaucucagcucacugcaa

SEQ ID NO: 2761053 - RNA, 15 nt, Human
caucauugguaccca

SEQ ID NO: 2761054 - RNA, 18 nt, Human
cauccaaaggcuccugag

SEQ ID NO: 2761055 - RNA, 17 nt, Human
cagccugcucccuagcc

SEQ ID NO: 2761056 - RNA, 16 nt, Human
cagccuggugggccuc

SEQ ID NO: 2761057 - RNA, 19 nt, Human
cagccuggugggccuccuc

SEQ ID NO: 2761058 - RNA, 20 nt, Human
cagccuggugggccuccucu

SEQ ID NO: 2761059 - RNA, 20 nt, Human
cagccugugcugcccgucuu

SEQ ID NO: 2761060 - RNA, 20 nt, Human
cagcgauuaauaacaggcaa

SEQ ID NO: 2761061 - RNA, 19 nt, Human
cagcgguuuauauaagcuu

SEQ ID NO: 2761062 - RNA, 19 nt, Human
cagcuaccugcucagcccu

SEQ ID NO: 2761063 - RNA, 21 nt, Human
cagcuaccugcucagcccugc

SEQ ID NO: 2761064 - RNA, 13 nt, Human
cagcuacuuggga

SEQ ID NO: 2761065 - RNA, 18 nt, Human
cagcuagaauucacucca

SEQ ID NO: 2761066 - RNA, 22 nt, Human
cagcuagaauucacuccacuug

SEQ ID NO: 2761067 - RNA, 13 nt, Human
cagcucaggcugg

SEQ ID NO: 2761068 - RNA, 19 nt, Human
cagcucagggcucuuuccu

SEQ ID NO: 2761069 - RNA, 13 nt, Human
cagcuccagcugc

SEQ ID NO: 2761070 - RNA, 14 nt, Human
cagcuccagcugcu

SEQ ID NO: 2761071 - RNA, 18 nt, Human
cagcuccagcugcucugu

SEQ ID NO: 2761072 - RNA, 15 nt, Human
cagcucuaaauguca

SEQ ID NO: 2761073 - RNA, 16 nt, Human
cagcucuaucccaacc

SEQ ID NO: 2761074 - RNA, 22 nt, Human
cagcucuaucccaaccucuccc

SEQ ID NO: 2761075 - RNA, 18 nt, Human
cagcucugcauacucauu

SEQ ID NO: 2761076 - RNA, 17 nt, Human
cagcugacacaucuccc

SEQ ID NO: 2761077 - RNA, 17 nt, Human
cagcugcccccagagcc

SEQ ID NO: 2761078 - RNA, 15 nt, Human
cagcugccccgggga

SEQ ID NO: 2761079 - RNA, 20 nt, Human
cagcugccccggggaggggc

SEQ ID NO: 2761080 - RNA, 21 nt, Human
cagcugccccggggaggggcg

SEQ ID NO: 2761081 - RNA, 15 nt, Human
cagcugccuccccuc

SEQ ID NO: 2761082 - RNA, 16 nt, Human
cagcugccuccccucc

SEQ ID NO: 2761083 - RNA, 18 nt, Human
cagcugcucaauaaagua

SEQ ID NO: 2761084 - RNA, 20 nt, Human
cagcuggccgggagccugau

SEQ ID NO: 2761085 - RNA, 15 nt, Human
cagcuggccuuguga

SEQ ID NO: 2761086 - RNA, 23 nt, Human
cagcuggccuugugaggagcugg

SEQ ID NO: 2761087 - RNA, 16 nt, Human
cagcuggggccaggcu

SEQ ID NO: 2761088 - RNA, 18 nt, Human
cagcuggggccaggcugg

SEQ ID NO: 2761089 - RNA, 17 nt, Human
cagcuggucagcccccu

SEQ ID NO: 2761090 - RNA, 21 nt, Human
cagcuggucagcccccuaagc

SEQ ID NO: 2761091 - RNA, 19 nt, Human
cagcuguaugauucccagc

SEQ ID NO: 2761092 - RNA, 18 nt, Human
cagcuuauugucuaguga

SEQ ID NO: 2761093 - RNA, 14 nt, Human
cagcuucacccuga

SEQ ID NO: 2761094 - RNA, 15 nt, Human
cagcuucacccugag

SEQ ID NO: 2761095 - RNA, 11 nt, Human
cagcuuccagg

SEQ ID NO: 2761096 - RNA, 18 nt, Human
cagcuuccaggcuggcgu

SEQ ID NO: 2761097 - RNA, 20 nt, Human
cagcuucucaauuucuacaa

SEQ ID NO: 2761098 - RNA, 16 nt, Human
cagcuucucauccugc

SEQ ID NO: 2761099 - RNA, 20 nt, Human
cagcuuguuauuuauaacaa

SEQ ID NO: 2761100 - RNA, 14 nt, Human
cagcuuuagccaag

SEQ ID NO: 2761101 - RNA, 20 nt, Human
cagcuuuagccaagugcagg

SEQ ID NO: 2761102 - RNA, 16 nt, Human
cagcuuuuucucuccc

SEQ ID NO: 2761103 - RNA, 15 nt, Human
caggaaagagagcac

SEQ ID NO: 2761104 - RNA, 18 nt, Human
caggaacaaacagggcug

SEQ ID NO: 2761105 - RNA, 16 nt, Human
caggaaccacaagacu

SEQ ID NO: 2761106 - RNA, 18 nt, Human
caggaaccacaagacugc

SEQ ID NO: 2761107 - RNA, 19 nt, Human
caggaagcugugagagcag

SEQ ID NO: 2761108 - RNA, 20 nt, Human
caggaaggggugugcugagu

SEQ ID NO: 2761109 - RNA, 15 nt, Human
caggaaguagaggag

SEQ ID NO: 2761110 - RNA, 17 nt, Human
caggaaguagaggaggc

SEQ ID NO: 2761111 - RNA, 12 nt, Human
caggacagcccu

SEQ ID NO: 2761112 - RNA, 21 nt, Human
caggaccccauggcaguggga

SEQ ID NO: 2761113 - RNA, 18 nt, Human
caggacccuguccaaucu

SEQ ID NO: 2761114 - RNA, 15 nt, Human
caggacgcccucacu

SEQ ID NO: 2761115 - RNA, 15 nt, Human
caggacuagggcugg

SEQ ID NO: 2761116 - RNA, 18 nt, Human
caggacuagggcuggagu

SEQ ID NO: 2761117 - RNA, 19 nt, Human
caggacuagggcuggagug

SEQ ID NO: 2761118 - RNA, 20 nt, Human
caggacuagggcuggaguga

SEQ ID NO: 2761119 - RNA, 17 nt, Human
caggagcaucuccucaa

SEQ ID NO: 2761120 - RNA, 19 nt, Human
caggagcugggcagaaggc

SEQ ID NO: 2761121 - RNA, 14 nt, Human
caggaggcauccaa

SEQ ID NO: 2761122 - RNA, 20 nt, Human
caggaggggcuucugggcag

SEQ ID NO: 2761123 - RNA, 12 nt, Human
caggagguguga

SEQ ID NO: 2761124 - RNA, 17 nt, Human
caggaguuccuaaccag

SEQ ID NO: 2761125 - RNA, 21 nt, Human
caggaguuucguuuucaaaau

SEQ ID NO: 2761126 - RNA, 16 nt, Human
caggaguuuggccaga

SEQ ID NO: 2761127 - RNA, 17 nt, Human
caggauacuggcacaga

SEQ ID NO: 2761128 - RNA, 18 nt, Human
caggauauccucccucca

SEQ ID NO: 2761129 - RNA, 18 nt, Human
caggaucguuuuuuccca

SEQ ID NO: 2761130 - RNA, 21 nt, Human
caggaucguuuuuucccaggg

SEQ ID NO: 2761131 - RNA, 19 nt, Human
caggaugagggaaaagaaa

SEQ ID NO: 2761132 - RNA, 21 nt, Human
caggauggcaaccagaccauu

SEQ ID NO: 2761133 - RNA, 18 nt, Human
caggauggcgcaggaacu

SEQ ID NO: 2761134 - RNA, 20 nt, Human
caggaugguucccuugauga

SEQ ID NO: 2761135 - RNA, 19 nt, Human
caggauguuugcucagcuu

SEQ ID NO: 2761136 - RNA, 22 nt, Human
caggauuagauaaggcuguucu

SEQ ID NO: 2761137 - RNA, 15 nt, Human
caggauuugggcucu

SEQ ID NO: 2761138 - RNA, 17 nt, Human
caggcaacugaggcaga

SEQ ID NO: 2761139 - RNA, 19 nt, Human
caggcaaucugcccgccug

SEQ ID NO: 2761140 - RNA, 18 nt, Human
caggcacagguccccaga

SEQ ID NO: 2761141 - RNA, 14 nt, Human
caggcacaguggcu

SEQ ID NO: 2761142 - RNA, 23 nt, Human
caggcacaguggcucacaccugu

SEQ ID NO: 2761143 - RNA, 21 nt, Human
caggcacuaucuggguuuugg

SEQ ID NO: 2761144 - RNA, 19 nt, Human
caggcagauguuccuaaua

SEQ ID NO: 2761145 - RNA, 15 nt, Human
caggcagccugccuu

SEQ ID NO: 2761146 - RNA, 21 nt, Human
caggcaggaacaaacagggcu

SEQ ID NO: 2761147 - RNA, 23 nt, Human
caggcaugagucagucugaugag

SEQ ID NO: 2761148 - RNA, 14 nt, Human
caggccccaagccc

SEQ ID NO: 2761149 - RNA, 17 nt, Human
caggccccaucuggucc

SEQ ID NO: 2761150 - RNA, 19 nt, Human
caggccuagaggccugacu

SEQ ID NO: 2761151 - RNA, 20 nt, Human
caggcgugaccugacagccc

SEQ ID NO: 2761152 - RNA, 13 nt, Human
caggcgugagcca

SEQ ID NO: 2761153 - RNA, 15 nt, Human
caggcgugagccacc

SEQ ID NO: 2761154 - RNA, 16 nt, Human
caggcgugagccacca

SEQ ID NO: 2761155 - RNA, 14 nt, Human
caggcuacugucag

SEQ ID NO: 2761156 - RNA, 20 nt, Human
caggcuccaaacuggagcuu

SEQ ID NO: 2761157 - RNA, 23 nt, Human
caggcuccccuccucggcuuccu

SEQ ID NO: 2761158 - RNA, 16 nt, Human
caggcugagccucagu

SEQ ID NO: 2761159 - RNA, 13 nt, Human
caggcugcucagg

SEQ ID NO: 2761160 - RNA, 15 nt, Human
caggcugcucagggc

SEQ ID NO: 2761161 - RNA, 18 nt, Human
caggcugcucagggcugg

SEQ ID NO: 2761162 - RNA, 16 nt, Human
caggcuggagugcagu

SEQ ID NO: 2761163 - RNA, 13 nt, Human
caggcuggcaccg

SEQ ID NO: 2761164 - RNA, 15 nt, Human
caggcuggcaccgcu

SEQ ID NO: 2761165 - RNA, 11 nt, Human
caggcuggguc

SEQ ID NO: 2761166 - RNA, 16 nt, Human
caggcuugaaucaaag

SEQ ID NO: 2761167 - RNA, 16 nt, Human
caggcuugccugcagg

SEQ ID NO: 2761168 - RNA, 17 nt, Human
caggcuugccugcaggc

SEQ ID NO: 2761169 - RNA, 18 nt, Human
caggcuugccugcaggca

SEQ ID NO: 2761170 - RNA, 22 nt, Human
caggcuugucucgaacuccuga

SEQ ID NO: 2761171 - RNA, 15 nt, Human
caggcuuucuuuuuu

SEQ ID NO: 2761172 - RNA, 19 nt, Human
cagggacagacauacauuu

SEQ ID NO: 2761173 - RNA, 15 nt, Human
cagggacuugaaccc

SEQ ID NO: 2761174 - RNA, 13 nt, Human
cagggagccccuu

SEQ ID NO: 2761175 - RNA, 20 nt, Human
cagggaggacgcucucuggc

SEQ ID NO: 2761176 - RNA, 22 nt, Human
cagggaggacgcucucuggccu

SEQ ID NO: 2761177 - RNA, 23 nt, Human
cagggaggacgcucucuggccuu

SEQ ID NO: 2761178 - RNA, 16 nt, Human
cagggaggucauuuug

SEQ ID NO: 2761179 - RNA, 22 nt, Human
cagggcauggcugggaacccaa

SEQ ID NO: 2761180 - RNA, 15 nt, Human
cagggccccagcacu

SEQ ID NO: 2761181 - RNA, 21 nt, Human
cagggccccagcacuaaagca

SEQ ID NO: 2761182 - RNA, 16 nt, Human
cagggccuggcuggga

SEQ ID NO: 2761183 - RNA, 16 nt, Human
cagggcuacgcgcgcu

SEQ ID NO: 2761184 - RNA, 13 nt, Human
cagggcucagccu

SEQ ID NO: 2761185 - RNA, 15 nt, Human
cagggcugaagcugu

SEQ ID NO: 2761186 - RNA, 20 nt, Human
cagggcugaagcuguguccu

SEQ ID NO: 2761187 - RNA, 20 nt, Human
caggggccacaccaaccuuc

SEQ ID NO: 2761188 - RNA, 22 nt, Human
caggggccacaccaaccuucug

SEQ ID NO: 2761189 - RNA, 13 nt, Human
caggggccacucu

SEQ ID NO: 2761190 - RNA, 17 nt, Human
caggggugcugggaccu

SEQ ID NO: 2761191 - RNA, 16 nt, Human
cagggucaggagaggg

SEQ ID NO: 2761192 - RNA, 17 nt, Human
caggguuucaccauguu

SEQ ID NO: 2761193 - RNA, 14 nt, Human
cagguaaaacaggg

SEQ ID NO: 2761194 - RNA, 21 nt, Human
cagguaaaacagggccacaua

SEQ ID NO: 2761195 - RNA, 12 nt, Human
caggucacacaa

SEQ ID NO: 2761196 - RNA, 20 nt, Human
caggucacgcuuucaugaau

SEQ ID NO: 2761197 - RNA, 20 nt, Human
cagguccugcugaaacugcc

SEQ ID NO: 2761198 - RNA, 11 nt, Human
caggucuacca

SEQ ID NO: 2761199 - RNA, 22 nt, Human
caggucuaccaaaaaucucaau

SEQ ID NO: 2761200 - RNA, 12 nt, Human
caggucucaugg

SEQ ID NO: 2761201 - RNA, 19 nt, Human
caggugccaguuauggcua

SEQ ID NO: 2761202 - RNA, 20 nt, Human
caggugccaguuauggcuau

SEQ ID NO: 2761203 - RNA, 21 nt, Human
caggugcuucaggauaccaua

SEQ ID NO: 2761204 - RNA, 14 nt, Human
caaaugcauuucua

SEQ ID NO: 2761205 - RNA, 16 nt, Human
caaaugcauuucuaaa

SEQ ID NO: 2761206 - RNA, 12 nt, Human
caaaugggaaac

SEQ ID NO: 2761207 - RNA, 20 nt, Human
caaauguucaucaaugaaug

SEQ ID NO: 2761208 - RNA, 16 nt, Human
caaauuccagaaugau

SEQ ID NO: 2761209 - RNA, 15 nt, Human
caaauucuguuucuu

SEQ ID NO: 2761210 - RNA, 15 nt, Human
caaauugagcuaggg

SEQ ID NO: 2761211 - RNA, 15 nt, Human
caaauugucacagga

SEQ ID NO: 2761212 - RNA, 12 nt, Human
caaauuuacaga

SEQ ID NO: 2761213 - RNA, 23 nt, Human
caaauuuagauuugugugcauca

SEQ ID NO: 2761214 - RNA, 13 nt, Human
caaauuuguauuu

SEQ ID NO: 2761215 - RNA, 17 nt, Human
caacacaauucuucuuc

SEQ ID NO: 2761216 - RNA, 18 nt, Human
caacacacagauuugagc

SEQ ID NO: 2761217 - RNA, 21 nt, Human
caacacacagauuugagcuca

SEQ ID NO: 2761218 - RNA, 21 nt, Human
caacacaucaggaaagagagc

SEQ ID NO: 2761219 - RNA, 12 nt, Human
caacacccugag

SEQ ID NO: 2761220 - RNA, 23 nt, Human
caacacccugagguugugugugg

SEQ ID NO: 2761221 - RNA, 16 nt, Human
caacacgagcaggcua

SEQ ID NO: 2761222 - RNA, 14 nt, Human
caacacuaacauau

SEQ ID NO: 2761223 - RNA, 16 nt, Human
caacagcacccucucc

SEQ ID NO: 2761224 - RNA, 17 nt, Human
caacagcacccucucca

SEQ ID NO: 2761225 - RNA, 18 nt, Human
caacagcacccucuccag

SEQ ID NO: 2761226 - RNA, 20 nt, Human
caacagcacccucuccagau

SEQ ID NO: 2761227 - RNA, 16 nt, Human
caacaguuuuuuaugc

SEQ ID NO: 2761228 - RNA, 18 nt, Human
caacaguuuuuuaugcua

SEQ ID NO: 2761229 - RNA, 22 nt, Human
caacauagugggacccugucuc

SEQ ID NO: 2761230 - RNA, 23 nt, Human
caacauagugggacccugucucu

SEQ ID NO: 2761231 - RNA, 13 nt, Human
caacaucuaguga

SEQ ID NO: 2761232 - RNA, 13 nt, Human
caacauggugaaa

SEQ ID NO: 2761233 - RNA, 17 nt, Human
caacauggugaaacccc

SEQ ID NO: 2761234 - RNA, 10 nt, Human
caacauuaaa

SEQ ID NO: 2761235 - RNA, 15 nt, Human
caacauuaaaacaau

SEQ ID NO: 2761236 - RNA, 18 nt, Human
caaccacacccacacuca

SEQ ID NO: 2761237 - RNA, 20 nt, Human
caaccagauugucagcuccu

SEQ ID NO: 2761238 - RNA, 23 nt, Human
caaccaugagaccacuguuauca

SEQ ID NO: 2761239 - RNA, 21 nt, Human
caacccccauuucuauuuauu

SEQ ID NO: 2761240 - RNA, 23 nt, Human
caacccgaggcccgcaugcggcc

SEQ ID NO: 2761241 - RNA, 14 nt, Human
caacccuuucauua

SEQ ID NO: 2761242 - RNA, 18 nt, Human
caaccucucccaacuaua

SEQ ID NO: 2761243 - RNA, 12 nt, Human
caaccucugccu

SEQ ID NO: 2761244 - RNA, 13 nt, Human
caaccucugccuc

SEQ ID NO: 2761245 - RNA, 14 nt, Human
caaccucugccucc

SEQ ID NO: 2761246 - RNA, 18 nt, Human
caaccuggaguugaaaau

SEQ ID NO: 2761247 - RNA, 13 nt, Human
caaccugggggcu

SEQ ID NO: 2761248 - RNA, 19 nt, Human
caaccuucugaggagcugu

SEQ ID NO: 2761249 - RNA, 14 nt, Human
caacguggcccaga

SEQ ID NO: 2761250 - RNA, 23 nt, Human
caacuaaugauuuagugaucaaa

SEQ ID NO: 2761251 - RNA, 14 nt, Human
caacuauaaaacua

SEQ ID NO: 2761252 - RNA, 13 nt, Human
caacuauauuguu

SEQ ID NO: 2761253 - RNA, 23 nt, Human
caacuaucucauuuccaagcaag

SEQ ID NO: 2761254 - RNA, 10 nt, Human
caacucccug

SEQ ID NO: 2761255 - RNA, 13 nt, Human
caacucccugccc

SEQ ID NO: 2761256 - RNA, 21 nt, Human
caacucucuuauugccucacu

SEQ ID NO: 2761257 - RNA, 17 nt, Human
caacugaggcagacagc

SEQ ID NO: 2761258 - RNA, 23 nt, Human
caacugaggcagacagcagcuca

SEQ ID NO: 2761259 - RNA, 17 nt, Human
caacugggguggguggg

SEQ ID NO: 2761260 - RNA, 22 nt, Human
caacugggguggguggggcagu

SEQ ID NO: 2761261 - RNA, 19 nt, Human
caacuuauauuucugcuuu

SEQ ID NO: 2761262 - RNA, 21 nt, Human
caacuuuuguguaaugaaaau

SEQ ID NO: 2761263 - RNA, 21 nt, Human
caagaaaauaagagcucagga

SEQ ID NO: 2761264 - RNA, 14 nt, Human
caagaaauauuccu

SEQ ID NO: 2761265 - RNA, 22 nt, Human
caagaacuuauuuguacauuuu

SEQ ID NO: 2761266 - RNA, 17 nt, Human
caagaagccacagaccu

SEQ ID NO: 2761267 - RNA, 14 nt, Human
caagaaggaaagau

SEQ ID NO: 2761268 - RNA, 17 nt, Human
caagaaugagaagaaug

SEQ ID NO: 2761269 - RNA, 13 nt, Human
caagaccagccug

SEQ ID NO: 2761270 - RNA, 14 nt, Human
caagacccaaaagg

SEQ ID NO: 2761271 - RNA, 17 nt, Human
caagacccaaaaggcag

SEQ ID NO: 2761272 - RNA, 19 nt, Human
caagacccaaaaggcagaa

SEQ ID NO: 2761273 - RNA, 15 nt, Human
caagacucugucuca

SEQ ID NO: 2761274 - RNA, 21 nt, Human
caagacucugucucaaaaaau

SEQ ID NO: 2761275 - RNA, 22 nt, Human
caagagaauugcuugaacccag

SEQ ID NO: 2761276 - RNA, 23 nt, Human
caagagagcgagacccugucuca

SEQ ID NO: 2761277 - RNA, 19 nt, Human
caagagccuuuuuuugaaa

SEQ ID NO: 2761278 - RNA, 22 nt, Human
caagagugaagggaagagacag

SEQ ID NO: 2761279 - RNA, 18 nt, Human
caagaugugggcagugau

SEQ ID NO: 2761280 - RNA, 13 nt, Human
caagcaaauauaa

SEQ ID NO: 2761281 - RNA, 14 nt, Human
caagcaaauauaaa

SEQ ID NO: 2761282 - RNA, 17 nt, Human
caagcaaugccugccca

SEQ ID NO: 2761283 - RNA, 22 nt, Human
caagcacuuucccucuuggugc

SEQ ID NO: 2761284 - RNA, 22 nt, Human
caagcagagguggcgauuuguu

SEQ ID NO: 2761285 - RNA, 19 nt, Human
caagcaggaagaaggaaaa

SEQ ID NO: 2761286 - RNA, 16 nt, Human
caagcaguuauuugau

SEQ ID NO: 2761287 - RNA, 20 nt, Human
caagcauaccaacacgagca

SEQ ID NO: 2761288 - RNA, 20 nt, Human
caagccagauuuuccugaaa

SEQ ID NO: 2761289 - RNA, 22 nt, Human
caagccagauuuuccugaaaac

SEQ ID NO: 2761290 - RNA, 19 nt, Human
caagccauggguagccugg

SEQ ID NO: 2761291 - RNA, 20 nt, Human
caagccuaaaauuguauaga

SEQ ID NO: 2761292 - RNA, 22 nt, Human
caagccuaaaauuguauagacc

SEQ ID NO: 2761293 - RNA, 20 nt, Human
caagccuccuuuuaaaguaa

SEQ ID NO: 2761294 - RNA, 12 nt, Human
caagccugccuc

SEQ ID NO: 2761295 - RNA, 13 nt, Human
caagccugccuca

SEQ ID NO: 2761296 - RNA, 22 nt, Human
caagcucuaucaccaaggagcc

SEQ ID NO: 2761297 - RNA, 23 nt, Human
caagcugcaucuagaggcuuccu

SEQ ID NO: 2761298 - RNA, 23 nt, Human
caagcugcuguggccaucaaccu

SEQ ID NO: 2761299 - RNA, 21 nt, Human
caagcuuuuuuuuuuuuucuu

SEQ ID NO: 2761300 - RNA, 14 nt, Human
caaggaaaaaauaa

SEQ ID NO: 2761301 - RNA, 15 nt, Human
caaggaaaaaauaac

SEQ ID NO: 2761302 - RNA, 21 nt, Human
caaggaaaaaauaacaaugaa

SEQ ID NO: 2761303 - RNA, 15 nt, Human
caaggagaggcaaag

SEQ ID NO: 2761304 - RNA, 21 nt, Human
caaggagaggcaaagaaagga

SEQ ID NO: 2761305 - RNA, 13 nt, Human
caaggaugaauua

SEQ ID NO: 2761306 - RNA, 19 nt, Human
caaggaugccccguccccc

SEQ ID NO: 2761307 - RNA, 22 nt, Human
caaggaugccccgucccccucu

SEQ ID NO: 2761308 - RNA, 17 nt, Human
caaggcccccgggccga

SEQ ID NO: 2761309 - RNA, 18 nt, Human
caaggcuagaaccaccug

SEQ ID NO: 2761310 - RNA, 15 nt, Human
caaggcuggagugca

SEQ ID NO: 2761311 - RNA, 23 nt, Human
caaggcuggagugcaguggcgca

SEQ ID NO: 2761312 - RNA, 16 nt, Human
caaggcuuagacccuc

SEQ ID NO: 2761313 - RNA, 22 nt, Human
caaggcuuagacccucaugcug

SEQ ID NO: 2761314 - RNA, 16 nt, Human
caagggcuggagucug

SEQ ID NO: 2761315 - RNA, 14 nt, Human
caaggguacacugc

SEQ ID NO: 2761316 - RNA, 17 nt, Human
caagggugugugcagca

SEQ ID NO: 2761317 - RNA, 17 nt, Human
caaggguucaccugggc

SEQ ID NO: 2761318 - RNA, 23 nt, Human
caagguuaggguuggagcagggg

SEQ ID NO: 2761319 - RNA, 18 nt, Human
caaguaaaaggaaaugcu

SEQ ID NO: 2761320 - RNA, 21 nt, Human
caaguaaaaggaaaugcuccu

SEQ ID NO: 2761321 - RNA, 12 nt, Human
caaguaaauguu

SEQ ID NO: 2761322 - RNA, 17 nt, Human
caaguauggcuccucca

SEQ ID NO: 2761323 - RNA, 19 nt, Human
caagugauccucaggcagg

SEQ ID NO: 2761324 - RNA, 18 nt, Human
caagugcuucuccagccu

SEQ ID NO: 2761325 - RNA, 22 nt, Human
caagugcuucuccagccucagc

SEQ ID NO: 2761326 - RNA, 19 nt, Human
caaguuauccaccugccuu

SEQ ID NO: 2761327 - RNA, 23 nt, Human
caaguuauccaccugccuuggcu

SEQ ID NO: 2761328 - RNA, 20 nt, Human
caauaaaacuuuuccaauga

SEQ ID NO: 2761329 - RNA, 13 nt, Human
caauaaagcaaug

SEQ ID NO: 2761330 - RNA, 14 nt, Human
caauaaagcaaugu

SEQ ID NO: 2761331 - RNA, 16 nt, Human
caauaaagcaaugugg

SEQ ID NO: 2761332 - RNA, 23 nt, Human
caauaaagcaaugugguaguucc

SEQ ID NO: 2761333 - RNA, 16 nt, Human
caauaaauagaccauu

SEQ ID NO: 2761334 - RNA, 15 nt, Human
caauaacgauaaaag

SEQ ID NO: 2761335 - RNA, 21 nt, Human
caauauaagcuuuucuuuucu

SEQ ID NO: 2761336 - RNA, 17 nt, Human
caauaucagacuuuuuu

SEQ ID NO: 2761337 - RNA, 23 nt, Human
caauauuuuucuuacugauuuuu

SEQ ID NO: 2761338 - RNA, 14 nt, Human
caaucaaauaagua

SEQ ID NO: 2761339 - RNA, 23 nt, Human
caaucaguagccagcaucugccu

SEQ ID NO: 2761340 - RNA, 14 nt, Human
caaucaugaauuag

SEQ ID NO: 2761341 - RNA, 16 nt, Human
caauccaagaacuuau

SEQ ID NO: 2761342 - RNA, 23 nt, Human
caauccaagaacuuauuuguaca

SEQ ID NO: 2761343 - RNA, 19 nt, Human
caaucuguccguucacaug

SEQ ID NO: 2761344 - RNA, 17 nt, Human
caaucuuaacucauugc

SEQ ID NO: 2761345 - RNA, 23 nt, Human
caaucuuaucauauuucaaauga

SEQ ID NO: 2761346 - RNA, 16 nt, Human
caaucuuugacaauug

SEQ ID NO: 2761347 - RNA, 12 nt, Human
caaugaaaagga

SEQ ID NO: 2761348 - RNA, 15 nt, Human
caaugaaugaaugaa

SEQ ID NO: 2761349 - RNA, 22 nt, Human
caaugcagugccuuucuucucu

SEQ ID NO: 2761350 - RNA, 18 nt, Human
caaugccccugaauuuaa

SEQ ID NO: 2761351 - RNA, 21 nt, Human
caaugccccugaauuuaaaua

SEQ ID NO: 2761352 - RNA, 13 nt, Human
caaugcuguauuu

SEQ ID NO: 2761353 - RNA, 20 nt, Human
caauguaauaaaaagccucu

SEQ ID NO: 2761354 - RNA, 16 nt, Human
caauguucccccucuc

SEQ ID NO: 2761355 - RNA, 21 nt, Human
caauuaauuccuucagcacuu

SEQ ID NO: 2761356 - RNA, 14 nt, Human
caauuaccacacca

SEQ ID NO: 2761357 - RNA, 15 nt, Human
caauuagcuccuccu

SEQ ID NO: 2761358 - RNA, 22 nt, Human
caauuauaagcuguuuuuauau

SEQ ID NO: 2761359 - RNA, 14 nt, Human
caauuccucuggga

SEQ ID NO: 2761360 - RNA, 17 nt, Human
caauucgauccccuguc

SEQ ID NO: 2761361 - RNA, 15 nt, Human
caauucuugccaaau

SEQ ID NO: 2761362 - RNA, 14 nt, Human
caauugacuauagu

SEQ ID NO: 2761363 - RNA, 19 nt, Human
caauugcuuuaccuuuuuu

SEQ ID NO: 2761364 - RNA, 16 nt, Human
cacaaagcccaucaua

SEQ ID NO: 2761365 - RNA, 17 nt, Human
cacaaccacucauucaa

SEQ ID NO: 2761366 - RNA, 21 nt, Human
cacaacuauauuaucaugcaa

SEQ ID NO: 2761367 - RNA, 19 nt, Human
cacaagaaaugaaagcagg

SEQ ID NO: 2761368 - RNA, 23 nt, Human
cacaagaaaugaaagcagggacu

SEQ ID NO: 2761369 - RNA, 15 nt, Human
cacaagcacuuuccc

SEQ ID NO: 2761370 - RNA, 18 nt, Human
cacaauaauuuucuaccu

SEQ ID NO: 2761371 - RNA, 16 nt, Human
cacaauacaucccuua

SEQ ID NO: 2761372 - RNA, 16 nt, Human
cacacaccaccacgcc

SEQ ID NO: 2761373 - RNA, 20 nt, Human
cacacagauuugagcucagc

SEQ ID NO: 2761374 - RNA, 23 nt, Human
cacacagauuugagcucagcccu

SEQ ID NO: 2761375 - RNA, 12 nt, Human
cacacagugcuu

SEQ ID NO: 2761376 - RNA, 14 nt, Human
cacacaugggauca

SEQ ID NO: 2761377 - RNA, 17 nt, Human
cacacauuaaaauguua

SEQ ID NO: 2761378 - RNA, 17 nt, Human
cacaccaaccuucugag

SEQ ID NO: 2761379 - RNA, 13 nt, Human
cacaccaucuccc

SEQ ID NO: 2761380 - RNA, 19 nt, Human
cacacucaugcauuguccu

SEQ ID NO: 2761381 - RNA, 16 nt, Human
cacacugagccagcag

SEQ ID NO: 2761382 - RNA, 18 nt, Human
cacacugagccagcagcc

SEQ ID NO: 2761383 - RNA, 22 nt, Human
cacagaccaaccuggaguugaa

SEQ ID NO: 2761384 - RNA, 17 nt, Human
cacagaccuuugaacua

SEQ ID NO: 2761385 - RNA, 17 nt, Human
cacagaucacagcuuca

SEQ ID NO: 2761386 - RNA, 17 nt, Human
cacagaucuuucugccu

SEQ ID NO: 2761387 - RNA, 17 nt, Human
cacagauguucacccaa

SEQ ID NO: 2761388 - RNA, 14 nt, Human
cacagauuugagcu

SEQ ID NO: 2761389 - RNA, 17 nt, Human
cacagauuugagcucag

SEQ ID NO: 2761390 - RNA, 19 nt, Human
cacagcaagggugauggga

SEQ ID NO: 2761391 - RNA, 16 nt, Human
cacagcacgggggcca

SEQ ID NO: 2761392 - RNA, 20 nt, Human
cacagcacgggggccaagga

SEQ ID NO: 2761393 - RNA, 18 nt, Human
cacagcauggagucacag

SEQ ID NO: 2761394 - RNA, 20 nt, Human
cacagcauggagucacagcc

SEQ ID NO: 2761395 - RNA, 16 nt, Human
cacagccagacuggca

SEQ ID NO: 2761396 - RNA, 19 nt, Human
cacagcccuggccucugcu

SEQ ID NO: 2761397 - RNA, 20 nt, Human
cacagcccuggccucugcuc

SEQ ID NO: 2761398 - RNA, 14 nt, Human
cacagccucuuaga

SEQ ID NO: 2761399 - RNA, 23 nt, Human
cacagcugaacuuguugagaucc

SEQ ID NO: 2761400 - RNA, 22 nt, Human
cacagcugcucaauaaaguaca

SEQ ID NO: 2761401 - RNA, 14 nt, Human
cacagcuucagcca

SEQ ID NO: 2761402 - RNA, 16 nt, Human
cacagcuucagccagg

SEQ ID NO: 2761403 - RNA, 19 nt, Human
cacaggaaccacaagacug

SEQ ID NO: 2761404 - RNA, 13 nt, Human
cacaggacagccc

SEQ ID NO: 2761405 - RNA, 15 nt, Human
cacaggacagcccuu

SEQ ID NO: 2761406 - RNA, 19 nt, Human
cacaggagcuuaaacagcu

SEQ ID NO: 2761407 - RNA, 13 nt, Human
cacaggauggcag

SEQ ID NO: 2761408 - RNA, 20 nt, Human
cacaggcacagguccccaga

SEQ ID NO: 2761409 - RNA, 15 nt, Human
cacaggcuccaaacu

SEQ ID NO: 2761410 - RNA, 16 nt, Human
cacagggccuggggag

SEQ ID NO: 2761411 - RNA, 16 nt, Human
cacagugggagccagg

SEQ ID NO: 2761412 - RNA, 17 nt, Human
cacauaaugcucauacu

SEQ ID NO: 2761413 - RNA, 18 nt, Human
cacauaaugcucauacuu

SEQ ID NO: 2761414 - RNA, 14 nt, Human
cacauagaugcuga

SEQ ID NO: 2761415 - RNA, 13 nt, Human
cacauaucaaacu

SEQ ID NO: 2761416 - RNA, 17 nt, Human
cacauaucgauuuuuaa

SEQ ID NO: 2761417 - RNA, 14 nt, Human
cacaucaggaaaga

SEQ ID NO: 2761418 - RNA, 21 nt, Human
cacaucgcagauucucccuug

SEQ ID NO: 2761419 - RNA, 13 nt, Human
cacaucugagccc

SEQ ID NO: 2761420 - RNA, 21 nt, Human
cacaugaacuuguaaaggaau

SEQ ID NO: 2761421 - RNA, 11 nt, Human
cacaugaaguc

SEQ ID NO: 2761422 - RNA, 19 nt, Human
cacaugauuccagccauca

SEQ ID NO: 2761423 - RNA, 16 nt, Human
cacaugcugaacauca

SEQ ID NO: 2761424 - RNA, 23 nt, Human
cacauggcuucaccuguccccga

SEQ ID NO: 2761425 - RNA, 19 nt, Human
cacauguaucuaugcauuu

SEQ ID NO: 2761426 - RNA, 21 nt, Human
cacauguaucuaugcauuuuc

SEQ ID NO: 2761427 - RNA, 18 nt, Human
cacaugucagcaaguccu

SEQ ID NO: 2761428 - RNA, 14 nt, Human
cacaugucuuaaug

SEQ ID NO: 2761429 - RNA, 23 nt, Human
cacaugucuuaaugaaguuugaa

SEQ ID NO: 2761430 - RNA, 17 nt, Human
cacauguuccccuuggg

SEQ ID NO: 2761431 - RNA, 20 nt, Human
cacauuccucugcccuuccu

SEQ ID NO: 2761432 - RNA, 21 nt, Human
cacauuccucugcccuuccug

SEQ ID NO: 2761433 - RNA, 21 nt, Human
cacauuccugaacaggauauu

SEQ ID NO: 2761434 - RNA, 19 nt, Human
cacauuggcuauuuaaaga

SEQ ID NO: 2761435 - RNA, 13 nt, Human
cacauuuaaauaa

SEQ ID NO: 2761436 - RNA, 22 nt, Human
caccaaacccggccugauuaaa

SEQ ID NO: 2761437 - RNA, 14 nt, Human
caccaaccuucuga

SEQ ID NO: 2761438 - RNA, 14 nt, Human
caccaacuuugaag

SEQ ID NO: 2761439 - RNA, 19 nt, Human
caccaacuuugaagucuga

SEQ ID NO: 2761440 - RNA, 13 nt, Human
caccaagccuuga

SEQ ID NO: 2761441 - RNA, 13 nt, Human
caccaaggagcca

SEQ ID NO: 2761442 - RNA, 20 nt, Human
caccaaggcugauuaaacca

SEQ ID NO: 2761443 - RNA, 15 nt, Human
caccacauccagccu

SEQ ID NO: 2761444 - RNA, 15 nt, Human
caccaccacgccugg

SEQ ID NO: 2761445 - RNA, 20 nt, Human
caccacuucaagugaccacc

SEQ ID NO: 2761446 - RNA, 17 nt, Human
caccaggacgcccucga

SEQ ID NO: 2761447 - RNA, 16 nt, Human
caccaggagucccugg

SEQ ID NO: 2761448 - RNA, 17 nt, Human
caccaggcugcucaggg

SEQ ID NO: 2761449 - RNA, 23 nt, Human
caccaggcuugccugcaggcaug

SEQ ID NO: 2761450 - RNA, 17 nt, Human
caccagggccuggcugg

SEQ ID NO: 2761451 - RNA, 19 nt, Human
caccagggccuggcuggga

SEQ ID NO: 2761452 - RNA, 21 nt, Human
caccagggccuggcugggagu

SEQ ID NO: 2761453 - RNA, 23 nt, Human
caccagggccuggcugggagugg

SEQ ID NO: 2761454 - RNA, 22 nt, Human
caccagucugacuguuuccauc

SEQ ID NO: 2761455 - RNA, 20 nt, Human
caccaucgucuucuuggcca

SEQ ID NO: 2761456 - RNA, 22 nt, Human
caccaucgucuucuuggccaug

SEQ ID NO: 2761457 - RNA, 17 nt, Human
caccaugcugcugggga

SEQ ID NO: 2761458 - RNA, 20 nt, Human
caccauguuagccaggcugg

SEQ ID NO: 2761459 - RNA, 23 nt, Human
caccauucaggucuuucuuuccg

SEQ ID NO: 2761460 - RNA, 19 nt, Human
caccauuccuucugcccug

SEQ ID NO: 2761461 - RNA, 18 nt, Human
cacccaaacggaggcagc

SEQ ID NO: 2761462 - RNA, 17 nt, Human
cacccaaccacauccca

SEQ ID NO: 2761463 - RNA, 19 nt, Human
cacccaaggaugucugcca

SEQ ID NO: 2761464 - RNA, 19 nt, Human
cacccacacucagauccuc

SEQ ID NO: 2761465 - RNA, 12 nt, Human
cacccacuuccc

SEQ ID NO: 2761466 - RNA, 22 nt, Human
cacccaggaguauccucuugcc

SEQ ID NO: 2761467 - RNA, 19 nt, Human
cacccagguuggagugcag

SEQ ID NO: 2761468 - RNA, 20 nt, Human
cacccagguuggagugcagu

SEQ ID NO: 2761469 - RNA, 19 nt, Human
cacccauuagcagucccuc

SEQ ID NO: 2761470 - RNA, 23 nt, Human
cacccauuagcagucccuccaca

SEQ ID NO: 2761471 - RNA, 19 nt, Human
caccccaacagcacccucu

SEQ ID NO: 2761472 - RNA, 20 nt, Human
cacccccagaaugaccuggc

SEQ ID NO: 2761473 - RNA, 22 nt, Human
caccccuaaaagaaacccugca

SEQ ID NO: 2761474 - RNA, 12 nt, Human
caccccuccccu

SEQ ID NO: 2761475 - RNA, 14 nt, Human
caccccuccccugc

SEQ ID NO: 2761476 - RNA, 16 nt, Human
caccccuccccugccc

SEQ ID NO: 2761477 - RNA, 14 nt, Human
cacccgccucagcc

SEQ ID NO: 2761478 - RNA, 18 nt, Human
cacccgccucagccuccc

SEQ ID NO: 2761479 - RNA, 19 nt, Human
cacccgccucagccuccca

SEQ ID NO: 2761480 - RNA, 20 nt, Human
cacccgccucagccucccaa

SEQ ID NO: 2761481 - RNA, 16 nt, Human
cacccucccacugcca

SEQ ID NO: 2761482 - RNA, 15 nt, Human
cacccucuccagaug

SEQ ID NO: 2761483 - RNA, 16 nt, Human
cacccucuccagauga

SEQ ID NO: 2761484 - RNA, 21 nt, Human
cacccucuccagaugagagua

SEQ ID NO: 2761485 - RNA, 17 nt, Human
cacccucuccagaugca

SEQ ID NO: 2761486 - RNA, 20 nt, Human
cacccugaggugagcaucau

SEQ ID NO: 2761487 - RNA, 13 nt, Human
cacccugauuuua

SEQ ID NO: 2761488 - RNA, 14 nt, Human
cacccugcccagcc

SEQ ID NO: 2761489 - RNA, 23 nt, Human
cacccugcccagccgucaaaaga

SEQ ID NO: 2761490 - RNA, 15 nt, Human
cacccuugccaugga

SEQ ID NO: 2761491 - RNA, 15 nt, Human
caccgaguggcccuu

SEQ ID NO: 2761492 - RNA, 20 nt, Human
caccgcaggauuugggcucu

SEQ ID NO: 2761493 - RNA, 20 nt, Human
caccgcagggugaacugcag

SEQ ID NO: 2761494 - RNA, 14 nt, Human
caccgcgcccagcc

SEQ ID NO: 2761495 - RNA, 14 nt, Human
caccgcuguacgcg

SEQ ID NO: 2761496 - RNA, 20 nt, Human
caccgcuguacgcgagcgcg

SEQ ID NO: 2761497 - RNA, 23 nt, Human
caccucaaaauaccaugccauuu

SEQ ID NO: 2761498 - RNA, 14 nt, Human
caccucagcugccu

SEQ ID NO: 2761499 - RNA, 15 nt, Human
caccucagcugccuc

SEQ ID NO: 2761500 - RNA, 21 nt, Human
caccucagcugccuccccagc

SEQ ID NO: 2761501 - RNA, 22 nt, Human
caccucagcugccuccccagcu

SEQ ID NO: 2761502 - RNA, 13 nt, Human
caccucauggaau

SEQ ID NO: 2761503 - RNA, 23 nt, Human
caccucauggaauuggagcucgu

SEQ ID NO: 2761504 - RNA, 14 nt, Human
caccucccccaucu

SEQ ID NO: 2761505 - RNA, 17 nt, Human
caccucccccaucucuu

SEQ ID NO: 2761506 - RNA, 22 nt, Human
caccucccccaucucuucuggg

SEQ ID NO: 2761507 - RNA, 16 nt, Human
caccuccccccccccg

SEQ ID NO: 2761508 - RNA, 14 nt, Human
caccucccugcaau

SEQ ID NO: 2761509 - RNA, 20 nt, Human
caccuccuggguucaagcga

SEQ ID NO: 2761510 - RNA, 22 nt, Human
caccuccuggguucaagcgauu

SEQ ID NO: 2761511 - RNA, 15 nt, Human
caccugcaggcguga

SEQ ID NO: 2761512 - RNA, 17 nt, Human
caccugcugagccccaa

SEQ ID NO: 2761513 - RNA, 13 nt, Human
caccuguaauccc

SEQ ID NO: 2761514 - RNA, 15 nt, Human
caccuguaaucccag

SEQ ID NO: 2761515 - RNA, 17 nt, Human
caccugucaucucacau

SEQ ID NO: 2761516 - RNA, 16 nt, Human
caccugucccagaaaa

SEQ ID NO: 2761517 - RNA, 21 nt, Human
caccugucccagaaaaagcau

SEQ ID NO: 2761518 - RNA, 18 nt, Human
caccuguccccgaaacua

SEQ ID NO: 2761519 - RNA, 13 nt, Human
caccugugccguc

SEQ ID NO: 2761520 - RNA, 19 nt, Human
caccuguuuuuaagcuguu

SEQ ID NO: 2761521 - RNA, 19 nt, Human
caccuuagaccaccaagcc

SEQ ID NO: 2761522 - RNA, 18 nt, Human
caccuuaucuauguagaa

SEQ ID NO: 2761523 - RNA, 21 nt, Human
caccuucuggguucaagcgau

SEQ ID NO: 2761524 - RNA, 13 nt, Human
cacgaugggcuuu

SEQ ID NO: 2761525 - RNA, 15 nt, Human
cacgcacacugucug

SEQ ID NO: 2761526 - RNA, 13 nt, Human
cacgcauggaaaa

SEQ ID NO: 2761527 - RNA, 17 nt, Human
cacgccacagcccuuuu

SEQ ID NO: 2761528 - RNA, 20 nt, Human
cacgccuggcuaauuuuugu

SEQ ID NO: 2761529 - RNA, 20 nt, Human
cacgccuguaaucccagcau

SEQ ID NO: 2761530 - RNA, 15 nt, Human
cacgcucugggucgc

SEQ ID NO: 2761531 - RNA, 19 nt, Human
cacggccuaaaagccucuu

SEQ ID NO: 2761532 - RNA, 19 nt, Human
cacguacugcagccuccag

SEQ ID NO: 2761533 - RNA, 16 nt, Human
cacgugugggcaaugu

SEQ ID NO: 2761534 - RNA, 15 nt, Human
cacuaaaaaggcaug

SEQ ID NO: 2761535 - RNA, 14 nt, Human
cacuaaacaaagag

SEQ ID NO: 2761536 - RNA, 22 nt, Human
cacuaaacaaagagugaaggau

SEQ ID NO: 2761537 - RNA, 21 nt, Human
cacuaaagaaggugugggcca

SEQ ID NO: 2761538 - RNA, 21 nt, Human
cacuaaauugacacuuaaaaa

SEQ ID NO: 2761539 - RNA, 23 nt, Human
cacuaaauugacacuuaaaaaug

SEQ ID NO: 2761540 - RNA, 14 nt, Human
cacuaacauauaau

SEQ ID NO: 2761541 - RNA, 22 nt, Human
cacuacaaccuccgccucccau

SEQ ID NO: 2761542 - RNA, 13 nt, Human
cacuacgccuggc

SEQ ID NO: 2761543 - RNA, 23 nt, Human
cacuacgccuggcugauuuuugu

SEQ ID NO: 2761544 - RNA, 17 nt, Human
cacuagacaaguccagc

SEQ ID NO: 2761545 - RNA, 19 nt, Human
cacuagacccacuggacuc

SEQ ID NO: 2761546 - RNA, 20 nt, Human
cacuagacccacuggacuca

SEQ ID NO: 2761547 - RNA, 20 nt, Human
cacuagcuaauaucaauaga

SEQ ID NO: 2761548 - RNA, 18 nt, Human
cacuaggguccaccagga

SEQ ID NO: 2761549 - RNA, 19 nt, Human
cacuaguauuucuaugaaa

SEQ ID NO: 2761550 - RNA, 22 nt, Human
cacuaguauuucuaugaaauau

SEQ ID NO: 2761551 - RNA, 13 nt, Human
cacuaucuguaau

SEQ ID NO: 2761552 - RNA, 15 nt, Human
cacuaugguauuuga

SEQ ID NO: 2761553 - RNA, 13 nt, Human
cacucaaaucaag

SEQ ID NO: 2761554 - RNA, 13 nt, Human
cacucaaauuguu

SEQ ID NO: 2761555 - RNA, 17 nt, Human
cacucacaacagcugcc

SEQ ID NO: 2761556 - RNA, 17 nt, Human
cacucacauccauucuu

SEQ ID NO: 2761557 - RNA, 15 nt, Human
cacucagauccuccu

SEQ ID NO: 2761558 - RNA, 17 nt, Human
cacucagauccuccuca

SEQ ID NO: 2761559 - RNA, 21 nt, Human
cacucaugcauuguccucuuu

SEQ ID NO: 2761560 - RNA, 13 nt, Human
cacuccagccuga

SEQ ID NO: 2761561 - RNA, 14 nt, Human
cacuccagccugag

SEQ ID NO: 2761562 - RNA, 20 nt, Human
cacuccagccugagcgacag

SEQ ID NO: 2761563 - RNA, 16 nt, Human
cacuccagugagacag

SEQ ID NO: 2761564 - RNA, 18 nt, Human
cacuccagugagacagcu

SEQ ID NO: 2761565 - RNA, 19 nt, Human
cacucugagucccagagcc

SEQ ID NO: 2761566 - RNA, 21 nt, Human
cacucugagucccagagccaa

SEQ ID NO: 2761567 - RNA, 16 nt, Human
cacucugcaagaagaa

SEQ ID NO: 2761568 - RNA, 14 nt, Human
cacucuugaaaaau

SEQ ID NO: 2761569 - RNA, 12 nt, Human
cacugacacaca

SEQ ID NO: 2761570 - RNA, 13 nt, Human
cacugacacacac

SEQ ID NO: 2761571 - RNA, 14 nt, Human
cacugacacacacg

SEQ ID NO: 2761572 - RNA, 19 nt, Human
cacugacuucuaaguaaaa

SEQ ID NO: 2761573 - RNA, 15 nt, Human
cacugagccagcagc

SEQ ID NO: 2761574 - RNA, 19 nt, Human
cacugaugacuuuuuauac

SEQ ID NO: 2761575 - RNA, 17 nt, Human
cacugcaaccucugccu

SEQ ID NO: 2761576 - RNA, 22 nt, Human
cacugcaaccucugccucccag

SEQ ID NO: 2761577 - RNA, 23 nt, Human
cacugcacgaauggaagaggcac

SEQ ID NO: 2761578 - RNA, 19 nt, Human
cacugccuucucaacucca

SEQ ID NO: 2761579 - RNA, 14 nt, Human
cacugcucacacug

SEQ ID NO: 2761580 - RNA, 15 nt, Human
cacugcuugaacuag

SEQ ID NO: 2761581 - RNA, 16 nt, Human
cacuggacucaccucc

SEQ ID NO: 2761582 - RNA, 23 nt, Human
cacuggacucaccucccccaucu

SEQ ID NO: 2761583 - RNA, 21 nt, Human
cacuggacugacgacuugagu

SEQ ID NO: 2761584 - RNA, 17 nt, Human
cacuggcucccuggaag

SEQ ID NO: 2761585 - RNA, 20 nt, Human
cacuggcucccuggaagaga

SEQ ID NO: 2761586 - RNA, 17 nt, Human
cacuggcuguuaaucuu

SEQ ID NO: 2761587 - RNA, 20 nt, Human
cacugggagaaaugaaaaaa

SEQ ID NO: 2761588 - RNA, 21 nt, Human
cacugggagaaaugaaaaaau

SEQ ID NO: 2761589 - RNA, 13 nt, Human
cacuguacuugcu

SEQ ID NO: 2761590 - RNA, 15 nt, Human
cacuguacuugcucu

SEQ ID NO: 2761591 - RNA, 24 nt, Human
cacuguauguccuuggugccugga

SEQ ID NO: 2761592 - RNA, 22 nt, Human
cacuguccauucuuccucccau

SEQ ID NO: 2761593 - RNA, 18 nt, Human
cacugucugcccccguuc

SEQ ID NO: 2761594 - RNA, 16 nt, Human
cacugugcaaauauau

SEQ ID NO: 2761595 - RNA, 15 nt, Human
cacuguguuggccag

SEQ ID NO: 2761596 - RNA, 17 nt, Human
cacuguguuggccagga

SEQ ID NO: 2761597 - RNA, 14 nt, Human
cacuguuaucaaaa

SEQ ID NO: 2761598 - RNA, 14 nt, Human
cacuguuaucuuca

SEQ ID NO: 2761599 - RNA, 16 nt, Human
cacuuaaaaaugguuu

SEQ ID NO: 2761600 - RNA, 14 nt, Human
cacuuauaggaauu

SEQ ID NO: 2761601 - RNA, 17 nt, Human
cacuucaaaacaguauu

SEQ ID NO: 2761602 - RNA, 15 nt, Human
cacuucacuuuuuuu

SEQ ID NO: 2761603 - RNA, 14 nt, Human
cacuucagccuccc

SEQ ID NO: 2761604 - RNA, 14 nt, Human
cacuucccacuauu

SEQ ID NO: 2761605 - RNA, 15 nt, Human
cacuuccucccggcc

SEQ ID NO: 2761606 - RNA, 20 nt, Human
cacuuccucccggccgcgcu

SEQ ID NO: 2761607 - RNA, 21 nt, Human
cacuucuucuuggucuuauuu

SEQ ID NO: 2761608 - RNA, 15 nt, Human
cacuugaacccggga

SEQ ID NO: 2761609 - RNA, 21 nt, Human
cacuugaacccgggaggcaga

SEQ ID NO: 2761610 - RNA, 22 nt, Human
cacuugaacccgggaggcagag

SEQ ID NO: 2761611 - RNA, 18 nt, Human
cacuugcggauauucugg

SEQ ID NO: 2761612 - RNA, 17 nt, Human
cacuuggacaugggccc

SEQ ID NO: 2761613 - RNA, 19 nt, Human
cacuugggucuucccugua

SEQ ID NO: 2761614 - RNA, 12 nt, Human
cacuuggucugu

SEQ ID NO: 2761615 - RNA, 18 nt, Human
cacuuggucugugagaug

SEQ ID NO: 2761616 - RNA, 20 nt, Human
cacuuggucugugagaugcu

SEQ ID NO: 2761617 - RNA, 24 nt, Human
cacuuggucugugagaugcuagaa

SEQ ID NO: 2761618 - RNA, 24 nt, Human
cacuugucaauaaaauccauacau

SEQ ID NO: 2761619 - RNA, 21 nt, Human
cacuuuagaauaugccuuguu

SEQ ID NO: 2761620 - RNA, 18 nt, Human
cacuuuaucuugaauaau

SEQ ID NO: 2761621 - RNA, 18 nt, Human
cacuuucccucuuggugc

SEQ ID NO: 2761622 - RNA, 20 nt, Human
cacuuugaacuacuagaaaa

SEQ ID NO: 2761623 - RNA, 13 nt, Human
cacuuuuauaaga

SEQ ID NO: 2761624 - RNA, 23 nt, Human
cacuuuuauguuaaugcucugga

SEQ ID NO: 2761625 - RNA, 18 nt, Human
cacuuuuggcuuguaaag

SEQ ID NO: 2761626 - RNA, 13 nt, Human
cacuuuuuuucuu

SEQ ID NO: 2761627 - RNA, 16 nt, Human
cacuuuuuuucuuuuc

SEQ ID NO: 2761628 - RNA, 20 nt, Human
cagaaaaagcaucauggcua

SEQ ID NO: 2761629 - RNA, 20 nt, Human
cagaaaacaaggaugaauua

SEQ ID NO: 2761630 - RNA, 13 nt, Human
cagaaaaguugaa

SEQ ID NO: 2761631 - RNA, 22 nt, Human
cagaaacuccuguucaugccca

SEQ ID NO: 2761632 - RNA, 18 nt, Human
cagaaagcagaacaguga

SEQ ID NO: 2761633 - RNA, 22 nt, Human
cagaaagcaguugagacaagaa

SEQ ID NO: 2761634 - RNA, 23 nt, Human
cagaaagcaguugagacaagaaa

SEQ ID NO: 2761635 - RNA, 19 nt, Human
cagaaauacagauuuugau

SEQ ID NO: 2761636 - RNA, 23 nt, Human
cagaaauuuaauucauguuucuu

SEQ ID NO: 2761637 - RNA, 12 nt, Human
cagaacagugau

SEQ ID NO: 2761638 - RNA, 15 nt, Human
cagaacuaaaaauua

SEQ ID NO: 2761639 - RNA, 22 nt, Human
cagaacuaaaaauuaaaaccuc

SEQ ID NO: 2761640 - RNA, 16 nt, Human
cagaagcaacccaaau

SEQ ID NO: 2761641 - RNA, 21 nt, Human
cagaagcaacccaaauguuca

SEQ ID NO: 2761642 - RNA, 18 nt, Human
cagaagugcuuucuucuc

SEQ ID NO: 2761643 - RNA, 17 nt, Human
cagaaguuucuucuuua

SEQ ID NO: 2761644 - RNA, 19 nt, Human
cagaauagaaauuaguacu

SEQ ID NO: 2761645 - RNA, 18 nt, Human
cagaaucucucuucuuuu

SEQ ID NO: 2761646 - RNA, 14 nt, Human
cagaaugaccuggc

SEQ ID NO: 2761647 - RNA, 15 nt, Human
cagaauucauucacu

SEQ ID NO: 2761648 - RNA, 20 nt, Human
cagaauucauucacucaaca

SEQ ID NO: 2761649 - RNA, 13 nt, Human
cagaauucugcua

SEQ ID NO: 2761650 - RNA, 13 nt, Human
cagacaagcugca

SEQ ID NO: 2761651 - RNA, 17 nt, Human
cagacaagcugcauuuc

SEQ ID NO: 2761652 - RNA, 18 nt, Human
cagacacaaauaaaggaa

SEQ ID NO: 2761653 - RNA, 20 nt, Human
cagacacaaauaaaggaaac

SEQ ID NO: 2761654 - RNA, 14 nt, Human
cagacagaaaaaac

SEQ ID NO: 2761655 - RNA, 12 nt, Human
cagacagaugga

SEQ ID NO: 2761656 - RNA, 17 nt, Human
cagacagauggaaaagg

SEQ ID NO: 2761657 - RNA, 15 nt, Human
cagacaguguuuucu

SEQ ID NO: 2761658 - RNA, 14 nt, Human
cagacauacauuuc

SEQ ID NO: 2761659 - RNA, 18 nt, Human
cagacauacauuucucau

SEQ ID NO: 2761660 - RNA, 17 nt, Human
cagacaucaacagauaa

SEQ ID NO: 2761661 - RNA, 21 nt, Human
cagacauguggugggacaggg

SEQ ID NO: 2761662 - RNA, 15 nt, Human
cagaccauaauguua

SEQ ID NO: 2761663 - RNA, 17 nt, Human
cagaccauaauguuaca

SEQ ID NO: 2761664 - RNA, 23 nt, Human
cagaccgggguucccgugugccu

SEQ ID NO: 2761665 - RNA, 21 nt, Human
cagaccuuugaacuagaguuu

SEQ ID NO: 2761666 - RNA, 14 nt, Human
cagacucacugugg

SEQ ID NO: 2761667 - RNA, 16 nt, Human
cagacucacuguggga

SEQ ID NO: 2761668 - RNA, 14 nt, Human
cagacucuaagaaa

SEQ ID NO: 2761669 - RNA, 16 nt, Human
cagacucuaagaaaga

SEQ ID NO: 2761670 - RNA, 18 nt, Human
cagacucuaagaaagaac

SEQ ID NO: 2761671 - RNA, 19 nt, Human
cagacucuaagaaagaaca

SEQ ID NO: 2761672 - RNA, 21 nt, Human
cagacuggauaguccgucucu

SEQ ID NO: 2761673 - RNA, 20 nt, Human
cagacuggcacaguuuucug

SEQ ID NO: 2761674 - RNA, 21 nt, Human
cagacuguuuuucagggaggu

SEQ ID NO: 2761675 - RNA, 23 nt, Human
cagacuuuuuuuuuuuuuuaaac

SEQ ID NO: 2761676 - RNA, 16 nt, Human
cagagaaaauaaaagc

SEQ ID NO: 2761677 - RNA, 19 nt, Human
cagagaaaauaaaagcacu

SEQ ID NO: 2761678 - RNA, 18 nt, Human
cagagaagggcuuggacu

SEQ ID NO: 2761679 - RNA, 20 nt, Human
cagagaagggcuuggacuca

SEQ ID NO: 2761680 - RNA, 20 nt, Human
cagagaaguuuucuggaggu

SEQ ID NO: 2761681 - RNA, 18 nt, Human
cagagacagaaagcagaa

SEQ ID NO: 2761682 - RNA, 14 nt, Human
cagagacaggaccu

SEQ ID NO: 2761683 - RNA, 17 nt, Human
cagagaccuuccagaaa

SEQ ID NO: 2761684 - RNA, 23 nt, Human
cagagacgggguuugccaugcug

SEQ ID NO: 2761685 - RNA, 23 nt, Human
cagagacucagggccccagcacu

SEQ ID NO: 2761686 - RNA, 13 nt, Human
cagagauaaagcu

SEQ ID NO: 2761687 - RNA, 20 nt, Human
cagagaugaggccgccaugu

SEQ ID NO: 2761688 - RNA, 19 nt, Human
cagagcaagaccccaucuc

SEQ ID NO: 2761689 - RNA, 14 nt, Human
cagagccucgagga

SEQ ID NO: 2761690 - RNA, 16 nt, Human
cagagcugcccucucc

SEQ ID NO: 2761691 - RNA, 18 nt, Human
cagagcugcccucuccug

SEQ ID NO: 2761692 - RNA, 19 nt, Human
cagagcugcccucuccugg

SEQ ID NO: 2761693 - RNA, 16 nt, Human
cagaggcucuaaugua

SEQ ID NO: 2761694 - RNA, 18 nt, Human
cagaggcucuaauguaca

SEQ ID NO: 2761695 - RNA, 21 nt, Human
cagaggcucuaauguacaaua

SEQ ID NO: 2761696 - RNA, 22 nt, Human
cagaggcucuaauguacaauaa

SEQ ID NO: 2761697 - RNA, 23 nt, Human
cagaggcucuaauguacaauaaa

SEQ ID NO: 2761698 - RNA, 16 nt, Human
cagagggaucaagcag

SEQ ID NO: 2761699 - RNA, 15 nt, Human
cagaggggcccauga

SEQ ID NO: 2761700 - RNA, 14 nt, Human
cagagguugcagug

SEQ ID NO: 2761701 - RNA, 22 nt, Human
cagaguacuggcugauggagua

SEQ ID NO: 2761702 - RNA, 14 nt, Human
cagagucaagggug

SEQ ID NO: 2761703 - RNA, 18 nt, Human
cagagucaagggugugug

SEQ ID NO: 2761704 - RNA, 19 nt, Human
cagagucaagggugugugc

SEQ ID NO: 2761705 - RNA, 23 nt, Human
cagagucaagggugugugcagca

SEQ ID NO: 2761706 - RNA, 21 nt, Human
cagagucaaugaacuuuccac

SEQ ID NO: 2761707 - RNA, 18 nt, Human
cagagucuuccucugucu

SEQ ID NO: 2761708 - RNA, 18 nt, Human
cagaguuccgacugccau

SEQ ID NO: 2761709 - RNA, 18 nt, Human
cagaguuggugacacagc

SEQ ID NO: 2761710 - RNA, 15 nt, Human
cagauaugauucaaa

SEQ ID NO: 2761711 - RNA, 16 nt, Human
cagaucaagccugccu

SEQ ID NO: 2761712 - RNA, 12 nt, Human
cagaucacagcu

SEQ ID NO: 2761713 - RNA, 15 nt, Human
cagaucacuugagcu

SEQ ID NO: 2761714 - RNA, 15 nt, Human
cagaucauuucaaaa

SEQ ID NO: 2761715 - RNA, 19 nt, Human
cagauccccaagccuggca

SEQ ID NO: 2761716 - RNA, 17 nt, Human
cagauccuccucauuca

SEQ ID NO: 2761717 - RNA, 20 nt, Human
cagauccuccucauucacau

SEQ ID NO: 2761718 - RNA, 13 nt, Human
cagauccuggaaa

SEQ ID NO: 2761719 - RNA, 14 nt, Human
cagauccuggaaau

SEQ ID NO: 2761720 - RNA, 22 nt, Human
cagaucuaugccacaagaaccc

SEQ ID NO: 2761721 - RNA, 15 nt, Human
cagaucuuucugccu

SEQ ID NO: 2761722 - RNA, 20 nt, Human
cagaugcacaugagcuggcg

SEQ ID NO: 2761723 - RNA, 21 nt, Human
cagauggccuggcugcugcug

SEQ ID NO: 2761724 - RNA, 21 nt, Human
cagaugucgcccuacucaccu

SEQ ID NO: 2761725 - RNA, 16 nt, Human
cagauucaugcacugu

SEQ ID NO: 2761726 - RNA, 20 nt, Human
cagauucucccuugcucugc

SEQ ID NO: 2761727 - RNA, 19 nt, Human
cagauucuuuacccccugg

SEQ ID NO: 2761728 - RNA, 14 nt, Human
cagauuugagcuca

SEQ ID NO: 2761729 - RNA, 15 nt, Human
cagauuugcaaaguu

SEQ ID NO: 2761730 - RNA, 12 nt, Human
cagauuuuccug

SEQ ID NO: 2761731 - RNA, 17 nt, Human
cagauuuuccugaaaac

SEQ ID NO: 2761732 - RNA, 18 nt, Human
cagauuuuuacacaugua

SEQ ID NO: 2761733 - RNA, 22 nt, Human
cagcaagggugaugggaaagca

SEQ ID NO: 2761734 - RNA, 13 nt, Human
cagcacccucucc

SEQ ID NO: 2761735 - RNA, 17 nt, Human
cagcacccucuccagau

SEQ ID NO: 2761736 - RNA, 19 nt, Human
cagcacgggggccaaggau

SEQ ID NO: 2761737 - RNA, 22 nt, Human
cagcacgggggccaaggaugcc

SEQ ID NO: 2761738 - RNA, 22 nt, Human
cagcagccagccaacccuuuca

SEQ ID NO: 2761739 - RNA, 21 nt, Human
cagcagcugcagcucaugagu

SEQ ID NO: 2761740 - RNA, 11 nt, Human
cagcaguucag

SEQ ID NO: 2761741 - RNA, 13 nt, Human
cagcaguucagag

SEQ ID NO: 2761742 - RNA, 15 nt, Human
cagcaguucagagcu

SEQ ID NO: 2761743 - RNA, 16 nt, Human
cagcaguucagagcug

SEQ ID NO: 2761744 - RNA, 17 nt, Human
cagcaguucagagcugc

SEQ ID NO: 2761745 - RNA, 15 nt, Human
cagcaguugaaaaga

SEQ ID NO: 2761746 - RNA, 17 nt, Human
cagcaguugaaaagacu

SEQ ID NO: 2761747 - RNA, 18 nt, Human
cagcauaauacuugcuuu

SEQ ID NO: 2761748 - RNA, 14 nt, Human
cagcaucagcaucc

SEQ ID NO: 2761749 - RNA, 23 nt, Human
cagcaucucugaacauuucucug

SEQ ID NO: 2761750 - RNA, 17 nt, Human
cagcaucugccuccccu

SEQ ID NO: 2761751 - RNA, 20 nt, Human
cagcaugcugagauuacagg

SEQ ID NO: 2761752 - RNA, 21 nt, Human
cagcauuuuacuacuuuaaaa

SEQ ID NO: 2761753 - RNA, 14 nt, Human
cagccaaccugggg

SEQ ID NO: 2761754 - RNA, 14 nt, Human
cagccaccagucca

SEQ ID NO: 2761755 - RNA, 15 nt, Human
cagccagcacagccu

SEQ ID NO: 2761756 - RNA, 12 nt, Human
cagccagcagcc

SEQ ID NO: 2761757 - RNA, 16 nt, Human
cagccagcaguucaga

SEQ ID NO: 2761758 - RNA, 15 nt, Human
cagccagccaacccu

SEQ ID NO: 2761759 - RNA, 16 nt, Human
cagccagcccucuucu

SEQ ID NO: 2761760 - RNA, 23 nt, Human
cagccagcccucuucugacacua

SEQ ID NO: 2761761 - RNA, 17 nt, Human
cagccagcucucagcca

SEQ ID NO: 2761762 - RNA, 18 nt, Human
cagccaggagcugggcag

SEQ ID NO: 2761763 - RNA, 23 nt, Human
cagccaggagcugggcagaaggc

SEQ ID NO: 2761764 - RNA, 13 nt, Human
cagccaggcggcu

SEQ ID NO: 2761765 - RNA, 23 nt, Human
cagccagugaccaaccuuuuccc

SEQ ID NO: 2761766 - RNA, 16 nt, Human
cagcccaagggugggu

SEQ ID NO: 2761767 - RNA, 16 nt, Human
cagcccaggauacugg

SEQ ID NO: 2761768 - RNA, 12 nt, Human
cagccccuggga

SEQ ID NO: 2761769 - RNA, 14 nt, Human
cagccccugggacc

SEQ ID NO: 2761770 - RNA, 15 nt, Human
cagccccugggacca

SEQ ID NO: 2761771 - RNA, 21 nt, Human
cagccccugggaccaggcacc

SEQ ID NO: 2761772 - RNA, 13 nt, Human
cagcccugcacca

SEQ ID NO: 2761773 - RNA, 17 nt, Human
cagcccugcaccaugcu

SEQ ID NO: 2761774 - RNA, 20 nt, Human
cagcccugcaccaugcugcu

SEQ ID NO: 2761775 - RNA, 17 nt, Human
cagcccuggcaacugcu

SEQ ID NO: 2761776 - RNA, 15 nt, Human
cagcccuggugggca

SEQ ID NO: 2761777 - RNA, 21 nt, Human
cagcccuuagcccuuccccuc

SEQ ID NO: 2761778 - RNA, 23 nt, Human
cagcccuucuuuccacagaagcu

SEQ ID NO: 2761779 - RNA, 14 nt, Human
cagcccuuuugucu

SEQ ID NO: 2761780 - RNA, 18 nt, Human
cagcccuuuugucucugc

SEQ ID NO: 2761781 - RNA, 19 nt, Human
cagcccuuuugucucugca

SEQ ID NO: 2761782 - RNA, 14 nt, Human
cagccgucaaaaga

SEQ ID NO: 2761783 - RNA, 18 nt, Human
cagccuagccgaccucag

SEQ ID NO: 2761784 - RNA, 20 nt, Human
cagccuagccgaccucagcc

SEQ ID NO: 2761785 - RNA, 13 nt, Human
cagccucagccuc

SEQ ID NO: 2761786 - RNA, 15 nt, Human
cagccucagccuccc

SEQ ID NO: 2761787 - RNA, 17 nt, Human
cagccucagccucccaa

SEQ ID NO: 2761788 - RNA, 22 nt, Human
cagccucccaaagugcugggau

SEQ ID NO: 2761789 - RNA, 23 nt, Human
cagccucccaaagugcugggauu

SEQ ID NO: 2761790 - RNA, 13 nt, Human
cagccucccaagc

SEQ ID NO: 2761791 - RNA, 22 nt, Human
cagccucccaagcaccugggau

SEQ ID NO: 2761792 - RNA, 18 nt, Human
cagccucuuagaugcagu

SEQ ID NO: 2761793 - RNA, 20 nt, Human
cagccucuuagaugcaguuc

SEQ ID NO: 2761794 - RNA, 23 nt, Human
cagccugaaacucauagacacug

SEQ ID NO: 2761795 - RNA, 20 nt, Human
cagccugaaagaggaaugaa

SEQ ID NO: 2761796 - RNA, 23 nt, Human
cagccugaaagaggaaugaagua

SEQ ID NO: 2761797 - RNA, 20 nt, Human
cagccugcagacucacugug

SEQ ID NO: 2761798 - RNA, 15 nt, Human
cagccugcucccuag

SEQ ID NO: 2761799 - RNA, 13 nt, Human
uuuucuuuucauu

SEQ ID NO: 2761800 - RNA, 15 nt, Human
uuuucuuuucauuua

SEQ ID NO: 2761801 - RNA, 19 nt, Human
uuuugaaaacuggcuacug

SEQ ID NO: 2761802 - RNA, 19 nt, Human
uuuugaagcuguauacugu

SEQ ID NO: 2761803 - RNA, 22 nt, Human
uuuugagauggagucuugcucu

SEQ ID NO: 2761804 - RNA, 16 nt, Human
uuuugagggugggggu

SEQ ID NO: 2761805 - RNA, 17 nt, Human
uuuugagggugggggug

SEQ ID NO: 2761806 - RNA, 22 nt, Human
uuuugcccaucccaaaaucaua

SEQ ID NO: 2761807 - RNA, 14 nt, Human
uuuugcuguagaag

SEQ ID NO: 2761808 - RNA, 13 nt, Human
uuuugcuguggca

SEQ ID NO: 2761809 - RNA, 13 nt, Human
uuuuggcauuuua

SEQ ID NO: 2761810 - RNA, 20 nt, Human
uuuugugaagaaacauuuau

SEQ ID NO: 2761811 - RNA, 18 nt, Human
uuuugugggaaauccaca

SEQ ID NO: 2761812 - RNA, 22 nt, Human
uuuuguuugguauuguauuuau

SEQ ID NO: 2761813 - RNA, 21 nt, Human
uuuuuaaaaauuaaaucaacc

SEQ ID NO: 2761814 - RNA, 11 nt, Human
uuuuuaaacaa

SEQ ID NO: 2761815 - RNA, 12 nt, Human
uuuuuaaauaaa

SEQ ID NO: 2761816 - RNA, 15 nt, Human
uuuuuaaauaaagaa

SEQ ID NO: 2761817 - RNA, 17 nt, Human
uuuuuaauuauauggcu

SEQ ID NO: 2761818 - RNA, 12 nt, Human
uuuuuaauuucu

SEQ ID NO: 2761819 - RNA, 23 nt, Human
uuuuuacauucugaauauguccu

SEQ ID NO: 2761820 - RNA, 22 nt, Human
uuuuuagagaaguucaauauaa

SEQ ID NO: 2761821 - RNA, 14 nt, Human
uuuuuaucauguga

SEQ ID NO: 2761822 - RNA, 16 nt, Human
uuuuuauuaugcauua

SEQ ID NO: 2761823 - RNA, 20 nt, Human
uuuuucagaaucucucuucu

SEQ ID NO: 2761824 - RNA, 14 nt, Human
uuuuucauaaagca

SEQ ID NO: 2761825 - RNA, 22 nt, Human
uuuuuccaauuagcuccuccuu

SEQ ID NO: 2761826 - RNA, 22 nt, Human
uuuuuccccaaaaagaauggga

SEQ ID NO: 2761827 - RNA, 16 nt, Human
uuuuuguaacuggagc

SEQ ID NO: 2761828 - RNA, 12 nt, Human
uuuuuguaaguu

SEQ ID NO: 2761829 - RNA, 12 nt, Human
uuuuuguucaua

SEQ ID NO: 2761830 - RNA, 14 nt, Human
uuuuuguuuuguuu

SEQ ID NO: 2761831 - RNA, 12 nt, Human
uuuuuuaaauag

SEQ ID NO: 2761832 - RNA, 13 nt, Human
uuuuuuacuuccu

SEQ ID NO: 2761833 - RNA, 13 nt, Human
uuuuuuauaauca

SEQ ID NO: 2761834 - RNA, 12 nt, Human
uuuuuucugaaa

SEQ ID NO: 2761835 - RNA, 11 nt, Human
uuuuuuuaaaa

SEQ ID NO: 2761836 - RNA, 18 nt, Human
uuuuuuuaaaaaauagca

SEQ ID NO: 2761837 - RNA, 12 nt, Human
uuuuuuuaauaa

SEQ ID NO: 2761838 - RNA, 12 nt, Human
uuuuuuuuaaac

SEQ ID NO: 2761839 - RNA, 11 nt, Human
uuuuuuuucaa

SEQ ID NO: 2761840 - RNA, 11 nt, Human
uuuuuuuuccc

SEQ ID NO: 2761841 - RNA, 13 nt, Human
uuuuuuuuuucaa

SEQ ID NO: 2761842 - RNA, 13 nt, Human
uuuuuuuuuuccc

SEQ ID NO: 2761843 - RNA, 15 nt, Human
uuuccaauuagcucc

SEQ ID NO: 2761844 - RNA, 17 nt, Human
uuuccaauuagcuccuc

SEQ ID NO: 2761845 - RNA, 14 nt, Human
uuuccacagaagcu

SEQ ID NO: 2761846 - RNA, 18 nt, Human
uuuccacagugacuccac

SEQ ID NO: 2761847 - RNA, 17 nt, Human
uuuccacauucagagcu

SEQ ID NO: 2761848 - RNA, 16 nt, Human
uuuccaucaaggguac

SEQ ID NO: 2761849 - RNA, 23 nt, Human
uuuccaucaaggguacacugccu

SEQ ID NO: 2761850 - RNA, 17 nt, Human
uuuccaugaguugcagu

SEQ ID NO: 2761851 - RNA, 14 nt, Human
uuucccaacuccag

SEQ ID NO: 2761852 - RNA, 15 nt, Human
uuucccagucuucag

SEQ ID NO: 2761853 - RNA, 20 nt, Human
uuucccucuuggugccucag

SEQ ID NO: 2761854 - RNA, 12 nt, Human
uuucccuucuuu

SEQ ID NO: 2761855 - RNA, 13 nt, Human
uuucccuucuuuu

SEQ ID NO: 2761856 - RNA, 15 nt, Human
uuuccuaauuuugag

SEQ ID NO: 2761857 - RNA, 18 nt, Human
uuuccuauguaacugcau

SEQ ID NO: 2761858 - RNA, 21 nt, Human
uuuccucaaaaagauuucccc

SEQ ID NO: 2761859 - RNA, 23 nt, Human
uuuccucaaaaagauuuccccau

SEQ ID NO: 2761860 - RNA, 22 nt, Human
uuuccucaacguugcuccccau

SEQ ID NO: 2761861 - RNA, 15 nt, Human
uuuccucauuuuuau

SEQ ID NO: 2761862 - RNA, 23 nt, Human
uuuccuccacaccauucaggucu

SEQ ID NO: 2761863 - RNA, 16 nt, Human
uuuccugaaaacccuu

SEQ ID NO: 2761864 - RNA, 16 nt, Human
uuuccugggagcuuuu

SEQ ID NO: 2761865 - RNA, 17 nt, Human
uuuccugggagcuuuug

SEQ ID NO: 2761866 - RNA, 12 nt, Human
uuuccuuccagu

SEQ ID NO: 2761867 - RNA, 18 nt, Human
uuuccuucuuuuuuucuu

SEQ ID NO: 2761868 - RNA, 20 nt, Human
uuuccuucuuuuuuucuuga

SEQ ID NO: 2761869 - RNA, 21 nt, Human
uuucgaugguacauauuucuu

SEQ ID NO: 2761870 - RNA, 20 nt, Human
uuucgucuguuuauaaacau

SEQ ID NO: 2761871 - RNA, 13 nt, Human
uuucuaaaaguuu

SEQ ID NO: 2761872 - RNA, 14 nt, Human
uuucuaaugagaua

SEQ ID NO: 2761873 - RNA, 16 nt, Human
uuucuauaauuuaaau

SEQ ID NO: 2761874 - RNA, 17 nt, Human
uuucuauaauuuaaaua

SEQ ID NO: 2761875 - RNA, 13 nt, Human
uuucuaucuaauu

SEQ ID NO: 2761876 - RNA, 12 nt, Human
uuucuaugaaau

SEQ ID NO: 2761877 - RNA, 14 nt, Human
uuucuaugaaauau

SEQ ID NO: 2761878 - RNA, 12 nt, Human
uuucuauuuauu

SEQ ID NO: 2761879 - RNA, 18 nt, Human
uuucucaucuugucccca

SEQ ID NO: 2761880 - RNA, 20 nt, Human
uuucucaucuuguccccaac

SEQ ID NO: 2761881 - RNA, 17 nt, Human
uuucucaucuuuuuacu

SEQ ID NO: 2761882 - RNA, 13 nt, Human
uuucucugagggg

SEQ ID NO: 2761883 - RNA, 18 nt, Human
uuucucugauacagaaaa

SEQ ID NO: 2761884 - RNA, 14 nt, Human
uuucugaaauuucc

SEQ ID NO: 2761885 - RNA, 16 nt, Human
uuucugaaauuuccug

SEQ ID NO: 2761886 - RNA, 19 nt, Human
uuucugagcauuuaauaug

SEQ ID NO: 2761887 - RNA, 16 nt, Human
uuucugaguuccugca

SEQ ID NO: 2761888 - RNA, 17 nt, Human
uuucugcauguucuaaa

SEQ ID NO: 2761889 - RNA, 15 nt, Human
uuucugccacccaaa

SEQ ID NO: 2761890 - RNA, 14 nt, Human
uuucuuaaagaauu

SEQ ID NO: 2761891 - RNA, 16 nt, Human
uuucuuaaagaauuuu

SEQ ID NO: 2761892 - RNA, 20 nt, Human
uuucuucaaauaaaucucuc

SEQ ID NO: 2761893 - RNA, 17 nt, Human
uuucuucuauugccucu

SEQ ID NO: 2761894 - RNA, 15 nt, Human
uuucuucucacauuu

SEQ ID NO: 2761895 - RNA, 12 nt, Human
uuucuucuccca

SEQ ID NO: 2761896 - RNA, 15 nt, Human
uuucuugaguuuugu

SEQ ID NO: 2761897 - RNA, 14 nt, Human
uuucuuuaguuuuu

SEQ ID NO: 2761898 - RNA, 15 nt, Human
uuucuuuauuuugag

SEQ ID NO: 2761899 - RNA, 11 nt, Human
uuucuuuguaa

SEQ ID NO: 2761900 - RNA, 14 nt, Human
uuucuuuguuucuu

SEQ ID NO: 2761901 - RNA, 17 nt, Human
uuugaaaccaugaagag

SEQ ID NO: 2761902 - RNA, 17 nt, Human
uuugaaagcuuuauuua

SEQ ID NO: 2761903 - RNA, 11 nt, Human
uuugaaauugu

SEQ ID NO: 2761904 - RNA, 23 nt, Human
uuugaacaacucgaaucacucau

SEQ ID NO: 2761905 - RNA, 21 nt, Human
uuugaacuacuagaaaauugu

SEQ ID NO: 2761906 - RNA, 22 nt, Human
uuugaacuagaguuuagcugga

SEQ ID NO: 2761907 - RNA, 15 nt, Human
uuugaauaaauaaau

SEQ ID NO: 2761908 - RNA, 21 nt, Human
uuugaauaaauaaauguaucu

SEQ ID NO: 2761909 - RNA, 17 nt, Human
uuugacuagaaaauuua

SEQ ID NO: 2761910 - RNA, 11 nt, Human
uuugagacaga

SEQ ID NO: 2761911 - RNA, 22 nt, Human
uuugagacagggaaagggucuc

SEQ ID NO: 2761912 - RNA, 17 nt, Human
uuugaguguuuuaagau

SEQ ID NO: 2761913 - RNA, 15 nt, Human
uuugauaugugaaca

SEQ ID NO: 2761914 - RNA, 20 nt, Human
uuugaugaacaaaauuuccu

SEQ ID NO: 2761915 - RNA, 22 nt, Human
uuugaugcuacaggauuugaaa

SEQ ID NO: 2761916 - RNA, 19 nt, Human
uuugccaaguucuccacua

SEQ ID NO: 2761917 - RNA, 21 nt, Human
uuugccaugcuggccaggcug

SEQ ID NO: 2761918 - RNA, 20 nt, Human
uuugccgcuuaagcuuucag

SEQ ID NO: 2761919 - RNA, 23 nt, Human
uuugcuaagcauuccaacuaucu

SEQ ID NO: 2761920 - RNA, 11 nt, Human
uuugcucagcu

SEQ ID NO: 2761921 - RNA, 19 nt, Human
uuugcucauggaauuggag

SEQ ID NO: 2761922 - RNA, 13 nt, Human
uuugcuguagaag

SEQ ID NO: 2761923 - RNA, 16 nt, Human
uuugcuguuauuuuau

SEQ ID NO: 2761924 - RNA, 22 nt, Human
uuugcuguuauuuuaucugcua

SEQ ID NO: 2761925 - RNA, 21 nt, Human
uuuggcauuuuacuguacaga

SEQ ID NO: 2761926 - RNA, 16 nt, Human
uuuggcuuguaaagua

SEQ ID NO: 2761927 - RNA, 21 nt, Human
uuugggaugcuacucuaguau

SEQ ID NO: 2761928 - RNA, 14 nt, Human
uuuggucuucuguu

SEQ ID NO: 2761929 - RNA, 13 nt, Human
uuugguucuaaua

SEQ ID NO: 2761930 - RNA, 19 nt, Human
uuugguuucuucauucuuu

SEQ ID NO: 2761931 - RNA, 12 nt, Human
uuuguaauauuu

SEQ ID NO: 2761932 - RNA, 21 nt, Human
uucuucuaccacccaccaguu

SEQ ID NO: 2761933 - RNA, 12 nt, Human
uucuucucccaa

SEQ ID NO: 2761934 - RNA, 22 nt, Human
uucuucucccaauucauccuca

SEQ ID NO: 2761935 - RNA, 13 nt, Human
uucuucuccuaaa

SEQ ID NO: 2761936 - RNA, 23 nt, Human
uucuugauaccugggauacugug

SEQ ID NO: 2761937 - RNA, 19 nt, Human
uucuuuaucuuuuuaguau

SEQ ID NO: 2761938 - RNA, 17 nt, Human
uucuuuguaaugaaaac

SEQ ID NO: 2761939 - RNA, 12 nt, Human
uucuuuugugaa

SEQ ID NO: 2761940 - RNA, 13 nt, Human
uucuuuuugcuau

SEQ ID NO: 2761941 - RNA, 22 nt, Human
uucuuuuuguuccccuuugcuu

SEQ ID NO: 2761942 - RNA, 13 nt, Human
uucuuuuuuuucu

SEQ ID NO: 2761943 - RNA, 17 nt, Human
uugaaaaaugcauguug

SEQ ID NO: 2761944 - RNA, 19 nt, Human
uugaaaacuggcuacugcu

SEQ ID NO: 2761945 - RNA, 22 nt, Human
uugaaaaucuuauaauuuaaaa

SEQ ID NO: 2761946 - RNA, 20 nt, Human
uugaaaaugguauuaaagau

SEQ ID NO: 2761947 - RNA, 23 nt, Human
uugaaaauuaacaugaauauuua

SEQ ID NO: 2761948 - RNA, 15 nt, Human
uugaaauagugucug

SEQ ID NO: 2761949 - RNA, 17 nt, Human
uugaacaacucgaauca

SEQ ID NO: 2761950 - RNA, 20 nt, Human
uugaacaaguuguuucauug

SEQ ID NO: 2761951 - RNA, 15 nt, Human
uugaacacuuuuuua

SEQ ID NO: 2761952 - RNA, 21 nt, Human
uugaacccugggacguggcua

SEQ ID NO: 2761953 - RNA, 15 nt, Human
uugaacuuuuuauug

SEQ ID NO: 2761954 - RNA, 15 nt, Human
uugaagcacagugau

SEQ ID NO: 2761955 - RNA, 21 nt, Human
uugaagcacagugaucaaguu

SEQ ID NO: 2761956 - RNA, 17 nt, Human
uugaaggaguccuugca

SEQ ID NO: 2761957 - RNA, 15 nt, Human
uugaaggaugcuguc

SEQ ID NO: 2761958 - RNA, 16 nt, Human
uugaagggaaauuuca

SEQ ID NO: 2761959 - RNA, 14 nt, Human
uugaaucucugaau

SEQ ID NO: 2761960 - RNA, 12 nt, Human
uugaauuuccau

SEQ ID NO: 2761961 - RNA, 19 nt, Human
uugaauuuccuaucuguau

SEQ ID NO: 2761962 - RNA, 13 nt, Human
uugacaaagguaa

SEQ ID NO: 2761963 - RNA, 15 nt, Human
uugacacuuaaaaau

SEQ ID NO: 2761964 - RNA, 19 nt, Human
uugacacuuaaaaaugguu

SEQ ID NO: 2761965 - RNA, 13 nt, Human
uugacccacaaga

SEQ ID NO: 2761966 - RNA, 14 nt, Human
uugacccacaagaa

SEQ ID NO: 2761967 - RNA, 15 nt, Human
uugacccacaagaaa

SEQ ID NO: 2761968 - RNA, 21 nt, Human
uugacuagaaaauuuaaaaca

SEQ ID NO: 2761969 - RNA, 23 nt, Human
uugacuuauuuauauaaauuuuu

SEQ ID NO: 2761970 - RNA, 16 nt, Human
uugagaaagucuuauu

SEQ ID NO: 2761971 - RNA, 14 nt, Human
uugagaagagaaua

SEQ ID NO: 2761972 - RNA, 19 nt, Human
uugagaaggagcucccagg

SEQ ID NO: 2761973 - RNA, 22 nt, Human
uugagaaggagcucccaggagg

SEQ ID NO: 2761974 - RNA, 15 nt, Human
uugagacaagaaaau

SEQ ID NO: 2761975 - RNA, 16 nt, Human
uugagacaagaaaaua

SEQ ID NO: 2761976 - RNA, 17 nt, Human
uugagacaagaaaauaa

SEQ ID NO: 2761977 - RNA, 11 nt, Human
uugagacagag

SEQ ID NO: 2761978 - RNA, 15 nt, Human
uugagcaucagugag

SEQ ID NO: 2761979 - RNA, 12 nt, Human
uugagccaccaa

SEQ ID NO: 2761980 - RNA, 19 nt, Human
uugagcccucuauggugug

SEQ ID NO: 2761981 - RNA, 15 nt, Human
uugagcucagcccug

SEQ ID NO: 2761982 - RNA, 21 nt, Human
uugaggaaaaugggcuuugga

SEQ ID NO: 2761983 - RNA, 21 nt, Human
uugaggcacagaaacuccugu

SEQ ID NO: 2761984 - RNA, 15 nt, Human
uugagggagcaaguc

SEQ ID NO: 2761985 - RNA, 22 nt, Human
uugaguacuuauggcccugaaa

SEQ ID NO: 2761986 - RNA, 15 nt, Human
uugaguuuaaauugu

SEQ ID NO: 2761987 - RNA, 19 nt, Human
uugauaagaucuuuuauuu

SEQ ID NO: 2761988 - RNA, 20 nt, Human
uugauagaguguuaucaguc

SEQ ID NO: 2761989 - RNA, 16 nt, Human
uugauccagaaagaaa

SEQ ID NO: 2761990 - RNA, 21 nt, Human
uugaugaagaaguugauaugc

SEQ ID NO: 2761991 - RNA, 19 nt, Human
uugauggagauauuuacau

SEQ ID NO: 2761992 - RNA, 15 nt, Human
uugauuaagaaagga

SEQ ID NO: 2761993 - RNA, 16 nt, Human
uugauuaagaaaggaa

SEQ ID NO: 2761994 - RNA, 23 nt, Human
uugauuuuauaugcuauuuauua

SEQ ID NO: 2761995 - RNA, 13 nt, Human
uugauuuucauua

SEQ ID NO: 2761996 - RNA, 20 nt, Human
uugcaagacauagaauagug

SEQ ID NO: 2761997 - RNA, 22 nt, Human
uugcaagacauagaauaguguu

SEQ ID NO: 2761998 - RNA, 14 nt, Human
uugcacaaaccaau

SEQ ID NO: 2761999 - RNA, 19 nt, Human
uugcauagaauaaaauuuu

SEQ ID NO: 2762000 - RNA, 18 nt, Human
uugcauagauucccugag

SEQ ID NO: 2762001 - RNA, 18 nt, Human
uugcaucaauuuuucuua

SEQ ID NO: 2762002 - RNA, 13 nt, Human
uugcauuuuacuu

SEQ ID NO: 2762003 - RNA, 21 nt, Human
uugccaaggcuggagugcagu

SEQ ID NO: 2762004 - RNA, 24 nt, Human
uugccaaggcuggagugcaguggc

SEQ ID NO: 2762005 - RNA, 19 nt, Human
uugccaggcuggagugcag

SEQ ID NO: 2762006 - RNA, 13 nt, Human
uugccaucccucc

SEQ ID NO: 2762007 - RNA, 17 nt, Human
uugccaucccucccucc

SEQ ID NO: 2762008 - RNA, 19 nt, Human
uugccaucccucccuccac

SEQ ID NO: 2762009 - RNA, 15 nt, Human
uugccaugagcuaga

SEQ ID NO: 2762010 - RNA, 14 nt, Human
uugccaugugcuag

SEQ ID NO: 2762011 - RNA, 18 nt, Human
uugcccagggcucagccu

SEQ ID NO: 2762012 - RNA, 21 nt, Human
uugcccugcugcccucccccu

SEQ ID NO: 2762013 - RNA, 15 nt, Human
uugccuaauuuguuu

SEQ ID NO: 2762014 - RNA, 21 nt, Human
uugccuaggcauagcccugcc

SEQ ID NO: 2762015 - RNA, 22 nt, Human
uugccuaggcauagcccugccu

SEQ ID NO: 2762016 - RNA, 23 nt, Human
uugccucaaccucccaagcaguu

SEQ ID NO: 2762017 - RNA, 23 nt, Human
uugccucacuucagguauaccuc

SEQ ID NO: 2762018 - RNA, 12 nt, Human
uugccucugaga

SEQ ID NO: 2762019 - RNA, 16 nt, Human
uugccucugagagcau

SEQ ID NO: 2762020 - RNA, 17 nt, Human
uugcuaacuggguuaaa

SEQ ID NO: 2762021 - RNA, 16 nt, Human
uugcuaacugguuaaa

SEQ ID NO: 2762022 - RNA, 20 nt, Human
uugcuaagcauuccaacuau

SEQ ID NO: 2762023 - RNA, 13 nt, Human
uugcuaauuuuua

SEQ ID NO: 2762024 - RNA, 15 nt, Human
uugcucauggaauug

SEQ ID NO: 2762025 - RNA, 15 nt, Human
uugcugcugagugca

SEQ ID NO: 2762026 - RNA, 14 nt, Human
uugcuggagcucug

SEQ ID NO: 2762027 - RNA, 16 nt, Human
uuggaaaacccagaua

SEQ ID NO: 2762028 - RNA, 22 nt, Human
uuggaaaacccagauaaagguu

SEQ ID NO: 2762029 - RNA, 18 nt, Human
uuggaagaggacuccuua

SEQ ID NO: 2762030 - RNA, 21 nt, Human
uuggaaggcugaggcaggagg

SEQ ID NO: 2762031 - RNA, 13 nt, Human
uuggacgagaaaa

SEQ ID NO: 2762032 - RNA, 22 nt, Human
uuggagcucguggaacaguuac

SEQ ID NO: 2762033 - RNA, 24 nt, Human
uuggauacgcaucagacagaugga

SEQ ID NO: 2762034 - RNA, 18 nt, Human
uuggauccuguguggaga

SEQ ID NO: 2762035 - RNA, 18 nt, Human
uuacuggaaggcuuccac

SEQ ID NO: 2762036 - RNA, 15 nt, Human
uuacuguaagaaaau

SEQ ID NO: 2762037 - RNA, 23 nt, Human
uuacuguacagacagaaaaaacu

SEQ ID NO: 2762038 - RNA, 19 nt, Human
uuacuuuccccuugguucu

SEQ ID NO: 2762039 - RNA, 10 nt, Human
uuacuuuuuc

SEQ ID NO: 2762040 - RNA, 21 nt, Human
uuagaaaaguuauguagaaaa

SEQ ID NO: 2762041 - RNA, 22 nt, Human
uuagaacuucaagcucuccaaa

SEQ ID NO: 2762042 - RNA, 19 nt, Human
uuagacccucaugcugcca

SEQ ID NO: 2762043 - RNA, 20 nt, Human
uuagacccucaugcugccaa

SEQ ID NO: 2762044 - RNA, 14 nt, Human
uuagaccucagccu

SEQ ID NO: 2762045 - RNA, 10 nt, Human
uuagagaagu

SEQ ID NO: 2762046 - RNA, 14 nt, Human
uuagagaauuuccu

SEQ ID NO: 2762047 - RNA, 15 nt, Human
uuagagaauuuccuu

SEQ ID NO: 2762048 - RNA, 16 nt, Human
uuagagauuuuuaaau

SEQ ID NO: 2762049 - RNA, 16 nt, Human
uuagauagaugaagaa

SEQ ID NO: 2762050 - RNA, 23 nt, Human
uuagaugcaguucugaagaagau

SEQ ID NO: 2762051 - RNA, 15 nt, Human
uuagaugggcauggu

SEQ ID NO: 2762052 - RNA, 22 nt, Human
uuagcagucccuccacauuucc

SEQ ID NO: 2762053 - RNA, 15 nt, Human
uuagccaagugcagg

SEQ ID NO: 2762054 - RNA, 17 nt, Human
uuagccgggcauggugg

SEQ ID NO: 2762055 - RNA, 16 nt, Human
uuagcuaaaucccucc

SEQ ID NO: 2762056 - RNA, 12 nt, Human
uuagcuggaaaa

SEQ ID NO: 2762057 - RNA, 24 nt, Human
uuagcuggaaaaguauguuagugc

SEQ ID NO: 2762058 - RNA, 19 nt, Human
uuagcuuagaccucagccu

SEQ ID NO: 2762059 - RNA, 17 nt, Human
uuagcuuuacuguuugu

SEQ ID NO: 2762060 - RNA, 18 nt, Human
uuaggaggacaaaaggaa

SEQ ID NO: 2762061 - RNA, 16 nt, Human
uuaggauguugaaaaa

SEQ ID NO: 2762062 - RNA, 12 nt, Human
uuagggagagaa

SEQ ID NO: 2762063 - RNA, 16 nt, Human
uuaguagagacagggu

SEQ ID NO: 2762064 - RNA, 18 nt, Human
uuagugaaauauuauuuu

SEQ ID NO: 2762065 - RNA, 22 nt, Human
uuagugcaaauugucacaggac

SEQ ID NO: 2762066 - RNA, 13 nt, Human
uuaguguacauga

SEQ ID NO: 2762067 - RNA, 14 nt, Human
uuaguguucauaaa

SEQ ID NO: 2762068 - RNA, 14 nt, Human
uuaguuuaaaaacc

SEQ ID NO: 2762069 - RNA, 18 nt, Human
uuauaaaaauaaaaaaca

SEQ ID NO: 2762070 - RNA, 13 nt, Human
uuauaaaaauaua

SEQ ID NO: 2762071 - RNA, 15 nt, Human
uuauaaaaauauaua

SEQ ID NO: 2762072 - RNA, 23 nt, Human
uuauaaauauauuuaagauaauu

SEQ ID NO: 2762073 - RNA, 22 nt, Human
uuauaagaaauaggaaauauuu

SEQ ID NO: 2762074 - RNA, 16 nt, Human
uuauaagcuguuuuua

SEQ ID NO: 2762075 - RNA, 17 nt, Human
uuauaaucuuucacagg

SEQ ID NO: 2762076 - RNA, 17 nt, Human
uuauaauuuuaaauguu

SEQ ID NO: 2762077 - RNA, 19 nt, Human
uuauacacuuuuuaaaauc

SEQ ID NO: 2762078 - RNA, 15 nt, Human
uuauacagugucuua

SEQ ID NO: 2762079 - RNA, 22 nt, Human
uuauacgauaaauaacuuuuuu

SEQ ID NO: 2762080 - RNA, 16 nt, Human
uuauagaauauuuauu

SEQ ID NO: 2762081 - RNA, 17 nt, Human
uuauagaauauuuauua

SEQ ID NO: 2762082 - RNA, 15 nt, Human
uuauagcuacuaauu

SEQ ID NO: 2762083 - RNA, 21 nt, Human
uuauagcuacuaauuuuaaaa

SEQ ID NO: 2762084 - RNA, 22 nt, Human
uuauagcuacuaauuuuaaaau

SEQ ID NO: 2762085 - RNA, 23 nt, Human
uuauagcuacuaauuuuaaaaug

SEQ ID NO: 2762086 - RNA, 23 nt, Human
uuauauagaaauguauucuuuua

SEQ ID NO: 2762087 - RNA, 19 nt, Human
uuauauauauauauuuuuu

SEQ ID NO: 2762088 - RNA, 15 nt, Human
uuauauauuguagau

SEQ ID NO: 2762089 - RNA, 18 nt, Human
uuauauauuguagauaau

SEQ ID NO: 2762090 - RNA, 14 nt, Human
uuauaugcuauuua

SEQ ID NO: 2762091 - RNA, 18 nt, Human
uuauauggggaauauauu

SEQ ID NO: 2762092 - RNA, 11 nt, Human
uuauauuucca

SEQ ID NO: 2762093 - RNA, 16 nt, Human
uuauauuuccaagaaa

SEQ ID NO: 2762094 - RNA, 15 nt, Human
uuauauuucuguuaa

SEQ ID NO: 2762095 - RNA, 14 nt, Human
uuauauuugaaaua

SEQ ID NO: 2762096 - RNA, 17 nt, Human
uuauauuugaaauauug

SEQ ID NO: 2762097 - RNA, 14 nt, Human
uuauauuuuuguga

SEQ ID NO: 2762098 - RNA, 19 nt, Human
uuaucaauaucuaauauau

SEQ ID NO: 2762099 - RNA, 13 nt, Human
uuaucauauuuca

SEQ ID NO: 2762100 - RNA, 20 nt, Human
uuaucaugugaaaucauuca

SEQ ID NO: 2762101 - RNA, 12 nt, Human
uuaucauuuuca

SEQ ID NO: 2762102 - RNA, 19 nt, Human
uuauccugucccuccucca

SEQ ID NO: 2762103 - RNA, 18 nt, Human
uuaucuaguuuaauuaau

SEQ ID NO: 2762104 - RNA, 16 nt, Human
uuaucuuaaaacuccu

SEQ ID NO: 2762105 - RNA, 20 nt, Human
uuaucuucaggacacucacu

SEQ ID NO: 2762106 - RNA, 19 nt, Human
uuaucuuuucauacauuuu

SEQ ID NO: 2762107 - RNA, 14 nt, Human
uuaugaaacauuac

SEQ ID NO: 2762108 - RNA, 23 nt, Human
uuaugaagcuuuuaugugaaaca

SEQ ID NO: 2762109 - RNA, 18 nt, Human
uuaugaguggcuuuaaug

SEQ ID NO: 2762110 - RNA, 21 nt, Human
uuaugaguggcuuuaaugaau

SEQ ID NO: 2762111 - RNA, 14 nt, Human
uuaugcauagauaa

SEQ ID NO: 2762112 - RNA, 13 nt, Human
uuaugcuaaguga

SEQ ID NO: 2762113 - RNA, 22 nt, Human
uuaugugcaauaaaauguauuu

SEQ ID NO: 2762114 - RNA, 14 nt, Human
uuauguuacuacau

SEQ ID NO: 2762115 - RNA, 18 nt, Human
uuauguuccuuuuaaaga

SEQ ID NO: 2762116 - RNA, 20 nt, Human
uuauguugcauagaauaaaa

SEQ ID NO: 2762117 - RNA, 13 nt, Human
uuauguuuaauuc

SEQ ID NO: 2762118 - RNA, 21 nt, Human
uuauguuuaauucugaaagca

SEQ ID NO: 2762119 - RNA, 13 nt, Human
uuauuaauaaaca

SEQ ID NO: 2762120 - RNA, 13 nt, Human
uuauuaauuugua

SEQ ID NO: 2762121 - RNA, 20 nt, Human
uuauuaccucugauaccuca

SEQ ID NO: 2762122 - RNA, 17 nt, Human
uuauuacuguaagaaaa

SEQ ID NO: 2762123 - RNA, 15 nt, Human
uuauuagaaguuuca

SEQ ID NO: 2762124 - RNA, 18 nt, Human
uuauuauagucacuaguu

SEQ ID NO: 2762125 - RNA, 14 nt, Human
uuauuauauuuaca

SEQ ID NO: 2762126 - RNA, 11 nt, Human
uuauuaugcau

SEQ ID NO: 2762127 - RNA, 12 nt, Human
uuauuauuuaua

SEQ ID NO: 2762128 - RNA, 13 nt, Human
uuauugagcaccu

SEQ ID NO: 2762129 - RNA, 14 nt, Human
uuauuguuuaaaau

SEQ ID NO: 2762130 - RNA, 22 nt, Human
uuauuuauaacaaccuaaauuu

SEQ ID NO: 2762131 - RNA, 13 nt, Human
uuauuucacuuua

SEQ ID NO: 2762132 - RNA, 17 nt, Human
uuauuucccucccaagu

SEQ ID NO: 2762133 - RNA, 17 nt, Human
uuauuuguacauuuuuu

SEQ ID NO: 2762134 - RNA, 18 nt, Human
uuauuuguuuaaaaagcg

SEQ ID NO: 2762135 - RNA, 15 nt, Human
uuauuuuuaaacugu

SEQ ID NO: 2762136 - RNA, 12 nt, Human
uuauuuuuuaau

SEQ ID NO: 2762137 - RNA, 13 nt, Human
uucaaaaaaaaac

SEQ ID NO: 2762138 - RNA, 17 nt, Human
uucaaaacuuauuggaa

SEQ ID NO: 2762139 - RNA, 17 nt, Human
uucaaaaguugaaauua

SEQ ID NO: 2762140 - RNA, 17 nt, Human
uucaaauccuugaagau

SEQ ID NO: 2762141 - RNA, 24 nt, Human
uucaaaugauuuucaaauuugaug

SEQ ID NO: 2762142 - RNA, 13 nt, Human
uucaacaguuuuu

SEQ ID NO: 2762143 - RNA, 15 nt, Human
uucaacuuuuccuuu

SEQ ID NO: 2762144 - RNA, 15 nt, Human
uucaagaccagccug

SEQ ID NO: 2762145 - RNA, 22 nt, Human
uucaauaaaacuuuuccaauga

SEQ ID NO: 2762146 - RNA, 22 nt, Human
uucaauaucuuuuuuuuaauaa

SEQ ID NO: 2762147 - RNA, 14 nt, Human
uucaauauuuauua

SEQ ID NO: 2762148 - RNA, 16 nt, Human
uucaaugccccugaau

SEQ ID NO: 2762149 - RNA, 21 nt, Human
uucacaaccacucauucaaaa

SEQ ID NO: 2762150 - RNA, 15 nt, Human
uucacaagugaaaaa

SEQ ID NO: 2762151 - RNA, 18 nt, Human
uuacacacauuaaaaugu

SEQ ID NO: 2762152 - RNA, 12 nt, Human
uuacacauuuuu

SEQ ID NO: 2762153 - RNA, 15 nt, Human
uuacacauuuuucag

SEQ ID NO: 2762154 - RNA, 19 nt, Human
uuacagaaagauuugaugu

SEQ ID NO: 2762155 - RNA, 20 nt, Human
uuacagagacagaaagcaga

SEQ ID NO: 2762156 - RNA, 16 nt, Human
uuacaggcgugagcca

SEQ ID NO: 2762157 - RNA, 21 nt, Human
uuacaggcgugagccaccaaa

SEQ ID NO: 2762158 - RNA, 18 nt, Human
uuacagguccugcugaaa

SEQ ID NO: 2762159 - RNA, 16 nt, Human
uuacaggugugagcca

SEQ ID NO: 2762160 - RNA, 15 nt, Human
uuacaucuuucacau

SEQ ID NO: 2762161 - RNA, 22 nt, Human
uuacaugaauugcauuuuacuu

SEQ ID NO: 2762162 - RNA, 16 nt, Human
uuacauguuuucuuug

SEQ ID NO: 2762163 - RNA, 23 nt, Human
uuacauuauuaucaacaauagug

SEQ ID NO: 2762164 - RNA, 14 nt, Human
uuacauuuccuaaa

SEQ ID NO: 2762165 - RNA, 17 nt, Human
uuacauuuccuaaauau

SEQ ID NO: 2762166 - RNA, 16 nt, Human
uuacauuuuaaacaca

SEQ ID NO: 2762167 - RNA, 17 nt, Human
uuaccagggacugaggg

SEQ ID NO: 2762168 - RNA, 20 nt, Human
uuaccauuauggauaaagau

SEQ ID NO: 2762169 - RNA, 22 nt, Human
uuaccucugccucagaaaacaa

SEQ ID NO: 2762170 - RNA, 15 nt, Human
uuaccugggaaaggg

SEQ ID NO: 2762171 - RNA, 16 nt, Human
uuaccugggaaagggc

SEQ ID NO: 2762172 - RNA, 17 nt, Human
uuaccuuuguucccaaa

SEQ ID NO: 2762173 - RNA, 15 nt, Human
uuaccuuuuuccuuc

SEQ ID NO: 2762174 - RNA, 15 nt, Human
uuacuacuuuaaaaa

SEQ ID NO: 2762175 - RNA, 17 nt, Human
uuacuaugcacaacaga

SEQ ID NO: 2762176 - RNA, 17 nt, Human
uuacucuguugccaggc

SEQ ID NO: 2762177 - RNA, 19 nt, Human
uuacugccgguuugaaaau

SEQ ID NO: 2762178 - RNA, 14 nt, Human
uguacuuuuuccag

SEQ ID NO: 2762179 - RNA, 21 nt, Human
uguagaaaaaaguaaauguga

SEQ ID NO: 2762180 - RNA, 13 nt, Human
uguagaaaagcua

SEQ ID NO: 2762181 - RNA, 23 nt, Human
uguagaaaagcuauaaaaugaau

SEQ ID NO: 2762182 - RNA, 19 nt, Human
uguagaaaugguuguauua

SEQ ID NO: 2762183 - RNA, 13 nt, Human
uguagaauauauu

SEQ ID NO: 2762184 - RNA, 18 nt, Human
uguagaauugugcaacca

SEQ ID NO: 2762185 - RNA, 16 nt, Human
uguagauaaacucaga

SEQ ID NO: 2762186 - RNA, 22 nt, Human
uguagauaauacaguucgguga

SEQ ID NO: 2762187 - RNA, 23 nt, Human
uguaggaaagaccauuuuuccuc

SEQ ID NO: 2762188 - RNA, 17 nt, Human
uguaggauguugagcag

SEQ ID NO: 2762189 - RNA, 22 nt, Human
uguaggcauguagcuacaggac

SEQ ID NO: 2762190 - RNA, 23 nt, Human
uguagguagaucuggucuuuaga

SEQ ID NO: 2762191 - RNA, 19 nt, Human
uguaggugacuauuauauu

SEQ ID NO: 2762192 - RNA, 15 nt, Human
uguaguguuggagaa

SEQ ID NO: 2762193 - RNA, 19 nt, Human
uguaguguuggagaagaac

SEQ ID NO: 2762194 - RNA, 13 nt, Human
uguaguuuuuaua

SEQ ID NO: 2762195 - RNA, 14 nt, Human
uguaguuuuuauau

SEQ ID NO: 2762196 - RNA, 21 nt, Human
uguauaaaauaauuuuuauau

SEQ ID NO: 2762197 - RNA, 22 nt, Human
uguauacugugugcuaaaacaa

SEQ ID NO: 2762198 - RNA, 21 nt, Human
uguauagaccuaaaauaaaau

SEQ ID NO: 2762199 - RNA, 13 nt, Human
uguauauuuuaua

SEQ ID NO: 2762200 - RNA, 20 nt, Human
uguauauuuuauaucaauuu

SEQ ID NO: 2762201 - RNA, 21 nt, Human
uguauauuuuauaucaauuua

SEQ ID NO: 2762202 - RNA, 16 nt, Human
uguaucacaaaucuua

SEQ ID NO: 2762203 - RNA, 15 nt, Human
uguaucuagccugga

SEQ ID NO: 2762204 - RNA, 16 nt, Human
uguaugacgugacugg

SEQ ID NO: 2762205 - RNA, 19 nt, Human
uguauuaaguuguuaauaa

SEQ ID NO: 2762206 - RNA, 15 nt, Human
uguauuacaaauauu

SEQ ID NO: 2762207 - RNA, 16 nt, Human
uguauuacaaauauuu

SEQ ID NO: 2762208 - RNA, 20 nt, Human
uguauuacaaauauuuugcu

SEQ ID NO: 2762209 - RNA, 16 nt, Human
uguauuaugcuaccug

SEQ ID NO: 2762210 - RNA, 16 nt, Human
uguauuauuuauaauu

SEQ ID NO: 2762211 - RNA, 18 nt, Human
uguauuauuuuuuaaaaa

SEQ ID NO: 2762212 - RNA, 23 nt, Human
uguauucagcuuuaguagauauu

SEQ ID NO: 2762213 - RNA, 14 nt, Human
uguauucuuuuagu

SEQ ID NO: 2762214 - RNA, 18 nt, Human
uguauucuuuuaguuuuu

SEQ ID NO: 2762215 - RNA, 13 nt, Human
uguauugcauuaa

SEQ ID NO: 2762216 - RNA, 15 nt, Human
uguauuuauaaauau

SEQ ID NO: 2762217 - RNA, 19 nt, Human
uguauuuauaaauauauuu

SEQ ID NO: 2762218 - RNA, 22 nt, Human
uguauuuauucaauaaaguauu

SEQ ID NO: 2762219 - RNA, 16 nt, Human
uguauuuauuuuuuua

SEQ ID NO: 2762220 - RNA, 20 nt, Human
uguauuuccccaacauguaa

SEQ ID NO: 2762221 - RNA, 14 nt, Human
uguauuuuaaaaga

SEQ ID NO: 2762222 - RNA, 15 nt, Human
uguauuuuaaaagaa

SEQ ID NO: 2762223 - RNA, 21 nt, Human
uguauuuuaaaauaaauuauu

SEQ ID NO: 2762224 - RNA, 18 nt, Human
uguauuuuuaccuuuuuc

SEQ ID NO: 2762225 - RNA, 12 nt, Human
uguauuuuuagu

SEQ ID NO: 2762226 - RNA, 19 nt, Human
uguauuuuuuuucuuguau

SEQ ID NO: 2762227 - RNA, 17 nt, Human
ugucaacuuguauuuuu

SEQ ID NO: 2762228 - RNA, 15 nt, Human
ugucaauaaaaucca

SEQ ID NO: 2762229 - RNA, 13 nt, Human
ugucaaugcagcc

SEQ ID NO: 2762230 - RNA, 23 nt, Human
ugucaauucuugccaaauauaaa

SEQ ID NO: 2762231 - RNA, 19 nt, Human
ugucacccagguuggagug

SEQ ID NO: 2762232 - RNA, 23 nt, Human
ugucacgugugggcaauguuccc

SEQ ID NO: 2762233 - RNA, 17 nt, Human
ugucauaaugguuuuua

SEQ ID NO: 2762234 - RNA, 20 nt, Human
ugucauaggcucuuuuggga

SEQ ID NO: 2762235 - RNA, 13 nt, Human
ugucauuugcugg

SEQ ID NO: 2762236 - RNA, 18 nt, Human
uguccauucuuccuccca

SEQ ID NO: 2762237 - RNA, 13 nt, Human
uguccccuauccu

SEQ ID NO: 2762238 - RNA, 21 nt, Human
uguccucaugagggcuggaug

SEQ ID NO: 2762239 - RNA, 14 nt, Human
uguccuuuuuaaug

SEQ ID NO: 2762240 - RNA, 14 nt, Human
ugucuaccuggucu

SEQ ID NO: 2762241 - RNA, 13 nt, Human
ugucuauucuagu

SEQ ID NO: 2762242 - RNA, 14 nt, Human
ugucuccucucucu

SEQ ID NO: 2762243 - RNA, 21 nt, Human
ugucucuaccaaaaaaaggaa

SEQ ID NO: 2762244 - RNA, 20 nt, Human
ugucucuacuaaaaauacaa

SEQ ID NO: 2762245 - RNA, 22 nt, Human
ugucucuacuaaaaauacaaaa

SEQ ID NO: 2762246 - RNA, 12 nt, Human
ugucucugaggg

SEQ ID NO: 2762247 - RNA, 21 nt, Human
ugucucugcaaacugccuucu

SEQ ID NO: 2762248 - RNA, 13 nt, Human
ugucugagacaga

SEQ ID NO: 2762249 - RNA, 18 nt, Human
ugucuggaaauagcccug

SEQ ID NO: 2762250 - RNA, 18 nt, Human
ugucuggacuuuccagag

SEQ ID NO: 2762251 - RNA, 18 nt, Human
ugucuuaauuaaaagaau

SEQ ID NO: 2762252 - RNA, 17 nt, Human
ugucuucaggggccaca

SEQ ID NO: 2762253 - RNA, 18 nt, Human
ugucuugcuugauuguau

SEQ ID NO: 2762254 - RNA, 16 nt, Human
ugucuuguguuucuuu

SEQ ID NO: 2762255 - RNA, 19 nt, Human
ugucuuguuggacgagaaa

SEQ ID NO: 2762256 - RNA, 18 nt, Human
ugucuuugccaaguucuc

SEQ ID NO: 2762257 - RNA, 15 nt, Human
ugucuuuguucuucu

SEQ ID NO: 2762258 - RNA, 21 nt, Human
ugucuuuuuucuaaaguaaaa

SEQ ID NO: 2762259 - RNA, 19 nt, Human
ugugaaaaaaaauuuuaua

SEQ ID NO: 2762260 - RNA, 14 nt, Human
ugugaacccaaagu

SEQ ID NO: 2762261 - RNA, 17 nt, Human
ugugaacgauuuagaaa

SEQ ID NO: 2762262 - RNA, 17 nt, Human
ugugaagguggaaauaa

SEQ ID NO: 2762263 - RNA, 15 nt, Human
ugugaaguuuaauug

SEQ ID NO: 2762264 - RNA, 16 nt, Human
ugugagaugcuagaac

SEQ ID NO: 2762265 - RNA, 22 nt, Human
ugugagccaccacauccagccu

SEQ ID NO: 2762266 - RNA, 17 nt, Human
ugugagcucaccagucc

SEQ ID NO: 2762267 - RNA, 22 nt, Human
ugugagcucaccagucccuccc

SEQ ID NO: 2762268 - RNA, 12 nt, Human
ugugaggagcug

SEQ ID NO: 2762269 - RNA, 22 nt, Human
ugugauauguaccuaacgaagu

SEQ ID NO: 2762270 - RNA, 16 nt, Human
ugugauuacccucugg

SEQ ID NO: 2762271 - RNA, 21 nt, Human
ugugauucacccugauuuuac

SEQ ID NO: 2762272 - RNA, 20 nt, Human
ugugauuuacgcucauugua

SEQ ID NO: 2762273 - RNA, 16 nt, Human
ugugcagccaccaguc

SEQ ID NO: 2762274 - RNA, 17 nt, Human
ugugcauauuuuauuau

SEQ ID NO: 2762275 - RNA, 21 nt, Human
ugugcaucaggcuuucuuuuu

SEQ ID NO: 2762276 - RNA, 21 nt, Human
ugugcauucuggauuuuaaaa

SEQ ID NO: 2762277 - RNA, 19 nt, Human
ugugccagauuuaugcaua

SEQ ID NO: 2762278 - RNA, 15 nt, Human
ugugccccugcacuc

SEQ ID NO: 2762279 - RNA, 14 nt, Human
ugugccuucauuuu

SEQ ID NO: 2762280 - RNA, 21 nt, Human
ugugccuuguuucaacaguuu

SEQ ID NO: 2762281 - RNA, 13 nt, Human
ugugcuaaaacaa

SEQ ID NO: 2762282 - RNA, 19 nt, Human
ugugcuaaaacaagcacua

SEQ ID NO: 2762283 - RNA, 18 nt, Human
ugugcuaguaauuggaaa

SEQ ID NO: 2762284 - RNA, 19 nt, Human
ugugcuaguaauuggaaag

SEQ ID NO: 2762285 - RNA, 14 nt, Human
ugugcucaggagcc

SEQ ID NO: 2762286 - RNA, 13 nt, Human
ugugcuggccacc

SEQ ID NO: 2762287 - RNA, 18 nt, Human
ugugcuggccaccugcug

SEQ ID NO: 2762288 - RNA, 16 nt, Human
ugugcuggcuuaaaau

SEQ ID NO: 2762289 - RNA, 15 nt, Human
ugugcuugagccagg

SEQ ID NO: 2762290 - RNA, 17 nt, Human
ugugcuugagccaggag

SEQ ID NO: 2762291 - RNA, 15 nt, Human
ugugcuuuuaaaaaa

SEQ ID NO: 2762292 - RNA, 19 nt, Human
uguggaacuagguuuuaau

SEQ ID NO: 2762293 - RNA, 17 nt, Human
uguggagagggaaugug

SEQ ID NO: 2762294 - RNA, 16 nt, Human
uguggcauuuucacuu

SEQ ID NO: 2762295 - RNA, 15 nt, Human
ugugggcuuuuauug

SEQ ID NO: 2762296 - RNA, 22 nt, Human
uguggguaguggggaagagggu

SEQ ID NO: 2762297 - RNA, 14 nt, Human
ugugggucauaccg

SEQ ID NO: 2762298 - RNA, 22 nt, Human
ugugguacaagcauucugucuu

SEQ ID NO: 2762299 - RNA, 18 nt, Human
uguggucacaggaaguag

SEQ ID NO: 2762300 - RNA, 17 nt, Human
uguguacagaauucugc

SEQ ID NO: 2762301 - RNA, 10 nt, Human
uguguauuuu

SEQ ID NO: 2762302 - RNA, 17 nt, Human
ugugucccauuccccca

SEQ ID NO: 2762303 - RNA, 23 nt, Human
ugugucugagagauucaugcuga

SEQ ID NO: 2762304 - RNA, 11 nt, Human
ugugugcagca

SEQ ID NO: 2762305 - RNA, 16 nt, Human
uguguguguaugugug

SEQ ID NO: 2762306 - RNA, 15 nt, Human
uguguguuauuuaaa

SEQ ID NO: 2762307 - RNA, 14 nt, Human
uguguguuuuaaaa

SEQ ID NO: 2762308 - RNA, 16 nt, Human
uguguguuuuaaaaug

SEQ ID NO: 2762309 - RNA, 14 nt, Human
uguguguuuuucau

SEQ ID NO: 2762310 - RNA, 14 nt, Human
uguguuauuuaaau

SEQ ID NO: 2762311 - RNA, 19 nt, Human
uguguuauuucccucccaa

SEQ ID NO: 2762312 - RNA, 18 nt, Human
uguguuuacuuuauguua

SEQ ID NO: 2762313 - RNA, 14 nt, Human
uguguuugaagcac

SEQ ID NO: 2762314 - RNA, 19 nt, Human
uguguuuuaaaaugagaaa

SEQ ID NO: 2762315 - RNA, 19 nt, Human
uguguuuuuaacaugucaa

SEQ ID NO: 2762316 - RNA, 15 nt, Human
uguguuuuucauaaa

SEQ ID NO: 2762317 - RNA, 18 nt, Human
uguuaaaacugggacagg

SEQ ID NO: 2762318 - RNA, 19 nt, Human
uguuaaaacugggacaggg

SEQ ID NO: 2762319 - RNA, 22 nt, Human
uguuaaaagaugaaaauauuug

SEQ ID NO: 2762320 - RNA, 15 nt, Human
uguuaaaugauuuca

SEQ ID NO: 2762321 - RNA, 19 nt, Human
uguuaauauugauuuauua

SEQ ID NO: 2762322 - RNA, 13 nt, Human
uguuagcaaaaug

SEQ ID NO: 2762323 - RNA, 20 nt, Human
uguuagccaggcuggucuca

SEQ ID NO: 2762324 - RNA, 17 nt, Human
uguuaucagucauaacu

SEQ ID NO: 2762325 - RNA, 15 nt, Human
uguuaucuucacuuu

SEQ ID NO: 2762326 - RNA, 15 nt, Human
uguuauguauuauua

SEQ ID NO: 2762327 - RNA, 12 nt, Human
uguuauuuauaa

SEQ ID NO: 2762328 - RNA, 18 nt, Human
uguuauuuuuuaauuauu

SEQ ID NO: 2762329 - RNA, 21 nt, Human
uguucaagcgauucuccugcc

SEQ ID NO: 2762330 - RNA, 22 nt, Human
uguucaagcgauucuccugccu

SEQ ID NO: 2762331 - RNA, 24 nt, Human
uguucaagcgauucuccugccuca

SEQ ID NO: 2762332 - RNA, 14 nt, Human
uguucacccaacca

SEQ ID NO: 2762333 - RNA, 17 nt, Human
uguucauaaauaaaguu

SEQ ID NO: 2762334 - RNA, 19 nt, Human
uguucaugcccauaccccu

SEQ ID NO: 2762335 - RNA, 15 nt, Human
uguucauuuccucaa

SEQ ID NO: 2762336 - RNA, 20 nt, Human
uguucccaccaggcugcuca

SEQ ID NO: 2762337 - RNA, 23 nt, Human
uguucccuggggcuuuaacuccu

SEQ ID NO: 2762338 - RNA, 15 nt, Human
uguuccuaauaaagc

SEQ ID NO: 2762339 - RNA, 16 nt, Human
ugagguaaaagcauca

SEQ ID NO: 2762340 - RNA, 19 nt, Human
ugagguaaccucauuauca

SEQ ID NO: 2762341 - RNA, 20 nt, Human
ugaguauauugauccagaaa

SEQ ID NO: 2762342 - RNA, 13 nt, Human
ugagucaacuccu

SEQ ID NO: 2762343 - RNA, 18 nt, Human
ugagucaacuccuuucuc

SEQ ID NO: 2762344 - RNA, 19 nt, Human
ugagucccaggcugagccu

SEQ ID NO: 2762345 - RNA, 14 nt, Human
ugagugcaccacuu

SEQ ID NO: 2762346 - RNA, 18 nt, Human
ugagugccuguaaucaca

SEQ ID NO: 2762347 - RNA, 19 nt, Human
ugagugcguggugcgagug

SEQ ID NO: 2762348 - RNA, 23 nt, Human
ugagugcucaguagucagacugg

SEQ ID NO: 2762349 - RNA, 18 nt, Human
ugaguggaugauguuucg

SEQ ID NO: 2762350 - RNA, 18 nt, Human
ugagugucuuaauuaaaa

SEQ ID NO: 2762351 - RNA, 22 nt, Human
ugaguguugccuaauuuguuuu

SEQ ID NO: 2762352 - RNA, 20 nt, Human
ugaguuacacuggaugaaaa

SEQ ID NO: 2762353 - RNA, 18 nt, Human
ugaguuuaaauuguaaua

SEQ ID NO: 2762354 - RNA, 19 nt, Human
ugaguuuuugauagcuuua

SEQ ID NO: 2762355 - RNA, 13 nt, Human
ugauaacuggaaa

SEQ ID NO: 2762356 - RNA, 14 nt, Human
ugauaacuggaaac

SEQ ID NO: 2762357 - RNA, 16 nt, Human
ugauaacuggaaacuu

SEQ ID NO: 2762358 - RNA, 20 nt, Human
ugauaacuggaaacuucagc

SEQ ID NO: 2762359 - RNA, 23 nt, Human
ugauaauaaaauucauuccauuu

SEQ ID NO: 2762360 - RNA, 12 nt, Human
ugauacagaaaa

SEQ ID NO: 2762361 - RNA, 16 nt, Human
ugauacagaaaaguug

SEQ ID NO: 2762362 - RNA, 13 nt, Human
ugauaccugggau

SEQ ID NO: 2762363 - RNA, 17 nt, Human
ugauacuugaaaauuaa

SEQ ID NO: 2762364 - RNA, 22 nt, Human
ugauaguuguaccgcaauguga

SEQ ID NO: 2762365 - RNA, 14 nt, Human
ugauaucaguccag

SEQ ID NO: 2762366 - RNA, 22 nt, Human
ugauaucccccagccucaaguc

SEQ ID NO: 2762367 - RNA, 12 nt, Human
ugauaugccuuu

SEQ ID NO: 2762368 - RNA, 19 nt, Human
ugauaugggucuugauaaa

SEQ ID NO: 2762369 - RNA, 16 nt, Human
ugauaugugaacaguu

SEQ ID NO: 2762370 - RNA, 14 nt, Human
ugaucaccugcccu

SEQ ID NO: 2762371 - RNA, 19 nt, Human
ugaucaccugcccugcuga

SEQ ID NO: 2762372 - RNA, 17 nt, Human
ugaucagaccauaaugu

SEQ ID NO: 2762373 - RNA, 18 nt, Human
ugaucagaccauaauguu

SEQ ID NO: 2762374 - RNA, 19 nt, Human
ugauccacccgccucagcc

SEQ ID NO: 2762375 - RNA, 20 nt, Human
ugauccgcccaucuccgucu

SEQ ID NO: 2762376 - RNA, 15 nt, Human
ugauccugcaauucc

SEQ ID NO: 2762377 - RNA, 23 nt, Human
ugaucgacuugccaaauuuagau

SEQ ID NO: 2762378 - RNA, 12 nt, Human
ugaucucagcuc

SEQ ID NO: 2762379 - RNA, 13 nt, Human
ugaucucagcuca

SEQ ID NO: 2762380 - RNA, 14 nt, Human
ugaucucagcucac

SEQ ID NO: 2762381 - RNA, 15 nt, Human
ugaucucagcucacu

SEQ ID NO: 2762382 - RNA, 23 nt, Human
ugaucuugcucucggugcuucca

SEQ ID NO: 2762383 - RNA, 17 nt, Human
ugaucuuuaaaauacac

SEQ ID NO: 2762384 - RNA, 15 nt, Human
ugaugacuuuuuaua

SEQ ID NO: 2762385 - RNA, 17 nt, Human
ugaugaucuuuaaaaua

SEQ ID NO: 2762386 - RNA, 21 nt, Human
ugaugcaacauccuugucuuu

SEQ ID NO: 2762387 - RNA, 21 nt, Human
ugaugcuacaggauuugaaau

SEQ ID NO: 2762388 - RNA, 15 nt, Human
ugaugggcaaaaaac

SEQ ID NO: 2762389 - RNA, 17 nt, Human
ugaugguuguacauaua

SEQ ID NO: 2762390 - RNA, 23 nt, Human
ugauguuguuaugggcaggaugg

SEQ ID NO: 2762391 - RNA, 16 nt, Human
ugauguuuagaaacac

SEQ ID NO: 2762392 - RNA, 22 nt, Human
ugauguuuagaaacacaacuau

SEQ ID NO: 2762393 - RNA, 13 nt, Human
ugauuacauuuua

SEQ ID NO: 2762394 - RNA, 20 nt, Human
ugauuacugccuauuuuaau

SEQ ID NO: 2762395 - RNA, 13 nt, Human
ugauuauauguca

SEQ ID NO: 2762396 - RNA, 20 nt, Human
ugauuaugaauuacauuugu

SEQ ID NO: 2762397 - RNA, 18 nt, Human
ugauuauuuuauguuuua

SEQ ID NO: 2762398 - RNA, 19 nt, Human
ugauucacccugauuuuac

SEQ ID NO: 2762399 - RNA, 17 nt, Human
ugauugcugguuuuagu

SEQ ID NO: 2762400 - RNA, 16 nt, Human
ugauuguaugaauuua

SEQ ID NO: 2762401 - RNA, 20 nt, Human
ugauuguaugaauuuaugcu

SEQ ID NO: 2762402 - RNA, 16 nt, Human
ugauuuaaggccaggc

SEQ ID NO: 2762403 - RNA, 22 nt, Human
ugauuuacgcucauuguagaaa

SEQ ID NO: 2762404 - RNA, 15 nt, Human
ugauuucauucaaua

SEQ ID NO: 2762405 - RNA, 18 nt, Human
ugauuucauucaauaucu

SEQ ID NO: 2762406 - RNA, 12 nt, Human
ugauuuccacag

SEQ ID NO: 2762407 - RNA, 16 nt, Human
ugauuuguguauuaua

SEQ ID NO: 2762408 - RNA, 22 nt, Human
ugauuuuacggagauaucccag

SEQ ID NO: 2762409 - RNA, 15 nt, Human
ugauuuuauaugcua

SEQ ID NO: 2762410 - RNA, 17 nt, Human
ugauuuuauuagaaguu

SEQ ID NO: 2762411 - RNA, 18 nt, Human
ugauuuugugauugauua

SEQ ID NO: 2762412 - RNA, 23 nt, Human
ugauuuuuaaguuauuuuuacau

SEQ ID NO: 2762413 - RNA, 16 nt, Human
ugcaaacugccuucuu

SEQ ID NO: 2762414 - RNA, 23 nt, Human
ugcaaauaaauauccuuuaauug

SEQ ID NO: 2762415 - RNA, 16 nt, Human
ugcaaauauaucugcu

SEQ ID NO: 2762416 - RNA, 13 nt, Human
ugcaaauugucac

SEQ ID NO: 2762417 - RNA, 16 nt, Human
ugcaaauugucacagg

SEQ ID NO: 2762418 - RNA, 17 nt, Human
ugcaaauugucacagga

SEQ ID NO: 2762419 - RNA, 12 nt, Human
ugcaaccaucac

SEQ ID NO: 2762420 - RNA, 15 nt, Human
ugcaaccaucaccag

SEQ ID NO: 2762421 - RNA, 14 nt, Human
ugcaaccuccaccu

SEQ ID NO: 2762422 - RNA, 18 nt, Human
ugcaaccucugccuccca

SEQ ID NO: 2762423 - RNA, 16 nt, Human
ugcaacuacuauccaa

SEQ ID NO: 2762424 - RNA, 17 nt, Human
ugcaacuuuguauaaaa

SEQ ID NO: 2762425 - RNA, 16 nt, Human
ugcaagccagauuuuc

SEQ ID NO: 2762426 - RNA, 21 nt, Human
ugcaauaaaauggguuuuacu

SEQ ID NO: 2762427 - RNA, 16 nt, Human
ugcaauacuucaauac

SEQ ID NO: 2762428 - RNA, 15 nt, Human
ugcaauuccacuuau

SEQ ID NO: 2762429 - RNA, 19 nt, Human
ugcacacagcacgggggcc

SEQ ID NO: 2762430 - RNA, 20 nt, Human
ugcacacagcacgggggcca

SEQ ID NO: 2762431 - RNA, 20 nt, Human
ugcacacccuccagagacaa

SEQ ID NO: 2762432 - RNA, 11 nt, Human
ugcacaucaaa

SEQ ID NO: 2762433 - RNA, 17 nt, Human
ugcacaucaaaauaugc

SEQ ID NO: 2762434 - RNA, 18 nt, Human
ugcaccacuucaagugac

SEQ ID NO: 2762435 - RNA, 12 nt, Human
ugcaccaugcug

SEQ ID NO: 2762436 - RNA, 16 nt, Human
ugcaccaugcugcugg

SEQ ID NO: 2762437 - RNA, 19 nt, Human
ugcaccaugcugcugggga

SEQ ID NO: 2762438 - RNA, 21 nt, Human
ugcaccaugcugcuggggaag

SEQ ID NO: 2762439 - RNA, 11 nt, Human
ugcaccauguc

SEQ ID NO: 2762440 - RNA, 16 nt, Human
ugcacuccagccugag

SEQ ID NO: 2762441 - RNA, 23 nt, Human
ugcacuggccacccaaggauguc

SEQ ID NO: 2762442 - RNA, 16 nt, Human
ugcagacucacugugg

SEQ ID NO: 2762443 - RNA, 18 nt, Human
ugcagacucacuguggga

SEQ ID NO: 2762444 - RNA, 19 nt, Human
ugcagagaugaggccgcca

SEQ ID NO: 2762445 - RNA, 21 nt, Human
ugcagaguacuggcugaugga

SEQ ID NO: 2762446 - RNA, 15 nt, Human
ugcagcaucagcauc

SEQ ID NO: 2762447 - RNA, 20 nt, Human
ugcagcauuuacuaugcaca

SEQ ID NO: 2762448 - RNA, 17 nt, Human
ugcagcgaguacuuccc

SEQ ID NO: 2762449 - RNA, 13 nt, Human
ugcagucccugca

SEQ ID NO: 2762450 - RNA, 11 nt, Human
ugcagugagcc

SEQ ID NO: 2762451 - RNA, 15 nt, Human
ugcagugccuuucuu

SEQ ID NO: 2762452 - RNA, 22 nt, Human
ugcagugccuuucuucucucca

SEQ ID NO: 2762453 - RNA, 17 nt, Human
ugcagugucugcuggag

SEQ ID NO: 2762454 - RNA, 18 nt, Human
ugcagugucugcuggaga

SEQ ID NO: 2762455 - RNA, 15 nt, Human
ugcaguucugaagaa

SEQ ID NO: 2762456 - RNA, 14 nt, Human
ugcauacaaucuga

SEQ ID NO: 2762457 - RNA, 20 nt, Human
ugcauacaguaauuuuaagu

SEQ ID NO: 2762458 - RNA, 20 nt, Human
ugcauacucauuaggauggc

SEQ ID NO: 2762459 - RNA, 22 nt, Human
ugcauacucauuaggauggcua

SEQ ID NO: 2762460 - RNA, 16 nt, Human
ugcauagaauaaaauu

SEQ ID NO: 2762461 - RNA, 23 nt, Human
ugcauagaauaaaauuuuuaauc

SEQ ID NO: 2762462 - RNA, 17 nt, Human
ugcauagguuuaauaau

SEQ ID NO: 2762463 - RNA, 16 nt, Human
ugcauauacuuuaaua

SEQ ID NO: 2762464 - RNA, 21 nt, Human
ugcaucaauuuuucuuauuuc

SEQ ID NO: 2762465 - RNA, 15 nt, Human
ugcaucagcugcuga

SEQ ID NO: 2762466 - RNA, 18 nt, Human
ugcaugcacuucuuacaa

SEQ ID NO: 2762467 - RNA, 18 nt, Human
ugcaugguuuagaaagcu

SEQ ID NO: 2762468 - RNA, 14 nt, Human
ugcauuaaauauaa

SEQ ID NO: 2762469 - RNA, 16 nt, Human
ugcauuauauuuauua

SEQ ID NO: 2762470 - RNA, 20 nt, Human
ugcauugagaacugcauaug

SEQ ID NO: 2762471 - RNA, 16 nt, Human
ugcauuguaggauguu

SEQ ID NO: 2762472 - RNA, 18 nt, Human
ugcauuucagaaaugcug

SEQ ID NO: 2762473 - RNA, 14 nt, Human
ugcauuucuaaagc

SEQ ID NO: 2762474 - RNA, 23 nt, Human
ugcauuuuguuugguauuguauu

SEQ ID NO: 2762475 - RNA, 14 nt, Human
ucugcuugccaucc

SEQ ID NO: 2762476 - RNA, 14 nt, Human
ucuggaaaccacau

SEQ ID NO: 2762477 - RNA, 13 nt, Human
ucuggacuugccu

SEQ ID NO: 2762478 - RNA, 20 nt, Human
ucuggauuugcaaccccauc

SEQ ID NO: 2762479 - RNA, 19 nt, Human
ucuggauuuuaaaaguuuu

SEQ ID NO: 2762480 - RNA, 14 nt, Human
ucuggcacuuggga

SEQ ID NO: 2762481 - RNA, 23 nt, Human
ucuggcacuugggacaaaaacaa

SEQ ID NO: 2762482 - RNA, 15 nt, Human
ucuggccuucggccu

SEQ ID NO: 2762483 - RNA, 23 nt, Human
ucuggccuucggccuccauccug

SEQ ID NO: 2762484 - RNA, 15 nt, Human
ucuggccuuguaaga

SEQ ID NO: 2762485 - RNA, 15 nt, Human
ucuggcuccagcugg

SEQ ID NO: 2762486 - RNA, 14 nt, Human
ucugggcagacucu

SEQ ID NO: 2762487 - RNA, 15 nt, Human
ucuggggcucuggga

SEQ ID NO: 2762488 - RNA, 16 nt, Human
ucugggucucaguguc

SEQ ID NO: 2762489 - RNA, 15 nt, Human
ucuggguuccuuccu

SEQ ID NO: 2762490 - RNA, 22 nt, Human
ucuggguuccuuccucugagcc

SEQ ID NO: 2762491 - RNA, 21 nt, Human
ucuggguugaagggcaguguu

SEQ ID NO: 2762492 - RNA, 20 nt, Human
ucugguagcuaaauauauau

SEQ ID NO: 2762493 - RNA, 16 nt, Human
ucugguugggcagcca

SEQ ID NO: 2762494 - RNA, 17 nt, Human
ucugguugggcagccag

SEQ ID NO: 2762495 - RNA, 14 nt, Human
ucuguaucuagccu

SEQ ID NO: 2762496 - RNA, 18 nt, Human
ucuguaucuagccuggaa

SEQ ID NO: 2762497 - RNA, 14 nt, Human
ucugucauuucaaa

SEQ ID NO: 2762498 - RNA, 13 nt, Human
ucuguccagggcc

SEQ ID NO: 2762499 - RNA, 23 nt, Human
ucugucuaccuggucugguuggg

SEQ ID NO: 2762500 - RNA, 18 nt, Human
ucugugaagugagaccuu

SEQ ID NO: 2762501 - RNA, 17 nt, Human
ucugugagaugcuagaa

SEQ ID NO: 2762502 - RNA, 19 nt, Human
ucugugagaugcuagaacu

SEQ ID NO: 2762503 - RNA, 20 nt, Human
ucugugagaugcuagaacuc

SEQ ID NO: 2762504 - RNA, 19 nt, Human
ucuguggccagaauuuaaa

SEQ ID NO: 2762505 - RNA, 14 nt, Human
ucuguucauuuccu

SEQ ID NO: 2762506 - RNA, 14 nt, Human
ucuguuccuuucuc

SEQ ID NO: 2762507 - RNA, 19 nt, Human
ucuguuuucccuccuugga

SEQ ID NO: 2762508 - RNA, 17 nt, Human
uccaacccgaggcccgc

SEQ ID NO: 2762509 - RNA, 24 nt, Human
uccaacuaucucauuuccaagcaa

SEQ ID NO: 2762510 - RNA, 20 nt, Human
uccaagcaaaugugaaucau

SEQ ID NO: 2762511 - RNA, 17 nt, Human
uccaagcaaguauuaga

SEQ ID NO: 2762512 - RNA, 15 nt, Human
uccaagccucauguc

SEQ ID NO: 2762513 - RNA, 20 nt, Human
uccaagccucauguccacug

SEQ ID NO: 2762514 - RNA, 14 nt, Human
uccaagccugacca

SEQ ID NO: 2762515 - RNA, 14 nt, Human
uccaagugauugaa

SEQ ID NO: 2762516 - RNA, 15 nt, Human
uccaagugauugaaa

SEQ ID NO: 2762517 - RNA, 17 nt, Human
uccaaguucaaaacuua

SEQ ID NO: 2762518 - RNA, 17 nt, Human
uccaauuagcuccuccu

SEQ ID NO: 2762519 - RNA, 18 nt, Human
uccaauuagcuccuccuu

SEQ ID NO: 2762520 - RNA, 23 nt, Human
uccaauuuuuggccaugaggaag

SEQ ID NO: 2762521 - RNA, 17 nt, Human
uccacaacacacagauu

SEQ ID NO: 2762522 - RNA, 20 nt, Human
uccacauuucccccuagccu

SEQ ID NO: 2762523 - RNA, 23 nt, Human
uccaccaggaguucucccaccac

SEQ ID NO: 2762524 - RNA, 23 nt, Human
uccaccaggauauccucccucca

SEQ ID NO: 2762525 - RNA, 17 nt, Human
uccaccagguucuuucu

SEQ ID NO: 2762526 - RNA, 21 nt, Human
uccacccgccucagccuccca

SEQ ID NO: 2762527 - RNA, 17 nt, Human
uccaccuacaugaggua

SEQ ID NO: 2762528 - RNA, 16 nt, Human
uccaccucccugcaau

SEQ ID NO: 2762529 - RNA, 21 nt, Human
uccaccucccugcaauaaaau

SEQ ID NO: 2762530 - RNA, 17 nt, Human
uccaccucgcagguuca

SEQ ID NO: 2762531 - RNA, 15 nt, Human
uccaccuuacuucuu

SEQ ID NO: 2762532 - RNA, 17 nt, Human
uccacguacugcagccu

SEQ ID NO: 2762533 - RNA, 14 nt, Human
uccacuuggucugu

SEQ ID NO: 2762534 - RNA, 17 nt, Human
uccacuuggucugugag

SEQ ID NO: 2762535 - RNA, 20 nt, Human
uccacuuuaucuugaauaau

SEQ ID NO: 2762536 - RNA, 19 nt, Human
uccacuuuaugugcaucuu

SEQ ID NO: 2762537 - RNA, 18 nt, Human
uccagaaagaaaacuugu

SEQ ID NO: 2762538 - RNA, 15 nt, Human
uccagacacuuuuuu

SEQ ID NO: 2762539 - RNA, 16 nt, Human
uccagaccugaagaau

SEQ ID NO: 2762540 - RNA, 20 nt, Human
uccagagggaauugcagagu

SEQ ID NO: 2762541 - RNA, 19 nt, Human
uccagauauacuugguucu

SEQ ID NO: 2762542 - RNA, 14 nt, Human
uccagauccuggaa

SEQ ID NO: 2762543 - RNA, 16 nt, Human
uccagauccuggaaau

SEQ ID NO: 2762544 - RNA, 21 nt, Human
uccagauccuggaaaucaggg

SEQ ID NO: 2762545 - RNA, 19 nt, Human
uccagaugagaguacaccc

SEQ ID NO: 2762546 - RNA, 22 nt, Human
uccagaugagaguacaccccaa

SEQ ID NO: 2762547 - RNA, 23 nt, Human
uccagaugagaguacaccccaac

SEQ ID NO: 2762548 - RNA, 19 nt, Human
uccagccaggccccaagcc

SEQ ID NO: 2762549 - RNA, 17 nt, Human
uccagccagggcaagag

SEQ ID NO: 2762550 - RNA, 14 nt, Human
uccagccucagccu

SEQ ID NO: 2762551 - RNA, 20 nt, Human
uccagccugagcgacaguga

SEQ ID NO: 2762552 - RNA, 16 nt, Human
uccagccugcugccug

SEQ ID NO: 2762553 - RNA, 19 nt, Human
uccagccuggcaaggguuc

SEQ ID NO: 2762554 - RNA, 21 nt, Human
uccagccuucucucaaggaga

SEQ ID NO: 2762555 - RNA, 13 nt, Human
uccagcugccccg

SEQ ID NO: 2762556 - RNA, 20 nt, Human
uccaggagaccuacccucca

SEQ ID NO: 2762557 - RNA, 15 nt, Human
uccaggcaccaggac

SEQ ID NO: 2762558 - RNA, 23 nt, Human
uccaggcuggcgugcagcaucag

SEQ ID NO: 2762559 - RNA, 21 nt, Human
uccaggugguaagcaccagga

SEQ ID NO: 2762560 - RNA, 19 nt, Human
uccaguauuguuccuuuug

SEQ ID NO: 2762561 - RNA, 12 nt, Human
uccagugauaag

SEQ ID NO: 2762562 - RNA, 15 nt, Human
ugaaagaaaauaacg

SEQ ID NO: 2762563 - RNA, 17 nt, Human
ugaaagaaaauaacgau

SEQ ID NO: 2762564 - RNA, 23 nt, Human
ugaaagaugacggaugccuagag

SEQ ID NO: 2762565 - RNA, 19 nt, Human
ugaaagcagggacuugaac

SEQ ID NO: 2762566 - RNA, 22 nt, Human
ugaaagggguugugaagaggug

SEQ ID NO: 2762567 - RNA, 14 nt, Human
ugaaagguacuuca

SEQ ID NO: 2762568 - RNA, 21 nt, Human
ugaaagguacuucaaauccuu

SEQ ID NO: 2762569 - RNA, 21 nt, Human
ugaaauaaacgucuuaaauau

SEQ ID NO: 2762570 - RNA, 15 nt, Human
ugaaauaagccagac

SEQ ID NO: 2762571 - RNA, 18 nt, Human
ugaaauaagccagacauc

SEQ ID NO: 2762572 - RNA, 17 nt, Human
ugaaauauugacuuuuu

SEQ ID NO: 2762573 - RNA, 18 nt, Human
ugaaauauugacuuuuua

SEQ ID NO: 2762574 - RNA, 13 nt, Human
ugaaaugcagagu

SEQ ID NO: 2762575 - RNA, 19 nt, Human
ugaaauggacuuuuguaca

SEQ ID NO: 2762576 - RNA, 21 nt, Human
ugaaauggacuuuuguacaua

SEQ ID NO: 2762577 - RNA, 17 nt, Human
ugaaauggugaaaugca

SEQ ID NO: 2762578 - RNA, 12 nt, Human
ugaaauuauuca

SEQ ID NO: 2762579 - RNA, 16 nt, Human
ugaaauuguauuacaa

SEQ ID NO: 2762580 - RNA, 21 nt, Human
ugaaauuuacaucauuucuuu

SEQ ID NO: 2762581 - RNA, 19 nt, Human
ugaacaaauuuacagagac

SEQ ID NO: 2762582 - RNA, 19 nt, Human
ugaacacugggggagggga

SEQ ID NO: 2762583 - RNA, 17 nt, Human
ugaacaggauauucuca

SEQ ID NO: 2762584 - RNA, 22 nt, Human
ugaacccauauuuguacaccaa

SEQ ID NO: 2762585 - RNA, 17 nt, Human
ugaaccucaagcugcau

SEQ ID NO: 2762586 - RNA, 20 nt, Human
ugaacuaggcugagcaaucu

SEQ ID NO: 2762587 - RNA, 21 nt, Human
ugaacuauaugacuggccaca

SEQ ID NO: 2762588 - RNA, 16 nt, Human
ugaacuucuccccugg

SEQ ID NO: 2762589 - RNA, 18 nt, Human
ugaacuugguuuuaauua

SEQ ID NO: 2762590 - RNA, 22 nt, Human
ugaagaaacauuuaucuuugua

SEQ ID NO: 2762591 - RNA, 13 nt, Human
ugaagaaguugau

SEQ ID NO: 2762592 - RNA, 14 nt, Human
ugaagaaguugaua

SEQ ID NO: 2762593 - RNA, 13 nt, Human
ugaagacccccaa

SEQ ID NO: 2762594 - RNA, 14 nt, Human
ugaagauguagagg

SEQ ID NO: 2762595 - RNA, 22 nt, Human
ugaagcaaaauuuuuucucuag

SEQ ID NO: 2762596 - RNA, 17 nt, Human
ugaaggauuuauguuua

SEQ ID NO: 2762597 - RNA, 14 nt, Human
ugaaggcaucccca

SEQ ID NO: 2762598 - RNA, 18 nt, Human
ugaaggggcggcggcccu

SEQ ID NO: 2762599 - RNA, 17 nt, Human
ugaagggguucucacag

SEQ ID NO: 2762600 - RNA, 21 nt, Human
ugaagguaaaauugaaaggca

SEQ ID NO: 2762601 - RNA, 17 nt, Human
ugaagguggaaauaaac

SEQ ID NO: 2762602 - RNA, 21 nt, Human
ugaaguacccguucacauuuu

SEQ ID NO: 2762603 - RNA, 16 nt, Human
ugaaguccaagcauuu

SEQ ID NO: 2762604 - RNA, 23 nt, Human
ugaaguccaagcauuuagaugua

SEQ ID NO: 2762605 - RNA, 21 nt, Human
ugaaguuuaauugacuuauuu

SEQ ID NO: 2762606 - RNA, 15 nt, Human
ugaauaauguaagac

SEQ ID NO: 2762607 - RNA, 14 nt, Human
ugaauacuuuauaa

SEQ ID NO: 2762608 - RNA, 13 nt, Human
ugaauauaaauuu

SEQ ID NO: 2762609 - RNA, 14 nt, Human
ugaauauaaauuua

SEQ ID NO: 2762610 - RNA, 17 nt, Human
ugaauauaaauuuauca

SEQ ID NO: 2762611 - RNA, 18 nt, Human
ugaauaucuauuaauaua

SEQ ID NO: 2762612 - RNA, 19 nt, Human
ugaauaucuauuaauauau

SEQ ID NO: 2762613 - RNA, 15 nt, Human
ugaauccucucucug

SEQ ID NO: 2762614 - RNA, 15 nt, Human
ugaaugaauggcuaa

SEQ ID NO: 2762615 - RNA, 15 nt, Human
ugaauggcuaagcaa

SEQ ID NO: 2762616 - RNA, 22 nt, Human
ugaauggcuaagcaaaauguga

SEQ ID NO: 2762617 - RNA, 18 nt, Human
ugaauguuaaauaaauug

SEQ ID NO: 2762618 - RNA, 21 nt, Human
ugaauguuaaauaaauuguau

SEQ ID NO: 2762619 - RNA, 13 nt, Human
ugaauuaaagaag

SEQ ID NO: 2762620 - RNA, 14 nt, Human
ugaauuaaagaaga

SEQ ID NO: 2762621 - RNA, 23 nt, Human
ugaauuacauuuguauaaaauaa

SEQ ID NO: 2762622 - RNA, 13 nt, Human
ugaauuaguuuua

SEQ ID NO: 2762623 - RNA, 16 nt, Human
ugaauuaguuuuauau

SEQ ID NO: 2762624 - RNA, 21 nt, Human
ugaauuaugaaacuuuuggaa

SEQ ID NO: 2762625 - RNA, 22 nt, Human
ugaauuauguuugcauguucac

SEQ ID NO: 2762626 - RNA, 23 nt, Human
ugaauuauguuugcauguucacu

SEQ ID NO: 2762627 - RNA, 14 nt, Human
ugaauucugucauu

SEQ ID NO: 2762628 - RNA, 21 nt, Human
ugaauuguaggugacuauuau

SEQ ID NO: 2762629 - RNA, 22 nt, Human
ugaauuuaaauagcuuuuuucu

SEQ ID NO: 2762630 - RNA, 22 nt, Human
ugaauuuuuuucaucuucucug

SEQ ID NO: 2762631 - RNA, 14 nt, Human
ugacaaagacaucg

SEQ ID NO: 2762632 - RNA, 13 nt, Human
ugacaaccaaaag

SEQ ID NO: 2762633 - RNA, 15 nt, Human
ugacaacuugaauaa

SEQ ID NO: 2762634 - RNA, 16 nt, Human
ugacaagguucuuccc

SEQ ID NO: 2762635 - RNA, 21 nt, Human
ugacacuaaaacaccucagcu

SEQ ID NO: 2762636 - RNA, 14 nt, Human
ugacagagucaagg

SEQ ID NO: 2762637 - RNA, 17 nt, Human
ugacagcccaagggugg

SEQ ID NO: 2762638 - RNA, 11 nt, Human
ugacaggaugu

SEQ ID NO: 2762639 - RNA, 12 nt, Human
ugacauuagaug

SEQ ID NO: 2762640 - RNA, 19 nt, Human
ugacauucggggugauccu

SEQ ID NO: 2762641 - RNA, 22 nt, Human
ugacauucggggugauccuguu

SEQ ID NO: 2762642 - RNA, 23 nt, Human
ugaccaacaucgcagacacaugu

SEQ ID NO: 2762643 - RNA, 19 nt, Human
ugaccaauaaccaugccca

SEQ ID NO: 2762644 - RNA, 11 nt, Human
ugaccacugca

SEQ ID NO: 2762645 - RNA, 17 nt, Human
ugaccacugcagaagac

SEQ ID NO: 2762646 - RNA, 20 nt, Human
ugaccaggcauccuccacaa

SEQ ID NO: 2762647 - RNA, 22 nt, Human
ugaccauacuaauuauaccccc

SEQ ID NO: 2762648 - RNA, 20 nt, Human
ugaccucaagugaucugccc

SEQ ID NO: 2762649 - RNA, 19 nt, Human
ugaccucaggcaaucugcc

SEQ ID NO: 2762650 - RNA, 16 nt, Human
ugaccugucucaccau

SEQ ID NO: 2762651 - RNA, 23 nt, Human
ugacggaagaguugagaccuaac

SEQ ID NO: 2762652 - RNA, 14 nt, Human
ugacgucaucauca

SEQ ID NO: 2762653 - RNA, 14 nt, Human
ugacgugacuggcc

SEQ ID NO: 2762654 - RNA, 20 nt, Human
ugacuagaaaauuuaaaaca

SEQ ID NO: 2762655 - RNA, 22 nt, Human
ugacuaugcaaccuuuggaugc

SEQ ID NO: 2762656 - RNA, 17 nt, Human
ugacuauggcuaccaaa

SEQ ID NO: 2762657 - RNA, 16 nt, Human
ugacuauuauagaaug

SEQ ID NO: 2762658 - RNA, 14 nt, Human
ugacuauuauauuu

SEQ ID NO: 2762659 - RNA, 16 nt, Human
ugacuauuauauuucc

SEQ ID NO: 2762660 - RNA, 17 nt, Human
ugacucuuggcacagca

SEQ ID NO: 2762661 - RNA, 19 nt, Human
ugacugccaagccaugggu

SEQ ID NO: 2762662 - RNA, 18 nt, Human
ugacugcuaguuuauaua

SEQ ID NO: 2762663 - RNA, 12 nt, Human
ugacugucacau

SEQ ID NO: 2762664 - RNA, 19 nt, Human
ugacuuaguguacaugaaa

SEQ ID NO: 2762665 - RNA, 20 nt, Human
ugacuuauuuauauaaauuu

SEQ ID NO: 2762666 - RNA, 19 nt, Human
ugacuucuaaguaaaacca

SEQ ID NO: 2762667 - RNA, 14 nt, Human
ugacuuuuuauacu

SEQ ID NO: 2762668 - RNA, 12 nt, Human
ugagaaagacua

SEQ ID NO: 2762669 - RNA, 18 nt, Human
ugagaaauuuauaaacuu

SEQ ID NO: 2762670 - RNA, 21 nt, Human
ugagaaggcuguggauuuaau

SEQ ID NO: 2762671 - RNA, 19 nt, Human
ugagaagucugcuacccuc

SEQ ID NO: 2762672 - RNA, 15 nt, Human
ugagacacugucucu

SEQ ID NO: 2762673 - RNA, 13 nt, Human
ugagacagagucu

SEQ ID NO: 2762674 - RNA, 20 nt, Human
ugagaccacuguuaucaaaa

SEQ ID NO: 2762675 - RNA, 14 nt, Human
ugagacucugucuc

SEQ ID NO: 2762676 - RNA, 19 nt, Human
ugagagaacagggcugaag

SEQ ID NO: 2762677 - RNA, 15 nt, Human
ugagagacagcaggu

SEQ ID NO: 2762678 - RNA, 21 nt, Human
ugagagauucaugcugauugu

SEQ ID NO: 2762679 - RNA, 22 nt, Human
ugagagcccugaggccuagacu

SEQ ID NO: 2762680 - RNA, 16 nt, Human
ugagaguacaccccaa

SEQ ID NO: 2762681 - RNA, 17 nt, Human
ugagagucugugaccca

SEQ ID NO: 2762682 - RNA, 15 nt, Human
ugagagugaacaaau

SEQ ID NO: 2762683 - RNA, 20 nt, Human
ugagagugaacaaauuuaca

SEQ ID NO: 2762684 - RNA, 16 nt, Human
ugagauacaaacaugu

SEQ ID NO: 2762685 - RNA, 13 nt, Human
ugagauccuuccu

SEQ ID NO: 2762686 - RNA, 23 nt, Human
ugagauccuuccuuuugagggag

SEQ ID NO: 2762687 - RNA, 19 nt, Human
ugagaucggugcguucucc

SEQ ID NO: 2762688 - RNA, 18 nt, Human
ugagaugggagaaucacu

SEQ ID NO: 2762689 - RNA, 18 nt, Human
ugagaugguuucuagaga

SEQ ID NO: 2762690 - RNA, 14 nt, Human
ugagauuacaggug

SEQ ID NO: 2762691 - RNA, 12 nt, Human
ugagcaccugca

SEQ ID NO: 2762692 - RNA, 19 nt, Human
ugagcaccugcaggcguga

SEQ ID NO: 2762693 - RNA, 23 nt, Human
ugagcaccugcaggcgugaccug

SEQ ID NO: 2762694 - RNA, 18 nt, Human
ugagcaucagugagguua

SEQ ID NO: 2762695 - RNA, 14 nt, Human
ugagcauguacuga

SEQ ID NO: 2762696 - RNA, 16 nt, Human
ugagccaaauguaaaa

SEQ ID NO: 2762697 - RNA, 13 nt, Human
ugagccaccaaac

SEQ ID NO: 2762698 - RNA, 15 nt, Human
ugagccaccacaucc

SEQ ID NO: 2762699 - RNA, 20 nt, Human
ugagccaccacauccagccu

SEQ ID NO: 2762700 - RNA, 13 nt, Human
ugagccagcagcc

SEQ ID NO: 2762701 - RNA, 21 nt, Human
ugagccagugucaggaggaag

SEQ ID NO: 2762702 - RNA, 23 nt, Human
ugagcccauggcacucuauguuc

SEQ ID NO: 2762703 - RNA, 14 nt, Human
ugagccccaaaagg

SEQ ID NO: 2762704 - RNA, 16 nt, Human
ugagccccgaaucuga

SEQ ID NO: 2762705 - RNA, 16 nt, Human
ugagccccggaggucg

SEQ ID NO: 2762706 - RNA, 15 nt, Human
ugagccuuuguugcu

SEQ ID NO: 2762707 - RNA, 19 nt, Human
ugagcgcccacuagaccca

SEQ ID NO: 2762708 - RNA, 21 nt, Human
ugagcgcccacuagacccacu

SEQ ID NO: 2762709 - RNA, 17 nt, Human
ugagcggaccuucccag

SEQ ID NO: 2762710 - RNA, 14 nt, Human
ugagcucaccaguc

SEQ ID NO: 2762711 - RNA, 12 nt, Human
uauuuuuucccc

SEQ ID NO: 2762712 - RNA, 12 nt, Human
uauuuuuuucug

SEQ ID NO: 2762713 - RNA, 20 nt, Human
uauuuuuuucugaauuauuu

SEQ ID NO: 2762714 - RNA, 22 nt, Human
uauuuuuuuuuuuuuuuuagcu

SEQ ID NO: 2762715 - RNA, 19 nt, Human
ucaaaaaaaaaaacaaaca

SEQ ID NO: 2762716 - RNA, 16 nt, Human
ucaaaaaauaaaaaua

SEQ ID NO: 2762717 - RNA, 21 nt, Human
ucaaaaagauuuccccauuua

SEQ ID NO: 2762718 - RNA, 20 nt, Human
ucaaaacuucagacauagaa

SEQ ID NO: 2762719 - RNA, 21 nt, Human
ucaaaacuucagacauagaau

SEQ ID NO: 2762720 - RNA, 16 nt, Human
ucaaaagaaagaaaau

SEQ ID NO: 2762721 - RNA, 15 nt, Human
ucaaaagguauuuau

SEQ ID NO: 2762722 - RNA, 17 nt, Human
ucaaaaguugaaauuaa

SEQ ID NO: 2762723 - RNA, 20 nt, Human
ucaaaauggagggaauaaua

SEQ ID NO: 2762724 - RNA, 18 nt, Human
ucaaaauuagugcuuuuu

SEQ ID NO: 2762725 - RNA, 13 nt, Human
ucaaacagucuca

SEQ ID NO: 2762726 - RNA, 22 nt, Human
ucaaacagucucaggaaaucaa

SEQ ID NO: 2762727 - RNA, 21 nt, Human
ucaaacccauucccucuccag

SEQ ID NO: 2762728 - RNA, 14 nt, Human
ucaaacugaaacaa

SEQ ID NO: 2762729 - RNA, 16 nt, Human
ucaaacuuuacagaaa

SEQ ID NO: 2762730 - RNA, 15 nt, Human
ucaaagauagggagg

SEQ ID NO: 2762731 - RNA, 20 nt, Human
ucaaagcaaagcucuuuacu

SEQ ID NO: 2762732 - RNA, 15 nt, Human
ucaaaggacaccauu

SEQ ID NO: 2762733 - RNA, 21 nt, Human
ucaaaggacaccauuuuggca

SEQ ID NO: 2762734 - RNA, 23 nt, Human
ucaaaggacaccauuuuggcaag

SEQ ID NO: 2762735 - RNA, 18 nt, Human
ucaaaggcacacagcaag

SEQ ID NO: 2762736 - RNA, 14 nt, Human
ucaaagugcuggca

SEQ ID NO: 2762737 - RNA, 17 nt, Human
ucaaauaaguauuuaua

SEQ ID NO: 2762738 - RNA, 18 nt, Human
ucaaauccuugaagauuu

SEQ ID NO: 2762739 - RNA, 18 nt, Human
ucaaauuguaagcaugca

SEQ ID NO: 2762740 - RNA, 19 nt, Human
ucaaauugugugaaaggua

SEQ ID NO: 2762741 - RNA, 17 nt, Human
ucaaauuguucucuaau

SEQ ID NO: 2762742 - RNA, 20 nt, Human
ucaaauuugaugaaaucaga

SEQ ID NO: 2762743 - RNA, 23 nt, Human
ucaacaagagacuggaaggacca

SEQ ID NO: 2762744 - RNA, 18 nt, Human
ucaacaauagugauugau

SEQ ID NO: 2762745 - RNA, 16 nt, Human
ucaacagauaaauagu

SEQ ID NO: 2762746 - RNA, 15 nt, Human
ucaaccaaauggagu

SEQ ID NO: 2762747 - RNA, 23 nt, Human
ucaaccaaauggagugacuuagu

SEQ ID NO: 2762748 - RNA, 17 nt, Human
ucaacccccauuucuau

SEQ ID NO: 2762749 - RNA, 21 nt, Human
ucaaccugccagcuggccuug

SEQ ID NO: 2762750 - RNA, 17 nt, Human
ucaacguugcuccccau

SEQ ID NO: 2762751 - RNA, 15 nt, Human
ucaacuaaugauuua

SEQ ID NO: 2762752 - RNA, 16 nt, Human
ucaacucauauuuuca

SEQ ID NO: 2762753 - RNA, 18 nt, Human
ucaacucauauuuucaug

SEQ ID NO: 2762754 - RNA, 22 nt, Human
ucaacuccaaacugacucuuaa

SEQ ID NO: 2762755 - RNA, 15 nt, Human
ucaacucccugcccc

SEQ ID NO: 2762756 - RNA, 21 nt, Human
ucaacucccugccccccagcc

SEQ ID NO: 2762757 - RNA, 19 nt, Human
ucaacuccuuucucaucuu

SEQ ID NO: 2762758 - RNA, 20 nt, Human
ucaacucucuuauugccuca

SEQ ID NO: 2762759 - RNA, 22 nt, Human
ucaacuuguauuuuuuuucuug

SEQ ID NO: 2762760 - RNA, 18 nt, Human
ucaacuuugauacuuacu

SEQ ID NO: 2762761 - RNA, 13 nt, Human
ucaagaaacuuaa

SEQ ID NO: 2762762 - RNA, 19 nt, Human
ucaagaagcaucgugucug

SEQ ID NO: 2762763 - RNA, 21 nt, Human
ucaagacaaaugacccccauc

SEQ ID NO: 2762764 - RNA, 23 nt, Human
ucaagaugaugaugaucuuuaaa

SEQ ID NO: 2762765 - RNA, 12 nt, Human
ucaagccugccu

SEQ ID NO: 2762766 - RNA, 20 nt, Human
ucaagcgauucuccugccuc

SEQ ID NO: 2762767 - RNA, 21 nt, Human
ucaagcgauucucuugccuca

SEQ ID NO: 2762768 - RNA, 12 nt, Human
ucaagcucucca

SEQ ID NO: 2762769 - RNA, 19 nt, Human
ucaaggcuuagacccucau

SEQ ID NO: 2762770 - RNA, 15 nt, Human
ucaagggugugugca

SEQ ID NO: 2762771 - RNA, 19 nt, Human
ucaagucagcucuucucca

SEQ ID NO: 2762772 - RNA, 20 nt, Human
ucaagucuuucacauuuaaa

SEQ ID NO: 2762773 - RNA, 17 nt, Human
ucaaguuauuuuuaauu

SEQ ID NO: 2762774 - RNA, 18 nt, Human
ucaauaaaauccauacau

SEQ ID NO: 2762775 - RNA, 14 nt, Human
ucaauaaauaaaua

SEQ ID NO: 2762776 - RNA, 17 nt, Human
ucaauaagccucagcuu

SEQ ID NO: 2762777 - RNA, 21 nt, Human
ucaauaagccucagcuuucua

SEQ ID NO: 2762778 - RNA, 15 nt, Human
ucaauaaguuuauuu

SEQ ID NO: 2762779 - RNA, 21 nt, Human
ucaauagaaggauguacauuu

SEQ ID NO: 2762780 - RNA, 13 nt, Human
ucaauaucuuuuu

SEQ ID NO: 2762781 - RNA, 23 nt, Human
ucaauaucuuuuuuuuaauaaac

SEQ ID NO: 2762782 - RNA, 12 nt, Human
ucaauauuuauu

SEQ ID NO: 2762783 - RNA, 19 nt, Human
ucaauauuuauuauuuuca

SEQ ID NO: 2762784 - RNA, 15 nt, Human
ucaaucaaauaagua

SEQ ID NO: 2762785 - RNA, 16 nt, Human
ucaaucaaauaaguau

SEQ ID NO: 2762786 - RNA, 22 nt, Human
ucaaucaagacugcaaacccuu

SEQ ID NO: 2762787 - RNA, 11 nt, Human
ucaaugaacuu

SEQ ID NO: 2762788 - RNA, 23 nt, Human
ucaaugaaugaaugaauggcuaa

SEQ ID NO: 2762789 - RNA, 16 nt, Human
ucaaugccccugaauu

SEQ ID NO: 2762790 - RNA, 23 nt, Human
ucaaugccccugaauuuaaauag

SEQ ID NO: 2762791 - RNA, 12 nt, Human
ucaauuaccaca

SEQ ID NO: 2762792 - RNA, 15 nt, Human
ucaauuccucuggga

SEQ ID NO: 2762793 - RNA, 19 nt, Human
ucaauucuauuacgugcaa

SEQ ID NO: 2762794 - RNA, 15 nt, Human
ucaauuuaaaaaaaa

SEQ ID NO: 2762795 - RNA, 21 nt, Human
ucaauuuuucuuauuucauuu

SEQ ID NO: 2762796 - RNA, 16 nt, Human
ucacaaacucauccau

SEQ ID NO: 2762797 - RNA, 16 nt, Human
ucacaaaucuuaacuu

SEQ ID NO: 2762798 - RNA, 18 nt, Human
ucacaacagcugccugga

SEQ ID NO: 2762799 - RNA, 18 nt, Human
ucacaaccacucauucaa

SEQ ID NO: 2762800 - RNA, 16 nt, Human
ucacaagacccaaaag

SEQ ID NO: 2762801 - RNA, 16 nt, Human
ucacaagugaaaaaca

SEQ ID NO: 2762802 - RNA, 13 nt, Human
ucacaauacuguu

SEQ ID NO: 2762803 - RNA, 23 nt, Human
ucacaauggauaggcacaggaaa

SEQ ID NO: 2762804 - RNA, 18 nt, Human
ucacacaaccugucccag

SEQ ID NO: 2762805 - RNA, 13 nt, Human
ucacacacaaugu

SEQ ID NO: 2762806 - RNA, 17 nt, Human
ucacacauuacaacagu

SEQ ID NO: 2762807 - RNA, 23 nt, Human
ucacaccaggcuugccugcaggc

SEQ ID NO: 2762808 - RNA, 19 nt, Human
ucacaccuuaucuauguag

SEQ ID NO: 2762809 - RNA, 21 nt, Human
ucacaccuuaucuauguagaa

SEQ ID NO: 2762810 - RNA, 17 nt, Human
ucacagaagaaggaaau

SEQ ID NO: 2762811 - RNA, 21 nt, Human
ucacagaaugacugacaaaga

SEQ ID NO: 2762812 - RNA, 23 nt, Human
ucacagaaugacugacaaagaca

SEQ ID NO: 2762813 - RNA, 18 nt, Human
ucacagaggaucugcuug

SEQ ID NO: 2762814 - RNA, 17 nt, Human
ucacagcuacacagauc

SEQ ID NO: 2762815 - RNA, 16 nt, Human
ucacaggagcuuaaac

SEQ ID NO: 2762816 - RNA, 23 nt, Human
ucacagggccuggggagauggag

SEQ ID NO: 2762817 - RNA, 17 nt, Human
ucacaggggacaggaug

SEQ ID NO: 2762818 - RNA, 18 nt, Human
ucacagugggagccaggg

SEQ ID NO: 2762819 - RNA, 12 nt, Human
ucacauacaauu

SEQ ID NO: 2762820 - RNA, 17 nt, Human
ucacauccauucuuccc

SEQ ID NO: 2762821 - RNA, 18 nt, Human
ucacaucgcagauucucc

SEQ ID NO: 2762822 - RNA, 21 nt, Human
ucacaucgcagauucucccuu

SEQ ID NO: 2762823 - RNA, 21 nt, Human
ucacaugaacuuguaaaggaa

SEQ ID NO: 2762824 - RNA, 19 nt, Human
ucacaugauuccagccauc

SEQ ID NO: 2762825 - RNA, 18 nt, Human
ucacauuccaagccucau

SEQ ID NO: 2762826 - RNA, 15 nt, Human
ucacauuccucugcc

SEQ ID NO: 2762827 - RNA, 18 nt, Human
ucacauuggcuauuuaaa

SEQ ID NO: 2762828 - RNA, 15 nt, Human
ucacauuuaaauaaa

SEQ ID NO: 2762829 - RNA, 16 nt, Human
ucacauuuaaauaaag

SEQ ID NO: 2762830 - RNA, 16 nt, Human
ucacauuuucccuucc

SEQ ID NO: 2762831 - RNA, 19 nt, Human
ucacauuuucccuucccug

SEQ ID NO: 2762832 - RNA, 13 nt, Human
ucaccaagcugcu

SEQ ID NO: 2762833 - RNA, 19 nt, Human
ucaccaaggcugauuaaac

SEQ ID NO: 2762834 - RNA, 12 nt, Human
ucaccaauaagu

SEQ ID NO: 2762835 - RNA, 18 nt, Human
ucaccagcccuggcaacu

SEQ ID NO: 2762836 - RNA, 20 nt, Human
ucaccauguacauagcuuga

SEQ ID NO: 2762837 - RNA, 14 nt, Human
ucaccauguuggcc

SEQ ID NO: 2762838 - RNA, 14 nt, Human
ucaccauguuggcu

SEQ ID NO: 2762839 - RNA, 15 nt, Human
ucaccauguuggcua

SEQ ID NO: 2762840 - RNA, 19 nt, Human
ucacccaaccacaucccac

SEQ ID NO: 2762841 - RNA, 15 nt, Human
ucacccacuucccac

SEQ ID NO: 2762842 - RNA, 12 nt, Human
ucaccucaugga

SEQ ID NO: 2762843 - RNA, 20 nt, Human
ucaccucauggaauuggagc

SEQ ID NO: 2762844 - RNA, 11 nt, Human
ucaccugcccu

SEQ ID NO: 2762845 - RNA, 17 nt, Human
ucaccugcccugcugag

SEQ ID NO: 2762846 - RNA, 16 nt, Human
ucaccugggcugaggc

SEQ ID NO: 2762847 - RNA, 17 nt, Human
ucaccuguuauaauaaa

SEQ ID NO: 2762848 - RNA, 17 nt, Human
ucaccuuuuggucugga

SEQ ID NO: 2762849 - RNA, 18 nt, Human
ucacgccuguaaucccag

SEQ ID NO: 2762850 - RNA, 19 nt, Human
ucacgccuguaaucccagc

SEQ ID NO: 2762851 - RNA, 13 nt, Human
ucacuaucuguaa

SEQ ID NO: 2762852 - RNA, 14 nt, Human
ucacuaucuguaau

SEQ ID NO: 2762853 - RNA, 18 nt, Human
ucacucaaauuguucucu

SEQ ID NO: 2762854 - RNA, 21 nt, Human
ucacucacauccauucuuccc

SEQ ID NO: 2762855 - RNA, 21 nt, Human
ucacucuguucauuccuccag

SEQ ID NO: 2762856 - RNA, 14 nt, Human
ucacugacacacac

SEQ ID NO: 2762857 - RNA, 16 nt, Human
ucacugcaaccuccac

SEQ ID NO: 2762858 - RNA, 23 nt, Human
ucacugcaaccuccaccucgcag

SEQ ID NO: 2762859 - RNA, 18 nt, Human
ucacugcaaccucugccu

SEQ ID NO: 2762860 - RNA, 19 nt, Human
ucacugcaaccucugccuc

SEQ ID NO: 2762861 - RNA, 13 nt, Human
ucacuguaaaaua

SEQ ID NO: 2762862 - RNA, 20 nt, Human
ucacuguauguccuuggugc

SEQ ID NO: 2762863 - RNA, 14 nt, Human
ucacuguguuggcc

SEQ ID NO: 2762864 - RNA, 17 nt, Human
ucacuguguuggccagg

SEQ ID NO: 2762865 - RNA, 18 nt, Human
ucacuguguuggccagga

SEQ ID NO: 2762866 - RNA, 16 nt, Human
ucacuuaauccuuugu

SEQ ID NO: 2762867 - RNA, 21 nt, Human
ucacuuaauccuuuguuuucu

SEQ ID NO: 2762868 - RNA, 11 nt, Human
ucacuugagcc

SEQ ID NO: 2762869 - RNA, 22 nt, Human
ucacuugagcucaggaggucaa

SEQ ID NO: 2762870 - RNA, 19 nt, Human
ucacuugugcaguguugac

SEQ ID NO: 2762871 - RNA, 19 nt, Human
ucacuuuaggccuggugug

SEQ ID NO: 2762872 - RNA, 13 nt, Human
ucacuuucccaaa

SEQ ID NO: 2762873 - RNA, 17 nt, Human
ucagaaaugucaugugg

SEQ ID NO: 2762874 - RNA, 12 nt, Human
ucagaaauuuaa

SEQ ID NO: 2762875 - RNA, 13 nt, Human
ucagaagaaauuc

SEQ ID NO: 2762876 - RNA, 20 nt, Human
ucagaaggaaagaauaacca

SEQ ID NO: 2762877 - RNA, 20 nt, Human
ucagaaucaugcugagagag

SEQ ID NO: 2762878 - RNA, 21 nt, Human
ucagaaucucucuucuuuuca

SEQ ID NO: 2762879 - RNA, 21 nt, Human
ucagacaagcugcauuucaga

SEQ ID NO: 2762880 - RNA, 21 nt, Human
ucagacacaaauaaaggaaac

SEQ ID NO: 2762881 - RNA, 17 nt, Human
ucagacauagaauuaac

SEQ ID NO: 2762882 - RNA, 17 nt, Human
ucagaccauaauguuac

SEQ ID NO: 2762883 - RNA, 15 nt, Human
ucagagccuccuuuc

SEQ ID NO: 2762884 - RNA, 19 nt, Human
ucagagcugcccucuccug

SEQ ID NO: 2762885 - RNA, 20 nt, Human
ucagagcugcccucuccugg

SEQ ID NO: 2762886 - RNA, 15 nt, Human
ucagaggcgcaugaa

SEQ ID NO: 2762887 - RNA, 15 nt, Human
ucagauaaucacaau

SEQ ID NO: 2762888 - RNA, 18 nt, Human
ucagauauaaaagacuga

SEQ ID NO: 2762889 - RNA, 17 nt, Human
ucagaucauuucaaaac

SEQ ID NO: 2762890 - RNA, 21 nt, Human
ucagaucauuucaaaacucau

SEQ ID NO: 2762891 - RNA, 20 nt, Human
ucagcaaaaaaguacuuaaa

SEQ ID NO: 2762892 - RNA, 12 nt, Human
ucagcaccccag

SEQ ID NO: 2762893 - RNA, 16 nt, Human
ucagcagagaaguuuu

SEQ ID NO: 2762894 - RNA, 18 nt, Human
ucagccagcccucuucug

SEQ ID NO: 2762895 - RNA, 21 nt, Human
ucagccagcccucuucugaca

SEQ ID NO: 2762896 - RNA, 17 nt, Human
ucagcccccuaagcccc

SEQ ID NO: 2762897 - RNA, 16 nt, Human
ucagccccgggagugg

SEQ ID NO: 2762898 - RNA, 20 nt, Human
ucagcccugcaccaugcugc

SEQ ID NO: 2762899 - RNA, 22 nt, Human
ucagcccugcaccaugcugcug

SEQ ID NO: 2762900 - RNA, 23 nt, Human
ucagcccugcaccaugcugcugg

SEQ ID NO: 2762901 - RNA, 22 nt, Human
ucagcccugggauagugcuguc

SEQ ID NO: 2762902 - RNA, 14 nt, Human
ucagcccugguggg

SEQ ID NO: 2762903 - RNA, 21 nt, Human
ucagccucccaaagugcuggg

SEQ ID NO: 2762904 - RNA, 18 nt, Human
ucagccuuccccuugccc

SEQ ID NO: 2762905 - RNA, 21 nt, Human
ucagccuuccccuugcccagg

SEQ ID NO: 2762906 - RNA, 12 nt, Human
ucagcugccucc

SEQ ID NO: 2762907 - RNA, 15 nt, Human
ucagcugccucccca

SEQ ID NO: 2762908 - RNA, 20 nt, Human
ucaggagagaguugaaccua

SEQ ID NO: 2762909 - RNA, 23 nt, Human
ucaggagaggggcagaacagccg

SEQ ID NO: 2762910 - RNA, 22 nt, Human
ucaggagauuucaugccuggug

SEQ ID NO: 2762911 - RNA, 15 nt, Human
ucaggaggaaggcuu

SEQ ID NO: 2762912 - RNA, 20 nt, Human
ucaggaggaaggcuuacacc

SEQ ID NO: 2762913 - RNA, 15 nt, Human
ucaggcugaccacuu

SEQ ID NO: 2762914 - RNA, 21 nt, Human
ucagggcagaugaugcuuuga

SEQ ID NO: 2762915 - RNA, 15 nt, Human
ucagggcucuuuccu

SEQ ID NO: 2762916 - RNA, 19 nt, Human
ucagguguguugcaguguc

SEQ ID NO: 2762917 - RNA, 17 nt, Human
ucagucauaacuaaaua

SEQ ID NO: 2762918 - RNA, 16 nt, Human
ucaguccaugaagaug

SEQ ID NO: 2762919 - RNA, 19 nt, Human
ucaguccaugaagauguag

SEQ ID NO: 2762920 - RNA, 15 nt, Human
ucagucuuuuccaug

SEQ ID NO: 2762921 - RNA, 18 nt, Human
ucagugucaaugcagccc

SEQ ID NO: 2762922 - RNA, 19 nt, Human
uauuauuuuuuaaaaaaau

SEQ ID NO: 2762923 - RNA, 16 nt, Human
uauucagaauuucuaa

SEQ ID NO: 2762924 - RNA, 21 nt, Human
uauucagaguugaugguugua

SEQ ID NO: 2762925 - RNA, 23 nt, Human
uauucagccccgggaguggcgcg

SEQ ID NO: 2762926 - RNA, 20 nt, Human
uauucauaagauuuaaauua

SEQ ID NO: 2762927 - RNA, 13 nt, Human
uauuccuccuucc

SEQ ID NO: 2762928 - RNA, 14 nt, Human
uauucuagucuauu

SEQ ID NO: 2762929 - RNA, 18 nt, Human
uauucuagucuauuuguu

SEQ ID NO: 2762930 - RNA, 14 nt, Human
uauucuugauguaa

SEQ ID NO: 2762931 - RNA, 15 nt, Human
uauucuugauguaaa

SEQ ID NO: 2762932 - RNA, 21 nt, Human
uauugauaagaucuuuuauuu

SEQ ID NO: 2762933 - RNA, 18 nt, Human
uauugauaauaaaauuca

SEQ ID NO: 2762934 - RNA, 20 nt, Human
uauugauccagaaagaaaac

SEQ ID NO: 2762935 - RNA, 21 nt, Human
uauugauuuauuaauauauau

SEQ ID NO: 2762936 - RNA, 15 nt, Human
uauugccucugagag

SEQ ID NO: 2762937 - RNA, 13 nt, Human
uauugcuguccug

SEQ ID NO: 2762938 - RNA, 19 nt, Human
uauuggucucccuucucua

SEQ ID NO: 2762939 - RNA, 15 nt, Human
uauuguaccucucuu

SEQ ID NO: 2762940 - RNA, 12 nt, Human
uauugucacuga

SEQ ID NO: 2762941 - RNA, 20 nt, Human
uauugucuagugaaacucgu

SEQ ID NO: 2762942 - RNA, 18 nt, Human
uauuguguguuauuuaaa

SEQ ID NO: 2762943 - RNA, 21 nt, Human
uauuguugcauuaaaaaugca

SEQ ID NO: 2762944 - RNA, 23 nt, Human
uauuguugcauuaaaaaugcaua

SEQ ID NO: 2762945 - RNA, 13 nt, Human
uauuguuuuucuu

SEQ ID NO: 2762946 - RNA, 14 nt, Human
uauuuaaagacaaa

SEQ ID NO: 2762947 - RNA, 13 nt, Human
uauuuaauuauuu

SEQ ID NO: 2762948 - RNA, 19 nt, Human
uauuuaauuauuucacuuu

SEQ ID NO: 2762949 - RNA, 13 nt, Human
uauuuaauucaug

SEQ ID NO: 2762950 - RNA, 23 nt, Human
uauuuacaaaugggaaacaaaag

SEQ ID NO: 2762951 - RNA, 17 nt, Human
uauuuacggaacucaaa

SEQ ID NO: 2762952 - RNA, 19 nt, Human
uauuuacugagcuucucug

SEQ ID NO: 2762953 - RNA, 21 nt, Human
uauuuaguguucauaaauaaa

SEQ ID NO: 2762954 - RNA, 20 nt, Human
uauuuauaaauauauuuaag

SEQ ID NO: 2762955 - RNA, 22 nt, Human
uauuuauaaauauauuuaagau

SEQ ID NO: 2762956 - RNA, 21 nt, Human
uauuuauaacaaccuaaauuu

SEQ ID NO: 2762957 - RNA, 19 nt, Human
uauuuauauaaauuuuuuu

SEQ ID NO: 2762958 - RNA, 22 nt, Human
uauuuaugccucuguauuuaaa

SEQ ID NO: 2762959 - RNA, 17 nt, Human
uauuuauuaaguauuuu

SEQ ID NO: 2762960 - RNA, 16 nt, Human
uauuuauucauauuuu

SEQ ID NO: 2762961 - RNA, 13 nt, Human
uauuuauuuuaau

SEQ ID NO: 2762962 - RNA, 14 nt, Human
uauuuauuuuaaua

SEQ ID NO: 2762963 - RNA, 15 nt, Human
uauuuauuuuaauaa

SEQ ID NO: 2762964 - RNA, 16 nt, Human
uauuuauuuuaauaau

SEQ ID NO: 2762965 - RNA, 13 nt, Human
uauuuauuuuuuu

SEQ ID NO: 2762966 - RNA, 18 nt, Human
uauuuauuuuuuuacuuc

SEQ ID NO: 2762967 - RNA, 22 nt, Human
uauuucagauaaucacaauaca

SEQ ID NO: 2762968 - RNA, 19 nt, Human
uauuuccauauuaaaauca

SEQ ID NO: 2762969 - RNA, 20 nt, Human
uauuuccccaugguuuuaau

SEQ ID NO: 2762970 - RNA, 13 nt, Human
uauuucuaugaaa

SEQ ID NO: 2762971 - RNA, 16 nt, Human
uauuucuaugaaauau

SEQ ID NO: 2762972 - RNA, 18 nt, Human
uauuucucucuuuuuaga

SEQ ID NO: 2762973 - RNA, 20 nt, Human
uauuucuucaaauaaaucuc

SEQ ID NO: 2762974 - RNA, 17 nt, Human
uauuucuuugccuuuau

SEQ ID NO: 2762975 - RNA, 21 nt, Human
uauuugaacuuuuuauugauu

SEQ ID NO: 2762976 - RNA, 16 nt, Human
uauuugaauuuuaaau

SEQ ID NO: 2762977 - RNA, 19 nt, Human
uauuugcaagacauagaau

SEQ ID NO: 2762978 - RNA, 21 nt, Human
uauuugcuguuauuuuaucug

SEQ ID NO: 2762979 - RNA, 16 nt, Human
uauuuuaaauauuuuu

SEQ ID NO: 2762980 - RNA, 17 nt, Human
uauuuuaacuuccuugg

SEQ ID NO: 2762981 - RNA, 22 nt, Human
uauuuuaaucaccaaggcugau

SEQ ID NO: 2762982 - RNA, 15 nt, Human
uauuuuaauguuucu

SEQ ID NO: 2762983 - RNA, 15 nt, Human
uauuuuauaucaauu

SEQ ID NO: 2762984 - RNA, 23 nt, Human
uauuuuauuaggaguaccauaau

SEQ ID NO: 2762985 - RNA, 18 nt, Human
uauuuucaguuauuauau

SEQ ID NO: 2762986 - RNA, 17 nt, Human
uauuuucaugcuguuca

SEQ ID NO: 2762987 - RNA, 18 nt, Human
uauuuugcauaguaccaa

SEQ ID NO: 2762988 - RNA, 23 nt, Human
uauuuugugaugcaaauaaauau

SEQ ID NO: 2762989 - RNA, 12 nt, Human
uauuuuguuuca

SEQ ID NO: 2762990 - RNA, 18 nt, Human
uauuuuguuucagugcac

SEQ ID NO: 2762991 - RNA, 14 nt, Human
uauuuuuaaacugu

SEQ ID NO: 2762992 - RNA, 23 nt, Human
uauuuuucagaaucucucuucuu

SEQ ID NO: 2762993 - RNA, 19 nt, Human
uauuuuucaugauuuugaa

SEQ ID NO: 2762994 - RNA, 16 nt, Human
uauuuuugugauuuug

SEQ ID NO: 2762995 - RNA, 14 nt, Human
gaaggugggaggau

SEQ ID NO: 2762996 - RNA, 13 nt, Human
gaaggugugggcc

SEQ ID NO: 2762997 - RNA, 18 nt, Human
gaaguaaauguuguuuua

SEQ ID NO: 2762998 - RNA, 17 nt, Human
gaaguauaggccaggca

SEQ ID NO: 2762999 - RNA, 12 nt, Human
gaagucaaggcu

SEQ ID NO: 2763000 - RNA, 21 nt, Human
gaagucacauuccugaacagg

SEQ ID NO: 2763001 - RNA, 21 nt, Human
gaagugaaaaucuacacucca

SEQ ID NO: 2763002 - RNA, 20 nt, Human
gaagugcuaauuuugaaaaa

SEQ ID NO: 2763003 - RNA, 13 nt, Human
gaaguugcagauu

SEQ ID NO: 2763004 - RNA, 19 nt, Human
gaaguuggcuggugucccu

SEQ ID NO: 2763005 - RNA, 17 nt, Human
gaauaaacauuuguagc

SEQ ID NO: 2763006 - RNA, 12 nt, Human
gaauaaauaaau

SEQ ID NO: 2763007 - RNA, 22 nt, Human
gaauaacauggugugcuucuua

SEQ ID NO: 2763008 - RNA, 15 nt, Human
gaauaaccaacaccc

SEQ ID NO: 2763009 - RNA, 18 nt, Human
gaauaaccaacacccuga

SEQ ID NO: 2763010 - RNA, 22 nt, Human
gaauaaccaacacccugagguu

SEQ ID NO: 2763011 - RNA, 22 nt, Human
gaauaauacuagucuuauaaua

SEQ ID NO: 2763012 - RNA, 16 nt, Human
gaauaauguaagacaa

SEQ ID NO: 2763013 - RNA, 20 nt, Human
gaauaccacaggaaccacaa

SEQ ID NO: 2763014 - RNA, 15 nt, Human
gaauacuaauaaaau

SEQ ID NO: 2763015 - RNA, 16 nt, Human
gaauacuaauaaaaua

SEQ ID NO: 2763016 - RNA, 19 nt, Human
gaauacuaauaaaauacau

SEQ ID NO: 2763017 - RNA, 20 nt, Human
gaauacucuuauaucuauau

SEQ ID NO: 2763018 - RNA, 19 nt, Human
gaauacuuuauaaaggauu

SEQ ID NO: 2763019 - RNA, 23 nt, Human
gaauaggcgaucacaacgugcau

SEQ ID NO: 2763020 - RNA, 22 nt, Human
gaauaguguuggaaaaugugca

SEQ ID NO: 2763021 - RNA, 12 nt, Human
gaauauauuucc

SEQ ID NO: 2763022 - RNA, 14 nt, Human
gaauaucaguuauu

SEQ ID NO: 2763023 - RNA, 19 nt, Human
gaauaucuccgucaacuca

SEQ ID NO: 2763024 - RNA, 19 nt, Human
gaaucaccuuuuggucugg

SEQ ID NO: 2763025 - RNA, 19 nt, Human
gaaucacucauuuauuucc

SEQ ID NO: 2763026 - RNA, 22 nt, Human
gaaucagccuacaggccucaca

SEQ ID NO: 2763027 - RNA, 18 nt, Human
gaaucaugcugagagagc

SEQ ID NO: 2763028 - RNA, 13 nt, Human
gaauccucugugu

SEQ ID NO: 2763029 - RNA, 12 nt, Human
gaauccugggga

SEQ ID NO: 2763030 - RNA, 15 nt, Human
gaaucucucuucuuu

SEQ ID NO: 2763031 - RNA, 12 nt, Human
gaaucuuguaaa

SEQ ID NO: 2763032 - RNA, 19 nt, Human
gaauggaacucaaggaaau

SEQ ID NO: 2763033 - RNA, 14 nt, Human
gaaugggggcagca

SEQ ID NO: 2763034 - RNA, 20 nt, Human
gaaugguaucaauaaauaga

SEQ ID NO: 2763035 - RNA, 13 nt, Human
gaauguaaucaau

SEQ ID NO: 2763036 - RNA, 22 nt, Human
gaauuaaguuuuuuuuuaaaaa

SEQ ID NO: 2763037 - RNA, 22 nt, Human
gaauuaauggaauauguaaaua

SEQ ID NO: 2763038 - RNA, 19 nt, Human
gaauuacaggcgugagcca

SEQ ID NO: 2763039 - RNA, 22 nt, Human
gaauuacaggcgugagccacca

SEQ ID NO: 2763040 - RNA, 22 nt, Human
gaauuaguuuuauaugcuucug

SEQ ID NO: 2763041 - RNA, 20 nt, Human
gaauucauucacucaacaaa

SEQ ID NO: 2763042 - RNA, 18 nt, Human
gaauucuguugauggaaa

SEQ ID NO: 2763043 - RNA, 18 nt, Human
gaauucuuacauguuuuc

SEQ ID NO: 2763044 - RNA, 21 nt, Human
gaauugcagaguacuggcuga

SEQ ID NO: 2763045 - RNA, 20 nt, Human
gaauugcucucccagcccuu

SEQ ID NO: 2763046 - RNA, 15 nt, Human
gaauuggagcucgug

SEQ ID NO: 2763047 - RNA, 16 nt, Human
gaauuggagcucgugg

SEQ ID NO: 2763048 - RNA, 22 nt, Human
gaauuuaaaaauccuacuuuca

SEQ ID NO: 2763049 - RNA, 15 nt, Human
gaauuuaaauagcuu

SEQ ID NO: 2763050 - RNA, 21 nt, Human
gaauuuaaauagcuuuuuucu

SEQ ID NO: 2763051 - RNA, 18 nt, Human
gaauuuccuuacucuuga

SEQ ID NO: 2763052 - RNA, 17 nt, Human
gaauuucuguucuucca

SEQ ID NO: 2763053 - RNA, 14 nt, Human
gaauuuucuuccaa

SEQ ID NO: 2763054 - RNA, 19 nt, Human
gaauuuuuuucaucuucuc

SEQ ID NO: 2763055 - RNA, 19 nt, Human
gaauuuuuuuuaacauucc

SEQ ID NO: 2763056 - RNA, 16 nt, Human
gacaaaaacaaacaaa

SEQ ID NO: 2763057 - RNA, 16 nt, Human
gacaaagacaaauucu

SEQ ID NO: 2763058 - RNA, 15 nt, Human
gacaaaugcuuauga

SEQ ID NO: 2763059 - RNA, 17 nt, Human
gacaaaugcuuaugaaa

SEQ ID NO: 2763060 - RNA, 21 nt, Human
gacaacagguaaaacagggcc

SEQ ID NO: 2763061 - RNA, 16 nt, Human
gacaagcucacagacc

SEQ ID NO: 2763062 - RNA, 17 nt, Human
gacaagcucacagaccu

SEQ ID NO: 2763063 - RNA, 19 nt, Human
gacaaguauggcuccucca

SEQ ID NO: 2763064 - RNA, 17 nt, Human
gacaauuguuggagagc

SEQ ID NO: 2763065 - RNA, 13 nt, Human
gacacaaauaaag

SEQ ID NO: 2763066 - RNA, 18 nt, Human
gacacaaauaaaggaaac

SEQ ID NO: 2763067 - RNA, 14 nt, Human
gacacacugaagaa

SEQ ID NO: 2763068 - RNA, 23 nt, Human
gacacaggcuccaaacuggagcu

SEQ ID NO: 2763069 - RNA, 18 nt, Human
gacacauaucaaacugaa

SEQ ID NO: 2763070 - RNA, 23 nt, Human
gacacauaucaaacugaaacaaa

SEQ ID NO: 2763071 - RNA, 21 nt, Human
gacacaucucccgcuccucua

SEQ ID NO: 2763072 - RNA, 15 nt, Human
gacacaugcugaaca

SEQ ID NO: 2763073 - RNA, 17 nt, Human
gacacaugggugcuauu

SEQ ID NO: 2763074 - RNA, 14 nt, Human
gacacauguauuug

SEQ ID NO: 2763075 - RNA, 22 nt, Human
gagucccaggcugagccucagu

SEQ ID NO: 2763076 - RNA, 18 nt, Human
gaguccuccuguccagcc

SEQ ID NO: 2763077 - RNA, 22 nt, Human
gaguccuugcaucaauuuuucu

SEQ ID NO: 2763078 - RNA, 14 nt, Human
gagucucagcuuca

SEQ ID NO: 2763079 - RNA, 14 nt, Human
gagucugcacggga

SEQ ID NO: 2763080 - RNA, 20 nt, Human
gagugaagggaagagacagc

SEQ ID NO: 2763081 - RNA, 13 nt, Human
gagugcacuacug

SEQ ID NO: 2763082 - RNA, 22 nt, Human
gagugcaguggcgcgaucucag

SEQ ID NO: 2763083 - RNA, 22 nt, Human
gagugcaguggcgugaucucag

SEQ ID NO: 2763084 - RNA, 14 nt, Human
gagugcccccaaca

SEQ ID NO: 2763085 - RNA, 14 nt, Human
gagugccuguaauc

SEQ ID NO: 2763086 - RNA, 14 nt, Human
gagugcguggugcg

SEQ ID NO: 2763087 - RNA, 22 nt, Human
gaguggcgcgcgccaccacgcc

SEQ ID NO: 2763088 - RNA, 20 nt, Human
gaguggcuggggcauggaag

SEQ ID NO: 2763089 - RNA, 16 nt, Human
gaguggguuucacaag

SEQ ID NO: 2763090 - RNA, 18 nt, Human
gagugucuuaauuaaaag

SEQ ID NO: 2763091 - RNA, 22 nt, Human
gaguuacacuggaugaaaaugu

SEQ ID NO: 2763092 - RNA, 18 nt, Human
gaguuccuaaccagccug

SEQ ID NO: 2763093 - RNA, 16 nt, Human
gaguuccuucugcucc

SEQ ID NO: 2763094 - RNA, 16 nt, Human
gaguucugucuggacu

SEQ ID NO: 2763095 - RNA, 19 nt, Human
gaguuuagcuggaaaagua

SEQ ID NO: 2763096 - RNA, 14 nt, Human
gauaaaagacagug

SEQ ID NO: 2763097 - RNA, 16 nt, Human
gauaaaagacagugaa

SEQ ID NO: 2763098 - RNA, 17 nt, Human
gauaaaagacagugaaa

SEQ ID NO: 2763099 - RNA, 21 nt, Human
gauaaaagacagugaaagaaa

SEQ ID NO: 2763100 - RNA, 17 nt, Human
gauaaacaguagugaua

SEQ ID NO: 2763101 - RNA, 19 nt, Human
gauaaaguugguaaaccuu

SEQ ID NO: 2763102 - RNA, 12 nt, Human
gauaaauaguuu

SEQ ID NO: 2763103 - RNA, 15 nt, Human
gauaagaucuuuuau

SEQ ID NO: 2763104 - RNA, 19 nt, Human
gauaagaucuuuuauuuug

SEQ ID NO: 2763105 - RNA, 14 nt, Human
gauaauaaaauuca

SEQ ID NO: 2763106 - RNA, 22 nt, Human
gauaauaaaauucauuccauuu

SEQ ID NO: 2763107 - RNA, 18 nt, Human
gauaauaugagaaucaga

SEQ ID NO: 2763108 - RNA, 16 nt, Human
gauaaucacaauacau

SEQ ID NO: 2763109 - RNA, 13 nt, Human
gauacagggauga

SEQ ID NO: 2763110 - RNA, 20 nt, Human
gauaccaugaugcugagccc

SEQ ID NO: 2763111 - RNA, 21 nt, Human
gauacuagaucuuacaucugc

SEQ ID NO: 2763112 - RNA, 17 nt, Human
gauacuccauggggugg

SEQ ID NO: 2763113 - RNA, 22 nt, Human
gauacuugaaaauuaacaugaa

SEQ ID NO: 2763114 - RNA, 17 nt, Human
gauagcagggcauggcu

SEQ ID NO: 2763115 - RNA, 16 nt, Human
gauagcuuuauuuuuu

SEQ ID NO: 2763116 - RNA, 15 nt, Human
gauagguuaccagua

SEQ ID NO: 2763117 - RNA, 18 nt, Human
gauagguuaccaguaacg

SEQ ID NO: 2763118 - RNA, 15 nt, Human
gauauaaaagacuga

SEQ ID NO: 2763119 - RNA, 14 nt, Human
gauauccucccucc

SEQ ID NO: 2763120 - RNA, 17 nt, Human
gauaucucaucucuucu

SEQ ID NO: 2763121 - RNA, 14 nt, Human
gauaucuucagaaa

SEQ ID NO: 2763122 - RNA, 15 nt, Human
gauaugccuuuuccc

SEQ ID NO: 2763123 - RNA, 14 nt, Human
gauaugugaacagu

SEQ ID NO: 2763124 - RNA, 15 nt, Human
gaucaaaggcacaca

SEQ ID NO: 2763125 - RNA, 22 nt, Human
gaucaaguccugcaagcagagg

SEQ ID NO: 2763126 - RNA, 16 nt, Human
gaucaaguuauuuuua

SEQ ID NO: 2763127 - RNA, 16 nt, Human
gaucaccugcccugcu

SEQ ID NO: 2763128 - RNA, 18 nt, Human
gaucaccugcccugcuga

SEQ ID NO: 2763129 - RNA, 14 nt, Human
gaucacuugagccc

SEQ ID NO: 2763130 - RNA, 19 nt, Human
gaucacuuuaggccuggug

SEQ ID NO: 2763131 - RNA, 16 nt, Human
gaucagccugggcaac

SEQ ID NO: 2763132 - RNA, 21 nt, Human
gaucagcuuauugucuaguga

SEQ ID NO: 2763133 - RNA, 15 nt, Human
gaucauguauuuauu

SEQ ID NO: 2763134 - RNA, 19 nt, Human
gaucauguauuuauuuuuu

SEQ ID NO: 2763135 - RNA, 20 nt, Human
gaucauugugaaauuauuca

SEQ ID NO: 2763136 - RNA, 14 nt, Human
gauccacccgccuc

SEQ ID NO: 2763137 - RNA, 14 nt, Human
gauccagaaagaaa

SEQ ID NO: 2763138 - RNA, 17 nt, Human
gauccagaaagaaaacu

SEQ ID NO: 2763139 - RNA, 16 nt, Human
gauccccacgccacag

SEQ ID NO: 2763140 - RNA, 18 nt, Human
gauccccacgccacagcc

SEQ ID NO: 2763141 - RNA, 14 nt, Human
gauccuggaaauca

SEQ ID NO: 2763142 - RNA, 21 nt, Human
gauccuuccuuuugagggagc

SEQ ID NO: 2763143 - RNA, 17 nt, Human
gaucuacaugucuagag

SEQ ID NO: 2763144 - RNA, 23 nt, Human
gaucuacaugucuagagaacacu

SEQ ID NO: 2763145 - RNA, 19 nt, Human
gaucucagaaauuguaucu

SEQ ID NO: 2763146 - RNA, 17 nt, Human
gaucucagcucacugca

SEQ ID NO: 2763147 - RNA, 23 nt, Human
gaucucggcucacugcaaccucc

SEQ ID NO: 2763148 - RNA, 16 nt, Human
gaucuggcucuggaca

SEQ ID NO: 2763149 - RNA, 22 nt, Human
gaucuggcucuggacaggcacu

SEQ ID NO: 2763150 - RNA, 15 nt, Human
gaugaaauaaguuaa

SEQ ID NO: 2763151 - RNA, 11 nt, Human
gaugaacuuuu

SEQ ID NO: 2763152 - RNA, 12 nt, Human
gaugaagaaguu

SEQ ID NO: 2763153 - RNA, 19 nt, Human
gaugaagaaguugauaugc

SEQ ID NO: 2763154 - RNA, 13 nt, Human
gaugaauuaaguu

SEQ ID NO: 2763155 - RNA, 16 nt, Human
gaugaggccgccaugu

SEQ ID NO: 2763156 - RNA, 15 nt, Human
uacccuuugaaaaag

SEQ ID NO: 2763157 - RNA, 16 nt, Human
uaccuagcuggcucug

SEQ ID NO: 2763158 - RNA, 23 nt, Human
uaccuagcuggcucugugagggu

SEQ ID NO: 2763159 - RNA, 14 nt, Human
uaccuaguccccag

SEQ ID NO: 2763160 - RNA, 23 nt, Human
uaccuaguccccagccugcuccc

SEQ ID NO: 2763161 - RNA, 19 nt, Human
uaccucaguucccucuugc

SEQ ID NO: 2763162 - RNA, 19 nt, Human
uaccuccaaggaccggccu

SEQ ID NO: 2763163 - RNA, 17 nt, Human
uaccugcucagcccugc

SEQ ID NO: 2763164 - RNA, 18 nt, Human
uaccugcucagcccugca

SEQ ID NO: 2763165 - RNA, 20 nt, Human
uaccugcucagcccugcacc

SEQ ID NO: 2763166 - RNA, 21 nt, Human
uaccugcucagcccugcacca

SEQ ID NO: 2763167 - RNA, 13 nt, Human
uaccugggcauuc

SEQ ID NO: 2763168 - RNA, 16 nt, Human
uaccuguucgcgcgcc

SEQ ID NO: 2763169 - RNA, 22 nt, Human
uaccuguucgcgcgccuccgcu

SEQ ID NO: 2763170 - RNA, 16 nt, Human
uaccuuuugcuguggc

SEQ ID NO: 2763171 - RNA, 15 nt, Human
uacgcaucagacaga

SEQ ID NO: 2763172 - RNA, 18 nt, Human
uacgcaucagacagaugg

SEQ ID NO: 2763173 - RNA, 14 nt, Human
uacgcgagcgcgcg

SEQ ID NO: 2763174 - RNA, 13 nt, Human
uacgcgcgcuccg

SEQ ID NO: 2763175 - RNA, 22 nt, Human
uacgugggcauucaaauguauu

SEQ ID NO: 2763176 - RNA, 16 nt, Human
uacguuaggaggacaa

SEQ ID NO: 2763177 - RNA, 12 nt, Human
uacuaaaaauac

SEQ ID NO: 2763178 - RNA, 18 nt, Human
uacuaaaaauacaaaaaa

SEQ ID NO: 2763179 - RNA, 14 nt, Human
uacuaaacucagag

SEQ ID NO: 2763180 - RNA, 12 nt, Human
uacuaaaugcuc

SEQ ID NO: 2763181 - RNA, 14 nt, Human
uacuaauuauaccc

SEQ ID NO: 2763182 - RNA, 15 nt, Human
uacuaauuuuaaaau

SEQ ID NO: 2763183 - RNA, 16 nt, Human
uacuaauuuuaaaaug

SEQ ID NO: 2763184 - RNA, 14 nt, Human
uacuaguuucccuu

SEQ ID NO: 2763185 - RNA, 15 nt, Human
uacuauauuuuaggu

SEQ ID NO: 2763186 - RNA, 21 nt, Human
uacuauauuuuaggucuuaau

SEQ ID NO: 2763187 - RNA, 12 nt, Human
uacuauuuaauu

SEQ ID NO: 2763188 - RNA, 18 nt, Human
uacucacauuuggggcua

SEQ ID NO: 2763189 - RNA, 22 nt, Human
uacucaccugagcgcucagcuu

SEQ ID NO: 2763190 - RNA, 22 nt, Human
uacuccuaguaauuuaagauuu

SEQ ID NO: 2763191 - RNA, 22 nt, Human
uacucugaagggcaucaugcau

SEQ ID NO: 2763192 - RNA, 19 nt, Human
uacucuuauaucuauauuu

SEQ ID NO: 2763193 - RNA, 23 nt, Human
uacucuucuuacuggugcuauuu

SEQ ID NO: 2763194 - RNA, 19 nt, Human
uacucuugauugugggaua

SEQ ID NO: 2763195 - RNA, 22 nt, Human
uacugagagugaacaaauuuac

SEQ ID NO: 2763196 - RNA, 19 nt, Human
uacugagccuuguaauucu

SEQ ID NO: 2763197 - RNA, 11 nt, Human
uacugcaugca

SEQ ID NO: 2763198 - RNA, 20 nt, Human
uacugccgguuugaaaauau

SEQ ID NO: 2763199 - RNA, 23 nt, Human
uacugccuaucagcauuuuacua

SEQ ID NO: 2763200 - RNA, 13 nt, Human
uacuguaagaaaa

SEQ ID NO: 2763201 - RNA, 23 nt, Human
uacuguaagaaaauaucacuugu

SEQ ID NO: 2763202 - RNA, 12 nt, Human
uacuguacagac

SEQ ID NO: 2763203 - RNA, 17 nt, Human
uacugucuuuuuucuaa

SEQ ID NO: 2763204 - RNA, 17 nt, Human
uacuguguaagggccag

SEQ ID NO: 2763205 - RNA, 19 nt, Human
uacuuaaaacuguaaauuu

SEQ ID NO: 2763206 - RNA, 21 nt, Human
uacuuaaaacuguaaauuuau

SEQ ID NO: 2763207 - RNA, 21 nt, Human
uacuucauuuaaaauauuuuu

SEQ ID NO: 2763208 - RNA, 23 nt, Human
uacuucauuuaaaauauuuuuau

SEQ ID NO: 2763209 - RNA, 23 nt, Human
uacuuccagggcuacgcgcgcuc

SEQ ID NO: 2763210 - RNA, 14 nt, Human
uacuuccccuuccu

SEQ ID NO: 2763211 - RNA, 20 nt, Human
uacuucccgcuguuccucgc

SEQ ID NO: 2763212 - RNA, 21 nt, Human
uacuucccgcuguuccucgcc

SEQ ID NO: 2763213 - RNA, 12 nt, Human
uacuugcucuug

SEQ ID NO: 2763214 - RNA, 23 nt, Human
uacuugggagaccuguaaucaua

SEQ ID NO: 2763215 - RNA, 19 nt, Human
uacuugguucucuccacca

SEQ ID NO: 2763216 - RNA, 15 nt, Human
uacuuuaauaaaugu

SEQ ID NO: 2763217 - RNA, 15 nt, Human
uacuuuagggaagua

SEQ ID NO: 2763218 - RNA, 13 nt, Human
uacuuuauuuucu

SEQ ID NO: 2763219 - RNA, 14 nt, Human
uagaaaaaaguaaa

SEQ ID NO: 2763220 - RNA, 17 nt, Human
uagaaaaaaguaaaugu

SEQ ID NO: 2763221 - RNA, 19 nt, Human
uagaaaaaaguaaauguga

SEQ ID NO: 2763222 - RNA, 20 nt, Human
uagaaaagcuauaaaaugaa

SEQ ID NO: 2763223 - RNA, 19 nt, Human
uagaaaagggaacugaaca

SEQ ID NO: 2763224 - RNA, 19 nt, Human
uagaaaaguuauguagaaa

SEQ ID NO: 2763225 - RNA, 22 nt, Human
uagaaaaguuauguagaaaaaa

SEQ ID NO: 2763226 - RNA, 13 nt, Human
uagaaaauuuaaa

SEQ ID NO: 2763227 - RNA, 21 nt, Human
uagaaacacaacuauauuguu

SEQ ID NO: 2763228 - RNA, 15 nt, Human
uagaaagaagaugaa

SEQ ID NO: 2763229 - RNA, 21 nt, Human
uagaaagaagcccaauauuau

SEQ ID NO: 2763230 - RNA, 17 nt, Human
uagaaaggccuuuaaaa

SEQ ID NO: 2763231 - RNA, 21 nt, Human
uagaaaguugauuuuaagaau

SEQ ID NO: 2763232 - RNA, 22 nt, Human
uagaaauguauucuuuuaguuu

SEQ ID NO: 2763233 - RNA, 19 nt, Human
uagaacauuuucaucaccc

SEQ ID NO: 2763234 - RNA, 20 nt, Human
uagaaccaccugccuauauu

SEQ ID NO: 2763235 - RNA, 15 nt, Human
uagaacucccuuuca

SEQ ID NO: 2763236 - RNA, 16 nt, Human
uagaacucccuuucaa

SEQ ID NO: 2763237 - RNA, 17 nt, Human
uagaagcaucacagguu

SEQ ID NO: 2763238 - RNA, 17 nt, Human
uagaagucacauuccug

SEQ ID NO: 2763239 - RNA, 20 nt, Human
uagaagucacauuccugaac

SEQ ID NO: 2763240 - RNA, 21 nt, Human
uagaagucacauuccugaaca

SEQ ID NO: 2763241 - RNA, 17 nt, Human
uagaauaguguuggaaa

SEQ ID NO: 2763242 - RNA, 20 nt, Human
uagaauaguguuggaaaaug

SEQ ID NO: 2763243 - RNA, 14 nt, Human
uagaauauauuucc

SEQ ID NO: 2763244 - RNA, 15 nt, Human
uagaauauauuuccu

SEQ ID NO: 2763245 - RNA, 16 nt, Human
uagaauauauuuccuu

SEQ ID NO: 2763246 - RNA, 14 nt, Human
uagaauauuuauua

SEQ ID NO: 2763247 - RNA, 15 nt, Human
uagaauauuuauuac

SEQ ID NO: 2763248 - RNA, 22 nt, Human
uagaauauuuauuaccucugau

SEQ ID NO: 2763249 - RNA, 22 nt, Human
uagaauggaacucaaggaaauc

SEQ ID NO: 2763250 - RNA, 14 nt, Human
uagaauuaauggaa

SEQ ID NO: 2763251 - RNA, 16 nt, Human
uagaauugugcaacca

SEQ ID NO: 2763252 - RNA, 17 nt, Human
uagacacugaucuggcu

SEQ ID NO: 2763253 - RNA, 13 nt, Human
uagaccucagccu

SEQ ID NO: 2763254 - RNA, 23 nt, Human
uagacucugucuaccuggucugg

SEQ ID NO: 2763255 - RNA, 11 nt, Human
uagagaaguuc

SEQ ID NO: 2763256 - RNA, 14 nt, Human
uagagaauuuccuu

SEQ ID NO: 2763257 - RNA, 15 nt, Human
uagagaauuuccuua

SEQ ID NO: 2763258 - RNA, 17 nt, Human
uagagacuuugugaaaa

SEQ ID NO: 2763259 - RNA, 18 nt, Human
uagagacuuugugaaaaa

SEQ ID NO: 2763260 - RNA, 20 nt, Human
uagagacuuugugaaaaaaa

SEQ ID NO: 2763261 - RNA, 23 nt, Human
uagagacuuugugaaaaaaaauu

SEQ ID NO: 2763262 - RNA, 16 nt, Human
uagauaaacucagaaa

SEQ ID NO: 2763263 - RNA, 14 nt, Human
uagauaaggaaaua

SEQ ID NO: 2763264 - RNA, 19 nt, Human
uagauacaugcuuuuuaau

SEQ ID NO: 2763265 - RNA, 16 nt, Human
uagauacugaauguaa

SEQ ID NO: 2763266 - RNA, 22 nt, Human
uagauacugaauguaaacaaag

SEQ ID NO: 2763267 - RNA, 15 nt, Human
uagauagaugaagaa

SEQ ID NO: 2763268 - RNA, 23 nt, Human
uagauaggucagugcaaauacuc

SEQ ID NO: 2763269 - RNA, 17 nt, Human
uagaucuuacaucugca

SEQ ID NO: 2763270 - RNA, 18 nt, Human
uagaucuuacaucugcag

SEQ ID NO: 2763271 - RNA, 21 nt, Human
uagaugagagaacagggcuga

SEQ ID NO: 2763272 - RNA, 18 nt, Human
uagaugccacuagcccuc

SEQ ID NO: 2763273 - RNA, 22 nt, Human
uagaugccacuagcccuccucu

SEQ ID NO: 2763274 - RNA, 15 nt, Human
uagauguagauaaac

SEQ ID NO: 2763275 - RNA, 23 nt, Human
uagauguauagguugaugguggu

SEQ ID NO: 2763276 - RNA, 15 nt, Human
uagauucccugagca

SEQ ID NO: 2763277 - RNA, 19 nt, Human
uagauucuaauggcuuuau

SEQ ID NO: 2763278 - RNA, 20 nt, Human
uagauucuaauggcuuuauu

SEQ ID NO: 2763279 - RNA, 13 nt, Human
uagauucuuuauu

SEQ ID NO: 2763280 - RNA, 14 nt, Human
uagcaaauguuaug

SEQ ID NO: 2763281 - RNA, 19 nt, Human
uagcaacuuuuguguaaug

SEQ ID NO: 2763282 - RNA, 18 nt, Human
uagcagagggaucaagca

SEQ ID NO: 2763283 - RNA, 22 nt, Human
uagcagauacagggaugaggca

SEQ ID NO: 2763284 - RNA, 14 nt, Human
uagcagcagcaucu

SEQ ID NO: 2763285 - RNA, 19 nt, Human
uagcagcucauaaaugaaa

SEQ ID NO: 2763286 - RNA, 17 nt, Human
uagcagcuuauucacaa

SEQ ID NO: 2763287 - RNA, 14 nt, Human
uagcagugagccaa

SEQ ID NO: 2763288 - RNA, 22 nt, Human
uagcaguugaaacaagaagcca

SEQ ID NO: 2763289 - RNA, 17 nt, Human
uagcauaaguuucuggg

SEQ ID NO: 2763290 - RNA, 20 nt, Human
uagcauauguuuuuguaagu

SEQ ID NO: 2763291 - RNA, 17 nt, Human
uagcauccucuuuaaug

SEQ ID NO: 2763292 - RNA, 18 nt, Human
uagcauccuggaauaucu

SEQ ID NO: 2763293 - RNA, 21 nt, Human
uagcaucucaggagauuucau

SEQ ID NO: 2763294 - RNA, 13 nt, Human
uagcaugaagaca

SEQ ID NO: 2763295 - RNA, 14 nt, Human
uagccaagugcagg

SEQ ID NO: 2763296 - RNA, 18 nt, Human
uagccaagugcagggccu

SEQ ID NO: 2763297 - RNA, 16 nt, Human
uagccaauauuuuucu

SEQ ID NO: 2763298 - RNA, 10 nt, Human
uagccagagg

SEQ ID NO: 2763299 - RNA, 17 nt, Human
uagccagaggcucuaau

SEQ ID NO: 2763300 - RNA, 18 nt, Human
uaacccuggaaaaugaau

SEQ ID NO: 2763301 - RNA, 17 nt, Human
uaaccucuaaauucuuu

SEQ ID NO: 2763302 - RNA, 18 nt, Human
uaacgaaguauccuucag

SEQ ID NO: 2763303 - RNA, 21 nt, Human
uaacgaaguauccuucagccu

SEQ ID NO: 2763304 - RNA, 14 nt, Human
uaacgauaaaagac

SEQ ID NO: 2763305 - RNA, 15 nt, Human
uaacgauaaaagaca

SEQ ID NO: 2763306 - RNA, 17 nt, Human
uaacgauaaaagacagu

SEQ ID NO: 2763307 - RNA, 20 nt, Human
uaacgauaaaagacagugaa

SEQ ID NO: 2763308 - RNA, 23 nt, Human
uaacgauaaaagacagugaaaga

SEQ ID NO: 2763309 - RNA, 13 nt, Human
uaacguauaaaag

SEQ ID NO: 2763310 - RNA, 18 nt, Human
uaacguauaaaagccugu

SEQ ID NO: 2763311 - RNA, 18 nt, Human
uaacuagaauuuauucaa

SEQ ID NO: 2763312 - RNA, 16 nt, Human
uaacucagaaacauca

SEQ ID NO: 2763313 - RNA, 14 nt, Human
uaacucaucuguca

SEQ ID NO: 2763314 - RNA, 21 nt, Human
uaacuccuaggaaaauacuau

SEQ ID NO: 2763315 - RNA, 13 nt, Human
uaacucuauaaug

SEQ ID NO: 2763316 - RNA, 22 nt, Human
uaacugauuuguaacaagccuc

SEQ ID NO: 2763317 - RNA, 20 nt, Human
uaacugcauugagaacugca

SEQ ID NO: 2763318 - RNA, 15 nt, Human
uaacugcuacaaaua

SEQ ID NO: 2763319 - RNA, 22 nt, Human
uaacuuacauucuuaaaguguc

SEQ ID NO: 2763320 - RNA, 12 nt, Human
uaacuuaugaac

SEQ ID NO: 2763321 - RNA, 18 nt, Human
uaagaaaacuaagaaaua

SEQ ID NO: 2763322 - RNA, 20 nt, Human
uaagaaacauuuauauugau

SEQ ID NO: 2763323 - RNA, 13 nt, Human
uaagaaaggaagu

SEQ ID NO: 2763324 - RNA, 23 nt, Human
uaagaaaggauaaaguugguaaa

SEQ ID NO: 2763325 - RNA, 23 nt, Human
uaagaaauaggaaauauuuuaau

SEQ ID NO: 2763326 - RNA, 17 nt, Human
uaagaaauaugcacaau

SEQ ID NO: 2763327 - RNA, 20 nt, Human
uaagaaauaugcacaauagc

SEQ ID NO: 2763328 - RNA, 15 nt, Human
uaagaaauuuuugcc

SEQ ID NO: 2763329 - RNA, 23 nt, Human
uaagaagacugcauuauauuuau

SEQ ID NO: 2763330 - RNA, 12 nt, Human
uaagaaggcacc

SEQ ID NO: 2763331 - RNA, 20 nt, Human
uaagaaucuuuauaguucua

SEQ ID NO: 2763332 - RNA, 22 nt, Human
uaagaauucuguugauggaaau

SEQ ID NO: 2763333 - RNA, 23 nt, Human
uaagaauucuguugauggaaaua

SEQ ID NO: 2763334 - RNA, 21 nt, Human
uaagacaaaaagcuacuuauu

SEQ ID NO: 2763335 - RNA, 23 nt, Human
uaagacggauuuauuuuuccauu

SEQ ID NO: 2763336 - RNA, 16 nt, Human
uaagagcuuaagaacc

SEQ ID NO: 2763337 - RNA, 19 nt, Human
uaagauaccaaaaccacag

SEQ ID NO: 2763338 - RNA, 15 nt, Human
uaagauauuuuucau

SEQ ID NO: 2763339 - RNA, 18 nt, Human
uaagaucuuuuauuuugc

SEQ ID NO: 2763340 - RNA, 17 nt, Human
uaagauuuaaauuauuu

SEQ ID NO: 2763341 - RNA, 17 nt, Human
uaagauuuguaauauuu

SEQ ID NO: 2763342 - RNA, 19 nt, Human
uaagcaacaucuagcaaau

SEQ ID NO: 2763343 - RNA, 16 nt, Human
uaagcaccaggacgcc

SEQ ID NO: 2763344 - RNA, 16 nt, Human
uaagcauuccaacuau

SEQ ID NO: 2763345 - RNA, 20 nt, Human
uaagccuguuagcaugcugg

SEQ ID NO: 2763346 - RNA, 17 nt, Human
uaagccuucugguuuua

SEQ ID NO: 2763347 - RNA, 18 nt, Human
uaagccuucugguuuuau

SEQ ID NO: 2763348 - RNA, 22 nt, Human
uaagcgcuagaggaagcagcca

SEQ ID NO: 2763349 - RNA, 20 nt, Human
uaagcugccauauauuuugu

SEQ ID NO: 2763350 - RNA, 12 nt, Human
uaagcuggagug

SEQ ID NO: 2763351 - RNA, 14 nt, Human
uaagcuguuuccau

SEQ ID NO: 2763352 - RNA, 15 nt, Human
uaagcuuuucuuuuc

SEQ ID NO: 2763353 - RNA, 17 nt, Human
uaaggaaauaagaacca

SEQ ID NO: 2763354 - RNA, 18 nt, Human
uaaggaggcugagagccc

SEQ ID NO: 2763355 - RNA, 14 nt, Human
uaaggauucugaga

SEQ ID NO: 2763356 - RNA, 19 nt, Human
uaaggcccucuugaaucuc

SEQ ID NO: 2763357 - RNA, 24 nt, Human
uaaggggaauugaggacacugaua

SEQ ID NO: 2763358 - RNA, 23 nt, Human
uaaguaaguuugauuucauuaau

SEQ ID NO: 2763359 - RNA, 12 nt, Human
uaaguaaugaua

SEQ ID NO: 2763360 - RNA, 16 nt, Human
uaaguaaugauaacug

SEQ ID NO: 2763361 - RNA, 13 nt, Human
uaaguaauuucag

SEQ ID NO: 2763362 - RNA, 12 nt, Human
uaaguauuuaua

SEQ ID NO: 2763363 - RNA, 21 nt, Human
uaagucaucugaugagaacaa

SEQ ID NO: 2763364 - RNA, 21 nt, Human
uaagucugugagauucauuca

SEQ ID NO: 2763365 - RNA, 23 nt, Human
uaagucugugagauucauucaug

SEQ ID NO: 2763366 - RNA, 12 nt, Human
uaagugaaauaa

SEQ ID NO: 2763367 - RNA, 19 nt, Human
uaagugauugcugguuuua

SEQ ID NO: 2763368 - RNA, 13 nt, Human
uaagugcagcccc

SEQ ID NO: 2763369 - RNA, 19 nt, Human
uaaguguguguuuuucaua

SEQ ID NO: 2763370 - RNA, 20 nt, Human
uaaguguguguuuuucauaa

SEQ ID NO: 2763371 - RNA, 13 nt, Human
uaaguuauuuuua

SEQ ID NO: 2763372 - RNA, 15 nt, Human
uaaguuuauuucuua

SEQ ID NO: 2763373 - RNA, 15 nt, Human
uaaguuuugugugua

SEQ ID NO: 2763374 - RNA, 18 nt, Human
uaaguuuuuuuuuaaaaa

SEQ ID NO: 2763375 - RNA, 12 nt, Human
uaauaaaacaug

SEQ ID NO: 2763376 - RNA, 13 nt, Human
uaauaaaauucau

SEQ ID NO: 2763377 - RNA, 19 nt, Human
uaauaaaugugccuucauu

SEQ ID NO: 2763378 - RNA, 21 nt, Human
uaauaauauauuuuaaauauu

SEQ ID NO: 2763379 - RNA, 18 nt, Human
uaauaauguuucaaacau

SEQ ID NO: 2763380 - RNA, 15 nt, Human
uaauacaaaggcuua

SEQ ID NO: 2763381 - RNA, 20 nt, Human
uaauaccacagcuuuuuacc

SEQ ID NO: 2763382 - RNA, 19 nt, Human
uaauaggcguaacuaauuu

SEQ ID NO: 2763383 - RNA, 21 nt, Human
uaauaggcguaacuaauuuua

SEQ ID NO: 2763384 - RNA, 14 nt, Human
uaauauaaaacagg

SEQ ID NO: 2763385 - RNA, 21 nt, Human
uaauauaagcugccauauauu

SEQ ID NO: 2763386 - RNA, 22 nt, Human
uaauauaagcugccauauauuu

SEQ ID NO: 2763387 - RNA, 12 nt, Human
uaauauauauau

SEQ ID NO: 2763388 - RNA, 14 nt, Human
uaauauauauuauc

SEQ ID NO: 2763389 - RNA, 20 nt, Human
uaauauauauuaucuuuuca

SEQ ID NO: 2763390 - RNA, 15 nt, Human
uaauauauguauuau

SEQ ID NO: 2763391 - RNA, 15 nt, Human
uaauauauuuuaaau

SEQ ID NO: 2763392 - RNA, 14 nt, Human
uaauaucuuaucuu

SEQ ID NO: 2763393 - RNA, 18 nt, Human
uaauauguuauuauuaaa

SEQ ID NO: 2763394 - RNA, 23 nt, Human
uaauauuccucaguucauccauu

SEQ ID NO: 2763395 - RNA, 22 nt, Human
uaauauugauuuauuaauauau

SEQ ID NO: 2763396 - RNA, 18 nt, Human
uaauauuucuucaaauaa

SEQ ID NO: 2763397 - RNA, 13 nt, Human
uaauauuuuuaau

SEQ ID NO: 2763398 - RNA, 16 nt, Human
uaaucaauguucauca

SEQ ID NO: 2763399 - RNA, 22 nt, Human
uaaucagggaggucauuuuggu

SEQ ID NO: 2763400 - RNA, 19 nt, Human
uaaucauauaauaaaugua

SEQ ID NO: 2763401 - RNA, 16 nt, Human
uaauccaagcaaaugu

SEQ ID NO: 2763402 - RNA, 20 nt, Human
uaaucccagcaugcugagau

SEQ ID NO: 2763403 - RNA, 22 nt, Human
uaaucccgauucacccugucca

SEQ ID NO: 2763404 - RNA, 23 nt, Human
uaauccuuuguuuucugacuaau

SEQ ID NO: 2763405 - RNA, 17 nt, Human
uaauccuuuuuuauucc

SEQ ID NO: 2763406 - RNA, 15 nt, Human
uaaucuccuguuaau

SEQ ID NO: 2763407 - RNA, 12 nt, Human
uaaucugccucc

SEQ ID NO: 2763408 - RNA, 21 nt, Human
uaaucuuacaaugaaaaggac

SEQ ID NO: 2763409 - RNA, 13 nt, Human
uaaucuuucacag

SEQ ID NO: 2763410 - RNA, 21 nt, Human
uaaugaaguuugaauguuaaa

SEQ ID NO: 2763411 - RNA, 15 nt, Human
uaaugaauaaacauu

SEQ ID NO: 2763412 - RNA, 16 nt, Human
uaaugaauacuuuaua

SEQ ID NO: 2763413 - RNA, 15 nt, Human
uaaugaauuaaagaa

SEQ ID NO: 2763414 - RNA, 15 nt, Human
uaaugauaacuggaa

SEQ ID NO: 2763415 - RNA, 15 nt, Human
uaaugccacuaaauu

SEQ ID NO: 2763416 - RNA, 15 nt, Human
uaaugccuuuucuca

SEQ ID NO: 2763417 - RNA, 22 nt, Human
uaaugccuuuucucaccuguca

SEQ ID NO: 2763418 - RNA, 21 nt, Human
uaauguaaacaauaucagacu

SEQ ID NO: 2763419 - RNA, 14 nt, Human
uaauguguauuaca

SEQ ID NO: 2763420 - RNA, 19 nt, Human
uaauguugaguuauuaaua

SEQ ID NO: 2763421 - RNA, 16 nt, Human
uaauguuucaaacaua

SEQ ID NO: 2763422 - RNA, 18 nt, Human
uaauguuucaaacauaua

SEQ ID NO: 2763423 - RNA, 19 nt, Human
uaauuagccagugaaaaac

SEQ ID NO: 2763424 - RNA, 20 nt, Human
uaauuagccagugaaaaacu

SEQ ID NO: 2763425 - RNA, 12 nt, Human
uaauuagugaac

SEQ ID NO: 2763426 - RNA, 23 nt, Human
uaauuaucuaguuuaauuaaucu

SEQ ID NO: 2763427 - RNA, 18 nt, Human
uaauuauguucuaagugc

SEQ ID NO: 2763428 - RNA, 15 nt, Human
uaauuauuauuuaua

SEQ ID NO: 2763429 - RNA, 14 nt, Human
uaauuauuucacuu

SEQ ID NO: 2763430 - RNA, 18 nt, Human
uaauucaaacuaauagaa

SEQ ID NO: 2763431 - RNA, 16 nt, Human
uaauucaaaggcauuu

SEQ ID NO: 2763432 - RNA, 23 nt, Human
uaauucacauuguauucagaguu

SEQ ID NO: 2763433 - RNA, 17 nt, Human
uaauucauuaaucugcc

SEQ ID NO: 2763434 - RNA, 14 nt, Human
uaauuccacagcug

SEQ ID NO: 2763435 - RNA, 19 nt, Human
uaauuccuauauccuguga

SEQ ID NO: 2763436 - RNA, 14 nt, Human
uaauucuaugagau

SEQ ID NO: 2763437 - RNA, 14 nt, Human
uaauucugaaagca

SEQ ID NO: 2763438 - RNA, 20 nt, Human
uaauugacuuauuuauauaa

SEQ ID NO: 2763439 - RNA, 24 nt, Human
uaauuuaaaauaugcucuaaacau

SEQ ID NO: 2763440 - RNA, 16 nt, Human
uaauuuaagauuuugu

SEQ ID NO: 2763441 - RNA, 17 nt, Human
uaauuuaugaguuuuug

SEQ ID NO: 2763442 - RNA, 16 nt, Human
uaauuucaugaaaaga

SEQ ID NO: 2763443 - RNA, 19 nt, Human
uaauuugaaauauuuucuu

SEQ ID NO: 2763444 - RNA, 15 nt, Human
uaauuugguuuucac

SEQ ID NO: 2763445 - RNA, 23 nt, Human
uaauuuguaguguuggagaagaa

SEQ ID NO: 2763446 - RNA, 15 nt, Human
uaauuuuaacucuau

SEQ ID NO: 2763447 - RNA, 14 nt, Human
uaauuuugaaaaac

SEQ ID NO: 2763448 - RNA, 15 nt, Human
uaauuuugaaaaacu

SEQ ID NO: 2763449 - RNA, 17 nt, Human
ugggaaagcauuguaaa

SEQ ID NO: 2763450 - RNA, 20 nt, Human
ugggaacccaaguccaagca

SEQ ID NO: 2763451 - RNA, 16 nt, Human
ugggaaugaagcaaug

SEQ ID NO: 2763452 - RNA, 15 nt, Human
ugggacagggaggac

SEQ ID NO: 2763453 - RNA, 17 nt, Human
ugggacagggaggacgc

SEQ ID NO: 2763454 - RNA, 11 nt, Leptospira interrogans serovar lai str. 56601
aaaaaaaacag

SEQ ID NO: 2763455 - RNA, 9 nt, Leptospira interrogans serovar lai str. 56601
aaaaaaaau

SEQ ID NO: 2763456 - RNA, 12 nt, Leptospira interrogans serovar lai str. 56601
aaaaaaaauacg

SEQ ID NO: 2763457 - RNA, 13 nt, Leptospira interrogans serovar lai str. 56601
aaaaaaacaugaa

SEQ ID NO: 2763458 - RNA, 14 nt, Leptospira interrogans serovar lai str. 56601
aaaaaaacgucuuu

SEQ ID NO: 2763459 - RNA, 19 nt, Leptospira interrogans serovar lai str. 56601
aaaaaaaguauauauuaaa

SEQ ID NO: 2763460 - RNA, 13 nt, Leptospira interrogans serovar lai str. 56601
aaaaaaaguuuua

SEQ ID NO: 2763461 - RNA, 14 nt, Leptospira interrogans serovar lai str. 56601
aaaaaaauaaauca

SEQ ID NO: 2763462 - RNA, 13 nt, Leptospira interrogans serovar lai str. 56601
aaaaaaauaacga

SEQ ID NO: 2763463 - RNA, 21 nt, Leptospira interrogans serovar lai str. 56601
aaaaaaauaacgauacuuaaa

SEQ ID NO: 2763464 - RNA, 11 nt, Leptospira interrogans serovar lai str. 56601
aaaaaaauaag

SEQ ID NO: 2763465 - RNA, 12 nt, Leptospira interrogans serovar lai str. 56601
aaaaaaauaaua

SEQ ID NO: 2763466 - RNA, 21 nt, Leptospira interrogans serovar lai str. 56601
aaaaaaauaauauauuuauaa

SEQ ID NO: 2763467 - RNA, 14 nt, Leptospira interrogans serovar lai str. 56601
aaaaaaauauuaaa

SEQ ID NO: 2763468 - RNA, 16 nt, Leptospira interrogans serovar lai str. 56601
aaaaaaaugaauuuuu

SEQ ID NO: 2763469 - RNA, 12 nt, Leptospira interrogans serovar lai str. 56601
aaaaaaauuaaa

SEQ ID NO: 2763470 - RNA, 13 nt, Leptospira interrogans serovar lai str. 56601
aaaaaaauuagaa

SEQ ID NO: 2763471 - RNA, 11 nt, Leptospira interrogans serovar lai str. 56601
aaaaaacaaau

SEQ ID NO: 2763472 - RNA, 18 nt, Leptospira interrogans serovar lai str. 56601
aaaaaacuauaaaucauu

SEQ ID NO: 2763473 - RNA, 17 nt, Leptospira interrogans serovar lai str. 56601
aaaaaacucaauguguu

SEQ ID NO: 2763474 - RNA, 22 nt, Leptospira interrogans serovar lai str. 56601
aaaaaacuuuuuaaaacgauuu

SEQ ID NO: 2763475 - RNA, 16 nt, Leptospira interrogans serovar lai str. 56601
aaaaaacuuuuuauaa

SEQ ID NO: 2763476 - RNA, 12 nt, Leptospira interrogans serovar lai str. 56601
aaaaaagaaagc

SEQ ID NO: 2763477 - RNA, 13 nt, Leptospira interrogans serovar lai str. 56601
aaaaaagaaagca

SEQ ID NO: 2763478 - RNA, 14 nt, Leptospira interrogans serovar lai str. 56601
aaaaaagacuuaaa

SEQ ID NO: 2763479 - RNA, 13 nt, Leptospira interrogans serovar lai str. 56601
aaaaaagagaaag

SEQ ID NO: 2763480 - RNA, 15 nt, Leptospira interrogans serovar lai str. 56601
aaaaaagagaaagaa

SEQ ID NO: 2763481 - RNA, 16 nt, Leptospira interrogans serovar lai str. 56601
aaaaaagaucuuauaa

SEQ ID NO: 2763482 - RNA, 12 nt, Leptospira interrogans serovar lai str. 56601
aaaaaagcagcu

SEQ ID NO: 2763483 - RNA, 18 nt, Leptospira interrogans serovar lai str. 56601
aaaaaagcugaacuuaaa

SEQ ID NO: 2763484 - RNA, 17 nt, Leptospira interrogans serovar lai str. 56601
aaaaaaguccaaaacaa

SEQ ID NO: 2763485 - RNA, 13 nt, Leptospira interrogans serovar lai str. 56601
aaaaaauaaaaug

SEQ ID NO: 2763486 - RNA, 13 nt, Leptospira interrogans serovar lai str. 56601
aaaaaauaaaauu

SEQ ID NO: 2763487 - RNA, 14 nt, Leptospira interrogans serovar lai str. 56601
aaaaaauaaaauuu

SEQ ID NO: 2763488 - RNA, 18 nt, Leptospira interrogans serovar lai str. 56601
aaaaaauaagaaagaauu

SEQ ID NO: 2763489 - RNA, 12 nt, Leptospira interrogans serovar lai str. 56601
aaaaaauacaaa

SEQ ID NO: 2763490 - RNA, 16 nt, Leptospira interrogans serovar lai str. 56601
aaaaaauacaaaguuu

SEQ ID NO: 2763491 - RNA, 14 nt, Leptospira interrogans serovar lai str. 56601
aaaaaauacgauuc

SEQ ID NO: 2763492 - RNA, 20 nt, Leptospira interrogans serovar lai str. 56601
aaaaaauagcgauacuuaaa

SEQ ID NO: 2763493 - RNA, 23 nt, Leptospira interrogans serovar lai str. 56601
aaaaaauauaauauacuagggaa

SEQ ID NO: 2763494 - RNA, 14 nt, Leptospira interrogans serovar lai str. 56601
aaaaaauaucauuu

SEQ ID NO: 2763495 - RNA, 14 nt, Leptospira interrogans serovar lai str. 56601
aaaaaauaucuuau

SEQ ID NO: 2763496 - RNA, 14 nt, Leptospira interrogans serovar lai str. 56601
aaaaaauauuuucu

SEQ ID NO: 2763497 - RNA, 22 nt, Leptospira interrogans serovar lai str. 56601
aaaaaaucgacuuuucugauuu

SEQ ID NO: 2763498 - RNA, 18 nt, Leptospira interrogans serovar lai str. 56601
aaaaaaugaauguuuaaa

SEQ ID NO: 2763499 - RNA, 22 nt, Leptospira interrogans serovar lai str. 56601
aaaaaaugaauguuuaaaauuu

SEQ ID NO: 2763500 - RNA, 12 nt, Leptospira interrogans serovar lai str. 56601
aaaaaaugaauu

SEQ ID NO: 2763501 - RNA, 18 nt, Leptospira interrogans serovar lai str. 56601
aaaaaaugagaaagaauu

SEQ ID NO: 2763502 - RNA, 22 nt, Leptospira interrogans serovar lai str. 56601
aaaaaaugcucaaaaauuauaa

SEQ ID NO: 2763503 - RNA, 11 nt, Leptospira interrogans serovar lai str. 56601
aaaaaauggag

SEQ ID NO: 2763504 - RNA, 11 nt, Leptospira interrogans serovar lai str. 56601
aaaaauuuuuu

SEQ ID NO: 2763505 - RNA, 19 nt, Leptospira interrogans serovar lai str. 56601
aaaaauuuuuucuuuuuag

SEQ ID NO: 2763506 - RNA, 16 nt, Leptospira interrogans serovar lai str. 56601
aaaaauuuuuuuaaac

SEQ ID NO: 2763507 - RNA, 15 nt, Leptospira interrogans serovar lai str. 56601
aaaacaaaaaaacaa

SEQ ID NO: 2763508 - RNA, 23 nt, Leptospira interrogans serovar lai str. 56601
aaaacaaauuaaguuuaaaaaca

SEQ ID NO: 2763509 - RNA, 19 nt, Leptospira interrogans serovar lai str. 56601
aaaacaagcucaauuuuga

SEQ ID NO: 2763510 - RNA, 20 nt, Leptospira interrogans serovar lai str. 56601
aaaacaauagcuucuuuaaa

SEQ ID NO: 2763511 - RNA, 15 nt, Leptospira interrogans serovar lai str. 56601
aaaacaauauucuaa

SEQ ID NO: 2763512 - RNA, 14 nt, Leptospira interrogans serovar lai str. 56601
aaaacacaaaggaa

SEQ ID NO: 2763513 - RNA, 22 nt, Leptospira interrogans serovar lai str. 56601
aaaacaccgugaucuccuaaaa

SEQ ID NO: 2763514 - RNA, 19 nt, Leptospira interrogans serovar lai str. 56601
aaaacacuuuacauuuuua

SEQ ID NO: 2763515 - RNA, 19 nt, Leptospira interrogans serovar lai str. 56601
aaaacagaucaagaauuaa

SEQ ID NO: 2763516 - RNA, 19 nt, Leptospira interrogans serovar lai str. 56601
aaaacagauggagaauuaa

SEQ ID NO: 2763517 - RNA, 15 nt, Leptospira interrogans serovar lai str. 56601
aaaacaggucccaaa

SEQ ID NO: 2763518 - RNA, 19 nt, Leptospira interrogans serovar lai str. 56601
aaaacaggucccaaacuuu

SEQ ID NO: 2763519 - RNA, 21 nt, Leptospira interrogans serovar lai str. 56601
aaaacaguauuuguaaaaaug

SEQ ID NO: 2763520 - RNA, 14 nt, Leptospira interrogans serovar lai str. 56601
aaaacauaaaaauu

SEQ ID NO: 2763521 - RNA, 14 nt, Leptospira interrogans serovar lai str. 56601
aaaacauuucguuu

SEQ ID NO: 2763522 - RNA, 10 nt, Leptospira interrogans serovar lai str. 56601
aaaaccaaaa

SEQ ID NO: 2763523 - RNA, 15 nt, Leptospira interrogans serovar lai str. 56601
aaaaccaaaacaucu

SEQ ID NO: 2763524 - RNA, 14 nt, Leptospira interrogans serovar lai str. 56601
aaaaccaaaaugcu

SEQ ID NO: 2763525 - RNA, 17 nt, Leptospira interrogans serovar lai str. 56601
aaaaccaaaaugcugaa

SEQ ID NO: 2763526 - RNA, 17 nt, Leptospira interrogans serovar lai str. 56601
aaaaccaaauaauaaaa

SEQ ID NO: 2763527 - RNA, 13 nt, Leptospira interrogans serovar lai str. 56601
aaaaccaaucgau

SEQ ID NO: 2763528 - RNA, 15 nt, Leptospira interrogans serovar lai str. 56601
aaaaccacaaaaaca

SEQ ID NO: 2763529 - RNA, 18 nt, Leptospira interrogans serovar lai str. 56601
aaaaccacaaaaacaaau

SEQ ID NO: 2763530 - RNA, 19 nt, Leptospira interrogans serovar lai str. 56601
aaaaccacccccaccaaaa

SEQ ID NO: 2763531 - RNA, 16 nt, Leptospira interrogans serovar lai str. 56601
aaaaccaucuuugaua

SEQ ID NO: 2763532 - RNA, 22 nt, Leptospira interrogans serovar lai str. 56601
aaaacccaucguaaacaaaagu

SEQ ID NO: 2763533 - RNA, 19 nt, Leptospira interrogans serovar lai str. 56601
aaaacccuuagucugaaau

SEQ ID NO: 2763534 - RNA, 19 nt, Leptospira interrogans serovar lai str. 56601
aaaacccuuucuuugaaga

SEQ ID NO: 2763535 - RNA, 17 nt, Leptospira interrogans serovar lai str. 56601
aaaaccgcugaaaaaaa

SEQ ID NO: 2763536 - RNA, 22 nt, Leptospira interrogans serovar lai str. 56601
aaaaccgucccaaaacaauagc

SEQ ID NO: 2763537 - RNA, 16 nt, Leptospira interrogans serovar lai str. 56601
aaaaccgucccaaaau

SEQ ID NO: 2763538 - RNA, 19 nt, Leptospira interrogans serovar lai str. 56601
aaaaccgucccaaaaucuu

SEQ ID NO: 2763539 - RNA, 19 nt, Leptospira interrogans serovar lai str. 56601
aaaaccguuguuuuacagc

SEQ ID NO: 2763540 - RNA, 14 nt, Leptospira interrogans serovar lai str. 56601
aaaaccucaaaaaa

SEQ ID NO: 2763541 - RNA, 23 nt, Leptospira interrogans serovar lai str. 56601
aaaaccucaaaaaauuuacacga

SEQ ID NO: 2763542 - RNA, 20 nt, Leptospira interrogans serovar lai str. 56601
aaaaccugauuuuucuguaa

SEQ ID NO: 2763543 - RNA, 18 nt, Leptospira interrogans serovar lai str. 56601
aaaaccuguaaaugaauu

SEQ ID NO: 2763544 - RNA, 20 nt, Leptospira interrogans serovar lai str. 56601
aaaaccuuuauuuaauaaaa

SEQ ID NO: 2763545 - RNA, 21 nt, Leptospira interrogans serovar lai str. 56601
aaaaccuuuauuuaauaaaau

SEQ ID NO: 2763546 - RNA, 20 nt, Leptospira interrogans serovar lai str. 56601
aaaacgaaauuauacaaaac

SEQ ID NO: 2763547 - RNA, 14 nt, Leptospira interrogans serovar lai str. 56601
aaaacgaauaucau

SEQ ID NO: 2763548 - RNA, 18 nt, Leptospira interrogans serovar lai str. 56601
aaaacgagacguugaguu

SEQ ID NO: 2763549 - RNA, 16 nt, Leptospira interrogans serovar lai str. 56601
aaaacgauauuuuuua

SEQ ID NO: 2763550 - RNA, 18 nt, Leptospira interrogans serovar lai str. 56601
aaaacgauauuuuuuaaa

SEQ ID NO: 2763551 - RNA, 22 nt, Leptospira interrogans serovar lai str. 56601
aaaacgauucucguucaacuuu

SEQ ID NO: 2763552 - RNA, 21 nt, Leptospira interrogans serovar lai str. 56601
aaaacgauucugcacuuuuua

SEQ ID NO: 2763553 - RNA, 16 nt, Leptospira interrogans serovar lai str. 56601
aaaacgauuuuucaaa

SEQ ID NO: 2763554 - RNA, 17 nt, Leptospira interrogans serovar lai str. 56601
aaaacgcgauccguaga

SEQ ID NO: 2763555 - RNA, 21 nt, Leptospira interrogans serovar lai str. 56601
aaaacggaauuuuguuugaau

SEQ ID NO: 2763556 - RNA, 23 nt, Leptospira interrogans serovar lai str. 56601
aaaacgguaauuuuauguagaaa

SEQ ID NO: 2763557 - RNA, 16 nt, Leptospira interrogans serovar lai str. 56601
aaaacgguauuuaaaa

SEQ ID NO: 2763558 - RNA, 19 nt, Leptospira interrogans serovar lai str. 56601
aaaacgguauuuaaaauua

SEQ ID NO: 2763559 - RNA, 23 nt, Leptospira interrogans serovar lai str. 56601
aaaacgucuuuauccauccauac

SEQ ID NO: 2763560 - RNA, 21 nt, Leptospira interrogans serovar lai str. 56601
aaaacguuuuguugaguuuga

SEQ ID NO: 2763561 - RNA, 14 nt, Leptospira interrogans serovar lai str. 56601
aaaacuaaaaccga

SEQ ID NO: 2763562 - RNA, 20 nt, Leptospira interrogans serovar lai str. 56601
aaaacuacaucgucuucuuu

SEQ ID NO: 2763563 - RNA, 23 nt, Leptospira interrogans serovar lai str. 56601
aaaacuagggaaaguuuuuuaaa

SEQ ID NO: 2763564 - RNA, 19 nt, Leptospira interrogans serovar lai str. 56601
aaaacuaucaguuuucaga

SEQ ID NO: 2763565 - RNA, 20 nt, Leptospira interrogans serovar lai str. 56601
aaaacucaacacaacgcucu

SEQ ID NO: 2763566 - RNA, 17 nt, Leptospira interrogans serovar lai str. 56601
aaaacucagugaaugcc

SEQ ID NO: 2763567 - RNA, 13 nt, Leptospira interrogans serovar lai str. 56601
aaaacucaucaca

SEQ ID NO: 2763568 - RNA, 21 nt, Leptospira interrogans serovar lai str. 56601
aaaacucuaccuuuauuuaaa

SEQ ID NO: 2763569 - RNA, 16 nt, Leptospira interrogans serovar lai str. 56601
aaaacucuauuaaacu

SEQ ID NO: 2763570 - RNA, 22 nt, Leptospira interrogans serovar lai str. 56601
aaaacucuguucaguguaagau

SEQ ID NO: 2763571 - RNA, 20 nt, Leptospira interrogans serovar lai str. 56601
aaaacugauuuaauuauuua

SEQ ID NO: 2763572 - RNA, 15 nt, Leptospira interrogans serovar lai str. 56601
aaaacuguaaauuag

SEQ ID NO: 2763573 - RNA, 16 nt, Leptospira interrogans serovar lai str. 56601
aaaacuguacaauaga

SEQ ID NO: 2763574 - RNA, 23 nt, Leptospira interrogans serovar lai str. 56601
aaaacuuaaaucccauuuuaacg

SEQ ID NO: 2763575 - RNA, 18 nt, Leptospira interrogans serovar lai str. 56601
aaaacuuaaugagauuaa

SEQ ID NO: 2763576 - RNA, 20 nt, Leptospira interrogans serovar lai str. 56601
aaaacuugauauuucuguaa

SEQ ID NO: 2763577 - RNA, 18 nt, Leptospira interrogans serovar lai str. 56601
aaaacuuggguuucuuaa

SEQ ID NO: 2763578 - RNA, 23 nt, Leptospira interrogans serovar lai str. 56601
aaaacuuggguuucuuaaaucuu

SEQ ID NO: 2763579 - RNA, 17 nt, Leptospira interrogans serovar lai str. 56601
aaaacuugucccaaaau

SEQ ID NO: 2763580 - RNA, 12 nt, Leptospira interrogans serovar lai str. 56601
aaaacuuucgga

SEQ ID NO: 2763581 - RNA, 19 nt, Leptospira interrogans serovar lai str. 56601
aaaacuuucggaauaaaac

SEQ ID NO: 2763582 - RNA, 22 nt, Leptospira interrogans serovar lai str. 56601
aaaacuuucggaauaaaacccu

SEQ ID NO: 2763583 - RNA, 20 nt, Leptospira interrogans serovar lai str. 56601
aaaacuuucuaaaaauaaga

SEQ ID NO: 2763584 - RNA, 15 nt, Leptospira interrogans serovar lai str. 56601
aaaacuuucuuaaau

SEQ ID NO: 2763585 - RNA, 21 nt, Leptospira interrogans serovar lai str. 56601
aaaacuuugaccauucuuugu

SEQ ID NO: 2763586 - RNA, 13 nt, Leptospira interrogans serovar lai str. 56601
aaaauaaaaaauu

SEQ ID NO: 2763587 - RNA, 12 nt, Leptospira interrogans serovar lai str. 56601
aaaauaaaaauu

SEQ ID NO: 2763588 - RNA, 17 nt, Leptospira interrogans serovar lai str. 56601
aaaauaaacguggaaau

SEQ ID NO: 2763589 - RNA, 16 nt, Leptospira interrogans serovar lai str. 56601
aaaauaaacuaucuaa

SEQ ID NO: 2763590 - RNA, 15 nt, Leptospira interrogans serovar lai str. 56601
aaaauaaagaaacug

SEQ ID NO: 2763591 - RNA, 12 nt, Leptospira interrogans serovar lai str. 56601
aaaauaaaucau

SEQ ID NO: 2763592 - RNA, 21 nt, Leptospira interrogans serovar lai str. 56601
aaaauaaaucgauuacaauua

SEQ ID NO: 2763593 - RNA, 15 nt, Leptospira interrogans serovar lai str. 56601
aaaauaaauuuauaa

SEQ ID NO: 2763594 - RNA, 18 nt, Leptospira interrogans serovar lai str. 56601
aaaauaacgauccuaaag

SEQ ID NO: 2763595 - RNA, 17 nt, Leptospira interrogans serovar lai str. 56601
aaaauaagaaaauaaag

SEQ ID NO: 2763596 - RNA, 18 nt, Leptospira interrogans serovar lai str. 56601
aaaauaagguuuuauaaa

SEQ ID NO: 2763597 - RNA, 13 nt, Leptospira interrogans serovar lai str. 56601
aaaauaauaauau

SEQ ID NO: 2763598 - RNA, 14 nt, Leptospira interrogans serovar lai str. 56601
aaaauaauaauauu

SEQ ID NO: 2763599 - RNA, 13 nt, Leptospira interrogans serovar lai str. 56601
aaaauaauaccaa

SEQ ID NO: 2763600 - RNA, 17 nt, Leptospira interrogans serovar lai str. 56601
aaaauaauaccaaguua

SEQ ID NO: 2763601 - RNA, 13 nt, Leptospira interrogans serovar lai str. 56601
aaaauaauacuac

SEQ ID NO: 2763602 - RNA, 18 nt, Leptospira interrogans serovar lai str. 56601
aaaauaauaucaaaauga

SEQ ID NO: 2763603 - RNA, 15 nt, Leptospira interrogans serovar lai str. 56601
aaaauaauauuauaa

SEQ ID NO: 2763604 - RNA, 16 nt, Leptospira interrogans serovar lai str. 56601
aaaauacaaaguuugu

SEQ ID NO: 2763605 - RNA, 23 nt, Leptospira interrogans serovar lai str. 56601
aaaauacaaaguuuguaguaacu

SEQ ID NO: 2763606 - RNA, 24 nt, Leptospira interrogans serovar lai str. 56601
aaaauacaaaguuuguaguaacuc

SEQ ID NO: 2763607 - RNA, 19 nt, Leptospira interrogans serovar lai str. 56601
aaaauacaguacuauauuu

SEQ ID NO: 2763608 - RNA, 15 nt, Leptospira interrogans serovar lai str. 56601
aaaauacauaaaaaa

SEQ ID NO: 2763609 - RNA, 21 nt, Leptospira interrogans serovar lai str. 56601
aaaauacauaggaaccugauu

SEQ ID NO: 2763610 - RNA, 20 nt, Leptospira interrogans serovar lai str. 56601
aaaauacauuuguaaauaaa

SEQ ID NO: 2763611 - RNA, 23 nt, Leptospira interrogans serovar lai str. 56601
aaaauacggcacucaauuuuaua

SEQ ID NO: 2763612 - RNA, 22 nt, Leptospira interrogans serovar lai str. 56601
aaaauacuaaaagaguaauucu

SEQ ID NO: 2763613 - RNA, 21 nt, Leptospira interrogans serovar lai str. 56601
aaaauacuucucuaaagaucg

SEQ ID NO: 2763614 - RNA, 14 nt, Leptospira interrogans serovar lai str. 56601
aaaauacuuuaccg

SEQ ID NO: 2763615 - RNA, 14 nt, Leptospira interrogans serovar lai str. 56601
aaaauacuuuauuu

SEQ ID NO: 2763616 - RNA, 20 nt, Leptospira interrogans serovar lai str. 56601
aaaauacuuugaacuugucc

SEQ ID NO: 2763617 - RNA, 16 nt, Leptospira interrogans serovar lai str. 56601
aaaauacuuuuagaaa

SEQ ID NO: 2763618 - RNA, 18 nt, Leptospira interrogans serovar lai str. 56601
aaaauacuuuuagaaaau

SEQ ID NO: 2763619 - RNA, 15 nt, Leptospira interrogans serovar lai str. 56601
aaaauagaaacagau

SEQ ID NO: 2763620 - RNA, 22 nt, Leptospira interrogans serovar lai str. 56601
aaaauagaauuguugaaaaauu

SEQ ID NO: 2763621 - RNA, 17 nt, Leptospira interrogans serovar lai str. 56601
aaaauagaauuuuugua

SEQ ID NO: 2763622 - RNA, 17 nt, Leptospira interrogans serovar lai str. 56601
aaaauagccuucaauua

SEQ ID NO: 2763623 - RNA, 19 nt, Leptospira interrogans serovar lai str. 56601
aaaauagcgauacuuaaaa

SEQ ID NO: 2763624 - RNA, 15 nt, Leptospira interrogans serovar lai str. 56601
aaaauaggauuuaaa

SEQ ID NO: 2763625 - RNA, 16 nt, Leptospira interrogans serovar lai str. 56601
aaaauagggaaaacuc

SEQ ID NO: 2763626 - RNA, 17 nt, Leptospira interrogans serovar lai str. 56601
aaaauagggaaaacuca

SEQ ID NO: 2763627 - RNA, 19 nt, Leptospira interrogans serovar lai str. 56601
aaaauaguauccaaaauua

SEQ ID NO: 2763628 - RNA, 11 nt, Leptospira interrogans serovar lai str. 56601
aaaauauaaau

SEQ ID NO: 2763629 - RNA, 12 nt, Leptospira interrogans serovar lai str. 56601
aaaauauaauau

SEQ ID NO: 2763630 - RNA, 15 nt, Leptospira interrogans serovar lai str. 56601
aaaauauaauauacu

SEQ ID NO: 2763631 - RNA, 21 nt, Leptospira interrogans serovar lai str. 56601
aaaauauacuuuucaaacgau

SEQ ID NO: 2763632 - RNA, 22 nt, Leptospira interrogans serovar lai str. 56601
aaaauauaggaacucuuacuuu

SEQ ID NO: 2763633 - RNA, 19 nt, Leptospira interrogans serovar lai str. 56601
aaaauauagugguuuguaa

SEQ ID NO: 2763634 - RNA, 21 nt, Leptospira interrogans serovar lai str. 56601
aaaauauagugguuuguaaua

SEQ ID NO: 2763635 - RNA, 22 nt, Leptospira interrogans serovar lai str. 56601
aaaauauauucagaaaacagaa

SEQ ID NO: 2763636 - RNA, 15 nt, Leptospira interrogans serovar lai str. 56601
aaaauaucauuuaac

SEQ ID NO: 2763637 - RNA, 18 nt, Leptospira interrogans serovar lai str. 56601
aaaauauccguaaaaccu

SEQ ID NO: 2763638 - RNA, 20 nt, Leptospira interrogans serovar lai str. 56601
aaaauauccguaaaaccucc

SEQ ID NO: 2763639 - RNA, 14 nt, Leptospira interrogans serovar lai str. 56601
aaaauaucuuagaa

SEQ ID NO: 2763640 - RNA, 15 nt, Leptospira interrogans serovar lai str. 56601
aaaauaugauuuaaa

SEQ ID NO: 2763641 - RNA, 17 nt, Leptospira interrogans serovar lai str. 56601
aaaauaugauuuaaaau

SEQ ID NO: 2763642 - RNA, 12 nt, Leptospira interrogans serovar lai str. 56601
aaaauauuugca

SEQ ID NO: 2763643 - RNA, 20 nt, Leptospira interrogans serovar lai str. 56601
aaaauauuugcauaaacuuc

SEQ ID NO: 2763644 - RNA, 12 nt, Leptospira interrogans serovar lai str. 56601
aaaauauuuuga

SEQ ID NO: 2763645 - RNA, 12 nt, Leptospira interrogans serovar lai str. 56601
aaaaucaaagag

SEQ ID NO: 2763646 - RNA, 14 nt, Leptospira interrogans serovar lai str. 56601
aaaaucaaagauau

SEQ ID NO: 2763647 - RNA, 12 nt, Leptospira interrogans serovar lai str. 56601
aaaaucaaauau

SEQ ID NO: 2763648 - RNA, 17 nt, Leptospira interrogans serovar lai str. 56601
aaaaucacaaaaaagau

SEQ ID NO: 2763649 - RNA, 22 nt, Leptospira interrogans serovar lai str. 56601
aaaaucacaaaaaagauaaaaa

SEQ ID NO: 2763650 - RNA, 15 nt, Leptospira interrogans serovar lai str. 56601
aaaaucagucauaaa

SEQ ID NO: 2763651 - RNA, 18 nt, Leptospira interrogans serovar lai str. 56601
aaaaucagucauaaaaaa

SEQ ID NO: 2763652 - RNA, 14 nt, Leptospira interrogans serovar lai str. 56601
aaaaucaguuaaua

SEQ ID NO: 2763653 - RNA, 15 nt, Leptospira interrogans serovar lai str. 56601
aaaaucaguuaauac

SEQ ID NO: 2763654 - RNA, 23 nt, Leptospira interrogans serovar lai str. 56601
aaaaucaguuaauacaaaacuua

SEQ ID NO: 2763655 - RNA, 17 nt, Leptospira interrogans serovar lai str. 56601
aaaaucauacuuuuaaa

SEQ ID NO: 2763656 - RNA, 19 nt, Leptospira interrogans serovar lai str. 56601
aaaaucauacuuuuaaaaa

SEQ ID NO: 2763657 - RNA, 20 nt, Leptospira interrogans serovar lai str. 56601
aaaaucauacuuuuaaaaaa

SEQ ID NO: 2763658 - RNA, 13 nt, Leptospira interrogans serovar lai str. 56601
aaaaucauaucca

SEQ ID NO: 2763659 - RNA, 17 nt, Leptospira interrogans serovar lai str. 56601
aaaaucauauuuucaaa

SEQ ID NO: 2763660 - RNA, 20 nt, Leptospira interrogans serovar lai str. 56601
aaaaucauauuuucaaaaaa

SEQ ID NO: 2763661 - RNA, 21 nt, Leptospira interrogans serovar lai str. 56601
aaaaucauauuuucaaaaaau

SEQ ID NO: 2763662 - RNA, 18 nt, Leptospira interrogans serovar lai str. 56601
aaaaucauuuaaagcaaa

SEQ ID NO: 2763663 - RNA, 22 nt, Leptospira interrogans serovar lai str. 56601
aaaaucauuuaaagcaaauacc

SEQ ID NO: 2763664 - RNA, 15 nt, Leptospira interrogans serovar lai str. 56601
aaaauccagaauaau

SEQ ID NO: 2763665 - RNA, 18 nt, Leptospira interrogans serovar lai str. 56601
aaaauccagaauaauaau

SEQ ID NO: 2763666 - RNA, 18 nt, Leptospira interrogans serovar lai str. 56601
aaaauccaugauuuguaa

SEQ ID NO: 2763667 - RNA, 13 nt, Leptospira interrogans serovar lai str. 56601
aaaaucccagaaa

SEQ ID NO: 2763668 - RNA, 19 nt, Leptospira interrogans serovar lai str. 56601
aaaaucccagaaaggaacu

SEQ ID NO: 2763669 - RNA, 16 nt, Leptospira interrogans serovar lai str. 56601
aaaauuagaaucugaa

SEQ ID NO: 2763670 - RNA, 16 nt, Leptospira interrogans serovar lai str. 56601
aaaauuagagaaguua

SEQ ID NO: 2763671 - RNA, 22 nt, Leptospira interrogans serovar lai str. 56601
aaaauuagagaaguuaaaaaau

SEQ ID NO: 2763672 - RNA, 19 nt, Leptospira interrogans serovar lai str. 56601
aaaauuagauuuauugaaa

SEQ ID NO: 2763673 - RNA, 20 nt, Leptospira interrogans serovar lai str. 56601
aaaauuagauuuauugaaaa

SEQ ID NO: 2763674 - RNA, 21 nt, Leptospira interrogans serovar lai str. 56601
aaaauuagauuuauugaaaaa

SEQ ID NO: 2763675 - RNA, 20 nt, Leptospira interrogans serovar lai str. 56601
aaaauuaggcuuaucuguaa

SEQ ID NO: 2763676 - RNA, 22 nt, Leptospira interrogans serovar lai str. 56601
aaaauuaggcuuaucuguaaaa

SEQ ID NO: 2763677 - RNA, 19 nt, Leptospira interrogans serovar lai str. 56601
aaaauuauagauaauuuuu

SEQ ID NO: 2763678 - RNA, 14 nt, Leptospira interrogans serovar lai str. 56601
aaaauuauuuugaa

SEQ ID NO: 2763679 - RNA, 21 nt, Leptospira interrogans serovar lai str. 56601
aaaauucaaguggguuacuuu

SEQ ID NO: 2763680 - RNA, 21 nt, Leptospira interrogans serovar lai str. 56601
aaaauucaguuucaaacugag

SEQ ID NO: 2763681 - RNA, 17 nt, Leptospira interrogans serovar lai str. 56601
aaaauucauauugagau

SEQ ID NO: 2763682 - RNA, 19 nt, Leptospira interrogans serovar lai str. 56601
aaaauuccauagcaacaau

SEQ ID NO: 2763683 - RNA, 22 nt, Leptospira interrogans serovar lai str. 56601
aaaauuccgaauucuaaaauac

SEQ ID NO: 2763684 - RNA, 16 nt, Leptospira interrogans serovar lai str. 56601
aaaauuccuaaaacac

SEQ ID NO: 2763685 - RNA, 18 nt, Leptospira interrogans serovar lai str. 56601
aaaauuccuaaaacaccu

SEQ ID NO: 2763686 - RNA, 21 nt, Leptospira interrogans serovar lai str. 56601
aaaauuccuaaaacaccuucu

SEQ ID NO: 2763687 - RNA, 17 nt, Leptospira interrogans serovar lai str. 56601
aaaauuccuuacucguu

SEQ ID NO: 2763688 - RNA, 20 nt, Leptospira interrogans serovar lai str. 56601
aaaauucgaaucauuuugua

SEQ ID NO: 2763689 - RNA, 13 nt, Leptospira interrogans serovar lai str. 56601
aaaauucuccucc

SEQ ID NO: 2763690 - RNA, 22 nt, Leptospira interrogans serovar lai str. 56601
aaaauucuccuccugaaaauuu

SEQ ID NO: 2763691 - RNA, 19 nt, Leptospira interrogans serovar lai str. 56601
aaaauucuccucuucacca

SEQ ID NO: 2763692 - RNA, 22 nt, Leptospira interrogans serovar lai str. 56601
aaaauucugucguaaaaaguuu

SEQ ID NO: 2763693 - RNA, 14 nt, Leptospira interrogans serovar lai str. 56601
aaaauucuuaaaaa

SEQ ID NO: 2763694 - RNA, 16 nt, Leptospira interrogans serovar lai str. 56601
aaaauucuuaaaaaau

SEQ ID NO: 2763695 - RNA, 18 nt, Leptospira interrogans serovar lai str. 56601
aaaauucuuaaaaaauau

SEQ ID NO: 2763696 - RNA, 17 nt, Leptospira interrogans serovar lai str. 56601
aaaauucuuaauauacu

SEQ ID NO: 2763697 - RNA, 20 nt, Leptospira interrogans serovar lai str. 56601
aaaauucuuagaguaaaacu

SEQ ID NO: 2763698 - RNA, 18 nt, Leptospira interrogans serovar lai str. 56601
aaaauugaauaucauaaa

SEQ ID NO: 2763699 - RNA, 19 nt, Leptospira interrogans serovar lai str. 56601
aaaauugaauaucauaaau

SEQ ID NO: 2763700 - RNA, 15 nt, Leptospira interrogans serovar lai str. 56601
aaaauugaauauuca

SEQ ID NO: 2763701 - RNA, 15 nt, Leptospira interrogans serovar lai str. 56601
aaaauugaauuuaaa

SEQ ID NO: 2763702 - RNA, 20 nt, Leptospira interrogans serovar lai str. 56601
aaaauugaauuuaaaaguuu

SEQ ID NO: 2763703 - RNA, 15 nt, Leptospira interrogans serovar lai str. 56601
aaaauugagcuuguu

SEQ ID NO: 2763704 - RNA, 15 nt, Leptospira interrogans serovar lai str. 56601
aaaauuggaaagaac

SEQ ID NO: 2763705 - RNA, 16 nt, Leptospira interrogans serovar lai str. 56601
aaaauuguagaaacuu

SEQ ID NO: 2763706 - RNA, 20 nt, Leptospira interrogans serovar lai str. 56601
aaaauuguagaaacuuauac

SEQ ID NO: 2763707 - RNA, 23 nt, Leptospira interrogans serovar lai str. 56601
aaaauugugggaacuauuauaaa

SEQ ID NO: 2763708 - RNA, 17 nt, Leptospira interrogans serovar lai str. 56601
aaaauuguugaagaauu

SEQ ID NO: 2763709 - RNA, 12 nt, Leptospira interrogans serovar lai str. 56601
aaaauuuaaaaa

SEQ ID NO: 2763710 - RNA, 20 nt, Leptospira interrogans serovar lai str. 56601
aaaauuuaaauguuuuugua

SEQ ID NO: 2763711 - RNA, 16 nt, Leptospira interrogans serovar lai str. 56601
aaaauuuaacaacauu

SEQ ID NO: 2763712 - RNA, 23 nt, Leptospira interrogans serovar lai str. 56601
aaaauuuaacgacauuagaacua

SEQ ID NO: 2763713 - RNA, 12 nt, Leptospira interrogans serovar lai str. 56601
aaaauuuagaac

SEQ ID NO: 2763714 - RNA, 12 nt, Leptospira interrogans serovar lai str. 56601
aaaauuuagaau

SEQ ID NO: 2763715 - RNA, 14 nt, Leptospira interrogans serovar lai str. 56601
aaaauuuagaauug

SEQ ID NO: 2763716 - RNA, 21 nt, Leptospira interrogans serovar lai str. 56601
aaaauuuaucuguaaaauuug

SEQ ID NO: 2763717 - RNA, 17 nt, Leptospira interrogans serovar lai str. 56601
aaaauuuccaacgaagu

SEQ ID NO: 2763718 - RNA, 21 nt, Leptospira interrogans serovar lai str. 56601
aaaauuucccgauucucaaaa

SEQ ID NO: 2763719 - RNA, 18 nt, Leptospira interrogans serovar lai str. 56601
aaaauuucuaaagaauua

SEQ ID NO: 2763720 - RNA, 17 nt, Leptospira interrogans serovar lai str. 56601
aaaauuucuuuuuugua

SEQ ID NO: 2763721 - RNA, 12 nt, Leptospira interrogans serovar lai str. 56601
aaaauuugaaaa

SEQ ID NO: 2763722 - RNA, 22 nt, Leptospira interrogans serovar lai str. 56601
aaaauuugaaaguaaaaaagag

SEQ ID NO: 2763723 - RNA, 23 nt, Leptospira interrogans serovar lai str. 56601
aaaauuugaaaguaaaaaagagc

SEQ ID NO: 2763724 - RNA, 23 nt, Leptospira interrogans serovar lai str. 56601
aaaauuugauauauuuuuaaagc

SEQ ID NO: 2763725 - RNA, 22 nt, Leptospira interrogans serovar lai str. 56601
aaaauuugauccucuaaucgcu

SEQ ID NO: 2763726 - RNA, 11 nt, Leptospira interrogans serovar lai str. 56601
aaaauuugauu

SEQ ID NO: 2763727 - RNA, 12 nt, Leptospira interrogans serovar lai str. 56601
aaaauuuuaaaa

SEQ ID NO: 2763728 - RNA, 13 nt, Leptospira interrogans serovar lai str. 56601
aaaauuuuauaaa

SEQ ID NO: 2763729 - RNA, 17 nt, Leptospira interrogans serovar lai str. 56601
aaaauuuuauaaaaauc

SEQ ID NO: 2763730 - RNA, 15 nt, Leptospira interrogans serovar lai str. 56601
aaaauuuuauaauag

SEQ ID NO: 2763731 - RNA, 21 nt, Leptospira interrogans serovar lai str. 56601
aaaauuuuauaguagauauua

SEQ ID NO: 2763732 - RNA, 13 nt, Leptospira interrogans serovar lai str. 56601
aaaauuuucauuu

SEQ ID NO: 2763733 - RNA, 11 nt, Leptospira interrogans serovar lai str. 56601
aaaauuuuccg

SEQ ID NO: 2763734 - RNA, 18 nt, Leptospira interrogans serovar lai str. 56601
aaaauuuuccgaaccuua

SEQ ID NO: 2763735 - RNA, 21 nt, Leptospira interrogans serovar lai str. 56601
aaaauuuuccgaaccuuacca

SEQ ID NO: 2763736 - RNA, 20 nt, Leptospira interrogans serovar lai str. 56601
aaaauuuuccggacuuucca

SEQ ID NO: 2763737 - RNA, 21 nt, Leptospira interrogans serovar lai str. 56601
aaaauuuuccguuaauaaauc

SEQ ID NO: 2763738 - RNA, 12 nt, Leptospira interrogans serovar lai str. 56601
aaaauuuuccuu

SEQ ID NO: 2763739 - RNA, 18 nt, Leptospira interrogans serovar lai str. 56601
aaaauuuucuguuuauuu

SEQ ID NO: 2763740 - RNA, 17 nt, Leptospira interrogans serovar lai str. 56601
aaaauuuugcuucugaa

SEQ ID NO: 2763741 - RNA, 17 nt, Leptospira interrogans serovar lai str. 56601
aaaauuuuuaauaaaau

SEQ ID NO: 2763742 - RNA, 20 nt, Leptospira interrogans serovar lai str. 56601
aaaauuuuuacgcguaauuu

SEQ ID NO: 2763743 - RNA, 11 nt, Leptospira interrogans serovar lai str. 56601
aaaauuuuuau

SEQ ID NO: 2763744 - RNA, 22 nt, Leptospira interrogans serovar lai str. 56601
aaaauuuuuaucgcaaagcucu

SEQ ID NO: 2763745 - RNA, 20 nt, Leptospira interrogans serovar lai str. 56601
aaaauuuuuguguaaaauua

SEQ ID NO: 2763746 - RNA, 17 nt, Leptospira interrogans serovar lai str. 56601
aaaauuuuuuagaguua

SEQ ID NO: 2763747 - RNA, 22 nt, Leptospira interrogans serovar lai str. 56601
aaaauuuuuuauuuuaugaaua

SEQ ID NO: 2763748 - RNA, 16 nt, Leptospira interrogans serovar lai str. 56601
aaaauuuuuugaaguu

SEQ ID NO: 2763749 - RNA, 15 nt, Leptospira interrogans serovar lai str. 56601
aaaauuuuuuuaaac

SEQ ID NO: 2763750 - RNA, 15 nt, Leptospira interrogans serovar lai str. 56601
aaaauuuuuuuguaa

SEQ ID NO: 2763751 - RNA, 20 nt, Leptospira interrogans serovar lai str. 56601
aaacaaaacguaagauaggu

SEQ ID NO: 2763752 - RNA, 16 nt, Leptospira interrogans serovar lai str. 56601
aaaccugauuuuucca

SEQ ID NO: 2763753 - RNA, 19 nt, Leptospira interrogans serovar lai str. 56601
aaaccugauuuuuccauaa

SEQ ID NO: 2763754 - RNA, 18 nt, Leptospira interrogans serovar lai str. 56601
aaaccuggauuugucucu

SEQ ID NO: 2763755 - RNA, 19 nt, Leptospira interrogans serovar lai str. 56601
aaaccuucuuuaagauauu

SEQ ID NO: 2763756 - RNA, 16 nt, Leptospira interrogans serovar lai str. 56601
aaaccuuuauagaauu

SEQ ID NO: 2763757 - RNA, 22 nt, Leptospira interrogans serovar lai str. 56601
aaaccuuuccccccacccaaaa

SEQ ID NO: 2763758 - RNA, 23 nt, Leptospira interrogans serovar lai str. 56601
aaaccuuuccccccacccaaaaa

SEQ ID NO: 2763759 - RNA, 20 nt, Leptospira interrogans serovar lai str. 56601
aaacgaaauuauacaaaacu

SEQ ID NO: 2763760 - RNA, 22 nt, Leptospira interrogans serovar lai str. 56601
aaacgaacuuuucuauaaaauc

SEQ ID NO: 2763761 - RNA, 18 nt, Leptospira interrogans serovar lai str. 56601
aaacgauacaaauuccgu

SEQ ID NO: 2763762 - RNA, 18 nt, Leptospira interrogans serovar lai str. 56601
aaacgauauuuuuuaaaa

SEQ ID NO: 2763763 - RNA, 20 nt, Leptospira interrogans serovar lai str. 56601
aaacgaucagaaaaacaaaa

SEQ ID NO: 2763764 - RNA, 22 nt, Leptospira interrogans serovar lai str. 56601
aaacgaucauacuuuagaaauu

SEQ ID NO: 2763765 - RNA, 16 nt, Leptospira interrogans serovar lai str. 56601
aaacgaucuacuuugc

SEQ ID NO: 2763766 - RNA, 15 nt, Leptospira interrogans serovar lai str. 56601
aaacgauuaauccau

SEQ ID NO: 2763767 - RNA, 22 nt, Leptospira interrogans serovar lai str. 56601
aaacgauuaugauuuuuuugaa

SEQ ID NO: 2763768 - RNA, 18 nt, Leptospira interrogans serovar lai str. 56601
aaacgauuauuuuuuaaa

SEQ ID NO: 2763769 - RNA, 16 nt, Leptospira interrogans serovar lai str. 56601
aaacgauugauugaag

SEQ ID NO: 2763770 - RNA, 21 nt, Leptospira interrogans serovar lai str. 56601
aaacgauugauugaagcaguu

SEQ ID NO: 2763771 - RNA, 13 nt, Leptospira interrogans serovar lai str. 56601
aaacgauuuaaaa

SEQ ID NO: 2763772 - RNA, 16 nt, Leptospira interrogans serovar lai str. 56601
aaacgcgauccguaga

SEQ ID NO: 2763773 - RNA, 17 nt, Leptospira interrogans serovar lai str. 56601
aaacgcugaguuugaaa

SEQ ID NO: 2763774 - RNA, 16 nt, Leptospira interrogans serovar lai str. 56601
aaacgcuuucguaaaa

SEQ ID NO: 2763775 - RNA, 14 nt, Leptospira interrogans serovar lai str. 56601
aaacggaagaaaau

SEQ ID NO: 2763776 - RNA, 16 nt, Leptospira interrogans serovar lai str. 56601
aaacggaagaaaauua

SEQ ID NO: 2763777 - RNA, 21 nt, Leptospira interrogans serovar lai str. 56601
aaacgggcccaaauaaaaaca

SEQ ID NO: 2763778 - RNA, 23 nt, Leptospira interrogans serovar lai str. 56601
aaacgggcccaaauaaaaacacu

SEQ ID NO: 2763779 - RNA, 16 nt, Leptospira interrogans serovar lai str. 56601
aaacgguaaaaggagc

SEQ ID NO: 2763780 - RNA, 18 nt, Leptospira interrogans serovar lai str. 56601
aaacgguaaaaggagcca

SEQ ID NO: 2763781 - RNA, 20 nt, Leptospira interrogans serovar lai str. 56601
aaacgguaauuucauaaaau

SEQ ID NO: 2763782 - RNA, 16 nt, Leptospira interrogans serovar lai str. 56601
aaacggugcauuuaaa

SEQ ID NO: 2763783 - RNA, 23 nt, Leptospira interrogans serovar lai str. 56601
aaacguaagcuugauuuucgauu

SEQ ID NO: 2763784 - RNA, 16 nt, Leptospira interrogans serovar lai str. 56601
aaacguacauuuuuca

SEQ ID NO: 2763785 - RNA, 17 nt, Leptospira interrogans serovar lai str. 56601
aaacguacuuacugaaa

SEQ ID NO: 2763786 - RNA, 15 nt, Leptospira interrogans serovar lai str. 56601
aaacguauaaaaaca

SEQ ID NO: 2763787 - RNA, 22 nt, Leptospira interrogans serovar lai str. 56601
aaacgucauaguucccacaaau

SEQ ID NO: 2763788 - RNA, 21 nt, Leptospira interrogans serovar lai str. 56601
aaacguuuauuucaaaauuuu

SEQ ID NO: 2763789 - RNA, 17 nt, Leptospira interrogans serovar lai str. 56601
aaacguuuucaaaaaau

SEQ ID NO: 2763790 - RNA, 15 nt, Leptospira interrogans serovar lai str. 56601
aaacguuuuguugag

SEQ ID NO: 2763791 - RNA, 14 nt, Leptospira interrogans serovar lai str. 56601
aaacuaaaaaaaau

SEQ ID NO: 2763792 - RNA, 13 nt, Leptospira interrogans serovar lai str. 56601
aaacuaaauuagu

SEQ ID NO: 2763793 - RNA, 20 nt, Leptospira interrogans serovar lai str. 56601
aaacuaauuuguaggaauua

SEQ ID NO: 2763794 - RNA, 14 nt, Leptospira interrogans serovar lai str. 56601
aaacuacuaaaucu

SEQ ID NO: 2763795 - RNA, 17 nt, Leptospira interrogans serovar lai str. 56601
aaacuacuaaaucucaa

SEQ ID NO: 2763796 - RNA, 14 nt, Leptospira interrogans serovar lai str. 56601
aaacuacuguaaga

SEQ ID NO: 2763797 - RNA, 17 nt, Leptospira interrogans serovar lai str. 56601
aaacuacuuccgucuuu

SEQ ID NO: 2763798 - RNA, 13 nt, Leptospira interrogans serovar lai str. 56601
aaacuaggaucuc

SEQ ID NO: 2763799 - RNA, 23 nt, Leptospira interrogans serovar lai str. 56601
aaacuagggaaaguuuuuuaaaa

SEQ ID NO: 2763800 - RNA, 18 nt, Leptospira interrogans serovar lai str. 56601
aaacuauagagaaaucca

SEQ ID NO: 2763801 - RNA, 15 nt, Leptospira interrogans serovar lai str. 56601
aaacuauccaaaagu

SEQ ID NO: 2763802 - RNA, 16 nt, Leptospira interrogans serovar lai str. 56601
aaacuaucgaaugcga

SEQ ID NO: 2763803 - RNA, 17 nt, Leptospira interrogans serovar lai str. 56601
aaacuauuacaaauagg

SEQ ID NO: 2763804 - RNA, 17 nt, Leptospira interrogans serovar lai str. 56601
aaacuauuuaauauagg

SEQ ID NO: 2763805 - RNA, 13 nt, Leptospira interrogans serovar lai str. 56601
aaacucaaagaau

SEQ ID NO: 2763806 - RNA, 17 nt, Leptospira interrogans serovar lai str. 56601
aaacucaaaggaaaaug

SEQ ID NO: 2763807 - RNA, 18 nt, Leptospira interrogans serovar lai str. 56601
aaacucaaaucuacaaaa

SEQ ID NO: 2763808 - RNA, 20 nt, Leptospira interrogans serovar lai str. 56601
aaacucaacacaacgcucuc

SEQ ID NO: 2763809 - RNA, 16 nt, Leptospira interrogans serovar lai str. 56601
aaacucaacacaacgg

SEQ ID NO: 2763810 - RNA, 19 nt, Leptospira interrogans serovar lai str. 56601
aaacucacgcuaaaauaaa

SEQ ID NO: 2763811 - RNA, 19 nt, Leptospira interrogans serovar lai str. 56601
aaacucaguaaaacgcucu

SEQ ID NO: 2763812 - RNA, 14 nt, Leptospira interrogans serovar lai str. 56601
aaacucauuuuaaa

SEQ ID NO: 2763813 - RNA, 14 nt, Leptospira interrogans serovar lai str. 56601
aaacucauuuuucu

SEQ ID NO: 2763814 - RNA, 20 nt, Leptospira interrogans serovar lai str. 56601
aaacucauuuuucuaaaaaa

SEQ ID NO: 2763815 - RNA, 14 nt, Leptospira interrogans serovar lai str. 56601
aaacuccagaauua

SEQ ID NO: 2763816 - RNA, 14 nt, Leptospira interrogans serovar lai str. 56601
aaacucuaaauuca

SEQ ID NO: 2763817 - RNA, 22 nt, Leptospira interrogans serovar lai str. 56601
aaacucuaccuuuauuuaaaaa

SEQ ID NO: 2763818 - RNA, 17 nt, Leptospira interrogans serovar lai str. 56601
aaacucuauuagaauug

SEQ ID NO: 2763819 - RNA, 20 nt, Leptospira interrogans serovar lai str. 56601
aaacucuuuuucuucugcug

SEQ ID NO: 2763820 - RNA, 22 nt, Leptospira interrogans serovar lai str. 56601
aaacugagauuugucucaaaau

SEQ ID NO: 2763821 - RNA, 20 nt, Leptospira interrogans serovar lai str. 56601
aaacugaguaccguuuauuu

SEQ ID NO: 2763822 - RNA, 13 nt, Leptospira interrogans serovar lai str. 56601
aaacugauuaaaa

SEQ ID NO: 2763823 - RNA, 22 nt, Leptospira interrogans serovar lai str. 56601
aaacugauuuaauuauuuauuu

SEQ ID NO: 2763824 - RNA, 18 nt, Leptospira interrogans serovar lai str. 56601
aaacugcgguaauaccug

SEQ ID NO: 2763825 - RNA, 20 nt, Leptospira interrogans serovar lai str. 56601
aaacugcgguucuaguauua

SEQ ID NO: 2763826 - RNA, 13 nt, Leptospira interrogans serovar lai str. 56601
aaacuguuuaaua

SEQ ID NO: 2763827 - RNA, 14 nt, Leptospira interrogans serovar lai str. 56601
aaacuguuuccagu

SEQ ID NO: 2763828 - RNA, 22 nt, Leptospira interrogans serovar lai str. 56601
aaacuguuucuuacucgacaaa

SEQ ID NO: 2763829 - RNA, 12 nt, Leptospira interrogans serovar lai str. 56601
aaacuuaaaaau

SEQ ID NO: 2763830 - RNA, 14 nt, Leptospira interrogans serovar lai str. 56601
aaacuuaaaaaugu

SEQ ID NO: 2763831 - RNA, 14 nt, Leptospira interrogans serovar lai str. 56601
aaacuuaaaucuca

SEQ ID NO: 2763832 - RNA, 20 nt, Leptospira interrogans serovar lai str. 56601
aaacuuaaguuugucuguaa

SEQ ID NO: 2763833 - RNA, 15 nt, Leptospira interrogans serovar lai str. 56601
aaacuuaauaaaaau

SEQ ID NO: 2763834 - RNA, 16 nt, Leptospira interrogans serovar lai str. 56601
aaacuuaauaaaaauc

SEQ ID NO: 2763835 - RNA, 19 nt, Leptospira interrogans serovar lai str. 56601
aaagacuauauucuucgcu

SEQ ID NO: 2763836 - RNA, 15 nt, Leptospira interrogans serovar lai str. 56601
aaagacucacaccuu

SEQ ID NO: 2763837 - RNA, 21 nt, Leptospira interrogans serovar lai str. 56601
aaagacucacaccuucuuuuu

SEQ ID NO: 2763838 - RNA, 16 nt, Leptospira interrogans serovar lai str. 56601
aaagacucauucuugu

SEQ ID NO: 2763839 - RNA, 19 nt, Leptospira interrogans serovar lai str. 56601
aaagacuuaaaagaagauu

SEQ ID NO: 2763840 - RNA, 14 nt, Leptospira interrogans serovar lai str. 56601
aaagagaaaacaau

SEQ ID NO: 2763841 - RNA, 14 nt, Leptospira interrogans serovar lai str. 56601
aaagagaaagaaaa

SEQ ID NO: 2763842 - RNA, 17 nt, Leptospira interrogans serovar lai str. 56601
aaagagacauugaagaa

SEQ ID NO: 2763843 - RNA, 21 nt, Leptospira interrogans serovar lai str. 56601
aaagagacauugaagaaaaaa

SEQ ID NO: 2763844 - RNA, 23 nt, Leptospira interrogans serovar lai str. 56601
aaagagacauugaagaaaaaaag

SEQ ID NO: 2763845 - RNA, 21 nt, Leptospira interrogans serovar lai str. 56601
aaagagacguaaucuguggga

SEQ ID NO: 2763846 - RNA, 19 nt, Leptospira interrogans serovar lai str. 56601
aaagagaugauuucuugag

SEQ ID NO: 2763847 - RNA, 23 nt, Leptospira interrogans serovar lai str. 56601
aaagagaugguuuagaaaacgga

SEQ ID NO: 2763848 - RNA, 15 nt, Leptospira interrogans serovar lai str. 56601
aaagaggucuaugau

SEQ ID NO: 2763849 - RNA, 22 nt, Leptospira interrogans serovar lai str. 56601
aaagaguaauucuaaguaauuu

SEQ ID NO: 2763850 - RNA, 14 nt, Leptospira interrogans serovar lai str. 56601
aaagaguuguuuau

SEQ ID NO: 2763851 - RNA, 18 nt, Leptospira interrogans serovar lai str. 56601
aaagaguuguuuaucuuc

SEQ ID NO: 2763852 - RNA, 13 nt, Leptospira interrogans serovar lai str. 56601
aaagaguuuaaaa

SEQ ID NO: 2763853 - RNA, 15 nt, Leptospira interrogans serovar lai str. 56601
aaagaguuuaaaaaa

SEQ ID NO: 2763854 - RNA, 13 nt, Leptospira interrogans serovar lai str. 56601
aaagauaaaaaag

SEQ ID NO: 2763855 - RNA, 13 nt, Leptospira interrogans serovar lai str. 56601
aaagauaaaaaga

SEQ ID NO: 2763856 - RNA, 16 nt, Leptospira interrogans serovar lai str. 56601
aaagauaaaaagagac

SEQ ID NO: 2763857 - RNA, 20 nt, Leptospira interrogans serovar lai str. 56601
aaagauauuucaauauaaaa

SEQ ID NO: 2763858 - RNA, 15 nt, Leptospira interrogans serovar lai str. 56601
aaagauuaaagauuu

SEQ ID NO: 2763859 - RNA, 21 nt, Leptospira interrogans serovar lai str. 56601
aaagauuaaagauuugcucuu

SEQ ID NO: 2763860 - RNA, 16 nt, Leptospira interrogans serovar lai str. 56601
aaagauuagaaaaacu

SEQ ID NO: 2763861 - RNA, 22 nt, Leptospira interrogans serovar lai str. 56601
aaagauucacuuagaaagauag

SEQ ID NO: 2763862 - RNA, 15 nt, Leptospira interrogans serovar lai str. 56601
aaagauucuugauaa

SEQ ID NO: 2763863 - RNA, 21 nt, Leptospira interrogans serovar lai str. 56601
aaagauugaacgguaaaaucu

SEQ ID NO: 2763864 - RNA, 12 nt, Leptospira interrogans serovar lai str. 56601
aaagauugaauu

SEQ ID NO: 2763865 - RNA, 18 nt, Leptospira interrogans serovar lai str. 56601
aaagauuuccuaauaacu

SEQ ID NO: 2763866 - RNA, 15 nt, Leptospira interrogans serovar lai str. 56601
aaagauuuguuuuau

SEQ ID NO: 2763867 - RNA, 13 nt, Leptospira interrogans serovar lai str. 56601
aaagauuuuaaaa

SEQ ID NO: 2763868 - RNA, 23 nt, Leptospira interrogans serovar lai str. 56601
aaagauuuuaaaaauucaacuaa

SEQ ID NO: 2763869 - RNA, 15 nt, Leptospira interrogans serovar lai str. 56601
aaagauuuucgucuu

SEQ ID NO: 2763870 - RNA, 14 nt, Leptospira interrogans serovar lai str. 56601
aaagauuuuuaucg

SEQ ID NO: 2763871 - RNA, 18 nt, Leptospira interrogans serovar lai str. 56601
aaagauuuuuaucgauuc

SEQ ID NO: 2763872 - RNA, 21 nt, Leptospira interrogans serovar lai str. 56601
aaagcaaacuuuuuauaaaaa

SEQ ID NO: 2763873 - RNA, 20 nt, Leptospira interrogans serovar lai str. 56601
aaagcaacugugggaacuac

SEQ ID NO: 2763874 - RNA, 13 nt, Leptospira interrogans serovar lai str. 56601
aaagcaagaaaau

SEQ ID NO: 2763875 - RNA, 19 nt, Leptospira interrogans serovar lai str. 56601
aaagcaauccauucaaaaa

SEQ ID NO: 2763876 - RNA, 15 nt, Leptospira interrogans serovar lai str. 56601
aaagcacaaaacgau

SEQ ID NO: 2763877 - RNA, 17 nt, Leptospira interrogans serovar lai str. 56601
aaagcacuguuuuaacg

SEQ ID NO: 2763878 - RNA, 14 nt, Leptospira interrogans serovar lai str. 56601
aaagcagcaaagaa

SEQ ID NO: 2763879 - RNA, 16 nt, Leptospira interrogans serovar lai str. 56601
aaagcagcuaaaaaga

SEQ ID NO: 2763880 - RNA, 19 nt, Leptospira interrogans serovar lai str. 56601
aaagcauaacgucuugauu

SEQ ID NO: 2763881 - RNA, 23 nt, Leptospira interrogans serovar lai str. 56601
aaagcauaaugucggaucauaau

SEQ ID NO: 2763882 - RNA, 18 nt, Leptospira interrogans serovar lai str. 56601
aaagccauuucaaaaaua

SEQ ID NO: 2763883 - RNA, 19 nt, Leptospira interrogans serovar lai str. 56601
aaagcccguucuguugagu

SEQ ID NO: 2763884 - RNA, 14 nt, Leptospira interrogans serovar lai str. 56601
aaagcccuauaucc

SEQ ID NO: 2763885 - RNA, 18 nt, Leptospira interrogans serovar lai str. 56601
aaagccgcacaaaccaaa

SEQ ID NO: 2763886 - RNA, 20 nt, Leptospira interrogans serovar lai str. 56601
aaagccguuuucgaaaacuu

SEQ ID NO: 2763887 - RNA, 15 nt, Leptospira interrogans serovar lai str. 56601
aaagcgauugaagug

SEQ ID NO: 2763888 - RNA, 21 nt, Leptospira interrogans serovar lai str. 56601
aaagcgcucuuugaaauucag

SEQ ID NO: 2763889 - RNA, 18 nt, Leptospira interrogans serovar lai str. 56601
aaagcggucuugaaaauu

SEQ ID NO: 2763890 - RNA, 23 nt, Leptospira interrogans serovar lai str. 56601
aaagcgugacuaaaauugacaaa

SEQ ID NO: 2763891 - RNA, 17 nt, Leptospira interrogans serovar lai str. 56601
aaagcguuguguugagu

SEQ ID NO: 2763892 - RNA, 18 nt, Leptospira interrogans serovar lai str. 56601
aaagcguuucauugaguu

SEQ ID NO: 2763893 - RNA, 19 nt, Leptospira interrogans serovar lai str. 56601
aaagcguuucguucuuuuu

SEQ ID NO: 2763894 - RNA, 19 nt, Leptospira interrogans serovar lai str. 56601
aaagcucuccaucuuuuuu

SEQ ID NO: 2763895 - RNA, 13 nt, Leptospira interrogans serovar lai str. 56601
aaaggaaaacgau

SEQ ID NO: 2763896 - RNA, 15 nt, Leptospira interrogans serovar lai str. 56601
aaaggaaaagaaacc

SEQ ID NO: 2763897 - RNA, 24 nt, Leptospira interrogans serovar lai str. 56601
aaaggaaggaguaucaauagaaau

SEQ ID NO: 2763898 - RNA, 23 nt, Leptospira interrogans serovar lai str. 56601
aaaggaauacaauugauuuaaaa

SEQ ID NO: 2763899 - RNA, 13 nt, Leptospira interrogans serovar lai str. 56601
aaaggaauccaug

SEQ ID NO: 2763900 - RNA, 21 nt, Leptospira interrogans serovar lai str. 56601
aaaggaauccaugauucugaa

SEQ ID NO: 2763901 - RNA, 14 nt, Leptospira interrogans serovar lai str. 56601
aaaggaaucccaaa

SEQ ID NO: 2763902 - RNA, 18 nt, Leptospira interrogans serovar lai str. 56601
aaaggaauucgaauuccu

SEQ ID NO: 2763903 - RNA, 21 nt, Leptospira interrogans serovar lai str. 56601
aaaggagccaacacauuccau

SEQ ID NO: 2763904 - RNA, 15 nt, Leptospira interrogans serovar lai str. 56601
aaaggaguauuuuuu

SEQ ID NO: 2763905 - RNA, 17 nt, Leptospira interrogans serovar lai str. 56601
aaaggauaaucuacccc

SEQ ID NO: 2763906 - RNA, 16 nt, Leptospira interrogans serovar lai str. 56601
aaaggauccuuuucuu

SEQ ID NO: 2763907 - RNA, 22 nt, Leptospira interrogans serovar lai str. 56601
aaaggcaccggcuacaggugga

SEQ ID NO: 2763908 - RNA, 18 nt, Leptospira interrogans serovar lai str. 56601
aaaggcccuuuguagaaa

SEQ ID NO: 2763909 - RNA, 19 nt, Leptospira interrogans serovar lai str. 56601
aaaggcucucuuuugagag

SEQ ID NO: 2763910 - RNA, 20 nt, Leptospira interrogans serovar lai str. 56601
aaaggggaucaacaaaauua

SEQ ID NO: 2763911 - RNA, 18 nt, Leptospira interrogans serovar lai str. 56601
aaaggguuuuuacaauua

SEQ ID NO: 2763912 - RNA, 14 nt, Leptospira interrogans serovar lai str. 56601
aaagguuaaaaauu

SEQ ID NO: 2763913 - RNA, 23 nt, Leptospira interrogans serovar lai str. 56601
aaagguuauguaacaaucuuauu

SEQ ID NO: 2763914 - RNA, 11 nt, Leptospira interrogans serovar lai str. 56601
aaagguugagc

SEQ ID NO: 2763915 - RNA, 20 nt, Leptospira interrogans serovar lai str. 56601
aaagguugagcaguaaaauc

SEQ ID NO: 2763916 - RNA, 22 nt, Leptospira interrogans serovar lai str. 56601
aaagguugagcaguaaaaucuu

SEQ ID NO: 2763917 - RNA, 11 nt, Leptospira interrogans serovar lai str. 56601
aaagguugagu

SEQ ID NO: 2763918 - RNA, 11 nt, Leptospira interrogans serovar lai str. 56601
aaauaaaaaag

SEQ ID NO: 2763919 - RNA, 19 nt, Leptospira interrogans serovar lai str. 56601
aaauaaaaacgucaaaauu

SEQ ID NO: 2763920 - RNA, 12 nt, Leptospira interrogans serovar lai str. 56601
aaauaaaaauau

SEQ ID NO: 2763921 - RNA, 19 nt, Leptospira interrogans serovar lai str. 56601
aaauaaaaggaguaauucu

SEQ ID NO: 2763922 - RNA, 15 nt, Leptospira interrogans serovar lai str. 56601
aaauaaaauuuuaua

SEQ ID NO: 2763923 - RNA, 13 nt, Leptospira interrogans serovar lai str. 56601
aaauaaagaaaag

SEQ ID NO: 2763924 - RNA, 15 nt, Leptospira interrogans serovar lai str. 56601
aaauaaagaaaagga

SEQ ID NO: 2763925 - RNA, 21 nt, Leptospira interrogans serovar lai str. 56601
aaauaaaggcccuuuguagaa

SEQ ID NO: 2763926 - RNA, 12 nt, Leptospira interrogans serovar lai str. 56601
aaauaaagguuu

SEQ ID NO: 2763927 - RNA, 13 nt, Leptospira interrogans serovar lai str. 56601
aaauaaagguuuu

SEQ ID NO: 2763928 - RNA, 17 nt, Leptospira interrogans serovar lai str. 56601
aaauaaagguuuuauag

SEQ ID NO: 2763929 - RNA, 16 nt, Leptospira interrogans serovar lai str. 56601
aaauaaauaauacauu

SEQ ID NO: 2763930 - RNA, 18 nt, Leptospira interrogans serovar lai str. 56601
aaauaaaucaugaucaaa

SEQ ID NO: 2763931 - RNA, 20 nt, Leptospira interrogans serovar lai str. 56601
aaauaaaucaugaucaaauu

SEQ ID NO: 2763932 - RNA, 21 nt, Leptospira interrogans serovar lai str. 56601
aaauaaaucaugaucaaauuc

SEQ ID NO: 2763933 - RNA, 17 nt, Leptospira interrogans serovar lai str. 56601
aaauaaauuccccaaaa

SEQ ID NO: 2763934 - RNA, 13 nt, Leptospira interrogans serovar lai str. 56601
aaauaaauuuaaa

SEQ ID NO: 2763935 - RNA, 15 nt, Leptospira interrogans serovar lai str. 56601
aaauaaauuuaaaug

SEQ ID NO: 2763936 - RNA, 12 nt, Leptospira interrogans serovar lai str. 56601
aaauaaauuuau

SEQ ID NO: 2763937 - RNA, 14 nt, Leptospira interrogans serovar lai str. 56601
aaauaaauuuauaa

SEQ ID NO: 2763938 - RNA, 15 nt, Leptospira interrogans serovar lai str. 56601
aaauaacaauagcuu

SEQ ID NO: 2763939 - RNA, 20 nt, Leptospira interrogans serovar lai str. 56601
aaauaacgauuccauuuuuu

SEQ ID NO: 2763940 - RNA, 13 nt, Leptospira interrogans serovar lai str. 56601
aaauaagaagcca

SEQ ID NO: 2763941 - RNA, 16 nt, Leptospira interrogans serovar lai str. 56601
aaauaagaaucgaaaa

SEQ ID NO: 2763942 - RNA, 19 nt, Leptospira interrogans serovar lai str. 56601
aaauaagcccgaagauucu

SEQ ID NO: 2763943 - RNA, 20 nt, Leptospira interrogans serovar lai str. 56601
aaauaagcuaagcauaaaau

SEQ ID NO: 2763944 - RNA, 15 nt, Leptospira interrogans serovar lai str. 56601
aaauaaguaaaucua

SEQ ID NO: 2763945 - RNA, 21 nt, Leptospira interrogans serovar lai str. 56601
aaauaauaauaugauguaaau

SEQ ID NO: 2763946 - RNA, 19 nt, Leptospira interrogans serovar lai str. 56601
aaauaauacaauucugaaa

SEQ ID NO: 2763947 - RNA, 15 nt, Leptospira interrogans serovar lai str. 56601
aaauaauauuauaaa

SEQ ID NO: 2763948 - RNA, 19 nt, Leptospira interrogans serovar lai str. 56601
aaauaauuuuuacuuccca

SEQ ID NO: 2763949 - RNA, 13 nt, Leptospira interrogans serovar lai str. 56601
aaauacaaaauga

SEQ ID NO: 2763950 - RNA, 16 nt, Leptospira interrogans serovar lai str. 56601
aaauacaaaauuuuuu

SEQ ID NO: 2763951 - RNA, 14 nt, Leptospira interrogans serovar lai str. 56601
aaauacaaaguauu

SEQ ID NO: 2763952 - RNA, 17 nt, Leptospira interrogans serovar lai str. 56601
aaauacacggagauaaa

SEQ ID NO: 2763953 - RNA, 18 nt, Leptospira interrogans serovar lai str. 56601
aaauacagugucuugaaa

SEQ ID NO: 2763954 - RNA, 13 nt, Leptospira interrogans serovar lai str. 56601
aaauacauaaaaa

SEQ ID NO: 2763955 - RNA, 20 nt, Leptospira interrogans serovar lai str. 56601
aaauacauaaaaaaauaaua

SEQ ID NO: 2763956 - RNA, 21 nt, Leptospira interrogans serovar lai str. 56601
aaauacauaaaugauacuuug

SEQ ID NO: 2763957 - RNA, 15 nt, Leptospira interrogans serovar lai str. 56601
aaauacauacaauga

SEQ ID NO: 2763958 - RNA, 15 nt, Leptospira interrogans serovar lai str. 56601
aaauaccaauaacuu

SEQ ID NO: 2763959 - RNA, 20 nt, Leptospira interrogans serovar lai str. 56601
aaauaccaauaacuuaaccu

SEQ ID NO: 2763960 - RNA, 16 nt, Leptospira interrogans serovar lai str. 56601
aaauaccgcuggaaau

SEQ ID NO: 2763961 - RNA, 17 nt, Leptospira interrogans serovar lai str. 56601
aaauaccuaaauauuua

SEQ ID NO: 2763962 - RNA, 15 nt, Leptospira interrogans serovar lai str. 56601
aaauacgaaaacaau

SEQ ID NO: 2763963 - RNA, 16 nt, Leptospira interrogans serovar lai str. 56601
aaauacgaaaacaauu

SEQ ID NO: 2763964 - RNA, 20 nt, Leptospira interrogans serovar lai str. 56601
aaauacgaucuaauuuguaa

SEQ ID NO: 2763965 - RNA, 15 nt, Leptospira interrogans serovar lai str. 56601
aaauacgauucgaaa

SEQ ID NO: 2763966 - RNA, 15 nt, Leptospira interrogans serovar lai str. 56601
aaauacuaaauuaag

SEQ ID NO: 2763967 - RNA, 16 nt, Leptospira interrogans serovar lai str. 56601
aaauacucaauccgaa

SEQ ID NO: 2763968 - RNA, 21 nt, Leptospira interrogans serovar lai str. 56601
aaauacucaauccgaauaguu

SEQ ID NO: 2763969 - RNA, 17 nt, Leptospira interrogans serovar lai str. 56601
aaauacucuaauuuuuu

SEQ ID NO: 2763970 - RNA, 18 nt, Leptospira interrogans serovar lai str. 56601
aaauacuguuaauuuuua

SEQ ID NO: 2763971 - RNA, 15 nt, Leptospira interrogans serovar lai str. 56601
aaauacuuaaaaacc

SEQ ID NO: 2763972 - RNA, 18 nt, Leptospira interrogans serovar lai str. 56601
aaauacuuagaauuuuuu

SEQ ID NO: 2763973 - RNA, 23 nt, Leptospira interrogans serovar lai str. 56601
aaauacuucuccacgauugauuu

SEQ ID NO: 2763974 - RNA, 12 nt, Leptospira interrogans serovar lai str. 56601
aaauacuuuacc

SEQ ID NO: 2763975 - RNA, 23 nt, Leptospira interrogans serovar lai str. 56601
aaauacuuuauaauugaacauuu

SEQ ID NO: 2763976 - RNA, 14 nt, Leptospira interrogans serovar lai str. 56601
aaauacuuuaucuu

SEQ ID NO: 2763977 - RNA, 13 nt, Leptospira interrogans serovar lai str. 56601
aaauacuuugauu

SEQ ID NO: 2763978 - RNA, 15 nt, Leptospira interrogans serovar lai str. 56601
aaauacuuugauuau

SEQ ID NO: 2763979 - RNA, 20 nt, Leptospira interrogans serovar lai str. 56601
aaauacuuuuagaaaauuag

SEQ ID NO: 2763980 - RNA, 13 nt, Leptospira interrogans serovar lai str. 56601
aaauagaaagacu

SEQ ID NO: 2763981 - RNA, 14 nt, Leptospira interrogans serovar lai str. 56601
aaauagaaagacuu

SEQ ID NO: 2763982 - RNA, 16 nt, Leptospira interrogans serovar lai str. 56601
aaauagaauaaauuau

SEQ ID NO: 2763983 - RNA, 11 nt, Leptospira interrogans serovar lai str. 56601
aaauagaauuu

SEQ ID NO: 2763984 - RNA, 18 nt, Leptospira interrogans serovar lai str. 56601
aaauagaauuuugcaaaa

SEQ ID NO: 2763985 - RNA, 21 nt, Leptospira interrogans serovar lai str. 56601
aaauagaauuuugcaaaaaaa

SEQ ID NO: 2763986 - RNA, 23 nt, Leptospira interrogans serovar lai str. 56601
aaauagaauuuugcaaaaaaaau

SEQ ID NO: 2763987 - RNA, 14 nt, Leptospira interrogans serovar lai str. 56601
aaauagaauuuuua

SEQ ID NO: 2763988 - RNA, 14 nt, Leptospira interrogans serovar lai str. 56601
aaauagaauuuuug

SEQ ID NO: 2763989 - RNA, 22 nt, Leptospira interrogans serovar lai str. 56601
aaauagagcuuuguaauaaaaa

SEQ ID NO: 2763990 - RNA, 23 nt, Leptospira interrogans serovar lai str. 56601
aaauagagcuuuguaauaaaaau

SEQ ID NO: 2763991 - RNA, 21 nt, Leptospira interrogans serovar lai str. 56601
aaauagaguaccauaaauuuu

SEQ ID NO: 2763992 - RNA, 23 nt, Leptospira interrogans serovar lai str. 56601
aaauagaguaccauaaauuuuua

SEQ ID NO: 2763993 - RNA, 19 nt, Leptospira interrogans serovar lai str. 56601
aaauagaucugauauuuua

SEQ ID NO: 2763994 - RNA, 21 nt, Leptospira interrogans serovar lai str. 56601
aaauagaucugauauuuuaaa

SEQ ID NO: 2763995 - RNA, 22 nt, Leptospira interrogans serovar lai str. 56601
aaauagauggagaauucauuuu

SEQ ID NO: 2763996 - RNA, 14 nt, Leptospira interrogans serovar lai str. 56601
aaauagauucaaaa

SEQ ID NO: 2763997 - RNA, 13 nt, Leptospira interrogans serovar lai str. 56601
aaauagauucuaa

SEQ ID NO: 2763998 - RNA, 19 nt, Leptospira interrogans serovar lai str. 56601
aaauagauucuaauuuuuc

SEQ ID NO: 2763999 - RNA, 18 nt, Leptospira interrogans serovar lai str. 56601
aaauagcgauacuuaaaa

SEQ ID NO: 2764000 - RNA, 22 nt, Leptospira interrogans serovar lai str. 56601
aaauagcgauacuuaaaaauga

SEQ ID NO: 2764001 - RNA, 15 nt, Leptospira interrogans serovar lai str. 56601
aaaucccauuuuagc

SEQ ID NO: 2764002 - RNA, 14 nt, Leptospira interrogans serovar lai str. 56601
aaauccgaaaaugu

SEQ ID NO: 2764003 - RNA, 14 nt, Leptospira interrogans serovar lai str. 56601
aaauccguauacuu

SEQ ID NO: 2764004 - RNA, 15 nt, Leptospira interrogans serovar lai str. 56601
aaauccuaguuuuac

SEQ ID NO: 2764005 - RNA, 16 nt, Leptospira interrogans serovar lai str. 56601
aaauccuauucaacuu

SEQ ID NO: 2764006 - RNA, 15 nt, Leptospira interrogans serovar lai str. 56601
aaauccuucuuuucu

SEQ ID NO: 2764007 - RNA, 16 nt, Leptospira interrogans serovar lai str. 56601
aaauccuucuuuucuu

SEQ ID NO: 2764008 - RNA, 18 nt, Leptospira interrogans serovar lai str. 56601
aaauccuucuuuucuucu

SEQ ID NO: 2764009 - RNA, 20 nt, Leptospira interrogans serovar lai str. 56601
aaauccuucuuuucuucuuc

SEQ ID NO: 2764010 - RNA, 20 nt, Leptospira interrogans serovar lai str. 56601
aaaucgaagaugguacuuua

SEQ ID NO: 2764011 - RNA, 14 nt, Leptospira interrogans serovar lai str. 56601
aaaucgaauguacg

SEQ ID NO: 2764012 - RNA, 20 nt, Leptospira interrogans serovar lai str. 56601
aaaucgacuuuucugauuuu

SEQ ID NO: 2764013 - RNA, 17 nt, Leptospira interrogans serovar lai str. 56601
aaaucgaguuucacaaa

SEQ ID NO: 2764014 - RNA, 20 nt, Leptospira interrogans serovar lai str. 56601
aaaucgaugguuucaauuua

SEQ ID NO: 2764015 - RNA, 15 nt, Leptospira interrogans serovar lai str. 56601
aaaucgauuacaauu

SEQ ID NO: 2764016 - RNA, 14 nt, Leptospira interrogans serovar lai str. 56601
aaaucgauuuguaa

SEQ ID NO: 2764017 - RNA, 16 nt, Leptospira interrogans serovar lai str. 56601
aaaucgauuuguaaaa

SEQ ID NO: 2764018 - RNA, 20 nt, Leptospira interrogans serovar lai str. 56601
aaaucgauuuguaaaauuca

SEQ ID NO: 2764019 - RNA, 19 nt, Leptospira interrogans serovar lai str. 56601
aaaucggauaguuuaaauu

SEQ ID NO: 2764020 - RNA, 20 nt, Leptospira interrogans serovar lai str. 56601
aaaucgucccgaucauccaa

SEQ ID NO: 2764021 - RNA, 18 nt, Leptospira interrogans serovar lai str. 56601
aaaucgugaauuuacagu

SEQ ID NO: 2764022 - RNA, 16 nt, Leptospira interrogans serovar lai str. 56601
aaaucuaaaaaaacaa

SEQ ID NO: 2764023 - RNA, 13 nt, Leptospira interrogans serovar lai str. 56601
aaaucuaaauuuu

SEQ ID NO: 2764024 - RNA, 15 nt, Leptospira interrogans serovar lai str. 56601
aaaucuaauucuucu

SEQ ID NO: 2764025 - RNA, 23 nt, Leptospira interrogans serovar lai str. 56601
aaaucuaauucuucuaaugaagu

SEQ ID NO: 2764026 - RNA, 15 nt, Leptospira interrogans serovar lai str. 56601
aaaucuacaaaacuu

SEQ ID NO: 2764027 - RNA, 17 nt, Leptospira interrogans serovar lai str. 56601
aaaucuacaaaacuuua

SEQ ID NO: 2764028 - RNA, 19 nt, Leptospira interrogans serovar lai str. 56601
aaaucuacaaaacuuuacg

SEQ ID NO: 2764029 - RNA, 17 nt, Leptospira interrogans serovar lai str. 56601
aaaucuagguuuccuuc

SEQ ID NO: 2764030 - RNA, 23 nt, Leptospira interrogans serovar lai str. 56601
aaaucuaguucaacguaagaaaa

SEQ ID NO: 2764031 - RNA, 14 nt, Leptospira interrogans serovar lai str. 56601
aaaucuaucucaaa

SEQ ID NO: 2764032 - RNA, 20 nt, Leptospira interrogans serovar lai str. 56601
aaaucuaucucaaaaauacu

SEQ ID NO: 2764033 - RNA, 21 nt, Leptospira interrogans serovar lai str. 56601
aaaucuaucucaaaaauacuu

SEQ ID NO: 2764034 - RNA, 14 nt, Leptospira interrogans serovar lai str. 56601
aaaucucaaauucg

SEQ ID NO: 2764035 - RNA, 21 nt, Leptospira interrogans serovar lai str. 56601
aaaucucaauucaguaaauua

SEQ ID NO: 2764036 - RNA, 16 nt, Leptospira interrogans serovar lai str. 56601
aaaucucagaaaauuu

SEQ ID NO: 2764037 - RNA, 17 nt, Leptospira interrogans serovar lai str. 56601
aaaucucagaaaauuuu

SEQ ID NO: 2764038 - RNA, 14 nt, Leptospira interrogans serovar lai str. 56601
aaaucucauuacca

SEQ ID NO: 2764039 - RNA, 15 nt, Leptospira interrogans serovar lai str. 56601
aaaucucuaacaaaa

SEQ ID NO: 2764040 - RNA, 18 nt, Leptospira interrogans serovar lai str. 56601
aaaucucuaacaaaaagu

SEQ ID NO: 2764041 - RNA, 19 nt, Leptospira interrogans serovar lai str. 56601
aaaucugaaauucaucaaa

SEQ ID NO: 2764042 - RNA, 16 nt, Leptospira interrogans serovar lai str. 56601
aaaucugaacauaaaa

SEQ ID NO: 2764043 - RNA, 14 nt, Leptospira interrogans serovar lai str. 56601
aaaucugaauuuua

SEQ ID NO: 2764044 - RNA, 15 nt, Leptospira interrogans serovar lai str. 56601
aaaucuggauuuuga

SEQ ID NO: 2764045 - RNA, 17 nt, Leptospira interrogans serovar lai str. 56601
aaaucuuaaaagaaaau

SEQ ID NO: 2764046 - RNA, 20 nt, Leptospira interrogans serovar lai str. 56601
aaaucuuaauaaaauuuuca

SEQ ID NO: 2764047 - RNA, 15 nt, Leptospira interrogans serovar lai str. 56601
aaaucuuaauuugua

SEQ ID NO: 2764048 - RNA, 16 nt, Leptospira interrogans serovar lai str. 56601
aaaucuuaauuuguaa

SEQ ID NO: 2764049 - RNA, 17 nt, Leptospira interrogans serovar lai str. 56601
aaaucuuaggaacuuuu

SEQ ID NO: 2764050 - RNA, 21 nt, Leptospira interrogans serovar lai str. 56601
aaaucuuaggaacuuuuauaa

SEQ ID NO: 2764051 - RNA, 22 nt, Leptospira interrogans serovar lai str. 56601
aaaucuucaaguuugugagagu

SEQ ID NO: 2764052 - RNA, 22 nt, Leptospira interrogans serovar lai str. 56601
aaaucuucaguucuuauagaaa

SEQ ID NO: 2764053 - RNA, 22 nt, Leptospira interrogans serovar lai str. 56601
aaaucuuuaaguuugugagagu

SEQ ID NO: 2764054 - RNA, 16 nt, Leptospira interrogans serovar lai str. 56601
aaaucuuuagaauuuu

SEQ ID NO: 2764055 - RNA, 22 nt, Leptospira interrogans serovar lai str. 56601
aaaucuuuagaauuuuucgaaa

SEQ ID NO: 2764056 - RNA, 15 nt, Leptospira interrogans serovar lai str. 56601
aaaugaaaaaaaaca

SEQ ID NO: 2764057 - RNA, 20 nt, Leptospira interrogans serovar lai str. 56601
aaaugaaaaaaaacaaagag

SEQ ID NO: 2764058 - RNA, 20 nt, Leptospira interrogans serovar lai str. 56601
aaaugaaaaagaauuuuuaa

SEQ ID NO: 2764059 - RNA, 12 nt, Leptospira interrogans serovar lai str. 56601
aaaugaaaaauu

SEQ ID NO: 2764060 - RNA, 21 nt, Leptospira interrogans serovar lai str. 56601
aaaugaaaaauuacuuccauu

SEQ ID NO: 2764061 - RNA, 14 nt, Leptospira interrogans serovar lai str. 56601
aaaugaaaauuaua

SEQ ID NO: 2764062 - RNA, 20 nt, Leptospira interrogans serovar lai str. 56601
aaaugaacaaugaauuuuua

SEQ ID NO: 2764063 - RNA, 13 nt, Leptospira interrogans serovar lai str. 56601
aaaugaacucaac

SEQ ID NO: 2764064 - RNA, 18 nt, Leptospira interrogans serovar lai str. 56601
aaaugaacucaacagaac

SEQ ID NO: 2764065 - RNA, 14 nt, Leptospira interrogans serovar lai str. 56601
aaaugaauuuagaa

SEQ ID NO: 2764066 - RNA, 17 nt, Leptospira interrogans serovar lai str. 56601
aaaugaauuuagaaaau

SEQ ID NO: 2764067 - RNA, 14 nt, Leptospira interrogans serovar lai str. 56601
aaaugaauuuuaaa

SEQ ID NO: 2764068 - RNA, 14 nt, Leptospira interrogans serovar lai str. 56601
aaaugaauuuuuua

SEQ ID NO: 2764069 - RNA, 14 nt, Leptospira interrogans serovar lai str. 56601
aaaugaccaaaauu

SEQ ID NO: 2764070 - RNA, 15 nt, Leptospira interrogans serovar lai str. 56601
aaaugaccaaaauuu

SEQ ID NO: 2764071 - RNA, 22 nt, Leptospira interrogans serovar lai str. 56601
aaaugacuaacuacaucaguau

SEQ ID NO: 2764072 - RNA, 20 nt, Leptospira interrogans serovar lai str. 56601
aaaugacuugcauuuaauau

SEQ ID NO: 2764073 - RNA, 21 nt, Leptospira interrogans serovar lai str. 56601
aaaugagaaagaauuucuaaa

SEQ ID NO: 2764074 - RNA, 20 nt, Leptospira interrogans serovar lai str. 56601
aaaugaguuauaguaaaaga

SEQ ID NO: 2764075 - RNA, 17 nt, Leptospira interrogans serovar lai str. 56601
aaaugaguuuuagaaua

SEQ ID NO: 2764076 - RNA, 23 nt, Leptospira interrogans serovar lai str. 56601
aaaugauaauaauuagaaaaaua

SEQ ID NO: 2764077 - RNA, 20 nt, Leptospira interrogans serovar lai str. 56601
aaaugauacuuuguaaaaug

SEQ ID NO: 2764078 - RNA, 16 nt, Leptospira interrogans serovar lai str. 56601
aaaugcagcaaaaccu

SEQ ID NO: 2764079 - RNA, 18 nt, Leptospira interrogans serovar lai str. 56601
aaaugcagcaaaaccuuc

SEQ ID NO: 2764080 - RNA, 24 nt, Leptospira interrogans serovar lai str. 56601
aaaugcagcaaaaccuucgugaaa

SEQ ID NO: 2764081 - RNA, 23 nt, Leptospira interrogans serovar lai str. 56601
aaaugcaguaaugccuacaaauc

SEQ ID NO: 2764082 - RNA, 18 nt, Leptospira interrogans serovar lai str. 56601
aaaugccgccccauagga

SEQ ID NO: 2764083 - RNA, 17 nt, Leptospira interrogans serovar lai str. 56601
aaaugcucaaaaauuau

SEQ ID NO: 2764084 - RNA, 22 nt, Leptospira interrogans serovar lai str. 56601
aaaugcucaaaaauuauaaauc

SEQ ID NO: 2764085 - RNA, 22 nt, Leptospira interrogans serovar lai str. 56601
aaaugcucgguacucuauuaua

SEQ ID NO: 2764086 - RNA, 12 nt, Leptospira interrogans serovar lai str. 56601
aaauggaaaauu

SEQ ID NO: 2764087 - RNA, 13 nt, Leptospira interrogans serovar lai str. 56601
aaauggaaaauug

SEQ ID NO: 2764088 - RNA, 18 nt, Leptospira interrogans serovar lai str. 56601
aaauggaaaauugaaaca

SEQ ID NO: 2764089 - RNA, 17 nt, Leptospira interrogans serovar lai str. 56601
aaauggagaacuuuaca

SEQ ID NO: 2764090 - RNA, 16 nt, Leptospira interrogans serovar lai str. 56601
aaauggauaaauuuua

SEQ ID NO: 2764091 - RNA, 19 nt, Leptospira interrogans serovar lai str. 56601
aaauggauggaaaaugaau

SEQ ID NO: 2764092 - RNA, 22 nt, Leptospira interrogans serovar lai str. 56601
aaauggccucuugcuaauuucc

SEQ ID NO: 2764093 - RNA, 18 nt, Leptospira interrogans serovar lai str. 56601
aaaugggaugauagauua

SEQ ID NO: 2764094 - RNA, 17 nt, Leptospira interrogans serovar lai str. 56601
aaauggguuuucauuuu

SEQ ID NO: 2764095 - RNA, 22 nt, Leptospira interrogans serovar lai str. 56601
aaauguaaaaacuaccacaaau

SEQ ID NO: 2764096 - RNA, 19 nt, Leptospira interrogans serovar lai str. 56601
aaauguaaucucgauuucu

SEQ ID NO: 2764097 - RNA, 22 nt, Leptospira interrogans serovar lai str. 56601
aaauguaaucucgauuucuaaa

SEQ ID NO: 2764098 - RNA, 15 nt, Leptospira interrogans serovar lai str. 56601
aaauguaggaacuac

SEQ ID NO: 2764099 - RNA, 14 nt, Leptospira interrogans serovar lai str. 56601
aaauguaggaacuc

SEQ ID NO: 2764100 - RNA, 21 nt, Leptospira interrogans serovar lai str. 56601
aaauguaguaacuacuauguu

SEQ ID NO: 2764101 - RNA, 17 nt, Leptospira interrogans serovar lai str. 56601
aaauguaguaguuucca

SEQ ID NO: 2764102 - RNA, 21 nt, Leptospira interrogans serovar lai str. 56601
aaauguauccaauccaaaauu

SEQ ID NO: 2764103 - RNA, 23 nt, Leptospira interrogans serovar lai str. 56601
aaaugucauuugugcuauauuca

SEQ ID NO: 2764104 - RNA, 16 nt, Leptospira interrogans serovar lai str. 56601
aaaugucuaugauuaa

SEQ ID NO: 2764105 - RNA, 17 nt, Leptospira interrogans serovar lai str. 56601
aaaugugagaguuccca

SEQ ID NO: 2764106 - RNA, 19 nt, Leptospira interrogans serovar lai str. 56601
aaaugugagaguucccacg

SEQ ID NO: 2764107 - RNA, 15 nt, Leptospira interrogans serovar lai str. 56601
aaaugugggaacuac

SEQ ID NO: 2764108 - RNA, 19 nt, Leptospira interrogans serovar lai str. 56601
aaaugugggaacuacuaca

SEQ ID NO: 2764109 - RNA, 23 nt, Leptospira interrogans serovar lai str. 56601
aaaugugggaacuacuacaauua

SEQ ID NO: 2764110 - RNA, 14 nt, Leptospira interrogans serovar lai str. 56601
aaaugugggaacuc

SEQ ID NO: 2764111 - RNA, 21 nt, Leptospira interrogans serovar lai str. 56601
aaaugugggaacucucacaaa

SEQ ID NO: 2764112 - RNA, 16 nt, Leptospira interrogans serovar lai str. 56601
aaauguuaaaaaacua

SEQ ID NO: 2764113 - RNA, 19 nt, Leptospira interrogans serovar lai str. 56601
aaauguuaaaaaacuauaa

SEQ ID NO: 2764114 - RNA, 22 nt, Leptospira interrogans serovar lai str. 56601
aaauguuaaaaaacuauaaauc

SEQ ID NO: 2764115 - RNA, 15 nt, Leptospira interrogans serovar lai str. 56601
aaauguuccaaagcc

SEQ ID NO: 2764116 - RNA, 13 nt, Leptospira interrogans serovar lai str. 56601
aaauguuuaaaga

SEQ ID NO: 2764117 - RNA, 18 nt, Leptospira interrogans serovar lai str. 56601
aaauguuuaaagaauuuu

SEQ ID NO: 2764118 - RNA, 15 nt, Leptospira interrogans serovar lai str. 56601
aaauuaaaaaaaaau

SEQ ID NO: 2764119 - RNA, 12 nt, Leptospira interrogans serovar lai str. 56601
aaauuaaaaaau

SEQ ID NO: 2764120 - RNA, 20 nt, Leptospira interrogans serovar lai str. 56601
aaauuaaacccauuuuagaa

SEQ ID NO: 2764121 - RNA, 15 nt, Leptospira interrogans serovar lai str. 56601
aaauuaaaguaucca

SEQ ID NO: 2764122 - RNA, 17 nt, Leptospira interrogans serovar lai str. 56601
aaauuaaaguauccauu

SEQ ID NO: 2764123 - RNA, 18 nt, Leptospira interrogans serovar lai str. 56601
aaauuaaaguauccauuc

SEQ ID NO: 2764124 - RNA, 22 nt, Leptospira interrogans serovar lai str. 56601
aaauuaacuacccuuaagauag

SEQ ID NO: 2764125 - RNA, 23 nt, Leptospira interrogans serovar lai str. 56601
aaauuaacuuucuucgauuucuu

SEQ ID NO: 2764126 - RNA, 16 nt, Leptospira interrogans serovar lai str. 56601
aaauuaagcauuauaa

SEQ ID NO: 2764127 - RNA, 15 nt, Leptospira interrogans serovar lai str. 56601
aaauuaaguuuaaaa

SEQ ID NO: 2764128 - RNA, 14 nt, Leptospira interrogans serovar lai str. 56601
aaauuaaguuuauu

SEQ ID NO: 2764129 - RNA, 16 nt, Leptospira interrogans serovar lai str. 56601
aaauuaauauuuauaa

SEQ ID NO: 2764130 - RNA, 22 nt, Leptospira interrogans serovar lai str. 56601
aaauuaauauuuauaaaacaau

SEQ ID NO: 2764131 - RNA, 17 nt, Leptospira interrogans serovar lai str. 56601
aaauuaaucuguaaagu

SEQ ID NO: 2764132 - RNA, 17 nt, Leptospira interrogans serovar lai str. 56601
aaauuaauuacuuagau

SEQ ID NO: 2764133 - RNA, 16 nt, Leptospira interrogans serovar lai str. 56601
aaauuaauucuccauc

SEQ ID NO: 2764134 - RNA, 14 nt, Leptospira interrogans serovar lai str. 56601
aaauuaauuuuaua

SEQ ID NO: 2764135 - RNA, 14 nt, Leptospira interrogans serovar lai str. 56601
aaauuaccgcuaga

SEQ ID NO: 2764136 - RNA, 17 nt, Leptospira interrogans serovar lai str. 56601
aaauuaccuuucauuuu

SEQ ID NO: 2764137 - RNA, 17 nt, Leptospira interrogans serovar lai str. 56601
aaauuacgcugauuaga

SEQ ID NO: 2764138 - RNA, 18 nt, Leptospira interrogans serovar lai str. 56601
aaauuacugauuucaaaa

SEQ ID NO: 2764139 - RNA, 18 nt, Leptospira interrogans serovar lai str. 56601
aaauuacuucaauugucc

SEQ ID NO: 2764140 - RNA, 13 nt, Leptospira interrogans serovar lai str. 56601
aaauuagaaaauu

SEQ ID NO: 2764141 - RNA, 13 nt, Leptospira interrogans serovar lai str. 56601
aaauuagaaagaa

SEQ ID NO: 2764142 - RNA, 20 nt, Leptospira interrogans serovar lai str. 56601
aaauuagaaaugauuuuuua

SEQ ID NO: 2764143 - RNA, 14 nt, Leptospira interrogans serovar lai str. 56601
aaauuagaauuuua

SEQ ID NO: 2764144 - RNA, 21 nt, Leptospira interrogans serovar lai str. 56601
aaauuagagaaguuaaaaaau

SEQ ID NO: 2764145 - RNA, 14 nt, Leptospira interrogans serovar lai str. 56601
aaauuagauuuauu

SEQ ID NO: 2764146 - RNA, 22 nt, Leptospira interrogans serovar lai str. 56601
aaauuagauuuauugaaaaaua

SEQ ID NO: 2764147 - RNA, 19 nt, Leptospira interrogans serovar lai str. 56601
aaauuagcuuaagaauuuc

SEQ ID NO: 2764148 - RNA, 16 nt, Leptospira interrogans serovar lai str. 56601
aaauuaguucuucaaa

SEQ ID NO: 2764149 - RNA, 17 nt, Leptospira interrogans serovar lai str. 56601
aaauuauaaguagaaau

SEQ ID NO: 2764150 - RNA, 23 nt, Leptospira interrogans serovar lai str. 56601
aaauuauacaaaacucuuuaaaa

SEQ ID NO: 2764151 - RNA, 18 nt, Leptospira interrogans serovar lai str. 56601
aaauuauacaauuuaaua

SEQ ID NO: 2764152 - RNA, 17 nt, Leptospira interrogans serovar lai str. 56601
aaauuauagauaauuuu

SEQ ID NO: 2764153 - RNA, 14 nt, Leptospira interrogans serovar lai str. 56601
aaauuauauuuuga

SEQ ID NO: 2764154 - RNA, 13 nt, Leptospira interrogans serovar lai str. 56601
aaauuauuuugaa

SEQ ID NO: 2764155 - RNA, 14 nt, Leptospira interrogans serovar lai str. 56601
aaauucaaaauaag

SEQ ID NO: 2764156 - RNA, 12 nt, Leptospira interrogans serovar lai str. 56601
aaauucaaaauu

SEQ ID NO: 2764157 - RNA, 13 nt, Leptospira interrogans serovar lai str. 56601
aaauucaaaauug

SEQ ID NO: 2764158 - RNA, 22 nt, Leptospira interrogans serovar lai str. 56601
aaauucaaaggccgcuucuuua

SEQ ID NO: 2764159 - RNA, 18 nt, Leptospira interrogans serovar lai str. 56601
aaauucaaauucuuuuug

SEQ ID NO: 2764160 - RNA, 17 nt, Leptospira interrogans serovar lai str. 56601
aaauucaccuuccaaag

SEQ ID NO: 2764161 - RNA, 17 nt, Leptospira interrogans serovar lai str. 56601
aaauucacguucaacaa

SEQ ID NO: 2764162 - RNA, 21 nt, Leptospira interrogans serovar lai str. 56601
aaauucacuguuaaaagauuu

SEQ ID NO: 2764163 - RNA, 13 nt, Leptospira interrogans serovar lai str. 56601
aaauucagauuuc

SEQ ID NO: 2764164 - RNA, 11 nt, Leptospira interrogans serovar lai str. 56601
aaauucaguuc

SEQ ID NO: 2764165 - RNA, 15 nt, Leptospira interrogans serovar lai str. 56601
aaauucaguuucaaa

SEQ ID NO: 2764166 - RNA, 13 nt, Leptospira interrogans serovar lai str. 56601
aaauucauaauaa

SEQ ID NO: 2764167 - RNA, 23 nt, Leptospira interrogans serovar lai str. 56601
aaauuuacacgauaauuuucuuu

SEQ ID NO: 2764168 - RNA, 14 nt, Leptospira interrogans serovar lai str. 56601
aaauuuacagauac

SEQ ID NO: 2764169 - RNA, 15 nt, Leptospira interrogans serovar lai str. 56601
aaauuuacuauuuug

SEQ ID NO: 2764170 - RNA, 21 nt, Leptospira interrogans serovar lai str. 56601
aaauuuacucuuauaaaauuu

SEQ ID NO: 2764171 - RNA, 17 nt, Leptospira interrogans serovar lai str. 56601
aaauuuagaauuguuau

SEQ ID NO: 2764172 - RNA, 23 nt, Leptospira interrogans serovar lai str. 56601
aaauuuaguaguaaauaaaaaac

SEQ ID NO: 2764173 - RNA, 16 nt, Leptospira interrogans serovar lai str. 56601
aaauuuauaguuuuua

SEQ ID NO: 2764174 - RNA, 14 nt, Leptospira interrogans serovar lai str. 56601
aaauuuauuuuaaa

SEQ ID NO: 2764175 - RNA, 12 nt, Leptospira interrogans serovar lai str. 56601
aaauuuccggaa

SEQ ID NO: 2764176 - RNA, 14 nt, Leptospira interrogans serovar lai str. 56601
aaauuuccggaaaa

SEQ ID NO: 2764177 - RNA, 22 nt, Leptospira interrogans serovar lai str. 56601
aaauuuccggaaaacgaauauc

SEQ ID NO: 2764178 - RNA, 17 nt, Leptospira interrogans serovar lai str. 56601
aaauuucuaauaaaaua

SEQ ID NO: 2764179 - RNA, 18 nt, Leptospira interrogans serovar lai str. 56601
aaauuucuaauaaaauau

SEQ ID NO: 2764180 - RNA, 15 nt, Leptospira interrogans serovar lai str. 56601
aaauuucugcaugaa

SEQ ID NO: 2764181 - RNA, 21 nt, Leptospira interrogans serovar lai str. 56601
aaauuucugcaugaaauugau

SEQ ID NO: 2764182 - RNA, 14 nt, Leptospira interrogans serovar lai str. 56601
aaauuucuuaaaag

SEQ ID NO: 2764183 - RNA, 16 nt, Leptospira interrogans serovar lai str. 56601
aaauuucuuaaaagau

SEQ ID NO: 2764184 - RNA, 20 nt, Leptospira interrogans serovar lai str. 56601
aaauuucuuugucuuuaugc

SEQ ID NO: 2764185 - RNA, 16 nt, Leptospira interrogans serovar lai str. 56601
aaauuucuuuuuugua

SEQ ID NO: 2764186 - RNA, 16 nt, Leptospira interrogans serovar lai str. 56601
aaauuugcgaaaaaaa

SEQ ID NO: 2764187 - RNA, 17 nt, Leptospira interrogans serovar lai str. 56601
aaauuugcgaaaaaaau

SEQ ID NO: 2764188 - RNA, 19 nt, Leptospira interrogans serovar lai str. 56601
aaauuugcgaaaaaaauaa

SEQ ID NO: 2764189 - RNA, 18 nt, Leptospira interrogans serovar lai str. 56601
aaauuugcgauauucuau

SEQ ID NO: 2764190 - RNA, 14 nt, Leptospira interrogans serovar lai str. 56601
aaauuugcguaaua

SEQ ID NO: 2764191 - RNA, 15 nt, Leptospira interrogans serovar lai str. 56601
aaauuuggaaauugu

SEQ ID NO: 2764192 - RNA, 13 nt, Leptospira interrogans serovar lai str. 56601
aaauuuuaaguuc

SEQ ID NO: 2764193 - RNA, 23 nt, Leptospira interrogans serovar lai str. 56601
aaauuuuaauauuauuaaauuuu

SEQ ID NO: 2764194 - RNA, 17 nt, Leptospira interrogans serovar lai str. 56601
aaauuuuauaauuaauc

SEQ ID NO: 2764195 - RNA, 15 nt, Leptospira interrogans serovar lai str. 56601
aaauuuuauaguaga

SEQ ID NO: 2764196 - RNA, 20 nt, Leptospira interrogans serovar lai str. 56601
aaauuuucagugaauaaaau

SEQ ID NO: 2764197 - RNA, 18 nt, Leptospira interrogans serovar lai str. 56601
aaauuuucaucuuuucca

SEQ ID NO: 2764198 - RNA, 16 nt, Leptospira interrogans serovar lai str. 56601
aaauuuucauuuuaua

SEQ ID NO: 2764199 - RNA, 23 nt, Leptospira interrogans serovar lai str. 56601
aaauuuuccguuaauaaaucaau

SEQ ID NO: 2764200 - RNA, 12 nt, Leptospira interrogans serovar lai str. 56601
aaauuuuccuuu

SEQ ID NO: 2764201 - RNA, 13 nt, Leptospira interrogans serovar lai str. 56601
aaauuuuccuuua

SEQ ID NO: 2764202 - RNA, 13 nt, Leptospira interrogans serovar lai str. 56601
aaauuuucguuuu

SEQ ID NO: 2764203 - RNA, 12 nt, Leptospira interrogans serovar lai str. 56601
aaauuuucuaaa

SEQ ID NO: 2764204 - RNA, 15 nt, Leptospira interrogans serovar lai str. 56601
aaauuuucuguuuau

SEQ ID NO: 2764205 - RNA, 21 nt, Leptospira interrogans serovar lai str. 56601
aaauuuucuguuuauuuugaa

SEQ ID NO: 2764206 - RNA, 20 nt, Leptospira interrogans serovar lai str. 56601
aaauuuucuuagaaaacuug

SEQ ID NO: 2764207 - RNA, 16 nt, Leptospira interrogans serovar lai str. 56601
aaauuuugaaacaaau

SEQ ID NO: 2764208 - RNA, 12 nt, Leptospira interrogans serovar lai str. 56601
aaauuuugaagg

SEQ ID NO: 2764209 - RNA, 22 nt, Leptospira interrogans serovar lai str. 56601
aaauuuugaaggaaauuuuguu

SEQ ID NO: 2764210 - RNA, 12 nt, Leptospira interrogans serovar lai str. 56601
aaauuuuuaaaa

SEQ ID NO: 2764211 - RNA, 24 nt, Leptospira interrogans serovar lai str. 56601
aaauuuuuaauaaaaugcaguagu

SEQ ID NO: 2764212 - RNA, 16 nt, Leptospira interrogans serovar lai str. 56601
aaauuuuuaauauacu

SEQ ID NO: 2764213 - RNA, 14 nt, Leptospira interrogans serovar lai str. 56601
aaauuuuuaaucaa

SEQ ID NO: 2764214 - RNA, 18 nt, Leptospira interrogans serovar lai str. 56601
aaauuuuuaaucaaaugc

SEQ ID NO: 2764215 - RNA, 20 nt, Leptospira interrogans serovar lai str. 56601
aaauuuuuacgcguaauuuu

SEQ ID NO: 2764216 - RNA, 20 nt, Leptospira interrogans serovar lai str. 56601
aaauuuuuauaaaauaccaa

SEQ ID NO: 2764217 - RNA, 23 nt, Leptospira interrogans serovar lai str. 56601
aaauuuuuauaaaauaccaauaa

SEQ ID NO: 2764218 - RNA, 12 nt, Leptospira interrogans serovar lai str. 56601
aaauuuuuauac

SEQ ID NO: 2764219 - RNA, 19 nt, Leptospira interrogans serovar lai str. 56601
aaauuuuuaucauaaaaca

SEQ ID NO: 2764220 - RNA, 21 nt, Leptospira interrogans serovar lai str. 56601
aaauuuuuaucauaaaacacu

SEQ ID NO: 2764221 - RNA, 19 nt, Leptospira interrogans serovar lai str. 56601
aaauuuuugacuaccuuua

SEQ ID NO: 2764222 - RNA, 10 nt, Leptospira interrogans serovar lai str. 56601
aaauuuuugu

SEQ ID NO: 2764223 - RNA, 23 nt, Leptospira interrogans serovar lai str. 56601
aaauuuuuuagaguuaagagaau

SEQ ID NO: 2764224 - RNA, 15 nt, Leptospira interrogans serovar lai str. 56601
aaauuuuuuccuuua

SEQ ID NO: 2764225 - RNA, 19 nt, Leptospira interrogans serovar lai str. 56601
aaauuuuuugcaaaaaaau

SEQ ID NO: 2764226 - RNA, 19 nt, Leptospira interrogans serovar lai str. 56601
aaauuuuuuggaaaucgaa

SEQ ID NO: 2764227 - RNA, 22 nt, Leptospira interrogans serovar lai str. 56601
aaauuuuuuucuaaaauauagg

SEQ ID NO: 2764228 - RNA, 16 nt, Leptospira interrogans serovar lai str. 56601
aaauuuuuuuguaauc

SEQ ID NO: 2764229 - RNA, 12 nt, Leptospira interrogans serovar lai str. 56601
aacaaaaaaugc

SEQ ID NO: 2764230 - RNA, 20 nt, Leptospira interrogans serovar lai str. 56601
aacaaaaaguguuuauaauu

SEQ ID NO: 2764231 - RNA, 13 nt, Leptospira interrogans serovar lai str. 56601
aacaaaaaucaac

SEQ ID NO: 2764232 - RNA, 18 nt, Leptospira interrogans serovar lai str. 56601
aacaaacaaauagaaaua

SEQ ID NO: 2764233 - RNA, 19 nt, Leptospira interrogans serovar lai str. 56601
aacaaacacgggaauaaaa

SEQ ID NO: 2764234 - RNA, 14 nt, Leptospira interrogans serovar lai str. 56601
aacaaacaugcaau

SEQ ID NO: 2764235 - RNA, 15 nt, Leptospira interrogans serovar lai str. 56601
aacaaacucuugaac

SEQ ID NO: 2764236 - RNA, 19 nt, Leptospira interrogans serovar lai str. 56601
aacaaacuuuuaucgaaug

SEQ ID NO: 2764237 - RNA, 15 nt, Leptospira interrogans serovar lai str. 56601
aacaaagaauaccaa

SEQ ID NO: 2764238 - RNA, 22 nt, Leptospira interrogans serovar lai str. 56601
aacaaagccgcacaaaccaaaa

SEQ ID NO: 2764239 - RNA, 17 nt, Leptospira interrogans serovar lai str. 56601
aacaaauggagaauuaa

SEQ ID NO: 2764240 - RNA, 23 nt, Leptospira interrogans serovar lai str. 56601
aacaaauucuaaaauuguaggaa

SEQ ID NO: 2764241 - RNA, 13 nt, Leptospira interrogans serovar lai str. 56601
aacaaauugaaau

SEQ ID NO: 2764242 - RNA, 15 nt, Leptospira interrogans serovar lai str. 56601
aacaaauuuaaaaua

SEQ ID NO: 2764243 - RNA, 14 nt, Leptospira interrogans serovar lai str. 56601
aacaacaaaaaaua

SEQ ID NO: 2764244 - RNA, 19 nt, Leptospira interrogans serovar lai str. 56601
aacaacaccaccaacagca

SEQ ID NO: 2764245 - RNA, 17 nt, Leptospira interrogans serovar lai str. 56601
aacaacaguacaagaau

SEQ ID NO: 2764246 - RNA, 22 nt, Leptospira interrogans serovar lai str. 56601
aacaacaguacaagaaucaaaa

SEQ ID NO: 2764247 - RNA, 13 nt, Leptospira interrogans serovar lai str. 56601
aacaacauuagaa

SEQ ID NO: 2764248 - RNA, 15 nt, Leptospira interrogans serovar lai str. 56601
aacaacauugaguuu

SEQ ID NO: 2764249 - RNA, 24 nt, Leptospira interrogans serovar lai str. 56601
aacaaccaccuuuacauaauaaua

SEQ ID NO: 2764250 - RNA, 15 nt, Leptospira interrogans serovar lai str. 56601
aacauuuuuaaaaau

SEQ ID NO: 2764251 - RNA, 19 nt, Leptospira interrogans serovar lai str. 56601
aacauuuuuaaaaauuaga

SEQ ID NO: 2764252 - RNA, 14 nt, Leptospira interrogans serovar lai str. 56601
aacauuuuuucaua

SEQ ID NO: 2764253 - RNA, 13 nt, Leptospira interrogans serovar lai str. 56601
aaccaaaaauuca

SEQ ID NO: 2764254 - RNA, 10 nt, Leptospira interrogans serovar lai str. 56601
aaccaaaaug

SEQ ID NO: 2764255 - RNA, 18 nt, Leptospira interrogans serovar lai str. 56601
aaccaaccucucacuucu

SEQ ID NO: 2764256 - RNA, 22 nt, Leptospira interrogans serovar lai str. 56601
aaccaaccucucacuucuugaa

SEQ ID NO: 2764257 - RNA, 23 nt, Leptospira interrogans serovar lai str. 56601
aaccaaucgauaacuugauuuua

SEQ ID NO: 2764258 - RNA, 17 nt, Leptospira interrogans serovar lai str. 56601
aaccaauucuaaaauca

SEQ ID NO: 2764259 - RNA, 20 nt, Leptospira interrogans serovar lai str. 56601
aaccaauucuaaaaucauac

SEQ ID NO: 2764260 - RNA, 13 nt, Leptospira interrogans serovar lai str. 56601
aaccaauuuuuca

SEQ ID NO: 2764261 - RNA, 14 nt, Leptospira interrogans serovar lai str. 56601
aaccaauuuuucaa

SEQ ID NO: 2764262 - RNA, 17 nt, Leptospira interrogans serovar lai str. 56601
aaccacaaaaacaaauu

SEQ ID NO: 2764263 - RNA, 19 nt, Leptospira interrogans serovar lai str. 56601
aaccacaaaaacaaauuca

SEQ ID NO: 2764264 - RNA, 24 nt, Leptospira interrogans serovar lai str. 56601
aaccacaagacaaacaaacaugca

SEQ ID NO: 2764265 - RNA, 22 nt, Leptospira interrogans serovar lai str. 56601
aaccaccucuauggaauuuuuu

SEQ ID NO: 2764266 - RNA, 15 nt, Leptospira interrogans serovar lai str. 56601
aaccaccuuuacaua

SEQ ID NO: 2764267 - RNA, 17 nt, Leptospira interrogans serovar lai str. 56601
aaccauaaaauaaaaaa

SEQ ID NO: 2764268 - RNA, 22 nt, Leptospira interrogans serovar lai str. 56601
aaccauccgcgguuaugauaua

SEQ ID NO: 2764269 - RNA, 16 nt, Leptospira interrogans serovar lai str. 56601
aaccaucucaaaaaca

SEQ ID NO: 2764270 - RNA, 17 nt, Leptospira interrogans serovar lai str. 56601
aaccaucucaaaaacac

SEQ ID NO: 2764271 - RNA, 18 nt, Leptospira interrogans serovar lai str. 56601
aaccaucucaaaaacacu

SEQ ID NO: 2764272 - RNA, 21 nt, Leptospira interrogans serovar lai str. 56601
aaccaucucaaaaauaucuua

SEQ ID NO: 2764273 - RNA, 16 nt, Leptospira interrogans serovar lai str. 56601
aaccaugauucugaaa

SEQ ID NO: 2764274 - RNA, 20 nt, Leptospira interrogans serovar lai str. 56601
aaccaugauucugaaaaaag

SEQ ID NO: 2764275 - RNA, 12 nt, Leptospira interrogans serovar lai str. 56601
aaccauuuuguu

SEQ ID NO: 2764276 - RNA, 21 nt, Leptospira interrogans serovar lai str. 56601
aacccaacuuucgcauuuguu

SEQ ID NO: 2764277 - RNA, 19 nt, Leptospira interrogans serovar lai str. 56601
aacccauacaaaauuuaaa

SEQ ID NO: 2764278 - RNA, 12 nt, Leptospira interrogans serovar lai str. 56601
aaccccauuaaa

SEQ ID NO: 2764279 - RNA, 19 nt, Leptospira interrogans serovar lai str. 56601
aaccccauuaaaaagcuca

SEQ ID NO: 2764280 - RNA, 15 nt, Leptospira interrogans serovar lai str. 56601
aacccucaucaguca

SEQ ID NO: 2764281 - RNA, 18 nt, Leptospira interrogans serovar lai str. 56601
aacccugccaaaauccca

SEQ ID NO: 2764282 - RNA, 23 nt, Leptospira interrogans serovar lai str. 56601
aaccgaaauagaaauacauaaau

SEQ ID NO: 2764283 - RNA, 14 nt, Leptospira interrogans serovar lai str. 56601
aaccgacuugagau

SEQ ID NO: 2764284 - RNA, 17 nt, Leptospira interrogans serovar lai str. 56601
aaccgaucuuaaaaacu

SEQ ID NO: 2764285 - RNA, 21 nt, Leptospira interrogans serovar lai str. 56601
aaccgauuucaauuuucucaa

SEQ ID NO: 2764286 - RNA, 18 nt, Leptospira interrogans serovar lai str. 56601
aaccgcuuuuaguuuuuc

SEQ ID NO: 2764287 - RNA, 17 nt, Leptospira interrogans serovar lai str. 56601
aaccgguaaaaaguaaa

SEQ ID NO: 2764288 - RNA, 22 nt, Leptospira interrogans serovar lai str. 56601
aaccguccaaugugggaacuac

SEQ ID NO: 2764289 - RNA, 16 nt, Leptospira interrogans serovar lai str. 56601
aaccgucccaaaaucu

SEQ ID NO: 2764290 - RNA, 13 nt, Leptospira interrogans serovar lai str. 56601
aaccuauaucuua

SEQ ID NO: 2764291 - RNA, 14 nt, Leptospira interrogans serovar lai str. 56601
aaccucaaaaaauu

SEQ ID NO: 2764292 - RNA, 16 nt, Leptospira interrogans serovar lai str. 56601
aaccucaaaaaauuua

SEQ ID NO: 2764293 - RNA, 16 nt, Leptospira interrogans serovar lai str. 56601
aaccucaaaaaauuuu

SEQ ID NO: 2764294 - RNA, 16 nt, Leptospira interrogans serovar lai str. 56601
aaccucaaagaaauuu

SEQ ID NO: 2764295 - RNA, 21 nt, Leptospira interrogans serovar lai str. 56601
aaccuccguucccacugauca

SEQ ID NO: 2764296 - RNA, 11 nt, Leptospira interrogans serovar lai str. 56601
aaccucucacu

SEQ ID NO: 2764297 - RNA, 19 nt, Leptospira interrogans serovar lai str. 56601
aaccucuguaaauacaaaa

SEQ ID NO: 2764298 - RNA, 13 nt, Leptospira interrogans serovar lai str. 56601
aaccucuucugau

SEQ ID NO: 2764299 - RNA, 23 nt, Leptospira interrogans serovar lai str. 56601
aaccugaguucgacguaaguaau

SEQ ID NO: 2764300 - RNA, 22 nt, Leptospira interrogans serovar lai str. 56601
aaccugauuuuucuguaaaaau

SEQ ID NO: 2764301 - RNA, 23 nt, Leptospira interrogans serovar lai str. 56601
aaccugauuuuucuguaaaaaua

SEQ ID NO: 2764302 - RNA, 18 nt, Leptospira interrogans serovar lai str. 56601
aaccugcuccauaaaagu

SEQ ID NO: 2764303 - RNA, 15 nt, Leptospira interrogans serovar lai str. 56601
aaccuuacccacaaa

SEQ ID NO: 2764304 - RNA, 21 nt, Leptospira interrogans serovar lai str. 56601
aaccuucggguuccguagaac

SEQ ID NO: 2764305 - RNA, 15 nt, Leptospira interrogans serovar lai str. 56601
aaccuuuaguuucca

SEQ ID NO: 2764306 - RNA, 17 nt, Leptospira interrogans serovar lai str. 56601
aaccuuuguuuccucuu

SEQ ID NO: 2764307 - RNA, 21 nt, Leptospira interrogans serovar lai str. 56601
aaccuuuguuuccucuugaag

SEQ ID NO: 2764308 - RNA, 20 nt, Leptospira interrogans serovar lai str. 56601
aacgaaagaagacuauaaac

SEQ ID NO: 2764309 - RNA, 15 nt, Leptospira interrogans serovar lai str. 56601
aacgaagaacggaga

SEQ ID NO: 2764310 - RNA, 16 nt, Leptospira interrogans serovar lai str. 56601
aacgaaucauauuuaa

SEQ ID NO: 2764311 - RNA, 20 nt, Leptospira interrogans serovar lai str. 56601
aacgaauugcacauaaaaga

SEQ ID NO: 2764312 - RNA, 17 nt, Leptospira interrogans serovar lai str. 56601
aacgacauuagaacuac

SEQ ID NO: 2764313 - RNA, 23 nt, Leptospira interrogans serovar lai str. 56601
aacgaccccgucauuuacucaaa

SEQ ID NO: 2764314 - RNA, 17 nt, Leptospira interrogans serovar lai str. 56601
aacgagacgcugaauua

SEQ ID NO: 2764315 - RNA, 21 nt, Leptospira interrogans serovar lai str. 56601
aacgagacguugaguuauaca

SEQ ID NO: 2764316 - RNA, 14 nt, Leptospira interrogans serovar lai str. 56601
aacgagcaucuuua

SEQ ID NO: 2764317 - RNA, 23 nt, Leptospira interrogans serovar lai str. 56601
aacgaguuuuuguuaucaacuuu

SEQ ID NO: 2764318 - RNA, 19 nt, Leptospira interrogans serovar lai str. 56601
aacgauacuuaaaaauacc

SEQ ID NO: 2764319 - RNA, 17 nt, Leptospira interrogans serovar lai str. 56601
aacgauaucgauagcca

SEQ ID NO: 2764320 - RNA, 15 nt, Leptospira interrogans serovar lai str. 56601
aacgaucagaaaaac

SEQ ID NO: 2764321 - RNA, 16 nt, Leptospira interrogans serovar lai str. 56601
aacgaucagaaaaaca

SEQ ID NO: 2764322 - RNA, 19 nt, Leptospira interrogans serovar lai str. 56601
aacgaugagccaucuuuuu

SEQ ID NO: 2764323 - RNA, 18 nt, Leptospira interrogans serovar lai str. 56601
aacgauuccauuuuuuag

SEQ ID NO: 2764324 - RNA, 13 nt, Leptospira interrogans serovar lai str. 56601
aacgauuguaaaa

SEQ ID NO: 2764325 - RNA, 17 nt, Leptospira interrogans serovar lai str. 56601
aacgauuucuauuuuuc

SEQ ID NO: 2764326 - RNA, 18 nt, Leptospira interrogans serovar lai str. 56601
aacgauuucuguagaaau

SEQ ID NO: 2764327 - RNA, 11 nt, Leptospira interrogans serovar lai str. 56601
aacgcaaaaag

SEQ ID NO: 2764328 - RNA, 13 nt, Leptospira interrogans serovar lai str. 56601
aacgcaaaauacu

SEQ ID NO: 2764329 - RNA, 23 nt, Leptospira interrogans serovar lai str. 56601
aacgcaaguuccgcgauugaaaa

SEQ ID NO: 2764330 - RNA, 14 nt, Leptospira interrogans serovar lai str. 56601
aacgcaugaaaaua

SEQ ID NO: 2764331 - RNA, 15 nt, Leptospira interrogans serovar lai str. 56601
aacgcgaaguauucu

SEQ ID NO: 2764332 - RNA, 19 nt, Leptospira interrogans serovar lai str. 56601
aacgcgacccauaggaaag

SEQ ID NO: 2764333 - RNA, 14 nt, Leptospira interrogans serovar lai str. 56601
aacuauuuuuugua

SEQ ID NO: 2764334 - RNA, 15 nt, Leptospira interrogans serovar lai str. 56601
aacuauuuuuuguau

SEQ ID NO: 2764335 - RNA, 18 nt, Leptospira interrogans serovar lai str. 56601
aacucaaaaaauuuuuac

SEQ ID NO: 2764336 - RNA, 24 nt, Leptospira interrogans serovar lai str. 56601
aacucaaagaaauuuuacacguaa

SEQ ID NO: 2764337 - RNA, 14 nt, Leptospira interrogans serovar lai str. 56601
aacucaaaggaaaa

SEQ ID NO: 2764338 - RNA, 13 nt, Leptospira interrogans serovar lai str. 56601
aacucaacagaac

SEQ ID NO: 2764339 - RNA, 24 nt, Leptospira interrogans serovar lai str. 56601
aacucaacagaacgggcuuucuau

SEQ ID NO: 2764340 - RNA, 21 nt, Leptospira interrogans serovar lai str. 56601
aacucaauguaucgcuucuau

SEQ ID NO: 2764341 - RNA, 15 nt, Leptospira interrogans serovar lai str. 56601
aacucaauguguugu

SEQ ID NO: 2764342 - RNA, 17 nt, Leptospira interrogans serovar lai str. 56601
aacucaauguugcuccu

SEQ ID NO: 2764343 - RNA, 16 nt, Leptospira interrogans serovar lai str. 56601
aacucacacaaaauua

SEQ ID NO: 2764344 - RNA, 17 nt, Leptospira interrogans serovar lai str. 56601
aacucacguuaaaagua

SEQ ID NO: 2764345 - RNA, 22 nt, Leptospira interrogans serovar lai str. 56601
aacucacguuaaauagaaacca

SEQ ID NO: 2764346 - RNA, 15 nt, Leptospira interrogans serovar lai str. 56601
aacucacguuaagua

SEQ ID NO: 2764347 - RNA, 19 nt, Leptospira interrogans serovar lai str. 56601
aacucacguuauuuuaacu

SEQ ID NO: 2764348 - RNA, 21 nt, Leptospira interrogans serovar lai str. 56601
aacucacguuauuuuaacuug

SEQ ID NO: 2764349 - RNA, 20 nt, Leptospira interrogans serovar lai str. 56601
aacucacuucgacaacuuug

SEQ ID NO: 2764350 - RNA, 21 nt, Leptospira interrogans serovar lai str. 56601
aacucagcgaaaauacuucuc

SEQ ID NO: 2764351 - RNA, 12 nt, Leptospira interrogans serovar lai str. 56601
aacucaguaaaa

SEQ ID NO: 2764352 - RNA, 13 nt, Leptospira interrogans serovar lai str. 56601
aacucaguaaaac

SEQ ID NO: 2764353 - RNA, 17 nt, Leptospira interrogans serovar lai str. 56601
aacucaguaaaacgcuc

SEQ ID NO: 2764354 - RNA, 15 nt, Leptospira interrogans serovar lai str. 56601
aacucaguaaacuca

SEQ ID NO: 2764355 - RNA, 17 nt, Leptospira interrogans serovar lai str. 56601
aacucauauagaaauua

SEQ ID NO: 2764356 - RNA, 21 nt, Leptospira interrogans serovar lai str. 56601
aacucauauuuuuagaaaauu

SEQ ID NO: 2764357 - RNA, 22 nt, Leptospira interrogans serovar lai str. 56601
aacucauauuuuuagaaaauuu

SEQ ID NO: 2764358 - RNA, 23 nt, Leptospira interrogans serovar lai str. 56601
aacucaucuaaucgaaacuauaa

SEQ ID NO: 2764359 - RNA, 16 nt, Leptospira interrogans serovar lai str. 56601
aacucaugauucugaa

SEQ ID NO: 2764360 - RNA, 17 nt, Leptospira interrogans serovar lai str. 56601
aacucaugcaauuuuug

SEQ ID NO: 2764361 - RNA, 20 nt, Leptospira interrogans serovar lai str. 56601
aacuccagaauuagauuaaa

SEQ ID NO: 2764362 - RNA, 19 nt, Leptospira interrogans serovar lai str. 56601
aacucccacaauuuugaau

SEQ ID NO: 2764363 - RNA, 16 nt, Leptospira interrogans serovar lai str. 56601
aacucccugauaacuc

SEQ ID NO: 2764364 - RNA, 22 nt, Leptospira interrogans serovar lai str. 56601
aacuccuugguucaaaguuuuc

SEQ ID NO: 2764365 - RNA, 16 nt, Leptospira interrogans serovar lai str. 56601
aacucgguguaaaaaa

SEQ ID NO: 2764366 - RNA, 14 nt, Leptospira interrogans serovar lai str. 56601
aacucuaauacaaa

SEQ ID NO: 2764367 - RNA, 16 nt, Leptospira interrogans serovar lai str. 56601
aacucuaauauaaaaa

SEQ ID NO: 2764368 - RNA, 23 nt, Leptospira interrogans serovar lai str. 56601
aacucuaauauaaaaaccacaaa

SEQ ID NO: 2764369 - RNA, 16 nt, Leptospira interrogans serovar lai str. 56601
aacucuaauauaaaau

SEQ ID NO: 2764370 - RNA, 15 nt, Leptospira interrogans serovar lai str. 56601
aacucuaaugaauuu

SEQ ID NO: 2764371 - RNA, 19 nt, Leptospira interrogans serovar lai str. 56601
aacucuaaugaauuuacca

SEQ ID NO: 2764372 - RNA, 16 nt, Leptospira interrogans serovar lai str. 56601
aacucuaauguaggaa

SEQ ID NO: 2764373 - RNA, 15 nt, Leptospira interrogans serovar lai str. 56601
aacucuauauaaaga

SEQ ID NO: 2764374 - RNA, 19 nt, Leptospira interrogans serovar lai str. 56601
aacucuaucacgaaauuug

SEQ ID NO: 2764375 - RNA, 16 nt, Leptospira interrogans serovar lai str. 56601
aacucuauuaaagaag

SEQ ID NO: 2764376 - RNA, 19 nt, Leptospira interrogans serovar lai str. 56601
aacucuauucauaaaugau

SEQ ID NO: 2764377 - RNA, 14 nt, Leptospira interrogans serovar lai str. 56601
aacucucacaaauc

SEQ ID NO: 2764378 - RNA, 17 nt, Leptospira interrogans serovar lai str. 56601
aacucucacaaaucgug

SEQ ID NO: 2764379 - RNA, 18 nt, Leptospira interrogans serovar lai str. 56601
aacucuuaaauuucggac

SEQ ID NO: 2764380 - RNA, 13 nt, Leptospira interrogans serovar lai str. 56601
aacucuuacaauu

SEQ ID NO: 2764381 - RNA, 16 nt, Leptospira interrogans serovar lai str. 56601
aacucuuacauuuuga

SEQ ID NO: 2764382 - RNA, 19 nt, Leptospira interrogans serovar lai str. 56601
aacucuuacuuugagaaaa

SEQ ID NO: 2764383 - RNA, 22 nt, Leptospira interrogans serovar lai str. 56601
aacucuucuucuagauuuuaaa

SEQ ID NO: 2764384 - RNA, 16 nt, Leptospira interrogans serovar lai str. 56601
aacucuugaacagaaa

SEQ ID NO: 2764385 - RNA, 22 nt, Leptospira interrogans serovar lai str. 56601
aacucuugaacagaaagaucau

SEQ ID NO: 2764386 - RNA, 16 nt, Leptospira interrogans serovar lai str. 56601
aacucuuuauuuuuaa

SEQ ID NO: 2764387 - RNA, 20 nt, Leptospira interrogans serovar lai str. 56601
aacucuuuuaccuuaccacc

SEQ ID NO: 2764388 - RNA, 17 nt, Leptospira interrogans serovar lai str. 56601
aacugaaaaugaccaaa

SEQ ID NO: 2764389 - RNA, 22 nt, Leptospira interrogans serovar lai str. 56601
aacugacauuccagcuucuugc

SEQ ID NO: 2764390 - RNA, 14 nt, Leptospira interrogans serovar lai str. 56601
aacugagagaaagu

SEQ ID NO: 2764391 - RNA, 15 nt, Leptospira interrogans serovar lai str. 56601
aacugauuauaaaaa

SEQ ID NO: 2764392 - RNA, 17 nt, Leptospira interrogans serovar lai str. 56601
aacugcaguaguucccg

SEQ ID NO: 2764393 - RNA, 21 nt, Leptospira interrogans serovar lai str. 56601
aacugcucgaaaguucacaaa

SEQ ID NO: 2764394 - RNA, 16 nt, Leptospira interrogans serovar lai str. 56601
aacugcucgaaaguuu

SEQ ID NO: 2764395 - RNA, 16 nt, Leptospira interrogans serovar lai str. 56601
aacuggauucaaaauu

SEQ ID NO: 2764396 - RNA, 17 nt, Leptospira interrogans serovar lai str. 56601
aacuguaaacuugauua

SEQ ID NO: 2764397 - RNA, 16 nt, Leptospira interrogans serovar lai str. 56601
aacuguauuauaaaga

SEQ ID NO: 2764398 - RNA, 14 nt, Leptospira interrogans serovar lai str. 56601
aacuguugaaaaaa

SEQ ID NO: 2764399 - RNA, 15 nt, Leptospira interrogans serovar lai str. 56601
aacuguugaaaaaau

SEQ ID NO: 2764400 - RNA, 22 nt, Leptospira interrogans serovar lai str. 56601
aacuguugaaaaaauccauauc

SEQ ID NO: 2764401 - RNA, 18 nt, Leptospira interrogans serovar lai str. 56601
aacuguuuaauaaagauu

SEQ ID NO: 2764402 - RNA, 15 nt, Leptospira interrogans serovar lai str. 56601
aacuguuugauacuu

SEQ ID NO: 2764403 - RNA, 21 nt, Leptospira interrogans serovar lai str. 56601
aacuguuugauacuuucggac

SEQ ID NO: 2764404 - RNA, 19 nt, Leptospira interrogans serovar lai str. 56601
aacuuaaauucggaaauuu

SEQ ID NO: 2764405 - RNA, 14 nt, Leptospira interrogans serovar lai str. 56601
aacuuaauuuuaua

SEQ ID NO: 2764406 - RNA, 12 nt, Leptospira interrogans serovar lai str. 56601
aacuuacagauu

SEQ ID NO: 2764407 - RNA, 21 nt, Leptospira interrogans serovar lai str. 56601
aacuuacggcugaguuccaaa

SEQ ID NO: 2764408 - RNA, 16 nt, Leptospira interrogans serovar lai str. 56601
aacuuacguaaaacgg

SEQ ID NO: 2764409 - RNA, 20 nt, Leptospira interrogans serovar lai str. 56601
aacuuagaaucuaucucaaa

SEQ ID NO: 2764410 - RNA, 23 nt, Leptospira interrogans serovar lai str. 56601
aacuuaguucccgccucacaacg

SEQ ID NO: 2764411 - RNA, 15 nt, Leptospira interrogans serovar lai str. 56601
aacuuauaagacauu

SEQ ID NO: 2764412 - RNA, 22 nt, Leptospira interrogans serovar lai str. 56601
aacuuauacuuuauagaaaauu

SEQ ID NO: 2764413 - RNA, 23 nt, Leptospira interrogans serovar lai str. 56601
aacuuaugcuauuuaauuuugua

SEQ ID NO: 2764414 - RNA, 24 nt, Leptospira interrogans serovar lai str. 56601
aacuuaugcuauuuaauuuuguag

SEQ ID NO: 2764415 - RNA, 19 nt, Leptospira interrogans serovar lai str. 56601
aacuuauugaagauaaaaa

SEQ ID NO: 2764416 - RNA, 13 nt, Leptospira interrogans serovar lai str. 56601
aagaaaguauuaa

SEQ ID NO: 2764417 - RNA, 15 nt, Leptospira interrogans serovar lai str. 56601
aagaaaguauuaauu

SEQ ID NO: 2764418 - RNA, 16 nt, Leptospira interrogans serovar lai str. 56601
aagaaaguauuaauuu

SEQ ID NO: 2764419 - RNA, 12 nt, Leptospira interrogans serovar lai str. 56601
aagaaaguuuau

SEQ ID NO: 2764420 - RNA, 16 nt, Leptospira interrogans serovar lai str. 56601
aagaaauagaaaagca

SEQ ID NO: 2764421 - RNA, 13 nt, Leptospira interrogans serovar lai str. 56601
aagaaauauuaaa

SEQ ID NO: 2764422 - RNA, 14 nt, Leptospira interrogans serovar lai str. 56601
aagaaauauuaaaa

SEQ ID NO: 2764423 - RNA, 15 nt, Leptospira interrogans serovar lai str. 56601
aagaaauauuaaaaa

SEQ ID NO: 2764424 - RNA, 18 nt, Leptospira interrogans serovar lai str. 56601
aagaaauauuaaaaaaau

SEQ ID NO: 2764425 - RNA, 19 nt, Leptospira interrogans serovar lai str. 56601
aagaaauauuaaaaaaaua

SEQ ID NO: 2764426 - RNA, 16 nt, Leptospira interrogans serovar lai str. 56601
aagaaauuuaaguuuu

SEQ ID NO: 2764427 - RNA, 19 nt, Leptospira interrogans serovar lai str. 56601
aagaacaauuuaaaauaau

SEQ ID NO: 2764428 - RNA, 20 nt, Leptospira interrogans serovar lai str. 56601
aagaacaauuuaaaauaauu

SEQ ID NO: 2764429 - RNA, 22 nt, Leptospira interrogans serovar lai str. 56601
aagaaccucuucugauuguaac

SEQ ID NO: 2764430 - RNA, 14 nt, Leptospira interrogans serovar lai str. 56601
aagaacgaacuaau

SEQ ID NO: 2764431 - RNA, 17 nt, Leptospira interrogans serovar lai str. 56601
aagaacuucgaucauuu

SEQ ID NO: 2764432 - RNA, 14 nt, Leptospira interrogans serovar lai str. 56601
aagaagaaaagaau

SEQ ID NO: 2764433 - RNA, 18 nt, Leptospira interrogans serovar lai str. 56601
aagaagaggugaaauuuc

SEQ ID NO: 2764434 - RNA, 16 nt, Leptospira interrogans serovar lai str. 56601
aagaagagguucugag

SEQ ID NO: 2764435 - RNA, 15 nt, Leptospira interrogans serovar lai str. 56601
aagaagagucaaaca

SEQ ID NO: 2764436 - RNA, 12 nt, Leptospira interrogans serovar lai str. 56601
aagaagauaaaa

SEQ ID NO: 2764437 - RNA, 16 nt, Leptospira interrogans serovar lai str. 56601
aagaagaugcuuucuc

SEQ ID NO: 2764438 - RNA, 21 nt, Leptospira interrogans serovar lai str. 56601
aagaagaugcuuucucuuuuu

SEQ ID NO: 2764439 - RNA, 15 nt, Leptospira interrogans serovar lai str. 56601
aagaagccaauucca

SEQ ID NO: 2764440 - RNA, 22 nt, Leptospira interrogans serovar lai str. 56601
aagaagccaauuccaaaaaucu

SEQ ID NO: 2764441 - RNA, 21 nt, Leptospira interrogans serovar lai str. 56601
aagaaggcagcuaagaaaaaa

SEQ ID NO: 2764442 - RNA, 15 nt, Leptospira interrogans serovar lai str. 56601
aagaagggaugaaau

SEQ ID NO: 2764443 - RNA, 19 nt, Leptospira interrogans serovar lai str. 56601
aagaaguuuguagauaaag

SEQ ID NO: 2764444 - RNA, 15 nt, Leptospira interrogans serovar lai str. 56601
aagaauaauuuaaac

SEQ ID NO: 2764445 - RNA, 17 nt, Leptospira interrogans serovar lai str. 56601
aagaauaccaaaaaagu

SEQ ID NO: 2764446 - RNA, 18 nt, Leptospira interrogans serovar lai str. 56601
aagaauauuauaaauauu

SEQ ID NO: 2764447 - RNA, 15 nt, Leptospira interrogans serovar lai str. 56601
aagaauauuucuaaa

SEQ ID NO: 2764448 - RNA, 22 nt, Leptospira interrogans serovar lai str. 56601
aagaauauuugggcgaaucgcu

SEQ ID NO: 2764449 - RNA, 12 nt, Leptospira interrogans serovar lai str. 56601
aagaaucaaaac

SEQ ID NO: 2764450 - RNA, 12 nt, Leptospira interrogans serovar lai str. 56601
aagaaucaaauc

SEQ ID NO: 2764451 - RNA, 11 nt, Leptospira interrogans serovar lai str. 56601
aagaaucaaua

SEQ ID NO: 2764452 - RNA, 22 nt, Leptospira interrogans serovar lai str. 56601
aagaaucauacaaucaaauuuu

SEQ ID NO: 2764453 - RNA, 14 nt, Leptospira interrogans serovar lai str. 56601
aagaaucauuugca

SEQ ID NO: 2764454 - RNA, 14 nt, Leptospira interrogans serovar lai str. 56601
aagaauccgaaaaa

SEQ ID NO: 2764455 - RNA, 16 nt, Leptospira interrogans serovar lai str. 56601
aagaauccgaaaaacc

SEQ ID NO: 2764456 - RNA, 17 nt, Leptospira interrogans serovar lai str. 56601
aagaauccgaaaaaccu

SEQ ID NO: 2764457 - RNA, 14 nt, Leptospira interrogans serovar lai str. 56601
aagaaucgaaaaaa

SEQ ID NO: 2764458 - RNA, 22 nt, Leptospira interrogans serovar lai str. 56601
aagaaucgauaggaguauaagu

SEQ ID NO: 2764459 - RNA, 20 nt, Leptospira interrogans serovar lai str. 56601
aagaaucugccccaaaauuu

SEQ ID NO: 2764460 - RNA, 22 nt, Leptospira interrogans serovar lai str. 56601
aagaaucugccccaaaauuuag

SEQ ID NO: 2764461 - RNA, 22 nt, Leptospira interrogans serovar lai str. 56601
aagaaucuugggguuuuuguaa

SEQ ID NO: 2764462 - RNA, 16 nt, Leptospira interrogans serovar lai str. 56601
aagaaucuuuuuaaaa

SEQ ID NO: 2764463 - RNA, 15 nt, Leptospira interrogans serovar lai str. 56601
aagaaugaaaaaacu

SEQ ID NO: 2764464 - RNA, 18 nt, Leptospira interrogans serovar lai str. 56601
aagaaugagucuuuuuac

SEQ ID NO: 2764465 - RNA, 22 nt, Leptospira interrogans serovar lai str. 56601
aagaaugauaaaucuuggauca

SEQ ID NO: 2764466 - RNA, 20 nt, Leptospira interrogans serovar lai str. 56601
aagaaugaucgcauaaaauu

SEQ ID NO: 2764467 - RNA, 20 nt, Leptospira interrogans serovar lai str. 56601
aagaauguauaccaauaauu

SEQ ID NO: 2764468 - RNA, 17 nt, Leptospira interrogans serovar lai str. 56601
aagaauuaucauguaaa

SEQ ID NO: 2764469 - RNA, 16 nt, Leptospira interrogans serovar lai str. 56601
aagaauuauuuacuuu

SEQ ID NO: 2764470 - RNA, 19 nt, Leptospira interrogans serovar lai str. 56601
aagaauugaucuaaagggu

SEQ ID NO: 2764471 - RNA, 15 nt, Leptospira interrogans serovar lai str. 56601
aagaauuuaauaaaa

SEQ ID NO: 2764472 - RNA, 16 nt, Leptospira interrogans serovar lai str. 56601
aagaauuuaauaaaaa

SEQ ID NO: 2764473 - RNA, 18 nt, Leptospira interrogans serovar lai str. 56601
aagaauuuaucauuucuu

SEQ ID NO: 2764474 - RNA, 15 nt, Leptospira interrogans serovar lai str. 56601
aagaauuuauuucaa

SEQ ID NO: 2764475 - RNA, 22 nt, Leptospira interrogans serovar lai str. 56601
aagaauuuccagucgcaccccc

SEQ ID NO: 2764476 - RNA, 14 nt, Leptospira interrogans serovar lai str. 56601
aagaauuucguuuc

SEQ ID NO: 2764477 - RNA, 20 nt, Leptospira interrogans serovar lai str. 56601
aagaauuucuaaaaguaaaa

SEQ ID NO: 2764478 - RNA, 20 nt, Leptospira interrogans serovar lai str. 56601
aagaauuuguucauaaaauc

SEQ ID NO: 2764479 - RNA, 13 nt, Leptospira interrogans serovar lai str. 56601
aagaauuuuaaaa

SEQ ID NO: 2764480 - RNA, 20 nt, Leptospira interrogans serovar lai str. 56601
aagaauuuuaaaaaauguga

SEQ ID NO: 2764481 - RNA, 18 nt, Leptospira interrogans serovar lai str. 56601
aagaauuuuagaauauaa

SEQ ID NO: 2764482 - RNA, 19 nt, Leptospira interrogans serovar lai str. 56601
aagaauuuuagaauauaau

SEQ ID NO: 2764483 - RNA, 12 nt, Leptospira interrogans serovar lai str. 56601
aagaauuuuuaa

SEQ ID NO: 2764484 - RNA, 14 nt, Leptospira interrogans serovar lai str. 56601
aagacaaacaaaca

SEQ ID NO: 2764485 - RNA, 19 nt, Leptospira interrogans serovar lai str. 56601
aagacaaaguauuuucuag

SEQ ID NO: 2764486 - RNA, 16 nt, Leptospira interrogans serovar lai str. 56601
aagacauuggcaaaug

SEQ ID NO: 2764487 - RNA, 19 nt, Leptospira interrogans serovar lai str. 56601
aagacauuggcaaauguua

SEQ ID NO: 2764488 - RNA, 13 nt, Leptospira interrogans serovar lai str. 56601
aagacccuaaaaa

SEQ ID NO: 2764489 - RNA, 15 nt, Leptospira interrogans serovar lai str. 56601
aagacccuaaaaaau

SEQ ID NO: 2764490 - RNA, 22 nt, Leptospira interrogans serovar lai str. 56601
aagacccuaaaaaauuuuuaga

SEQ ID NO: 2764491 - RNA, 16 nt, Leptospira interrogans serovar lai str. 56601
aagaccucaaauaacu

SEQ ID NO: 2764492 - RNA, 14 nt, Leptospira interrogans serovar lai str. 56601
aagacgaaaagaag

SEQ ID NO: 2764493 - RNA, 16 nt, Leptospira interrogans serovar lai str. 56601
aagacgcuuaaaaaug

SEQ ID NO: 2764494 - RNA, 16 nt, Leptospira interrogans serovar lai str. 56601
aagacuauaaaaccuu

SEQ ID NO: 2764495 - RNA, 19 nt, Leptospira interrogans serovar lai str. 56601
aagacuauauucuucgcuu

SEQ ID NO: 2764496 - RNA, 18 nt, Leptospira interrogans serovar lai str. 56601
aagacucauauuuuuaga

SEQ ID NO: 2764497 - RNA, 19 nt, Leptospira interrogans serovar lai str. 56601
aagacucauauuuuuagaa

SEQ ID NO: 2764498 - RNA, 23 nt, Leptospira interrogans serovar lai str. 56601
aagacucauauuuuuagaaaauu

SEQ ID NO: 2764499 - RNA, 13 nt, Leptospira interrogans serovar lai str. 56601
aagccaaaaccaa

SEQ ID NO: 2764500 - RNA, 13 nt, Leptospira interrogans serovar lai str. 56601
aagccagaauuuu

SEQ ID NO: 2764501 - RNA, 15 nt, Leptospira interrogans serovar lai str. 56601
aagccauuucaaaaa

SEQ ID NO: 2764502 - RNA, 15 nt, Leptospira interrogans serovar lai str. 56601
aagccccagaacaaa

SEQ ID NO: 2764503 - RNA, 18 nt, Leptospira interrogans serovar lai str. 56601
aagcccccgaagaauuau

SEQ ID NO: 2764504 - RNA, 20 nt, Leptospira interrogans serovar lai str. 56601
aagcccuauauccggaaaca

SEQ ID NO: 2764505 - RNA, 14 nt, Leptospira interrogans serovar lai str. 56601
aagccgcuugaaca

SEQ ID NO: 2764506 - RNA, 19 nt, Leptospira interrogans serovar lai str. 56601
aagccuuccaucaaauaca

SEQ ID NO: 2764507 - RNA, 20 nt, Leptospira interrogans serovar lai str. 56601
aagcgagacgaaaaacucag

SEQ ID NO: 2764508 - RNA, 20 nt, Leptospira interrogans serovar lai str. 56601
aagcgcggucgcgagccauu

SEQ ID NO: 2764509 - RNA, 22 nt, Leptospira interrogans serovar lai str. 56601
aagcggguuuuucuuuuuaaau

SEQ ID NO: 2764510 - RNA, 13 nt, Leptospira interrogans serovar lai str. 56601
aagcguuuucuua

SEQ ID NO: 2764511 - RNA, 14 nt, Leptospira interrogans serovar lai str. 56601
aagcguuuucuuaa

SEQ ID NO: 2764512 - RNA, 17 nt, Leptospira interrogans serovar lai str. 56601
aagcucagauuccaacu

SEQ ID NO: 2764513 - RNA, 17 nt, Leptospira interrogans serovar lai str. 56601
aagcucgaauaaaaaca

SEQ ID NO: 2764514 - RNA, 19 nt, Leptospira interrogans serovar lai str. 56601
aagcugaaaauuuucccua

SEQ ID NO: 2764515 - RNA, 15 nt, Leptospira interrogans serovar lai str. 56601
aagcugaacaaacuc

SEQ ID NO: 2764516 - RNA, 15 nt, Leptospira interrogans serovar lai str. 56601
aagcugaacuuaaaa

SEQ ID NO: 2764517 - RNA, 21 nt, Leptospira interrogans serovar lai str. 56601
aagcugaagacuuccacgaau

SEQ ID NO: 2764518 - RNA, 22 nt, Leptospira interrogans serovar lai str. 56601
aagcuuauacuuuaagaaaauu

SEQ ID NO: 2764519 - RNA, 19 nt, Leptospira interrogans serovar lai str. 56601
aagcuuguuucaaaaguua

SEQ ID NO: 2764520 - RNA, 13 nt, Leptospira interrogans serovar lai str. 56601
aagcuuuagaaaa

SEQ ID NO: 2764521 - RNA, 15 nt, Leptospira interrogans serovar lai str. 56601
aagcuuuagaaaaua

SEQ ID NO: 2764522 - RNA, 22 nt, Leptospira interrogans serovar lai str. 56601
aagcuuuauuaaauuauauuuu

SEQ ID NO: 2764523 - RNA, 17 nt, Leptospira interrogans serovar lai str. 56601
aagcuuuggauuuugau

SEQ ID NO: 2764524 - RNA, 16 nt, Leptospira interrogans serovar lai str. 56601
aaggaaauaaaaauau

SEQ ID NO: 2764525 - RNA, 22 nt, Leptospira interrogans serovar lai str. 56601
aaggaaauucauuuuucugaaa

SEQ ID NO: 2764526 - RNA, 23 nt, Leptospira interrogans serovar lai str. 56601
aaggaagauaaaacguacuuacu

SEQ ID NO: 2764527 - RNA, 21 nt, Leptospira interrogans serovar lai str. 56601
aaggaagaucgauagaaguag

SEQ ID NO: 2764528 - RNA, 21 nt, Leptospira interrogans serovar lai str. 56601
aaggaagccuuccaggaggga

SEQ ID NO: 2764529 - RNA, 13 nt, Leptospira interrogans serovar lai str. 56601
aaggaagugaaau

SEQ ID NO: 2764530 - RNA, 16 nt, Leptospira interrogans serovar lai str. 56601
aaggaauauucauuca

SEQ ID NO: 2764531 - RNA, 13 nt, Leptospira interrogans serovar lai str. 56601
aaggaauccauga

SEQ ID NO: 2764532 - RNA, 14 nt, Leptospira interrogans serovar lai str. 56601
aaggaauccaugau

SEQ ID NO: 2764533 - RNA, 15 nt, Leptospira interrogans serovar lai str. 56601
aaggaauccaugauu

SEQ ID NO: 2764534 - RNA, 14 nt, Leptospira interrogans serovar lai str. 56601
aaggagaauucaau

SEQ ID NO: 2764535 - RNA, 22 nt, Leptospira interrogans serovar lai str. 56601
aaggagcucaucauucugaaaa

SEQ ID NO: 2764536 - RNA, 20 nt, Leptospira interrogans serovar lai str. 56601
aaggaguaucaauagaaaua

SEQ ID NO: 2764537 - RNA, 18 nt, Leptospira interrogans serovar lai str. 56601
aaggauaacccucaucag

SEQ ID NO: 2764538 - RNA, 19 nt, Leptospira interrogans serovar lai str. 56601
aaggauaacccucaucagu

SEQ ID NO: 2764539 - RNA, 19 nt, Leptospira interrogans serovar lai str. 56601
aaggauccaauacaaaaca

SEQ ID NO: 2764540 - RNA, 20 nt, Leptospira interrogans serovar lai str. 56601
aaggauccaauacaaaacaa

SEQ ID NO: 2764541 - RNA, 23 nt, Leptospira interrogans serovar lai str. 56601
aaggauccaauacaaaacaagua

SEQ ID NO: 2764542 - RNA, 17 nt, Leptospira interrogans serovar lai str. 56601
aaggauguggaaguuuu

SEQ ID NO: 2764543 - RNA, 20 nt, Leptospira interrogans serovar lai str. 56601
aaggauuagcaugaaauuuu

SEQ ID NO: 2764544 - RNA, 21 nt, Leptospira interrogans serovar lai str. 56601
aaggauuagcaugaaauuuuc

SEQ ID NO: 2764545 - RNA, 16 nt, Leptospira interrogans serovar lai str. 56601
aaggauucuuuucccg

SEQ ID NO: 2764546 - RNA, 22 nt, Leptospira interrogans serovar lai str. 56601
aaggcagcuaagaaaaaaguug

SEQ ID NO: 2764547 - RNA, 13 nt, Leptospira interrogans serovar lai str. 56601
aaggcuaaagaau

SEQ ID NO: 2764548 - RNA, 16 nt, Leptospira interrogans serovar lai str. 56601
aaggcugucuucagca

SEQ ID NO: 2764549 - RNA, 19 nt, Leptospira interrogans serovar lai str. 56601
aaggcuuuguaauaaaaau

SEQ ID NO: 2764550 - RNA, 21 nt, Leptospira interrogans serovar lai str. 56601
aagggaguuuguaaagguaga

SEQ ID NO: 2764551 - RNA, 18 nt, Leptospira interrogans serovar lai str. 56601
aagguaauuuauauuaca

SEQ ID NO: 2764552 - RNA, 16 nt, Leptospira interrogans serovar lai str. 56601
aagguagauaaagguu

SEQ ID NO: 2764553 - RNA, 13 nt, Leptospira interrogans serovar lai str. 56601
aaggucucaacaa

SEQ ID NO: 2764554 - RNA, 17 nt, Leptospira interrogans serovar lai str. 56601
aaggugaucuuagaaaa

SEQ ID NO: 2764555 - RNA, 16 nt, Leptospira interrogans serovar lai str. 56601
aaggugcaugaaaaua

SEQ ID NO: 2764556 - RNA, 15 nt, Leptospira interrogans serovar lai str. 56601
aagguuaaaaauuua

SEQ ID NO: 2764557 - RNA, 18 nt, Leptospira interrogans serovar lai str. 56601
aagguuagauuauuucaa

SEQ ID NO: 2764558 - RNA, 19 nt, Leptospira interrogans serovar lai str. 56601
aagguuccaccggaagggu

SEQ ID NO: 2764559 - RNA, 17 nt, Leptospira interrogans serovar lai str. 56601
aagguucggacaauuuu

SEQ ID NO: 2764560 - RNA, 10 nt, Leptospira interrogans serovar lai str. 56601
aagguugagc

SEQ ID NO: 2764561 - RNA, 20 nt, Leptospira interrogans serovar lai str. 56601
aagguugagcaguaaaaucu

SEQ ID NO: 2764562 - RNA, 23 nt, Leptospira interrogans serovar lai str. 56601
aagguugagcaguaaaaucuuua

SEQ ID NO: 2764563 - RNA, 21 nt, Leptospira interrogans serovar lai str. 56601
aagguuggaaucuaaacucua

SEQ ID NO: 2764564 - RNA, 15 nt, Leptospira interrogans serovar lai str. 56601
aagguuuucgauucc

SEQ ID NO: 2764565 - RNA, 14 nt, Leptospira interrogans serovar lai str. 56601
aaguaaaaagacuc

SEQ ID NO: 2764566 - RNA, 15 nt, Leptospira interrogans serovar lai str. 56601
aaguaaaaaugcaaa

SEQ ID NO: 2764567 - RNA, 14 nt, Leptospira interrogans serovar lai str. 56601
aaguaaaauuaaaa

SEQ ID NO: 2764568 - RNA, 15 nt, Leptospira interrogans serovar lai str. 56601
aaguaaaauuaaaag

SEQ ID NO: 2764569 - RNA, 15 nt, Leptospira interrogans serovar lai str. 56601
aaguaaaauuaaagu

SEQ ID NO: 2764570 - RNA, 14 nt, Leptospira interrogans serovar lai str. 56601
aaguaaaauuaaau

SEQ ID NO: 2764571 - RNA, 13 nt, Leptospira interrogans serovar lai str. 56601
aaguaaaauuaca

SEQ ID NO: 2764572 - RNA, 23 nt, Leptospira interrogans serovar lai str. 56601
aaguaaagguuucacaaauuuua

SEQ ID NO: 2764573 - RNA, 17 nt, Leptospira interrogans serovar lai str. 56601
aaguaaauggauaaauu

SEQ ID NO: 2764574 - RNA, 18 nt, Leptospira interrogans serovar lai str. 56601
aaguaaauucgaucuaag

SEQ ID NO: 2764575 - RNA, 18 nt, Leptospira interrogans serovar lai str. 56601
aaguaacguaaauuuuua

SEQ ID NO: 2764576 - RNA, 17 nt, Leptospira interrogans serovar lai str. 56601
aaguaaguugagaauau

SEQ ID NO: 2764577 - RNA, 15 nt, Leptospira interrogans serovar lai str. 56601
aaguaauauuucucu

SEQ ID NO: 2764578 - RNA, 18 nt, Leptospira interrogans serovar lai str. 56601
aaguaaucguuuaaagau

SEQ ID NO: 2764579 - RNA, 19 nt, Leptospira interrogans serovar lai str. 56601
aaguaaucguuuaaagauu

SEQ ID NO: 2764580 - RNA, 22 nt, Leptospira interrogans serovar lai str. 56601
aaguaaucuuuauagguuucuu

SEQ ID NO: 2764581 - RNA, 17 nt, Leptospira interrogans serovar lai str. 56601
aaguaaucuuuuuaaaa

SEQ ID NO: 2764582 - RNA, 17 nt, Leptospira interrogans serovar lai str. 56601
aaguucuauaaacucaa

SEQ ID NO: 2764583 - RNA, 22 nt, Leptospira interrogans serovar lai str. 56601
aaguucuauaaacucaaagaau

SEQ ID NO: 2764584 - RNA, 11 nt, Leptospira interrogans serovar lai str. 56601
aaguucucaag

SEQ ID NO: 2764585 - RNA, 21 nt, Leptospira interrogans serovar lai str. 56601
aaguucucuucauccagauuc

SEQ ID NO: 2764586 - RNA, 18 nt, Leptospira interrogans serovar lai str. 56601
aaguucuggguaaaaaaa

SEQ ID NO: 2764587 - RNA, 21 nt, Leptospira interrogans serovar lai str. 56601
aaguucuggguaaaaaaaaau

SEQ ID NO: 2764588 - RNA, 20 nt, Leptospira interrogans serovar lai str. 56601
aaguugaaugagcuagauuu

SEQ ID NO: 2764589 - RNA, 22 nt, Leptospira interrogans serovar lai str. 56601
aaguugagaauauaagaaagua

SEQ ID NO: 2764590 - RNA, 14 nt, Leptospira interrogans serovar lai str. 56601
aaguugaucuuaua

SEQ ID NO: 2764591 - RNA, 23 nt, Leptospira interrogans serovar lai str. 56601
aaguugaucuuauacucuuaaaa

SEQ ID NO: 2764592 - RNA, 20 nt, Leptospira interrogans serovar lai str. 56601
aaguugauuaugauccaaac

SEQ ID NO: 2764593 - RNA, 21 nt, Leptospira interrogans serovar lai str. 56601
aaguugauugacguccuuaua

SEQ ID NO: 2764594 - RNA, 16 nt, Leptospira interrogans serovar lai str. 56601
aaguugauuucagauc

SEQ ID NO: 2764595 - RNA, 14 nt, Leptospira interrogans serovar lai str. 56601
aaguugcuaagaaa

SEQ ID NO: 2764596 - RNA, 16 nt, Leptospira interrogans serovar lai str. 56601
aaguugggaucugaau

SEQ ID NO: 2764597 - RNA, 13 nt, Leptospira interrogans serovar lai str. 56601
aaguuuaaaaaca

SEQ ID NO: 2764598 - RNA, 21 nt, Leptospira interrogans serovar lai str. 56601
aaguuuacacaacauuaugaa

SEQ ID NO: 2764599 - RNA, 18 nt, Leptospira interrogans serovar lai str. 56601
aaguuuacaucaaaaaca

SEQ ID NO: 2764600 - RNA, 12 nt, Leptospira interrogans serovar lai str. 56601
aaguuuagauuu

SEQ ID NO: 2764601 - RNA, 14 nt, Leptospira interrogans serovar lai str. 56601
aaguuuaugaauuu

SEQ ID NO: 2764602 - RNA, 17 nt, Leptospira interrogans serovar lai str. 56601
aaguuuaugaauuucca

SEQ ID NO: 2764603 - RNA, 15 nt, Leptospira interrogans serovar lai str. 56601
aaguuuauucaauuu

SEQ ID NO: 2764604 - RNA, 17 nt, Leptospira interrogans serovar lai str. 56601
aaguuuauucaauuuua

SEQ ID NO: 2764605 - RNA, 19 nt, Leptospira interrogans serovar lai str. 56601
aaguuucuuauauaaaagu

SEQ ID NO: 2764606 - RNA, 17 nt, Leptospira interrogans serovar lai str. 56601
aaguuugugagaguucc

SEQ ID NO: 2764607 - RNA, 19 nt, Leptospira interrogans serovar lai str. 56601
aaguuugugagaguuccca

SEQ ID NO: 2764608 - RNA, 16 nt, Leptospira interrogans serovar lai str. 56601
aaguuuuaguuuacaa

SEQ ID NO: 2764609 - RNA, 11 nt, Leptospira interrogans serovar lai str. 56601
aaguuuucuuu

SEQ ID NO: 2764610 - RNA, 12 nt, Leptospira interrogans serovar lai str. 56601
aaguuuugauag

SEQ ID NO: 2764611 - RNA, 14 nt, Leptospira interrogans serovar lai str. 56601
aaguuuuuaaaaau

SEQ ID NO: 2764612 - RNA, 17 nt, Leptospira interrogans serovar lai str. 56601
aaguuuuucuuaaaaag

SEQ ID NO: 2764613 - RNA, 16 nt, Leptospira interrogans serovar lai str. 56601
aauaaaaaaaugaauu

SEQ ID NO: 2764614 - RNA, 13 nt, Leptospira interrogans serovar lai str. 56601
aauaaaaaacaaa

SEQ ID NO: 2764615 - RNA, 15 nt, Leptospira interrogans serovar lai str. 56601
aauaaaaaauuucuu

SEQ ID NO: 2764616 - RNA, 16 nt, Leptospira interrogans serovar lai str. 56601
aauaaaaaauuuuccg

SEQ ID NO: 2764617 - RNA, 18 nt, Leptospira interrogans serovar lai str. 56601
aauaaaaacaaaaucaaa

SEQ ID NO: 2764618 - RNA, 13 nt, Leptospira interrogans serovar lai str. 56601
aauaaaaacaaua

SEQ ID NO: 2764619 - RNA, 12 nt, Leptospira interrogans serovar lai str. 56601
aauaaaaacacu

SEQ ID NO: 2764620 - RNA, 16 nt, Leptospira interrogans serovar lai str. 56601
aauaaaaacuacaucg

SEQ ID NO: 2764621 - RNA, 18 nt, Leptospira interrogans serovar lai str. 56601
aauaaaaaucauaaaaca

SEQ ID NO: 2764622 - RNA, 13 nt, Leptospira interrogans serovar lai str. 56601
aauaaaaauuuaa

SEQ ID NO: 2764623 - RNA, 14 nt, Leptospira interrogans serovar lai str. 56601
aauaaaaauuuaca

SEQ ID NO: 2764624 - RNA, 12 nt, Leptospira interrogans serovar lai str. 56601
aauaaaaauuug

SEQ ID NO: 2764625 - RNA, 23 nt, Leptospira interrogans serovar lai str. 56601
aauaaaaccgcugaaaaaaaaau

SEQ ID NO: 2764626 - RNA, 21 nt, Leptospira interrogans serovar lai str. 56601
aauaaaaggaguaauucuaaa

SEQ ID NO: 2764627 - RNA, 15 nt, Leptospira interrogans serovar lai str. 56601
aauaaaauacaguac

SEQ ID NO: 2764628 - RNA, 19 nt, Leptospira interrogans serovar lai str. 56601
aauaaaaugcaguaguucc

SEQ ID NO: 2764629 - RNA, 17 nt, Leptospira interrogans serovar lai str. 56601
aauaaaauguaaaaacu

SEQ ID NO: 2764630 - RNA, 17 nt, Leptospira interrogans serovar lai str. 56601
aauaaaauguaguaacu

SEQ ID NO: 2764631 - RNA, 15 nt, Leptospira interrogans serovar lai str. 56601
aauaaaauuaacagu

SEQ ID NO: 2764632 - RNA, 13 nt, Leptospira interrogans serovar lai str. 56601
aauaaaauuauua

SEQ ID NO: 2764633 - RNA, 12 nt, Leptospira interrogans serovar lai str. 56601
aauaaaauuccu

SEQ ID NO: 2764634 - RNA, 14 nt, Leptospira interrogans serovar lai str. 56601
aauaaaauuugauu

SEQ ID NO: 2764635 - RNA, 17 nt, Leptospira interrogans serovar lai str. 56601
aauaaaauuuuauaaua

SEQ ID NO: 2764636 - RNA, 20 nt, Leptospira interrogans serovar lai str. 56601
aauaaaauuuucauuuuaua

SEQ ID NO: 2764637 - RNA, 16 nt, Leptospira interrogans serovar lai str. 56601
aauaaaauuuuccgga

SEQ ID NO: 2764638 - RNA, 13 nt, Leptospira interrogans serovar lai str. 56601
aauaaaauuuuua

SEQ ID NO: 2764639 - RNA, 14 nt, Leptospira interrogans serovar lai str. 56601
aauaaaauuuuuaa

SEQ ID NO: 2764640 - RNA, 17 nt, Leptospira interrogans serovar lai str. 56601
aauaaaauuuuuaaaaa

SEQ ID NO: 2764641 - RNA, 20 nt, Leptospira interrogans serovar lai str. 56601
aauaaaauuuuuaaaaaauu

SEQ ID NO: 2764642 - RNA, 16 nt, Leptospira interrogans serovar lai str. 56601
aauaaacaauaaaaua

SEQ ID NO: 2764643 - RNA, 19 nt, Leptospira interrogans serovar lai str. 56601
aauaaacaauaaaauaacu

SEQ ID NO: 2764644 - RNA, 15 nt, Leptospira interrogans serovar lai str. 56601
aauaaaccgcauaaa

SEQ ID NO: 2764645 - RNA, 13 nt, Leptospira interrogans serovar lai str. 56601
aauaaagaaaagg

SEQ ID NO: 2764646 - RNA, 16 nt, Leptospira interrogans serovar lai str. 56601
aauaaagagaaaacaa

SEQ ID NO: 2764647 - RNA, 19 nt, Leptospira interrogans serovar lai str. 56601
aauaaagauucacuuagaa

SEQ ID NO: 2764648 - RNA, 21 nt, Leptospira interrogans serovar lai str. 56601
aauaaaguauuuuuaagauaa

SEQ ID NO: 2764649 - RNA, 15 nt, Leptospira interrogans serovar lai str. 56601
aauaaaguuuuauac

SEQ ID NO: 2764650 - RNA, 14 nt, Leptospira interrogans serovar lai str. 56601
aauaaauaaugaaa

SEQ ID NO: 2764651 - RNA, 16 nt, Leptospira interrogans serovar lai str. 56601
aauaaaucaaaaggaa

SEQ ID NO: 2764652 - RNA, 22 nt, Leptospira interrogans serovar lai str. 56601
aauaaaucaauuuucuuucuaa

SEQ ID NO: 2764653 - RNA, 22 nt, Leptospira interrogans serovar lai str. 56601
aauaaauccggaaguaauuaca

SEQ ID NO: 2764654 - RNA, 15 nt, Leptospira interrogans serovar lai str. 56601
aauaaaucuucugaa

SEQ ID NO: 2764655 - RNA, 14 nt, Leptospira interrogans serovar lai str. 56601
aauaaaugugggaa

SEQ ID NO: 2764656 - RNA, 18 nt, Leptospira interrogans serovar lai str. 56601
aauaaauuaaaaaaaaau

SEQ ID NO: 2764657 - RNA, 13 nt, Leptospira interrogans serovar lai str. 56601
aauaaauuauaua

SEQ ID NO: 2764658 - RNA, 20 nt, Leptospira interrogans serovar lai str. 56601
aauaaauuccccaaaaugaa

SEQ ID NO: 2764659 - RNA, 18 nt, Leptospira interrogans serovar lai str. 56601
aauaaauugcauaaaaga

SEQ ID NO: 2764660 - RNA, 23 nt, Leptospira interrogans serovar lai str. 56601
aauaaauugcauaaaagaaacau

SEQ ID NO: 2764661 - RNA, 15 nt, Leptospira interrogans serovar lai str. 56601
aauaaauuuaaaugu

SEQ ID NO: 2764662 - RNA, 23 nt, Leptospira interrogans serovar lai str. 56601
aauaaauuuuucuggaaaaguuu

SEQ ID NO: 2764663 - RNA, 12 nt, Leptospira interrogans serovar lai str. 56601
aauaaauuuuug

SEQ ID NO: 2764664 - RNA, 20 nt, Leptospira interrogans serovar lai str. 56601
aauaaauuuuugacuaccuu

SEQ ID NO: 2764665 - RNA, 21 nt, Leptospira interrogans serovar lai str. 56601
aauagaaaccaguaauaguuu

SEQ ID NO: 2764666 - RNA, 16 nt, Leptospira interrogans serovar lai str. 56601
aauagaaaccuuucau

SEQ ID NO: 2764667 - RNA, 22 nt, Leptospira interrogans serovar lai str. 56601
aauagaaaccuuucaucuacau

SEQ ID NO: 2764668 - RNA, 13 nt, Leptospira interrogans serovar lai str. 56601
aauagaaagacuu

SEQ ID NO: 2764669 - RNA, 18 nt, Leptospira interrogans serovar lai str. 56601
aauagaaagacuuuucau

SEQ ID NO: 2764670 - RNA, 20 nt, Leptospira interrogans serovar lai str. 56601
aauagaaccuuuugaaguag

SEQ ID NO: 2764671 - RNA, 21 nt, Leptospira interrogans serovar lai str. 56601
aauagaauccuauaauaaaau

SEQ ID NO: 2764672 - RNA, 20 nt, Leptospira interrogans serovar lai str. 56601
aauagaauuguugaaaaauu

SEQ ID NO: 2764673 - RNA, 21 nt, Leptospira interrogans serovar lai str. 56601
aauagaauuguugaaaaauua

SEQ ID NO: 2764674 - RNA, 16 nt, Leptospira interrogans serovar lai str. 56601
aauagaauuuggcuuu

SEQ ID NO: 2764675 - RNA, 17 nt, Leptospira interrogans serovar lai str. 56601
aauagaauuuggcuuug

SEQ ID NO: 2764676 - RNA, 19 nt, Leptospira interrogans serovar lai str. 56601
aauagaauuuugcaaaaaa

SEQ ID NO: 2764677 - RNA, 16 nt, Leptospira interrogans serovar lai str. 56601
aauagaauuuuuauga

SEQ ID NO: 2764678 - RNA, 21 nt, Leptospira interrogans serovar lai str. 56601
aauagaauuuuuaugagcuuu

SEQ ID NO: 2764679 - RNA, 16 nt, Leptospira interrogans serovar lai str. 56601
aauagaauuuuuguag

SEQ ID NO: 2764680 - RNA, 19 nt, Leptospira interrogans serovar lai str. 56601
aauagaauuuuuguagaau

SEQ ID NO: 2764681 - RNA, 15 nt, Leptospira interrogans serovar lai str. 56601
aauagacuaacgauu

SEQ ID NO: 2764682 - RNA, 21 nt, Leptospira interrogans serovar lai str. 56601
aauagacuaacgauuguaaaa

SEQ ID NO: 2764683 - RNA, 16 nt, Leptospira interrogans serovar lai str. 56601
aauagagaaaaauuuu

SEQ ID NO: 2764684 - RNA, 19 nt, Leptospira interrogans serovar lai str. 56601
aauagagcuuuguaauaaa

SEQ ID NO: 2764685 - RNA, 18 nt, Leptospira interrogans serovar lai str. 56601
aauagaguaccauaaauu

SEQ ID NO: 2764686 - RNA, 20 nt, Leptospira interrogans serovar lai str. 56601
aauagaguaccauaaauuuu

SEQ ID NO: 2764687 - RNA, 18 nt, Leptospira interrogans serovar lai str. 56601
aauagagugccaaaauuu

SEQ ID NO: 2764688 - RNA, 20 nt, Leptospira interrogans serovar lai str. 56601
aauagaguuacagaaaaaau

SEQ ID NO: 2764689 - RNA, 21 nt, Leptospira interrogans serovar lai str. 56601
aauagaguuacagaaaaaauc

SEQ ID NO: 2764690 - RNA, 14 nt, Leptospira interrogans serovar lai str. 56601
aauagaguuguuaa

SEQ ID NO: 2764691 - RNA, 20 nt, Leptospira interrogans serovar lai str. 56601
aauagaguuguuaaaagugg

SEQ ID NO: 2764692 - RNA, 23 nt, Leptospira interrogans serovar lai str. 56601
aauagaguuguugaaaaauuuua

SEQ ID NO: 2764693 - RNA, 22 nt, Leptospira interrogans serovar lai str. 56601
aauagauagagaauuaauuuuu

SEQ ID NO: 2764694 - RNA, 21 nt, Leptospira interrogans serovar lai str. 56601
aauagaucugauauuuuaaau

SEQ ID NO: 2764695 - RNA, 22 nt, Leptospira interrogans serovar lai str. 56601
aauagaucugauauuuuaaauu

SEQ ID NO: 2764696 - RNA, 23 nt, Leptospira interrogans serovar lai str. 56601
aauagauggagaacucucucaaa

SEQ ID NO: 2764697 - RNA, 19 nt, Leptospira interrogans serovar lai str. 56601
aauagauggagaauuaauu

SEQ ID NO: 2764698 - RNA, 22 nt, Leptospira interrogans serovar lai str. 56601
aauagauggagaauuaauuuuu

SEQ ID NO: 2764699 - RNA, 14 nt, Leptospira interrogans serovar lai str. 56601
aauagauugauaau

SEQ ID NO: 2764700 - RNA, 22 nt, Leptospira interrogans serovar lai str. 56601
aauagauuucuaguuuaaacgu

SEQ ID NO: 2764701 - RNA, 24 nt, Leptospira interrogans serovar lai str. 56601
aauagauuucuaguuuaaacguuu

SEQ ID NO: 2764702 - RNA, 18 nt, Leptospira interrogans serovar lai str. 56601
aauagcagauuuucucaa

SEQ ID NO: 2764703 - RNA, 21 nt, Leptospira interrogans serovar lai str. 56601
aauagcuuaaaagugauuuaa

SEQ ID NO: 2764704 - RNA, 22 nt, Leptospira interrogans serovar lai str. 56601
aauagcuugucacuauuuuuau

SEQ ID NO: 2764705 - RNA, 21 nt, Leptospira interrogans serovar lai str. 56601
aauaggaucagaauuucuuuc

SEQ ID NO: 2764706 - RNA, 15 nt, Leptospira interrogans serovar lai str. 56601
aauaggauuuuagaa

SEQ ID NO: 2764707 - RNA, 15 nt, Leptospira interrogans serovar lai str. 56601
aauagggaaaacuca

SEQ ID NO: 2764708 - RNA, 13 nt, Leptospira interrogans serovar lai str. 56601
aauagggguuuua

SEQ ID NO: 2764709 - RNA, 22 nt, Leptospira interrogans serovar lai str. 56601
aauaguaagcccccgaagaauu

SEQ ID NO: 2764710 - RNA, 23 nt, Leptospira interrogans serovar lai str. 56601
aauaguaagcccccgaagaauua

SEQ ID NO: 2764711 - RNA, 18 nt, Leptospira interrogans serovar lai str. 56601
aauaguauauuuucugcu

SEQ ID NO: 2764712 - RNA, 19 nt, Leptospira interrogans serovar lai str. 56601
aauaguauauuuucugcuu

SEQ ID NO: 2764713 - RNA, 20 nt, Leptospira interrogans serovar lai str. 56601
aauaguauauuuucugcuua

SEQ ID NO: 2764714 - RNA, 16 nt, Leptospira interrogans serovar lai str. 56601
aauaguauccaaaauu

SEQ ID NO: 2764715 - RNA, 16 nt, Leptospira interrogans serovar lai str. 56601
aauagugauacaaugu

SEQ ID NO: 2764716 - RNA, 19 nt, Leptospira interrogans serovar lai str. 56601
aauaguuacgacauuuuaa

SEQ ID NO: 2764717 - RNA, 13 nt, Leptospira interrogans serovar lai str. 56601
aauaguuagaagu

SEQ ID NO: 2764718 - RNA, 22 nt, Leptospira interrogans serovar lai str. 56601
aauaguuagaaguugaucuuau

SEQ ID NO: 2764719 - RNA, 22 nt, Leptospira interrogans serovar lai str. 56601
aauaguucccacauuuuucaaa

SEQ ID NO: 2764720 - RNA, 17 nt, Leptospira interrogans serovar lai str. 56601
aauaguuccuauauuuu

SEQ ID NO: 2764721 - RNA, 23 nt, Leptospira interrogans serovar lai str. 56601
aauaguuuauacuuuaauaauau

SEQ ID NO: 2764722 - RNA, 12 nt, Leptospira interrogans serovar lai str. 56601
aauauaaaaaau

SEQ ID NO: 2764723 - RNA, 15 nt, Leptospira interrogans serovar lai str. 56601
aauauaaaauuuuua

SEQ ID NO: 2764724 - RNA, 16 nt, Leptospira interrogans serovar lai str. 56601
aauauaaaauuuuuau

SEQ ID NO: 2764725 - RNA, 12 nt, Leptospira interrogans serovar lai str. 56601
aauauaaacugu

SEQ ID NO: 2764726 - RNA, 17 nt, Leptospira interrogans serovar lai str. 56601
aauauaaacugucggaa

SEQ ID NO: 2764727 - RNA, 19 nt, Leptospira interrogans serovar lai str. 56601
aauauaagaaaguauuaau

SEQ ID NO: 2764728 - RNA, 19 nt, Leptospira interrogans serovar lai str. 56601
aauauaaguuaagugaaaa

SEQ ID NO: 2764729 - RNA, 21 nt, Leptospira interrogans serovar lai str. 56601
aauauaaguuaagugaaaauu

SEQ ID NO: 2764730 - RNA, 13 nt, Leptospira interrogans serovar lai str. 56601
aauauaauaaaau

SEQ ID NO: 2764731 - RNA, 14 nt, Leptospira interrogans serovar lai str. 56601
aauauaauaaaauu

SEQ ID NO: 2764732 - RNA, 17 nt, Leptospira interrogans serovar lai str. 56601
aauauaauaaaauuauu

SEQ ID NO: 2764733 - RNA, 17 nt, Leptospira interrogans serovar lai str. 56601
aauauaauaagagugca

SEQ ID NO: 2764734 - RNA, 15 nt, Leptospira interrogans serovar lai str. 56601
aauauaauaauuccg

SEQ ID NO: 2764735 - RNA, 23 nt, Leptospira interrogans serovar lai str. 56601
aauauacgugaccaggaauacuu

SEQ ID NO: 2764736 - RNA, 19 nt, Leptospira interrogans serovar lai str. 56601
aauauacguuauuuccguc

SEQ ID NO: 2764737 - RNA, 15 nt, Leptospira interrogans serovar lai str. 56601
aauauaguauaaauu

SEQ ID NO: 2764738 - RNA, 23 nt, Leptospira interrogans serovar lai str. 56601
aauauaguauaaauucgcaaaaa

SEQ ID NO: 2764739 - RNA, 19 nt, Leptospira interrogans serovar lai str. 56601
aauauagugguuuguaaua

SEQ ID NO: 2764740 - RNA, 22 nt, Leptospira interrogans serovar lai str. 56601
aauauagugguuuguaauaguu

SEQ ID NO: 2764741 - RNA, 13 nt, Leptospira interrogans serovar lai str. 56601
aauauaguuaaau

SEQ ID NO: 2764742 - RNA, 14 nt, Leptospira interrogans serovar lai str. 56601
aauauaguuaaauu

SEQ ID NO: 2764743 - RNA, 15 nt, Leptospira interrogans serovar lai str. 56601
aauauaguuaaauuu

SEQ ID NO: 2764744 - RNA, 22 nt, Leptospira interrogans serovar lai str. 56601
aauauaguuccuacaauuuuag

SEQ ID NO: 2764745 - RNA, 16 nt, Leptospira interrogans serovar lai str. 56601
aauauaucuucuuugg

SEQ ID NO: 2764746 - RNA, 15 nt, Leptospira interrogans serovar lai str. 56601
aauauauuagaguuu

SEQ ID NO: 2764747 - RNA, 23 nt, Leptospira interrogans serovar lai str. 56601
aaucacaauuuuacaaacaaauu

SEQ ID NO: 2764748 - RNA, 19 nt, Leptospira interrogans serovar lai str. 56601
aaucacauccaacccaaac

SEQ ID NO: 2764749 - RNA, 22 nt, Leptospira interrogans serovar lai str. 56601
aaucacauccaacccaaacaca

SEQ ID NO: 2764750 - RNA, 20 nt, Leptospira interrogans serovar lai str. 56601
aaucacccaaucuuacaagu

SEQ ID NO: 2764751 - RNA, 20 nt, Leptospira interrogans serovar lai str. 56601
aaucaccuuuuacuucauau

SEQ ID NO: 2764752 - RNA, 23 nt, Leptospira interrogans serovar lai str. 56601
aaucacgauuuuacaaacaaauu

SEQ ID NO: 2764753 - RNA, 19 nt, Leptospira interrogans serovar lai str. 56601
aaucagaaugaacucaaca

SEQ ID NO: 2764754 - RNA, 23 nt, Leptospira interrogans serovar lai str. 56601
aaucagagucuauuuaauuaugg

SEQ ID NO: 2764755 - RNA, 19 nt, Leptospira interrogans serovar lai str. 56601
aaucagauccuuauacuuu

SEQ ID NO: 2764756 - RNA, 16 nt, Leptospira interrogans serovar lai str. 56601
aaucagauuuuuguag

SEQ ID NO: 2764757 - RNA, 18 nt, Leptospira interrogans serovar lai str. 56601
aaucagggccggagaaaa

SEQ ID NO: 2764758 - RNA, 22 nt, Leptospira interrogans serovar lai str. 56601
aaucagguuuuuacagauuuau

SEQ ID NO: 2764759 - RNA, 20 nt, Leptospira interrogans serovar lai str. 56601
aaucaguguuuugugauaaa

SEQ ID NO: 2764760 - RNA, 15 nt, Leptospira interrogans serovar lai str. 56601
aaucaguuaaacccg

SEQ ID NO: 2764761 - RNA, 15 nt, Leptospira interrogans serovar lai str. 56601
aaucauacuuuuaaa

SEQ ID NO: 2764762 - RNA, 17 nt, Leptospira interrogans serovar lai str. 56601
aaucauagucauuuuga

SEQ ID NO: 2764763 - RNA, 22 nt, Leptospira interrogans serovar lai str. 56601
aaucauagucauuuugauaauu

SEQ ID NO: 2764764 - RNA, 17 nt, Leptospira interrogans serovar lai str. 56601
aaucauauccaauuuca

SEQ ID NO: 2764765 - RNA, 19 nt, Leptospira interrogans serovar lai str. 56601
aaucauauccaauuucaau

SEQ ID NO: 2764766 - RNA, 19 nt, Leptospira interrogans serovar lai str. 56601
aaucauauggauuauccaa

SEQ ID NO: 2764767 - RNA, 20 nt, Leptospira interrogans serovar lai str. 56601
aaucauauggauuauccaaa

SEQ ID NO: 2764768 - RNA, 23 nt, Leptospira interrogans serovar lai str. 56601
aaucauauggauuauccaaaaca

SEQ ID NO: 2764769 - RNA, 17 nt, Leptospira interrogans serovar lai str. 56601
aaucauauuuaacugua

SEQ ID NO: 2764770 - RNA, 20 nt, Leptospira interrogans serovar lai str. 56601
aaucauauuuuaauuuucua

SEQ ID NO: 2764771 - RNA, 14 nt, Leptospira interrogans serovar lai str. 56601
aaucauauuuucaa

SEQ ID NO: 2764772 - RNA, 16 nt, Leptospira interrogans serovar lai str. 56601
aaucauauuuucaaaa

SEQ ID NO: 2764773 - RNA, 17 nt, Leptospira interrogans serovar lai str. 56601
aaucauauuuucaaaaa

SEQ ID NO: 2764774 - RNA, 18 nt, Leptospira interrogans serovar lai str. 56601
aaucauauuuucaaaaaa

SEQ ID NO: 2764775 - RNA, 19 nt, Leptospira interrogans serovar lai str. 56601
aaucauccaauaauuuaac

SEQ ID NO: 2764776 - RNA, 21 nt, Leptospira interrogans serovar lai str. 56601
aaucaugaaccauggauuuuu

SEQ ID NO: 2764777 - RNA, 17 nt, Leptospira interrogans serovar lai str. 56601
aaucaugaucaaauuca

SEQ ID NO: 2764778 - RNA, 17 nt, Leptospira interrogans serovar lai str. 56601
aaucauggccuucugga

SEQ ID NO: 2764779 - RNA, 19 nt, Leptospira interrogans serovar lai str. 56601
aaucauggccuucuggaaa

SEQ ID NO: 2764780 - RNA, 22 nt, Leptospira interrogans serovar lai str. 56601
aaucauggccuucuggaaaaau

SEQ ID NO: 2764781 - RNA, 16 nt, Leptospira interrogans serovar lai str. 56601
aaucaugugaauucag

SEQ ID NO: 2764782 - RNA, 17 nt, Leptospira interrogans serovar lai str. 56601
aaucaugugaauucaga

SEQ ID NO: 2764783 - RNA, 22 nt, Leptospira interrogans serovar lai str. 56601
aaucaugugaauucagaaaaaa

SEQ ID NO: 2764784 - RNA, 22 nt, Leptospira interrogans serovar lai str. 56601
aaucauucuuuagaaauuuuua

SEQ ID NO: 2764785 - RNA, 20 nt, Leptospira interrogans serovar lai str. 56601
aaucauuggaguuuuuuaaa

SEQ ID NO: 2764786 - RNA, 18 nt, Leptospira interrogans serovar lai str. 56601
aaucauuuucaauuuuua

SEQ ID NO: 2764787 - RNA, 22 nt, Leptospira interrogans serovar lai str. 56601
aauccaaaguucccgccaaaug

SEQ ID NO: 2764788 - RNA, 14 nt, Leptospira interrogans serovar lai str. 56601
aauccaauaaaauu

SEQ ID NO: 2764789 - RNA, 13 nt, Leptospira interrogans serovar lai str. 56601
aauccaauauuua

SEQ ID NO: 2764790 - RNA, 19 nt, Leptospira interrogans serovar lai str. 56601
aauccaauauuuaugcuuu

SEQ ID NO: 2764791 - RNA, 16 nt, Leptospira interrogans serovar lai str. 56601
aauccagucaaguaaa

SEQ ID NO: 2764792 - RNA, 22 nt, Leptospira interrogans serovar lai str. 56601
aauccauagaaagguuauccuc

SEQ ID NO: 2764793 - RNA, 12 nt, Leptospira interrogans serovar lai str. 56601
aauccauaucua

SEQ ID NO: 2764794 - RNA, 13 nt, Leptospira interrogans serovar lai str. 56601
aauccauaucuac

SEQ ID NO: 2764795 - RNA, 23 nt, Leptospira interrogans serovar lai str. 56601
aauccauaucuacgacuaacaaa

SEQ ID NO: 2764796 - RNA, 16 nt, Leptospira interrogans serovar lai str. 56601
aauccaugauccauuu

SEQ ID NO: 2764797 - RNA, 18 nt, Leptospira interrogans serovar lai str. 56601
aauccaugauccauuuuu

SEQ ID NO: 2764798 - RNA, 18 nt, Leptospira interrogans serovar lai str. 56601
aauccaugauucugaaaa

SEQ ID NO: 2764799 - RNA, 22 nt, Leptospira interrogans serovar lai str. 56601
aauccaugauucugaaaaaagu

SEQ ID NO: 2764800 - RNA, 14 nt, Leptospira interrogans serovar lai str. 56601
aaucccaaauucuu

SEQ ID NO: 2764801 - RNA, 12 nt, Leptospira interrogans serovar lai str. 56601
aaucccauuuua

SEQ ID NO: 2764802 - RNA, 16 nt, Leptospira interrogans serovar lai str. 56601
aauccgaaaaaccuug

SEQ ID NO: 2764803 - RNA, 15 nt, Leptospira interrogans serovar lai str. 56601
aauccgauuccagca

SEQ ID NO: 2764804 - RNA, 18 nt, Leptospira interrogans serovar lai str. 56601
aauccgcggauguuugaa

SEQ ID NO: 2764805 - RNA, 22 nt, Leptospira interrogans serovar lai str. 56601
aauccgcuuuggaauuggcuuc

SEQ ID NO: 2764806 - RNA, 13 nt, Leptospira interrogans serovar lai str. 56601
aauccuauaauaa

SEQ ID NO: 2764807 - RNA, 16 nt, Leptospira interrogans serovar lai str. 56601
aauccuauaucaacaa

SEQ ID NO: 2764808 - RNA, 19 nt, Leptospira interrogans serovar lai str. 56601
aauccuauaucaacaaucg

SEQ ID NO: 2764809 - RNA, 16 nt, Leptospira interrogans serovar lai str. 56601
aauccucaacagauac

SEQ ID NO: 2764810 - RNA, 20 nt, Leptospira interrogans serovar lai str. 56601
aauccucgcuuuuaauaauu

SEQ ID NO: 2764811 - RNA, 22 nt, Leptospira interrogans serovar lai str. 56601
aauccucgcuuuuaauaauuca

SEQ ID NO: 2764812 - RNA, 22 nt, Leptospira interrogans serovar lai str. 56601
aauccugcuaacugauuauaaa

SEQ ID NO: 2764813 - RNA, 18 nt, Leptospira interrogans serovar lai str. 56601
aauccuguuugaaaaaau

SEQ ID NO: 2764814 - RNA, 19 nt, Leptospira interrogans serovar lai str. 56601
aauccuguuugaaaaaaug

SEQ ID NO: 2764815 - RNA, 23 nt, Leptospira interrogans serovar lai str. 56601
aauccuguuugaaaaaauguaac

SEQ ID NO: 2764816 - RNA, 13 nt, Leptospira interrogans serovar lai str. 56601
aauccuucuuuuc

SEQ ID NO: 2764817 - RNA, 22 nt, Leptospira interrogans serovar lai str. 56601
aaucgaagaugguacuuuacga

SEQ ID NO: 2764818 - RNA, 23 nt, Leptospira interrogans serovar lai str. 56601
aaucgaaugguacgaccaaaaca

SEQ ID NO: 2764819 - RNA, 16 nt, Leptospira interrogans serovar lai str. 56601
aaucgaauguauuuag

SEQ ID NO: 2764820 - RNA, 21 nt, Leptospira interrogans serovar lai str. 56601
aaucgaauguauuuagcgcuu

SEQ ID NO: 2764821 - RNA, 12 nt, Leptospira interrogans serovar lai str. 56601
aaucgaauuucc

SEQ ID NO: 2764822 - RNA, 14 nt, Leptospira interrogans serovar lai str. 56601
aaucgaauuuccau

SEQ ID NO: 2764823 - RNA, 22 nt, Leptospira interrogans serovar lai str. 56601
aaucgaccguuuccauaaaaua

SEQ ID NO: 2764824 - RNA, 23 nt, Leptospira interrogans serovar lai str. 56601
aaucgacguuauguggaaaacuu

SEQ ID NO: 2764825 - RNA, 18 nt, Leptospira interrogans serovar lai str. 56601
aaucgacuuuucugauuu

SEQ ID NO: 2764826 - RNA, 20 nt, Leptospira interrogans serovar lai str. 56601
aaucgagauugauauuucuu

SEQ ID NO: 2764827 - RNA, 21 nt, Leptospira interrogans serovar lai str. 56601
aaucgaucuguaaaauucaga

SEQ ID NO: 2764828 - RNA, 20 nt, Leptospira interrogans serovar lai str. 56601
aaucgauucuaggaaacuca

SEQ ID NO: 2764829 - RNA, 17 nt, Leptospira interrogans serovar lai str. 56601
aaugaaaagauuucaaa

SEQ ID NO: 2764830 - RNA, 23 nt, Leptospira interrogans serovar lai str. 56601
aaugaaagguaauuuugaaguau

SEQ ID NO: 2764831 - RNA, 23 nt, Leptospira interrogans serovar lai str. 56601
aaugaaaucuacaaaacuguuuu

SEQ ID NO: 2764832 - RNA, 22 nt, Leptospira interrogans serovar lai str. 56601
aaugaacaaugaauuuuuauaa

SEQ ID NO: 2764833 - RNA, 14 nt, Leptospira interrogans serovar lai str. 56601
aaugaacucaacag

SEQ ID NO: 2764834 - RNA, 16 nt, Leptospira interrogans serovar lai str. 56601
aaugaaggaauuggaa

SEQ ID NO: 2764835 - RNA, 20 nt, Leptospira interrogans serovar lai str. 56601
aaugaaggaauuggaauauc

SEQ ID NO: 2764836 - RNA, 18 nt, Leptospira interrogans serovar lai str. 56601
aaugaauccuauaaacua

SEQ ID NO: 2764837 - RNA, 15 nt, Leptospira interrogans serovar lai str. 56601
aaugaaucguaaaaa

SEQ ID NO: 2764838 - RNA, 16 nt, Leptospira interrogans serovar lai str. 56601
aaugaaucguaaaaaa

SEQ ID NO: 2764839 - RNA, 18 nt, Leptospira interrogans serovar lai str. 56601
aaugaaucguaaaaaaau

SEQ ID NO: 2764840 - RNA, 21 nt, Leptospira interrogans serovar lai str. 56601
aaugaaucguaaaaaaauauu

SEQ ID NO: 2764841 - RNA, 12 nt, Leptospira interrogans serovar lai str. 56601
aaugaauucucu

SEQ ID NO: 2764842 - RNA, 14 nt, Leptospira interrogans serovar lai str. 56601
aaugaauuguaaaa

SEQ ID NO: 2764843 - RNA, 16 nt, Leptospira interrogans serovar lai str. 56601
aaugaauuguaaaaaa

SEQ ID NO: 2764844 - RNA, 18 nt, Leptospira interrogans serovar lai str. 56601
aaugaauuguaaaaaacc

SEQ ID NO: 2764845 - RNA, 16 nt, Leptospira interrogans serovar lai str. 56601
aaugaauuuagaaaau

SEQ ID NO: 2764846 - RNA, 17 nt, Leptospira interrogans serovar lai str. 56601
aaugaauuuagaaaauu

SEQ ID NO: 2764847 - RNA, 20 nt, Leptospira interrogans serovar lai str. 56601
aaugaauuuagcauuuuuaa

SEQ ID NO: 2764848 - RNA, 18 nt, Leptospira interrogans serovar lai str. 56601
aaugaauuuuuauaaaaa

SEQ ID NO: 2764849 - RNA, 19 nt, Leptospira interrogans serovar lai str. 56601
aaugaauuuuuauaaaaau

SEQ ID NO: 2764850 - RNA, 13 nt, Leptospira interrogans serovar lai str. 56601
aaugacuugcauu

SEQ ID NO: 2764851 - RNA, 14 nt, Leptospira interrogans serovar lai str. 56601
aaugacuugcauuu

SEQ ID NO: 2764852 - RNA, 18 nt, Leptospira interrogans serovar lai str. 56601
aaugacuugcauuuaaua

SEQ ID NO: 2764853 - RNA, 17 nt, Leptospira interrogans serovar lai str. 56601
aaugagaaagaauuucu

SEQ ID NO: 2764854 - RNA, 21 nt, Leptospira interrogans serovar lai str. 56601
aaugagaguucgugaagaaau

SEQ ID NO: 2764855 - RNA, 18 nt, Leptospira interrogans serovar lai str. 56601
aaugagauuaaaacugcu

SEQ ID NO: 2764856 - RNA, 18 nt, Leptospira interrogans serovar lai str. 56601
aaugagucugucccaaaa

SEQ ID NO: 2764857 - RNA, 19 nt, Leptospira interrogans serovar lai str. 56601
aaugagucugucccaaaau

SEQ ID NO: 2764858 - RNA, 20 nt, Leptospira interrogans serovar lai str. 56601
aaugagucugucccaaaauc

SEQ ID NO: 2764859 - RNA, 22 nt, Leptospira interrogans serovar lai str. 56601
aaugagucugucccaaaaucug

SEQ ID NO: 2764860 - RNA, 15 nt, Leptospira interrogans serovar lai str. 56601
aaugagucuuuuuac

SEQ ID NO: 2764861 - RNA, 17 nt, Leptospira interrogans serovar lai str. 56601
aaugauagaaacuaauu

SEQ ID NO: 2764862 - RNA, 15 nt, Leptospira interrogans serovar lai str. 56601
aaugauagaaauauu

SEQ ID NO: 2764863 - RNA, 18 nt, Leptospira interrogans serovar lai str. 56601
aaugauaggcuaaucaaa

SEQ ID NO: 2764864 - RNA, 22 nt, Leptospira interrogans serovar lai str. 56601
aaugauauuugucuauagaugc

SEQ ID NO: 2764865 - RNA, 15 nt, Leptospira interrogans serovar lai str. 56601
aaugaucuaagauuu

SEQ ID NO: 2764866 - RNA, 23 nt, Leptospira interrogans serovar lai str. 56601
aaugaugugggaacuauuacaaa

SEQ ID NO: 2764867 - RNA, 21 nt, Leptospira interrogans serovar lai str. 56601
aaugaugugggaacucucaca

SEQ ID NO: 2764868 - RNA, 13 nt, Leptospira interrogans serovar lai str. 56601
aaugauucuaacu

SEQ ID NO: 2764869 - RNA, 15 nt, Leptospira interrogans serovar lai str. 56601
aaugauuucagauuc

SEQ ID NO: 2764870 - RNA, 14 nt, Leptospira interrogans serovar lai str. 56601
aaugauuucuugau

SEQ ID NO: 2764871 - RNA, 17 nt, Leptospira interrogans serovar lai str. 56601
aaugcaacgaaaucaau

SEQ ID NO: 2764872 - RNA, 12 nt, Leptospira interrogans serovar lai str. 56601
aaugcaaguucu

SEQ ID NO: 2764873 - RNA, 16 nt, Leptospira interrogans serovar lai str. 56601
aaugcaauaguuccug

SEQ ID NO: 2764874 - RNA, 23 nt, Leptospira interrogans serovar lai str. 56601
aaugcaguaaugccuacaaauca

SEQ ID NO: 2764875 - RNA, 18 nt, Leptospira interrogans serovar lai str. 56601
aaugcaguaguuccuaua

SEQ ID NO: 2764876 - RNA, 21 nt, Leptospira interrogans serovar lai str. 56601
aaugcauucaaaaaguuuuau

SEQ ID NO: 2764877 - RNA, 15 nt, Leptospira interrogans serovar lai str. 56601
aaugcgaaaauuuaa

SEQ ID NO: 2764878 - RNA, 22 nt, Leptospira interrogans serovar lai str. 56601
aaugcgaaauagauugaagcgu

SEQ ID NO: 2764879 - RNA, 14 nt, Leptospira interrogans serovar lai str. 56601
aaugcgauuccagu

SEQ ID NO: 2764880 - RNA, 22 nt, Leptospira interrogans serovar lai str. 56601
aaugcgauuccaguaggauaau

SEQ ID NO: 2764881 - RNA, 16 nt, Leptospira interrogans serovar lai str. 56601
aaugcuauugaauccu

SEQ ID NO: 2764882 - RNA, 20 nt, Leptospira interrogans serovar lai str. 56601
aaugcuauugaauccuuccu

SEQ ID NO: 2764883 - RNA, 15 nt, Leptospira interrogans serovar lai str. 56601
aaugcugaauugcuc

SEQ ID NO: 2764884 - RNA, 12 nt, Leptospira interrogans serovar lai str. 56601
aauggaaaauug

SEQ ID NO: 2764885 - RNA, 17 nt, Leptospira interrogans serovar lai str. 56601
aauggaaaucuuuuaaa

SEQ ID NO: 2764886 - RNA, 13 nt, Leptospira interrogans serovar lai str. 56601
aauggaaauggau

SEQ ID NO: 2764887 - RNA, 16 nt, Leptospira interrogans serovar lai str. 56601
aauggaucaaaagagu

SEQ ID NO: 2764888 - RNA, 17 nt, Leptospira interrogans serovar lai str. 56601
aauggauggaaaaugaa

SEQ ID NO: 2764889 - RNA, 19 nt, Leptospira interrogans serovar lai str. 56601
aauggcaaaacgauauuuu

SEQ ID NO: 2764890 - RNA, 13 nt, Leptospira interrogans serovar lai str. 56601
aaugggaguucgu

SEQ ID NO: 2764891 - RNA, 19 nt, Leptospira interrogans serovar lai str. 56601
aaugggaguucguaugagu

SEQ ID NO: 2764892 - RNA, 19 nt, Leptospira interrogans serovar lai str. 56601
aaugguaucugcgauuaaa

SEQ ID NO: 2764893 - RNA, 12 nt, Leptospira interrogans serovar lai str. 56601
aaugguuccgau

SEQ ID NO: 2764894 - RNA, 15 nt, Leptospira interrogans serovar lai str. 56601
aaugguugcaaaaaa

SEQ ID NO: 2764895 - RNA, 14 nt, Leptospira interrogans serovar lai str. 56601
aauguaaaaaaaua

SEQ ID NO: 2764896 - RNA, 14 nt, Leptospira interrogans serovar lai str. 56601
aauguaauaugagu

SEQ ID NO: 2764897 - RNA, 19 nt, Leptospira interrogans serovar lai str. 56601
aauguacaacauccuucaa

SEQ ID NO: 2764898 - RNA, 14 nt, Leptospira interrogans serovar lai str. 56601
aauguacaauuaaa

SEQ ID NO: 2764899 - RNA, 16 nt, Leptospira interrogans serovar lai str. 56601
aauguacuaaaauuuu

SEQ ID NO: 2764900 - RNA, 16 nt, Leptospira interrogans serovar lai str. 56601
aauguagaaacuacug

SEQ ID NO: 2764901 - RNA, 16 nt, Leptospira interrogans serovar lai str. 56601
aauguagccaaaaauu

SEQ ID NO: 2764902 - RNA, 18 nt, Leptospira interrogans serovar lai str. 56601
aauguaguaacuacuaug

SEQ ID NO: 2764903 - RNA, 14 nt, Leptospira interrogans serovar lai str. 56601
aauguauaauccuu

SEQ ID NO: 2764904 - RNA, 15 nt, Leptospira interrogans serovar lai str. 56601
aauguauaccaauaa

SEQ ID NO: 2764905 - RNA, 18 nt, Leptospira interrogans serovar lai str. 56601
aauguauccaauccaaaa

SEQ ID NO: 2764906 - RNA, 20 nt, Leptospira interrogans serovar lai str. 56601
aauguauccaauccaaaauu

SEQ ID NO: 2764907 - RNA, 22 nt, Leptospira interrogans serovar lai str. 56601
aauguauguuuacuugaaaaua

SEQ ID NO: 2764908 - RNA, 20 nt, Leptospira interrogans serovar lai str. 56601
aauguauucuauaaaauuug

SEQ ID NO: 2764909 - RNA, 19 nt, Leptospira interrogans serovar lai str. 56601
aauguauuuaguuuuuuga

SEQ ID NO: 2764910 - RNA, 13 nt, Leptospira interrogans serovar lai str. 56601
aaugucaaaaaaa

SEQ ID NO: 2764911 - RNA, 16 nt, Leptospira interrogans serovar lai str. 56601
aaugucccagauucgu

SEQ ID NO: 2764912 - RNA, 15 nt, Leptospira interrogans serovar lai str. 56601
aauuauccuuaaaau

SEQ ID NO: 2764913 - RNA, 16 nt, Leptospira interrogans serovar lai str. 56601
aauuauccuuaaaaug

SEQ ID NO: 2764914 - RNA, 19 nt, Leptospira interrogans serovar lai str. 56601
aauuauuaacuaauuuuag

SEQ ID NO: 2764915 - RNA, 14 nt, Leptospira interrogans serovar lai str. 56601
aauuauugauauua

SEQ ID NO: 2764916 - RNA, 13 nt, Leptospira interrogans serovar lai str. 56601
aauuauuuacuuu

SEQ ID NO: 2764917 - RNA, 18 nt, Leptospira interrogans serovar lai str. 56601
aauuauuuacuuuuucca

SEQ ID NO: 2764918 - RNA, 20 nt, Leptospira interrogans serovar lai str. 56601
aauuauuuuaggauuuuugg

SEQ ID NO: 2764919 - RNA, 15 nt, Leptospira interrogans serovar lai str. 56601
aauucaaaauaagaa

SEQ ID NO: 2764920 - RNA, 16 nt, Leptospira interrogans serovar lai str. 56601
aauucaaaauaagaaa

SEQ ID NO: 2764921 - RNA, 13 nt, Leptospira interrogans serovar lai str. 56601
aauucaaaauuug

SEQ ID NO: 2764922 - RNA, 16 nt, Leptospira interrogans serovar lai str. 56601
aauucaacuaaauccu

SEQ ID NO: 2764923 - RNA, 14 nt, Leptospira interrogans serovar lai str. 56601
aauucaacuuguaa

SEQ ID NO: 2764924 - RNA, 21 nt, Leptospira interrogans serovar lai str. 56601
aauucaagacuuuauagucaa

SEQ ID NO: 2764925 - RNA, 13 nt, Leptospira interrogans serovar lai str. 56601
aauucaaguuaau

SEQ ID NO: 2764926 - RNA, 19 nt, Leptospira interrogans serovar lai str. 56601
aauucacauuauauauuua

SEQ ID NO: 2764927 - RNA, 21 nt, Leptospira interrogans serovar lai str. 56601
aauucaccuuccaaagauuuu

SEQ ID NO: 2764928 - RNA, 22 nt, Leptospira interrogans serovar lai str. 56601
aauucaccuuccaaagauuuua

SEQ ID NO: 2764929 - RNA, 21 nt, Leptospira interrogans serovar lai str. 56601
aauucacgaccuuaaauaaua

SEQ ID NO: 2764930 - RNA, 13 nt, Leptospira interrogans serovar lai str. 56601
aauucacguuaaa

SEQ ID NO: 2764931 - RNA, 17 nt, Leptospira interrogans serovar lai str. 56601
aauucacguuaaaauaa

SEQ ID NO: 2764932 - RNA, 18 nt, Leptospira interrogans serovar lai str. 56601
aauucacucuuaaauacu

SEQ ID NO: 2764933 - RNA, 14 nt, Leptospira interrogans serovar lai str. 56601
aauucaguaaauua

SEQ ID NO: 2764934 - RNA, 13 nt, Leptospira interrogans serovar lai str. 56601
aauucaguucuga

SEQ ID NO: 2764935 - RNA, 14 nt, Leptospira interrogans serovar lai str. 56601
aauucauacuuuua

SEQ ID NO: 2764936 - RNA, 16 nt, Leptospira interrogans serovar lai str. 56601
aauucauacuuuuaaa

SEQ ID NO: 2764937 - RNA, 15 nt, Leptospira interrogans serovar lai str. 56601
aauucaucuaaaaaa

SEQ ID NO: 2764938 - RNA, 17 nt, Leptospira interrogans serovar lai str. 56601
aauucaugauaguuaau

SEQ ID NO: 2764939 - RNA, 17 nt, Leptospira interrogans serovar lai str. 56601
aauucauuccuauaaau

SEQ ID NO: 2764940 - RNA, 15 nt, Leptospira interrogans serovar lai str. 56601
aauucauugauagau

SEQ ID NO: 2764941 - RNA, 20 nt, Leptospira interrogans serovar lai str. 56601
aauucauuguaagaaauaug

SEQ ID NO: 2764942 - RNA, 18 nt, Leptospira interrogans serovar lai str. 56601
aauucauuuaccuaaaau

SEQ ID NO: 2764943 - RNA, 19 nt, Leptospira interrogans serovar lai str. 56601
aauucauuuggaucuguaa

SEQ ID NO: 2764944 - RNA, 23 nt, Leptospira interrogans serovar lai str. 56601
aauucauuuuacagaauauuaaa

SEQ ID NO: 2764945 - RNA, 13 nt, Leptospira interrogans serovar lai str. 56601
aauucauuuuucu

SEQ ID NO: 2764946 - RNA, 20 nt, Leptospira interrogans serovar lai str. 56601
aauucauuuuucugaaaaaa

SEQ ID NO: 2764947 - RNA, 16 nt, Leptospira interrogans serovar lai str. 56601
aauuccaaaaaucuca

SEQ ID NO: 2764948 - RNA, 15 nt, Leptospira interrogans serovar lai str. 56601
aauuccacucagacc

SEQ ID NO: 2764949 - RNA, 18 nt, Leptospira interrogans serovar lai str. 56601
aauuccacuucucacaaa

SEQ ID NO: 2764950 - RNA, 19 nt, Leptospira interrogans serovar lai str. 56601
aauuccauagugaagauuu

SEQ ID NO: 2764951 - RNA, 22 nt, Leptospira interrogans serovar lai str. 56601
aauuccauagugaagauuugua

SEQ ID NO: 2764952 - RNA, 16 nt, Leptospira interrogans serovar lai str. 56601
aauucccaaugaugaa

SEQ ID NO: 2764953 - RNA, 15 nt, Leptospira interrogans serovar lai str. 56601
aauucccauuaaagu

SEQ ID NO: 2764954 - RNA, 14 nt, Leptospira interrogans serovar lai str. 56601
aauuccccaaaaug

SEQ ID NO: 2764955 - RNA, 20 nt, Leptospira interrogans serovar lai str. 56601
aauuccgacccagaaaaaac

SEQ ID NO: 2764956 - RNA, 23 nt, Leptospira interrogans serovar lai str. 56601
aauuccgacccagaaaaaaccuc

SEQ ID NO: 2764957 - RNA, 17 nt, Leptospira interrogans serovar lai str. 56601
aauuccuacaguuuuag

SEQ ID NO: 2764958 - RNA, 19 nt, Leptospira interrogans serovar lai str. 56601
aauuccuacaguuuuagaa

SEQ ID NO: 2764959 - RNA, 21 nt, Leptospira interrogans serovar lai str. 56601
aauuccuacauucauuuuuau

SEQ ID NO: 2764960 - RNA, 19 nt, Leptospira interrogans serovar lai str. 56601
aauuccuuccaaguuuuug

SEQ ID NO: 2764961 - RNA, 13 nt, Leptospira interrogans serovar lai str. 56601
aauuccuucggaa

SEQ ID NO: 2764962 - RNA, 22 nt, Leptospira interrogans serovar lai str. 56601
aauuccuucguuuuguugugaa

SEQ ID NO: 2764963 - RNA, 19 nt, Leptospira interrogans serovar lai str. 56601
aauucgaauuccuauucag

SEQ ID NO: 2764964 - RNA, 16 nt, Leptospira interrogans serovar lai str. 56601
aauucgaguaguuaau

SEQ ID NO: 2764965 - RNA, 22 nt, Leptospira interrogans serovar lai str. 56601
aauucgauacugccaaugauga

SEQ ID NO: 2764966 - RNA, 21 nt, Leptospira interrogans serovar lai str. 56601
aauucgauccaggaucagaac

SEQ ID NO: 2764967 - RNA, 14 nt, Leptospira interrogans serovar lai str. 56601
aauucgguugacuc

SEQ ID NO: 2764968 - RNA, 21 nt, Leptospira interrogans serovar lai str. 56601
aauucgguugacuccaaaaac

SEQ ID NO: 2764969 - RNA, 10 nt, Leptospira interrogans serovar lai str. 56601
aauucguuaa

SEQ ID NO: 2764970 - RNA, 14 nt, Leptospira interrogans serovar lai str. 56601
aauucguuccaaau

SEQ ID NO: 2764971 - RNA, 18 nt, Leptospira interrogans serovar lai str. 56601
aauucguugagacgaaaa

SEQ ID NO: 2764972 - RNA, 19 nt, Leptospira interrogans serovar lai str. 56601
aauucguuuuuuaaaaugu

SEQ ID NO: 2764973 - RNA, 13 nt, Leptospira interrogans serovar lai str. 56601
aauucuaaaaaaa

SEQ ID NO: 2764974 - RNA, 14 nt, Leptospira interrogans serovar lai str. 56601
aauucuaaaaaaau

SEQ ID NO: 2764975 - RNA, 15 nt, Leptospira interrogans serovar lai str. 56601
aauucuaaaaucaua

SEQ ID NO: 2764976 - RNA, 16 nt, Leptospira interrogans serovar lai str. 56601
aauucuaaaauuguag

SEQ ID NO: 2764977 - RNA, 14 nt, Leptospira interrogans serovar lai str. 56601
aauucuaaaauuug

SEQ ID NO: 2764978 - RNA, 15 nt, Leptospira interrogans serovar lai str. 56601
aauucuaaaucugaa

SEQ ID NO: 2764979 - RNA, 19 nt, Leptospira interrogans serovar lai str. 56601
aauucuaagaccuaaaccc

SEQ ID NO: 2764980 - RNA, 16 nt, Leptospira interrogans serovar lai str. 56601
aauucuaauauuauuu

SEQ ID NO: 2764981 - RNA, 16 nt, Leptospira interrogans serovar lai str. 56601
aauucuacauucugaa

SEQ ID NO: 2764982 - RNA, 18 nt, Leptospira interrogans serovar lai str. 56601
aauucuacgaaacuuuua

SEQ ID NO: 2764983 - RNA, 19 nt, Leptospira interrogans serovar lai str. 56601
aauucuagcgucuaaaaaa

SEQ ID NO: 2764984 - RNA, 20 nt, Leptospira interrogans serovar lai str. 56601
aauucuauaguaaagauuag

SEQ ID NO: 2764985 - RNA, 18 nt, Leptospira interrogans serovar lai str. 56601
aauucuccaauagaauug

SEQ ID NO: 2764986 - RNA, 15 nt, Leptospira interrogans serovar lai str. 56601
aauucuccaucuguu

SEQ ID NO: 2764987 - RNA, 19 nt, Leptospira interrogans serovar lai str. 56601
aauucuccauuuguuucua

SEQ ID NO: 2764988 - RNA, 19 nt, Leptospira interrogans serovar lai str. 56601
aauucuccuccugaaaauu

SEQ ID NO: 2764989 - RNA, 17 nt, Leptospira interrogans serovar lai str. 56601
aauucuccucuucacca

SEQ ID NO: 2764990 - RNA, 16 nt, Leptospira interrogans serovar lai str. 56601
aauucucuauggguuu

SEQ ID NO: 2764991 - RNA, 19 nt, Leptospira interrogans serovar lai str. 56601
aauucucuuuugaccaaaa

SEQ ID NO: 2764992 - RNA, 14 nt, Leptospira interrogans serovar lai str. 56601
aauucucuuuuugg

SEQ ID NO: 2764993 - RNA, 19 nt, Leptospira interrogans serovar lai str. 56601
aauucucuuuuugggaauu

SEQ ID NO: 2764994 - RNA, 23 nt, Leptospira interrogans serovar lai str. 56601
aauucucuuuuugggaauuuuuu

SEQ ID NO: 2764995 - RNA, 18 nt, Leptospira interrogans serovar lai str. 56601
aauuugcgauauucuauu

SEQ ID NO: 2764996 - RNA, 15 nt, Leptospira interrogans serovar lai str. 56601
aauuugcuaaaauaa

SEQ ID NO: 2764997 - RNA, 23 nt, Leptospira interrogans serovar lai str. 56601
aauuugcuucaacacugagucaa

SEQ ID NO: 2764998 - RNA, 15 nt, Leptospira interrogans serovar lai str. 56601
aauuuggaaauugug

SEQ ID NO: 2764999 - RNA, 16 nt, Leptospira interrogans serovar lai str. 56601
aauuuggaaauuguga

SEQ ID NO: 2765000 - RNA, 16 nt, Leptospira interrogans serovar lai str. 56601
aauuuguaauaguucc

SEQ ID NO: 2765001 - RNA, 18 nt, Leptospira interrogans serovar lai str. 56601
aauuuguaggaacuacug

SEQ ID NO: 2765002 - RNA, 21 nt, Leptospira interrogans serovar lai str. 56601
aauuuguaggaacuacugcag

SEQ ID NO: 2765003 - RNA, 15 nt, Leptospira interrogans serovar lai str. 56601
aauuugugaacuuuc

SEQ ID NO: 2765004 - RNA, 16 nt, Leptospira interrogans serovar lai str. 56601
aauuugugaacuuucg

SEQ ID NO: 2765005 - RNA, 19 nt, Leptospira interrogans serovar lai str. 56601
aauuuguggagcucgauuu

SEQ ID NO: 2765006 - RNA, 23 nt, Leptospira interrogans serovar lai str. 56601
aauuuguggagcucgauuuuaua

SEQ ID NO: 2765007 - RNA, 20 nt, Leptospira interrogans serovar lai str. 56601
aauuuguuuguaaaauagug

SEQ ID NO: 2765008 - RNA, 19 nt, Leptospira interrogans serovar lai str. 56601
aauuuguuuuaaaauuuau

SEQ ID NO: 2765009 - RNA, 21 nt, Leptospira interrogans serovar lai str. 56601
aauuuguuuuuaaaauuguga

SEQ ID NO: 2765010 - RNA, 17 nt, Leptospira interrogans serovar lai str. 56601
aauuuguuuuucuugcu

SEQ ID NO: 2765011 - RNA, 15 nt, Leptospira interrogans serovar lai str. 56601
aauuuuaaaaccaau

SEQ ID NO: 2765012 - RNA, 12 nt, Leptospira interrogans serovar lai str. 56601
aauuuuaaauaa

SEQ ID NO: 2765013 - RNA, 14 nt, Leptospira interrogans serovar lai str. 56601
aauuuuaaauaaua

SEQ ID NO: 2765014 - RNA, 13 nt, Leptospira interrogans serovar lai str. 56601
aauuuuaaauauu

SEQ ID NO: 2765015 - RNA, 18 nt, Leptospira interrogans serovar lai str. 56601
aauuuuaaaucgacaaaa

SEQ ID NO: 2765016 - RNA, 22 nt, Leptospira interrogans serovar lai str. 56601
aauuuuaaaucgacaaaaugag

SEQ ID NO: 2765017 - RNA, 23 nt, Leptospira interrogans serovar lai str. 56601
aauuuuaagaacaauuuaaaaua

SEQ ID NO: 2765018 - RNA, 15 nt, Leptospira interrogans serovar lai str. 56601
aauuuuaauuguaaa

SEQ ID NO: 2765019 - RNA, 12 nt, Leptospira interrogans serovar lai str. 56601
aauuuuacaaac

SEQ ID NO: 2765020 - RNA, 22 nt, Leptospira interrogans serovar lai str. 56601
aauuuuacaaacaaauuccgaa

SEQ ID NO: 2765021 - RNA, 20 nt, Leptospira interrogans serovar lai str. 56601
aauuuuacacguaauucuuu

SEQ ID NO: 2765022 - RNA, 21 nt, Leptospira interrogans serovar lai str. 56601
aauuuuacacguaauucuuug

SEQ ID NO: 2765023 - RNA, 21 nt, Leptospira interrogans serovar lai str. 56601
aauuuuacacuauaauucuuu

SEQ ID NO: 2765024 - RNA, 14 nt, Leptospira interrogans serovar lai str. 56601
aauuuuacagagau

SEQ ID NO: 2765025 - RNA, 19 nt, Leptospira interrogans serovar lai str. 56601
aauuuuacagauugauucu

SEQ ID NO: 2765026 - RNA, 13 nt, Leptospira interrogans serovar lai str. 56601
aauuuuacaguaa

SEQ ID NO: 2765027 - RNA, 12 nt, Leptospira interrogans serovar lai str. 56601
aauuuuaccaaa

SEQ ID NO: 2765028 - RNA, 15 nt, Leptospira interrogans serovar lai str. 56601
aauuuuaccaaaaau

SEQ ID NO: 2765029 - RNA, 20 nt, Leptospira interrogans serovar lai str. 56601
aauuuuaccaaaaaugcaaa

SEQ ID NO: 2765030 - RNA, 23 nt, Leptospira interrogans serovar lai str. 56601
aauuuuacgugauaauucuuuag

SEQ ID NO: 2765031 - RNA, 12 nt, Leptospira interrogans serovar lai str. 56601
aauuuuacuaaa

SEQ ID NO: 2765032 - RNA, 15 nt, Leptospira interrogans serovar lai str. 56601
aauuuuacuaaaaau

SEQ ID NO: 2765033 - RNA, 19 nt, Leptospira interrogans serovar lai str. 56601
aauuuuacuaaaaauucau

SEQ ID NO: 2765034 - RNA, 17 nt, Leptospira interrogans serovar lai str. 56601
aauuuuacuuauacaac

SEQ ID NO: 2765035 - RNA, 17 nt, Leptospira interrogans serovar lai str. 56601
aauuuuagaauaucuua

SEQ ID NO: 2765036 - RNA, 19 nt, Leptospira interrogans serovar lai str. 56601
aauuuuagaauauuaugaa

SEQ ID NO: 2765037 - RNA, 20 nt, Leptospira interrogans serovar lai str. 56601
aauuuuagaauauuaugaaa

SEQ ID NO: 2765038 - RNA, 20 nt, Leptospira interrogans serovar lai str. 56601
aauuuuagaauuuauuugua

SEQ ID NO: 2765039 - RNA, 17 nt, Leptospira interrogans serovar lai str. 56601
aauuuuagacaaaaaau

SEQ ID NO: 2765040 - RNA, 15 nt, Leptospira interrogans serovar lai str. 56601
aauuuuaguaaacua

SEQ ID NO: 2765041 - RNA, 19 nt, Leptospira interrogans serovar lai str. 56601
aauuuuaguucucucgaaa

SEQ ID NO: 2765042 - RNA, 19 nt, Leptospira interrogans serovar lai str. 56601
aauuuuaguuuauuuuaaa

SEQ ID NO: 2765043 - RNA, 15 nt, Leptospira interrogans serovar lai str. 56601
aauuuuauauagaac

SEQ ID NO: 2765044 - RNA, 20 nt, Leptospira interrogans serovar lai str. 56601
aauuuuauauagaacuuuuc

SEQ ID NO: 2765045 - RNA, 23 nt, Leptospira interrogans serovar lai str. 56601
aauuuuaucuuaauguaaaguuc

SEQ ID NO: 2765046 - RNA, 15 nt, Leptospira interrogans serovar lai str. 56601
aauuuuaugaccuaa

SEQ ID NO: 2765047 - RNA, 17 nt, Leptospira interrogans serovar lai str. 56601
aauuuuaugauuuucuu

SEQ ID NO: 2765048 - RNA, 16 nt, Leptospira interrogans serovar lai str. 56601
aauuuuauguagaaau

SEQ ID NO: 2765049 - RNA, 17 nt, Leptospira interrogans serovar lai str. 56601
aauuuuauuuauauaua

SEQ ID NO: 2765050 - RNA, 14 nt, Leptospira interrogans serovar lai str. 56601
aauuuucaaaaaau

SEQ ID NO: 2765051 - RNA, 13 nt, Leptospira interrogans serovar lai str. 56601
aauuuucaaaauc

SEQ ID NO: 2765052 - RNA, 15 nt, Leptospira interrogans serovar lai str. 56601
aauuuucaucaaaua

SEQ ID NO: 2765053 - RNA, 13 nt, Leptospira interrogans serovar lai str. 56601
aauuuucaugaac

SEQ ID NO: 2765054 - RNA, 23 nt, Leptospira interrogans serovar lai str. 56601
aauuuucaugaacgaauuuuuca

SEQ ID NO: 2765055 - RNA, 15 nt, Leptospira interrogans serovar lai str. 56601
aauuuucauuuuaua

SEQ ID NO: 2765056 - RNA, 21 nt, Leptospira interrogans serovar lai str. 56601
aauuuuccagaucauuuugua

SEQ ID NO: 2765057 - RNA, 21 nt, Leptospira interrogans serovar lai str. 56601
aauuuuccgaaccuuaccacc

SEQ ID NO: 2765058 - RNA, 22 nt, Leptospira interrogans serovar lai str. 56601
aauuuuccgaaccuuaccaccc

SEQ ID NO: 2765059 - RNA, 23 nt, Leptospira interrogans serovar lai str. 56601
aauuuuccgccccacccaaaaau

SEQ ID NO: 2765060 - RNA, 22 nt, Leptospira interrogans serovar lai str. 56601
aauuuuccucccggcauuaaua

SEQ ID NO: 2765061 - RNA, 14 nt, Leptospira interrogans serovar lai str. 56601
aauuuuccuuuaaa

SEQ ID NO: 2765062 - RNA, 14 nt, Leptospira interrogans serovar lai str. 56601
aauuuucuaaaagu

SEQ ID NO: 2765063 - RNA, 16 nt, Leptospira interrogans serovar lai str. 56601
aauuuucuuguuuaaa

SEQ ID NO: 2765064 - RNA, 18 nt, Leptospira interrogans serovar lai str. 56601
aauuuucuuguuuaaauc

SEQ ID NO: 2765065 - RNA, 16 nt, Leptospira interrogans serovar lai str. 56601
aauuuucuuuagaaau

SEQ ID NO: 2765066 - RNA, 17 nt, Leptospira interrogans serovar lai str. 56601
aauuuucuuuagaaauu

SEQ ID NO: 2765067 - RNA, 18 nt, Leptospira interrogans serovar lai str. 56601
aauuuugaagacuauaaa

SEQ ID NO: 2765068 - RNA, 13 nt, Leptospira interrogans serovar lai str. 56601
aauuuugauuaca

SEQ ID NO: 2765069 - RNA, 20 nt, Leptospira interrogans serovar lai str. 56601
aauuuugcaguaaggauucu

SEQ ID NO: 2765070 - RNA, 22 nt, Leptospira interrogans serovar lai str. 56601
aauuuugcaguaaggauucuuu

SEQ ID NO: 2765071 - RNA, 20 nt, Leptospira interrogans serovar lai str. 56601
aauuuugcucacucauuuuu

SEQ ID NO: 2765072 - RNA, 10 nt, Leptospira interrogans serovar lai str. 56601
aauuuugcuu

SEQ ID NO: 2765073 - RNA, 17 nt, Leptospira interrogans serovar lai str. 56601
aauuuugcuucuaaaaa

SEQ ID NO: 2765074 - RNA, 18 nt, Leptospira interrogans serovar lai str. 56601
aauuuugcuucuaaaaag

SEQ ID NO: 2765075 - RNA, 21 nt, Leptospira interrogans serovar lai str. 56601
aauuuuguuugaauccaaaag

SEQ ID NO: 2765076 - RNA, 13 nt, Leptospira interrogans serovar lai str. 56601
aauuuuuaaaaaa

SEQ ID NO: 2765077 - RNA, 13 nt, Leptospira interrogans serovar lai str. 56601
aauuuuuaaaaag

SEQ ID NO: 2765078 - RNA, 20 nt, Leptospira interrogans serovar lai str. 56601
acaaaggaaucccaaauucu

SEQ ID NO: 2765079 - RNA, 21 nt, Leptospira interrogans serovar lai str. 56601
acaaaguaaguucaaauuuau

SEQ ID NO: 2765080 - RNA, 19 nt, Leptospira interrogans serovar lai str. 56601
acaaaguagccuuuuuaac

SEQ ID NO: 2765081 - RNA, 19 nt, Leptospira interrogans serovar lai str. 56601
acaaaguauuuaauuuuaa

SEQ ID NO: 2765082 - RNA, 15 nt, Leptospira interrogans serovar lai str. 56601
acaaagugaugaaga

SEQ ID NO: 2765083 - RNA, 18 nt, Leptospira interrogans serovar lai str. 56601
acaaagugaugaagagaa

SEQ ID NO: 2765084 - RNA, 23 nt, Leptospira interrogans serovar lai str. 56601
acaaagugaugaagagaaaguaa

SEQ ID NO: 2765085 - RNA, 14 nt, Leptospira interrogans serovar lai str. 56601
acaaauaaaaggag

SEQ ID NO: 2765086 - RNA, 20 nt, Leptospira interrogans serovar lai str. 56601
acaaauagguuuugaacuac

SEQ ID NO: 2765087 - RNA, 12 nt, Leptospira interrogans serovar lai str. 56601
acaaaucaaauc

SEQ ID NO: 2765088 - RNA, 20 nt, Leptospira interrogans serovar lai str. 56601
acaaaucacauccaacccaa

SEQ ID NO: 2765089 - RNA, 21 nt, Leptospira interrogans serovar lai str. 56601
acaaaucacauccaacccaaa

SEQ ID NO: 2765090 - RNA, 19 nt, Leptospira interrogans serovar lai str. 56601
acaaaucagguuuuuacag

SEQ ID NO: 2765091 - RNA, 18 nt, Leptospira interrogans serovar lai str. 56601
acaaaucgugaauuuaca

SEQ ID NO: 2765092 - RNA, 15 nt, Leptospira interrogans serovar lai str. 56601
acaaaucuauauuuu

SEQ ID NO: 2765093 - RNA, 19 nt, Leptospira interrogans serovar lai str. 56601
acaaaucuauauuuuacag

SEQ ID NO: 2765094 - RNA, 20 nt, Leptospira interrogans serovar lai str. 56601
acaaaucuauauuuuacagu

SEQ ID NO: 2765095 - RNA, 20 nt, Leptospira interrogans serovar lai str. 56601
acaaaucuucuguaaaacuu

SEQ ID NO: 2765096 - RNA, 13 nt, Leptospira interrogans serovar lai str. 56601
acaaaugauagaa

SEQ ID NO: 2765097 - RNA, 21 nt, Leptospira interrogans serovar lai str. 56601
acaaauuaguauuuuucuuaa

SEQ ID NO: 2765098 - RNA, 22 nt, Leptospira interrogans serovar lai str. 56601
acaaauuaguauuuuucuuaau

SEQ ID NO: 2765099 - RNA, 11 nt, Leptospira interrogans serovar lai str. 56601
acaaauuccaa

SEQ ID NO: 2765100 - RNA, 21 nt, Leptospira interrogans serovar lai str. 56601
acaaauuccaauuuuucugaa

SEQ ID NO: 2765101 - RNA, 23 nt, Leptospira interrogans serovar lai str. 56601
acaaauuccaauuuuucugaaaa

SEQ ID NO: 2765102 - RNA, 22 nt, Leptospira interrogans serovar lai str. 56601
acaaauuccgucauaaguguau

SEQ ID NO: 2765103 - RNA, 22 nt, Leptospira interrogans serovar lai str. 56601
acaaauucuaaaguuguaggaa

SEQ ID NO: 2765104 - RNA, 22 nt, Leptospira interrogans serovar lai str. 56601
acaaauuggcagaugaaacuaa

SEQ ID NO: 2765105 - RNA, 16 nt, Leptospira interrogans serovar lai str. 56601
acaaauugguuuuuau

SEQ ID NO: 2765106 - RNA, 22 nt, Leptospira interrogans serovar lai str. 56601
acaaauugguuuuuauuauaua

SEQ ID NO: 2765107 - RNA, 13 nt, Leptospira interrogans serovar lai str. 56601
acaaauugucaaa

SEQ ID NO: 2765108 - RNA, 18 nt, Leptospira interrogans serovar lai str. 56601
acaaauuuuaaaguaaau

SEQ ID NO: 2765109 - RNA, 19 nt, Leptospira interrogans serovar lai str. 56601
acaacaaaaaauauacuuu

SEQ ID NO: 2765110 - RNA, 19 nt, Leptospira interrogans serovar lai str. 56601
acaacauccuucaaacuuu

SEQ ID NO: 2765111 - RNA, 21 nt, Leptospira interrogans serovar lai str. 56601
acaacauuagaauuguuugaa

SEQ ID NO: 2765112 - RNA, 20 nt, Leptospira interrogans serovar lai str. 56601
acaacauuaugaaucuuuca

SEQ ID NO: 2765113 - RNA, 19 nt, Leptospira interrogans serovar lai str. 56601
acaacauugaguuugagaa

SEQ ID NO: 2765114 - RNA, 19 nt, Leptospira interrogans serovar lai str. 56601
acaacccccguuauuaaaa

SEQ ID NO: 2765115 - RNA, 20 nt, Leptospira interrogans serovar lai str. 56601
acaacccccguuauuaaaau

SEQ ID NO: 2765116 - RNA, 21 nt, Leptospira interrogans serovar lai str. 56601
acaaccgaaaagguuaaaaau

SEQ ID NO: 2765117 - RNA, 22 nt, Leptospira interrogans serovar lai str. 56601
acaaccgaaaagguuaaaaauu

SEQ ID NO: 2765118 - RNA, 17 nt, Leptospira interrogans serovar lai str. 56601
acaacgcucucuacgga

SEQ ID NO: 2765119 - RNA, 21 nt, Leptospira interrogans serovar lai str. 56601
acaacgcucucuccuauguuu

SEQ ID NO: 2765120 - RNA, 17 nt, Leptospira interrogans serovar lai str. 56601
acaacgcugcuuuccua

SEQ ID NO: 2765121 - RNA, 16 nt, Leptospira interrogans serovar lai str. 56601
acaacguuacuuuuaa

SEQ ID NO: 2765122 - RNA, 18 nt, Leptospira interrogans serovar lai str. 56601
acaacguuacuuuuaaga

SEQ ID NO: 2765123 - RNA, 15 nt, Leptospira interrogans serovar lai str. 56601
acaacucuaauacaa

SEQ ID NO: 2765124 - RNA, 17 nt, Leptospira interrogans serovar lai str. 56601
acaacucuaauacaaaa

SEQ ID NO: 2765125 - RNA, 14 nt, Leptospira interrogans serovar lai str. 56601
acaacucuaauuaa

SEQ ID NO: 2765126 - RNA, 17 nt, Leptospira interrogans serovar lai str. 56601
acaacucuauuaaagaa

SEQ ID NO: 2765127 - RNA, 21 nt, Leptospira interrogans serovar lai str. 56601
acaacucuauuaaagaagucu

SEQ ID NO: 2765128 - RNA, 15 nt, Leptospira interrogans serovar lai str. 56601
acaacucuauuacua

SEQ ID NO: 2765129 - RNA, 23 nt, Leptospira interrogans serovar lai str. 56601
acaacucuauuuaaguacuuaau

SEQ ID NO: 2765130 - RNA, 12 nt, Leptospira interrogans serovar lai str. 56601
acaacuuucaga

SEQ ID NO: 2765131 - RNA, 13 nt, Leptospira interrogans serovar lai str. 56601
acaacuuucagau

SEQ ID NO: 2765132 - RNA, 17 nt, Leptospira interrogans serovar lai str. 56601
acaacuuuugaaacuau

SEQ ID NO: 2765133 - RNA, 14 nt, Leptospira interrogans serovar lai str. 56601
acaacuuuuuuaau

SEQ ID NO: 2765134 - RNA, 13 nt, Leptospira interrogans serovar lai str. 56601
acaagaaucaaaa

SEQ ID NO: 2765135 - RNA, 12 nt, Leptospira interrogans serovar lai str. 56601
acaagaaugagu

SEQ ID NO: 2765136 - RNA, 13 nt, Leptospira interrogans serovar lai str. 56601
acaagacaaacaa

SEQ ID NO: 2765137 - RNA, 17 nt, Leptospira interrogans serovar lai str. 56601
acaagacaaacaaacau

SEQ ID NO: 2765138 - RNA, 22 nt, Leptospira interrogans serovar lai str. 56601
acaagacgcuacucgaauuuau

SEQ ID NO: 2765139 - RNA, 22 nt, Leptospira interrogans serovar lai str. 56601
acaagacuucuauacucuucaa

SEQ ID NO: 2765140 - RNA, 22 nt, Leptospira interrogans serovar lai str. 56601
acaagauuucguucggaaaaaa

SEQ ID NO: 2765141 - RNA, 21 nt, Leptospira interrogans serovar lai str. 56601
acaagcucaugauuauuacuc

SEQ ID NO: 2765142 - RNA, 13 nt, Leptospira interrogans serovar lai str. 56601
acaagcuuccuuu

SEQ ID NO: 2765143 - RNA, 22 nt, Leptospira interrogans serovar lai str. 56601
acaagggcggcuuuuuuuacuu

SEQ ID NO: 2765144 - RNA, 19 nt, Leptospira interrogans serovar lai str. 56601
acaaguccucuaugaaacu

SEQ ID NO: 2765145 - RNA, 20 nt, Leptospira interrogans serovar lai str. 56601
acaaguccucuaugaaacuu

SEQ ID NO: 2765146 - RNA, 17 nt, Leptospira interrogans serovar lai str. 56601
acaaguuccaaauuacu

SEQ ID NO: 2765147 - RNA, 14 nt, Leptospira interrogans serovar lai str. 56601
acaaguugaauagg

SEQ ID NO: 2765148 - RNA, 21 nt, Leptospira interrogans serovar lai str. 56601
acaaguugaauaggauuuuag

SEQ ID NO: 2765149 - RNA, 15 nt, Leptospira interrogans serovar lai str. 56601
acaaguuucuuaaau

SEQ ID NO: 2765150 - RNA, 19 nt, Leptospira interrogans serovar lai str. 56601
acaaguuucuuaaauuugu

SEQ ID NO: 2765151 - RNA, 19 nt, Leptospira interrogans serovar lai str. 56601
acaaguuuggaaauugacu

SEQ ID NO: 2765152 - RNA, 14 nt, Leptospira interrogans serovar lai str. 56601
acaaguuuuuuccg

SEQ ID NO: 2765153 - RNA, 12 nt, Leptospira interrogans serovar lai str. 56601
acaauaaaaacu

SEQ ID NO: 2765154 - RNA, 12 nt, Leptospira interrogans serovar lai str. 56601
acaauaaaaauu

SEQ ID NO: 2765155 - RNA, 15 nt, Leptospira interrogans serovar lai str. 56601
acaauaaaaauuaga

SEQ ID NO: 2765156 - RNA, 14 nt, Leptospira interrogans serovar lai str. 56601
acaauaaauagaau

SEQ ID NO: 2765157 - RNA, 16 nt, Leptospira interrogans serovar lai str. 56601
acaauagcuucuuuaa

SEQ ID NO: 2765158 - RNA, 18 nt, Leptospira interrogans serovar lai str. 56601
acaauagcuucuuuaaaa

SEQ ID NO: 2765159 - RNA, 15 nt, Leptospira interrogans serovar lai str. 56601
acaauaguucuauuu

SEQ ID NO: 2765160 - RNA, 18 nt, Leptospira interrogans serovar lai str. 56601
acaguaaaacuuugguuu

SEQ ID NO: 2765161 - RNA, 17 nt, Leptospira interrogans serovar lai str. 56601
acaguaagaagaaaagg

SEQ ID NO: 2765162 - RNA, 19 nt, Leptospira interrogans serovar lai str. 56601
acaguaauaaucuaaacuu

SEQ ID NO: 2765163 - RNA, 14 nt, Leptospira interrogans serovar lai str. 56601
acaguacuuuguaa

SEQ ID NO: 2765164 - RNA, 20 nt, Leptospira interrogans serovar lai str. 56601
acaguauauuauaauuuuaa

SEQ ID NO: 2765165 - RNA, 21 nt, Leptospira interrogans serovar lai str. 56601
acaguauauuauaauuuuaaa

SEQ ID NO: 2765166 - RNA, 18 nt, Leptospira interrogans serovar lai str. 56601
acaguauucaauuuuuau

SEQ ID NO: 2765167 - RNA, 20 nt, Leptospira interrogans serovar lai str. 56601
acaguauuucgucuuuaguu

SEQ ID NO: 2765168 - RNA, 18 nt, Leptospira interrogans serovar lai str. 56601
acaguuaaacuuuguaaa

SEQ ID NO: 2765169 - RNA, 19 nt, Leptospira interrogans serovar lai str. 56601
acaguuaauaaauuguaua

SEQ ID NO: 2765170 - RNA, 17 nt, Leptospira interrogans serovar lai str. 56601
acaguuauuauuuaaca

SEQ ID NO: 2765171 - RNA, 17 nt, Leptospira interrogans serovar lai str. 56601
acaguuccacuuuaaaa

SEQ ID NO: 2765172 - RNA, 15 nt, Leptospira interrogans serovar lai str. 56601
acaguucucacagau

SEQ ID NO: 2765173 - RNA, 18 nt, Leptospira interrogans serovar lai str. 56601
acaguucugaguaagaua

SEQ ID NO: 2765174 - RNA, 17 nt, Leptospira interrogans serovar lai str. 56601
acaguuuggcauuuaua

SEQ ID NO: 2765175 - RNA, 10 nt, Leptospira interrogans serovar lai str. 56601
acaguuuuua

SEQ ID NO: 2765176 - RNA, 13 nt, Leptospira interrogans serovar lai str. 56601
acauaaaaauuuu

SEQ ID NO: 2765177 - RNA, 18 nt, Leptospira interrogans serovar lai str. 56601
acauaaaaauuuuuuaaa

SEQ ID NO: 2765178 - RNA, 18 nt, Leptospira interrogans serovar lai str. 56601
acauaaaagaccuucgga

SEQ ID NO: 2765179 - RNA, 16 nt, Leptospira interrogans serovar lai str. 56601
acauaacuaauaaaaa

SEQ ID NO: 2765180 - RNA, 18 nt, Leptospira interrogans serovar lai str. 56601
acauaacuaauaaaaaca

SEQ ID NO: 2765181 - RNA, 22 nt, Leptospira interrogans serovar lai str. 56601
acauaagaaagaauuuucuaaa

SEQ ID NO: 2765182 - RNA, 21 nt, Leptospira interrogans serovar lai str. 56601
acauaaguuguuauaaaccaa

SEQ ID NO: 2765183 - RNA, 14 nt, Leptospira interrogans serovar lai str. 56601
acauaaugcugcaa

SEQ ID NO: 2765184 - RNA, 16 nt, Leptospira interrogans serovar lai str. 56601
acauaauguuucaauu

SEQ ID NO: 2765185 - RNA, 17 nt, Leptospira interrogans serovar lai str. 56601
acauacuuuuugcaagu

SEQ ID NO: 2765186 - RNA, 15 nt, Leptospira interrogans serovar lai str. 56601
acauauauaauuuau

SEQ ID NO: 2765187 - RNA, 23 nt, Leptospira interrogans serovar lai str. 56601
acauauuuauuuuuuuuaauaua

SEQ ID NO: 2765188 - RNA, 22 nt, Leptospira interrogans serovar lai str. 56601
acaucaaaaacaaauuaaguuu

SEQ ID NO: 2765189 - RNA, 18 nt, Leptospira interrogans serovar lai str. 56601
acaucaauuuuauuucua

SEQ ID NO: 2765190 - RNA, 18 nt, Leptospira interrogans serovar lai str. 56601
acaucauguaauauaagu

SEQ ID NO: 2765191 - RNA, 20 nt, Leptospira interrogans serovar lai str. 56601
acaucauucucauauugaaa

SEQ ID NO: 2765192 - RNA, 22 nt, Leptospira interrogans serovar lai str. 56601
acauccaaacucuuaaucugcu

SEQ ID NO: 2765193 - RNA, 19 nt, Leptospira interrogans serovar lai str. 56601
acauccaacccaaacacau

SEQ ID NO: 2765194 - RNA, 14 nt, Leptospira interrogans serovar lai str. 56601
acaucccuaagacu

SEQ ID NO: 2765195 - RNA, 22 nt, Leptospira interrogans serovar lai str. 56601
acauccgcauucucacaaauca

SEQ ID NO: 2765196 - RNA, 15 nt, Leptospira interrogans serovar lai str. 56601
acauccuucaaacuu

SEQ ID NO: 2765197 - RNA, 16 nt, Leptospira interrogans serovar lai str. 56601
acauccuucaaacuuu

SEQ ID NO: 2765198 - RNA, 15 nt, Leptospira interrogans serovar lai str. 56601
acaucgaaaaaacaa

SEQ ID NO: 2765199 - RNA, 16 nt, Leptospira interrogans serovar lai str. 56601
acaucgaaaaaacaaa

SEQ ID NO: 2765200 - RNA, 22 nt, Leptospira interrogans serovar lai str. 56601
acaucgaaaaaacaaauaucau

SEQ ID NO: 2765201 - RNA, 13 nt, Leptospira interrogans serovar lai str. 56601
acaucggaaacgc

SEQ ID NO: 2765202 - RNA, 22 nt, Leptospira interrogans serovar lai str. 56601
acaucgggagcuguucuuaguc

SEQ ID NO: 2765203 - RNA, 18 nt, Leptospira interrogans serovar lai str. 56601
acaucguuaccagcaagc

SEQ ID NO: 2765204 - RNA, 21 nt, Leptospira interrogans serovar lai str. 56601
acaucguuaccagcaagcaca

SEQ ID NO: 2765205 - RNA, 21 nt, Leptospira interrogans serovar lai str. 56601
acaucguuuagguaaagauuu

SEQ ID NO: 2765206 - RNA, 23 nt, Leptospira interrogans serovar lai str. 56601
acaucguuuagguaaagauuuuc

SEQ ID NO: 2765207 - RNA, 19 nt, Leptospira interrogans serovar lai str. 56601
acaucucaaucaaaauuuu

SEQ ID NO: 2765208 - RNA, 20 nt, Leptospira interrogans serovar lai str. 56601
acaucucuuuuuuaaagccu

SEQ ID NO: 2765209 - RNA, 17 nt, Leptospira interrogans serovar lai str. 56601
acaucuuaaaaaauaca

SEQ ID NO: 2765210 - RNA, 11 nt, Leptospira interrogans serovar lai str. 56601
acaugaagaag

SEQ ID NO: 2765211 - RNA, 23 nt, Leptospira interrogans serovar lai str. 56601
acauguaaaacuuagaucucacg

SEQ ID NO: 2765212 - RNA, 16 nt, Leptospira interrogans serovar lai str. 56601
acauguucaaaauuua

SEQ ID NO: 2765213 - RNA, 19 nt, Leptospira interrogans serovar lai str. 56601
acauguucaaaauuuaucu

SEQ ID NO: 2765214 - RNA, 20 nt, Leptospira interrogans serovar lai str. 56601
acauuacgaauuuuuaaaua

SEQ ID NO: 2765215 - RNA, 16 nt, Leptospira interrogans serovar lai str. 56601
acauuagaacuacuca

SEQ ID NO: 2765216 - RNA, 14 nt, Leptospira interrogans serovar lai str. 56601
acauuagaauuuua

SEQ ID NO: 2765217 - RNA, 11 nt, Leptospira interrogans serovar lai str. 56601
acauuauacau

SEQ ID NO: 2765218 - RNA, 21 nt, Leptospira interrogans serovar lai str. 56601
acauuauauauuuauuaugua

SEQ ID NO: 2765219 - RNA, 13 nt, Leptospira interrogans serovar lai str. 56601
acauuauuucaau

SEQ ID NO: 2765220 - RNA, 22 nt, Leptospira interrogans serovar lai str. 56601
acauuauuucaaugcaaaaaau

SEQ ID NO: 2765221 - RNA, 18 nt, Leptospira interrogans serovar lai str. 56601
acauucaagguaauuuau

SEQ ID NO: 2765222 - RNA, 16 nt, Leptospira interrogans serovar lai str. 56601
acauucaauuucuuua

SEQ ID NO: 2765223 - RNA, 21 nt, Leptospira interrogans serovar lai str. 56601
acauucaauuucuuuaauuuc

SEQ ID NO: 2765224 - RNA, 14 nt, Leptospira interrogans serovar lai str. 56601
acauucauuuuuuc

SEQ ID NO: 2765225 - RNA, 17 nt, Leptospira interrogans serovar lai str. 56601
acauucccauccgaaau

SEQ ID NO: 2765226 - RNA, 17 nt, Leptospira interrogans serovar lai str. 56601
acauuccgucaaaucau

SEQ ID NO: 2765227 - RNA, 14 nt, Leptospira interrogans serovar lai str. 56601
acauucguuuuaau

SEQ ID NO: 2765228 - RNA, 17 nt, Leptospira interrogans serovar lai str. 56601
acauucuauaaaguuga

SEQ ID NO: 2765229 - RNA, 19 nt, Leptospira interrogans serovar lai str. 56601
acauucugaaacuuuucaa

SEQ ID NO: 2765230 - RNA, 13 nt, Leptospira interrogans serovar lai str. 56601
acauugaagaaaa

SEQ ID NO: 2765231 - RNA, 15 nt, Leptospira interrogans serovar lai str. 56601
acauugaagaaaaaa

SEQ ID NO: 2765232 - RNA, 13 nt, Leptospira interrogans serovar lai str. 56601
acauugcgagauu

SEQ ID NO: 2765233 - RNA, 18 nt, Leptospira interrogans serovar lai str. 56601
acauugcgagauuuuaag

SEQ ID NO: 2765234 - RNA, 20 nt, Leptospira interrogans serovar lai str. 56601
acauuguguuuuuuaacauu

SEQ ID NO: 2765235 - RNA, 16 nt, Leptospira interrogans serovar lai str. 56601
acauuguuuuacucuu

SEQ ID NO: 2765236 - RNA, 23 nt, Leptospira interrogans serovar lai str. 56601
acauuguuuuacucuuauuuaua

SEQ ID NO: 2765237 - RNA, 13 nt, Leptospira interrogans serovar lai str. 56601
acauuuauuuuua

SEQ ID NO: 2765238 - RNA, 18 nt, Leptospira interrogans serovar lai str. 56601
acauuucaaaguuuugcu

SEQ ID NO: 2765239 - RNA, 21 nt, Leptospira interrogans serovar lai str. 56601
acauuuccaacuguuuauaua

SEQ ID NO: 2765240 - RNA, 20 nt, Leptospira interrogans serovar lai str. 56601
acauuugacaauuugugaac

SEQ ID NO: 2765241 - RNA, 16 nt, Leptospira interrogans serovar lai str. 56601
acauuugauuaaaaau

SEQ ID NO: 2765242 - RNA, 20 nt, Leptospira interrogans serovar lai str. 56601
acauuugauuaaaaauuucu

SEQ ID NO: 2765243 - RNA, 14 nt, Leptospira interrogans serovar lai str. 56601
accccuuuuuuaag

SEQ ID NO: 2765244 - RNA, 20 nt, Leptospira interrogans serovar lai str. 56601
accccuuuuuuaagaaucuc

SEQ ID NO: 2765245 - RNA, 13 nt, Leptospira interrogans serovar lai str. 56601
acccgaucuuuuu

SEQ ID NO: 2765246 - RNA, 20 nt, Leptospira interrogans serovar lai str. 56601
acccgaucuuuuuuaauuau

SEQ ID NO: 2765247 - RNA, 21 nt, Leptospira interrogans serovar lai str. 56601
acccgcuacuauucuacagau

SEQ ID NO: 2765248 - RNA, 23 nt, Leptospira interrogans serovar lai str. 56601
acccuaguuuaugugaguuccca

SEQ ID NO: 2765249 - RNA, 14 nt, Leptospira interrogans serovar lai str. 56601
acccugccaaaauc

SEQ ID NO: 2765250 - RNA, 18 nt, Leptospira interrogans serovar lai str. 56601
acccugccaaaaucccag

SEQ ID NO: 2765251 - RNA, 19 nt, Leptospira interrogans serovar lai str. 56601
acccuggucaagaaauucu

SEQ ID NO: 2765252 - RNA, 20 nt, Leptospira interrogans serovar lai str. 56601
accgaaacagagcuuuacaa

SEQ ID NO: 2765253 - RNA, 19 nt, Leptospira interrogans serovar lai str. 56601
accgaacucacguuauuuu

SEQ ID NO: 2765254 - RNA, 15 nt, Leptospira interrogans serovar lai str. 56601
accgaauucaaguua

SEQ ID NO: 2765255 - RNA, 21 nt, Leptospira interrogans serovar lai str. 56601
accgauaagucuagaaaugua

SEQ ID NO: 2765256 - RNA, 13 nt, Leptospira interrogans serovar lai str. 56601
accgaucuuaaaa

SEQ ID NO: 2765257 - RNA, 19 nt, Leptospira interrogans serovar lai str. 56601
accgauuucaauuuucuca

SEQ ID NO: 2765258 - RNA, 21 nt, Leptospira interrogans serovar lai str. 56601
accgcaaacaucuagauuuua

SEQ ID NO: 2765259 - RNA, 15 nt, Leptospira interrogans serovar lai str. 56601
accgcaaaucacaau

SEQ ID NO: 2765260 - RNA, 23 nt, Leptospira interrogans serovar lai str. 56601
accgcaaaucacaauuuuacaaa

SEQ ID NO: 2765261 - RNA, 17 nt, Leptospira interrogans serovar lai str. 56601
accgccuucacccacca

SEQ ID NO: 2765262 - RNA, 17 nt, Leptospira interrogans serovar lai str. 56601
accgcgcuuucagcucu

SEQ ID NO: 2765263 - RNA, 13 nt, Leptospira interrogans serovar lai str. 56601
accgcugaaaaaa

SEQ ID NO: 2765264 - RNA, 19 nt, Leptospira interrogans serovar lai str. 56601
accggauucacauuaaaau

SEQ ID NO: 2765265 - RNA, 15 nt, Leptospira interrogans serovar lai str. 56601
accgggauuuuaaaa

SEQ ID NO: 2765266 - RNA, 23 nt, Leptospira interrogans serovar lai str. 56601
accgggccuuuuuuauuucugag

SEQ ID NO: 2765267 - RNA, 17 nt, Leptospira interrogans serovar lai str. 56601
accgguucagcuagaaa

SEQ ID NO: 2765268 - RNA, 23 nt, Leptospira interrogans serovar lai str. 56601
accguaauucuuaauuuguuugg

SEQ ID NO: 2765269 - RNA, 14 nt, Leptospira interrogans serovar lai str. 56601
accgucaauuuuua

SEQ ID NO: 2765270 - RNA, 20 nt, Leptospira interrogans serovar lai str. 56601
accguccaaucaaauuuuug

SEQ ID NO: 2765271 - RNA, 14 nt, Leptospira interrogans serovar lai str. 56601
accgucccaaaauc

SEQ ID NO: 2765272 - RNA, 14 nt, Leptospira interrogans serovar lai str. 56601
accguugcuauaaa

SEQ ID NO: 2765273 - RNA, 15 nt, Leptospira interrogans serovar lai str. 56601
accguuguaugauuu

SEQ ID NO: 2765274 - RNA, 17 nt, Leptospira interrogans serovar lai str. 56601
accguugugagaaauac

SEQ ID NO: 2765275 - RNA, 14 nt, Leptospira interrogans serovar lai str. 56601
accguuuuuaaaug

SEQ ID NO: 2765276 - RNA, 11 nt, Leptospira interrogans serovar lai str. 56601
accuaaaaaua

SEQ ID NO: 2765277 - RNA, 14 nt, Leptospira interrogans serovar lai str. 56601
accuaaaaugaaaa

SEQ ID NO: 2765278 - RNA, 16 nt, Leptospira interrogans serovar lai str. 56601
accuaaaaugaaaaaa

SEQ ID NO: 2765279 - RNA, 22 nt, Leptospira interrogans serovar lai str. 56601
accuaaaauucaguuucaaacu

SEQ ID NO: 2765280 - RNA, 14 nt, Leptospira interrogans serovar lai str. 56601
accuaaaauuucca

SEQ ID NO: 2765281 - RNA, 12 nt, Leptospira interrogans serovar lai str. 56601
accuaaacccug

SEQ ID NO: 2765282 - RNA, 19 nt, Leptospira interrogans serovar lai str. 56601
accuaaacgaguuuuuguu

SEQ ID NO: 2765283 - RNA, 19 nt, Leptospira interrogans serovar lai str. 56601
accuaaauauuuauuacaa

SEQ ID NO: 2765284 - RNA, 16 nt, Leptospira interrogans serovar lai str. 56601
accuaaugcuauugaa

SEQ ID NO: 2765285 - RNA, 21 nt, Leptospira interrogans serovar lai str. 56601
accuaaugcuauugaauccuu

SEQ ID NO: 2765286 - RNA, 19 nt, Leptospira interrogans serovar lai str. 56601
accuaauguugaaugaaac

SEQ ID NO: 2765287 - RNA, 23 nt, Leptospira interrogans serovar lai str. 56601
accuaauguugaaugaaaccuga

SEQ ID NO: 2765288 - RNA, 21 nt, Leptospira interrogans serovar lai str. 56601
accuaauguuuuuuauuuaaa

SEQ ID NO: 2765289 - RNA, 18 nt, Leptospira interrogans serovar lai str. 56601
accuaauuuauuuguaaa

SEQ ID NO: 2765290 - RNA, 14 nt, Leptospira interrogans serovar lai str. 56601
accuagaggagcca

SEQ ID NO: 2765291 - RNA, 13 nt, Leptospira interrogans serovar lai str. 56601
accuauacuagaa

SEQ ID NO: 2765292 - RNA, 20 nt, Leptospira interrogans serovar lai str. 56601
accuaucacaaacuauucua

SEQ ID NO: 2765293 - RNA, 15 nt, Leptospira interrogans serovar lai str. 56601
accucaacauaaaaa

SEQ ID NO: 2765294 - RNA, 14 nt, Leptospira interrogans serovar lai str. 56601
accuccggaaaaaa

SEQ ID NO: 2765295 - RNA, 18 nt, Leptospira interrogans serovar lai str. 56601
accucguacuaauucuuu

SEQ ID NO: 2765296 - RNA, 14 nt, Leptospira interrogans serovar lai str. 56601
accucuauaaaauc

SEQ ID NO: 2765297 - RNA, 21 nt, Leptospira interrogans serovar lai str. 56601
accucuauaaaaucuaaaaaa

SEQ ID NO: 2765298 - RNA, 19 nt, Leptospira interrogans serovar lai str. 56601
accucuauccacuaaaaua

SEQ ID NO: 2765299 - RNA, 21 nt, Leptospira interrogans serovar lai str. 56601
accucuguuuugcgauuauua

SEQ ID NO: 2765300 - RNA, 17 nt, Leptospira interrogans serovar lai str. 56601
accugaaucuauuguaa

SEQ ID NO: 2765301 - RNA, 13 nt, Leptospira interrogans serovar lai str. 56601
accugauuuuucc

SEQ ID NO: 2765302 - RNA, 13 nt, Leptospira interrogans serovar lai str. 56601
accugauuuuucu

SEQ ID NO: 2765303 - RNA, 16 nt, Leptospira interrogans serovar lai str. 56601
accugauuuuucugua

SEQ ID NO: 2765304 - RNA, 23 nt, Leptospira interrogans serovar lai str. 56601
accugccuuauaaugaagacgcu

SEQ ID NO: 2765305 - RNA, 16 nt, Leptospira interrogans serovar lai str. 56601
accugccuuucuuauu

SEQ ID NO: 2765306 - RNA, 13 nt, Leptospira interrogans serovar lai str. 56601
accugcuuugguu

SEQ ID NO: 2765307 - RNA, 22 nt, Leptospira interrogans serovar lai str. 56601
accuggcauaguuuguuaucaa

SEQ ID NO: 2765308 - RNA, 16 nt, Leptospira interrogans serovar lai str. 56601
accuggcucucagcuc

SEQ ID NO: 2765309 - RNA, 13 nt, Leptospira interrogans serovar lai str. 56601
accuguaaaugaa

SEQ ID NO: 2765310 - RNA, 19 nt, Leptospira interrogans serovar lai str. 56601
accuguucggaguuguaua

SEQ ID NO: 2765311 - RNA, 19 nt, Leptospira interrogans serovar lai str. 56601
accuguuuuaguucaaaaa

SEQ ID NO: 2765312 - RNA, 23 nt, Leptospira interrogans serovar lai str. 56601
accuguuuuaguucaaaaacauc

SEQ ID NO: 2765313 - RNA, 18 nt, Leptospira interrogans serovar lai str. 56601
accuuaaguuucaaguuu

SEQ ID NO: 2765314 - RNA, 16 nt, Leptospira interrogans serovar lai str. 56601
accuuacugcauuuua

SEQ ID NO: 2765315 - RNA, 18 nt, Leptospira interrogans serovar lai str. 56601
accuuccaaagauuuuaa

SEQ ID NO: 2765316 - RNA, 18 nt, Leptospira interrogans serovar lai str. 56601
accuuccuacuccggcua

SEQ ID NO: 2765317 - RNA, 16 nt, Leptospira interrogans serovar lai str. 56601
accuucuaaaucauag

SEQ ID NO: 2765318 - RNA, 18 nt, Leptospira interrogans serovar lai str. 56601
accuuggaaagaaaaggu

SEQ ID NO: 2765319 - RNA, 20 nt, Leptospira interrogans serovar lai str. 56601
accuuuaccauaaauuuuuu

SEQ ID NO: 2765320 - RNA, 23 nt, Leptospira interrogans serovar lai str. 56601
accuuuauuuaauaaaauuuuua

SEQ ID NO: 2765321 - RNA, 19 nt, Leptospira interrogans serovar lai str. 56601
accuuucaucuacauaaaa

SEQ ID NO: 2765322 - RNA, 13 nt, Leptospira interrogans serovar lai str. 56601
accuuucuaaaaa

SEQ ID NO: 2765323 - RNA, 14 nt, Leptospira interrogans serovar lai str. 56601
accuuucuaaaaau

SEQ ID NO: 2765324 - RNA, 17 nt, Leptospira interrogans serovar lai str. 56601
accuuucuaaaaauuuc

SEQ ID NO: 2765325 - RNA, 15 nt, Leptospira interrogans serovar lai str. 56601
accuuugauagaacu

SEQ ID NO: 2765326 - RNA, 16 nt, Leptospira interrogans serovar lai str. 56601
acguaaucugugggaa

SEQ ID NO: 2765327 - RNA, 15 nt, Leptospira interrogans serovar lai str. 56601
acguaccaaaaccca

SEQ ID NO: 2765328 - RNA, 16 nt, Leptospira interrogans serovar lai str. 56601
acguaggaaaugaaaa

SEQ ID NO: 2765329 - RNA, 12 nt, Leptospira interrogans serovar lai str. 56601
acguauaaaaac

SEQ ID NO: 2765330 - RNA, 21 nt, Leptospira interrogans serovar lai str. 56601
acguauguguaaugauuucag

SEQ ID NO: 2765331 - RNA, 23 nt, Leptospira interrogans serovar lai str. 56601
acguauuauccauuucuauaaau

SEQ ID NO: 2765332 - RNA, 13 nt, Leptospira interrogans serovar lai str. 56601
acguauuccaagg

SEQ ID NO: 2765333 - RNA, 12 nt, Leptospira interrogans serovar lai str. 56601
acguauuuuuaa

SEQ ID NO: 2765334 - RNA, 16 nt, Leptospira interrogans serovar lai str. 56601
acguauuuuuaaaugu

SEQ ID NO: 2765335 - RNA, 20 nt, Leptospira interrogans serovar lai str. 56601
acgucauaguucccacaaau

SEQ ID NO: 2765336 - RNA, 19 nt, Leptospira interrogans serovar lai str. 56601
acgucgaacucacauuauu

SEQ ID NO: 2765337 - RNA, 16 nt, Leptospira interrogans serovar lai str. 56601
acgucuacagauaaac

SEQ ID NO: 2765338 - RNA, 13 nt, Leptospira interrogans serovar lai str. 56601
acgucuauaaagc

SEQ ID NO: 2765339 - RNA, 22 nt, Leptospira interrogans serovar lai str. 56601
acgucuucuaaauuuguaaauu

SEQ ID NO: 2765340 - RNA, 21 nt, Leptospira interrogans serovar lai str. 56601
acgugaauucgacguaaggaa

SEQ ID NO: 2765341 - RNA, 13 nt, Leptospira interrogans serovar lai str. 56601
acgugaauuguca

SEQ ID NO: 2765342 - RNA, 21 nt, Leptospira interrogans serovar lai str. 56601
acgugaauuuggcgguuaaaa

SEQ ID NO: 2765343 - RNA, 23 nt, Leptospira interrogans serovar lai str. 56601
acgugaguucggcuuaagaaaau

SEQ ID NO: 2765344 - RNA, 13 nt, Leptospira interrogans serovar lai str. 56601
acgugaguucgug

SEQ ID NO: 2765345 - RNA, 23 nt, Leptospira interrogans serovar lai str. 56601
acgugaguuugacguaaaaaaau

SEQ ID NO: 2765346 - RNA, 13 nt, Leptospira interrogans serovar lai str. 56601
acguggauuuuau

SEQ ID NO: 2765347 - RNA, 17 nt, Leptospira interrogans serovar lai str. 56601
acgugguaguucccaca

SEQ ID NO: 2765348 - RNA, 18 nt, Leptospira interrogans serovar lai str. 56601
acgugguaguucccacaa

SEQ ID NO: 2765349 - RNA, 12 nt, Leptospira interrogans serovar lai str. 56601
acguuacuuuua

SEQ ID NO: 2765350 - RNA, 13 nt, Leptospira interrogans serovar lai str. 56601
acguuauucuauu

SEQ ID NO: 2765351 - RNA, 15 nt, Leptospira interrogans serovar lai str. 56601
acguucaaacaacaa

SEQ ID NO: 2765352 - RNA, 14 nt, Leptospira interrogans serovar lai str. 56601
acguucaacaaaca

SEQ ID NO: 2765353 - RNA, 16 nt, Leptospira interrogans serovar lai str. 56601
acguuuauuucaaaau

SEQ ID NO: 2765354 - RNA, 11 nt, Leptospira interrogans serovar lai str. 56601
acguuuuaaag

SEQ ID NO: 2765355 - RNA, 19 nt, Leptospira interrogans serovar lai str. 56601
acguuuugaccugccuuuc

SEQ ID NO: 2765356 - RNA, 18 nt, Leptospira interrogans serovar lai str. 56601
acguuuugcuaaaagucu

SEQ ID NO: 2765357 - RNA, 18 nt, Leptospira interrogans serovar lai str. 56601
acuaaaaaacauaaaaau

SEQ ID NO: 2765358 - RNA, 12 nt, Leptospira interrogans serovar lai str. 56601
acuaaaaauuca

SEQ ID NO: 2765359 - RNA, 13 nt, Leptospira interrogans serovar lai str. 56601
acuaaaaauucau

SEQ ID NO: 2765360 - RNA, 13 nt, Leptospira interrogans serovar lai str. 56601
acuaaaauuaaaa

SEQ ID NO: 2765361 - RNA, 14 nt, Leptospira interrogans serovar lai str. 56601
acuaaaauuaaaaa

SEQ ID NO: 2765362 - RNA, 16 nt, Leptospira interrogans serovar lai str. 56601
acuaaaauuaaaaauu

SEQ ID NO: 2765363 - RNA, 16 nt, Leptospira interrogans serovar lai str. 56601
acuaaacgauuuuaua

SEQ ID NO: 2765364 - RNA, 16 nt, Leptospira interrogans serovar lai str. 56601
acuaaaucagaauaau

SEQ ID NO: 2765365 - RNA, 19 nt, Leptospira interrogans serovar lai str. 56601
acuaaauccuucuuuucuu

SEQ ID NO: 2765366 - RNA, 20 nt, Leptospira interrogans serovar lai str. 56601
acuaaauccuucuuuucuuc

SEQ ID NO: 2765367 - RNA, 23 nt, Leptospira interrogans serovar lai str. 56601
acuaaaucucaauucaguaaauu

SEQ ID NO: 2765368 - RNA, 21 nt, Leptospira interrogans serovar lai str. 56601
acuaaauuaaguuuauucaau

SEQ ID NO: 2765369 - RNA, 16 nt, Leptospira interrogans serovar lai str. 56601
acuaaauuauuuucaa

SEQ ID NO: 2765370 - RNA, 17 nt, Leptospira interrogans serovar lai str. 56601
acuaaauuauuuucaag

SEQ ID NO: 2765371 - RNA, 22 nt, Leptospira interrogans serovar lai str. 56601
acuaaauuuuucggaaauagaa

SEQ ID NO: 2765372 - RNA, 19 nt, Leptospira interrogans serovar lai str. 56601
acuaacaaaaugauuuuau

SEQ ID NO: 2765373 - RNA, 16 nt, Leptospira interrogans serovar lai str. 56601
acuaacacaguuugaa

SEQ ID NO: 2765374 - RNA, 18 nt, Leptospira interrogans serovar lai str. 56601
acuaacacaguuugaauu

SEQ ID NO: 2765375 - RNA, 20 nt, Leptospira interrogans serovar lai str. 56601
acuaacuacaucaguauuuu

SEQ ID NO: 2765376 - RNA, 23 nt, Leptospira interrogans serovar lai str. 56601
acuaaggcccacaucgaaaaaac

SEQ ID NO: 2765377 - RNA, 14 nt, Leptospira interrogans serovar lai str. 56601
acuaaguaaaaaug

SEQ ID NO: 2765378 - RNA, 12 nt, Leptospira interrogans serovar lai str. 56601
acuaaguuuaac

SEQ ID NO: 2765379 - RNA, 14 nt, Leptospira interrogans serovar lai str. 56601
acuaauaaaaacaa

SEQ ID NO: 2765380 - RNA, 16 nt, Leptospira interrogans serovar lai str. 56601
acuaaugcaaguucug

SEQ ID NO: 2765381 - RNA, 20 nt, Leptospira interrogans serovar lai str. 56601
acuaauugugucguauuaaa

SEQ ID NO: 2765382 - RNA, 19 nt, Leptospira interrogans serovar lai str. 56601
acuaauuuaucgauuuaaa

SEQ ID NO: 2765383 - RNA, 20 nt, Leptospira interrogans serovar lai str. 56601
acuaauuuaucgauuuaaaa

SEQ ID NO: 2765384 - RNA, 23 nt, Leptospira interrogans serovar lai str. 56601
acuaauuuuaguuuauuuuaaaa

SEQ ID NO: 2765385 - RNA, 15 nt, Leptospira interrogans serovar lai str. 56601
acuacaaaaauuuaa

SEQ ID NO: 2765386 - RNA, 16 nt, Leptospira interrogans serovar lai str. 56601
acuacaaaaauuuaau

SEQ ID NO: 2765387 - RNA, 23 nt, Leptospira interrogans serovar lai str. 56601
acuacaaaucacgauuuuacaaa

SEQ ID NO: 2765388 - RNA, 15 nt, Leptospira interrogans serovar lai str. 56601
acuacaauuaaaaag

SEQ ID NO: 2765389 - RNA, 17 nt, Leptospira interrogans serovar lai str. 56601
acuacaauuaaaaagau

SEQ ID NO: 2765390 - RNA, 15 nt, Leptospira interrogans serovar lai str. 56601
acuacacguuuuccu

SEQ ID NO: 2765391 - RNA, 16 nt, Leptospira interrogans serovar lai str. 56601
acuacagaauaaagua

SEQ ID NO: 2765392 - RNA, 16 nt, Leptospira interrogans serovar lai str. 56601
acuacagacaauccua

SEQ ID NO: 2765393 - RNA, 18 nt, Leptospira interrogans serovar lai str. 56601
acuacaucgucuucuuuu

SEQ ID NO: 2765394 - RNA, 20 nt, Leptospira interrogans serovar lai str. 56601
acuacaucuaaugauuucuu

SEQ ID NO: 2765395 - RNA, 21 nt, Leptospira interrogans serovar lai str. 56601
acuacaucuaaugauuucuug

SEQ ID NO: 2765396 - RNA, 13 nt, Leptospira interrogans serovar lai str. 56601
acuaccaaagcuu

SEQ ID NO: 2765397 - RNA, 14 nt, Leptospira interrogans serovar lai str. 56601
acuaccacagaaag

SEQ ID NO: 2765398 - RNA, 23 nt, Leptospira interrogans serovar lai str. 56601
acuaccacagaaagcuuucuccu

SEQ ID NO: 2765399 - RNA, 17 nt, Leptospira interrogans serovar lai str. 56601
acuaccucaauuuucca

SEQ ID NO: 2765400 - RNA, 13 nt, Leptospira interrogans serovar lai str. 56601
acuaccuuauaaa

SEQ ID NO: 2765401 - RNA, 15 nt, Leptospira interrogans serovar lai str. 56601
acuacgaaaauuuaa

SEQ ID NO: 2765402 - RNA, 16 nt, Leptospira interrogans serovar lai str. 56601
acuacuaaaucucaau

SEQ ID NO: 2765403 - RNA, 21 nt, Leptospira interrogans serovar lai str. 56601
acuacuaaaucucaauucagu

SEQ ID NO: 2765404 - RNA, 14 nt, Leptospira interrogans serovar lai str. 56601
acuacuacaaaaau

SEQ ID NO: 2765405 - RNA, 18 nt, Leptospira interrogans serovar lai str. 56601
acuacuacaauuaaaaag

SEQ ID NO: 2765406 - RNA, 17 nt, Leptospira interrogans serovar lai str. 56601
acuacuacgaaaauuua

SEQ ID NO: 2765407 - RNA, 16 nt, Leptospira interrogans serovar lai str. 56601
acuacuacuuuucuga

SEQ ID NO: 2765408 - RNA, 12 nt, Leptospira interrogans serovar lai str. 56601
acuacuaugaaa

SEQ ID NO: 2765409 - RNA, 18 nt, Leptospira interrogans serovar lai str. 56601
acucuaguaaagaaacuc

SEQ ID NO: 2765410 - RNA, 15 nt, Leptospira interrogans serovar lai str. 56601
acucuauagauugau

SEQ ID NO: 2765411 - RNA, 17 nt, Leptospira interrogans serovar lai str. 56601
acucuauagauugauuu

SEQ ID NO: 2765412 - RNA, 20 nt, Leptospira interrogans serovar lai str. 56601
acucuauagauugauuuaaa

SEQ ID NO: 2765413 - RNA, 22 nt, Leptospira interrogans serovar lai str. 56601
acucuaucacgaaauuugugga

SEQ ID NO: 2765414 - RNA, 21 nt, Leptospira interrogans serovar lai str. 56601
acucuauucauaaaugauaau

SEQ ID NO: 2765415 - RNA, 15 nt, Leptospira interrogans serovar lai str. 56601
acucucacaaaucgu

SEQ ID NO: 2765416 - RNA, 21 nt, Leptospira interrogans serovar lai str. 56601
acucugguuauuaaauuguau

SEQ ID NO: 2765417 - RNA, 18 nt, Leptospira interrogans serovar lai str. 56601
acucuuauaaaauuuuag

SEQ ID NO: 2765418 - RNA, 17 nt, Leptospira interrogans serovar lai str. 56601
acucuucuucuagauuu

SEQ ID NO: 2765419 - RNA, 22 nt, Leptospira interrogans serovar lai str. 56601
acucuucuucuagauuuuaaau

SEQ ID NO: 2765420 - RNA, 12 nt, Leptospira interrogans serovar lai str. 56601
acucuuucaaag

SEQ ID NO: 2765421 - RNA, 15 nt, Leptospira interrogans serovar lai str. 56601
acucuuucaaagcua

SEQ ID NO: 2765422 - RNA, 16 nt, Leptospira interrogans serovar lai str. 56601
acucuuugacccauaa

SEQ ID NO: 2765423 - RNA, 20 nt, Leptospira interrogans serovar lai str. 56601
acucuuuuaccuuaccaccg

SEQ ID NO: 2765424 - RNA, 17 nt, Leptospira interrogans serovar lai str. 56601
acucuuuuuauuuuuug

SEQ ID NO: 2765425 - RNA, 13 nt, Leptospira interrogans serovar lai str. 56601
acugaaaaugacc

SEQ ID NO: 2765426 - RNA, 19 nt, Leptospira interrogans serovar lai str. 56601
acugaaaaugaccaaaauu

SEQ ID NO: 2765427 - RNA, 13 nt, Leptospira interrogans serovar lai str. 56601
acugaauaaaaag

SEQ ID NO: 2765428 - RNA, 18 nt, Leptospira interrogans serovar lai str. 56601
acugaauaaaaaguacau

SEQ ID NO: 2765429 - RNA, 14 nt, Leptospira interrogans serovar lai str. 56601
acugacugaaaaaa

SEQ ID NO: 2765430 - RNA, 20 nt, Leptospira interrogans serovar lai str. 56601
acugagauuugucucaaaau

SEQ ID NO: 2765431 - RNA, 16 nt, Leptospira interrogans serovar lai str. 56601
acugaguuucaaacac

SEQ ID NO: 2765432 - RNA, 16 nt, Leptospira interrogans serovar lai str. 56601
acugauucuuuaaaug

SEQ ID NO: 2765433 - RNA, 17 nt, Leptospira interrogans serovar lai str. 56601
acugauuuaauuauuua

SEQ ID NO: 2765434 - RNA, 13 nt, Leptospira interrogans serovar lai str. 56601
acugauuuagaga

SEQ ID NO: 2765435 - RNA, 19 nt, Leptospira interrogans serovar lai str. 56601
acugauuucaaaaauaaau

SEQ ID NO: 2765436 - RNA, 14 nt, Leptospira interrogans serovar lai str. 56601
acugauuuuuuaaa

SEQ ID NO: 2765437 - RNA, 23 nt, Leptospira interrogans serovar lai str. 56601
acugcaaaaucaguuaauacaaa

SEQ ID NO: 2765438 - RNA, 13 nt, Leptospira interrogans serovar lai str. 56601
acugcaagaaacc

SEQ ID NO: 2765439 - RNA, 12 nt, Leptospira interrogans serovar lai str. 56601
acugcauuuuau

SEQ ID NO: 2765440 - RNA, 18 nt, Leptospira interrogans serovar lai str. 56601
acugcauuuuauuaaaaa

SEQ ID NO: 2765441 - RNA, 19 nt, Leptospira interrogans serovar lai str. 56601
acugcauuuuauuaaaaau

SEQ ID NO: 2765442 - RNA, 21 nt, Leptospira interrogans serovar lai str. 56601
acugcauuuuauuaaaaauau

SEQ ID NO: 2765443 - RNA, 18 nt, Leptospira interrogans serovar lai str. 56601
acugcauuuuauuaaaga

SEQ ID NO: 2765444 - RNA, 20 nt, Leptospira interrogans serovar lai str. 56601
acugcauuuuauuaaagaau

SEQ ID NO: 2765445 - RNA, 20 nt, Leptospira interrogans serovar lai str. 56601
acugcccguuucaauuuuug

SEQ ID NO: 2765446 - RNA, 23 nt, Leptospira interrogans serovar lai str. 56601
acugcccguuucaauuuuugaaa

SEQ ID NO: 2765447 - RNA, 12 nt, Leptospira interrogans serovar lai str. 56601
acugcuauaauu

SEQ ID NO: 2765448 - RNA, 20 nt, Leptospira interrogans serovar lai str. 56601
acugcucgaaaguucacaaa

SEQ ID NO: 2765449 - RNA, 21 nt, Leptospira interrogans serovar lai str. 56601
acugcucgaaaguucacaaau

SEQ ID NO: 2765450 - RNA, 20 nt, Leptospira interrogans serovar lai str. 56601
acuggaauauucuuuuuaga

SEQ ID NO: 2765451 - RNA, 16 nt, Leptospira interrogans serovar lai str. 56601
acuggauucaaaauug

SEQ ID NO: 2765452 - RNA, 11 nt, Leptospira interrogans serovar lai str. 56601
acugguuuugg

SEQ ID NO: 2765453 - RNA, 14 nt, Leptospira interrogans serovar lai str. 56601
acugguuuuucuuu

SEQ ID NO: 2765454 - RNA, 21 nt, Leptospira interrogans serovar lai str. 56601
acuguaaaaguuuuugaaaug

SEQ ID NO: 2765455 - RNA, 15 nt, Leptospira interrogans serovar lai str. 56601
acuguaaaauuuaaa

SEQ ID NO: 2765456 - RNA, 23 nt, Leptospira interrogans serovar lai str. 56601
acuguaaaauuuagguuuguggu

SEQ ID NO: 2765457 - RNA, 22 nt, Leptospira interrogans serovar lai str. 56601
acuguaaacuugauuaaacagg

SEQ ID NO: 2765458 - RNA, 15 nt, Leptospira interrogans serovar lai str. 56601
acuguaaauccacga

SEQ ID NO: 2765459 - RNA, 21 nt, Leptospira interrogans serovar lai str. 56601
acuguaucauagaauaaucgg

SEQ ID NO: 2765460 - RNA, 15 nt, Leptospira interrogans serovar lai str. 56601
acugugggaacuacu

SEQ ID NO: 2765461 - RNA, 12 nt, Leptospira interrogans serovar lai str. 56601
acuguguucuuu

SEQ ID NO: 2765462 - RNA, 16 nt, Leptospira interrogans serovar lai str. 56601
acuguuaguuugcaau

SEQ ID NO: 2765463 - RNA, 19 nt, Leptospira interrogans serovar lai str. 56601
acuguuuaauaaagauuca

SEQ ID NO: 2765464 - RNA, 20 nt, Leptospira interrogans serovar lai str. 56601
acuguuuuaacgcaaaauac

SEQ ID NO: 2765465 - RNA, 20 nt, Leptospira interrogans serovar lai str. 56601
acuguuuuugaaacauuucu

SEQ ID NO: 2765466 - RNA, 13 nt, Leptospira interrogans serovar lai str. 56601
acuuaaaaaugau

SEQ ID NO: 2765467 - RNA, 21 nt, Leptospira interrogans serovar lai str. 56601
acuuaaaagaagauuuuucuu

SEQ ID NO: 2765468 - RNA, 22 nt, Leptospira interrogans serovar lai str. 56601
acuuaaaagaagauuuuucuuu

SEQ ID NO: 2765469 - RNA, 12 nt, Leptospira interrogans serovar lai str. 56601
acuuaaaaucua

SEQ ID NO: 2765470 - RNA, 16 nt, Leptospira interrogans serovar lai str. 56601
acuuaaggguugcauu

SEQ ID NO: 2765471 - RNA, 11 nt, Leptospira interrogans serovar lai str. 56601
acuuaaucuca

SEQ ID NO: 2765472 - RNA, 16 nt, Leptospira interrogans serovar lai str. 56601
acuuaaucugugggaa

SEQ ID NO: 2765473 - RNA, 18 nt, Leptospira interrogans serovar lai str. 56601
acuuaauuuguaggaacu

SEQ ID NO: 2765474 - RNA, 19 nt, Leptospira interrogans serovar lai str. 56601
acuuacaaagcacuuuuuu

SEQ ID NO: 2765475 - RNA, 23 nt, Leptospira interrogans serovar lai str. 56601
acuuacaaagcacuuuuuuccuc

SEQ ID NO: 2765476 - RNA, 14 nt, Leptospira interrogans serovar lai str. 56601
acuuacacuccuca

SEQ ID NO: 2765477 - RNA, 20 nt, Leptospira interrogans serovar lai str. 56601
acuuacagauugauuuuuua

SEQ ID NO: 2765478 - RNA, 14 nt, Leptospira interrogans serovar lai str. 56601
acuuacauuaaaua

SEQ ID NO: 2765479 - RNA, 17 nt, Leptospira interrogans serovar lai str. 56601
acuuaccccgaaauaca

SEQ ID NO: 2765480 - RNA, 20 nt, Leptospira interrogans serovar lai str. 56601
acuuacuaaacgauuuuaua

SEQ ID NO: 2765481 - RNA, 18 nt, Leptospira interrogans serovar lai str. 56601
acuuagcagaacgcucuc

SEQ ID NO: 2765482 - RNA, 20 nt, Leptospira interrogans serovar lai str. 56601
acuuaguucccgccucacaa

SEQ ID NO: 2765483 - RNA, 16 nt, Leptospira interrogans serovar lai str. 56601
acuuauaaagaauuuu

SEQ ID NO: 2765484 - RNA, 16 nt, Leptospira interrogans serovar lai str. 56601
acuuauaacugcaaga

SEQ ID NO: 2765485 - RNA, 18 nt, Leptospira interrogans serovar lai str. 56601
acuuaucacgaaaauuaa

SEQ ID NO: 2765486 - RNA, 18 nt, Leptospira interrogans serovar lai str. 56601
acuuaugagaguucccac

SEQ ID NO: 2765487 - RNA, 23 nt, Leptospira interrogans serovar lai str. 56601
acuuaugauuuaguaaaauuuaa

SEQ ID NO: 2765488 - RNA, 16 nt, Leptospira interrogans serovar lai str. 56601
acuuaugcuauuuaau

SEQ ID NO: 2765489 - RNA, 21 nt, Leptospira interrogans serovar lai str. 56601
acuuaugcuauuuaauuuugu

SEQ ID NO: 2765490 - RNA, 17 nt, Leptospira interrogans serovar lai str. 56601
acuuauuucuauaaaau

SEQ ID NO: 2765491 - RNA, 12 nt, Leptospira interrogans serovar lai str. 56601
acuuauuuuuga

SEQ ID NO: 2765492 - RNA, 18 nt, Leptospira interrogans serovar lai str. 56601
acuuucuuuuacauuacc

SEQ ID NO: 2765493 - RNA, 23 nt, Leptospira interrogans serovar lai str. 56601
acuuucuuuuucuuuuuuuaaac

SEQ ID NO: 2765494 - RNA, 21 nt, Leptospira interrogans serovar lai str. 56601
acuuugaaaauugugggaacu

SEQ ID NO: 2765495 - RNA, 14 nt, Leptospira interrogans serovar lai str. 56601
acuuugaaaauuuu

SEQ ID NO: 2765496 - RNA, 16 nt, Leptospira interrogans serovar lai str. 56601
acuuugaaaauuuuuu

SEQ ID NO: 2765497 - RNA, 21 nt, Leptospira interrogans serovar lai str. 56601
acuuugaaaauuuuuuuguaa

SEQ ID NO: 2765498 - RNA, 23 nt, Leptospira interrogans serovar lai str. 56601
acuuugaaugcaacgaaaucaau

SEQ ID NO: 2765499 - RNA, 12 nt, Leptospira interrogans serovar lai str. 56601
acuuugagaaaa

SEQ ID NO: 2765500 - RNA, 18 nt, Leptospira interrogans serovar lai str. 56601
acuuugagaaaauuuuuu

SEQ ID NO: 2765501 - RNA, 23 nt, Leptospira interrogans serovar lai str. 56601
acuuugagaaaauuuuuuuguaa

SEQ ID NO: 2765502 - RNA, 17 nt, Leptospira interrogans serovar lai str. 56601
acuuugagaaagaacaa

SEQ ID NO: 2765503 - RNA, 17 nt, Leptospira interrogans serovar lai str. 56601
acuuugagaugugggaa

SEQ ID NO: 2765504 - RNA, 19 nt, Leptospira interrogans serovar lai str. 56601
acuuugagaugugggaacu

SEQ ID NO: 2765505 - RNA, 21 nt, Leptospira interrogans serovar lai str. 56601
acuuugauuauaaccugcaac

SEQ ID NO: 2765506 - RNA, 17 nt, Leptospira interrogans serovar lai str. 56601
acuuugcagacugauuc

SEQ ID NO: 2765507 - RNA, 18 nt, Leptospira interrogans serovar lai str. 56601
acuuugcucguacguuua

SEQ ID NO: 2765508 - RNA, 21 nt, Leptospira interrogans serovar lai str. 56601
acuuugguuuguaauaguucc

SEQ ID NO: 2765509 - RNA, 22 nt, Leptospira interrogans serovar lai str. 56601
acuuuguaaaauggucuuuuag

SEQ ID NO: 2765510 - RNA, 15 nt, Leptospira interrogans serovar lai str. 56601
acuuuguaaauugug

SEQ ID NO: 2765511 - RNA, 16 nt, Leptospira interrogans serovar lai str. 56601
acuuuguuuuugcuca

SEQ ID NO: 2765512 - RNA, 15 nt, Leptospira interrogans serovar lai str. 56601
acuuuuaaaaaauuu

SEQ ID NO: 2765513 - RNA, 18 nt, Leptospira interrogans serovar lai str. 56601
acuuuuaaaacuuuuaau

SEQ ID NO: 2765514 - RNA, 18 nt, Leptospira interrogans serovar lai str. 56601
acuuuuacuguaaaauuu

SEQ ID NO: 2765515 - RNA, 15 nt, Leptospira interrogans serovar lai str. 56601
acuuuuagaaaaaau

SEQ ID NO: 2765516 - RNA, 17 nt, Leptospira interrogans serovar lai str. 56601
acuuuuagaaaaaauuu

SEQ ID NO: 2765517 - RNA, 21 nt, Leptospira interrogans serovar lai str. 56601
acuuuuagaaaaaauuuuucu

SEQ ID NO: 2765518 - RNA, 20 nt, Leptospira interrogans serovar lai str. 56601
acuuuuagaaaauuuuuacu

SEQ ID NO: 2765519 - RNA, 22 nt, Leptospira interrogans serovar lai str. 56601
acuuuuauaaaaucuaaaagaa

SEQ ID NO: 2765520 - RNA, 14 nt, Leptospira interrogans serovar lai str. 56601
acuuuuaucgaaug

SEQ ID NO: 2765521 - RNA, 18 nt, Leptospira interrogans serovar lai str. 56601
acuuuuaucgaauggaau

SEQ ID NO: 2765522 - RNA, 21 nt, Leptospira interrogans serovar lai str. 56601
acuuuucagggcucaaaguca

SEQ ID NO: 2765523 - RNA, 16 nt, Leptospira interrogans serovar lai str. 56601
acuuuucaucauuccc

SEQ ID NO: 2765524 - RNA, 13 nt, Leptospira interrogans serovar lai str. 56601
acuuuuccaaaua

SEQ ID NO: 2765525 - RNA, 15 nt, Leptospira interrogans serovar lai str. 56601
acuuuuccaaauaua

SEQ ID NO: 2765526 - RNA, 17 nt, Leptospira interrogans serovar lai str. 56601
acuuuucggaacaagau

SEQ ID NO: 2765527 - RNA, 13 nt, Leptospira interrogans serovar lai str. 56601
acuuuucuaaaag

SEQ ID NO: 2765528 - RNA, 12 nt, Leptospira interrogans serovar lai str. 56601
acuuuucuuccc

SEQ ID NO: 2765529 - RNA, 19 nt, Leptospira interrogans serovar lai str. 56601
acuuuuguaauaaaaauuu

SEQ ID NO: 2765530 - RNA, 21 nt, Leptospira interrogans serovar lai str. 56601
acuuuuuaaacgaucagaaaa

SEQ ID NO: 2765531 - RNA, 14 nt, Leptospira interrogans serovar lai str. 56601
acuuuuuacaugag

SEQ ID NO: 2765532 - RNA, 16 nt, Leptospira interrogans serovar lai str. 56601
acuuuuuauaaagauu

SEQ ID NO: 2765533 - RNA, 15 nt, Leptospira interrogans serovar lai str. 56601
acuuuuuaucauuag

SEQ ID NO: 2765534 - RNA, 13 nt, Leptospira interrogans serovar lai str. 56601
acuuuuucagaaa

SEQ ID NO: 2765535 - RNA, 19 nt, Leptospira interrogans serovar lai str. 56601
acuuuuucagaaaaaugaa

SEQ ID NO: 2765536 - RNA, 20 nt, Leptospira interrogans serovar lai str. 56601
acuuuuucagaaaaaugaau

SEQ ID NO: 2765537 - RNA, 22 nt, Leptospira interrogans serovar lai str. 56601
acuuuuucagaaaaaugaauca

SEQ ID NO: 2765538 - RNA, 17 nt, Leptospira interrogans serovar lai str. 56601
acuuuuuccaaaagcaa

SEQ ID NO: 2765539 - RNA, 20 nt, Leptospira interrogans serovar lai str. 56601
acuuuuucguuuuuuagaaa

SEQ ID NO: 2765540 - RNA, 13 nt, Leptospira interrogans serovar lai str. 56601
acuuuuuuauaua

SEQ ID NO: 2765541 - RNA, 14 nt, Leptospira interrogans serovar lai str. 56601
acuuuuuucagaaa

SEQ ID NO: 2765542 - RNA, 23 nt, Leptospira interrogans serovar lai str. 56601
acuuuuuugauaccgggauuuua

SEQ ID NO: 2765543 - RNA, 13 nt, Leptospira interrogans serovar lai str. 56601
agaaaaaaaaaga

SEQ ID NO: 2765544 - RNA, 15 nt, Leptospira interrogans serovar lai str. 56601
agaaaaaaaaagaau

SEQ ID NO: 2765545 - RNA, 13 nt, Leptospira interrogans serovar lai str. 56601
agaaaaaaagauu

SEQ ID NO: 2765546 - RNA, 19 nt, Leptospira interrogans serovar lai str. 56601
agaaaaaaaguauauauua

SEQ ID NO: 2765547 - RNA, 21 nt, Leptospira interrogans serovar lai str. 56601
agaaaaaaccuccguucccac

SEQ ID NO: 2765548 - RNA, 23 nt, Leptospira interrogans serovar lai str. 56601
agaaaaaaguugcuaagaaaaaa

SEQ ID NO: 2765549 - RNA, 15 nt, Leptospira interrogans serovar lai str. 56601
agaaaaaauacauaa

SEQ ID NO: 2765550 - RNA, 12 nt, Leptospira interrogans serovar lai str. 56601
agaaaaaauuuu

SEQ ID NO: 2765551 - RNA, 18 nt, Leptospira interrogans serovar lai str. 56601
agaaaaaauuuuucuuaa

SEQ ID NO: 2765552 - RNA, 18 nt, Leptospira interrogans serovar lai str. 56601
agaaaaacagguaaaccu

SEQ ID NO: 2765553 - RNA, 15 nt, Leptospira interrogans serovar lai str. 56601
agaaaaacuagggaa

SEQ ID NO: 2765554 - RNA, 13 nt, Leptospira interrogans serovar lai str. 56601
agaaaaagcacaa

SEQ ID NO: 2765555 - RNA, 14 nt, Leptospira interrogans serovar lai str. 56601
agaaaaagugaauu

SEQ ID NO: 2765556 - RNA, 13 nt, Leptospira interrogans serovar lai str. 56601
agaaaaaugaauu

SEQ ID NO: 2765557 - RNA, 16 nt, Leptospira interrogans serovar lai str. 56601
agaaaaaugaauuccu

SEQ ID NO: 2765558 - RNA, 22 nt, Leptospira interrogans serovar lai str. 56601
agaaaaauugaaaggaagaucg

SEQ ID NO: 2765559 - RNA, 15 nt, Leptospira interrogans serovar lai str. 56601
agaaaaauuuuccga

SEQ ID NO: 2765560 - RNA, 20 nt, Leptospira interrogans serovar lai str. 56601
agaaaacagaauguauuaaa

SEQ ID NO: 2765561 - RNA, 13 nt, Leptospira interrogans serovar lai str. 56601
agaaaaccaaaua

SEQ ID NO: 2765562 - RNA, 15 nt, Leptospira interrogans serovar lai str. 56601
agaaaaccaaauaau

SEQ ID NO: 2765563 - RNA, 17 nt, Leptospira interrogans serovar lai str. 56601
agaaaaccaaauaauaa

SEQ ID NO: 2765564 - RNA, 19 nt, Leptospira interrogans serovar lai str. 56601
agaaaaccuuuccccccac

SEQ ID NO: 2765565 - RNA, 18 nt, Leptospira interrogans serovar lai str. 56601
agaaaacucaaaucuaca

SEQ ID NO: 2765566 - RNA, 19 nt, Leptospira interrogans serovar lai str. 56601
agaaaacucaaaucuacaa

SEQ ID NO: 2765567 - RNA, 16 nt, Leptospira interrogans serovar lai str. 56601
agaaaaguguuuuuca

SEQ ID NO: 2765568 - RNA, 17 nt, Leptospira interrogans serovar lai str. 56601
agaaaaguguuuuucac

SEQ ID NO: 2765569 - RNA, 14 nt, Leptospira interrogans serovar lai str. 56601
agaaaauaaaaaau

SEQ ID NO: 2765570 - RNA, 15 nt, Leptospira interrogans serovar lai str. 56601
agaaaauaauaauau

SEQ ID NO: 2765571 - RNA, 12 nt, Leptospira interrogans serovar lai str. 56601
agaaaauccagu

SEQ ID NO: 2765572 - RNA, 23 nt, Leptospira interrogans serovar lai str. 56601
agaaaaugugagagaggauacua

SEQ ID NO: 2765573 - RNA, 17 nt, Leptospira interrogans serovar lai str. 56601
agaaaauuagaaagaau

SEQ ID NO: 2765574 - RNA, 16 nt, Leptospira interrogans serovar lai str. 56601
agaaaauuagaaagcg

SEQ ID NO: 2765575 - RNA, 22 nt, Leptospira interrogans serovar lai str. 56601
agaacaacccccguuauuaaaa

SEQ ID NO: 2765576 - RNA, 23 nt, Leptospira interrogans serovar lai str. 56601
agaacaacccccguuauuaaaau

SEQ ID NO: 2765577 - RNA, 17 nt, Leptospira interrogans serovar lai str. 56601
agaacaauuuaaaauaa

SEQ ID NO: 2765578 - RNA, 20 nt, Leptospira interrogans serovar lai str. 56601
agaacaauuuaaaauaauug

SEQ ID NO: 2765579 - RNA, 17 nt, Leptospira interrogans serovar lai str. 56601
agaacacugcauuuuau

SEQ ID NO: 2765580 - RNA, 22 nt, Leptospira interrogans serovar lai str. 56601
agaacacugcauuuuauuaaaa

SEQ ID NO: 2765581 - RNA, 23 nt, Leptospira interrogans serovar lai str. 56601
agaacacugcauuuuauuaaaaa

SEQ ID NO: 2765582 - RNA, 22 nt, Leptospira interrogans serovar lai str. 56601
agaacaucaauuuuauuucuaa

SEQ ID NO: 2765583 - RNA, 16 nt, Leptospira interrogans serovar lai str. 56601
agaacccaauaaaaac

SEQ ID NO: 2765584 - RNA, 16 nt, Leptospira interrogans serovar lai str. 56601
agaaccguaacugaca

SEQ ID NO: 2765585 - RNA, 13 nt, Leptospira interrogans serovar lai str. 56601
agaaccuaaaaau

SEQ ID NO: 2765586 - RNA, 17 nt, Leptospira interrogans serovar lai str. 56601
agaaccuaauguugaau

SEQ ID NO: 2765587 - RNA, 13 nt, Leptospira interrogans serovar lai str. 56601
agaaccuggaaaa

SEQ ID NO: 2765588 - RNA, 15 nt, Leptospira interrogans serovar lai str. 56601
agaaccuggaaaaga

SEQ ID NO: 2765589 - RNA, 21 nt, Leptospira interrogans serovar lai str. 56601
agaaccuuuaguuuccaaaaa

SEQ ID NO: 2765590 - RNA, 19 nt, Leptospira interrogans serovar lai str. 56601
agaacgaauugcacauaaa

SEQ ID NO: 2765591 - RNA, 20 nt, Leptospira interrogans serovar lai str. 56601
agaacgaauugcacauaaaa

SEQ ID NO: 2765592 - RNA, 19 nt, Leptospira interrogans serovar lai str. 56601
agaacgauccguaaaaauc

SEQ ID NO: 2765593 - RNA, 17 nt, Leptospira interrogans serovar lai str. 56601
agaacgauuuuuuacaa

SEQ ID NO: 2765594 - RNA, 20 nt, Leptospira interrogans serovar lai str. 56601
agaacgauuuuuuacaaaag

SEQ ID NO: 2765595 - RNA, 14 nt, Leptospira interrogans serovar lai str. 56601
agaacgcaaucugu

SEQ ID NO: 2765596 - RNA, 23 nt, Leptospira interrogans serovar lai str. 56601
agaacgcgaacuuuuuuauaaau

SEQ ID NO: 2765597 - RNA, 16 nt, Leptospira interrogans serovar lai str. 56601
agaacgggcuuucuau

SEQ ID NO: 2765598 - RNA, 17 nt, Leptospira interrogans serovar lai str. 56601
agaacguuuugcuaaaa

SEQ ID NO: 2765599 - RNA, 15 nt, Leptospira interrogans serovar lai str. 56601
agaacuacuuuuaua

SEQ ID NO: 2765600 - RNA, 16 nt, Leptospira interrogans serovar lai str. 56601
agaacuacuuuuauaa

SEQ ID NO: 2765601 - RNA, 17 nt, Leptospira interrogans serovar lai str. 56601
agaacuacuuuuauaaa

SEQ ID NO: 2765602 - RNA, 23 nt, Leptospira interrogans serovar lai str. 56601
agaacuacuuuuauaaaaaguuu

SEQ ID NO: 2765603 - RNA, 17 nt, Leptospira interrogans serovar lai str. 56601
agaacuagaaagaccuu

SEQ ID NO: 2765604 - RNA, 14 nt, Leptospira interrogans serovar lai str. 56601
agaacucacguuaa

SEQ ID NO: 2765605 - RNA, 13 nt, Leptospira interrogans serovar lai str. 56601
agaacucauucaa

SEQ ID NO: 2765606 - RNA, 15 nt, Leptospira interrogans serovar lai str. 56601
agaacuggauucaaa

SEQ ID NO: 2765607 - RNA, 17 nt, Leptospira interrogans serovar lai str. 56601
agaacuguugaaaaaau

SEQ ID NO: 2765608 - RNA, 20 nt, Leptospira interrogans serovar lai str. 56601
agaacuuuacagaucgauuc

SEQ ID NO: 2765609 - RNA, 20 nt, Leptospira interrogans serovar lai str. 56601
agaagagccucaaguaaaac

SEQ ID NO: 2765610 - RNA, 16 nt, Leptospira interrogans serovar lai str. 56601
agaagagguucugagu

SEQ ID NO: 2765611 - RNA, 18 nt, Leptospira interrogans serovar lai str. 56601
agaagaguuaagcaaaug

SEQ ID NO: 2765612 - RNA, 16 nt, Leptospira interrogans serovar lai str. 56601
agaagaguugaauauu

SEQ ID NO: 2765613 - RNA, 18 nt, Leptospira interrogans serovar lai str. 56601
agaagaguugaauauuuu

SEQ ID NO: 2765614 - RNA, 15 nt, Leptospira interrogans serovar lai str. 56601
agaagauaaaacuca

SEQ ID NO: 2765615 - RNA, 22 nt, Leptospira interrogans serovar lai str. 56601
agaagauagauuuauaauaaau

SEQ ID NO: 2765616 - RNA, 23 nt, Leptospira interrogans serovar lai str. 56601
agaagaugcucggcuucuucaau

SEQ ID NO: 2765617 - RNA, 13 nt, Leptospira interrogans serovar lai str. 56601
agaagauuuuuac

SEQ ID NO: 2765618 - RNA, 14 nt, Leptospira interrogans serovar lai str. 56601
agaagauuuuuacu

SEQ ID NO: 2765619 - RNA, 16 nt, Leptospira interrogans serovar lai str. 56601
agaagauuuuuacuca

SEQ ID NO: 2765620 - RNA, 20 nt, Leptospira interrogans serovar lai str. 56601
agaagccaauaaccaacccc

SEQ ID NO: 2765621 - RNA, 18 nt, Leptospira interrogans serovar lai str. 56601
agaagccaauuccaaaaa

SEQ ID NO: 2765622 - RNA, 14 nt, Leptospira interrogans serovar lai str. 56601
agaagccuauauuu

SEQ ID NO: 2765623 - RNA, 18 nt, Leptospira interrogans serovar lai str. 56601
agaagccuauauuuugau

SEQ ID NO: 2765624 - RNA, 20 nt, Leptospira interrogans serovar lai str. 56601
agaagccuauauuuugauaa

SEQ ID NO: 2765625 - RNA, 14 nt, Leptospira interrogans serovar lai str. 56601
agaagccugaguuu

SEQ ID NO: 2765626 - RNA, 23 nt, Leptospira interrogans serovar lai str. 56601
agaagccugaguuugagagagag

SEQ ID NO: 2765627 - RNA, 21 nt, Leptospira interrogans serovar lai str. 56601
agaagcuuuauuaaauuauau

SEQ ID NO: 2765628 - RNA, 23 nt, Leptospira interrogans serovar lai str. 56601
agaagcuuuuaguuguacaaaaa

SEQ ID NO: 2765629 - RNA, 17 nt, Leptospira interrogans serovar lai str. 56601
agaagggugaauuuuuu

SEQ ID NO: 2765630 - RNA, 11 nt, Leptospira interrogans serovar lai str. 56601
agaaguauucc

SEQ ID NO: 2765631 - RNA, 19 nt, Leptospira interrogans serovar lai str. 56601
agaaguuguaucagauguu

SEQ ID NO: 2765632 - RNA, 21 nt, Leptospira interrogans serovar lai str. 56601
agaauaaauacauacaaugaa

SEQ ID NO: 2765633 - RNA, 13 nt, Leptospira interrogans serovar lai str. 56601
agaauaaauuaua

SEQ ID NO: 2765634 - RNA, 15 nt, Leptospira interrogans serovar lai str. 56601
agaauaauaaucuua

SEQ ID NO: 2765635 - RNA, 22 nt, Leptospira interrogans serovar lai str. 56601
agaauaauaauuuuagaauauu

SEQ ID NO: 2765636 - RNA, 15 nt, Leptospira interrogans serovar lai str. 56601
agaauaauauuuuaa

SEQ ID NO: 2765637 - RNA, 16 nt, Leptospira interrogans serovar lai str. 56601
agaauaauuuaaacuu

SEQ ID NO: 2765638 - RNA, 15 nt, Leptospira interrogans serovar lai str. 56601
agaauaccaaaaaag

SEQ ID NO: 2765639 - RNA, 17 nt, Leptospira interrogans serovar lai str. 56601
agaauagagucuuuaaa

SEQ ID NO: 2765640 - RNA, 19 nt, Leptospira interrogans serovar lai str. 56601
agaauaguaguuuucacua

SEQ ID NO: 2765641 - RNA, 13 nt, Leptospira interrogans serovar lai str. 56601
agaauauaaaauc

SEQ ID NO: 2765642 - RNA, 14 nt, Leptospira interrogans serovar lai str. 56601
agaauauaaaaucu

SEQ ID NO: 2765643 - RNA, 12 nt, Leptospira interrogans serovar lai str. 56601
agaauauaagau

SEQ ID NO: 2765644 - RNA, 19 nt, Leptospira interrogans serovar lai str. 56601
agaauauaauaauuguuga

SEQ ID NO: 2765645 - RNA, 20 nt, Leptospira interrogans serovar lai str. 56601
agaauaucugcaaaauaaca

SEQ ID NO: 2765646 - RNA, 18 nt, Leptospira interrogans serovar lai str. 56601
agaauaucuuaauauaau

SEQ ID NO: 2765647 - RNA, 12 nt, Leptospira interrogans serovar lai str. 56601
agaauaugaaua

SEQ ID NO: 2765648 - RNA, 14 nt, Leptospira interrogans serovar lai str. 56601
agaauauuauaaau

SEQ ID NO: 2765649 - RNA, 13 nt, Leptospira interrogans serovar lai str. 56601
agaauauuaugaa

SEQ ID NO: 2765650 - RNA, 21 nt, Leptospira interrogans serovar lai str. 56601
agaauauuuucucaguaaaau

SEQ ID NO: 2765651 - RNA, 20 nt, Leptospira interrogans serovar lai str. 56601
agaaucaaaaugaacucaac

SEQ ID NO: 2765652 - RNA, 15 nt, Leptospira interrogans serovar lai str. 56601
agaaucaaaggaaau

SEQ ID NO: 2765653 - RNA, 19 nt, Leptospira interrogans serovar lai str. 56601
agaaucaagagaacucauu

SEQ ID NO: 2765654 - RNA, 17 nt, Leptospira interrogans serovar lai str. 56601
agaaucagaaugaacuc

SEQ ID NO: 2765655 - RNA, 19 nt, Leptospira interrogans serovar lai str. 56601
agaaucaucucaaaaauag

SEQ ID NO: 2765656 - RNA, 17 nt, Leptospira interrogans serovar lai str. 56601
agaaucaucuugcucua

SEQ ID NO: 2765657 - RNA, 23 nt, Leptospira interrogans serovar lai str. 56601
agaaucauuaaucagauuuuugc

SEQ ID NO: 2765658 - RNA, 14 nt, Leptospira interrogans serovar lai str. 56601
agacauaaaaaaau

SEQ ID NO: 2765659 - RNA, 17 nt, Leptospira interrogans serovar lai str. 56601
agacauaaaaaaauuaa

SEQ ID NO: 2765660 - RNA, 17 nt, Leptospira interrogans serovar lai str. 56601
agacauugaagaaaaaa

SEQ ID NO: 2765661 - RNA, 19 nt, Leptospira interrogans serovar lai str. 56601
agacauugaagaaaaaaag

SEQ ID NO: 2765662 - RNA, 21 nt, Leptospira interrogans serovar lai str. 56601
agacauugaagaaaaaaagau

SEQ ID NO: 2765663 - RNA, 22 nt, Leptospira interrogans serovar lai str. 56601
agacauuguuuuacucuuauuu

SEQ ID NO: 2765664 - RNA, 20 nt, Leptospira interrogans serovar lai str. 56601
agaccaguaguauguuuuuc

SEQ ID NO: 2765665 - RNA, 20 nt, Leptospira interrogans serovar lai str. 56601
agaccagugccauuuuucuu

SEQ ID NO: 2765666 - RNA, 15 nt, Leptospira interrogans serovar lai str. 56601
agaccauuuuccuuc

SEQ ID NO: 2765667 - RNA, 17 nt, Leptospira interrogans serovar lai str. 56601
agacccuaaaaaauuuu

SEQ ID NO: 2765668 - RNA, 14 nt, Leptospira interrogans serovar lai str. 56601
agaccgaacucaca

SEQ ID NO: 2765669 - RNA, 20 nt, Leptospira interrogans serovar lai str. 56601
agaccuaaaauugcaccccu

SEQ ID NO: 2765670 - RNA, 17 nt, Leptospira interrogans serovar lai str. 56601
agaccuaaacccugaga

SEQ ID NO: 2765671 - RNA, 20 nt, Leptospira interrogans serovar lai str. 56601
agaccuuuuagauaaauaca

SEQ ID NO: 2765672 - RNA, 16 nt, Leptospira interrogans serovar lai str. 56601
agacgaaaagaagaag

SEQ ID NO: 2765673 - RNA, 15 nt, Leptospira interrogans serovar lai str. 56601
agacgauuccuaaaa

SEQ ID NO: 2765674 - RNA, 22 nt, Leptospira interrogans serovar lai str. 56601
agacgcugaguuugaaagauug

SEQ ID NO: 2765675 - RNA, 22 nt, Leptospira interrogans serovar lai str. 56601
agacguaggaaaugaaaaagaa

SEQ ID NO: 2765676 - RNA, 14 nt, Leptospira interrogans serovar lai str. 56601
agacguaucaaaau

SEQ ID NO: 2765677 - RNA, 15 nt, Leptospira interrogans serovar lai str. 56601
agacguaucaaaaua

SEQ ID NO: 2765678 - RNA, 18 nt, Leptospira interrogans serovar lai str. 56601
agacgucuacagauaaac

SEQ ID NO: 2765679 - RNA, 12 nt, Leptospira interrogans serovar lai str. 56601
agacuaaaaagu

SEQ ID NO: 2765680 - RNA, 18 nt, Leptospira interrogans serovar lai str. 56601
agacuaacgauuguaaaa

SEQ ID NO: 2765681 - RNA, 21 nt, Leptospira interrogans serovar lai str. 56601
agacuaacgauuguaaaaaaa

SEQ ID NO: 2765682 - RNA, 20 nt, Leptospira interrogans serovar lai str. 56601
agacucacaccuucuuuuuu

SEQ ID NO: 2765683 - RNA, 21 nt, Leptospira interrogans serovar lai str. 56601
agacucaguauguuguucucc

SEQ ID NO: 2765684 - RNA, 12 nt, Leptospira interrogans serovar lai str. 56601
agacucauucuu

SEQ ID NO: 2765685 - RNA, 19 nt, Leptospira interrogans serovar lai str. 56601
agacucggaaauucucaaa

SEQ ID NO: 2765686 - RNA, 22 nt, Leptospira interrogans serovar lai str. 56601
agacucggaaauucucaaaaaa

SEQ ID NO: 2765687 - RNA, 17 nt, Leptospira interrogans serovar lai str. 56601
agacucuaguaaagaaa

SEQ ID NO: 2765688 - RNA, 14 nt, Leptospira interrogans serovar lai str. 56601
agacugacugaaaa

SEQ ID NO: 2765689 - RNA, 20 nt, Leptospira interrogans serovar lai str. 56601
agacugacugaaaaaaacgu

SEQ ID NO: 2765690 - RNA, 23 nt, Leptospira interrogans serovar lai str. 56601
agacugauucuuuaaauguggga

SEQ ID NO: 2765691 - RNA, 18 nt, Leptospira interrogans serovar lai str. 56601
agacugauuuuuuaaaug

SEQ ID NO: 2765692 - RNA, 14 nt, Leptospira interrogans serovar lai str. 56601
agacuuucuuugaa

SEQ ID NO: 2765693 - RNA, 16 nt, Leptospira interrogans serovar lai str. 56601
agacuuuucaucauuc

SEQ ID NO: 2765694 - RNA, 19 nt, Leptospira interrogans serovar lai str. 56601
agacuuuuccuaaaauuuu

SEQ ID NO: 2765695 - RNA, 13 nt, Leptospira interrogans serovar lai str. 56601
agagaaaaauuuu

SEQ ID NO: 2765696 - RNA, 14 nt, Leptospira interrogans serovar lai str. 56601
agagaaaagcauuc

SEQ ID NO: 2765697 - RNA, 12 nt, Leptospira interrogans serovar lai str. 56601
agagaaacuuua

SEQ ID NO: 2765698 - RNA, 15 nt, Leptospira interrogans serovar lai str. 56601
agagaaagaaaaaga

SEQ ID NO: 2765699 - RNA, 14 nt, Leptospira interrogans serovar lai str. 56601
agagaaaguaaaga

SEQ ID NO: 2765700 - RNA, 19 nt, Leptospira interrogans serovar lai str. 56601
agagaaauccaaucauaga

SEQ ID NO: 2765701 - RNA, 18 nt, Leptospira interrogans serovar lai str. 56601
agagaacgaugcuugagc

SEQ ID NO: 2765702 - RNA, 23 nt, Leptospira interrogans serovar lai str. 56601
agagaacgcgaacuuuuuuauaa

SEQ ID NO: 2765703 - RNA, 16 nt, Leptospira interrogans serovar lai str. 56601
agagaaguuaaaaaau

SEQ ID NO: 2765704 - RNA, 23 nt, Leptospira interrogans serovar lai str. 56601
agagaauaucugaauuuuuauaa

SEQ ID NO: 2765705 - RNA, 21 nt, Leptospira interrogans serovar lai str. 56601
agagaaucuguuuuguuuccu

SEQ ID NO: 2765706 - RNA, 22 nt, Leptospira interrogans serovar lai str. 56601
agagaaucuguuuuguuuccuu

SEQ ID NO: 2765707 - RNA, 19 nt, Leptospira interrogans serovar lai str. 56601
agagaaugaucaauagaau

SEQ ID NO: 2765708 - RNA, 22 nt, Leptospira interrogans serovar lai str. 56601
agagacauugaagaaaaaaaga

SEQ ID NO: 2765709 - RNA, 15 nt, Leptospira interrogans serovar lai str. 56601
agagacgaauuuuuu

SEQ ID NO: 2765710 - RNA, 21 nt, Leptospira interrogans serovar lai str. 56601
agagagcguuuuacugaguuu

SEQ ID NO: 2765711 - RNA, 13 nt, Leptospira interrogans serovar lai str. 56601
agagagugaaaaa

SEQ ID NO: 2765712 - RNA, 18 nt, Leptospira interrogans serovar lai str. 56601
agagaguucuacugaguu

SEQ ID NO: 2765713 - RNA, 20 nt, Leptospira interrogans serovar lai str. 56601
agagauauagaaauuuucaa

SEQ ID NO: 2765714 - RNA, 15 nt, Leptospira interrogans serovar lai str. 56601
agagaugguuuagaa

SEQ ID NO: 2765715 - RNA, 18 nt, Leptospira interrogans serovar lai str. 56601
agagaugugaguuuuaaa

SEQ ID NO: 2765716 - RNA, 19 nt, Leptospira interrogans serovar lai str. 56601
agagaugugaguuuuaaaa

SEQ ID NO: 2765717 - RNA, 14 nt, Leptospira interrogans serovar lai str. 56601
agagauuucugaga

SEQ ID NO: 2765718 - RNA, 16 nt, Leptospira interrogans serovar lai str. 56601
agagccguaaauauuu

SEQ ID NO: 2765719 - RNA, 19 nt, Leptospira interrogans serovar lai str. 56601
agagccuaauccaauaaaa

SEQ ID NO: 2765720 - RNA, 13 nt, Leptospira interrogans serovar lai str. 56601
agagccuuuuuau

SEQ ID NO: 2765721 - RNA, 18 nt, Leptospira interrogans serovar lai str. 56601
agagcgauauaauaaaau

SEQ ID NO: 2765722 - RNA, 14 nt, Leptospira interrogans serovar lai str. 56601
agagcgucuuugaa

SEQ ID NO: 2765723 - RNA, 22 nt, Leptospira interrogans serovar lai str. 56601
agagcuacucgaaaguuuauaa

SEQ ID NO: 2765724 - RNA, 24 nt, Leptospira interrogans serovar lai str. 56601
agagcuggaugaagcuaugaagag

SEQ ID NO: 2765725 - RNA, 17 nt, Leptospira interrogans serovar lai str. 56601
agagcuuaccacaguga

SEQ ID NO: 2765726 - RNA, 14 nt, Leptospira interrogans serovar lai str. 56601
agaggaacaauuug

SEQ ID NO: 2765727 - RNA, 23 nt, Leptospira interrogans serovar lai str. 56601
agagggucuuucgagauuaaaau

SEQ ID NO: 2765728 - RNA, 20 nt, Leptospira interrogans serovar lai str. 56601
agaggucgucucaaaaauau

SEQ ID NO: 2765729 - RNA, 16 nt, Leptospira interrogans serovar lai str. 56601
agaguaccauaaauuu

SEQ ID NO: 2765730 - RNA, 11 nt, Leptospira interrogans serovar lai str. 56601
agaguauuauc

SEQ ID NO: 2765731 - RNA, 14 nt, Leptospira interrogans serovar lai str. 56601
agagucaaaaguuu

SEQ ID NO: 2765732 - RNA, 18 nt, Leptospira interrogans serovar lai str. 56601
agagucaaaucaauuuua

SEQ ID NO: 2765733 - RNA, 22 nt, Leptospira interrogans serovar lai str. 56601
agagucauuuuuaaauacuuuu

SEQ ID NO: 2765734 - RNA, 15 nt, Leptospira interrogans serovar lai str. 56601
agagucguugaaaaa

SEQ ID NO: 2765735 - RNA, 17 nt, Leptospira interrogans serovar lai str. 56601
agagucguugaaaaauu

SEQ ID NO: 2765736 - RNA, 19 nt, Leptospira interrogans serovar lai str. 56601
agagucguugaaaaauuaa

SEQ ID NO: 2765737 - RNA, 21 nt, Leptospira interrogans serovar lai str. 56601
agagucuauaaaauaucuuua

SEQ ID NO: 2765738 - RNA, 16 nt, Leptospira interrogans serovar lai str. 56601
agagucuauauguaaa

SEQ ID NO: 2765739 - RNA, 19 nt, Leptospira interrogans serovar lai str. 56601
agagugcagauuaaaaaau

SEQ ID NO: 2765740 - RNA, 22 nt, Leptospira interrogans serovar lai str. 56601
agagugcucaauccaauauuua

SEQ ID NO: 2765741 - RNA, 18 nt, Leptospira interrogans serovar lai str. 56601
agauuccagcuuuuuuca

SEQ ID NO: 2765742 - RNA, 23 nt, Leptospira interrogans serovar lai str. 56601
agauuccguuuuuauuucuuuug

SEQ ID NO: 2765743 - RNA, 21 nt, Leptospira interrogans serovar lai str. 56601
agauuccuuuuaagaauacug

SEQ ID NO: 2765744 - RNA, 21 nt, Leptospira interrogans serovar lai str. 56601
agauucgaacuuuuuuuagaa

SEQ ID NO: 2765745 - RNA, 15 nt, Leptospira interrogans serovar lai str. 56601
agauucuaaaaauga

SEQ ID NO: 2765746 - RNA, 16 nt, Leptospira interrogans serovar lai str. 56601
agauucuaauuuuuca

SEQ ID NO: 2765747 - RNA, 19 nt, Leptospira interrogans serovar lai str. 56601
agauucuaauuuuucaaaa

SEQ ID NO: 2765748 - RNA, 16 nt, Leptospira interrogans serovar lai str. 56601
agauucuauuuucuuu

SEQ ID NO: 2765749 - RNA, 23 nt, Leptospira interrogans serovar lai str. 56601
agauucuauuuugagaaaaucca

SEQ ID NO: 2765750 - RNA, 12 nt, Leptospira interrogans serovar lai str. 56601
agauucuugaua

SEQ ID NO: 2765751 - RNA, 14 nt, Leptospira interrogans serovar lai str. 56601
agauugaaugaaau

SEQ ID NO: 2765752 - RNA, 22 nt, Leptospira interrogans serovar lai str. 56601
agauugauauucaaauuuacuc

SEQ ID NO: 2765753 - RNA, 14 nt, Leptospira interrogans serovar lai str. 56601
agauugauucuuua

SEQ ID NO: 2765754 - RNA, 13 nt, Leptospira interrogans serovar lai str. 56601
agauugauuuaaa

SEQ ID NO: 2765755 - RNA, 20 nt, Leptospira interrogans serovar lai str. 56601
agauugauuuaaauguggga

SEQ ID NO: 2765756 - RNA, 14 nt, Leptospira interrogans serovar lai str. 56601
agauugauuuuaau

SEQ ID NO: 2765757 - RNA, 19 nt, Leptospira interrogans serovar lai str. 56601
agauugauuuuaauuuguu

SEQ ID NO: 2765758 - RNA, 23 nt, Leptospira interrogans serovar lai str. 56601
agauugauuuuuuaaauguggga

SEQ ID NO: 2765759 - RNA, 15 nt, Leptospira interrogans serovar lai str. 56601
agauugcuuuuuaaa

SEQ ID NO: 2765760 - RNA, 14 nt, Leptospira interrogans serovar lai str. 56601
agauuguaaguuuu

SEQ ID NO: 2765761 - RNA, 15 nt, Leptospira interrogans serovar lai str. 56601
agauuguaaguuuuu

SEQ ID NO: 2765762 - RNA, 16 nt, Leptospira interrogans serovar lai str. 56601
agauuguaaguuuuug

SEQ ID NO: 2765763 - RNA, 14 nt, Leptospira interrogans serovar lai str. 56601
agauuuaauuuuuc

SEQ ID NO: 2765764 - RNA, 15 nt, Leptospira interrogans serovar lai str. 56601
agauuuaauuuuucu

SEQ ID NO: 2765765 - RNA, 16 nt, Leptospira interrogans serovar lai str. 56601
agauuuagauucuaaa

SEQ ID NO: 2765766 - RNA, 20 nt, Leptospira interrogans serovar lai str. 56601
agauuuauauguuucuuuug

SEQ ID NO: 2765767 - RNA, 19 nt, Leptospira interrogans serovar lai str. 56601
agauuuauauugagaucaa

SEQ ID NO: 2765768 - RNA, 17 nt, Leptospira interrogans serovar lai str. 56601
agauuuaugacagcuug

SEQ ID NO: 2765769 - RNA, 14 nt, Leptospira interrogans serovar lai str. 56601
agauuuauugaaaa

SEQ ID NO: 2765770 - RNA, 18 nt, Leptospira interrogans serovar lai str. 56601
agauuuauugaaaaauag

SEQ ID NO: 2765771 - RNA, 18 nt, Leptospira interrogans serovar lai str. 56601
agauuucagcuccaaaaa

SEQ ID NO: 2765772 - RNA, 19 nt, Leptospira interrogans serovar lai str. 56601
agauuucguucggaaaaag

SEQ ID NO: 2765773 - RNA, 20 nt, Leptospira interrogans serovar lai str. 56601
agauuucguucggaaaaagu

SEQ ID NO: 2765774 - RNA, 18 nt, Leptospira interrogans serovar lai str. 56601
agauuucuauauucaaaa

SEQ ID NO: 2765775 - RNA, 20 nt, Leptospira interrogans serovar lai str. 56601
agauuugauguaaagaaaac

SEQ ID NO: 2765776 - RNA, 21 nt, Leptospira interrogans serovar lai str. 56601
agauuuggugauuuaaaaaua

SEQ ID NO: 2765777 - RNA, 22 nt, Leptospira interrogans serovar lai str. 56601
agauuuggugauuuaaaaauag

SEQ ID NO: 2765778 - RNA, 13 nt, Leptospira interrogans serovar lai str. 56601
agauuuguaaaau

SEQ ID NO: 2765779 - RNA, 17 nt, Leptospira interrogans serovar lai str. 56601
agauuugucucaaaauu

SEQ ID NO: 2765780 - RNA, 19 nt, Leptospira interrogans serovar lai str. 56601
agauuugucucaaaauuua

SEQ ID NO: 2765781 - RNA, 20 nt, Leptospira interrogans serovar lai str. 56601
agauuugucucaaaauuuaa

SEQ ID NO: 2765782 - RNA, 16 nt, Leptospira interrogans serovar lai str. 56601
agauuuguguuaguuc

SEQ ID NO: 2765783 - RNA, 17 nt, Leptospira interrogans serovar lai str. 56601
agauuuguguuaguucc

SEQ ID NO: 2765784 - RNA, 23 nt, Leptospira interrogans serovar lai str. 56601
agauuuguguuaguucccacauu

SEQ ID NO: 2765785 - RNA, 18 nt, Leptospira interrogans serovar lai str. 56601
agauuuguugaaaaguga

SEQ ID NO: 2765786 - RNA, 19 nt, Leptospira interrogans serovar lai str. 56601
agauuuguugaaaagugag

SEQ ID NO: 2765787 - RNA, 16 nt, Leptospira interrogans serovar lai str. 56601
agauuuuaaaaauuca

SEQ ID NO: 2765788 - RNA, 20 nt, Leptospira interrogans serovar lai str. 56601
agauuuuaaaaauucaacua

SEQ ID NO: 2765789 - RNA, 19 nt, Leptospira interrogans serovar lai str. 56601
agauuuuacgaacaaauuc

SEQ ID NO: 2765790 - RNA, 21 nt, Leptospira interrogans serovar lai str. 56601
agauuuuacgauuaaauuuug

SEQ ID NO: 2765791 - RNA, 14 nt, Leptospira interrogans serovar lai str. 56601
agauuuuagaauca

SEQ ID NO: 2765792 - RNA, 18 nt, Leptospira interrogans serovar lai str. 56601
agauuuuagaaucagaau

SEQ ID NO: 2765793 - RNA, 22 nt, Leptospira interrogans serovar lai str. 56601
agauuuuauuuugauuccaaag

SEQ ID NO: 2765794 - RNA, 18 nt, Leptospira interrogans serovar lai str. 56601
agauuuucuaagaaucug

SEQ ID NO: 2765795 - RNA, 18 nt, Leptospira interrogans serovar lai str. 56601
agauuuucucaaaaaaag

SEQ ID NO: 2765796 - RNA, 21 nt, Leptospira interrogans serovar lai str. 56601
agauuuucucaaaaaaaguaa

SEQ ID NO: 2765797 - RNA, 15 nt, Leptospira interrogans serovar lai str. 56601
agauuuugcacaaaa

SEQ ID NO: 2765798 - RNA, 21 nt, Leptospira interrogans serovar lai str. 56601
agauuuugcacguaaacauuc

SEQ ID NO: 2765799 - RNA, 18 nt, Leptospira interrogans serovar lai str. 56601
agauuuugggacaagcuu

SEQ ID NO: 2765800 - RNA, 15 nt, Leptospira interrogans serovar lai str. 56601
agauuuuuaucgauu

SEQ ID NO: 2765801 - RNA, 14 nt, Leptospira interrogans serovar lai str. 56601
agauuuuucaaucu

SEQ ID NO: 2765802 - RNA, 17 nt, Leptospira interrogans serovar lai str. 56601
agauuuuucuuuaaacc

SEQ ID NO: 2765803 - RNA, 15 nt, Leptospira interrogans serovar lai str. 56601
agcaaaaauaaagua

SEQ ID NO: 2765804 - RNA, 12 nt, Leptospira interrogans serovar lai str. 56601
agcaaaaauuuu

SEQ ID NO: 2765805 - RNA, 18 nt, Leptospira interrogans serovar lai str. 56601
agcaaaaauuuucuaaaa

SEQ ID NO: 2765806 - RNA, 19 nt, Leptospira interrogans serovar lai str. 56601
agcaaacuuuuuauaaaaa

SEQ ID NO: 2765807 - RNA, 20 nt, Leptospira interrogans serovar lai str. 56601
agcaaacuuuuuauaaaaag

SEQ ID NO: 2765808 - RNA, 16 nt, Leptospira interrogans serovar lai str. 56601
agcaaaggaucaaauc

SEQ ID NO: 2765809 - RNA, 19 nt, Leptospira interrogans serovar lai str. 56601
agcaaaguuacuucccuuc

SEQ ID NO: 2765810 - RNA, 19 nt, Leptospira interrogans serovar lai str. 56601
agcaaaguuucuuauauaa

SEQ ID NO: 2765811 - RNA, 18 nt, Leptospira interrogans serovar lai str. 56601
agcaaauaacgauuccau

SEQ ID NO: 2765812 - RNA, 18 nt, Leptospira interrogans serovar lai str. 56601
agcaaauaccaaaccucu

SEQ ID NO: 2765813 - RNA, 18 nt, Leptospira interrogans serovar lai str. 56601
agcaaauucugauuuuac

SEQ ID NO: 2765814 - RNA, 19 nt, Leptospira interrogans serovar lai str. 56601
agcaaauucugauuuuaca

SEQ ID NO: 2765815 - RNA, 22 nt, Leptospira interrogans serovar lai str. 56601
agcaaauucugauuuuacagac

SEQ ID NO: 2765816 - RNA, 13 nt, Leptospira interrogans serovar lai str. 56601
agcaacuguggga

SEQ ID NO: 2765817 - RNA, 22 nt, Leptospira interrogans serovar lai str. 56601
agcaagaccuuguguuucagac

SEQ ID NO: 2765818 - RNA, 20 nt, Leptospira interrogans serovar lai str. 56601
agcaagcacauccgcauucu

SEQ ID NO: 2765819 - RNA, 16 nt, Leptospira interrogans serovar lai str. 56601
agcaauaaaaucaaua

SEQ ID NO: 2765820 - RNA, 21 nt, Leptospira interrogans serovar lai str. 56601
agcaaucuguuuagaauauuu

SEQ ID NO: 2765821 - RNA, 23 nt, Leptospira interrogans serovar lai str. 56601
agcaaucuguuuagaauauuuuc

SEQ ID NO: 2765822 - RNA, 23 nt, Leptospira interrogans serovar lai str. 56601
agcaaucuuccugggaaguugua

SEQ ID NO: 2765823 - RNA, 16 nt, Leptospira interrogans serovar lai str. 56601
agcuuuuuucagaauc

SEQ ID NO: 2765824 - RNA, 18 nt, Leptospira interrogans serovar lai str. 56601
aggaaaauuuaacaacau

SEQ ID NO: 2765825 - RNA, 22 nt, Leptospira interrogans serovar lai str. 56601
aggaaacgaguguuucaugucc

SEQ ID NO: 2765826 - RNA, 14 nt, Leptospira interrogans serovar lai str. 56601
aggaaacguauuuu

SEQ ID NO: 2765827 - RNA, 20 nt, Leptospira interrogans serovar lai str. 56601
aggaaauaauuccuccauga

SEQ ID NO: 2765828 - RNA, 20 nt, Leptospira interrogans serovar lai str. 56601
aggaaauucuaugucgaaau

SEQ ID NO: 2765829 - RNA, 13 nt, Leptospira interrogans serovar lai str. 56601
aggaaauuuuguu

SEQ ID NO: 2765830 - RNA, 13 nt, Leptospira interrogans serovar lai str. 56601
aggaacacaugau

SEQ ID NO: 2765831 - RNA, 18 nt, Leptospira interrogans serovar lai str. 56601
aggaaccaucaccaaccc

SEQ ID NO: 2765832 - RNA, 20 nt, Leptospira interrogans serovar lai str. 56601
aggaacccauacaaaauuua

SEQ ID NO: 2765833 - RNA, 13 nt, Leptospira interrogans serovar lai str. 56601
aggaacuacuacu

SEQ ID NO: 2765834 - RNA, 20 nt, Leptospira interrogans serovar lai str. 56601
aggaacuacuacuuuuagaa

SEQ ID NO: 2765835 - RNA, 15 nt, Leptospira interrogans serovar lai str. 56601
aggaacuacugcauu

SEQ ID NO: 2765836 - RNA, 20 nt, Leptospira interrogans serovar lai str. 56601
aggaacucauacuucuaaaa

SEQ ID NO: 2765837 - RNA, 21 nt, Leptospira interrogans serovar lai str. 56601
aggaacucuuacuuugagaaa

SEQ ID NO: 2765838 - RNA, 17 nt, Leptospira interrogans serovar lai str. 56601
aggaacugcuuccaaaa

SEQ ID NO: 2765839 - RNA, 17 nt, Leptospira interrogans serovar lai str. 56601
aggaagugaaauugagu

SEQ ID NO: 2765840 - RNA, 15 nt, Leptospira interrogans serovar lai str. 56601
aggaauacaauugau

SEQ ID NO: 2765841 - RNA, 21 nt, Leptospira interrogans serovar lai str. 56601
aggaauacaauugauuuaaaa

SEQ ID NO: 2765842 - RNA, 23 nt, Leptospira interrogans serovar lai str. 56601
aggaauagucaaugguugcaaaa

SEQ ID NO: 2765843 - RNA, 14 nt, Leptospira interrogans serovar lai str. 56601
aggaauccaugauu

SEQ ID NO: 2765844 - RNA, 15 nt, Leptospira interrogans serovar lai str. 56601
aggaaucguuuguaa

SEQ ID NO: 2765845 - RNA, 22 nt, Leptospira interrogans serovar lai str. 56601
aggaauuuccgauaaagaaagu

SEQ ID NO: 2765846 - RNA, 15 nt, Leptospira interrogans serovar lai str. 56601
aggaauuuuuaaaaa

SEQ ID NO: 2765847 - RNA, 16 nt, Leptospira interrogans serovar lai str. 56601
aggaauuuuuaaaaag

SEQ ID NO: 2765848 - RNA, 17 nt, Leptospira interrogans serovar lai str. 56601
aggaauuuuuaaaaaga

SEQ ID NO: 2765849 - RNA, 19 nt, Leptospira interrogans serovar lai str. 56601
aggaccgcagacuguauca

SEQ ID NO: 2765850 - RNA, 16 nt, Leptospira interrogans serovar lai str. 56601
aggaccugcuuugguu

SEQ ID NO: 2765851 - RNA, 15 nt, Leptospira interrogans serovar lai str. 56601
aggacggauuuuaga

SEQ ID NO: 2765852 - RNA, 19 nt, Leptospira interrogans serovar lai str. 56601
aggaguauaagucgaucua

SEQ ID NO: 2765853 - RNA, 19 nt, Leptospira interrogans serovar lai str. 56601
aggaguccaugauucugaa

SEQ ID NO: 2765854 - RNA, 11 nt, Leptospira interrogans serovar lai str. 56601
aggaguuccua

SEQ ID NO: 2765855 - RNA, 16 nt, Leptospira interrogans serovar lai str. 56601
aggauaaaacggauuu

SEQ ID NO: 2765856 - RNA, 23 nt, Leptospira interrogans serovar lai str. 56601
aggauaacccucaucagucauua

SEQ ID NO: 2765857 - RNA, 20 nt, Leptospira interrogans serovar lai str. 56601
aggauccaauacaaaacaag

SEQ ID NO: 2765858 - RNA, 21 nt, Leptospira interrogans serovar lai str. 56601
aggaucuccuugaaucaaaua

SEQ ID NO: 2765859 - RNA, 20 nt, Leptospira interrogans serovar lai str. 56601
aggaugaauugcuaaaaaag

SEQ ID NO: 2765860 - RNA, 19 nt, Leptospira interrogans serovar lai str. 56601
aggauuacuaaugcaaucc

SEQ ID NO: 2765861 - RNA, 21 nt, Leptospira interrogans serovar lai str. 56601
aggauuccauugauuuucauu

SEQ ID NO: 2765862 - RNA, 12 nt, Leptospira interrogans serovar lai str. 56601
aggauuccauuu

SEQ ID NO: 2765863 - RNA, 16 nt, Leptospira interrogans serovar lai str. 56601
aggauuccauuucauu

SEQ ID NO: 2765864 - RNA, 16 nt, Leptospira interrogans serovar lai str. 56601
aggauuccuuuccgau

SEQ ID NO: 2765865 - RNA, 22 nt, Leptospira interrogans serovar lai str. 56601
aggauuccuuuccgauuucuuu

SEQ ID NO: 2765866 - RNA, 15 nt, Leptospira interrogans serovar lai str. 56601
aggauuggcauucaa

SEQ ID NO: 2765867 - RNA, 19 nt, Leptospira interrogans serovar lai str. 56601
aggauuuuuggaauaaaau

SEQ ID NO: 2765868 - RNA, 22 nt, Leptospira interrogans serovar lai str. 56601
aggcaaacuuuuuuagcaaaua

SEQ ID NO: 2765869 - RNA, 15 nt, Leptospira interrogans serovar lai str. 56601
aggcaauauuauuuu

SEQ ID NO: 2765870 - RNA, 21 nt, Leptospira interrogans serovar lai str. 56601
aggcaauuuagaauaaagaga

SEQ ID NO: 2765871 - RNA, 22 nt, Leptospira interrogans serovar lai str. 56601
aggcaauuuagaauaaagagaa

SEQ ID NO: 2765872 - RNA, 23 nt, Leptospira interrogans serovar lai str. 56601
aggcaauuuagaauaaagagaag

SEQ ID NO: 2765873 - RNA, 14 nt, Leptospira interrogans serovar lai str. 56601
aggcacauuuuuca

SEQ ID NO: 2765874 - RNA, 15 nt, Leptospira interrogans serovar lai str. 56601
aggcacauuuuucaa

SEQ ID NO: 2765875 - RNA, 15 nt, Leptospira interrogans serovar lai str. 56601
aggcagcuaagaaaa

SEQ ID NO: 2765876 - RNA, 18 nt, Leptospira interrogans serovar lai str. 56601
aggcauaugaaaauaaua

SEQ ID NO: 2765877 - RNA, 15 nt, Leptospira interrogans serovar lai str. 56601
aggcaucauucuuua

SEQ ID NO: 2765878 - RNA, 17 nt, Leptospira interrogans serovar lai str. 56601
aggcccgaauuuuaaau

SEQ ID NO: 2765879 - RNA, 15 nt, Leptospira interrogans serovar lai str. 56601
aggcgauuuuacaaa

SEQ ID NO: 2765880 - RNA, 21 nt, Leptospira interrogans serovar lai str. 56601
aggcgguaaaacaaaaaaaca

SEQ ID NO: 2765881 - RNA, 22 nt, Leptospira interrogans serovar lai str. 56601
aggcugccgcucuuucuuccgg

SEQ ID NO: 2765882 - RNA, 21 nt, Leptospira interrogans serovar lai str. 56601
aggcugcgaccuguagagaag

SEQ ID NO: 2765883 - RNA, 16 nt, Leptospira interrogans serovar lai str. 56601
aggcuuaucuguaaaa

SEQ ID NO: 2765884 - RNA, 18 nt, Leptospira interrogans serovar lai str. 56601
aggcuuguuugaauuuuu

SEQ ID NO: 2765885 - RNA, 19 nt, Leptospira interrogans serovar lai str. 56601
agggaaaacucaacacaac

SEQ ID NO: 2765886 - RNA, 15 nt, Leptospira interrogans serovar lai str. 56601
agggaaaguuuuuua

SEQ ID NO: 2765887 - RNA, 18 nt, Leptospira interrogans serovar lai str. 56601
agggaaaguuuuuuaaaa

SEQ ID NO: 2765888 - RNA, 23 nt, Leptospira interrogans serovar lai str. 56601
agggaagguuuuguaaaaauucu

SEQ ID NO: 2765889 - RNA, 21 nt, Leptospira interrogans serovar lai str. 56601
agggaauucccacauuuucaa

SEQ ID NO: 2765890 - RNA, 14 nt, Leptospira interrogans serovar lai str. 56601
agggaauuugaauu

SEQ ID NO: 2765891 - RNA, 12 nt, Leptospira interrogans serovar lai str. 56601
agggaguuccua

SEQ ID NO: 2765892 - RNA, 20 nt, Leptospira interrogans serovar lai str. 56601
agggaguuuguaaagguaga

SEQ ID NO: 2765893 - RNA, 21 nt, Leptospira interrogans serovar lai str. 56601
agggaucgaucuguaaaaugu

SEQ ID NO: 2765894 - RNA, 22 nt, Leptospira interrogans serovar lai str. 56601
agggccgucuauaaaauucaaa

SEQ ID NO: 2765895 - RNA, 17 nt, Leptospira interrogans serovar lai str. 56601
agggcucgguaaaaaga

SEQ ID NO: 2765896 - RNA, 23 nt, Leptospira interrogans serovar lai str. 56601
aggguuuuuacaauuaaauccac

SEQ ID NO: 2765897 - RNA, 21 nt, Leptospira interrogans serovar lai str. 56601
agguaaaagagacauugaaga

SEQ ID NO: 2765898 - RNA, 21 nt, Leptospira interrogans serovar lai str. 56601
agguaacuaccgcaaaucaca

SEQ ID NO: 2765899 - RNA, 17 nt, Leptospira interrogans serovar lai str. 56601
agguauuuuagagaaac

SEQ ID NO: 2765900 - RNA, 21 nt, Leptospira interrogans serovar lai str. 56601
agguauuuuagagaaacuuua

SEQ ID NO: 2765901 - RNA, 18 nt, Leptospira interrogans serovar lai str. 56601
aggucacauuugauaauu

SEQ ID NO: 2765902 - RNA, 23 nt, Leptospira interrogans serovar lai str. 56601
aggucauuuuucaaauaaagaaa

SEQ ID NO: 2765903 - RNA, 13 nt, Leptospira interrogans serovar lai str. 56601
aggucccacaauc

SEQ ID NO: 2765904 - RNA, 17 nt, Leptospira interrogans serovar lai str. 56601
aggucccacaaucaaga

SEQ ID NO: 2765905 - RNA, 17 nt, Leptospira interrogans serovar lai str. 56601
aguauguuuuucugaua

SEQ ID NO: 2765906 - RNA, 17 nt, Leptospira interrogans serovar lai str. 56601
aguauuaauuuaaucaa

SEQ ID NO: 2765907 - RNA, 20 nt, Leptospira interrogans serovar lai str. 56601
aguauuaauuuaaucaaaau

SEQ ID NO: 2765908 - RNA, 17 nt, Leptospira interrogans serovar lai str. 56601
aguauuauaaauuuuga

SEQ ID NO: 2765909 - RNA, 16 nt, Leptospira interrogans serovar lai str. 56601
aguauucauuuucuau

SEQ ID NO: 2765910 - RNA, 22 nt, Leptospira interrogans serovar lai str. 56601
aguauucucccccaacugaaaa

SEQ ID NO: 2765911 - RNA, 11 nt, Leptospira interrogans serovar lai str. 56601
aguauucuuuc

SEQ ID NO: 2765912 - RNA, 18 nt, Leptospira interrogans serovar lai str. 56601
aguauuguuaagauaaau

SEQ ID NO: 2765913 - RNA, 21 nt, Leptospira interrogans serovar lai str. 56601
aguauuuuauuauauaaccau

SEQ ID NO: 2765914 - RNA, 21 nt, Leptospira interrogans serovar lai str. 56601
aguauuuucgcacauucuaua

SEQ ID NO: 2765915 - RNA, 14 nt, Leptospira interrogans serovar lai str. 56601
aguauuuucuagau

SEQ ID NO: 2765916 - RNA, 18 nt, Leptospira interrogans serovar lai str. 56601
aguauuuugcacugaaau

SEQ ID NO: 2765917 - RNA, 22 nt, Leptospira interrogans serovar lai str. 56601
aguauuuugugacuaauuuugu

SEQ ID NO: 2765918 - RNA, 15 nt, Leptospira interrogans serovar lai str. 56601
agucaaauuuggaaa

SEQ ID NO: 2765919 - RNA, 22 nt, Leptospira interrogans serovar lai str. 56601
agucaaauuuggaaauugugag

SEQ ID NO: 2765920 - RNA, 22 nt, Leptospira interrogans serovar lai str. 56601
agucaacgacucguaauuaaau

SEQ ID NO: 2765921 - RNA, 23 nt, Leptospira interrogans serovar lai str. 56601
agucaaugguugcaaaaaagaaa

SEQ ID NO: 2765922 - RNA, 19 nt, Leptospira interrogans serovar lai str. 56601
agucacauuguguuuuuua

SEQ ID NO: 2765923 - RNA, 21 nt, Leptospira interrogans serovar lai str. 56601
agucagguuuuaucaaauaaa

SEQ ID NO: 2765924 - RNA, 12 nt, Leptospira interrogans serovar lai str. 56601
agucaguuuuuu

SEQ ID NO: 2765925 - RNA, 15 nt, Leptospira interrogans serovar lai str. 56601
agucauacauuuugu

SEQ ID NO: 2765926 - RNA, 23 nt, Leptospira interrogans serovar lai str. 56601
agucauauaaaagugaacagucu

SEQ ID NO: 2765927 - RNA, 12 nt, Leptospira interrogans serovar lai str. 56601
agucauugaagg

SEQ ID NO: 2765928 - RNA, 16 nt, Leptospira interrogans serovar lai str. 56601
agucauuuccuccaaa

SEQ ID NO: 2765929 - RNA, 19 nt, Leptospira interrogans serovar lai str. 56601
agucauuuuuaaauacuuu

SEQ ID NO: 2765930 - RNA, 15 nt, Leptospira interrogans serovar lai str. 56601
aguccaaaacaaagu

SEQ ID NO: 2765931 - RNA, 18 nt, Leptospira interrogans serovar lai str. 56601
aguccaauuuuaaaacca

SEQ ID NO: 2765932 - RNA, 19 nt, Leptospira interrogans serovar lai str. 56601
aguccagagcgguuucaua

SEQ ID NO: 2765933 - RNA, 22 nt, Leptospira interrogans serovar lai str. 56601
aguccaugauucugaaaagaau

SEQ ID NO: 2765934 - RNA, 22 nt, Leptospira interrogans serovar lai str. 56601
agucccaauuccaccuuggaaa

SEQ ID NO: 2765935 - RNA, 19 nt, Leptospira interrogans serovar lai str. 56601
agucccacauuuuugugaa

SEQ ID NO: 2765936 - RNA, 20 nt, Leptospira interrogans serovar lai str. 56601
agucccauuuagcaauuugu

SEQ ID NO: 2765937 - RNA, 14 nt, Leptospira interrogans serovar lai str. 56601
aguccguuccuuua

SEQ ID NO: 2765938 - RNA, 14 nt, Leptospira interrogans serovar lai str. 56601
aguccuuuucuuau

SEQ ID NO: 2765939 - RNA, 20 nt, Leptospira interrogans serovar lai str. 56601
aguccuuuuugagaaacuuc

SEQ ID NO: 2765940 - RNA, 21 nt, Leptospira interrogans serovar lai str. 56601
agucgaaagaauuuuuggaac

SEQ ID NO: 2765941 - RNA, 22 nt, Leptospira interrogans serovar lai str. 56601
agucgcacccccgucuacuuuu

SEQ ID NO: 2765942 - RNA, 19 nt, Leptospira interrogans serovar lai str. 56601
agucguuguauuuuaaaca

SEQ ID NO: 2765943 - RNA, 13 nt, Leptospira interrogans serovar lai str. 56601
agucuaaaaacaa

SEQ ID NO: 2765944 - RNA, 17 nt, Leptospira interrogans serovar lai str. 56601
agucuaaaaacaacuca

SEQ ID NO: 2765945 - RNA, 18 nt, Leptospira interrogans serovar lai str. 56601
agucuaacaguaaaacuu

SEQ ID NO: 2765946 - RNA, 16 nt, Leptospira interrogans serovar lai str. 56601
agucuagaauucuuug

SEQ ID NO: 2765947 - RNA, 13 nt, Leptospira interrogans serovar lai str. 56601
agucuauaaaaua

SEQ ID NO: 2765948 - RNA, 13 nt, Leptospira interrogans serovar lai str. 56601
agucuauuuccca

SEQ ID NO: 2765949 - RNA, 14 nt, Leptospira interrogans serovar lai str. 56601
agucuauuucuaaa

SEQ ID NO: 2765950 - RNA, 22 nt, Leptospira interrogans serovar lai str. 56601
agucucaaaaccuguaaaugaa

SEQ ID NO: 2765951 - RNA, 23 nt, Leptospira interrogans serovar lai str. 56601
agucuccauuaggugcuacugca

SEQ ID NO: 2765952 - RNA, 15 nt, Leptospira interrogans serovar lai str. 56601
agucucuguuuucau

SEQ ID NO: 2765953 - RNA, 18 nt, Leptospira interrogans serovar lai str. 56601
agucugguuuauuuuuga

SEQ ID NO: 2765954 - RNA, 19 nt, Leptospira interrogans serovar lai str. 56601
agucuucuuguaauuuguu

SEQ ID NO: 2765955 - RNA, 13 nt, Leptospira interrogans serovar lai str. 56601
agucuuuaaaaaa

SEQ ID NO: 2765956 - RNA, 15 nt, Leptospira interrogans serovar lai str. 56601
agugaaagauuaaag

SEQ ID NO: 2765957 - RNA, 19 nt, Leptospira interrogans serovar lai str. 56601
agugaaagauuaaagauuu

SEQ ID NO: 2765958 - RNA, 23 nt, Leptospira interrogans serovar lai str. 56601
agugaagauuuguaaaauugcuu

SEQ ID NO: 2765959 - RNA, 15 nt, Leptospira interrogans serovar lai str. 56601
agugaauuuuugugg

SEQ ID NO: 2765960 - RNA, 13 nt, Leptospira interrogans serovar lai str. 56601
agugagguuuugg

SEQ ID NO: 2765961 - RNA, 16 nt, Leptospira interrogans serovar lai str. 56601
agugauaagaaaaauu

SEQ ID NO: 2765962 - RNA, 17 nt, Leptospira interrogans serovar lai str. 56601
agugauaagaaaaauug

SEQ ID NO: 2765963 - RNA, 22 nt, Leptospira interrogans serovar lai str. 56601
agugaucgcguuuaaaccuucu

SEQ ID NO: 2765964 - RNA, 15 nt, Leptospira interrogans serovar lai str. 56601
agugaugaagagaaa

SEQ ID NO: 2765965 - RNA, 17 nt, Leptospira interrogans serovar lai str. 56601
agugaugaagagaaagu

SEQ ID NO: 2765966 - RNA, 15 nt, Leptospira interrogans serovar lai str. 56601
agugcagauuaaaaa

SEQ ID NO: 2765967 - RNA, 21 nt, Leptospira interrogans serovar lai str. 56601
agugcaguaguuccuacaaau

SEQ ID NO: 2765968 - RNA, 20 nt, Leptospira interrogans serovar lai str. 56601
agugcauucgcugaguuuuc

SEQ ID NO: 2765969 - RNA, 16 nt, Leptospira interrogans serovar lai str. 56601
agugccauuuuucuuc

SEQ ID NO: 2765970 - RNA, 20 nt, Leptospira interrogans serovar lai str. 56601
aguggauuuaucaguuaaac

SEQ ID NO: 2765971 - RNA, 14 nt, Leptospira interrogans serovar lai str. 56601
agugggaaggaauu

SEQ ID NO: 2765972 - RNA, 16 nt, Leptospira interrogans serovar lai str. 56601
agugggaaggaauuuc

SEQ ID NO: 2765973 - RNA, 13 nt, Leptospira interrogans serovar lai str. 56601
aguggugaauuuu

SEQ ID NO: 2765974 - RNA, 18 nt, Leptospira interrogans serovar lai str. 56601
agugguuuguaauaguuc

SEQ ID NO: 2765975 - RNA, 13 nt, Leptospira interrogans serovar lai str. 56601
agugguuuucaaa

SEQ ID NO: 2765976 - RNA, 19 nt, Leptospira interrogans serovar lai str. 56601
aguguaaaauuaaaauccu

SEQ ID NO: 2765977 - RNA, 15 nt, Leptospira interrogans serovar lai str. 56601
aguguaauaugaauu

SEQ ID NO: 2765978 - RNA, 16 nt, Leptospira interrogans serovar lai str. 56601
aguguaaucuuauuuu

SEQ ID NO: 2765979 - RNA, 15 nt, Leptospira interrogans serovar lai str. 56601
aguguccauuucaau

SEQ ID NO: 2765980 - RNA, 18 nt, Leptospira interrogans serovar lai str. 56601
aguguuaguucccacauu

SEQ ID NO: 2765981 - RNA, 21 nt, Leptospira interrogans serovar lai str. 56601
aguguuccgacaagaaugagu

SEQ ID NO: 2765982 - RNA, 17 nt, Leptospira interrogans serovar lai str. 56601
aguguuuauaauuuuua

SEQ ID NO: 2765983 - RNA, 21 nt, Leptospira interrogans serovar lai str. 56601
aguuaaaacauuucguuuuua

SEQ ID NO: 2765984 - RNA, 15 nt, Leptospira interrogans serovar lai str. 56601
aguuaaacuuugaaa

SEQ ID NO: 2765985 - RNA, 16 nt, Leptospira interrogans serovar lai str. 56601
aguuaaacuuuguaaa

SEQ ID NO: 2765986 - RNA, 15 nt, Leptospira interrogans serovar lai str. 56601
aguuaaauauaaaag

SEQ ID NO: 2765987 - RNA, 16 nt, Leptospira interrogans serovar lai str. 56601
aguuaaaucaccuuuu

SEQ ID NO: 2765988 - RNA, 22 nt, Leptospira interrogans serovar lai str. 56601
aguucuggguaaaaaaaaauga

SEQ ID NO: 2765989 - RNA, 23 nt, Leptospira interrogans serovar lai str. 56601
aguucuggguaaaaaaaaaugag

SEQ ID NO: 2765990 - RNA, 15 nt, Leptospira interrogans serovar lai str. 56601
aguucuuaaauaaaa

SEQ ID NO: 2765991 - RNA, 19 nt, Leptospira interrogans serovar lai str. 56601
aguucuuaaauaaaauuuu

SEQ ID NO: 2765992 - RNA, 14 nt, Leptospira interrogans serovar lai str. 56601
aguucuucaaaauc

SEQ ID NO: 2765993 - RNA, 13 nt, Leptospira interrogans serovar lai str. 56601
aguucuuuucuua

SEQ ID NO: 2765994 - RNA, 18 nt, Leptospira interrogans serovar lai str. 56601
aguucuuuucuuaaaaaa

SEQ ID NO: 2765995 - RNA, 18 nt, Leptospira interrogans serovar lai str. 56601
aguugaaaguuuuucuuu

SEQ ID NO: 2765996 - RNA, 12 nt, Leptospira interrogans serovar lai str. 56601
aguugaaaucug

SEQ ID NO: 2765997 - RNA, 17 nt, Leptospira interrogans serovar lai str. 56601
aguugaaauucaccuuc

SEQ ID NO: 2765998 - RNA, 20 nt, Leptospira interrogans serovar lai str. 56601
aguugaagcaguuuuguuaa

SEQ ID NO: 2765999 - RNA, 15 nt, Leptospira interrogans serovar lai str. 56601
aguugaaucuauuaa

SEQ ID NO: 2766000 - RNA, 14 nt, Leptospira interrogans serovar lai str. 56601
aguugaguucuucu

SEQ ID NO: 2766001 - RNA, 18 nt, Leptospira interrogans serovar lai str. 56601
aguugauuaugauccaaa

SEQ ID NO: 2766002 - RNA, 15 nt, Leptospira interrogans serovar lai str. 56601
aguugauucuuccua

SEQ ID NO: 2766003 - RNA, 20 nt, Leptospira interrogans serovar lai str. 56601
aguugauuucagaucauaaa

SEQ ID NO: 2766004 - RNA, 17 nt, Leptospira interrogans serovar lai str. 56601
aguugcaaagaagaaau

SEQ ID NO: 2766005 - RNA, 13 nt, Leptospira interrogans serovar lai str. 56601
aguugcuaagaaa

SEQ ID NO: 2766006 - RNA, 21 nt, Leptospira interrogans serovar lai str. 56601
aguugcuaagaaaaaagcagc

SEQ ID NO: 2766007 - RNA, 12 nt, Leptospira interrogans serovar lai str. 56601
aguuggaauuug

SEQ ID NO: 2766008 - RNA, 14 nt, Leptospira interrogans serovar lai str. 56601
aguuguacaaaaau

SEQ ID NO: 2766009 - RNA, 17 nt, Leptospira interrogans serovar lai str. 56601
aguuguacaaaaaugug

SEQ ID NO: 2766010 - RNA, 18 nt, Leptospira interrogans serovar lai str. 56601
aguuguauaacagagugc

SEQ ID NO: 2766011 - RNA, 21 nt, Leptospira interrogans serovar lai str. 56601
aguuguauaacagagugcuca

SEQ ID NO: 2766012 - RNA, 17 nt, Leptospira interrogans serovar lai str. 56601
aguuguuauaaaccaau

SEQ ID NO: 2766013 - RNA, 17 nt, Leptospira interrogans serovar lai str. 56601
aguuguugaaaaauuuc

SEQ ID NO: 2766014 - RNA, 11 nt, Leptospira interrogans serovar lai str. 56601
aguuuaaaaac

SEQ ID NO: 2766015 - RNA, 18 nt, Leptospira interrogans serovar lai str. 56601
aguuuaacgcgaaguauu

SEQ ID NO: 2766016 - RNA, 19 nt, Leptospira interrogans serovar lai str. 56601
aguuuacauaucaauccug

SEQ ID NO: 2766017 - RNA, 18 nt, Leptospira interrogans serovar lai str. 56601
aguuuaccccgaagagcu

SEQ ID NO: 2766018 - RNA, 14 nt, Leptospira interrogans serovar lai str. 56601
aguuuauaaagcaa

SEQ ID NO: 2766019 - RNA, 16 nt, Leptospira interrogans serovar lai str. 56601
aguuuauaaagcaaaa

SEQ ID NO: 2766020 - RNA, 18 nt, Leptospira interrogans serovar lai str. 56601
aguuuauuuuaaaaaaau

SEQ ID NO: 2766021 - RNA, 18 nt, Leptospira interrogans serovar lai str. 56601
aguuucaaacacaaucug

SEQ ID NO: 2766022 - RNA, 16 nt, Leptospira interrogans serovar lai str. 56601
aguuucaaacgcuuuc

SEQ ID NO: 2766023 - RNA, 15 nt, Leptospira interrogans serovar lai str. 56601
aguuucaauuuaaaa

SEQ ID NO: 2766024 - RNA, 13 nt, Leptospira interrogans serovar lai str. 56601
aguuucaucuuug

SEQ ID NO: 2766025 - RNA, 22 nt, Leptospira interrogans serovar lai str. 56601
aguuuccacucuuugacccaua

SEQ ID NO: 2766026 - RNA, 20 nt, Leptospira interrogans serovar lai str. 56601
aguuucuacauuuuugugaa

SEQ ID NO: 2766027 - RNA, 15 nt, Leptospira interrogans serovar lai str. 56601
aguuucucauuuuau

SEQ ID NO: 2766028 - RNA, 16 nt, Leptospira interrogans serovar lai str. 56601
aguuucuugaacucaa

SEQ ID NO: 2766029 - RNA, 14 nt, Leptospira interrogans serovar lai str. 56601
aguuucuuuaaagu

SEQ ID NO: 2766030 - RNA, 22 nt, Leptospira interrogans serovar lai str. 56601
aguuugaaagagcguucugcua

SEQ ID NO: 2766031 - RNA, 13 nt, Leptospira interrogans serovar lai str. 56601
aguuugaaagucu

SEQ ID NO: 2766032 - RNA, 21 nt, Leptospira interrogans serovar lai str. 56601
aguuugacguaaaaaaaucug

SEQ ID NO: 2766033 - RNA, 21 nt, Leptospira interrogans serovar lai str. 56601
aguuugagagagaguucuacu

SEQ ID NO: 2766034 - RNA, 22 nt, Leptospira interrogans serovar lai str. 56601
aguuugaguuucuuuuugauua

SEQ ID NO: 2766035 - RNA, 23 nt, Leptospira interrogans serovar lai str. 56601
aguuuggcguaaaauggaaaaaa

SEQ ID NO: 2766036 - RNA, 19 nt, Leptospira interrogans serovar lai str. 56601
aguuugggcgaauaaaaaa

SEQ ID NO: 2766037 - RNA, 17 nt, Leptospira interrogans serovar lai str. 56601
aguuugguccuuuguga

SEQ ID NO: 2766038 - RNA, 18 nt, Leptospira interrogans serovar lai str. 56601
aguuugugagaguuccca

SEQ ID NO: 2766039 - RNA, 21 nt, Leptospira interrogans serovar lai str. 56601
aguuuguuaucaauagaaaua

SEQ ID NO: 2766040 - RNA, 21 nt, Leptospira interrogans serovar lai str. 56601
aguuuguuccaaaaccucaaa

SEQ ID NO: 2766041 - RNA, 21 nt, Leptospira interrogans serovar lai str. 56601
aguuuuacaaauuaguauuuu

SEQ ID NO: 2766042 - RNA, 18 nt, Leptospira interrogans serovar lai str. 56601
aguuuuacagaagauuuu

SEQ ID NO: 2766043 - RNA, 16 nt, Leptospira interrogans serovar lai str. 56601
aguuuuacuaaaagua

SEQ ID NO: 2766044 - RNA, 22 nt, Leptospira interrogans serovar lai str. 56601
aguuuuaguuuuuauuugauua

SEQ ID NO: 2766045 - RNA, 16 nt, Leptospira interrogans serovar lai str. 56601
aguuuuauccauaaau

SEQ ID NO: 2766046 - RNA, 14 nt, Leptospira interrogans serovar lai str. 56601
aguuuuaugugggu

SEQ ID NO: 2766047 - RNA, 13 nt, Leptospira interrogans serovar lai str. 56601
aguuuucaaaaau

SEQ ID NO: 2766048 - RNA, 22 nt, Leptospira interrogans serovar lai str. 56601
aguuuucaaucgaagaaauaca

SEQ ID NO: 2766049 - RNA, 16 nt, Leptospira interrogans serovar lai str. 56601
aguuuucauuacaaaa

SEQ ID NO: 2766050 - RNA, 14 nt, Leptospira interrogans serovar lai str. 56601
aguuuuccauucuc

SEQ ID NO: 2766051 - RNA, 13 nt, Leptospira interrogans serovar lai str. 56601
aguuuuccuucua

SEQ ID NO: 2766052 - RNA, 17 nt, Leptospira interrogans serovar lai str. 56601
aguuuucucaaaaucuu

SEQ ID NO: 2766053 - RNA, 22 nt, Leptospira interrogans serovar lai str. 56601
aguuuucuuuuuuaucauucuu

SEQ ID NO: 2766054 - RNA, 15 nt, Leptospira interrogans serovar lai str. 56601
aguuuugagauuaca

SEQ ID NO: 2766055 - RNA, 23 nt, Leptospira interrogans serovar lai str. 56601
aguuuugagcauaaaaaaauauu

SEQ ID NO: 2766056 - RNA, 22 nt, Leptospira interrogans serovar lai str. 56601
aguuuugcgggaacucccacaa

SEQ ID NO: 2766057 - RNA, 20 nt, Leptospira interrogans serovar lai str. 56601
aguuuugcuguaaaauuuag

SEQ ID NO: 2766058 - RNA, 14 nt, Leptospira interrogans serovar lai str. 56601
aguuuugucaaucu

SEQ ID NO: 2766059 - RNA, 15 nt, Leptospira interrogans serovar lai str. 56601
aguuuuguuaaccaa

SEQ ID NO: 2766060 - RNA, 20 nt, Leptospira interrogans serovar lai str. 56601
aguuuuguuaaccaaaaauu

SEQ ID NO: 2766061 - RNA, 13 nt, Leptospira interrogans serovar lai str. 56601
aguuuuuaaaaau

SEQ ID NO: 2766062 - RNA, 16 nt, Leptospira interrogans serovar lai str. 56601
aguuuuuaaaaauuuc

SEQ ID NO: 2766063 - RNA, 14 nt, Leptospira interrogans serovar lai str. 56601
aguuuuuaaaucca

SEQ ID NO: 2766064 - RNA, 15 nt, Leptospira interrogans serovar lai str. 56601
aguuuuuaguauucu

SEQ ID NO: 2766065 - RNA, 14 nt, Leptospira interrogans serovar lai str. 56601
aguuuuuauaaaau

SEQ ID NO: 2766066 - RNA, 17 nt, Leptospira interrogans serovar lai str. 56601
aguuuuucaacaacucu

SEQ ID NO: 2766067 - RNA, 15 nt, Leptospira interrogans serovar lai str. 56601
aguuuuucuaaauuu

SEQ ID NO: 2766068 - RNA, 21 nt, Leptospira interrogans serovar lai str. 56601
aguuuuuggccuaaggaucca

SEQ ID NO: 2766069 - RNA, 18 nt, Leptospira interrogans serovar lai str. 56601
aguuuuuguuaucaacuu

SEQ ID NO: 2766070 - RNA, 17 nt, Leptospira interrogans serovar lai str. 56601
aguuuuuuaaaauuaga

SEQ ID NO: 2766071 - RNA, 13 nt, Leptospira interrogans serovar lai str. 56601
auaaaauuuuucu

SEQ ID NO: 2766072 - RNA, 20 nt, Leptospira interrogans serovar lai str. 56601
auaaacagucgcuaaacuca

SEQ ID NO: 2766073 - RNA, 13 nt, Leptospira interrogans serovar lai str. 56601
auaaacauccuca

SEQ ID NO: 2766074 - RNA, 22 nt, Leptospira interrogans serovar lai str. 56601
auaaacgaucauacuuuagaaa

SEQ ID NO: 2766075 - RNA, 13 nt, Leptospira interrogans serovar lai str. 56601
auaaacgauuauu

SEQ ID NO: 2766076 - RNA, 15 nt, Leptospira interrogans serovar lai str. 56601
auaaacgauuauuuu

SEQ ID NO: 2766077 - RNA, 17 nt, Leptospira interrogans serovar lai str. 56601
auaaacgauuauuuuuu

SEQ ID NO: 2766078 - RNA, 21 nt, Leptospira interrogans serovar lai str. 56601
auaaacgauuauuuuuuaaaa

SEQ ID NO: 2766079 - RNA, 23 nt, Leptospira interrogans serovar lai str. 56601
auaaacgauuauuuuuuaaaaau

SEQ ID NO: 2766080 - RNA, 18 nt, Leptospira interrogans serovar lai str. 56601
auaaacguggaaauuacc

SEQ ID NO: 2766081 - RNA, 20 nt, Leptospira interrogans serovar lai str. 56601
auaaacuucuauuuuauaaa

SEQ ID NO: 2766082 - RNA, 17 nt, Leptospira interrogans serovar lai str. 56601
auaaacuucucuuaaaa

SEQ ID NO: 2766083 - RNA, 22 nt, Leptospira interrogans serovar lai str. 56601
auaaacuucucuuaaaauuuag

SEQ ID NO: 2766084 - RNA, 13 nt, Leptospira interrogans serovar lai str. 56601
auaaagaaaaccu

SEQ ID NO: 2766085 - RNA, 15 nt, Leptospira interrogans serovar lai str. 56601
auaaagaaaaccuuu

SEQ ID NO: 2766086 - RNA, 14 nt, Leptospira interrogans serovar lai str. 56601
auaaagaaaaggaa

SEQ ID NO: 2766087 - RNA, 15 nt, Leptospira interrogans serovar lai str. 56601
auaaagaaaaggaag

SEQ ID NO: 2766088 - RNA, 15 nt, Leptospira interrogans serovar lai str. 56601
auaaagaaacuguuu

SEQ ID NO: 2766089 - RNA, 11 nt, Leptospira interrogans serovar lai str. 56601
auaaagaaucg

SEQ ID NO: 2766090 - RNA, 13 nt, Leptospira interrogans serovar lai str. 56601
auaaagacuuuaa

SEQ ID NO: 2766091 - RNA, 20 nt, Leptospira interrogans serovar lai str. 56601
auaaagauuuccuaauaacu

SEQ ID NO: 2766092 - RNA, 17 nt, Leptospira interrogans serovar lai str. 56601
auaaagcgauucuacuu

SEQ ID NO: 2766093 - RNA, 18 nt, Leptospira interrogans serovar lai str. 56601
auaaagcgauucuacuua

SEQ ID NO: 2766094 - RNA, 20 nt, Leptospira interrogans serovar lai str. 56601
auaaaggcccuuuguagaaa

SEQ ID NO: 2766095 - RNA, 19 nt, Leptospira interrogans serovar lai str. 56601
auaaaggugcaugaaaaua

SEQ ID NO: 2766096 - RNA, 20 nt, Leptospira interrogans serovar lai str. 56601
auaaaggugcaugaaaauaa

SEQ ID NO: 2766097 - RNA, 13 nt, Leptospira interrogans serovar lai str. 56601
auaaaguaaaauu

SEQ ID NO: 2766098 - RNA, 17 nt, Leptospira interrogans serovar lai str. 56601
auaaaguaccuaauauu

SEQ ID NO: 2766099 - RNA, 16 nt, Leptospira interrogans serovar lai str. 56601
auaaaguagacaacua

SEQ ID NO: 2766100 - RNA, 21 nt, Leptospira interrogans serovar lai str. 56601
auaaaguauagaacaguuugu

SEQ ID NO: 2766101 - RNA, 22 nt, Leptospira interrogans serovar lai str. 56601
auaaaguauuuuuaagauaaau

SEQ ID NO: 2766102 - RNA, 19 nt, Leptospira interrogans serovar lai str. 56601
auaaagucuauuucccaaa

SEQ ID NO: 2766103 - RNA, 21 nt, Leptospira interrogans serovar lai str. 56601
auaaagucuauuucccaaaau

SEQ ID NO: 2766104 - RNA, 14 nt, Leptospira interrogans serovar lai str. 56601
auaaaguuaauaca

SEQ ID NO: 2766105 - RNA, 20 nt, Leptospira interrogans serovar lai str. 56601
auaaaguuuuaguuuacaaa

SEQ ID NO: 2766106 - RNA, 12 nt, Leptospira interrogans serovar lai str. 56601
auaaaguuuuau

SEQ ID NO: 2766107 - RNA, 18 nt, Leptospira interrogans serovar lai str. 56601
auaaauaaugaaaacuug

SEQ ID NO: 2766108 - RNA, 23 nt, Leptospira interrogans serovar lai str. 56601
auaaauacaucucuuuuuuaaag

SEQ ID NO: 2766109 - RNA, 16 nt, Leptospira interrogans serovar lai str. 56601
auaaauagggguuuua

SEQ ID NO: 2766110 - RNA, 13 nt, Leptospira interrogans serovar lai str. 56601
auaaauauuaauu

SEQ ID NO: 2766111 - RNA, 19 nt, Leptospira interrogans serovar lai str. 56601
auaaauauuaauuuaaaaa

SEQ ID NO: 2766112 - RNA, 22 nt, Leptospira interrogans serovar lai str. 56601
auaaauauuaauuuaaaaacaa

SEQ ID NO: 2766113 - RNA, 23 nt, Leptospira interrogans serovar lai str. 56601
auaaauauuaauuuaaaaacaag

SEQ ID NO: 2766114 - RNA, 16 nt, Leptospira interrogans serovar lai str. 56601
auaaauauucucuaug

SEQ ID NO: 2766115 - RNA, 13 nt, Leptospira interrogans serovar lai str. 56601
auaaauauuucca

SEQ ID NO: 2766116 - RNA, 17 nt, Leptospira interrogans serovar lai str. 56601
auaaaucaaaaggaaua

SEQ ID NO: 2766117 - RNA, 10 nt, Leptospira interrogans serovar lai str. 56601
auaaaucaau

SEQ ID NO: 2766118 - RNA, 12 nt, Leptospira interrogans serovar lai str. 56601
auaaaucaugau

SEQ ID NO: 2766119 - RNA, 14 nt, Leptospira interrogans serovar lai str. 56601
auaaaucaugauca

SEQ ID NO: 2766120 - RNA, 21 nt, Leptospira interrogans serovar lai str. 56601
auaaauccggaaguaauuaca

SEQ ID NO: 2766121 - RNA, 23 nt, Leptospira interrogans serovar lai str. 56601
auaaaucguuugcuuuucuauca

SEQ ID NO: 2766122 - RNA, 19 nt, Leptospira interrogans serovar lai str. 56601
auaaaucuguacuuaaauu

SEQ ID NO: 2766123 - RNA, 16 nt, Leptospira interrogans serovar lai str. 56601
auaaaugaauuuuaaa

SEQ ID NO: 2766124 - RNA, 21 nt, Leptospira interrogans serovar lai str. 56601
auaaaugauaauaauuagaaa

SEQ ID NO: 2766125 - RNA, 13 nt, Leptospira interrogans serovar lai str. 56601
auaaauuacugau

SEQ ID NO: 2766126 - RNA, 19 nt, Leptospira interrogans serovar lai str. 56601
auaaauuacugauuucaaa

SEQ ID NO: 2766127 - RNA, 20 nt, Leptospira interrogans serovar lai str. 56601
auaaauuacugauuucaaaa

SEQ ID NO: 2766128 - RNA, 14 nt, Leptospira interrogans serovar lai str. 56601
auaaauuagaaaau

SEQ ID NO: 2766129 - RNA, 17 nt, Leptospira interrogans serovar lai str. 56601
auaaauuagaaaauuau

SEQ ID NO: 2766130 - RNA, 18 nt, Leptospira interrogans serovar lai str. 56601
auaaauuagaaaauuaua

SEQ ID NO: 2766131 - RNA, 20 nt, Leptospira interrogans serovar lai str. 56601
auaaauuagaaaauuauaaa

SEQ ID NO: 2766132 - RNA, 17 nt, Leptospira interrogans serovar lai str. 56601
auaaauucgcaaaaaaa

SEQ ID NO: 2766133 - RNA, 18 nt, Leptospira interrogans serovar lai str. 56601
auaaauucgcaaaaaaaa

SEQ ID NO: 2766134 - RNA, 20 nt, Leptospira interrogans serovar lai str. 56601
auaaauucgccguaaaaaau

SEQ ID NO: 2766135 - RNA, 21 nt, Leptospira interrogans serovar lai str. 56601
auaaauucgccguaaaaaauc

SEQ ID NO: 2766136 - RNA, 15 nt, Leptospira interrogans serovar lai str. 56601
auaaauugaaaguaa

SEQ ID NO: 2766137 - RNA, 24 nt, Leptospira interrogans serovar lai str. 56601
auaaauugaacguaauacaaaaua

SEQ ID NO: 2766138 - RNA, 15 nt, Leptospira interrogans serovar lai str. 56601
auaaauugcaucaaa

SEQ ID NO: 2766139 - RNA, 22 nt, Leptospira interrogans serovar lai str. 56601
auaaauuggguaucuaaauauu

SEQ ID NO: 2766140 - RNA, 14 nt, Leptospira interrogans serovar lai str. 56601
auaaauuguuucau

SEQ ID NO: 2766141 - RNA, 12 nt, Leptospira interrogans serovar lai str. 56601
auaaauuuaaaa

SEQ ID NO: 2766142 - RNA, 13 nt, Leptospira interrogans serovar lai str. 56601
auaaauuuaguag

SEQ ID NO: 2766143 - RNA, 17 nt, Leptospira interrogans serovar lai str. 56601
auaaauuuaguaguaaa

SEQ ID NO: 2766144 - RNA, 13 nt, Leptospira interrogans serovar lai str. 56601
auaaauuuauaaa

SEQ ID NO: 2766145 - RNA, 14 nt, Leptospira interrogans serovar lai str. 56601
auaaauuuauaauu

SEQ ID NO: 2766146 - RNA, 18 nt, Leptospira interrogans serovar lai str. 56601
auaaauuuauaauucaaa

SEQ ID NO: 2766147 - RNA, 15 nt, Leptospira interrogans serovar lai str. 56601
auaaauuuuagaaua

SEQ ID NO: 2766148 - RNA, 17 nt, Leptospira interrogans serovar lai str. 56601
auaaauuuuagaauauc

SEQ ID NO: 2766149 - RNA, 18 nt, Leptospira interrogans serovar lai str. 56601
auaaauuuuagaauaucu

SEQ ID NO: 2766150 - RNA, 18 nt, Leptospira interrogans serovar lai str. 56601
auaaauuuugagccgaau

SEQ ID NO: 2766151 - RNA, 12 nt, Leptospira interrogans serovar lai str. 56601
auaaauuuugug

SEQ ID NO: 2766152 - RNA, 12 nt, Leptospira interrogans serovar lai str. 56601
auaaauuuuucu

SEQ ID NO: 2766153 - RNA, 22 nt, Leptospira interrogans serovar lai str. 56601
auaaauuuuucuggaaaaguuu

SEQ ID NO: 2766154 - RNA, 13 nt, Leptospira interrogans serovar lai str. 56601
auaauauuuuuau

SEQ ID NO: 2766155 - RNA, 18 nt, Leptospira interrogans serovar lai str. 56601
auaaucaaauacaaaaac

SEQ ID NO: 2766156 - RNA, 16 nt, Leptospira interrogans serovar lai str. 56601
auaauccuaugaaaau

SEQ ID NO: 2766157 - RNA, 22 nt, Leptospira interrogans serovar lai str. 56601
auaaucgaacccagucuucuug

SEQ ID NO: 2766158 - RNA, 17 nt, Leptospira interrogans serovar lai str. 56601
auaaucuaagacgaaaa

SEQ ID NO: 2766159 - RNA, 12 nt, Leptospira interrogans serovar lai str. 56601
auaaucuaagau

SEQ ID NO: 2766160 - RNA, 16 nt, Leptospira interrogans serovar lai str. 56601
auaaucugaaauagaa

SEQ ID NO: 2766161 - RNA, 19 nt, Leptospira interrogans serovar lai str. 56601
auaaucugaaauagaauuu

SEQ ID NO: 2766162 - RNA, 16 nt, Leptospira interrogans serovar lai str. 56601
auaaucuguaauaguu

SEQ ID NO: 2766163 - RNA, 13 nt, Leptospira interrogans serovar lai str. 56601
auaaucuuaacuu

SEQ ID NO: 2766164 - RNA, 22 nt, Leptospira interrogans serovar lai str. 56601
auaaucuuaacuuuaagcaaag

SEQ ID NO: 2766165 - RNA, 14 nt, Leptospira interrogans serovar lai str. 56601
auaaucuuaauauu

SEQ ID NO: 2766166 - RNA, 20 nt, Leptospira interrogans serovar lai str. 56601
auaaucuuaauauuucucuu

SEQ ID NO: 2766167 - RNA, 14 nt, Leptospira interrogans serovar lai str. 56601
auaaugaaaacuug

SEQ ID NO: 2766168 - RNA, 22 nt, Leptospira interrogans serovar lai str. 56601
auaaugaaucguaaaaaaauau

SEQ ID NO: 2766169 - RNA, 23 nt, Leptospira interrogans serovar lai str. 56601
auaaugaaucguaaaaaaauauu

SEQ ID NO: 2766170 - RNA, 17 nt, Leptospira interrogans serovar lai str. 56601
auaaugauagaaauauu

SEQ ID NO: 2766171 - RNA, 17 nt, Leptospira interrogans serovar lai str. 56601
auaauguccgaaauuuu

SEQ ID NO: 2766172 - RNA, 15 nt, Leptospira interrogans serovar lai str. 56601
auaauguggaacucu

SEQ ID NO: 2766173 - RNA, 13 nt, Leptospira interrogans serovar lai str. 56601
auaauguuaauuu

SEQ ID NO: 2766174 - RNA, 16 nt, Leptospira interrogans serovar lai str. 56601
auaauuaaaaagauaa

SEQ ID NO: 2766175 - RNA, 14 nt, Leptospira interrogans serovar lai str. 56601
auaauuaaacaaag

SEQ ID NO: 2766176 - RNA, 19 nt, Leptospira interrogans serovar lai str. 56601
auaauuaaacaaagaauaa

SEQ ID NO: 2766177 - RNA, 13 nt, Leptospira interrogans serovar lai str. 56601
auaauuaauaaaa

SEQ ID NO: 2766178 - RNA, 16 nt, Leptospira interrogans serovar lai str. 56601
auaauuaauaaaacug

SEQ ID NO: 2766179 - RNA, 15 nt, Leptospira interrogans serovar lai str. 56601
auaauuagaaaaaua

SEQ ID NO: 2766180 - RNA, 16 nt, Leptospira interrogans serovar lai str. 56601
auaauuagaaaaauau

SEQ ID NO: 2766181 - RNA, 20 nt, Leptospira interrogans serovar lai str. 56601
auaauuagaaaaauauuuug

SEQ ID NO: 2766182 - RNA, 23 nt, Leptospira interrogans serovar lai str. 56601
auaauuagcucuuguuaaaauaa

SEQ ID NO: 2766183 - RNA, 23 nt, Leptospira interrogans serovar lai str. 56601
auaauuauccuuaaaaugaaaau

SEQ ID NO: 2766184 - RNA, 12 nt, Leptospira interrogans serovar lai str. 56601
auaauucaagac

SEQ ID NO: 2766185 - RNA, 15 nt, Leptospira interrogans serovar lai str. 56601
auaauucaagacuuu

SEQ ID NO: 2766186 - RNA, 23 nt, Leptospira interrogans serovar lai str. 56601
auaauucaagacuuuauagucaa

SEQ ID NO: 2766187 - RNA, 19 nt, Leptospira interrogans serovar lai str. 56601
auaauucguuuuuuaaaau

SEQ ID NO: 2766188 - RNA, 15 nt, Leptospira interrogans serovar lai str. 56601
auaauucuaucgauu

SEQ ID NO: 2766189 - RNA, 13 nt, Leptospira interrogans serovar lai str. 56601
auaauucucuuuu

SEQ ID NO: 2766190 - RNA, 17 nt, Leptospira interrogans serovar lai str. 56601
auaauucuguaaaaaua

SEQ ID NO: 2766191 - RNA, 17 nt, Leptospira interrogans serovar lai str. 56601
auaauucuguaaaauaa

SEQ ID NO: 2766192 - RNA, 14 nt, Leptospira interrogans serovar lai str. 56601
auaauucuuuaaaa

SEQ ID NO: 2766193 - RNA, 15 nt, Leptospira interrogans serovar lai str. 56601
auaauugaacauuuu

SEQ ID NO: 2766194 - RNA, 17 nt, Leptospira interrogans serovar lai str. 56601
auaauugaacauuuuua

SEQ ID NO: 2766195 - RNA, 19 nt, Leptospira interrogans serovar lai str. 56601
auaauugaacauuuuuaaa

SEQ ID NO: 2766196 - RNA, 17 nt, Leptospira interrogans serovar lai str. 56601
auaauugauuagaguua

SEQ ID NO: 2766197 - RNA, 21 nt, Leptospira interrogans serovar lai str. 56601
auaauuuaaaaucguaaaaaa

SEQ ID NO: 2766198 - RNA, 22 nt, Leptospira interrogans serovar lai str. 56601
auaauuuaacgugauucagagu

SEQ ID NO: 2766199 - RNA, 23 nt, Leptospira interrogans serovar lai str. 56601
auaauuuaacucguuagagaaaa

SEQ ID NO: 2766200 - RNA, 13 nt, Leptospira interrogans serovar lai str. 56601
auaauuuacuuca

SEQ ID NO: 2766201 - RNA, 14 nt, Leptospira interrogans serovar lai str. 56601
auaauuuacuucau

SEQ ID NO: 2766202 - RNA, 15 nt, Leptospira interrogans serovar lai str. 56601
auaauuuaguuuuug

SEQ ID NO: 2766203 - RNA, 17 nt, Leptospira interrogans serovar lai str. 56601
auaauuuaguuuuugua

SEQ ID NO: 2766204 - RNA, 18 nt, Leptospira interrogans serovar lai str. 56601
auaauuucccauaaaaag

SEQ ID NO: 2766205 - RNA, 19 nt, Leptospira interrogans serovar lai str. 56601
auaauuucccauaaaaaga

SEQ ID NO: 2766206 - RNA, 21 nt, Leptospira interrogans serovar lai str. 56601
auaauuucuaguuugaauuua

SEQ ID NO: 2766207 - RNA, 17 nt, Leptospira interrogans serovar lai str. 56601
auaauuuuaaauaauaa

SEQ ID NO: 2766208 - RNA, 23 nt, Leptospira interrogans serovar lai str. 56601
auaauuuuaaauaauaauauacu

SEQ ID NO: 2766209 - RNA, 16 nt, Leptospira interrogans serovar lai str. 56601
auaauuuuaauauuuc

SEQ ID NO: 2766210 - RNA, 17 nt, Leptospira interrogans serovar lai str. 56601
auaauuuuaauauuucg

SEQ ID NO: 2766211 - RNA, 20 nt, Leptospira interrogans serovar lai str. 56601
auaauuuuagaauauuauga

SEQ ID NO: 2766212 - RNA, 12 nt, Leptospira interrogans serovar lai str. 56601
auaauuuuauaa

SEQ ID NO: 2766213 - RNA, 16 nt, Leptospira interrogans serovar lai str. 56601
auaauuuuauaauauu

SEQ ID NO: 2766214 - RNA, 16 nt, Leptospira interrogans serovar lai str. 56601
auaauuuucaugaacg

SEQ ID NO: 2766215 - RNA, 19 nt, Leptospira interrogans serovar lai str. 56601
auaauuuucuuuagaaauu

SEQ ID NO: 2766216 - RNA, 23 nt, Leptospira interrogans serovar lai str. 56601
auaauuuucuuuagaaauuuuua

SEQ ID NO: 2766217 - RNA, 20 nt, Leptospira interrogans serovar lai str. 56601
auaauuuuuacucaaagaau

SEQ ID NO: 2766218 - RNA, 14 nt, Leptospira interrogans serovar lai str. 56601
auaauuuuuagaaa

SEQ ID NO: 2766219 - RNA, 16 nt, Leptospira interrogans serovar lai str. 56601
auaauuuuuagaaauu

SEQ ID NO: 2766220 - RNA, 14 nt, Leptospira interrogans serovar lai str. 56601
auaauuuuuguuug

SEQ ID NO: 2766221 - RNA, 17 nt, Leptospira interrogans serovar lai str. 56601
auaauuuuuuaaaaaaa

SEQ ID NO: 2766222 - RNA, 13 nt, Leptospira interrogans serovar lai str. 56601
auacaaaaaaugu

SEQ ID NO: 2766223 - RNA, 23 nt, Leptospira interrogans serovar lai str. 56601
auacaaaaaauguuuaaagaauu

SEQ ID NO: 2766224 - RNA, 14 nt, Leptospira interrogans serovar lai str. 56601
auacaaaacuuaaa

SEQ ID NO: 2766225 - RNA, 18 nt, Leptospira interrogans serovar lai str. 56601
auacaaaacuuugaccau

SEQ ID NO: 2766226 - RNA, 18 nt, Leptospira interrogans serovar lai str. 56601
auacaaaagaaucaucau

SEQ ID NO: 2766227 - RNA, 15 nt, Leptospira interrogans serovar lai str. 56601
auacaaaauuuaaaa

SEQ ID NO: 2766228 - RNA, 14 nt, Leptospira interrogans serovar lai str. 56601
auacaaaguuuaua

SEQ ID NO: 2766229 - RNA, 22 nt, Leptospira interrogans serovar lai str. 56601
auacaacgaaaacagaucaaga

SEQ ID NO: 2766230 - RNA, 15 nt, Leptospira interrogans serovar lai str. 56601
auacaacuuucagau

SEQ ID NO: 2766231 - RNA, 24 nt, Leptospira interrogans serovar lai str. 56601
auacaacuuucagauuaaaaccgu

SEQ ID NO: 2766232 - RNA, 15 nt, Leptospira interrogans serovar lai str. 56601
auacaagacuucuau

SEQ ID NO: 2766233 - RNA, 15 nt, Leptospira interrogans serovar lai str. 56601
auacaauaaauagaa

SEQ ID NO: 2766234 - RNA, 14 nt, Leptospira interrogans serovar lai str. 56601
auacaauauuucgu

SEQ ID NO: 2766235 - RNA, 14 nt, Leptospira interrogans serovar lai str. 56601
auacaaugaaaaag

SEQ ID NO: 2766236 - RNA, 19 nt, Leptospira interrogans serovar lai str. 56601
auacaauucuuucuuaaau

SEQ ID NO: 2766237 - RNA, 22 nt, Leptospira interrogans serovar lai str. 56601
auagaaauuuucaaaaaauauc

SEQ ID NO: 2766238 - RNA, 15 nt, Leptospira interrogans serovar lai str. 56601
auagaaccuauaucu

SEQ ID NO: 2766239 - RNA, 18 nt, Leptospira interrogans serovar lai str. 56601
auagaaccuuuugaagua

SEQ ID NO: 2766240 - RNA, 22 nt, Leptospira interrogans serovar lai str. 56601
auagaacucuuuuaccuuacca

SEQ ID NO: 2766241 - RNA, 20 nt, Leptospira interrogans serovar lai str. 56601
auagaagcaauaaaaucaau

SEQ ID NO: 2766242 - RNA, 20 nt, Leptospira interrogans serovar lai str. 56601
auagaagcgagagacgcuga

SEQ ID NO: 2766243 - RNA, 20 nt, Leptospira interrogans serovar lai str. 56601
auagaauaaauuauacaauu

SEQ ID NO: 2766244 - RNA, 21 nt, Leptospira interrogans serovar lai str. 56601
auagaauaagguuagauuauu

SEQ ID NO: 2766245 - RNA, 17 nt, Leptospira interrogans serovar lai str. 56601
auagaauaaucggaaau

SEQ ID NO: 2766246 - RNA, 15 nt, Leptospira interrogans serovar lai str. 56601
auagaauccuauaau

SEQ ID NO: 2766247 - RNA, 17 nt, Leptospira interrogans serovar lai str. 56601
auagaauuguugaaaaa

SEQ ID NO: 2766248 - RNA, 11 nt, Leptospira interrogans serovar lai str. 56601
auagaauuuaa

SEQ ID NO: 2766249 - RNA, 19 nt, Leptospira interrogans serovar lai str. 56601
auagaauuuuuguagaauu

SEQ ID NO: 2766250 - RNA, 17 nt, Leptospira interrogans serovar lai str. 56601
auagacaacguuacuuu

SEQ ID NO: 2766251 - RNA, 22 nt, Leptospira interrogans serovar lai str. 56601
auagacaacguuacuuuuaaga

SEQ ID NO: 2766252 - RNA, 13 nt, Leptospira interrogans serovar lai str. 56601
auagagaaaaauu

SEQ ID NO: 2766253 - RNA, 16 nt, Leptospira interrogans serovar lai str. 56601
auagagagcguucugc

SEQ ID NO: 2766254 - RNA, 20 nt, Leptospira interrogans serovar lai str. 56601
auagagagcguuuuguugag

SEQ ID NO: 2766255 - RNA, 21 nt, Leptospira interrogans serovar lai str. 56601
auagagcuuuguaauaaaaau

SEQ ID NO: 2766256 - RNA, 22 nt, Leptospira interrogans serovar lai str. 56601
auagagcuuuguaauaaaaauu

SEQ ID NO: 2766257 - RNA, 14 nt, Leptospira interrogans serovar lai str. 56601
auagaggaugaauc

SEQ ID NO: 2766258 - RNA, 22 nt, Leptospira interrogans serovar lai str. 56601
auagaggucgucucaaaaauau

SEQ ID NO: 2766259 - RNA, 23 nt, Leptospira interrogans serovar lai str. 56601
auagaggucgucucaaaaauauu

SEQ ID NO: 2766260 - RNA, 20 nt, Leptospira interrogans serovar lai str. 56601
auagagucguugaaaaauua

SEQ ID NO: 2766261 - RNA, 15 nt, Leptospira interrogans serovar lai str. 56601
auagagucuuuaaaa

SEQ ID NO: 2766262 - RNA, 15 nt, Leptospira interrogans serovar lai str. 56601
auagaguuguuaaaa

SEQ ID NO: 2766263 - RNA, 14 nt, Leptospira interrogans serovar lai str. 56601
auagaucgauucuu

SEQ ID NO: 2766264 - RNA, 13 nt, Leptospira interrogans serovar lai str. 56601
auagaugcugaaa

SEQ ID NO: 2766265 - RNA, 14 nt, Leptospira interrogans serovar lai str. 56601
auagaugcugaaaa

SEQ ID NO: 2766266 - RNA, 22 nt, Leptospira interrogans serovar lai str. 56601
auagauggagaauuaauuuuuu

SEQ ID NO: 2766267 - RNA, 22 nt, Leptospira interrogans serovar lai str. 56601
auagauuaagucacauuguguu

SEQ ID NO: 2766268 - RNA, 18 nt, Leptospira interrogans serovar lai str. 56601
auagauuaaguccagagc

SEQ ID NO: 2766269 - RNA, 15 nt, Leptospira interrogans serovar lai str. 56601
auagauuaauuuuua

SEQ ID NO: 2766270 - RNA, 16 nt, Leptospira interrogans serovar lai str. 56601
auagauuaauuuuuau

SEQ ID NO: 2766271 - RNA, 18 nt, Leptospira interrogans serovar lai str. 56601
auagauuaguuuaaaaac

SEQ ID NO: 2766272 - RNA, 16 nt, Leptospira interrogans serovar lai str. 56601
auagauucaaaagucu

SEQ ID NO: 2766273 - RNA, 18 nt, Leptospira interrogans serovar lai str. 56601
auagauucaauuauuaua

SEQ ID NO: 2766274 - RNA, 15 nt, Leptospira interrogans serovar lai str. 56601
auagauucuuaaugu

SEQ ID NO: 2766275 - RNA, 15 nt, Leptospira interrogans serovar lai str. 56601
auagauugauuuaaa

SEQ ID NO: 2766276 - RNA, 14 nt, Leptospira interrogans serovar lai str. 56601
auagcaaaaaaauc

SEQ ID NO: 2766277 - RNA, 14 nt, Leptospira interrogans serovar lai str. 56601
auagcaacaauuaa

SEQ ID NO: 2766278 - RNA, 20 nt, Leptospira interrogans serovar lai str. 56601
auagcagaugagcauuuuuu

SEQ ID NO: 2766279 - RNA, 16 nt, Leptospira interrogans serovar lai str. 56601
auagccgcuauggaag

SEQ ID NO: 2766280 - RNA, 16 nt, Leptospira interrogans serovar lai str. 56601
auagccguagggauga

SEQ ID NO: 2766281 - RNA, 23 nt, Leptospira interrogans serovar lai str. 56601
auagccuucaauuaucaaagcaa

SEQ ID NO: 2766282 - RNA, 18 nt, Leptospira interrogans serovar lai str. 56601
auagcgauacuuaaaaau

SEQ ID NO: 2766283 - RNA, 20 nt, Leptospira interrogans serovar lai str. 56601
auagcgucguuaaauuugcg

SEQ ID NO: 2766284 - RNA, 22 nt, Leptospira interrogans serovar lai str. 56601
auagcuguuuuaguuguuccua

SEQ ID NO: 2766285 - RNA, 16 nt, Leptospira interrogans serovar lai str. 56601
auagcuuaaaagugau

SEQ ID NO: 2766286 - RNA, 15 nt, Leptospira interrogans serovar lai str. 56601
auagcuucuuuaaaa

SEQ ID NO: 2766287 - RNA, 20 nt, Leptospira interrogans serovar lai str. 56601
auaggaaagcguuguguuga

SEQ ID NO: 2766288 - RNA, 19 nt, Leptospira interrogans serovar lai str. 56601
auaggaaauaauuccucca

SEQ ID NO: 2766289 - RNA, 23 nt, Leptospira interrogans serovar lai str. 56601
auaggaacucuuacuuugagaaa

SEQ ID NO: 2766290 - RNA, 14 nt, Leptospira interrogans serovar lai str. 56601
auaggaucagaauu

SEQ ID NO: 2766291 - RNA, 15 nt, Leptospira interrogans serovar lai str. 56601
auaggaucagaauuu

SEQ ID NO: 2766292 - RNA, 21 nt, Leptospira interrogans serovar lai str. 56601
auaggaucguauuuuagaaau

SEQ ID NO: 2766293 - RNA, 15 nt, Leptospira interrogans serovar lai str. 56601
auaggauuuuagaau

SEQ ID NO: 2766294 - RNA, 17 nt, Leptospira interrogans serovar lai str. 56601
auaggcgcggaaaaauu

SEQ ID NO: 2766295 - RNA, 14 nt, Leptospira interrogans serovar lai str. 56601
auaggcuaaucaaa

SEQ ID NO: 2766296 - RNA, 18 nt, Leptospira interrogans serovar lai str. 56601
auaggcuaaucaaauuuc

SEQ ID NO: 2766297 - RNA, 20 nt, Leptospira interrogans serovar lai str. 56601
auagggaaaacucaacacaa

SEQ ID NO: 2766298 - RNA, 14 nt, Leptospira interrogans serovar lai str. 56601
auagggaguuccua

SEQ ID NO: 2766299 - RNA, 12 nt, Leptospira interrogans serovar lai str. 56601
auagggguuuua

SEQ ID NO: 2766300 - RNA, 17 nt, Leptospira interrogans serovar lai str. 56601
auagguuccaauuccau

SEQ ID NO: 2766301 - RNA, 21 nt, Leptospira interrogans serovar lai str. 56601
auagguuccaauuccauuucu

SEQ ID NO: 2766302 - RNA, 15 nt, Leptospira interrogans serovar lai str. 56601
auagguucuggauuu

SEQ ID NO: 2766303 - RNA, 13 nt, Leptospira interrogans serovar lai str. 56601
auaguaaaagaaa

SEQ ID NO: 2766304 - RNA, 13 nt, Leptospira interrogans serovar lai str. 56601
auaguaacagaaa

SEQ ID NO: 2766305 - RNA, 23 nt, Leptospira interrogans serovar lai str. 56601
auaguaagcccccgaagaauuau

SEQ ID NO: 2766306 - RNA, 16 nt, Leptospira interrogans serovar lai str. 56601
auaguauauuaacuuu

SEQ ID NO: 2766307 - RNA, 12 nt, Leptospira interrogans serovar lai str. 56601
auaguauccaaa

SEQ ID NO: 2766308 - RNA, 15 nt, Leptospira interrogans serovar lai str. 56601
auaguauccaaaauu

SEQ ID NO: 2766309 - RNA, 21 nt, Leptospira interrogans serovar lai str. 56601
auagucaaugguugcaaaaaa

SEQ ID NO: 2766310 - RNA, 14 nt, Leptospira interrogans serovar lai str. 56601
auagucaauugaag

SEQ ID NO: 2766311 - RNA, 17 nt, Leptospira interrogans serovar lai str. 56601
auagugauacaauguuc

SEQ ID NO: 2766312 - RNA, 13 nt, Leptospira interrogans serovar lai str. 56601
auagugcacugcu

SEQ ID NO: 2766313 - RNA, 11 nt, Leptospira interrogans serovar lai str. 56601
auaguuaaauu

SEQ ID NO: 2766314 - RNA, 20 nt, Leptospira interrogans serovar lai str. 56601
auaguuacgacauuuuaaua

SEQ ID NO: 2766315 - RNA, 13 nt, Leptospira interrogans serovar lai str. 56601
auaguuaugaaua

SEQ ID NO: 2766316 - RNA, 16 nt, Leptospira interrogans serovar lai str. 56601
auaguuaugaauaaaa

SEQ ID NO: 2766317 - RNA, 19 nt, Leptospira interrogans serovar lai str. 56601
auaguuaugaauaaaaaau

SEQ ID NO: 2766318 - RNA, 11 nt, Leptospira interrogans serovar lai str. 56601
auaguucccac

SEQ ID NO: 2766319 - RNA, 15 nt, Leptospira interrogans serovar lai str. 56601
auaguucccacaaau

SEQ ID NO: 2766320 - RNA, 23 nt, Leptospira interrogans serovar lai str. 56601
auauccgaaagauaaaucgcaaa

SEQ ID NO: 2766321 - RNA, 16 nt, Leptospira interrogans serovar lai str. 56601
auauccuugaaguaga

SEQ ID NO: 2766322 - RNA, 18 nt, Leptospira interrogans serovar lai str. 56601
auaucgaauacauuuaaa

SEQ ID NO: 2766323 - RNA, 17 nt, Leptospira interrogans serovar lai str. 56601
auaucgaauuucuucau

SEQ ID NO: 2766324 - RNA, 23 nt, Leptospira interrogans serovar lai str. 56601
auaucgaauuucuucauaaaauc

SEQ ID NO: 2766325 - RNA, 15 nt, Leptospira interrogans serovar lai str. 56601
auaucggaauaacuu

SEQ ID NO: 2766326 - RNA, 19 nt, Leptospira interrogans serovar lai str. 56601
auaucgugaaacuuuccac

SEQ ID NO: 2766327 - RNA, 17 nt, Leptospira interrogans serovar lai str. 56601
auaucuacaaaagauuu

SEQ ID NO: 2766328 - RNA, 16 nt, Leptospira interrogans serovar lai str. 56601
auaucugcaaaauaac

SEQ ID NO: 2766329 - RNA, 22 nt, Leptospira interrogans serovar lai str. 56601
auaucugccuucuuuuuucuaa

SEQ ID NO: 2766330 - RNA, 21 nt, Leptospira interrogans serovar lai str. 56601
auaucuggaacuuuaauuauu

SEQ ID NO: 2766331 - RNA, 24 nt, Leptospira interrogans serovar lai str. 56601
auaucuggaacuuuaauuauugau

SEQ ID NO: 2766332 - RNA, 15 nt, Leptospira interrogans serovar lai str. 56601
auaucuuaagaauug

SEQ ID NO: 2766333 - RNA, 21 nt, Leptospira interrogans serovar lai str. 56601
auaucuuaauauaauaauucc

SEQ ID NO: 2766334 - RNA, 15 nt, Leptospira interrogans serovar lai str. 56601
auaucuuaauuaaaa

SEQ ID NO: 2766335 - RNA, 11 nt, Leptospira interrogans serovar lai str. 56601
auaucuugaac

SEQ ID NO: 2766336 - RNA, 20 nt, Leptospira interrogans serovar lai str. 56601
auaucuuuuuuauucuuccg

SEQ ID NO: 2766337 - RNA, 13 nt, Leptospira interrogans serovar lai str. 56601
auaugaaaauaau

SEQ ID NO: 2766338 - RNA, 18 nt, Leptospira interrogans serovar lai str. 56601
auaugaauuaauuuguaa

SEQ ID NO: 2766339 - RNA, 13 nt, Leptospira interrogans serovar lai str. 56601
auaugaauuuuua

SEQ ID NO: 2766340 - RNA, 15 nt, Leptospira interrogans serovar lai str. 56601
auaugaauuuuuaau

SEQ ID NO: 2766341 - RNA, 12 nt, Leptospira interrogans serovar lai str. 56601
auaugagugaau

SEQ ID NO: 2766342 - RNA, 20 nt, Leptospira interrogans serovar lai str. 56601
auaugcauccgucucagcaa

SEQ ID NO: 2766343 - RNA, 21 nt, Leptospira interrogans serovar lai str. 56601
auauguauuuauucaaaauau

SEQ ID NO: 2766344 - RNA, 19 nt, Leptospira interrogans serovar lai str. 56601
auauguuuagaguauuaua

SEQ ID NO: 2766345 - RNA, 18 nt, Leptospira interrogans serovar lai str. 56601
auauguuucuuuuguaaa

SEQ ID NO: 2766346 - RNA, 22 nt, Leptospira interrogans serovar lai str. 56601
auauguuucuuuuguaaaacga

SEQ ID NO: 2766347 - RNA, 19 nt, Leptospira interrogans serovar lai str. 56601
auauguuuuuuuucaacaa

SEQ ID NO: 2766348 - RNA, 15 nt, Leptospira interrogans serovar lai str. 56601
auauuaaaaaaauaa

SEQ ID NO: 2766349 - RNA, 18 nt, Leptospira interrogans serovar lai str. 56601
auauuaaaacacuuuaca

SEQ ID NO: 2766350 - RNA, 12 nt, Leptospira interrogans serovar lai str. 56601
auauuaaaauga

SEQ ID NO: 2766351 - RNA, 23 nt, Leptospira interrogans serovar lai str. 56601
auauuaaagaauaauauuuuaau

SEQ ID NO: 2766352 - RNA, 13 nt, Leptospira interrogans serovar lai str. 56601
auauuaaauuuua

SEQ ID NO: 2766353 - RNA, 17 nt, Leptospira interrogans serovar lai str. 56601
auauuaaauuuuauuua

SEQ ID NO: 2766354 - RNA, 15 nt, Leptospira interrogans serovar lai str. 56601
auauuaacaaauuua

SEQ ID NO: 2766355 - RNA, 18 nt, Leptospira interrogans serovar lai str. 56601
auauuaacaaauuuaaaa

SEQ ID NO: 2766356 - RNA, 13 nt, Leptospira interrogans serovar lai str. 56601
auauuaacuuuca

SEQ ID NO: 2766357 - RNA, 17 nt, Leptospira interrogans serovar lai str. 56601
auauuaacuuucauuga

SEQ ID NO: 2766358 - RNA, 14 nt, Leptospira interrogans serovar lai str. 56601
auauuaagaauucu

SEQ ID NO: 2766359 - RNA, 13 nt, Leptospira interrogans serovar lai str. 56601
auauuaaguuuuu

SEQ ID NO: 2766360 - RNA, 18 nt, Leptospira interrogans serovar lai str. 56601
auauuaaguuuuuuaaau

SEQ ID NO: 2766361 - RNA, 22 nt, Leptospira interrogans serovar lai str. 56601
auauuaaguuuuuuaaauuuac

SEQ ID NO: 2766362 - RNA, 16 nt, Leptospira interrogans serovar lai str. 56601
auauuacauucaauaa

SEQ ID NO: 2766363 - RNA, 14 nt, Leptospira interrogans serovar lai str. 56601
auauuagaacugcu

SEQ ID NO: 2766364 - RNA, 19 nt, Leptospira interrogans serovar lai str. 56601
auauuagaauuguugaaaa

SEQ ID NO: 2766365 - RNA, 21 nt, Leptospira interrogans serovar lai str. 56601
auauuagaauuguugaaaaac

SEQ ID NO: 2766366 - RNA, 17 nt, Leptospira interrogans serovar lai str. 56601
auauuagaguuucuaaa

SEQ ID NO: 2766367 - RNA, 20 nt, Leptospira interrogans serovar lai str. 56601
auauuagaguuucuaaaaaa

SEQ ID NO: 2766368 - RNA, 14 nt, Leptospira interrogans serovar lai str. 56601
auauuagauuuaua

SEQ ID NO: 2766369 - RNA, 15 nt, Leptospira interrogans serovar lai str. 56601
auauuauaaauacaa

SEQ ID NO: 2766370 - RNA, 14 nt, Leptospira interrogans serovar lai str. 56601
auauuauaaauuua

SEQ ID NO: 2766371 - RNA, 13 nt, Leptospira interrogans serovar lai str. 56601
auauuauaauucu

SEQ ID NO: 2766372 - RNA, 16 nt, Leptospira interrogans serovar lai str. 56601
auauuauaauuuuaaa

SEQ ID NO: 2766373 - RNA, 13 nt, Leptospira interrogans serovar lai str. 56601
auauuauauuucg

SEQ ID NO: 2766374 - RNA, 17 nt, Leptospira interrogans serovar lai str. 56601
auauuauuaaauuuuua

SEQ ID NO: 2766375 - RNA, 17 nt, Leptospira interrogans serovar lai str. 56601
auauuauuauauuuaaa

SEQ ID NO: 2766376 - RNA, 20 nt, Leptospira interrogans serovar lai str. 56601
auauuauucuucaucauuau

SEQ ID NO: 2766377 - RNA, 18 nt, Leptospira interrogans serovar lai str. 56601
auauuauuuguaguuuca

SEQ ID NO: 2766378 - RNA, 23 nt, Leptospira interrogans serovar lai str. 56601
auauuauuuguaguuucaauuua

SEQ ID NO: 2766379 - RNA, 15 nt, Leptospira interrogans serovar lai str. 56601
auauuauuuuaacuu

SEQ ID NO: 2766380 - RNA, 19 nt, Leptospira interrogans serovar lai str. 56601
auauucaaaaaaguuuaua

SEQ ID NO: 2766381 - RNA, 13 nt, Leptospira interrogans serovar lai str. 56601
auauucaaaaaau

SEQ ID NO: 2766382 - RNA, 12 nt, Leptospira interrogans serovar lai str. 56601
auauucaaauuu

SEQ ID NO: 2766383 - RNA, 17 nt, Leptospira interrogans serovar lai str. 56601
auauucaacuuuuugaa

SEQ ID NO: 2766384 - RNA, 15 nt, Leptospira interrogans serovar lai str. 56601
auauucacaaaaaaa

SEQ ID NO: 2766385 - RNA, 15 nt, Leptospira interrogans serovar lai str. 56601
auauucacuuuucca

SEQ ID NO: 2766386 - RNA, 18 nt, Leptospira interrogans serovar lai str. 56601
auauucaguauucauuuu

SEQ ID NO: 2766387 - RNA, 14 nt, Leptospira interrogans serovar lai str. 56601
auauuccagaagua

SEQ ID NO: 2766388 - RNA, 18 nt, Leptospira interrogans serovar lai str. 56601
auauuccagaaguauuuu

SEQ ID NO: 2766389 - RNA, 16 nt, Leptospira interrogans serovar lai str. 56601
auauucguguucuauu

SEQ ID NO: 2766390 - RNA, 16 nt, Leptospira interrogans serovar lai str. 56601
auauucuagaagaguu

SEQ ID NO: 2766391 - RNA, 13 nt, Leptospira interrogans serovar lai str. 56601
auauucuauuaua

SEQ ID NO: 2766392 - RNA, 15 nt, Leptospira interrogans serovar lai str. 56601
auauucuauuauaua

SEQ ID NO: 2766393 - RNA, 20 nt, Leptospira interrogans serovar lai str. 56601
auauucuuauauaucuuugg

SEQ ID NO: 2766394 - RNA, 19 nt, Leptospira interrogans serovar lai str. 56601
auauucuucgcuuaacaaa

SEQ ID NO: 2766395 - RNA, 21 nt, Leptospira interrogans serovar lai str. 56601
auauucuuggguuuuaucuaa

SEQ ID NO: 2766396 - RNA, 15 nt, Leptospira interrogans serovar lai str. 56601
auauucuuuuauaua

SEQ ID NO: 2766397 - RNA, 14 nt, Leptospira interrogans serovar lai str. 56601
auauugagauaaaa

SEQ ID NO: 2766398 - RNA, 18 nt, Leptospira interrogans serovar lai str. 56601
auauugagaucaaauacu

SEQ ID NO: 2766399 - RNA, 20 nt, Leptospira interrogans serovar lai str. 56601
auauugaguuaauuuucgau

SEQ ID NO: 2766400 - RNA, 16 nt, Leptospira interrogans serovar lai str. 56601
auauugcacaugauau

SEQ ID NO: 2766401 - RNA, 18 nt, Leptospira interrogans serovar lai str. 56601
auauuggauaauuccaca

SEQ ID NO: 2766402 - RNA, 15 nt, Leptospira interrogans serovar lai str. 56601
auauuuaaaaauucu

SEQ ID NO: 2766403 - RNA, 16 nt, Leptospira interrogans serovar lai str. 56601
aucaaugguuuuucuu

SEQ ID NO: 2766404 - RNA, 24 nt, Leptospira interrogans serovar lai str. 56601
aucaauucacucuuaaauacuuaa

SEQ ID NO: 2766405 - RNA, 15 nt, Leptospira interrogans serovar lai str. 56601
aucaauucuuuaaau

SEQ ID NO: 2766406 - RNA, 22 nt, Leptospira interrogans serovar lai str. 56601
aucaauugacuuucuguauuuu

SEQ ID NO: 2766407 - RNA, 13 nt, Leptospira interrogans serovar lai str. 56601
aucaauuuuaaau

SEQ ID NO: 2766408 - RNA, 12 nt, Leptospira interrogans serovar lai str. 56601
aucaauuuugga

SEQ ID NO: 2766409 - RNA, 20 nt, Leptospira interrogans serovar lai str. 56601
aucacaaaaaagauaaaaag

SEQ ID NO: 2766410 - RNA, 13 nt, Leptospira interrogans serovar lai str. 56601
aucacaaaucaca

SEQ ID NO: 2766411 - RNA, 15 nt, Leptospira interrogans serovar lai str. 56601
aucacaaauuuuaaa

SEQ ID NO: 2766412 - RNA, 18 nt, Leptospira interrogans serovar lai str. 56601
aucacaaggguuguuuca

SEQ ID NO: 2766413 - RNA, 23 nt, Leptospira interrogans serovar lai str. 56601
aucacaaggguuguuucaguaag

SEQ ID NO: 2766414 - RNA, 16 nt, Leptospira interrogans serovar lai str. 56601
aucacaauuuuaagaa

SEQ ID NO: 2766415 - RNA, 18 nt, Leptospira interrogans serovar lai str. 56601
aucacaauuuuaagaaca

SEQ ID NO: 2766416 - RNA, 16 nt, Leptospira interrogans serovar lai str. 56601
aucacaauuuuacaaa

SEQ ID NO: 2766417 - RNA, 23 nt, Leptospira interrogans serovar lai str. 56601
aucacaauuuuuuuagaaucaug

SEQ ID NO: 2766418 - RNA, 17 nt, Leptospira interrogans serovar lai str. 56601
aucacauccaacccaaa

SEQ ID NO: 2766419 - RNA, 19 nt, Leptospira interrogans serovar lai str. 56601
aucacauccaacccaaaca

SEQ ID NO: 2766420 - RNA, 21 nt, Leptospira interrogans serovar lai str. 56601
aucacauccaacccaaacaca

SEQ ID NO: 2766421 - RNA, 23 nt, Leptospira interrogans serovar lai str. 56601
aucacgaaaaaugaauguuuaaa

SEQ ID NO: 2766422 - RNA, 18 nt, Leptospira interrogans serovar lai str. 56601
aucacgaaaauuaaaaaa

SEQ ID NO: 2766423 - RNA, 15 nt, Leptospira interrogans serovar lai str. 56601
aucacgauuuuacga

SEQ ID NO: 2766424 - RNA, 13 nt, Leptospira interrogans serovar lai str. 56601
aucacgcacaucg

SEQ ID NO: 2766425 - RNA, 15 nt, Leptospira interrogans serovar lai str. 56601
aucacgccgaaauua

SEQ ID NO: 2766426 - RNA, 15 nt, Leptospira interrogans serovar lai str. 56601
aucacguucaacguu

SEQ ID NO: 2766427 - RNA, 21 nt, Leptospira interrogans serovar lai str. 56601
aucacguucaacguucaaaca

SEQ ID NO: 2766428 - RNA, 13 nt, Leptospira interrogans serovar lai str. 56601
aucagaaaaacau

SEQ ID NO: 2766429 - RNA, 21 nt, Leptospira interrogans serovar lai str. 56601
aucagaaaaacauacuuuuug

SEQ ID NO: 2766430 - RNA, 18 nt, Leptospira interrogans serovar lai str. 56601
aucagaauagauucuuaa

SEQ ID NO: 2766431 - RNA, 15 nt, Leptospira interrogans serovar lai str. 56601
aucagaauuaaaaau

SEQ ID NO: 2766432 - RNA, 19 nt, Leptospira interrogans serovar lai str. 56601
aucagaauuucuuucucuc

SEQ ID NO: 2766433 - RNA, 15 nt, Leptospira interrogans serovar lai str. 56601
aucagauguuuuaaa

SEQ ID NO: 2766434 - RNA, 18 nt, Leptospira interrogans serovar lai str. 56601
aucagauguuuuaaaagu

SEQ ID NO: 2766435 - RNA, 18 nt, Leptospira interrogans serovar lai str. 56601
aucagauugauacugcau

SEQ ID NO: 2766436 - RNA, 15 nt, Leptospira interrogans serovar lai str. 56601
aucagauuuuuucug

SEQ ID NO: 2766437 - RNA, 18 nt, Leptospira interrogans serovar lai str. 56601
aucaggauaaccuaaaau

SEQ ID NO: 2766438 - RNA, 15 nt, Leptospira interrogans serovar lai str. 56601
aucaggcuuuauaaa

SEQ ID NO: 2766439 - RNA, 14 nt, Leptospira interrogans serovar lai str. 56601
aucagguuuuauaa

SEQ ID NO: 2766440 - RNA, 15 nt, Leptospira interrogans serovar lai str. 56601
aucagguuuuauaaa

SEQ ID NO: 2766441 - RNA, 16 nt, Leptospira interrogans serovar lai str. 56601
aucagguuuuauaaag

SEQ ID NO: 2766442 - RNA, 16 nt, Leptospira interrogans serovar lai str. 56601
aucaguagugaaaaac

SEQ ID NO: 2766443 - RNA, 13 nt, Leptospira interrogans serovar lai str. 56601
aucaguaguucuc

SEQ ID NO: 2766444 - RNA, 22 nt, Leptospira interrogans serovar lai str. 56601
aucagugauucgaaauuuucag

SEQ ID NO: 2766445 - RNA, 22 nt, Leptospira interrogans serovar lai str. 56601
aucaguguuuugugauaaaauu

SEQ ID NO: 2766446 - RNA, 23 nt, Leptospira interrogans serovar lai str. 56601
aucaguguuuugugauaaaauua

SEQ ID NO: 2766447 - RNA, 20 nt, Leptospira interrogans serovar lai str. 56601
aucaguuaaacuuugaaaau

SEQ ID NO: 2766448 - RNA, 13 nt, Leptospira interrogans serovar lai str. 56601
aucaguuauaagu

SEQ ID NO: 2766449 - RNA, 13 nt, Leptospira interrogans serovar lai str. 56601
aucaguuccgguu

SEQ ID NO: 2766450 - RNA, 12 nt, Leptospira interrogans serovar lai str. 56601
aucauaaaaaua

SEQ ID NO: 2766451 - RNA, 23 nt, Leptospira interrogans serovar lai str. 56601
aucauaaaggagagguuuuccuc

SEQ ID NO: 2766452 - RNA, 21 nt, Leptospira interrogans serovar lai str. 56601
aucauaaaggugcaugaaaau

SEQ ID NO: 2766453 - RNA, 15 nt, Leptospira interrogans serovar lai str. 56601
aucauagaguuucuu

SEQ ID NO: 2766454 - RNA, 21 nt, Leptospira interrogans serovar lai str. 56601
aucauauccaauuucaauuuc

SEQ ID NO: 2766455 - RNA, 15 nt, Leptospira interrogans serovar lai str. 56601
aucauauuguuuaau

SEQ ID NO: 2766456 - RNA, 21 nt, Leptospira interrogans serovar lai str. 56601
aucauauuguuuaauaccuaa

SEQ ID NO: 2766457 - RNA, 17 nt, Leptospira interrogans serovar lai str. 56601
aucauauuuaacuguaa

SEQ ID NO: 2766458 - RNA, 13 nt, Leptospira interrogans serovar lai str. 56601
aucauauuuuaau

SEQ ID NO: 2766459 - RNA, 18 nt, Leptospira interrogans serovar lai str. 56601
aucauauuuucaaaaaau

SEQ ID NO: 2766460 - RNA, 15 nt, Leptospira interrogans serovar lai str. 56601
aucaucauccaauga

SEQ ID NO: 2766461 - RNA, 15 nt, Leptospira interrogans serovar lai str. 56601
aucaucgucuaauca

SEQ ID NO: 2766462 - RNA, 13 nt, Leptospira interrogans serovar lai str. 56601
aucaucuuacaca

SEQ ID NO: 2766463 - RNA, 15 nt, Leptospira interrogans serovar lai str. 56601
aucaucuuacacacu

SEQ ID NO: 2766464 - RNA, 20 nt, Leptospira interrogans serovar lai str. 56601
aucaugaauauuuuccaaaa

SEQ ID NO: 2766465 - RNA, 21 nt, Leptospira interrogans serovar lai str. 56601
aucaugaucaaauucacauaa

SEQ ID NO: 2766466 - RNA, 21 nt, Leptospira interrogans serovar lai str. 56601
aucaugauucauuuuucugaa

SEQ ID NO: 2766467 - RNA, 22 nt, Leptospira interrogans serovar lai str. 56601
aucauggguucuuuacgucaaa

SEQ ID NO: 2766468 - RNA, 22 nt, Leptospira interrogans serovar lai str. 56601
aucaugucucaguucaaaauau

SEQ ID NO: 2766469 - RNA, 16 nt, Leptospira interrogans serovar lai str. 56601
aucaugugaauucaga

SEQ ID NO: 2766470 - RNA, 19 nt, Leptospira interrogans serovar lai str. 56601
aucauuacguaaagaacuu

SEQ ID NO: 2766471 - RNA, 22 nt, Leptospira interrogans serovar lai str. 56601
aucauucuauuuggauuuuaua

SEQ ID NO: 2766472 - RNA, 17 nt, Leptospira interrogans serovar lai str. 56601
aucauucuuuagaaauu

SEQ ID NO: 2766473 - RNA, 23 nt, Leptospira interrogans serovar lai str. 56601
aucauuggaguuuuuuaaaauua

SEQ ID NO: 2766474 - RNA, 14 nt, Leptospira interrogans serovar lai str. 56601
aucauuuaaagcaa

SEQ ID NO: 2766475 - RNA, 22 nt, Leptospira interrogans serovar lai str. 56601
aucauuuaaagcaaauaccaaa

SEQ ID NO: 2766476 - RNA, 14 nt, Leptospira interrogans serovar lai str. 56601
auccaaaacaaucu

SEQ ID NO: 2766477 - RNA, 18 nt, Leptospira interrogans serovar lai str. 56601
auccaaagaaagaaaaua

SEQ ID NO: 2766478 - RNA, 22 nt, Leptospira interrogans serovar lai str. 56601
auccaaagaaagaaaauacaua

SEQ ID NO: 2766479 - RNA, 19 nt, Leptospira interrogans serovar lai str. 56601
auccaaguagagagugaaa

SEQ ID NO: 2766480 - RNA, 15 nt, Leptospira interrogans serovar lai str. 56601
auccaauacaaaaca

SEQ ID NO: 2766481 - RNA, 19 nt, Leptospira interrogans serovar lai str. 56601
auccaaucauagauacaua

SEQ ID NO: 2766482 - RNA, 15 nt, Leptospira interrogans serovar lai str. 56601
auccaauccaaaauu

SEQ ID NO: 2766483 - RNA, 21 nt, Leptospira interrogans serovar lai str. 56601
auccaauuauaaaauuuuucu

SEQ ID NO: 2766484 - RNA, 16 nt, Leptospira interrogans serovar lai str. 56601
auccaauuauuuaugg

SEQ ID NO: 2766485 - RNA, 20 nt, Leptospira interrogans serovar lai str. 56601
auccaauugaauauaaaauu

SEQ ID NO: 2766486 - RNA, 14 nt, Leptospira interrogans serovar lai str. 56601
aucguacaucuucu

SEQ ID NO: 2766487 - RNA, 17 nt, Leptospira interrogans serovar lai str. 56601
aucguaggcacguggaa

SEQ ID NO: 2766488 - RNA, 20 nt, Leptospira interrogans serovar lai str. 56601
aucguaucuugaauacuaau

SEQ ID NO: 2766489 - RNA, 12 nt, Leptospira interrogans serovar lai str. 56601
aucgucccgauc

SEQ ID NO: 2766490 - RNA, 19 nt, Leptospira interrogans serovar lai str. 56601
aucgucuucuuuuuuuacc

SEQ ID NO: 2766491 - RNA, 21 nt, Leptospira interrogans serovar lai str. 56601
aucguguaacaaagccgcaca

SEQ ID NO: 2766492 - RNA, 22 nt, Leptospira interrogans serovar lai str. 56601
aucguguaacaaagccgcacaa

SEQ ID NO: 2766493 - RNA, 19 nt, Leptospira interrogans serovar lai str. 56601
aucguguuugagauuaaaa

SEQ ID NO: 2766494 - RNA, 18 nt, Leptospira interrogans serovar lai str. 56601
aucguuaccagcaagcac

SEQ ID NO: 2766495 - RNA, 13 nt, Leptospira interrogans serovar lai str. 56601
aucguuagguuau

SEQ ID NO: 2766496 - RNA, 14 nt, Leptospira interrogans serovar lai str. 56601
aucguuccaaaccc

SEQ ID NO: 2766497 - RNA, 16 nt, Leptospira interrogans serovar lai str. 56601
aucguuccaaacccug

SEQ ID NO: 2766498 - RNA, 21 nt, Leptospira interrogans serovar lai str. 56601
aucguuuauuuuucuaaaaaa

SEQ ID NO: 2766499 - RNA, 23 nt, Leptospira interrogans serovar lai str. 56601
aucguuugcuuuucuaucaaaaa

SEQ ID NO: 2766500 - RNA, 18 nt, Leptospira interrogans serovar lai str. 56601
aucguuuguaaaaucgua

SEQ ID NO: 2766501 - RNA, 12 nt, Leptospira interrogans serovar lai str. 56601
aucguuuuaaaa

SEQ ID NO: 2766502 - RNA, 19 nt, Leptospira interrogans serovar lai str. 56601
aucguuuuuuguauucuga

SEQ ID NO: 2766503 - RNA, 16 nt, Leptospira interrogans serovar lai str. 56601
aucuaaaaagauuauc

SEQ ID NO: 2766504 - RNA, 12 nt, Leptospira interrogans serovar lai str. 56601
aucuaaaaggac

SEQ ID NO: 2766505 - RNA, 20 nt, Leptospira interrogans serovar lai str. 56601
aucuaaacuagccccguuuu

SEQ ID NO: 2766506 - RNA, 16 nt, Leptospira interrogans serovar lai str. 56601
aucuaaacuuugcaaa

SEQ ID NO: 2766507 - RNA, 20 nt, Leptospira interrogans serovar lai str. 56601
aucuaaacuuuguaaaucua

SEQ ID NO: 2766508 - RNA, 16 nt, Leptospira interrogans serovar lai str. 56601
aucuaaagacuaaaaa

SEQ ID NO: 2766509 - RNA, 18 nt, Leptospira interrogans serovar lai str. 56601
aucuaaagacuaaaaagu

SEQ ID NO: 2766510 - RNA, 22 nt, Leptospira interrogans serovar lai str. 56601
aucuaaauuuguaauaguuccc

SEQ ID NO: 2766511 - RNA, 23 nt, Leptospira interrogans serovar lai str. 56601
aucuaaauuuguaauaguuccca

SEQ ID NO: 2766512 - RNA, 15 nt, Leptospira interrogans serovar lai str. 56601
aucuaaauuuuacaa

SEQ ID NO: 2766513 - RNA, 22 nt, Leptospira interrogans serovar lai str. 56601
aucuaaauuuuacaauuaaacu

SEQ ID NO: 2766514 - RNA, 18 nt, Leptospira interrogans serovar lai str. 56601
aucuaaauuuucuuuauu

SEQ ID NO: 2766515 - RNA, 20 nt, Leptospira interrogans serovar lai str. 56601
aucuaacccauucaacauca

SEQ ID NO: 2766516 - RNA, 17 nt, Leptospira interrogans serovar lai str. 56601
aucuaagauugaaugaa

SEQ ID NO: 2766517 - RNA, 20 nt, Leptospira interrogans serovar lai str. 56601
aucuaagauuuucuuugauu

SEQ ID NO: 2766518 - RNA, 16 nt, Leptospira interrogans serovar lai str. 56601
aucuaauauuuuucca

SEQ ID NO: 2766519 - RNA, 17 nt, Leptospira interrogans serovar lai str. 56601
aucuaaucgaaacuaua

SEQ ID NO: 2766520 - RNA, 14 nt, Leptospira interrogans serovar lai str. 56601
aucuaauucuucua

SEQ ID NO: 2766521 - RNA, 20 nt, Leptospira interrogans serovar lai str. 56601
aucuaauuuguaagaacacu

SEQ ID NO: 2766522 - RNA, 12 nt, Leptospira interrogans serovar lai str. 56601
aucuaauuuuuu

SEQ ID NO: 2766523 - RNA, 18 nt, Leptospira interrogans serovar lai str. 56601
aucuacaaaagauuuuua

SEQ ID NO: 2766524 - RNA, 14 nt, Leptospira interrogans serovar lai str. 56601
aucuacauaaaaaa

SEQ ID NO: 2766525 - RNA, 20 nt, Leptospira interrogans serovar lai str. 56601
aucuacggaagcuaaaacua

SEQ ID NO: 2766526 - RNA, 17 nt, Leptospira interrogans serovar lai str. 56601
aucuacguuucaauuac

SEQ ID NO: 2766527 - RNA, 22 nt, Leptospira interrogans serovar lai str. 56601
aucuacuaaaucagaauaaucu

SEQ ID NO: 2766528 - RNA, 13 nt, Leptospira interrogans serovar lai str. 56601
aucuacuugaauu

SEQ ID NO: 2766529 - RNA, 13 nt, Leptospira interrogans serovar lai str. 56601
aucuagauuuuac

SEQ ID NO: 2766530 - RNA, 22 nt, Leptospira interrogans serovar lai str. 56601
aucuagauuuuacgauuaaauu

SEQ ID NO: 2766531 - RNA, 19 nt, Leptospira interrogans serovar lai str. 56601
aucuagcaacacauuuuca

SEQ ID NO: 2766532 - RNA, 21 nt, Leptospira interrogans serovar lai str. 56601
aucuagcguucugaggaggau

SEQ ID NO: 2766533 - RNA, 15 nt, Leptospira interrogans serovar lai str. 56601
aucuaggauugugga

SEQ ID NO: 2766534 - RNA, 14 nt, Leptospira interrogans serovar lai str. 56601
aucuauauuuuaca

SEQ ID NO: 2766535 - RNA, 18 nt, Leptospira interrogans serovar lai str. 56601
aucuaucucaaaaauacu

SEQ ID NO: 2766536 - RNA, 21 nt, Leptospira interrogans serovar lai str. 56601
aucuaugauauugcugucaua

SEQ ID NO: 2766537 - RNA, 19 nt, Leptospira interrogans serovar lai str. 56601
aucuaugauucugaaaaaa

SEQ ID NO: 2766538 - RNA, 16 nt, Leptospira interrogans serovar lai str. 56601
aucuauguuuuuuccg

SEQ ID NO: 2766539 - RNA, 19 nt, Leptospira interrogans serovar lai str. 56601
aucuauuagaacaucaauu

SEQ ID NO: 2766540 - RNA, 22 nt, Leptospira interrogans serovar lai str. 56601
aucuauuagaacaucaauuuua

SEQ ID NO: 2766541 - RNA, 13 nt, Leptospira interrogans serovar lai str. 56601
aucuauuccuaaa

SEQ ID NO: 2766542 - RNA, 14 nt, Leptospira interrogans serovar lai str. 56601
aucuauucuuaaaa

SEQ ID NO: 2766543 - RNA, 17 nt, Leptospira interrogans serovar lai str. 56601
aucuauucuuaaaaugu

SEQ ID NO: 2766544 - RNA, 21 nt, Leptospira interrogans serovar lai str. 56601
aucuauucuuaaaauguagga

SEQ ID NO: 2766545 - RNA, 22 nt, Leptospira interrogans serovar lai str. 56601
aucuauucuuaaaauguaggaa

SEQ ID NO: 2766546 - RNA, 17 nt, Leptospira interrogans serovar lai str. 56601
aucuauugaaacaaaaa

SEQ ID NO: 2766547 - RNA, 20 nt, Leptospira interrogans serovar lai str. 56601
aucuauuguaauaaaucgaa

SEQ ID NO: 2766548 - RNA, 19 nt, Leptospira interrogans serovar lai str. 56601
aucuauuuccguuauauua

SEQ ID NO: 2766549 - RNA, 14 nt, Leptospira interrogans serovar lai str. 56601
aucucaaaaacacu

SEQ ID NO: 2766550 - RNA, 15 nt, Leptospira interrogans serovar lai str. 56601
aucucaaaaauacuu

SEQ ID NO: 2766551 - RNA, 15 nt, Leptospira interrogans serovar lai str. 56601
aucucaaaaauagca

SEQ ID NO: 2766552 - RNA, 17 nt, Leptospira interrogans serovar lai str. 56601
aucucaaaauaaaucga

SEQ ID NO: 2766553 - RNA, 22 nt, Leptospira interrogans serovar lai str. 56601
aucucaaaauaaaucgauuaca

SEQ ID NO: 2766554 - RNA, 21 nt, Leptospira interrogans serovar lai str. 56601
aucucaagauuaaucuggucg

SEQ ID NO: 2766555 - RNA, 17 nt, Leptospira interrogans serovar lai str. 56601
aucucaauauaaaucug

SEQ ID NO: 2766556 - RNA, 14 nt, Leptospira interrogans serovar lai str. 56601
aucucaaucaaaau

SEQ ID NO: 2766557 - RNA, 13 nt, Leptospira interrogans serovar lai str. 56601
aucucagaaaauu

SEQ ID NO: 2766558 - RNA, 16 nt, Leptospira interrogans serovar lai str. 56601
aucucagaaaauuuua

SEQ ID NO: 2766559 - RNA, 18 nt, Leptospira interrogans serovar lai str. 56601
aucuccaaaaucauuuaa

SEQ ID NO: 2766560 - RNA, 22 nt, Leptospira interrogans serovar lai str. 56601
aucuccacuauggaauuuuuua

SEQ ID NO: 2766561 - RNA, 19 nt, Leptospira interrogans serovar lai str. 56601
aucuccacuuaauuuuucu

SEQ ID NO: 2766562 - RNA, 19 nt, Leptospira interrogans serovar lai str. 56601
aucuccgcucuauuuccac

SEQ ID NO: 2766563 - RNA, 13 nt, Leptospira interrogans serovar lai str. 56601
aucuccuaaaaua

SEQ ID NO: 2766564 - RNA, 15 nt, Leptospira interrogans serovar lai str. 56601
aucuccuaaaauaaa

SEQ ID NO: 2766565 - RNA, 18 nt, Leptospira interrogans serovar lai str. 56601
aucuccuugaaucaaaua

SEQ ID NO: 2766566 - RNA, 15 nt, Leptospira interrogans serovar lai str. 56601
aucucgauuccuaaa

SEQ ID NO: 2766567 - RNA, 17 nt, Leptospira interrogans serovar lai str. 56601
aucucgauuccuaaaau

SEQ ID NO: 2766568 - RNA, 17 nt, Leptospira interrogans serovar lai str. 56601
aucucgauuucuaaaau

SEQ ID NO: 2766569 - RNA, 13 nt, Leptospira interrogans serovar lai str. 56601
aucuuuuuuaaaa

SEQ ID NO: 2766570 - RNA, 12 nt, Leptospira interrogans serovar lai str. 56601
aucuuuuuuaau

SEQ ID NO: 2766571 - RNA, 13 nt, Leptospira interrogans serovar lai str. 56601
aucuuuuuuucua

SEQ ID NO: 2766572 - RNA, 13 nt, Leptospira interrogans serovar lai str. 56601
aucuuuuuuuucu

SEQ ID NO: 2766573 - RNA, 23 nt, Leptospira interrogans serovar lai str. 56601
aucuuuuuuuucuaaaauauuug

SEQ ID NO: 2766574 - RNA, 15 nt, Leptospira interrogans serovar lai str. 56601
augaaaaaaaacaaa

SEQ ID NO: 2766575 - RNA, 22 nt, Leptospira interrogans serovar lai str. 56601
augaaaaaacuauuuaauauag

SEQ ID NO: 2766576 - RNA, 12 nt, Leptospira interrogans serovar lai str. 56601
augaaaaaacuu

SEQ ID NO: 2766577 - RNA, 20 nt, Leptospira interrogans serovar lai str. 56601
augaaaaaacuuuuuauaaa

SEQ ID NO: 2766578 - RNA, 12 nt, Leptospira interrogans serovar lai str. 56601
augaaaaagaaa

SEQ ID NO: 2766579 - RNA, 13 nt, Leptospira interrogans serovar lai str. 56601
augaaaaagaaac

SEQ ID NO: 2766580 - RNA, 23 nt, Leptospira interrogans serovar lai str. 56601
augaaaaagaaacggaagaaaau

SEQ ID NO: 2766581 - RNA, 14 nt, Leptospira interrogans serovar lai str. 56601
augaaaaagaauuu

SEQ ID NO: 2766582 - RNA, 19 nt, Leptospira interrogans serovar lai str. 56601
augaaaaagaauuuuuaaa

SEQ ID NO: 2766583 - RNA, 18 nt, Leptospira interrogans serovar lai str. 56601
augaaaacuaggaacucc

SEQ ID NO: 2766584 - RNA, 18 nt, Leptospira interrogans serovar lai str. 56601
augaaaagucaaaaaaug

SEQ ID NO: 2766585 - RNA, 15 nt, Leptospira interrogans serovar lai str. 56601
augaaaauuauaagu

SEQ ID NO: 2766586 - RNA, 12 nt, Leptospira interrogans serovar lai str. 56601
augaaaauuccc

SEQ ID NO: 2766587 - RNA, 12 nt, Leptospira interrogans serovar lai str. 56601
augaaaauucuu

SEQ ID NO: 2766588 - RNA, 17 nt, Leptospira interrogans serovar lai str. 56601
augaaagguaauuuuga

SEQ ID NO: 2766589 - RNA, 17 nt, Leptospira interrogans serovar lai str. 56601
augaaauacaaaaagaa

SEQ ID NO: 2766590 - RNA, 13 nt, Leptospira interrogans serovar lai str. 56601
augaaauagucaa

SEQ ID NO: 2766591 - RNA, 20 nt, Leptospira interrogans serovar lai str. 56601
augaaaucuacaaaacuguu

SEQ ID NO: 2766592 - RNA, 23 nt, Leptospira interrogans serovar lai str. 56601
augaaaugugggaccuggcucuc

SEQ ID NO: 2766593 - RNA, 14 nt, Leptospira interrogans serovar lai str. 56601
augaaauuuuaaaa

SEQ ID NO: 2766594 - RNA, 15 nt, Leptospira interrogans serovar lai str. 56601
augaaauuuucuuag

SEQ ID NO: 2766595 - RNA, 18 nt, Leptospira interrogans serovar lai str. 56601
augaaauuuucuuagaaa

SEQ ID NO: 2766596 - RNA, 13 nt, Leptospira interrogans serovar lai str. 56601
augaaauuuuuca

SEQ ID NO: 2766597 - RNA, 21 nt, Leptospira interrogans serovar lai str. 56601
augaaauuuuuguacaaaacc

SEQ ID NO: 2766598 - RNA, 15 nt, Leptospira interrogans serovar lai str. 56601
augaaccauggauuu

SEQ ID NO: 2766599 - RNA, 19 nt, Leptospira interrogans serovar lai str. 56601
augaacucuuacaauuuca

SEQ ID NO: 2766600 - RNA, 19 nt, Leptospira interrogans serovar lai str. 56601
augaacuucuuccauucua

SEQ ID NO: 2766601 - RNA, 16 nt, Leptospira interrogans serovar lai str. 56601
augaacuuuuuuauau

SEQ ID NO: 2766602 - RNA, 16 nt, Leptospira interrogans serovar lai str. 56601
augaagaagcuaaaau

SEQ ID NO: 2766603 - RNA, 19 nt, Leptospira interrogans serovar lai str. 56601
augaagacgcuuaaaaaug

SEQ ID NO: 2766604 - RNA, 13 nt, Leptospira interrogans serovar lai str. 56601
augaagagaaagu

SEQ ID NO: 2766605 - RNA, 21 nt, Leptospira interrogans serovar lai str. 56601
augaagagguacagaaacaaa

SEQ ID NO: 2766606 - RNA, 19 nt, Leptospira interrogans serovar lai str. 56601
augaaguaugaaguaaguu

SEQ ID NO: 2766607 - RNA, 20 nt, Leptospira interrogans serovar lai str. 56601
augaauaggcgauuuuacaa

SEQ ID NO: 2766608 - RNA, 18 nt, Leptospira interrogans serovar lai str. 56601
augaauauuuuccaaaaa

SEQ ID NO: 2766609 - RNA, 16 nt, Leptospira interrogans serovar lai str. 56601
augaaucgaauaaaaa

SEQ ID NO: 2766610 - RNA, 20 nt, Leptospira interrogans serovar lai str. 56601
augaaucguaaaaaaauauu

SEQ ID NO: 2766611 - RNA, 22 nt, Leptospira interrogans serovar lai str. 56601
augaaucuuucauguauuacuc

SEQ ID NO: 2766612 - RNA, 14 nt, Leptospira interrogans serovar lai str. 56601
augaauuaaagaag

SEQ ID NO: 2766613 - RNA, 19 nt, Leptospira interrogans serovar lai str. 56601
augaauucucuaucuuguu

SEQ ID NO: 2766614 - RNA, 16 nt, Leptospira interrogans serovar lai str. 56601
augaauugaauuuuuu

SEQ ID NO: 2766615 - RNA, 17 nt, Leptospira interrogans serovar lai str. 56601
augaauugaauuuuuua

SEQ ID NO: 2766616 - RNA, 20 nt, Leptospira interrogans serovar lai str. 56601
augaauugaauuuuuuaaau

SEQ ID NO: 2766617 - RNA, 14 nt, Leptospira interrogans serovar lai str. 56601
augaauuguaaaaa

SEQ ID NO: 2766618 - RNA, 16 nt, Leptospira interrogans serovar lai str. 56601
augaauuguaaaaaac

SEQ ID NO: 2766619 - RNA, 14 nt, Leptospira interrogans serovar lai str. 56601
augaauuuucaaaa

SEQ ID NO: 2766620 - RNA, 18 nt, Leptospira interrogans serovar lai str. 56601
augaauuuuuaaacauuu

SEQ ID NO: 2766621 - RNA, 16 nt, Leptospira interrogans serovar lai str. 56601
augaauuuuuauaaaa

SEQ ID NO: 2766622 - RNA, 18 nt, Leptospira interrogans serovar lai str. 56601
augaauuuuuauaaaaau

SEQ ID NO: 2766623 - RNA, 19 nt, Leptospira interrogans serovar lai str. 56601
augaauuuuuauaaaaaua

SEQ ID NO: 2766624 - RNA, 20 nt, Leptospira interrogans serovar lai str. 56601
augaauuuuuauaaaaauac

SEQ ID NO: 2766625 - RNA, 12 nt, Leptospira interrogans serovar lai str. 56601
augaauuuuuca

SEQ ID NO: 2766626 - RNA, 18 nt, Leptospira interrogans serovar lai str. 56601
augaauuuuucauuuugu

SEQ ID NO: 2766627 - RNA, 22 nt, Leptospira interrogans serovar lai str. 56601
augaauuuuuuauuaagaacuu

SEQ ID NO: 2766628 - RNA, 19 nt, Leptospira interrogans serovar lai str. 56601
augacacuuaucaaauaga

SEQ ID NO: 2766629 - RNA, 17 nt, Leptospira interrogans serovar lai str. 56601
augacgauuuucuccuc

SEQ ID NO: 2766630 - RNA, 14 nt, Leptospira interrogans serovar lai str. 56601
augacuuaaucugu

SEQ ID NO: 2766631 - RNA, 19 nt, Leptospira interrogans serovar lai str. 56601
augacuuaaucugugggaa

SEQ ID NO: 2766632 - RNA, 12 nt, Leptospira interrogans serovar lai str. 56601
augagaaacaaa

SEQ ID NO: 2766633 - RNA, 13 nt, Leptospira interrogans serovar lai str. 56601
augagaaacaaag

SEQ ID NO: 2766634 - RNA, 17 nt, Leptospira interrogans serovar lai str. 56601
augagaaacaaaguaga

SEQ ID NO: 2766635 - RNA, 18 nt, Leptospira interrogans serovar lai str. 56601
augagaaagaauuucuaa

SEQ ID NO: 2766636 - RNA, 17 nt, Leptospira interrogans serovar lai str. 56601
augagaaggaucaaaac

SEQ ID NO: 2766637 - RNA, 12 nt, Leptospira interrogans serovar lai str. 56601
augagaaucagu

SEQ ID NO: 2766638 - RNA, 13 nt, Leptospira interrogans serovar lai str. 56601
augagaguuccca

SEQ ID NO: 2766639 - RNA, 17 nt, Leptospira interrogans serovar lai str. 56601
augagaguucgugaaga

SEQ ID NO: 2766640 - RNA, 13 nt, Leptospira interrogans serovar lai str. 56601
augagauuuuugg

SEQ ID NO: 2766641 - RNA, 22 nt, Leptospira interrogans serovar lai str. 56601
augagcauucuugagaaaggag

SEQ ID NO: 2766642 - RNA, 23 nt, Leptospira interrogans serovar lai str. 56601
augagcauucuugagaaaggaga

SEQ ID NO: 2766643 - RNA, 21 nt, Leptospira interrogans serovar lai str. 56601
augagcuuuuuuagaaaaagc

SEQ ID NO: 2766644 - RNA, 18 nt, Leptospira interrogans serovar lai str. 56601
augagucugucccaaaau

SEQ ID NO: 2766645 - RNA, 20 nt, Leptospira interrogans serovar lai str. 56601
augagucugucccaaaaucu

SEQ ID NO: 2766646 - RNA, 23 nt, Leptospira interrogans serovar lai str. 56601
augagucuuuuuacuugcaaaaa

SEQ ID NO: 2766647 - RNA, 21 nt, Leptospira interrogans serovar lai str. 56601
augaguuauaguaaaagaaaa

SEQ ID NO: 2766648 - RNA, 22 nt, Leptospira interrogans serovar lai str. 56601
augaguuauaguaaaagaaaau

SEQ ID NO: 2766649 - RNA, 15 nt, Leptospira interrogans serovar lai str. 56601
augaguucacuucuu

SEQ ID NO: 2766650 - RNA, 14 nt, Leptospira interrogans serovar lai str. 56601
augaguucccacaa

SEQ ID NO: 2766651 - RNA, 19 nt, Leptospira interrogans serovar lai str. 56601
augaguucccacauucgau

SEQ ID NO: 2766652 - RNA, 23 nt, Leptospira interrogans serovar lai str. 56601
auggaauuuuucaacaacucuaa

SEQ ID NO: 2766653 - RNA, 23 nt, Leptospira interrogans serovar lai str. 56601
auggaauuuuuuaacaacucuaa

SEQ ID NO: 2766654 - RNA, 17 nt, Leptospira interrogans serovar lai str. 56601
auggaauuuuuuaauaa

SEQ ID NO: 2766655 - RNA, 19 nt, Leptospira interrogans serovar lai str. 56601
auggaauuuuuuaauaacu

SEQ ID NO: 2766656 - RNA, 21 nt, Leptospira interrogans serovar lai str. 56601
auggaauuuuuuaauaacucu

SEQ ID NO: 2766657 - RNA, 20 nt, Leptospira interrogans serovar lai str. 56601
auggacagaauccuuccaaa

SEQ ID NO: 2766658 - RNA, 21 nt, Leptospira interrogans serovar lai str. 56601
auggacuauuuuauuacaauu

SEQ ID NO: 2766659 - RNA, 21 nt, Leptospira interrogans serovar lai str. 56601
auggagaauuaauuuuucaau

SEQ ID NO: 2766660 - RNA, 13 nt, Leptospira interrogans serovar lai str. 56601
auggagaauuuau

SEQ ID NO: 2766661 - RNA, 12 nt, Leptospira interrogans serovar lai str. 56601
auggaucaaaac

SEQ ID NO: 2766662 - RNA, 14 nt, Leptospira interrogans serovar lai str. 56601
auggaucaaaacca

SEQ ID NO: 2766663 - RNA, 15 nt, Leptospira interrogans serovar lai str. 56601
auggaucaaaaccau

SEQ ID NO: 2766664 - RNA, 15 nt, Leptospira interrogans serovar lai str. 56601
auggaucaaaagagu

SEQ ID NO: 2766665 - RNA, 15 nt, Leptospira interrogans serovar lai str. 56601
auggaugaauugauu

SEQ ID NO: 2766666 - RNA, 15 nt, Leptospira interrogans serovar lai str. 56601
auggauuuauaauuc

SEQ ID NO: 2766667 - RNA, 15 nt, Leptospira interrogans serovar lai str. 56601
auggcucauuuuucu

SEQ ID NO: 2766668 - RNA, 19 nt, Leptospira interrogans serovar lai str. 56601
auggcucauuuuucuuaaa

SEQ ID NO: 2766669 - RNA, 20 nt, Leptospira interrogans serovar lai str. 56601
auggcucugaguagaaaguu

SEQ ID NO: 2766670 - RNA, 13 nt, Leptospira interrogans serovar lai str. 56601
auggguauugguu

SEQ ID NO: 2766671 - RNA, 16 nt, Leptospira interrogans serovar lai str. 56601
augguacgaccaaaac

SEQ ID NO: 2766672 - RNA, 15 nt, Leptospira interrogans serovar lai str. 56601
auggucaucucuaua

SEQ ID NO: 2766673 - RNA, 22 nt, Leptospira interrogans serovar lai str. 56601
auggucgcucugugaaacucag

SEQ ID NO: 2766674 - RNA, 18 nt, Leptospira interrogans serovar lai str. 56601
augguugcaaaaaagaaa

SEQ ID NO: 2766675 - RNA, 23 nt, Leptospira interrogans serovar lai str. 56601
augguugcaaaaaagaaagcagc

SEQ ID NO: 2766676 - RNA, 19 nt, Leptospira interrogans serovar lai str. 56601
augguuguuaggauaaaag

SEQ ID NO: 2766677 - RNA, 16 nt, Leptospira interrogans serovar lai str. 56601
augguuucaauuuaaa

SEQ ID NO: 2766678 - RNA, 23 nt, Leptospira interrogans serovar lai str. 56601
augguuuuggaugaugggaccaa

SEQ ID NO: 2766679 - RNA, 13 nt, Leptospira interrogans serovar lai str. 56601
augguuuuuucaa

SEQ ID NO: 2766680 - RNA, 23 nt, Leptospira interrogans serovar lai str. 56601
auguaaaguucuuuucuuaaaaa

SEQ ID NO: 2766681 - RNA, 11 nt, Leptospira interrogans serovar lai str. 56601
auguaaaucgg

SEQ ID NO: 2766682 - RNA, 22 nt, Leptospira interrogans serovar lai str. 56601
auguaacaguaagaagaaaagg

SEQ ID NO: 2766683 - RNA, 15 nt, Leptospira interrogans serovar lai str. 56601
auguaagaaaaucug

SEQ ID NO: 2766684 - RNA, 21 nt, Leptospira interrogans serovar lai str. 56601
auguaagaaacucauuuuucu

SEQ ID NO: 2766685 - RNA, 15 nt, Leptospira interrogans serovar lai str. 56601
auguaagaguuccua

SEQ ID NO: 2766686 - RNA, 23 nt, Leptospira interrogans serovar lai str. 56601
auguaauauaaguuaagugaaaa

SEQ ID NO: 2766687 - RNA, 21 nt, Leptospira interrogans serovar lai str. 56601
auguaauaugagugaauggag

SEQ ID NO: 2766688 - RNA, 13 nt, Leptospira interrogans serovar lai str. 56601
auguagaaauuug

SEQ ID NO: 2766689 - RNA, 14 nt, Leptospira interrogans serovar lai str. 56601
auguagauccuagc

SEQ ID NO: 2766690 - RNA, 21 nt, Leptospira interrogans serovar lai str. 56601
auguagauccuagcuauuuuc

SEQ ID NO: 2766691 - RNA, 12 nt, Leptospira interrogans serovar lai str. 56601
auguagccaaau

SEQ ID NO: 2766692 - RNA, 23 nt, Leptospira interrogans serovar lai str. 56601
auguaggaacccauacaaaauuu

SEQ ID NO: 2766693 - RNA, 17 nt, Leptospira interrogans serovar lai str. 56601
auguauggcucauuuuu

SEQ ID NO: 2766694 - RNA, 19 nt, Leptospira interrogans serovar lai str. 56601
auguauggcucauuuuucu

SEQ ID NO: 2766695 - RNA, 22 nt, Leptospira interrogans serovar lai str. 56601
auguauggcucauuuuucuuaa

SEQ ID NO: 2766696 - RNA, 20 nt, Leptospira interrogans serovar lai str. 56601
auguauuacucagaguuaua

SEQ ID NO: 2766697 - RNA, 17 nt, Leptospira interrogans serovar lai str. 56601
auguauucuauaaaauu

SEQ ID NO: 2766698 - RNA, 22 nt, Leptospira interrogans serovar lai str. 56601
auguauugcuuuaguaguauuu

SEQ ID NO: 2766699 - RNA, 11 nt, Leptospira interrogans serovar lai str. 56601
augucaacagg

SEQ ID NO: 2766700 - RNA, 16 nt, Leptospira interrogans serovar lai str. 56601
augucacagacuucuu

SEQ ID NO: 2766701 - RNA, 11 nt, Leptospira interrogans serovar lai str. 56601
auguccggguu

SEQ ID NO: 2766702 - RNA, 16 nt, Leptospira interrogans serovar lai str. 56601
augucguuaaauuuuc

SEQ ID NO: 2766703 - RNA, 21 nt, Leptospira interrogans serovar lai str. 56601
augucuuagaauuuuguuucu

SEQ ID NO: 2766704 - RNA, 15 nt, Leptospira interrogans serovar lai str. 56601
augugaauucagaaa

SEQ ID NO: 2766705 - RNA, 16 nt, Leptospira interrogans serovar lai str. 56601
augugaauucagaaaa

SEQ ID NO: 2766706 - RNA, 15 nt, Leptospira interrogans serovar lai str. 56601
augugagaguuccca

SEQ ID NO: 2766707 - RNA, 23 nt, Leptospira interrogans serovar lai str. 56601
augugaguucccacauuuuaaag

SEQ ID NO: 2766708 - RNA, 14 nt, Leptospira interrogans serovar lai str. 56601
augugaguucccau

SEQ ID NO: 2766709 - RNA, 16 nt, Leptospira interrogans serovar lai str. 56601
augugauagaaaggua

SEQ ID NO: 2766710 - RNA, 19 nt, Leptospira interrogans serovar lai str. 56601
augugcaaaggaguauuuu

SEQ ID NO: 2766711 - RNA, 19 nt, Leptospira interrogans serovar lai str. 56601
augugccuucguuuaaaaa

SEQ ID NO: 2766712 - RNA, 23 nt, Leptospira interrogans serovar lai str. 56601
auguggcagcuacuaggaaaauu

SEQ ID NO: 2766713 - RNA, 23 nt, Leptospira interrogans serovar lai str. 56601
augugggaacuacuacaaaucac

SEQ ID NO: 2766714 - RNA, 15 nt, Leptospira interrogans serovar lai str. 56601
augugggaacuacuc

SEQ ID NO: 2766715 - RNA, 16 nt, Leptospira interrogans serovar lai str. 56601
augugggaacucucac

SEQ ID NO: 2766716 - RNA, 15 nt, Leptospira interrogans serovar lai str. 56601
augugggaacucuua

SEQ ID NO: 2766717 - RNA, 15 nt, Leptospira interrogans serovar lai str. 56601
augugggaauuacua

SEQ ID NO: 2766718 - RNA, 21 nt, Leptospira interrogans serovar lai str. 56601
auguguaaugauuucagauuc

SEQ ID NO: 2766719 - RNA, 16 nt, Leptospira interrogans serovar lai str. 56601
auguuauagacaacgu

SEQ ID NO: 2766720 - RNA, 22 nt, Leptospira interrogans serovar lai str. 56601
auguuauagacaacguuacuuu

SEQ ID NO: 2766721 - RNA, 19 nt, Leptospira interrogans serovar lai str. 56601
auguuauauauuuuuaauu

SEQ ID NO: 2766722 - RNA, 11 nt, Leptospira interrogans serovar lai str. 56601
auguuauaucg

SEQ ID NO: 2766723 - RNA, 12 nt, Leptospira interrogans serovar lai str. 56601
auguuauuuuua

SEQ ID NO: 2766724 - RNA, 14 nt, Leptospira interrogans serovar lai str. 56601
auguuauuuuuaag

SEQ ID NO: 2766725 - RNA, 14 nt, Leptospira interrogans serovar lai str. 56601
auguuauuuuugca

SEQ ID NO: 2766726 - RNA, 23 nt, Leptospira interrogans serovar lai str. 56601
auguucaaaauuuaucuguaaaa

SEQ ID NO: 2766727 - RNA, 12 nt, Leptospira interrogans serovar lai str. 56601
auguucaaauuc

SEQ ID NO: 2766728 - RNA, 19 nt, Leptospira interrogans serovar lai str. 56601
auguucaaauucaucaauu

SEQ ID NO: 2766729 - RNA, 20 nt, Leptospira interrogans serovar lai str. 56601
auguucguucccacaaauua

SEQ ID NO: 2766730 - RNA, 17 nt, Leptospira interrogans serovar lai str. 56601
auguuguucuccaacuu

SEQ ID NO: 2766731 - RNA, 15 nt, Leptospira interrogans serovar lai str. 56601
auguuguuuguggau

SEQ ID NO: 2766732 - RNA, 21 nt, Leptospira interrogans serovar lai str. 56601
auguuucaguauucuagaaua

SEQ ID NO: 2766733 - RNA, 21 nt, Leptospira interrogans serovar lai str. 56601
auguuucccaguucuuaaaua

SEQ ID NO: 2766734 - RNA, 17 nt, Leptospira interrogans serovar lai str. 56601
auguuugaauuuuuaag

SEQ ID NO: 2766735 - RNA, 18 nt, Leptospira interrogans serovar lai str. 56601
auguuugagguuuuaaaa

SEQ ID NO: 2766736 - RNA, 14 nt, Leptospira interrogans serovar lai str. 56601
auguuuuauauaaa

SEQ ID NO: 2766737 - RNA, 22 nt, Leptospira interrogans serovar lai str. 56601
auguuuuccagaaaccauaaaa

SEQ ID NO: 2766738 - RNA, 22 nt, Leptospira interrogans serovar lai str. 56601
auguuuuguagagucaaaaguu

SEQ ID NO: 2766739 - RNA, 16 nt, Leptospira interrogans serovar lai str. 56601
auguuuuuaaaaucuu

SEQ ID NO: 2766740 - RNA, 20 nt, Leptospira interrogans serovar lai str. 56601
auguuuuucugauagagaaa

SEQ ID NO: 2766741 - RNA, 23 nt, Leptospira interrogans serovar lai str. 56601
auguuuuucugauagagaaaaau

SEQ ID NO: 2766742 - RNA, 22 nt, Leptospira interrogans serovar lai str. 56601
auguuuuuggguuuuacuaaaa

SEQ ID NO: 2766743 - RNA, 15 nt, Leptospira interrogans serovar lai str. 56601
auguuuuuguauuuu

SEQ ID NO: 2766744 - RNA, 22 nt, Leptospira interrogans serovar lai str. 56601
auguuuuuuccgguaauuauaa

SEQ ID NO: 2766745 - RNA, 20 nt, Leptospira interrogans serovar lai str. 56601
auuaaaaaaaaauguaaaaa

SEQ ID NO: 2766746 - RNA, 14 nt, Leptospira interrogans serovar lai str. 56601
auuaaaaaaauaau

SEQ ID NO: 2766747 - RNA, 15 nt, Leptospira interrogans serovar lai str. 56601
auuaaaaaaauaaua

SEQ ID NO: 2766748 - RNA, 11 nt, Leptospira interrogans serovar lai str. 56601
auuaaaaagaa

SEQ ID NO: 2766749 - RNA, 13 nt, Leptospira interrogans serovar lai str. 56601
auuaaaaauuucu

SEQ ID NO: 2766750 - RNA, 12 nt, Leptospira interrogans serovar lai str. 56601
auuaaaaauuuu

SEQ ID NO: 2766751 - RNA, 21 nt, Leptospira interrogans serovar lai str. 56601
auuaaaaccguuccauaaauu

SEQ ID NO: 2766752 - RNA, 21 nt, Leptospira interrogans serovar lai str. 56601
auuaaaacgauaagucucucu

SEQ ID NO: 2766753 - RNA, 12 nt, Leptospira interrogans serovar lai str. 56601
auuaaaauaaac

SEQ ID NO: 2766754 - RNA, 14 nt, Leptospira interrogans serovar lai str. 56601
auuaaaauaaacua

SEQ ID NO: 2766755 - RNA, 15 nt, Leptospira interrogans serovar lai str. 56601
auuaaaauccucaac

SEQ ID NO: 2766756 - RNA, 20 nt, Leptospira interrogans serovar lai str. 56601
auuaaaaucuaucucaaaaa

SEQ ID NO: 2766757 - RNA, 22 nt, Leptospira interrogans serovar lai str. 56601
auuaaaaucuaucucaaaaaua

SEQ ID NO: 2766758 - RNA, 19 nt, Leptospira interrogans serovar lai str. 56601
auuaaaauguacaauuaaa

SEQ ID NO: 2766759 - RNA, 15 nt, Leptospira interrogans serovar lai str. 56601
auuaaacaaagaaua

SEQ ID NO: 2766760 - RNA, 14 nt, Leptospira interrogans serovar lai str. 56601
auuaaacccauuuu

SEQ ID NO: 2766761 - RNA, 13 nt, Leptospira interrogans serovar lai str. 56601
auuaaaccgguaa

SEQ ID NO: 2766762 - RNA, 18 nt, Leptospira interrogans serovar lai str. 56601
auuaaaccgguaaaaagu

SEQ ID NO: 2766763 - RNA, 21 nt, Leptospira interrogans serovar lai str. 56601
auuaaaccgguaaaaaguaaa

SEQ ID NO: 2766764 - RNA, 22 nt, Leptospira interrogans serovar lai str. 56601
auuaaaccgguaaaaaguaaaa

SEQ ID NO: 2766765 - RNA, 15 nt, Leptospira interrogans serovar lai str. 56601
auuaaacuucaaaaa

SEQ ID NO: 2766766 - RNA, 19 nt, Leptospira interrogans serovar lai str. 56601
auuaaacuucaaaaaauau

SEQ ID NO: 2766767 - RNA, 16 nt, Leptospira interrogans serovar lai str. 56601
auuaaacuuuuauaaa

SEQ ID NO: 2766768 - RNA, 20 nt, Leptospira interrogans serovar lai str. 56601
auuaaacuuuuauaaaaucu

SEQ ID NO: 2766769 - RNA, 18 nt, Leptospira interrogans serovar lai str. 56601
auuaaagaauaauauuuu

SEQ ID NO: 2766770 - RNA, 16 nt, Leptospira interrogans serovar lai str. 56601
auuaaagauuugcucu

SEQ ID NO: 2766771 - RNA, 15 nt, Leptospira interrogans serovar lai str. 56601
auuaaaguaaauucg

SEQ ID NO: 2766772 - RNA, 21 nt, Leptospira interrogans serovar lai str. 56601
auuaaaguauuaauuuaauca

SEQ ID NO: 2766773 - RNA, 22 nt, Leptospira interrogans serovar lai str. 56601
auuaaaguccaaaucaaaaaag

SEQ ID NO: 2766774 - RNA, 15 nt, Leptospira interrogans serovar lai str. 56601
auuaaauaaagguuu

SEQ ID NO: 2766775 - RNA, 22 nt, Leptospira interrogans serovar lai str. 56601
auuaaaucgcauuugacaauuu

SEQ ID NO: 2766776 - RNA, 16 nt, Leptospira interrogans serovar lai str. 56601
auuaaaugaaguguaa

SEQ ID NO: 2766777 - RNA, 12 nt, Leptospira interrogans serovar lai str. 56601
auuaaauuaacg

SEQ ID NO: 2766778 - RNA, 20 nt, Leptospira interrogans serovar lai str. 56601
auuaaauucuagcgucuaaa

SEQ ID NO: 2766779 - RNA, 22 nt, Leptospira interrogans serovar lai str. 56601
auuaaauucuagcgucuaaaaa

SEQ ID NO: 2766780 - RNA, 14 nt, Leptospira interrogans serovar lai str. 56601
auuaaauucuaugg

SEQ ID NO: 2766781 - RNA, 20 nt, Leptospira interrogans serovar lai str. 56601
auuaaauuguaugaaagaaa

SEQ ID NO: 2766782 - RNA, 22 nt, Leptospira interrogans serovar lai str. 56601
auuaaauuuuauuuauauauau

SEQ ID NO: 2766783 - RNA, 22 nt, Leptospira interrogans serovar lai str. 56601
auuaaauuuugaaaaauuccau

SEQ ID NO: 2766784 - RNA, 12 nt, Leptospira interrogans serovar lai str. 56601
auuaaauuuuua

SEQ ID NO: 2766785 - RNA, 16 nt, Leptospira interrogans serovar lai str. 56601
auuaaauuuuuauaaa

SEQ ID NO: 2766786 - RNA, 19 nt, Leptospira interrogans serovar lai str. 56601
auuaaauuuuuauaaaaua

SEQ ID NO: 2766787 - RNA, 19 nt, Leptospira interrogans serovar lai str. 56601
auuaaauuuuuauacuuuu

SEQ ID NO: 2766788 - RNA, 13 nt, Leptospira interrogans serovar lai str. 56601
auuaacaaaacug

SEQ ID NO: 2766789 - RNA, 14 nt, Leptospira interrogans serovar lai str. 56601
auuaacaaaacugc

SEQ ID NO: 2766790 - RNA, 20 nt, Leptospira interrogans serovar lai str. 56601
auuaacaaauuuaaaauaac

SEQ ID NO: 2766791 - RNA, 14 nt, Leptospira interrogans serovar lai str. 56601
auuaacagccgaau

SEQ ID NO: 2766792 - RNA, 17 nt, Leptospira interrogans serovar lai str. 56601
auuaaccguagauuuua

SEQ ID NO: 2766793 - RNA, 17 nt, Leptospira interrogans serovar lai str. 56601
auuaacggccaaauuug

SEQ ID NO: 2766794 - RNA, 13 nt, Leptospira interrogans serovar lai str. 56601
auuaacuaauuuu

SEQ ID NO: 2766795 - RNA, 20 nt, Leptospira interrogans serovar lai str. 56601
auuaacuaauuuuaguuuau

SEQ ID NO: 2766796 - RNA, 13 nt, Leptospira interrogans serovar lai str. 56601
auuaacuuuacau

SEQ ID NO: 2766797 - RNA, 18 nt, Leptospira interrogans serovar lai str. 56601
auuaacuuuacaucaauu

SEQ ID NO: 2766798 - RNA, 22 nt, Leptospira interrogans serovar lai str. 56601
auuaagaaaaauuaaaauucua

SEQ ID NO: 2766799 - RNA, 15 nt, Leptospira interrogans serovar lai str. 56601
auuaagaacuuucuc

SEQ ID NO: 2766800 - RNA, 20 nt, Leptospira interrogans serovar lai str. 56601
auuaagcagaagcuuuauua

SEQ ID NO: 2766801 - RNA, 15 nt, Leptospira interrogans serovar lai str. 56601
auuaaguaguuuuuu

SEQ ID NO: 2766802 - RNA, 12 nt, Leptospira interrogans serovar lai str. 56601
auuaagucacau

SEQ ID NO: 2766803 - RNA, 23 nt, Leptospira interrogans serovar lai str. 56601
auuaagucacauuguguuuuuua

SEQ ID NO: 2766804 - RNA, 19 nt, Leptospira interrogans serovar lai str. 56601
auuaagucccauuuagcaa

SEQ ID NO: 2766805 - RNA, 16 nt, Leptospira interrogans serovar lai str. 56601
auuaaguuacauuaug

SEQ ID NO: 2766806 - RNA, 16 nt, Leptospira interrogans serovar lai str. 56601
auuaaguuuaaaaaca

SEQ ID NO: 2766807 - RNA, 22 nt, Leptospira interrogans serovar lai str. 56601
auuaaguuuaaaaacaguauuu

SEQ ID NO: 2766808 - RNA, 21 nt, Leptospira interrogans serovar lai str. 56601
auuaaguuuauucaauuuuag

SEQ ID NO: 2766809 - RNA, 13 nt, Leptospira interrogans serovar lai str. 56601
auuaauaaaacug

SEQ ID NO: 2766810 - RNA, 22 nt, Leptospira interrogans serovar lai str. 56601
auuaauagcuugucacuauuuu

SEQ ID NO: 2766811 - RNA, 13 nt, Leptospira interrogans serovar lai str. 56601
auuaauauaaaaa

SEQ ID NO: 2766812 - RNA, 14 nt, Leptospira interrogans serovar lai str. 56601
auuaauauaaaaaa

SEQ ID NO: 2766813 - RNA, 19 nt, Leptospira interrogans serovar lai str. 56601
auuaauauucuaauucauu

SEQ ID NO: 2766814 - RNA, 15 nt, Leptospira interrogans serovar lai str. 56601
auuaauauuuauaaa

SEQ ID NO: 2766815 - RNA, 17 nt, Leptospira interrogans serovar lai str. 56601
auuaauauuuauaaaac

SEQ ID NO: 2766816 - RNA, 22 nt, Leptospira interrogans serovar lai str. 56601
auuaauccucuuucguuuuuuu

SEQ ID NO: 2766817 - RNA, 15 nt, Leptospira interrogans serovar lai str. 56601
auuaaucuguaaauc

SEQ ID NO: 2766818 - RNA, 14 nt, Leptospira interrogans serovar lai str. 56601
auuauccuuaaaau

SEQ ID NO: 2766819 - RNA, 14 nt, Leptospira interrogans serovar lai str. 56601
auuaucuuuauauu

SEQ ID NO: 2766820 - RNA, 19 nt, Leptospira interrogans serovar lai str. 56601
auuaucuuucgauuuuaaa

SEQ ID NO: 2766821 - RNA, 11 nt, Leptospira interrogans serovar lai str. 56601
auuaugaagaa

SEQ ID NO: 2766822 - RNA, 12 nt, Leptospira interrogans serovar lai str. 56601
auuaugaagaau

SEQ ID NO: 2766823 - RNA, 13 nt, Leptospira interrogans serovar lai str. 56601
auuaugaagaaug

SEQ ID NO: 2766824 - RNA, 14 nt, Leptospira interrogans serovar lai str. 56601
auuaugaauuuuua

SEQ ID NO: 2766825 - RNA, 15 nt, Leptospira interrogans serovar lai str. 56601
auuaugaauuuuuaa

SEQ ID NO: 2766826 - RNA, 22 nt, Leptospira interrogans serovar lai str. 56601
auuaugaauuuuuaaacauuua

SEQ ID NO: 2766827 - RNA, 16 nt, Leptospira interrogans serovar lai str. 56601
auuaugauagucaaaa

SEQ ID NO: 2766828 - RNA, 17 nt, Leptospira interrogans serovar lai str. 56601
auuaugauuuuuuugaa

SEQ ID NO: 2766829 - RNA, 14 nt, Leptospira interrogans serovar lai str. 56601
auuaugcaguauuu

SEQ ID NO: 2766830 - RNA, 18 nt, Leptospira interrogans serovar lai str. 56601
auuaugcaguauuuugua

SEQ ID NO: 2766831 - RNA, 14 nt, Leptospira interrogans serovar lai str. 56601
auuaugccgaauuc

SEQ ID NO: 2766832 - RNA, 15 nt, Leptospira interrogans serovar lai str. 56601
auuaugccucuuuau

SEQ ID NO: 2766833 - RNA, 17 nt, Leptospira interrogans serovar lai str. 56601
auuauggacuauuuuau

SEQ ID NO: 2766834 - RNA, 18 nt, Leptospira interrogans serovar lai str. 56601
auuauguagccaaaucug

SEQ ID NO: 2766835 - RNA, 14 nt, Leptospira interrogans serovar lai str. 56601
auuauguuugccau

SEQ ID NO: 2766836 - RNA, 21 nt, Leptospira interrogans serovar lai str. 56601
auuauuagaguuguugaaaaa

SEQ ID NO: 2766837 - RNA, 23 nt, Leptospira interrogans serovar lai str. 56601
auuauugaucucuauaaaaucaa

SEQ ID NO: 2766838 - RNA, 12 nt, Leptospira interrogans serovar lai str. 56601
auuauuuacaua

SEQ ID NO: 2766839 - RNA, 21 nt, Leptospira interrogans serovar lai str. 56601
auuauuuacuuuuuccaaaag

SEQ ID NO: 2766840 - RNA, 18 nt, Leptospira interrogans serovar lai str. 56601
auuauuuauaauuuuaua

SEQ ID NO: 2766841 - RNA, 18 nt, Leptospira interrogans serovar lai str. 56601
auuauuucaaaaauuuaa

SEQ ID NO: 2766842 - RNA, 21 nt, Leptospira interrogans serovar lai str. 56601
auuauuuuccuuuaauauuuu

SEQ ID NO: 2766843 - RNA, 23 nt, Leptospira interrogans serovar lai str. 56601
auuauuuucguauuguuuacaaa

SEQ ID NO: 2766844 - RNA, 14 nt, Leptospira interrogans serovar lai str. 56601
auuauuuucugcgu

SEQ ID NO: 2766845 - RNA, 11 nt, Leptospira interrogans serovar lai str. 56601
auuauuuugaa

SEQ ID NO: 2766846 - RNA, 17 nt, Leptospira interrogans serovar lai str. 56601
auuauuuuuuaaaaauc

SEQ ID NO: 2766847 - RNA, 16 nt, Leptospira interrogans serovar lai str. 56601
auucaaaaacuaaaau

SEQ ID NO: 2766848 - RNA, 19 nt, Leptospira interrogans serovar lai str. 56601
auucaaaaacuaaaauaca

SEQ ID NO: 2766849 - RNA, 15 nt, Leptospira interrogans serovar lai str. 56601
auucaaaagauugaa

SEQ ID NO: 2766850 - RNA, 19 nt, Leptospira interrogans serovar lai str. 56601
auucaaaauaagaaaauaa

SEQ ID NO: 2766851 - RNA, 22 nt, Leptospira interrogans serovar lai str. 56601
auucaaaauugagaauagaagc

SEQ ID NO: 2766852 - RNA, 19 nt, Leptospira interrogans serovar lai str. 56601
auucaaaauuggaugaauu

SEQ ID NO: 2766853 - RNA, 13 nt, Leptospira interrogans serovar lai str. 56601
auucaaagauaaa

SEQ ID NO: 2766854 - RNA, 19 nt, Leptospira interrogans serovar lai str. 56601
auucaaagauaaaauauag

SEQ ID NO: 2766855 - RNA, 12 nt, Leptospira interrogans serovar lai str. 56601
auucaaaugucu

SEQ ID NO: 2766856 - RNA, 18 nt, Leptospira interrogans serovar lai str. 56601
auucaaauucuuuuugga

SEQ ID NO: 2766857 - RNA, 16 nt, Leptospira interrogans serovar lai str. 56601
auucaacaucauucuc

SEQ ID NO: 2766858 - RNA, 15 nt, Leptospira interrogans serovar lai str. 56601
auucaacuaaauccu

SEQ ID NO: 2766859 - RNA, 21 nt, Leptospira interrogans serovar lai str. 56601
auucaacuuuuugaagaaaca

SEQ ID NO: 2766860 - RNA, 22 nt, Leptospira interrogans serovar lai str. 56601
auucaacuuuuugaagaaacaa

SEQ ID NO: 2766861 - RNA, 17 nt, Leptospira interrogans serovar lai str. 56601
auucaaguuaauacagu

SEQ ID NO: 2766862 - RNA, 13 nt, Leptospira interrogans serovar lai str. 56601
auucaauaaaaua

SEQ ID NO: 2766863 - RNA, 15 nt, Leptospira interrogans serovar lai str. 56601
auucaauaauuuuaa

SEQ ID NO: 2766864 - RNA, 22 nt, Leptospira interrogans serovar lai str. 56601
auucaauuucuuuaauuucaau

SEQ ID NO: 2766865 - RNA, 23 nt, Leptospira interrogans serovar lai str. 56601
auucaauuucuuuaauuucaaua

SEQ ID NO: 2766866 - RNA, 12 nt, Leptospira interrogans serovar lai str. 56601
auucaauuuuua

SEQ ID NO: 2766867 - RNA, 12 nt, Leptospira interrogans serovar lai str. 56601
auucacaaaaaa

SEQ ID NO: 2766868 - RNA, 20 nt, Leptospira interrogans serovar lai str. 56601
auucacaaacgguuuuagua

SEQ ID NO: 2766869 - RNA, 18 nt, Leptospira interrogans serovar lai str. 56601
auucacauaaaguuaaua

SEQ ID NO: 2766870 - RNA, 15 nt, Leptospira interrogans serovar lai str. 56601
auucacauuaaaaua

SEQ ID NO: 2766871 - RNA, 20 nt, Leptospira interrogans serovar lai str. 56601
auucacauuauauauuuauu

SEQ ID NO: 2766872 - RNA, 19 nt, Leptospira interrogans serovar lai str. 56601
auucaccuuccaaagauuu

SEQ ID NO: 2766873 - RNA, 23 nt, Leptospira interrogans serovar lai str. 56601
auucaccuuccaaagauuuuaaa

SEQ ID NO: 2766874 - RNA, 18 nt, Leptospira interrogans serovar lai str. 56601
auucacgaccuuaaauaa

SEQ ID NO: 2766875 - RNA, 20 nt, Leptospira interrogans serovar lai str. 56601
auucacgaccuuaaauaaua

SEQ ID NO: 2766876 - RNA, 15 nt, Leptospira interrogans serovar lai str. 56601
auucacguuaaaaua

SEQ ID NO: 2766877 - RNA, 17 nt, Leptospira interrogans serovar lai str. 56601
auucacguuaaaauaau

SEQ ID NO: 2766878 - RNA, 17 nt, Leptospira interrogans serovar lai str. 56601
auucacucuuaaauacu

SEQ ID NO: 2766879 - RNA, 19 nt, Leptospira interrogans serovar lai str. 56601
auucacuguuaaaagauuu

SEQ ID NO: 2766880 - RNA, 15 nt, Leptospira interrogans serovar lai str. 56601
auucacuuagaaaga

SEQ ID NO: 2766881 - RNA, 19 nt, Leptospira interrogans serovar lai str. 56601
auucacuuagaaagauaga

SEQ ID NO: 2766882 - RNA, 14 nt, Leptospira interrogans serovar lai str. 56601
auucacuuccauug

SEQ ID NO: 2766883 - RNA, 19 nt, Leptospira interrogans serovar lai str. 56601
auucagaaaaaaaaagaau

SEQ ID NO: 2766884 - RNA, 21 nt, Leptospira interrogans serovar lai str. 56601
auucagaaaaaaaaagaauuu

SEQ ID NO: 2766885 - RNA, 19 nt, Leptospira interrogans serovar lai str. 56601
auucagcaucgaauauccu

SEQ ID NO: 2766886 - RNA, 13 nt, Leptospira interrogans serovar lai str. 56601
auucaggauuacu

SEQ ID NO: 2766887 - RNA, 21 nt, Leptospira interrogans serovar lai str. 56601
auucaggauuacuaaugcaau

SEQ ID NO: 2766888 - RNA, 13 nt, Leptospira interrogans serovar lai str. 56601
auucagucucauu

SEQ ID NO: 2766889 - RNA, 19 nt, Leptospira interrogans serovar lai str. 56601
auucaguuucaaacugaga

SEQ ID NO: 2766890 - RNA, 18 nt, Leptospira interrogans serovar lai str. 56601
auucaguuuccacucuuu

SEQ ID NO: 2766891 - RNA, 15 nt, Leptospira interrogans serovar lai str. 56601
auucaguuuuucgga

SEQ ID NO: 2766892 - RNA, 22 nt, Leptospira interrogans serovar lai str. 56601
auucaguuuuucggauggaauc

SEQ ID NO: 2766893 - RNA, 14 nt, Leptospira interrogans serovar lai str. 56601
auucauaaaugaua

SEQ ID NO: 2766894 - RNA, 14 nt, Leptospira interrogans serovar lai str. 56601
auucaucaaauuug

SEQ ID NO: 2766895 - RNA, 16 nt, Leptospira interrogans serovar lai str. 56601
auucauccuaagaauc

SEQ ID NO: 2766896 - RNA, 21 nt, Leptospira interrogans serovar lai str. 56601
auucauucagaccuuuuuuau

SEQ ID NO: 2766897 - RNA, 17 nt, Leptospira interrogans serovar lai str. 56601
auucauuccuauaaaua

SEQ ID NO: 2766898 - RNA, 22 nt, Leptospira interrogans serovar lai str. 56601
auucauuccuauaaauaaauuu

SEQ ID NO: 2766899 - RNA, 16 nt, Leptospira interrogans serovar lai str. 56601
auucauuguaagaaau

SEQ ID NO: 2766900 - RNA, 17 nt, Leptospira interrogans serovar lai str. 56601
auucauuguaagaaaua

SEQ ID NO: 2766901 - RNA, 16 nt, Leptospira interrogans serovar lai str. 56601
auucuaaaaaugaaau

SEQ ID NO: 2766902 - RNA, 12 nt, Leptospira interrogans serovar lai str. 56601
auucuaaaaauu

SEQ ID NO: 2766903 - RNA, 16 nt, Leptospira interrogans serovar lai str. 56601
auucuaaaaauuuuuu

SEQ ID NO: 2766904 - RNA, 13 nt, Leptospira interrogans serovar lai str. 56601
auucuaaaauacu

SEQ ID NO: 2766905 - RNA, 14 nt, Leptospira interrogans serovar lai str. 56601
auucuaaaauccua

SEQ ID NO: 2766906 - RNA, 19 nt, Leptospira interrogans serovar lai str. 56601
auucuaaaauuauaggaac

SEQ ID NO: 2766907 - RNA, 17 nt, Leptospira interrogans serovar lai str. 56601
auucuaaaauuguagaa

SEQ ID NO: 2766908 - RNA, 20 nt, Leptospira interrogans serovar lai str. 56601
auucuaaaauuguagaaacu

SEQ ID NO: 2766909 - RNA, 20 nt, Leptospira interrogans serovar lai str. 56601
auucuaaaauuguaggaacu

SEQ ID NO: 2766910 - RNA, 12 nt, Leptospira interrogans serovar lai str. 56601
auucuaaaauuu

SEQ ID NO: 2766911 - RNA, 21 nt, Leptospira interrogans serovar lai str. 56601
auucuaaaauuuguaggaacu

SEQ ID NO: 2766912 - RNA, 21 nt, Leptospira interrogans serovar lai str. 56601
auucuaaacuacuuccgucuu

SEQ ID NO: 2766913 - RNA, 14 nt, Leptospira interrogans serovar lai str. 56601
auucuaaagaaggg

SEQ ID NO: 2766914 - RNA, 19 nt, Leptospira interrogans serovar lai str. 56601
auucuaacugguuuuucuu

SEQ ID NO: 2766915 - RNA, 17 nt, Leptospira interrogans serovar lai str. 56601
auucuaagaucaaagag

SEQ ID NO: 2766916 - RNA, 23 nt, Leptospira interrogans serovar lai str. 56601
auucuaagaucaaagagaugauu

SEQ ID NO: 2766917 - RNA, 20 nt, Leptospira interrogans serovar lai str. 56601
auucuaagguuuugggacaa

SEQ ID NO: 2766918 - RNA, 21 nt, Leptospira interrogans serovar lai str. 56601
auucuaauauuauuuuuuucu

SEQ ID NO: 2766919 - RNA, 16 nt, Leptospira interrogans serovar lai str. 56601
auucuaauugugggaa

SEQ ID NO: 2766920 - RNA, 17 nt, Leptospira interrogans serovar lai str. 56601
auucuaauugugggaac

SEQ ID NO: 2766921 - RNA, 23 nt, Leptospira interrogans serovar lai str. 56601
auucuaauuuaaaaaagaagaau

SEQ ID NO: 2766922 - RNA, 13 nt, Leptospira interrogans serovar lai str. 56601
auucuaauuuuau

SEQ ID NO: 2766923 - RNA, 20 nt, Leptospira interrogans serovar lai str. 56601
auucuaauuuuauuccaaca

SEQ ID NO: 2766924 - RNA, 14 nt, Leptospira interrogans serovar lai str. 56601
auucuaauuuuuca

SEQ ID NO: 2766925 - RNA, 18 nt, Leptospira interrogans serovar lai str. 56601
auucuacaaauucuucuu

SEQ ID NO: 2766926 - RNA, 19 nt, Leptospira interrogans serovar lai str. 56601
auucuacaaauucuucuuc

SEQ ID NO: 2766927 - RNA, 17 nt, Leptospira interrogans serovar lai str. 56601
auucuacaauuguagga

SEQ ID NO: 2766928 - RNA, 19 nt, Leptospira interrogans serovar lai str. 56601
auucuacaauuguaggaau

SEQ ID NO: 2766929 - RNA, 22 nt, Leptospira interrogans serovar lai str. 56601
auucuacaccuucuaaaucaua

SEQ ID NO: 2766930 - RNA, 17 nt, Leptospira interrogans serovar lai str. 56601
auucuacagauaaaaau

SEQ ID NO: 2766931 - RNA, 21 nt, Leptospira interrogans serovar lai str. 56601
auucuacagauaaaaauagua

SEQ ID NO: 2766932 - RNA, 23 nt, Leptospira interrogans serovar lai str. 56601
auucuacaugauucauuuaaaaa

SEQ ID NO: 2766933 - RNA, 15 nt, Leptospira interrogans serovar lai str. 56601
auucuacauucugaa

SEQ ID NO: 2766934 - RNA, 17 nt, Leptospira interrogans serovar lai str. 56601
auucuacauuugauaua

SEQ ID NO: 2766935 - RNA, 20 nt, Leptospira interrogans serovar lai str. 56601
auucuacauuuguagagauu

SEQ ID NO: 2766936 - RNA, 17 nt, Leptospira interrogans serovar lai str. 56601
auucuacgaauuucaga

SEQ ID NO: 2766937 - RNA, 22 nt, Leptospira interrogans serovar lai str. 56601
auucuagaaccuggaaaagaau

SEQ ID NO: 2766938 - RNA, 14 nt, Leptospira interrogans serovar lai str. 56601
auucuagaauauaa

SEQ ID NO: 2766939 - RNA, 20 nt, Leptospira interrogans serovar lai str. 56601
auucuagaauauaaccguaa

SEQ ID NO: 2766940 - RNA, 17 nt, Leptospira interrogans serovar lai str. 56601
auucuagcgucuaaaaa

SEQ ID NO: 2766941 - RNA, 15 nt, Leptospira interrogans serovar lai str. 56601
auucuauaaaauuug

SEQ ID NO: 2766942 - RNA, 17 nt, Leptospira interrogans serovar lai str. 56601
auucuauaaaauuugaa

SEQ ID NO: 2766943 - RNA, 22 nt, Leptospira interrogans serovar lai str. 56601
auucuauauauugaaauauuau

SEQ ID NO: 2766944 - RNA, 13 nt, Leptospira interrogans serovar lai str. 56601
auucuaucgauuc

SEQ ID NO: 2766945 - RNA, 19 nt, Leptospira interrogans serovar lai str. 56601
auucuaugggaauuuuugu

SEQ ID NO: 2766946 - RNA, 21 nt, Leptospira interrogans serovar lai str. 56601
auucuaugggaauuuuuguaa

SEQ ID NO: 2766947 - RNA, 19 nt, Leptospira interrogans serovar lai str. 56601
auucuauuaguuuuuaugc

SEQ ID NO: 2766948 - RNA, 16 nt, Leptospira interrogans serovar lai str. 56601
auucuauucguauuuu

SEQ ID NO: 2766949 - RNA, 23 nt, Leptospira interrogans serovar lai str. 56601
auucuauucguauuuuauagaaa

SEQ ID NO: 2766950 - RNA, 14 nt, Leptospira interrogans serovar lai str. 56601
auucuauuuucuuu

SEQ ID NO: 2766951 - RNA, 13 nt, Leptospira interrogans serovar lai str. 56601
auucuauuuugag

SEQ ID NO: 2766952 - RNA, 21 nt, Leptospira interrogans serovar lai str. 56601
auucucaaaaaauuauaucuu

SEQ ID NO: 2766953 - RNA, 22 nt, Leptospira interrogans serovar lai str. 56601
auucuccauccgaauugaucuc

SEQ ID NO: 2766954 - RNA, 13 nt, Leptospira interrogans serovar lai str. 56601
auucuccauccua

SEQ ID NO: 2766955 - RNA, 14 nt, Leptospira interrogans serovar lai str. 56601
auucuccaucuauu

SEQ ID NO: 2766956 - RNA, 15 nt, Leptospira interrogans serovar lai str. 56601
auucuccaucuauuu

SEQ ID NO: 2766957 - RNA, 19 nt, Leptospira interrogans serovar lai str. 56601
auucuccaucuguuucuau

SEQ ID NO: 2766958 - RNA, 19 nt, Leptospira interrogans serovar lai str. 56601
auucuccaucuguuuucuu

SEQ ID NO: 2766959 - RNA, 13 nt, Leptospira interrogans serovar lai str. 56601
auucuccauucuu

SEQ ID NO: 2766960 - RNA, 12 nt, Leptospira interrogans serovar lai str. 56601
auucuccuccug

SEQ ID NO: 2766961 - RNA, 13 nt, Leptospira interrogans serovar lai str. 56601
auucuccuccuga

SEQ ID NO: 2766962 - RNA, 19 nt, Leptospira interrogans serovar lai str. 56601
auucuccuccugaaaauuu

SEQ ID NO: 2766963 - RNA, 15 nt, Leptospira interrogans serovar lai str. 56601
auucucgcauuuucc

SEQ ID NO: 2766964 - RNA, 16 nt, Leptospira interrogans serovar lai str. 56601
auucucgcauuuuccu

SEQ ID NO: 2766965 - RNA, 17 nt, Leptospira interrogans serovar lai str. 56601
auucucgcauuuuccuu

SEQ ID NO: 2766966 - RNA, 23 nt, Leptospira interrogans serovar lai str. 56601
auucucgcauuuuccuuuuuccg

SEQ ID NO: 2766967 - RNA, 13 nt, Leptospira interrogans serovar lai str. 56601
auucucuuuuugg

SEQ ID NO: 2766968 - RNA, 12 nt, Leptospira interrogans serovar lai str. 56601
auucugaaaaaa

SEQ ID NO: 2766969 - RNA, 17 nt, Leptospira interrogans serovar lai str. 56601
auucugaaaaaguuaga

SEQ ID NO: 2766970 - RNA, 14 nt, Leptospira interrogans serovar lai str. 56601
auucugaaaaugua

SEQ ID NO: 2766971 - RNA, 16 nt, Leptospira interrogans serovar lai str. 56601
auucugaaauuguuuu

SEQ ID NO: 2766972 - RNA, 19 nt, Leptospira interrogans serovar lai str. 56601
auucugaaauuguuuuaaa

SEQ ID NO: 2766973 - RNA, 16 nt, Leptospira interrogans serovar lai str. 56601
auucugauaacuauau

SEQ ID NO: 2766974 - RNA, 22 nt, Leptospira interrogans serovar lai str. 56601
auucugauaacuauauaacaaa

SEQ ID NO: 2766975 - RNA, 14 nt, Leptospira interrogans serovar lai str. 56601
auucugauuuuaca

SEQ ID NO: 2766976 - RNA, 22 nt, Leptospira interrogans serovar lai str. 56601
auucugcucgaauuuuuuuuau

SEQ ID NO: 2766977 - RNA, 17 nt, Leptospira interrogans serovar lai str. 56601
auucugcucuucuaauu

SEQ ID NO: 2766978 - RNA, 16 nt, Leptospira interrogans serovar lai str. 56601
auucugucguaaaaag

SEQ ID NO: 2766979 - RNA, 15 nt, Leptospira interrogans serovar lai str. 56601
auucuuaaaaaauau

SEQ ID NO: 2766980 - RNA, 18 nt, Leptospira interrogans serovar lai str. 56601
auucuuaaaaaauauuuu

SEQ ID NO: 2766981 - RNA, 15 nt, Leptospira interrogans serovar lai str. 56601
auucuuaaaaauuua

SEQ ID NO: 2766982 - RNA, 19 nt, Leptospira interrogans serovar lai str. 56601
auucuuaaaaauuuauaaa

SEQ ID NO: 2766983 - RNA, 21 nt, Leptospira interrogans serovar lai str. 56601
auucuuaaaaauuuauaaaga

SEQ ID NO: 2766984 - RNA, 23 nt, Leptospira interrogans serovar lai str. 56601
auugccuaaauuccuuccaaguu

SEQ ID NO: 2766985 - RNA, 14 nt, Leptospira interrogans serovar lai str. 56601
auugcgagauuuua

SEQ ID NO: 2766986 - RNA, 15 nt, Leptospira interrogans serovar lai str. 56601
auugcgguaguuccc

SEQ ID NO: 2766987 - RNA, 12 nt, Leptospira interrogans serovar lai str. 56601
auugcuaaaaaa

SEQ ID NO: 2766988 - RNA, 17 nt, Leptospira interrogans serovar lai str. 56601
auugcucaaagaauuuc

SEQ ID NO: 2766989 - RNA, 22 nt, Leptospira interrogans serovar lai str. 56601
auugcuuuaguaguauuuaaga

SEQ ID NO: 2766990 - RNA, 22 nt, Leptospira interrogans serovar lai str. 56601
auugcuuuaucuuuauaaaaau

SEQ ID NO: 2766991 - RNA, 12 nt, Leptospira interrogans serovar lai str. 56601
auugcuuuuuaa

SEQ ID NO: 2766992 - RNA, 14 nt, Leptospira interrogans serovar lai str. 56601
auugcuuuuuaaaa

SEQ ID NO: 2766993 - RNA, 16 nt, Leptospira interrogans serovar lai str. 56601
auugcuuuuuaaaaga

SEQ ID NO: 2766994 - RNA, 12 nt, Leptospira interrogans serovar lai str. 56601
auuggaauaucg

SEQ ID NO: 2766995 - RNA, 18 nt, Leptospira interrogans serovar lai str. 56601
auuggacgauuuugagac

SEQ ID NO: 2766996 - RNA, 18 nt, Leptospira interrogans serovar lai str. 56601
auuggacgguuuugggac

SEQ ID NO: 2766997 - RNA, 20 nt, Leptospira interrogans serovar lai str. 56601
auuggacgguuuugggacaa

SEQ ID NO: 2766998 - RNA, 15 nt, Leptospira interrogans serovar lai str. 56601
auuggacuaaaccac

SEQ ID NO: 2766999 - RNA, 17 nt, Leptospira interrogans serovar lai str. 56601
auuggaguuuuuuaaaa

SEQ ID NO: 2767000 - RNA, 15 nt, Leptospira interrogans serovar lai str. 56601
auuggauucuuucga

SEQ ID NO: 2767001 - RNA, 21 nt, Leptospira interrogans serovar lai str. 56601
auuggguauaagaagauuuua

SEQ ID NO: 2767002 - RNA, 21 nt, Leptospira interrogans serovar lai str. 56601
auugggucuacaauaaaggaa

SEQ ID NO: 2767003 - RNA, 21 nt, Leptospira interrogans serovar lai str. 56601
auugguguuguguuaguuccc

SEQ ID NO: 2767004 - RNA, 22 nt, Leptospira interrogans serovar lai str. 56601
auugguuguggaugauuuuucu

SEQ ID NO: 2767005 - RNA, 15 nt, Leptospira interrogans serovar lai str. 56601
auuguaaaaaaacau

SEQ ID NO: 2767006 - RNA, 16 nt, Leptospira interrogans serovar lai str. 56601
auuguaaaaaaacaug

SEQ ID NO: 2767007 - RNA, 18 nt, Leptospira interrogans serovar lai str. 56601
auuguaaaaaaacaugaa

SEQ ID NO: 2767008 - RNA, 21 nt, Leptospira interrogans serovar lai str. 56601
auuguaaaaaaacaugaagaa

SEQ ID NO: 2767009 - RNA, 13 nt, Leptospira interrogans serovar lai str. 56601
auuguaaacuucu

SEQ ID NO: 2767010 - RNA, 13 nt, Leptospira interrogans serovar lai str. 56601
auuguaagaaaua

SEQ ID NO: 2767011 - RNA, 16 nt, Leptospira interrogans serovar lai str. 56601
auuguaggaacuacua

SEQ ID NO: 2767012 - RNA, 22 nt, Leptospira interrogans serovar lai str. 56601
auuguaggaacucauauuuuua

SEQ ID NO: 2767013 - RNA, 20 nt, Leptospira interrogans serovar lai str. 56601
auuguauccgaaaaauucca

SEQ ID NO: 2767014 - RNA, 17 nt, Leptospira interrogans serovar lai str. 56601
auuguaugaagaaaacc

SEQ ID NO: 2767015 - RNA, 22 nt, Leptospira interrogans serovar lai str. 56601
auuguauuuucccgaaagaacu

SEQ ID NO: 2767016 - RNA, 14 nt, Leptospira interrogans serovar lai str. 56601
auuguccauuucaa

SEQ ID NO: 2767017 - RNA, 15 nt, Leptospira interrogans serovar lai str. 56601
auuguccauuuccau

SEQ ID NO: 2767018 - RNA, 19 nt, Leptospira interrogans serovar lai str. 56601
auugucuauuuuaauggaa

SEQ ID NO: 2767019 - RNA, 15 nt, Leptospira interrogans serovar lai str. 56601
auugucucaaaauua

SEQ ID NO: 2767020 - RNA, 20 nt, Leptospira interrogans serovar lai str. 56601
auugugaucucgauuccuaa

SEQ ID NO: 2767021 - RNA, 22 nt, Leptospira interrogans serovar lai str. 56601
auugugggaacuauuauaaaau

SEQ ID NO: 2767022 - RNA, 15 nt, Leptospira interrogans serovar lai str. 56601
auugugggaacuuua

SEQ ID NO: 2767023 - RNA, 15 nt, Leptospira interrogans serovar lai str. 56601
auugugguaguuccu

SEQ ID NO: 2767024 - RNA, 18 nt, Leptospira interrogans serovar lai str. 56601
auuguguguuacgguaau

SEQ ID NO: 2767025 - RNA, 16 nt, Leptospira interrogans serovar lai str. 56601
auuguguuaguuccca

SEQ ID NO: 2767026 - RNA, 20 nt, Leptospira interrogans serovar lai str. 56601
auuguguuuuuucuuuaaaa

SEQ ID NO: 2767027 - RNA, 21 nt, Leptospira interrogans serovar lai str. 56601
auuguguuuuuucuuuaaaau

SEQ ID NO: 2767028 - RNA, 19 nt, Leptospira interrogans serovar lai str. 56601
auuguuauaaacuucuauu

SEQ ID NO: 2767029 - RNA, 17 nt, Leptospira interrogans serovar lai str. 56601
auuguuccgaauuaaaa

SEQ ID NO: 2767030 - RNA, 15 nt, Leptospira interrogans serovar lai str. 56601
auuguucguuucguu

SEQ ID NO: 2767031 - RNA, 14 nt, Leptospira interrogans serovar lai str. 56601
auuguugaaaaacu

SEQ ID NO: 2767032 - RNA, 23 nt, Leptospira interrogans serovar lai str. 56601
auuguugaaaaauuaauucucca

SEQ ID NO: 2767033 - RNA, 23 nt, Leptospira interrogans serovar lai str. 56601
auuguugaaaaauuuauucucua

SEQ ID NO: 2767034 - RNA, 17 nt, Leptospira interrogans serovar lai str. 56601
auuguugaaaaauuuca

SEQ ID NO: 2767035 - RNA, 16 nt, Leptospira interrogans serovar lai str. 56601
auuguugaagaauuaa

SEQ ID NO: 2767036 - RNA, 23 nt, Leptospira interrogans serovar lai str. 56601
auuguugaagaauuaauucucca

SEQ ID NO: 2767037 - RNA, 16 nt, Leptospira interrogans serovar lai str. 56601
auuguugcuauggaau

SEQ ID NO: 2767038 - RNA, 19 nt, Leptospira interrogans serovar lai str. 56601
auuguugcuauggaauuuu

SEQ ID NO: 2767039 - RNA, 16 nt, Leptospira interrogans serovar lai str. 56601
auuguuguuauggaau

SEQ ID NO: 2767040 - RNA, 14 nt, Leptospira interrogans serovar lai str. 56601
auuguuuauaaaac

SEQ ID NO: 2767041 - RNA, 21 nt, Leptospira interrogans serovar lai str. 56601
auuguuugaaaguucccaaau

SEQ ID NO: 2767042 - RNA, 17 nt, Leptospira interrogans serovar lai str. 56601
auuguuuucuaaaggaa

SEQ ID NO: 2767043 - RNA, 15 nt, Leptospira interrogans serovar lai str. 56601
auuuaaaaaagaaga

SEQ ID NO: 2767044 - RNA, 14 nt, Leptospira interrogans serovar lai str. 56601
auuuaaaaaauuca

SEQ ID NO: 2767045 - RNA, 22 nt, Leptospira interrogans serovar lai str. 56601
auuuaaaaacuaucaguuuuca

SEQ ID NO: 2767046 - RNA, 11 nt, Leptospira interrogans serovar lai str. 56601
auuuaaaaaua

SEQ ID NO: 2767047 - RNA, 16 nt, Leptospira interrogans serovar lai str. 56601
auuuaaaaauugaucu

SEQ ID NO: 2767048 - RNA, 12 nt, Leptospira interrogans serovar lai str. 56601
auuuaaaauacu

SEQ ID NO: 2767049 - RNA, 19 nt, Leptospira interrogans serovar lai str. 56601
auuuaaaaucguaaaaaag

SEQ ID NO: 2767050 - RNA, 20 nt, Leptospira interrogans serovar lai str. 56601
auuuaaacuuacuaugaagu

SEQ ID NO: 2767051 - RNA, 21 nt, Leptospira interrogans serovar lai str. 56601
auuuaaagacgauuccuaaaa

SEQ ID NO: 2767052 - RNA, 22 nt, Leptospira interrogans serovar lai str. 56601
auuuaaagacgauuccuaaaaa

SEQ ID NO: 2767053 - RNA, 20 nt, Leptospira interrogans serovar lai str. 56601
auuuaaauguauguuuacuu

SEQ ID NO: 2767054 - RNA, 12 nt, Leptospira interrogans serovar lai str. 56601
auuuaaaugucu

SEQ ID NO: 2767055 - RNA, 17 nt, Leptospira interrogans serovar lai str. 56601
auuuaaaugugggaacu

SEQ ID NO: 2767056 - RNA, 18 nt, Leptospira interrogans serovar lai str. 56601
auuuaaauguuauuuugu

SEQ ID NO: 2767057 - RNA, 13 nt, Leptospira interrogans serovar lai str. 56601
auuuaaauucccu

SEQ ID NO: 2767058 - RNA, 17 nt, Leptospira interrogans serovar lai str. 56601
auuuaaauucccucaau

SEQ ID NO: 2767059 - RNA, 19 nt, Leptospira interrogans serovar lai str. 56601
auuuaacgacauuagaacu

SEQ ID NO: 2767060 - RNA, 19 nt, Leptospira interrogans serovar lai str. 56601
auuuaacgauauuagaacu

SEQ ID NO: 2767061 - RNA, 15 nt, Leptospira interrogans serovar lai str. 56601
auuuaacgugaguuc

SEQ ID NO: 2767062 - RNA, 13 nt, Leptospira interrogans serovar lai str. 56601
auuuaagaucuuu

SEQ ID NO: 2767063 - RNA, 20 nt, Leptospira interrogans serovar lai str. 56601
auuuaagaucuuuauaaauc

SEQ ID NO: 2767064 - RNA, 17 nt, Leptospira interrogans serovar lai str. 56601
auuuaaguuguguugaa

SEQ ID NO: 2767065 - RNA, 16 nt, Leptospira interrogans serovar lai str. 56601
auuuaauaaaauuuuu

SEQ ID NO: 2767066 - RNA, 21 nt, Leptospira interrogans serovar lai str. 56601
auuuaauaaaauuuuuaaaaa

SEQ ID NO: 2767067 - RNA, 13 nt, Leptospira interrogans serovar lai str. 56601
auuucaauacaac

SEQ ID NO: 2767068 - RNA, 13 nt, Leptospira interrogans serovar lai str. 56601
auuucaauacaau

SEQ ID NO: 2767069 - RNA, 13 nt, Leptospira interrogans serovar lai str. 56601
auuucaauauaaa

SEQ ID NO: 2767070 - RNA, 12 nt, Leptospira interrogans serovar lai str. 56601
auuucaaugcaa

SEQ ID NO: 2767071 - RNA, 18 nt, Leptospira interrogans serovar lai str. 56601
auuucaaugcaacagaaa

SEQ ID NO: 2767072 - RNA, 19 nt, Leptospira interrogans serovar lai str. 56601
auuucacgacgucuaugac

SEQ ID NO: 2767073 - RNA, 18 nt, Leptospira interrogans serovar lai str. 56601
auuucagcgcauuuagaa

SEQ ID NO: 2767074 - RNA, 20 nt, Leptospira interrogans serovar lai str. 56601
auuucagcuagaagaguuaa

SEQ ID NO: 2767075 - RNA, 15 nt, Leptospira interrogans serovar lai str. 56601
auuucagcuccaaaa

SEQ ID NO: 2767076 - RNA, 21 nt, Leptospira interrogans serovar lai str. 56601
auuucagcuccaaaaaaauaa

SEQ ID NO: 2767077 - RNA, 22 nt, Leptospira interrogans serovar lai str. 56601
auuucaggaaucguuuguaaaa

SEQ ID NO: 2767078 - RNA, 15 nt, Leptospira interrogans serovar lai str. 56601
auuucagucaauaaa

SEQ ID NO: 2767079 - RNA, 22 nt, Leptospira interrogans serovar lai str. 56601
auuucauagaccucaaauugua

SEQ ID NO: 2767080 - RNA, 15 nt, Leptospira interrogans serovar lai str. 56601
auuucaugcaaaaau

SEQ ID NO: 2767081 - RNA, 17 nt, Leptospira interrogans serovar lai str. 56601
auuucauuauuagaguu

SEQ ID NO: 2767082 - RNA, 14 nt, Leptospira interrogans serovar lai str. 56601
auuucauugaaaua

SEQ ID NO: 2767083 - RNA, 12 nt, Leptospira interrogans serovar lai str. 56601
auuucauuuuac

SEQ ID NO: 2767084 - RNA, 14 nt, Leptospira interrogans serovar lai str. 56601
auuuccaaacuaca

SEQ ID NO: 2767085 - RNA, 15 nt, Leptospira interrogans serovar lai str. 56601
auuuccaaacuacaa

SEQ ID NO: 2767086 - RNA, 23 nt, Leptospira interrogans serovar lai str. 56601
auuuccaaacucaaugcugcucu

SEQ ID NO: 2767087 - RNA, 18 nt, Leptospira interrogans serovar lai str. 56601
auuuccaacgaaguucca

SEQ ID NO: 2767088 - RNA, 13 nt, Leptospira interrogans serovar lai str. 56601
auuuccacauucc

SEQ ID NO: 2767089 - RNA, 23 nt, Leptospira interrogans serovar lai str. 56601
auuuccacuacaaucacuuuaua

SEQ ID NO: 2767090 - RNA, 13 nt, Leptospira interrogans serovar lai str. 56601
auuucccaaaauu

SEQ ID NO: 2767091 - RNA, 14 nt, Leptospira interrogans serovar lai str. 56601
auuucccaaaauuu

SEQ ID NO: 2767092 - RNA, 20 nt, Leptospira interrogans serovar lai str. 56601
auuucccaaaauuucagaua

SEQ ID NO: 2767093 - RNA, 20 nt, Leptospira interrogans serovar lai str. 56601
auuuccgauaaagaaaguaa

SEQ ID NO: 2767094 - RNA, 21 nt, Leptospira interrogans serovar lai str. 56601
auuuccgcuguuauccgauuu

SEQ ID NO: 2767095 - RNA, 19 nt, Leptospira interrogans serovar lai str. 56601
auuuccgguaaguaauaua

SEQ ID NO: 2767096 - RNA, 18 nt, Leptospira interrogans serovar lai str. 56601
auuuccgucguuugcauc

SEQ ID NO: 2767097 - RNA, 19 nt, Leptospira interrogans serovar lai str. 56601
auuuccguuauauuaaaau

SEQ ID NO: 2767098 - RNA, 22 nt, Leptospira interrogans serovar lai str. 56601
auuuccguuauauuaaaaugua

SEQ ID NO: 2767099 - RNA, 12 nt, Leptospira interrogans serovar lai str. 56601
auuuccuggauu

SEQ ID NO: 2767100 - RNA, 18 nt, Leptospira interrogans serovar lai str. 56601
auuucgaaaacgauuuuu

SEQ ID NO: 2767101 - RNA, 20 nt, Leptospira interrogans serovar lai str. 56601
auuucgaaaacgauuuuuca

SEQ ID NO: 2767102 - RNA, 22 nt, Leptospira interrogans serovar lai str. 56601
auuucgacaacuuauaauuuuc

SEQ ID NO: 2767103 - RNA, 21 nt, Leptospira interrogans serovar lai str. 56601
auuucguaaaauccaugauuu

SEQ ID NO: 2767104 - RNA, 22 nt, Leptospira interrogans serovar lai str. 56601
auuucguucggaaaaaauauga

SEQ ID NO: 2767105 - RNA, 23 nt, Leptospira interrogans serovar lai str. 56601
auuucguucggaaaaaauaugau

SEQ ID NO: 2767106 - RNA, 16 nt, Leptospira interrogans serovar lai str. 56601
auuucguuucguacau

SEQ ID NO: 2767107 - RNA, 21 nt, Leptospira interrogans serovar lai str. 56601
auuucguuuuuuuaauauuac

SEQ ID NO: 2767108 - RNA, 10 nt, Leptospira interrogans serovar lai str. 56601
auuucuaaaa

SEQ ID NO: 2767109 - RNA, 11 nt, Leptospira interrogans serovar lai str. 56601
auuucuaaaag

SEQ ID NO: 2767110 - RNA, 14 nt, Leptospira interrogans serovar lai str. 56601
auuucuaaaagaag

SEQ ID NO: 2767111 - RNA, 15 nt, Leptospira interrogans serovar lai str. 56601
auuucuaaaagaaga

SEQ ID NO: 2767112 - RNA, 19 nt, Leptospira interrogans serovar lai str. 56601
auuucuaaaauguagcaac

SEQ ID NO: 2767113 - RNA, 12 nt, Leptospira interrogans serovar lai str. 56601
auuucuaaaauu

SEQ ID NO: 2767114 - RNA, 17 nt, Leptospira interrogans serovar lai str. 56601
auuucuaaaauucuucc

SEQ ID NO: 2767115 - RNA, 17 nt, Leptospira interrogans serovar lai str. 56601
auuucuaaacaauuuua

SEQ ID NO: 2767116 - RNA, 21 nt, Leptospira interrogans serovar lai str. 56601
auuucuaaauugugagaacua

SEQ ID NO: 2767117 - RNA, 23 nt, Leptospira interrogans serovar lai str. 56601
auuucuaaauugugagaacuaca

SEQ ID NO: 2767118 - RNA, 13 nt, Leptospira interrogans serovar lai str. 56601
auuucuaaguccu

SEQ ID NO: 2767119 - RNA, 16 nt, Leptospira interrogans serovar lai str. 56601
auuucuaaguccuuuu

SEQ ID NO: 2767120 - RNA, 17 nt, Leptospira interrogans serovar lai str. 56601
auuucuaaguccuuuuc

SEQ ID NO: 2767121 - RNA, 19 nt, Leptospira interrogans serovar lai str. 56601
auuucuaaguccuuuucuu

SEQ ID NO: 2767122 - RNA, 22 nt, Leptospira interrogans serovar lai str. 56601
auuucuaaguccuuuucuuaua

SEQ ID NO: 2767123 - RNA, 21 nt, Leptospira interrogans serovar lai str. 56601
auuucuaauaguugaaauuca

SEQ ID NO: 2767124 - RNA, 22 nt, Leptospira interrogans serovar lai str. 56601
auuucuaauauuaaaaacacaa

SEQ ID NO: 2767125 - RNA, 21 nt, Leptospira interrogans serovar lai str. 56601
auuucuaauauucaaauuuua

SEQ ID NO: 2767126 - RNA, 14 nt, Leptospira interrogans serovar lai str. 56601
auuucuaguuuaaa

SEQ ID NO: 2767127 - RNA, 13 nt, Leptospira interrogans serovar lai str. 56601
auuucuauaaaau

SEQ ID NO: 2767128 - RNA, 19 nt, Leptospira interrogans serovar lai str. 56601
auuucuauauucaaaaaau

SEQ ID NO: 2767129 - RNA, 22 nt, Leptospira interrogans serovar lai str. 56601
auuucuauauucaaaaaaugga

SEQ ID NO: 2767130 - RNA, 15 nt, Leptospira interrogans serovar lai str. 56601
auuucuauuuuaaaa

SEQ ID NO: 2767131 - RNA, 17 nt, Leptospira interrogans serovar lai str. 56601
auuucuauuuuaaaagg

SEQ ID NO: 2767132 - RNA, 14 nt, Leptospira interrogans serovar lai str. 56601
auuucuauuuuucg

SEQ ID NO: 2767133 - RNA, 20 nt, Leptospira interrogans serovar lai str. 56601
auuucuccaagaacguuucc

SEQ ID NO: 2767134 - RNA, 23 nt, Leptospira interrogans serovar lai str. 56601
auuucucuaauucuaaaaauuuu

SEQ ID NO: 2767135 - RNA, 17 nt, Leptospira interrogans serovar lai str. 56601
auuucucucaaauucuu

SEQ ID NO: 2767136 - RNA, 19 nt, Leptospira interrogans serovar lai str. 56601
auuucucucaaauucuuca

SEQ ID NO: 2767137 - RNA, 15 nt, Leptospira interrogans serovar lai str. 56601
auuucugagaguaaa

SEQ ID NO: 2767138 - RNA, 18 nt, Leptospira interrogans serovar lai str. 56601
auuucuguaaaaaauaaa

SEQ ID NO: 2767139 - RNA, 15 nt, Leptospira interrogans serovar lai str. 56601
auuucuguagaaauu

SEQ ID NO: 2767140 - RNA, 18 nt, Leptospira interrogans serovar lai str. 56601
auuucuguagaaauucua

SEQ ID NO: 2767141 - RNA, 13 nt, Leptospira interrogans serovar lai str. 56601
auuucugugggaa

SEQ ID NO: 2767142 - RNA, 14 nt, Leptospira interrogans serovar lai str. 56601
auuucuguuuuaua

SEQ ID NO: 2767143 - RNA, 20 nt, Leptospira interrogans serovar lai str. 56601
auuucuuaaaagauucuauu

SEQ ID NO: 2767144 - RNA, 23 nt, Leptospira interrogans serovar lai str. 56601
auuucuuaaaagauucuauuuug

SEQ ID NO: 2767145 - RNA, 22 nt, Leptospira interrogans serovar lai str. 56601
auuucuuauuuauuaaagugag

SEQ ID NO: 2767146 - RNA, 20 nt, Leptospira interrogans serovar lai str. 56601
auuucuucauaucaaauuca

SEQ ID NO: 2767147 - RNA, 18 nt, Leptospira interrogans serovar lai str. 56601
auuucuucguuauuuuua

SEQ ID NO: 2767148 - RNA, 22 nt, Leptospira interrogans serovar lai str. 56601
auuucuugagggguuuuuccuu

SEQ ID NO: 2767149 - RNA, 15 nt, Leptospira interrogans serovar lai str. 56601
auuucuuucaaaaau

SEQ ID NO: 2767150 - RNA, 22 nt, Leptospira interrogans serovar lai str. 56601
auuuuaccagaucaauucuuaa

SEQ ID NO: 2767151 - RNA, 20 nt, Leptospira interrogans serovar lai str. 56601
auuuuacccugguuucaaaa

SEQ ID NO: 2767152 - RNA, 18 nt, Leptospira interrogans serovar lai str. 56601
auuuuaccguuuuuaaau

SEQ ID NO: 2767153 - RNA, 22 nt, Leptospira interrogans serovar lai str. 56601
auuuuacgaacaaauucuaaaa

SEQ ID NO: 2767154 - RNA, 20 nt, Leptospira interrogans serovar lai str. 56601
auuuuacgaaucuaauuuau

SEQ ID NO: 2767155 - RNA, 22 nt, Leptospira interrogans serovar lai str. 56601
auuuuacgauuaaauuuugaaa

SEQ ID NO: 2767156 - RNA, 12 nt, Leptospira interrogans serovar lai str. 56601
auuuuacgcaau

SEQ ID NO: 2767157 - RNA, 22 nt, Leptospira interrogans serovar lai str. 56601
auuuuacgcaggcuuguuugaa

SEQ ID NO: 2767158 - RNA, 18 nt, Leptospira interrogans serovar lai str. 56601
auuuuacgcuuaaauaga

SEQ ID NO: 2767159 - RNA, 22 nt, Leptospira interrogans serovar lai str. 56601
auuuuacgcuuaaauagagcuu

SEQ ID NO: 2767160 - RNA, 21 nt, Leptospira interrogans serovar lai str. 56601
auuuuacguuauaauucuuua

SEQ ID NO: 2767161 - RNA, 15 nt, Leptospira interrogans serovar lai str. 56601
auuuuacuauaaaca

SEQ ID NO: 2767162 - RNA, 14 nt, Leptospira interrogans serovar lai str. 56601
auuuuagaaauauu

SEQ ID NO: 2767163 - RNA, 16 nt, Leptospira interrogans serovar lai str. 56601
auuuuagaaaucgauu

SEQ ID NO: 2767164 - RNA, 18 nt, Leptospira interrogans serovar lai str. 56601
auuuuagaaucaaaauga

SEQ ID NO: 2767165 - RNA, 17 nt, Leptospira interrogans serovar lai str. 56601
auuuuagaaucagaaug

SEQ ID NO: 2767166 - RNA, 21 nt, Leptospira interrogans serovar lai str. 56601
auuuuagaaucagaaugaacu

SEQ ID NO: 2767167 - RNA, 23 nt, Leptospira interrogans serovar lai str. 56601
auuuuagaauuuguucuuaaaau

SEQ ID NO: 2767168 - RNA, 15 nt, Leptospira interrogans serovar lai str. 56601
auuuuagagaaacuu

SEQ ID NO: 2767169 - RNA, 20 nt, Leptospira interrogans serovar lai str. 56601
auuuuagagaaacuuuaaau

SEQ ID NO: 2767170 - RNA, 22 nt, Leptospira interrogans serovar lai str. 56601
auuuuagauaaggcuaaagaau

SEQ ID NO: 2767171 - RNA, 21 nt, Leptospira interrogans serovar lai str. 56601
auuuuaggaaucgaucuguaa

SEQ ID NO: 2767172 - RNA, 17 nt, Leptospira interrogans serovar lai str. 56601
auuuuagggaucaaucu

SEQ ID NO: 2767173 - RNA, 16 nt, Leptospira interrogans serovar lai str. 56601
auuuuagguauuucua

SEQ ID NO: 2767174 - RNA, 23 nt, Leptospira interrogans serovar lai str. 56601
auuuuaguaaacuacuaaaucuc

SEQ ID NO: 2767175 - RNA, 19 nt, Leptospira interrogans serovar lai str. 56601
auuuuaguuuauuuuaaaa

SEQ ID NO: 2767176 - RNA, 12 nt, Leptospira interrogans serovar lai str. 56601
auuuuauaaaaa

SEQ ID NO: 2767177 - RNA, 14 nt, Leptospira interrogans serovar lai str. 56601
auuuuauaaaaauc

SEQ ID NO: 2767178 - RNA, 18 nt, Leptospira interrogans serovar lai str. 56601
auuuuauaaaaaucuagg

SEQ ID NO: 2767179 - RNA, 15 nt, Leptospira interrogans serovar lai str. 56601
auuuuauaaauuauu

SEQ ID NO: 2767180 - RNA, 14 nt, Leptospira interrogans serovar lai str. 56601
auuuuauaaucgaa

SEQ ID NO: 2767181 - RNA, 20 nt, Leptospira interrogans serovar lai str. 56601
auuuuauaaucgaauuucca

SEQ ID NO: 2767182 - RNA, 22 nt, Leptospira interrogans serovar lai str. 56601
auuuuauaaucgaauuuccauu

SEQ ID NO: 2767183 - RNA, 23 nt, Leptospira interrogans serovar lai str. 56601
auuuuauaaucgaauuuccauuu

SEQ ID NO: 2767184 - RNA, 14 nt, Leptospira interrogans serovar lai str. 56601
auuuuauagaaaua

SEQ ID NO: 2767185 - RNA, 15 nt, Leptospira interrogans serovar lai str. 56601
auuuuaucuuaaugu

SEQ ID NO: 2767186 - RNA, 17 nt, Leptospira interrogans serovar lai str. 56601
auuuuaugaauaaaaaa

SEQ ID NO: 2767187 - RNA, 14 nt, Leptospira interrogans serovar lai str. 56601
auuuuaugauuuuc

SEQ ID NO: 2767188 - RNA, 15 nt, Leptospira interrogans serovar lai str. 56601
auuuuaugauuuucu

SEQ ID NO: 2767189 - RNA, 15 nt, Leptospira interrogans serovar lai str. 56601
auuuuauguaagaaa

SEQ ID NO: 2767190 - RNA, 18 nt, Leptospira interrogans serovar lai str. 56601
auuuuauguaagaaaaac

SEQ ID NO: 2767191 - RNA, 12 nt, Leptospira interrogans serovar lai str. 56601
auuuuauuaaaa

SEQ ID NO: 2767192 - RNA, 19 nt, Leptospira interrogans serovar lai str. 56601
auuuuauuaaaaauuuuua

SEQ ID NO: 2767193 - RNA, 17 nt, Leptospira interrogans serovar lai str. 56601
auuuuauuaaagaauua

SEQ ID NO: 2767194 - RNA, 13 nt, Leptospira interrogans serovar lai str. 56601
auuuuauuaaaua

SEQ ID NO: 2767195 - RNA, 15 nt, Leptospira interrogans serovar lai str. 56601
auuuuauuaaauaaa

SEQ ID NO: 2767196 - RNA, 17 nt, Leptospira interrogans serovar lai str. 56601
auuuuauuauauaacca

SEQ ID NO: 2767197 - RNA, 21 nt, Leptospira interrogans serovar lai str. 56601
auuuuauugugaguuuaaaga

SEQ ID NO: 2767198 - RNA, 16 nt, Leptospira interrogans serovar lai str. 56601
auuuuauuuauauaua

SEQ ID NO: 2767199 - RNA, 17 nt, Leptospira interrogans serovar lai str. 56601
auuuuauuuauauauau

SEQ ID NO: 2767200 - RNA, 15 nt, Leptospira interrogans serovar lai str. 56601
auuuuauuuuuacaa

SEQ ID NO: 2767201 - RNA, 13 nt, Leptospira interrogans serovar lai str. 56601
auuuuauuuuucu

SEQ ID NO: 2767202 - RNA, 23 nt, Leptospira interrogans serovar lai str. 56601
auuuuauuuuuuaugaaaaacuc

SEQ ID NO: 2767203 - RNA, 23 nt, Leptospira interrogans serovar lai str. 56601
auuuucaaaaaauaaaauuuuau

SEQ ID NO: 2767204 - RNA, 17 nt, Leptospira interrogans serovar lai str. 56601
auuuucaaaaaauauca

SEQ ID NO: 2767205 - RNA, 15 nt, Leptospira interrogans serovar lai str. 56601
auuuucagaaaaaug

SEQ ID NO: 2767206 - RNA, 16 nt, Leptospira interrogans serovar lai str. 56601
auuuucagaaaaauga

SEQ ID NO: 2767207 - RNA, 17 nt, Leptospira interrogans serovar lai str. 56601
auuuucagaaaaaugaa

SEQ ID NO: 2767208 - RNA, 18 nt, Leptospira interrogans serovar lai str. 56601
auuuucagaaaaaugaau

SEQ ID NO: 2767209 - RNA, 18 nt, Leptospira interrogans serovar lai str. 56601
auuuucaggcauagaauc

SEQ ID NO: 2767210 - RNA, 17 nt, Leptospira interrogans serovar lai str. 56601
auuuucagggaaaaaua

SEQ ID NO: 2767211 - RNA, 19 nt, Leptospira interrogans serovar lai str. 56601
auuuucagggaaaaauaag

SEQ ID NO: 2767212 - RNA, 18 nt, Leptospira interrogans serovar lai str. 56601
auuuucagguuuuaaaac

SEQ ID NO: 2767213 - RNA, 23 nt, Leptospira interrogans serovar lai str. 56601
auuuucagguuuuaaaacggaau

SEQ ID NO: 2767214 - RNA, 19 nt, Leptospira interrogans serovar lai str. 56601
auuuucagugaauaaaaua

SEQ ID NO: 2767215 - RNA, 20 nt, Leptospira interrogans serovar lai str. 56601
auuuucagugaauaaaauaa

SEQ ID NO: 2767216 - RNA, 20 nt, Leptospira interrogans serovar lai str. 56601
auuuucauaauaaauuuuuc

SEQ ID NO: 2767217 - RNA, 14 nt, Leptospira interrogans serovar lai str. 56601
auuuucauagaaaa

SEQ ID NO: 2767218 - RNA, 15 nt, Leptospira interrogans serovar lai str. 56601
auuuucauagaaaaa

SEQ ID NO: 2767219 - RNA, 21 nt, Leptospira interrogans serovar lai str. 56601
auuuucauagaaaaaauacau

SEQ ID NO: 2767220 - RNA, 13 nt, Leptospira interrogans serovar lai str. 56601
auuuucauauaua

SEQ ID NO: 2767221 - RNA, 18 nt, Leptospira interrogans serovar lai str. 56601
auuuucaucuuuuccauu

SEQ ID NO: 2767222 - RNA, 21 nt, Leptospira interrogans serovar lai str. 56601
auuuucaugaacgaauuuuuc

SEQ ID NO: 2767223 - RNA, 14 nt, Leptospira interrogans serovar lai str. 56601
auuuuccagaucau

SEQ ID NO: 2767224 - RNA, 17 nt, Leptospira interrogans serovar lai str. 56601
auuuuccagaucauuuu

SEQ ID NO: 2767225 - RNA, 22 nt, Leptospira interrogans serovar lai str. 56601
auuuucccaaacaggaaaauuu

SEQ ID NO: 2767226 - RNA, 22 nt, Leptospira interrogans serovar lai str. 56601
auuuucccgaaagaacuccacc

SEQ ID NO: 2767227 - RNA, 22 nt, Leptospira interrogans serovar lai str. 56601
auuuuccuuaagacccuaaaaa

SEQ ID NO: 2767228 - RNA, 19 nt, Leptospira interrogans serovar lai str. 56601
auuuuccuuuuuccggaau

SEQ ID NO: 2767229 - RNA, 15 nt, Leptospira interrogans serovar lai str. 56601
auuuucgaauucuuu

SEQ ID NO: 2767230 - RNA, 20 nt, Leptospira interrogans serovar lai str. 56601
auuuucgaauucuuucuauu

SEQ ID NO: 2767231 - RNA, 18 nt, Leptospira interrogans serovar lai str. 56601
auuuucgcacauucuaua

SEQ ID NO: 2767232 - RNA, 12 nt, Leptospira interrogans serovar lai str. 56601
auuuuucuucuu

SEQ ID NO: 2767233 - RNA, 14 nt, Leptospira interrogans serovar lai str. 56601
auuuuucuucuuug

SEQ ID NO: 2767234 - RNA, 15 nt, Leptospira interrogans serovar lai str. 56601
auuuuucuucuuugu

SEQ ID NO: 2767235 - RNA, 19 nt, Leptospira interrogans serovar lai str. 56601
auuuuucuuuuaaaauucg

SEQ ID NO: 2767236 - RNA, 22 nt, Leptospira interrogans serovar lai str. 56601
auuuuugacuaccuuuauuccu

SEQ ID NO: 2767237 - RNA, 16 nt, Leptospira interrogans serovar lai str. 56601
auuuuuggaaauucca

SEQ ID NO: 2767238 - RNA, 23 nt, Leptospira interrogans serovar lai str. 56601
auuuuuguaaaauccagaauaau

SEQ ID NO: 2767239 - RNA, 21 nt, Leptospira interrogans serovar lai str. 56601
auuuuuguagaauugaaagaa

SEQ ID NO: 2767240 - RNA, 20 nt, Leptospira interrogans serovar lai str. 56601
auuuuugugaaacuuaaucu

SEQ ID NO: 2767241 - RNA, 14 nt, Leptospira interrogans serovar lai str. 56601
auuuuugugaaguu

SEQ ID NO: 2767242 - RNA, 21 nt, Leptospira interrogans serovar lai str. 56601
auuuuuguuuguaaaauuuaa

SEQ ID NO: 2767243 - RNA, 22 nt, Leptospira interrogans serovar lai str. 56601
auuuuuguuuguaaaauuuaaa

SEQ ID NO: 2767244 - RNA, 11 nt, Leptospira interrogans serovar lai str. 56601
auuuuuuaaaa

SEQ ID NO: 2767245 - RNA, 13 nt, Leptospira interrogans serovar lai str. 56601
auuuuuuaaaaaa

SEQ ID NO: 2767246 - RNA, 23 nt, Leptospira interrogans serovar lai str. 56601
auuuuuuaaaaauauaaaucaau

SEQ ID NO: 2767247 - RNA, 17 nt, Leptospira interrogans serovar lai str. 56601
auuuuuuaaaaauuuua

SEQ ID NO: 2767248 - RNA, 13 nt, Leptospira interrogans serovar lai str. 56601
auuuuuuaaaaua

SEQ ID NO: 2767249 - RNA, 11 nt, Leptospira interrogans serovar lai str. 56601
auuuuuuaaac

SEQ ID NO: 2767250 - RNA, 12 nt, Leptospira interrogans serovar lai str. 56601
auuuuuuaaacu

SEQ ID NO: 2767251 - RNA, 20 nt, Leptospira interrogans serovar lai str. 56601
auuuuuuaaaugcagcuauu

SEQ ID NO: 2767252 - RNA, 22 nt, Leptospira interrogans serovar lai str. 56601
auuuuuuaaaugcagcuauuuu

SEQ ID NO: 2767253 - RNA, 23 nt, Leptospira interrogans serovar lai str. 56601
auuuuuuaaaugcagcuauuuuu

SEQ ID NO: 2767254 - RNA, 18 nt, Leptospira interrogans serovar lai str. 56601
auuuuuuaaaugugggaa

SEQ ID NO: 2767255 - RNA, 22 nt, Leptospira interrogans serovar lai str. 56601
auuuuuuaaauuuaucuauaaa

SEQ ID NO: 2767256 - RNA, 17 nt, Leptospira interrogans serovar lai str. 56601
auuuuuuaacaacucua

SEQ ID NO: 2767257 - RNA, 17 nt, Leptospira interrogans serovar lai str. 56601
auuuuuuaacaauucua

SEQ ID NO: 2767258 - RNA, 15 nt, Leptospira interrogans serovar lai str. 56601
auuuuuuaauaacuc

SEQ ID NO: 2767259 - RNA, 15 nt, Leptospira interrogans serovar lai str. 56601
auuuuuuagaaacua

SEQ ID NO: 2767260 - RNA, 19 nt, Leptospira interrogans serovar lai str. 56601
auuuuuuagaucuaaauuu

SEQ ID NO: 2767261 - RNA, 12 nt, Leptospira interrogans serovar lai str. 56601
auuuuuuauuaa

SEQ ID NO: 2767262 - RNA, 13 nt, Leptospira interrogans serovar lai str. 56601
auuuuuuccaaaa

SEQ ID NO: 2767263 - RNA, 19 nt, Leptospira interrogans serovar lai str. 56601
auuuuuuccugauuuucau

SEQ ID NO: 2767264 - RNA, 13 nt, Leptospira interrogans serovar lai str. 56601
auuuuuuccuuua

SEQ ID NO: 2767265 - RNA, 18 nt, Leptospira interrogans serovar lai str. 56601
auuuuuucguuccuuuga

SEQ ID NO: 2767266 - RNA, 11 nt, Leptospira interrogans serovar lai str. 56601
auuuuuucuuu

SEQ ID NO: 2767267 - RNA, 23 nt, Leptospira interrogans serovar lai str. 56601
auuuuuugcaaaaaaauaaaaug

SEQ ID NO: 2767268 - RNA, 19 nt, Leptospira interrogans serovar lai str. 56601
auuuuuuggaaaucgaaaa

SEQ ID NO: 2767269 - RNA, 17 nt, Leptospira interrogans serovar lai str. 56601
auuuuuugggcuucuga

SEQ ID NO: 2767270 - RNA, 17 nt, Leptospira interrogans serovar lai str. 56601
auuuuuugucuuuaaaa

SEQ ID NO: 2767271 - RNA, 14 nt, Leptospira interrogans serovar lai str. 56601
auuuuuuuaaaaaa

SEQ ID NO: 2767272 - RNA, 22 nt, Leptospira interrogans serovar lai str. 56601
auuuuuuuaaacuuuaaucauu

SEQ ID NO: 2767273 - RNA, 15 nt, Leptospira interrogans serovar lai str. 56601
auuuuuuuaauacaa

SEQ ID NO: 2767274 - RNA, 15 nt, Leptospira interrogans serovar lai str. 56601
auuuuuuuagaauca

SEQ ID NO: 2767275 - RNA, 16 nt, Leptospira interrogans serovar lai str. 56601
auuuuuuuagaaucau

SEQ ID NO: 2767276 - RNA, 17 nt, Leptospira interrogans serovar lai str. 56601
auuuuuuucaguauguu

SEQ ID NO: 2767277 - RNA, 23 nt, Leptospira interrogans serovar lai str. 56601
auuuuuuucgaauugaguuuuug

SEQ ID NO: 2767278 - RNA, 19 nt, Leptospira interrogans serovar lai str. 56601
auuuuuuucgcaaauucua

SEQ ID NO: 2767279 - RNA, 14 nt, Leptospira interrogans serovar lai str. 56601
auuuuuuucuccuu

SEQ ID NO: 2767280 - RNA, 15 nt, Leptospira interrogans serovar lai str. 56601
auuuuuuuguaaaaa

SEQ ID NO: 2767281 - RNA, 17 nt, Leptospira interrogans serovar lai str. 56601
auuuuuuuguaaaaaaa

SEQ ID NO: 2767282 - RNA, 17 nt, Leptospira interrogans serovar lai str. 56601
auuuuuuuguauauaaa

SEQ ID NO: 2767283 - RNA, 13 nt, Leptospira interrogans serovar lai str. 56601
auuuuuuuuaaua

SEQ ID NO: 2767284 - RNA, 15 nt, Leptospira interrogans serovar lai str. 56601
auuuuuuuuaaucau

SEQ ID NO: 2767285 - RNA, 17 nt, Leptospira interrogans serovar lai str. 56601
auuuuuuuuauuuuuag

SEQ ID NO: 2767286 - RNA, 13 nt, Leptospira interrogans serovar lai str. 56601
caaaaaaaauucg

SEQ ID NO: 2767287 - RNA, 14 nt, Leptospira interrogans serovar lai str. 56601
caaaaaaaauucgu

SEQ ID NO: 2767288 - RNA, 23 nt, Leptospira interrogans serovar lai str. 56601
caaaaaaauaaaauguaaaaacu

SEQ ID NO: 2767289 - RNA, 19 nt, Leptospira interrogans serovar lai str. 56601
caaaaaaauaaaucaugau

SEQ ID NO: 2767290 - RNA, 15 nt, Leptospira interrogans serovar lai str. 56601
caaaaaacucagcga

SEQ ID NO: 2767291 - RNA, 22 nt, Leptospira interrogans serovar lai str. 56601
caaaaaacucagcgaaaauacu

SEQ ID NO: 2767292 - RNA, 12 nt, Leptospira interrogans serovar lai str. 56601
caaaaaauauac

SEQ ID NO: 2767293 - RNA, 21 nt, Leptospira interrogans serovar lai str. 56601
caaaaaaugcauucaaaaagu

SEQ ID NO: 2767294 - RNA, 20 nt, Leptospira interrogans serovar lai str. 56601
caaaaaauuauaucuuauuu

SEQ ID NO: 2767295 - RNA, 14 nt, Leptospira interrogans serovar lai str. 56601
caaaaacgcaaaaa

SEQ ID NO: 2767296 - RNA, 16 nt, Leptospira interrogans serovar lai str. 56601
caaaaacuaaaauaca

SEQ ID NO: 2767297 - RNA, 12 nt, Leptospira interrogans serovar lai str. 56601
caaaaacucaaa

SEQ ID NO: 2767298 - RNA, 20 nt, Leptospira interrogans serovar lai str. 56601
caaaaacucaaagaaauuuu

SEQ ID NO: 2767299 - RNA, 21 nt, Leptospira interrogans serovar lai str. 56601
caaaaaggcacauuuuucaag

SEQ ID NO: 2767300 - RNA, 23 nt, Leptospira interrogans serovar lai str. 56601
caaaaaguguuuauaauuuuuac

SEQ ID NO: 2767301 - RNA, 15 nt, Leptospira interrogans serovar lai str. 56601
caaaaauaaaguauu

SEQ ID NO: 2767302 - RNA, 21 nt, Leptospira interrogans serovar lai str. 56601
caaaaauaaaguauuuuuaag

SEQ ID NO: 2767303 - RNA, 20 nt, Leptospira interrogans serovar lai str. 56601
caaaaauaaauuccccaaaa

SEQ ID NO: 2767304 - RNA, 16 nt, Leptospira interrogans serovar lai str. 56601
caaaaauacuaaauua

SEQ ID NO: 2767305 - RNA, 15 nt, Leptospira interrogans serovar lai str. 56601
caaaaauagaauuuu

SEQ ID NO: 2767306 - RNA, 14 nt, Leptospira interrogans serovar lai str. 56601
caaaaauagcagau

SEQ ID NO: 2767307 - RNA, 19 nt, Leptospira interrogans serovar lai str. 56601
caaaaauagggaaaacuca

SEQ ID NO: 2767308 - RNA, 22 nt, Leptospira interrogans serovar lai str. 56601
caaaaauagggaaaacucaaca

SEQ ID NO: 2767309 - RNA, 21 nt, Leptospira interrogans serovar lai str. 56601
caaaaauagggaaaacucauc

SEQ ID NO: 2767310 - RNA, 13 nt, Leptospira interrogans serovar lai str. 56601
caaaaauauauua

SEQ ID NO: 2767311 - RNA, 16 nt, Leptospira interrogans serovar lai str. 56601
caaaaaugaaaaaacu

SEQ ID NO: 2767312 - RNA, 21 nt, Leptospira interrogans serovar lai str. 56601
caaaaaugaaaaaacuuuuua

SEQ ID NO: 2767313 - RNA, 22 nt, Leptospira interrogans serovar lai str. 56601
caaaaauguauccaauccaaaa

SEQ ID NO: 2767314 - RNA, 18 nt, Leptospira interrogans serovar lai str. 56601
caaaaaugugggaacuau

SEQ ID NO: 2767315 - RNA, 17 nt, Leptospira interrogans serovar lai str. 56601
caaaauuuuuuccuuua

SEQ ID NO: 2767316 - RNA, 21 nt, Leptospira interrogans serovar lai str. 56601
caaaauuuuuuccuuuaaacu

SEQ ID NO: 2767317 - RNA, 14 nt, Leptospira interrogans serovar lai str. 56601
caaacaaauucuaa

SEQ ID NO: 2767318 - RNA, 16 nt, Leptospira interrogans serovar lai str. 56601
caaacacaugagcauu

SEQ ID NO: 2767319 - RNA, 13 nt, Leptospira interrogans serovar lai str. 56601
caaacaccacaau

SEQ ID NO: 2767320 - RNA, 19 nt, Leptospira interrogans serovar lai str. 56601
caaacacgggaauaaaaac

SEQ ID NO: 2767321 - RNA, 20 nt, Leptospira interrogans serovar lai str. 56601
caaacacgggaauaaaaaca

SEQ ID NO: 2767322 - RNA, 18 nt, Leptospira interrogans serovar lai str. 56601
caaacagccaaagaaaua

SEQ ID NO: 2767323 - RNA, 14 nt, Leptospira interrogans serovar lai str. 56601
caaacaggaaaauu

SEQ ID NO: 2767324 - RNA, 16 nt, Leptospira interrogans serovar lai str. 56601
caaacaggaaaauuua

SEQ ID NO: 2767325 - RNA, 21 nt, Leptospira interrogans serovar lai str. 56601
caaacauucaaauuucugaaa

SEQ ID NO: 2767326 - RNA, 22 nt, Leptospira interrogans serovar lai str. 56601
caaaccaaauagaaauagaaac

SEQ ID NO: 2767327 - RNA, 19 nt, Leptospira interrogans serovar lai str. 56601
caaacccugccaaaauccc

SEQ ID NO: 2767328 - RNA, 23 nt, Leptospira interrogans serovar lai str. 56601
caaaccucguacuaauucuuuug

SEQ ID NO: 2767329 - RNA, 13 nt, Leptospira interrogans serovar lai str. 56601
caaaccucuuuau

SEQ ID NO: 2767330 - RNA, 20 nt, Leptospira interrogans serovar lai str. 56601
caaacgaaguuuauuucuaa

SEQ ID NO: 2767331 - RNA, 17 nt, Leptospira interrogans serovar lai str. 56601
caaacgcuuucguaaaa

SEQ ID NO: 2767332 - RNA, 18 nt, Leptospira interrogans serovar lai str. 56601
caaacgcuuucguaaaaa

SEQ ID NO: 2767333 - RNA, 20 nt, Leptospira interrogans serovar lai str. 56601
caaacggucuuucuucugua

SEQ ID NO: 2767334 - RNA, 14 nt, Leptospira interrogans serovar lai str. 56601
caaacuaaauuuuu

SEQ ID NO: 2767335 - RNA, 15 nt, Leptospira interrogans serovar lai str. 56601
caaacucaaugcugc

SEQ ID NO: 2767336 - RNA, 17 nt, Leptospira interrogans serovar lai str. 56601
caaacucaaugcugcuc

SEQ ID NO: 2767337 - RNA, 20 nt, Leptospira interrogans serovar lai str. 56601
caaacucacgcuaaaauaaa

SEQ ID NO: 2767338 - RNA, 18 nt, Leptospira interrogans serovar lai str. 56601
caaacucuuuauuuuuaa

SEQ ID NO: 2767339 - RNA, 14 nt, Leptospira interrogans serovar lai str. 56601
caaacucuuuuucu

SEQ ID NO: 2767340 - RNA, 15 nt, Leptospira interrogans serovar lai str. 56601
caaacucuuuuucuu

SEQ ID NO: 2767341 - RNA, 16 nt, Leptospira interrogans serovar lai str. 56601
caaacucuuuuucuuc

SEQ ID NO: 2767342 - RNA, 21 nt, Leptospira interrogans serovar lai str. 56601
caaacucuuuuucuucugcug

SEQ ID NO: 2767343 - RNA, 22 nt, Leptospira interrogans serovar lai str. 56601
caaacucuuuuucuucugcugc

SEQ ID NO: 2767344 - RNA, 16 nt, Leptospira interrogans serovar lai str. 56601
caaacuuacaaaaauc

SEQ ID NO: 2767345 - RNA, 17 nt, Leptospira interrogans serovar lai str. 56601
caaacuugcaauuuuac

SEQ ID NO: 2767346 - RNA, 13 nt, Leptospira interrogans serovar lai str. 56601
caaacuuuaauua

SEQ ID NO: 2767347 - RNA, 19 nt, Leptospira interrogans serovar lai str. 56601
caaacuuuaauuauugaua

SEQ ID NO: 2767348 - RNA, 18 nt, Leptospira interrogans serovar lai str. 56601
caaacuuuuguaauaaaa

SEQ ID NO: 2767349 - RNA, 16 nt, Leptospira interrogans serovar lai str. 56601
caaacuuuuuauaaaa

SEQ ID NO: 2767350 - RNA, 20 nt, Leptospira interrogans serovar lai str. 56601
caaacuuuuuauaaaaagcu

SEQ ID NO: 2767351 - RNA, 14 nt, Leptospira interrogans serovar lai str. 56601
caaacuuuuuuagc

SEQ ID NO: 2767352 - RNA, 18 nt, Leptospira interrogans serovar lai str. 56601
caaagaaagaaaauacau

SEQ ID NO: 2767353 - RNA, 18 nt, Leptospira interrogans serovar lai str. 56601
caaagaaauagaaaagca

SEQ ID NO: 2767354 - RNA, 21 nt, Leptospira interrogans serovar lai str. 56601
caaagaauaccaaaaaaguac

SEQ ID NO: 2767355 - RNA, 20 nt, Leptospira interrogans serovar lai str. 56601
caaagaauauaaaaucuuaa

SEQ ID NO: 2767356 - RNA, 13 nt, Leptospira interrogans serovar lai str. 56601
caaagaaucgaga

SEQ ID NO: 2767357 - RNA, 15 nt, Leptospira interrogans serovar lai str. 56601
caaagacaaaguauu

SEQ ID NO: 2767358 - RNA, 20 nt, Leptospira interrogans serovar lai str. 56601
caaagacucggaaauucuca

SEQ ID NO: 2767359 - RNA, 20 nt, Leptospira interrogans serovar lai str. 56601
caaagagccgcuuaaacuuc

SEQ ID NO: 2767360 - RNA, 16 nt, Leptospira interrogans serovar lai str. 56601
caaagaguuuaaaaaa

SEQ ID NO: 2767361 - RNA, 18 nt, Leptospira interrogans serovar lai str. 56601
caaagaguuuaaaaaauc

SEQ ID NO: 2767362 - RNA, 16 nt, Leptospira interrogans serovar lai str. 56601
caaagauaaaaaagaa

SEQ ID NO: 2767363 - RNA, 17 nt, Leptospira interrogans serovar lai str. 56601
caaagauaaaaaagaaa

SEQ ID NO: 2767364 - RNA, 13 nt, Leptospira interrogans serovar lai str. 56601
caaagauaaaaua

SEQ ID NO: 2767365 - RNA, 14 nt, Leptospira interrogans serovar lai str. 56601
caaagauaaaauau

SEQ ID NO: 2767366 - RNA, 15 nt, Leptospira interrogans serovar lai str. 56601
caaagauaaaauaua

SEQ ID NO: 2767367 - RNA, 20 nt, Leptospira interrogans serovar lai str. 56601
caaagauauuucaauauaaa

SEQ ID NO: 2767368 - RNA, 22 nt, Leptospira interrogans serovar lai str. 56601
caaagauauuucaauauaaaaa

SEQ ID NO: 2767369 - RNA, 15 nt, Leptospira interrogans serovar lai str. 56601
caaagauuacauaau

SEQ ID NO: 2767370 - RNA, 21 nt, Leptospira interrogans serovar lai str. 56601
caaagauuucuauauucaaaa

SEQ ID NO: 2767371 - RNA, 17 nt, Leptospira interrogans serovar lai str. 56601
caaagcacuuuuuuccu

SEQ ID NO: 2767372 - RNA, 20 nt, Leptospira interrogans serovar lai str. 56601
caaagcacuuuuuuccucga

SEQ ID NO: 2767373 - RNA, 15 nt, Leptospira interrogans serovar lai str. 56601
caaagccgcacaaac

SEQ ID NO: 2767374 - RNA, 17 nt, Leptospira interrogans serovar lai str. 56601
caaagcuuguuucaaaa

SEQ ID NO: 2767375 - RNA, 16 nt, Leptospira interrogans serovar lai str. 56601
caaaggaaauaaaaau

SEQ ID NO: 2767376 - RNA, 22 nt, Leptospira interrogans serovar lai str. 56601
caaaggagaaggauaaagucua

SEQ ID NO: 2767377 - RNA, 18 nt, Leptospira interrogans serovar lai str. 56601
caaaggccgcuucuuuau

SEQ ID NO: 2767378 - RNA, 16 nt, Leptospira interrogans serovar lai str. 56601
caaaggcgggaauaaa

SEQ ID NO: 2767379 - RNA, 15 nt, Leptospira interrogans serovar lai str. 56601
caaaguauucuuucc

SEQ ID NO: 2767380 - RNA, 20 nt, Leptospira interrogans serovar lai str. 56601
caaaguauuuucuagauagg

SEQ ID NO: 2767381 - RNA, 14 nt, Leptospira interrogans serovar lai str. 56601
caaagucaaaggag

SEQ ID NO: 2767382 - RNA, 23 nt, Leptospira interrogans serovar lai str. 56601
caaagucaaaggagaaggauaaa

SEQ ID NO: 2767383 - RNA, 19 nt, Leptospira interrogans serovar lai str. 56601
caaagucgcccaaacccca

SEQ ID NO: 2767384 - RNA, 16 nt, Leptospira interrogans serovar lai str. 56601
caaaguuacuucccuu

SEQ ID NO: 2767385 - RNA, 20 nt, Leptospira interrogans serovar lai str. 56601
caaaguuauuucgauuggaa

SEQ ID NO: 2767386 - RNA, 19 nt, Leptospira interrogans serovar lai str. 56601
caaaguuucuuauauaaaa

SEQ ID NO: 2767387 - RNA, 21 nt, Leptospira interrogans serovar lai str. 56601
caaaguuuucacaaaaaaauu

SEQ ID NO: 2767388 - RNA, 12 nt, Leptospira interrogans serovar lai str. 56601
caaauaaaaaca

SEQ ID NO: 2767389 - RNA, 12 nt, Leptospira interrogans serovar lai str. 56601
caaauaaaagga

SEQ ID NO: 2767390 - RNA, 13 nt, Leptospira interrogans serovar lai str. 56601
caaauaaaaggag

SEQ ID NO: 2767391 - RNA, 12 nt, Leptospira interrogans serovar lai str. 56601
caaauaaaguuu

SEQ ID NO: 2767392 - RNA, 17 nt, Leptospira interrogans serovar lai str. 56601
caaauaaaguuuuauac

SEQ ID NO: 2767393 - RNA, 18 nt, Leptospira interrogans serovar lai str. 56601
caaauaaaguuuuauacc

SEQ ID NO: 2767394 - RNA, 13 nt, Leptospira interrogans serovar lai str. 56601
caaauaacgauuc

SEQ ID NO: 2767395 - RNA, 18 nt, Leptospira interrogans serovar lai str. 56601
caaauaacgauuccauuu

SEQ ID NO: 2767396 - RNA, 14 nt, Leptospira interrogans serovar lai str. 56601
caaauaauaaaacu

SEQ ID NO: 2767397 - RNA, 18 nt, Leptospira interrogans serovar lai str. 56601
caaauaauaaaacuacuc

SEQ ID NO: 2767398 - RNA, 23 nt, Leptospira interrogans serovar lai str. 56601
caacauugcgagauuuuaagaca

SEQ ID NO: 2767399 - RNA, 12 nt, Leptospira interrogans serovar lai str. 56601
caaccaagaauu

SEQ ID NO: 2767400 - RNA, 14 nt, Leptospira interrogans serovar lai str. 56601
caacgcucucuacg

SEQ ID NO: 2767401 - RNA, 18 nt, Leptospira interrogans serovar lai str. 56601
caacgcucuuuaugaauc

SEQ ID NO: 2767402 - RNA, 23 nt, Leptospira interrogans serovar lai str. 56601
caacgcucuuuaugaaucgcguu

SEQ ID NO: 2767403 - RNA, 13 nt, Leptospira interrogans serovar lai str. 56601
caacguaccaaaa

SEQ ID NO: 2767404 - RNA, 16 nt, Leptospira interrogans serovar lai str. 56601
caacguaccaaaaccc

SEQ ID NO: 2767405 - RNA, 20 nt, Leptospira interrogans serovar lai str. 56601
caacguagucguguuguuua

SEQ ID NO: 2767406 - RNA, 12 nt, Leptospira interrogans serovar lai str. 56601
caacuaaaagac

SEQ ID NO: 2767407 - RNA, 16 nt, Leptospira interrogans serovar lai str. 56601
caacuaaauccuucuu

SEQ ID NO: 2767408 - RNA, 16 nt, Leptospira interrogans serovar lai str. 56601
caacucagaugaaagu

SEQ ID NO: 2767409 - RNA, 10 nt, Leptospira interrogans serovar lai str. 56601
caacucuaau

SEQ ID NO: 2767410 - RNA, 18 nt, Leptospira interrogans serovar lai str. 56601
caacucuaaugaauuuac

SEQ ID NO: 2767411 - RNA, 22 nt, Leptospira interrogans serovar lai str. 56601
caacucuaauguaggaacuauu

SEQ ID NO: 2767412 - RNA, 14 nt, Leptospira interrogans serovar lai str. 56601
caacucuaauuuag

SEQ ID NO: 2767413 - RNA, 16 nt, Leptospira interrogans serovar lai str. 56601
caacucuauuacuaaa

SEQ ID NO: 2767414 - RNA, 19 nt, Leptospira interrogans serovar lai str. 56601
caacucuauuuaaguacuu

SEQ ID NO: 2767415 - RNA, 17 nt, Leptospira interrogans serovar lai str. 56601
caacucuauuucaguuc

SEQ ID NO: 2767416 - RNA, 21 nt, Leptospira interrogans serovar lai str. 56601
caacucuguaaauucaaagca

SEQ ID NO: 2767417 - RNA, 19 nt, Leptospira interrogans serovar lai str. 56601
caacucuucuucuagauuu

SEQ ID NO: 2767418 - RNA, 21 nt, Leptospira interrogans serovar lai str. 56601
caacugaaaaugaccaaaauu

SEQ ID NO: 2767419 - RNA, 18 nt, Leptospira interrogans serovar lai str. 56601
caacugugggaacuacua

SEQ ID NO: 2767420 - RNA, 19 nt, Leptospira interrogans serovar lai str. 56601
caacuuaaaacuguacaau

SEQ ID NO: 2767421 - RNA, 16 nt, Leptospira interrogans serovar lai str. 56601
caacuuacauuaaaua

SEQ ID NO: 2767422 - RNA, 16 nt, Leptospira interrogans serovar lai str. 56601
caacuuauaauuuucu

SEQ ID NO: 2767423 - RNA, 19 nt, Leptospira interrogans serovar lai str. 56601
caacuuauaauuuucuuaa

SEQ ID NO: 2767424 - RNA, 22 nt, Leptospira interrogans serovar lai str. 56601
caacuuauaauuuucuuaauaa

SEQ ID NO: 2767425 - RNA, 21 nt, Leptospira interrogans serovar lai str. 56601
caacuuggaaucuuaaaaaga

SEQ ID NO: 2767426 - RNA, 15 nt, Leptospira interrogans serovar lai str. 56601
caacuuuagaaaaau

SEQ ID NO: 2767427 - RNA, 14 nt, Leptospira interrogans serovar lai str. 56601
caacuuucagauua

SEQ ID NO: 2767428 - RNA, 12 nt, Leptospira interrogans serovar lai str. 56601
caacuuuuccag

SEQ ID NO: 2767429 - RNA, 15 nt, Leptospira interrogans serovar lai str. 56601
caacuuuugaaacua

SEQ ID NO: 2767430 - RNA, 18 nt, Leptospira interrogans serovar lai str. 56601
caacuuuuucagaaaaau

SEQ ID NO: 2767431 - RNA, 17 nt, Leptospira interrogans serovar lai str. 56601
caacuuuuugaagaaac

SEQ ID NO: 2767432 - RNA, 19 nt, Leptospira interrogans serovar lai str. 56601
caacuuuuugaagaaacaa

SEQ ID NO: 2767433 - RNA, 15 nt, Leptospira interrogans serovar lai str. 56601
caacuuuuuuaauuu

SEQ ID NO: 2767434 - RNA, 13 nt, Leptospira interrogans serovar lai str. 56601
caagaaucaaaac

SEQ ID NO: 2767435 - RNA, 19 nt, Leptospira interrogans serovar lai str. 56601
caagacaaacaaacaugca

SEQ ID NO: 2767436 - RNA, 17 nt, Leptospira interrogans serovar lai str. 56601
caagaccucaaauaacu

SEQ ID NO: 2767437 - RNA, 23 nt, Leptospira interrogans serovar lai str. 56601
caagaccuuguguuucagacuga

SEQ ID NO: 2767438 - RNA, 18 nt, Leptospira interrogans serovar lai str. 56601
caagagccaaguugaauc

SEQ ID NO: 2767439 - RNA, 19 nt, Leptospira interrogans serovar lai str. 56601
caagagugguuuucaaaua

SEQ ID NO: 2767440 - RNA, 19 nt, Leptospira interrogans serovar lai str. 56601
caagaguguucaucuucuc

SEQ ID NO: 2767441 - RNA, 13 nt, Leptospira interrogans serovar lai str. 56601
caagaucauucua

SEQ ID NO: 2767442 - RNA, 21 nt, Leptospira interrogans serovar lai str. 56601
caagauuaacaaucaauugaa

SEQ ID NO: 2767443 - RNA, 15 nt, Leptospira interrogans serovar lai str. 56601
caagauuauuuuuga

SEQ ID NO: 2767444 - RNA, 19 nt, Leptospira interrogans serovar lai str. 56601
caagauucauuucguaaaa

SEQ ID NO: 2767445 - RNA, 23 nt, Leptospira interrogans serovar lai str. 56601
caagauucauuucguaaaaucca

SEQ ID NO: 2767446 - RNA, 22 nt, Leptospira interrogans serovar lai str. 56601
caagauuucguucggaaaaaau

SEQ ID NO: 2767447 - RNA, 17 nt, Leptospira interrogans serovar lai str. 56601
caagauuuuucguucua

SEQ ID NO: 2767448 - RNA, 20 nt, Leptospira interrogans serovar lai str. 56601
caagcacauccgcauucuca

SEQ ID NO: 2767449 - RNA, 21 nt, Leptospira interrogans serovar lai str. 56601
caagccggauucgcccagauc

SEQ ID NO: 2767450 - RNA, 14 nt, Leptospira interrogans serovar lai str. 56601
caagcgcucgccuu

SEQ ID NO: 2767451 - RNA, 14 nt, Leptospira interrogans serovar lai str. 56601
caagcuuccuuuuu

SEQ ID NO: 2767452 - RNA, 15 nt, Leptospira interrogans serovar lai str. 56601
caagcuuccuuuuuu

SEQ ID NO: 2767453 - RNA, 15 nt, Leptospira interrogans serovar lai str. 56601
caagcuuuaaauuca

SEQ ID NO: 2767454 - RNA, 23 nt, Leptospira interrogans serovar lai str. 56601
caaggcggcucgcgaccuaaaac

SEQ ID NO: 2767455 - RNA, 21 nt, Leptospira interrogans serovar lai str. 56601
caagguuucacuuuuuuaaag

SEQ ID NO: 2767456 - RNA, 16 nt, Leptospira interrogans serovar lai str. 56601
caaguaaaaagacuca

SEQ ID NO: 2767457 - RNA, 15 nt, Leptospira interrogans serovar lai str. 56601
caaguagagagugaa

SEQ ID NO: 2767458 - RNA, 23 nt, Leptospira interrogans serovar lai str. 56601
caaguauaaaagugaauuuuugu

SEQ ID NO: 2767459 - RNA, 16 nt, Leptospira interrogans serovar lai str. 56601
caaguauucuauuuau

SEQ ID NO: 2767460 - RNA, 23 nt, Leptospira interrogans serovar lai str. 56601
caaguauuugaucucaauauaaa

SEQ ID NO: 2767461 - RNA, 23 nt, Leptospira interrogans serovar lai str. 56601
caaguguggucuauuacaaaacu

SEQ ID NO: 2767462 - RNA, 13 nt, Leptospira interrogans serovar lai str. 56601
caaguguuccgac

SEQ ID NO: 2767463 - RNA, 11 nt, Leptospira interrogans serovar lai str. 56601
caaguuaaauu

SEQ ID NO: 2767464 - RNA, 15 nt, Leptospira interrogans serovar lai str. 56601
caaguuaauagaguu

SEQ ID NO: 2767465 - RNA, 18 nt, Leptospira interrogans serovar lai str. 56601
caaguuauuguaaaacuc

SEQ ID NO: 2767466 - RNA, 20 nt, Leptospira interrogans serovar lai str. 56601
caaguuauuguaaaacucca

SEQ ID NO: 2767467 - RNA, 19 nt, Leptospira interrogans serovar lai str. 56601
caaguuccgcgauugaaaa

SEQ ID NO: 2767468 - RNA, 17 nt, Leptospira interrogans serovar lai str. 56601
caaguucgauuaaaaua

SEQ ID NO: 2767469 - RNA, 19 nt, Leptospira interrogans serovar lai str. 56601
caaguucgauuaaaauaaa

SEQ ID NO: 2767470 - RNA, 20 nt, Leptospira interrogans serovar lai str. 56601
caaguucgauuaaaauaaac

SEQ ID NO: 2767471 - RNA, 19 nt, Leptospira interrogans serovar lai str. 56601
caaguucgguagaaagaau

SEQ ID NO: 2767472 - RNA, 17 nt, Leptospira interrogans serovar lai str. 56601
caaguugaauaggauuu

SEQ ID NO: 2767473 - RNA, 21 nt, Leptospira interrogans serovar lai str. 56601
caaguugaaugagcuagauuu

SEQ ID NO: 2767474 - RNA, 15 nt, Leptospira interrogans serovar lai str. 56601
caaguuuaaaugaaa

SEQ ID NO: 2767475 - RNA, 17 nt, Leptospira interrogans serovar lai str. 56601
caaguuuaaaugaaaug

SEQ ID NO: 2767476 - RNA, 15 nt, Leptospira interrogans serovar lai str. 56601
caaguuugugagagu

SEQ ID NO: 2767477 - RNA, 20 nt, Leptospira interrogans serovar lai str. 56601
caaguuugugagaguuccca

SEQ ID NO: 2767478 - RNA, 22 nt, Leptospira interrogans serovar lai str. 56601
caaguuuuucgguaaaaucauu

SEQ ID NO: 2767479 - RNA, 12 nt, Leptospira interrogans serovar lai str. 56601
caauaaaauacc

SEQ ID NO: 2767480 - RNA, 14 nt, Leptospira interrogans serovar lai str. 56601
caauaaaaucaaua

SEQ ID NO: 2767481 - RNA, 13 nt, Leptospira interrogans serovar lai str. 56601
cacauuuucaaaa

SEQ ID NO: 2767482 - RNA, 19 nt, Leptospira interrogans serovar lai str. 56601
cacauuuuuaaaaguuauu

SEQ ID NO: 2767483 - RNA, 18 nt, Leptospira interrogans serovar lai str. 56601
cacauuuuucaaauuugg

SEQ ID NO: 2767484 - RNA, 23 nt, Leptospira interrogans serovar lai str. 56601
cacauuuuucaaguguuccgaca

SEQ ID NO: 2767485 - RNA, 22 nt, Leptospira interrogans serovar lai str. 56601
caccaaaaauagggaaaacuca

SEQ ID NO: 2767486 - RNA, 23 nt, Leptospira interrogans serovar lai str. 56601
cacccaaagucgcccaaacccca

SEQ ID NO: 2767487 - RNA, 15 nt, Leptospira interrogans serovar lai str. 56601
cacccaccaaaaaua

SEQ ID NO: 2767488 - RNA, 19 nt, Leptospira interrogans serovar lai str. 56601
caccgcacaaaugauagaa

SEQ ID NO: 2767489 - RNA, 21 nt, Leptospira interrogans serovar lai str. 56601
caccguugcuauaaaaaggau

SEQ ID NO: 2767490 - RNA, 13 nt, Leptospira interrogans serovar lai str. 56601
caccuaaaaugaa

SEQ ID NO: 2767491 - RNA, 15 nt, Leptospira interrogans serovar lai str. 56601
caccuaaaaugaaaa

SEQ ID NO: 2767492 - RNA, 17 nt, Leptospira interrogans serovar lai str. 56601
caccuaaaaugaaaaaa

SEQ ID NO: 2767493 - RNA, 19 nt, Leptospira interrogans serovar lai str. 56601
caccucuauggaauuuuuu

SEQ ID NO: 2767494 - RNA, 15 nt, Leptospira interrogans serovar lai str. 56601
caccuuccaaagauu

SEQ ID NO: 2767495 - RNA, 18 nt, Leptospira interrogans serovar lai str. 56601
caccuuccaaagauuuua

SEQ ID NO: 2767496 - RNA, 21 nt, Leptospira interrogans serovar lai str. 56601
caccuuccaaagauuuuaaaa

SEQ ID NO: 2767497 - RNA, 23 nt, Leptospira interrogans serovar lai str. 56601
caccuucugaaaguaguauucuu

SEQ ID NO: 2767498 - RNA, 21 nt, Leptospira interrogans serovar lai str. 56601
caccuuuuuuuaugaaaaaau

SEQ ID NO: 2767499 - RNA, 23 nt, Leptospira interrogans serovar lai str. 56601
cacgaucauucuuuagaaauuuu

SEQ ID NO: 2767500 - RNA, 22 nt, Leptospira interrogans serovar lai str. 56601
cacgauugauuuuggaaagaau

SEQ ID NO: 2767501 - RNA, 20 nt, Leptospira interrogans serovar lai str. 56601
cacgauuuauagagagcguu

SEQ ID NO: 2767502 - RNA, 22 nt, Leptospira interrogans serovar lai str. 56601
cacgauuuuacgaacaaauucu

SEQ ID NO: 2767503 - RNA, 19 nt, Leptospira interrogans serovar lai str. 56601
cacguuauuuagaucaaau

SEQ ID NO: 2767504 - RNA, 19 nt, Leptospira interrogans serovar lai str. 56601
cacguucaacguucaaaca

SEQ ID NO: 2767505 - RNA, 17 nt, Leptospira interrogans serovar lai str. 56601
cacguucuuagccuuua

SEQ ID NO: 2767506 - RNA, 22 nt, Leptospira interrogans serovar lai str. 56601
cacguugaauaagauuuuagaa

SEQ ID NO: 2767507 - RNA, 11 nt, Leptospira interrogans serovar lai str. 56601
cacuaaaauac

SEQ ID NO: 2767508 - RNA, 18 nt, Leptospira interrogans serovar lai str. 56601
cacuaaguaaaaaugcaa

SEQ ID NO: 2767509 - RNA, 16 nt, Leptospira interrogans serovar lai str. 56601
cacuaccuuauaaaaa

SEQ ID NO: 2767510 - RNA, 21 nt, Leptospira interrogans serovar lai str. 56601
cacuaugaaaguuuuucaaca

SEQ ID NO: 2767511 - RNA, 17 nt, Leptospira interrogans serovar lai str. 56601
cacuauggaauuuuuua

SEQ ID NO: 2767512 - RNA, 20 nt, Leptospira interrogans serovar lai str. 56601
cacuauggaauuuuuuaaca

SEQ ID NO: 2767513 - RNA, 12 nt, Leptospira interrogans serovar lai str. 56601
cacuauuuuuau

SEQ ID NO: 2767514 - RNA, 19 nt, Leptospira interrogans serovar lai str. 56601
cacucaauuuuauaucaau

SEQ ID NO: 2767515 - RNA, 15 nt, Leptospira interrogans serovar lai str. 56601
cacucgaacuucguu

SEQ ID NO: 2767516 - RNA, 18 nt, Leptospira interrogans serovar lai str. 56601
cacucuaaguuuuuaaau

SEQ ID NO: 2767517 - RNA, 19 nt, Leptospira interrogans serovar lai str. 56601
cacucuaaguuuuuaaaua

SEQ ID NO: 2767518 - RNA, 13 nt, Leptospira interrogans serovar lai str. 56601
cacucuuaaauac

SEQ ID NO: 2767519 - RNA, 16 nt, Leptospira interrogans serovar lai str. 56601
cacucuuugacuacuu

SEQ ID NO: 2767520 - RNA, 19 nt, Leptospira interrogans serovar lai str. 56601
cacugaauaaaaaguacau

SEQ ID NO: 2767521 - RNA, 18 nt, Leptospira interrogans serovar lai str. 56601
cacuguuucgacguaaaa

SEQ ID NO: 2767522 - RNA, 11 nt, Leptospira interrogans serovar lai str. 56601
cacuuaaaaag

SEQ ID NO: 2767523 - RNA, 20 nt, Leptospira interrogans serovar lai str. 56601
cacuuagaaagauagagaau

SEQ ID NO: 2767524 - RNA, 15 nt, Leptospira interrogans serovar lai str. 56601
cacuuccauuuuuug

SEQ ID NO: 2767525 - RNA, 12 nt, Leptospira interrogans serovar lai str. 56601
cacuucuuuuag

SEQ ID NO: 2767526 - RNA, 13 nt, Leptospira interrogans serovar lai str. 56601
cacuugaauacga

SEQ ID NO: 2767527 - RNA, 15 nt, Leptospira interrogans serovar lai str. 56601
cacuuguuauuaaaa

SEQ ID NO: 2767528 - RNA, 13 nt, Leptospira interrogans serovar lai str. 56601
cacuuuaaaaaug

SEQ ID NO: 2767529 - RNA, 14 nt, Leptospira interrogans serovar lai str. 56601
cacuuuauaaaagu

SEQ ID NO: 2767530 - RNA, 23 nt, Leptospira interrogans serovar lai str. 56601
cacuuuauaaaaguauaauauuu

SEQ ID NO: 2767531 - RNA, 20 nt, Leptospira interrogans serovar lai str. 56601
cacuuuaucuuuucuuaaaa

SEQ ID NO: 2767532 - RNA, 17 nt, Leptospira interrogans serovar lai str. 56601
cacuuuccuuaaaccca

SEQ ID NO: 2767533 - RNA, 15 nt, Leptospira interrogans serovar lai str. 56601
cacuuugagaaagaa

SEQ ID NO: 2767534 - RNA, 12 nt, Leptospira interrogans serovar lai str. 56601
cacuuuuaaaga

SEQ ID NO: 2767535 - RNA, 23 nt, Leptospira interrogans serovar lai str. 56601
cacuuuuuacaugagacuauaaa

SEQ ID NO: 2767536 - RNA, 16 nt, Leptospira interrogans serovar lai str. 56601
cagaaaaaaaaagaau

SEQ ID NO: 2767537 - RNA, 13 nt, Leptospira interrogans serovar lai str. 56601
cagaaaaaaaauc

SEQ ID NO: 2767538 - RNA, 20 nt, Leptospira interrogans serovar lai str. 56601
cagaaaaauguuaaaaaacu

SEQ ID NO: 2767539 - RNA, 22 nt, Leptospira interrogans serovar lai str. 56601
cagaaaaauguuaaaaaacuau

SEQ ID NO: 2767540 - RNA, 15 nt, Leptospira interrogans serovar lai str. 56601
cagaaaaccaaauaa

SEQ ID NO: 2767541 - RNA, 19 nt, Leptospira interrogans serovar lai str. 56601
cagaaaaccaaauaauaaa

SEQ ID NO: 2767542 - RNA, 14 nt, Leptospira interrogans serovar lai str. 56601
cagaaacauuggaa

SEQ ID NO: 2767543 - RNA, 23 nt, Leptospira interrogans serovar lai str. 56601
cagaaacauuggaacuuuuuauc

SEQ ID NO: 2767544 - RNA, 13 nt, Leptospira interrogans serovar lai str. 56601
cagaaaccauaaa

SEQ ID NO: 2767545 - RNA, 18 nt, Leptospira interrogans serovar lai str. 56601
cagaaaccauaaaauaaa

SEQ ID NO: 2767546 - RNA, 15 nt, Leptospira interrogans serovar lai str. 56601
cagaaacccucuccu

SEQ ID NO: 2767547 - RNA, 18 nt, Leptospira interrogans serovar lai str. 56601
cagaaaccguuguaugau

SEQ ID NO: 2767548 - RNA, 14 nt, Leptospira interrogans serovar lai str. 56601
cagaaacguucgua

SEQ ID NO: 2767549 - RNA, 19 nt, Leptospira interrogans serovar lai str. 56601
cagaacaaaacguuaucga

SEQ ID NO: 2767550 - RNA, 19 nt, Leptospira interrogans serovar lai str. 56601
cagaacccaauaaaaacua

SEQ ID NO: 2767551 - RNA, 16 nt, Leptospira interrogans serovar lai str. 56601
cagaaccguccaaugu

SEQ ID NO: 2767552 - RNA, 14 nt, Leptospira interrogans serovar lai str. 56601
cagaaccucaaaga

SEQ ID NO: 2767553 - RNA, 18 nt, Leptospira interrogans serovar lai str. 56601
cagaaccucaaagaaauu

SEQ ID NO: 2767554 - RNA, 21 nt, Leptospira interrogans serovar lai str. 56601
cagaaccuuuaguuuccaaaa

SEQ ID NO: 2767555 - RNA, 18 nt, Leptospira interrogans serovar lai str. 56601
cagaacgggcuuucuaug

SEQ ID NO: 2767556 - RNA, 16 nt, Leptospira interrogans serovar lai str. 56601
cagaaguauuccauau

SEQ ID NO: 2767557 - RNA, 13 nt, Leptospira interrogans serovar lai str. 56601
cagaauauuaaau

SEQ ID NO: 2767558 - RNA, 14 nt, Leptospira interrogans serovar lai str. 56601
cagaaucaaaggaa

SEQ ID NO: 2767559 - RNA, 16 nt, Leptospira interrogans serovar lai str. 56601
cagaaugaacucaaca

SEQ ID NO: 2767560 - RNA, 18 nt, Leptospira interrogans serovar lai str. 56601
cagaauguuuucuacaaa

SEQ ID NO: 2767561 - RNA, 22 nt, Leptospira interrogans serovar lai str. 56601
cagaauguuuucuacaaauaaa

SEQ ID NO: 2767562 - RNA, 13 nt, Leptospira interrogans serovar lai str. 56601
cagaauuaaaaau

SEQ ID NO: 2767563 - RNA, 16 nt, Leptospira interrogans serovar lai str. 56601
cagaauuaaaaauuaa

SEQ ID NO: 2767564 - RNA, 22 nt, Leptospira interrogans serovar lai str. 56601
caguaaaaaagcgaaagaaugu

SEQ ID NO: 2767565 - RNA, 15 nt, Leptospira interrogans serovar lai str. 56601
caguaaaaucuuuaa

SEQ ID NO: 2767566 - RNA, 17 nt, Leptospira interrogans serovar lai str. 56601
caguaaaaucuuuaagu

SEQ ID NO: 2767567 - RNA, 21 nt, Leptospira interrogans serovar lai str. 56601
caguaaaaucuuuaaguuugu

SEQ ID NO: 2767568 - RNA, 21 nt, Leptospira interrogans serovar lai str. 56601
caguaaggauucuuuucccgc

SEQ ID NO: 2767569 - RNA, 21 nt, Leptospira interrogans serovar lai str. 56601
caguaaugccuacaaaucaaa

SEQ ID NO: 2767570 - RNA, 16 nt, Leptospira interrogans serovar lai str. 56601
caguacaagaaucaaa

SEQ ID NO: 2767571 - RNA, 18 nt, Leptospira interrogans serovar lai str. 56601
caguacaagaaucaaaac

SEQ ID NO: 2767572 - RNA, 15 nt, Leptospira interrogans serovar lai str. 56601
caguacgaucaaauc

SEQ ID NO: 2767573 - RNA, 15 nt, Leptospira interrogans serovar lai str. 56601
caguaggcuauuuua

SEQ ID NO: 2767574 - RNA, 20 nt, Leptospira interrogans serovar lai str. 56601
caguaguuccuacaaauuaa

SEQ ID NO: 2767575 - RNA, 22 nt, Leptospira interrogans serovar lai str. 56601
caguauauuauaauuuuaaaua

SEQ ID NO: 2767576 - RNA, 16 nt, Leptospira interrogans serovar lai str. 56601
caguauguuguucucc

SEQ ID NO: 2767577 - RNA, 15 nt, Leptospira interrogans serovar lai str. 56601
caguauguuuuuuug

SEQ ID NO: 2767578 - RNA, 14 nt, Leptospira interrogans serovar lai str. 56601
caguauucaauuuu

SEQ ID NO: 2767579 - RNA, 15 nt, Leptospira interrogans serovar lai str. 56601
caguauucuagaaua

SEQ ID NO: 2767580 - RNA, 14 nt, Leptospira interrogans serovar lai str. 56601
caguauuuguaaaa

SEQ ID NO: 2767581 - RNA, 13 nt, Leptospira interrogans serovar lai str. 56601
caguauuuuguau

SEQ ID NO: 2767582 - RNA, 15 nt, Leptospira interrogans serovar lai str. 56601
cagucaaguaaagaa

SEQ ID NO: 2767583 - RNA, 18 nt, Leptospira interrogans serovar lai str. 56601
cagucaccucuauaaaau

SEQ ID NO: 2767584 - RNA, 19 nt, Leptospira interrogans serovar lai str. 56601
cagucaccucuauaaaauc

SEQ ID NO: 2767585 - RNA, 17 nt, Leptospira interrogans serovar lai str. 56601
cagucgcuaaacucauu

SEQ ID NO: 2767586 - RNA, 15 nt, Leptospira interrogans serovar lai str. 56601
cagugaauaaaauaa

SEQ ID NO: 2767587 - RNA, 15 nt, Leptospira interrogans serovar lai str. 56601
cagugauaagaaaaa

SEQ ID NO: 2767588 - RNA, 17 nt, Leptospira interrogans serovar lai str. 56601
cagugauucgaaauuuu

SEQ ID NO: 2767589 - RNA, 21 nt, Leptospira interrogans serovar lai str. 56601
cagugccauuuuucuucuuug

SEQ ID NO: 2767590 - RNA, 18 nt, Leptospira interrogans serovar lai str. 56601
caguguccauuucaauac

SEQ ID NO: 2767591 - RNA, 19 nt, Leptospira interrogans serovar lai str. 56601
caguguccauuucaauaca

SEQ ID NO: 2767592 - RNA, 21 nt, Leptospira interrogans serovar lai str. 56601
caguguuuugugauaaaauua

SEQ ID NO: 2767593 - RNA, 17 nt, Leptospira interrogans serovar lai str. 56601
caguuaaacuuugaaaa

SEQ ID NO: 2767594 - RNA, 21 nt, Leptospira interrogans serovar lai str. 56601
caguuaaacuuugaaaauugu

SEQ ID NO: 2767595 - RNA, 12 nt, Leptospira interrogans serovar lai str. 56601
caguuaaauuca

SEQ ID NO: 2767596 - RNA, 17 nt, Leptospira interrogans serovar lai str. 56601
caguuaauacaaaacuu

SEQ ID NO: 2767597 - RNA, 21 nt, Leptospira interrogans serovar lai str. 56601
caguuauaaguaaguaauuac

SEQ ID NO: 2767598 - RNA, 15 nt, Leptospira interrogans serovar lai str. 56601
caguucccacauuuu

SEQ ID NO: 2767599 - RNA, 15 nt, Leptospira interrogans serovar lai str. 56601
caguuccuaacaauu

SEQ ID NO: 2767600 - RNA, 17 nt, Leptospira interrogans serovar lai str. 56601
caguuccuaacaauuuu

SEQ ID NO: 2767601 - RNA, 19 nt, Leptospira interrogans serovar lai str. 56601
caguucuacuuuauuaaaa

SEQ ID NO: 2767602 - RNA, 21 nt, Leptospira interrogans serovar lai str. 56601
caguucuacuuuauuaaaaag

SEQ ID NO: 2767603 - RNA, 22 nt, Leptospira interrogans serovar lai str. 56601
caguucuacuuuauuaaaaagu

SEQ ID NO: 2767604 - RNA, 16 nt, Leptospira interrogans serovar lai str. 56601
caguucuuaaauaaaa

SEQ ID NO: 2767605 - RNA, 17 nt, Leptospira interrogans serovar lai str. 56601
caguugagaguuuuucu

SEQ ID NO: 2767606 - RNA, 19 nt, Leptospira interrogans serovar lai str. 56601
caguuucaaacugagauuu

SEQ ID NO: 2767607 - RNA, 14 nt, Leptospira interrogans serovar lai str. 56601
caguuuccacucuu

SEQ ID NO: 2767608 - RNA, 21 nt, Leptospira interrogans serovar lai str. 56601
caguuugaauuuuacuaaaaa

SEQ ID NO: 2767609 - RNA, 14 nt, Leptospira interrogans serovar lai str. 56601
caguuuguuagagu

SEQ ID NO: 2767610 - RNA, 19 nt, Leptospira interrogans serovar lai str. 56601
caguuuuuucguaaaaaau

SEQ ID NO: 2767611 - RNA, 20 nt, Leptospira interrogans serovar lai str. 56601
caguuuuuucguaaaaaaua

SEQ ID NO: 2767612 - RNA, 16 nt, Leptospira interrogans serovar lai str. 56601
caguuuuuugagaaac

SEQ ID NO: 2767613 - RNA, 18 nt, Leptospira interrogans serovar lai str. 56601
caguuuuuugagaaacaa

SEQ ID NO: 2767614 - RNA, 13 nt, Leptospira interrogans serovar lai str. 56601
cauaaaaaaauau

SEQ ID NO: 2767615 - RNA, 18 nt, Leptospira interrogans serovar lai str. 56601
cauaaaaaaauuaaaaaa

SEQ ID NO: 2767616 - RNA, 19 nt, Leptospira interrogans serovar lai str. 56601
cauaaaaaacauaagaaua

SEQ ID NO: 2767617 - RNA, 20 nt, Leptospira interrogans serovar lai str. 56601
cauaaaaaacauaagaauau

SEQ ID NO: 2767618 - RNA, 16 nt, Leptospira interrogans serovar lai str. 56601
cauaaaaauaaagaaa

SEQ ID NO: 2767619 - RNA, 17 nt, Leptospira interrogans serovar lai str. 56601
cauaaaaauuuuuuaaa

SEQ ID NO: 2767620 - RNA, 16 nt, Leptospira interrogans serovar lai str. 56601
cauaaaacucuaaauu

SEQ ID NO: 2767621 - RNA, 18 nt, Leptospira interrogans serovar lai str. 56601
cauaaaacucuaaauuca

SEQ ID NO: 2767622 - RNA, 21 nt, Leptospira interrogans serovar lai str. 56601
cauaaaagaaacauuauacau

SEQ ID NO: 2767623 - RNA, 14 nt, Leptospira interrogans serovar lai str. 56601
cauaaaagaacgaa

SEQ ID NO: 2767624 - RNA, 12 nt, Leptospira interrogans serovar lai str. 56601
cauaaaauaaaa

SEQ ID NO: 2767625 - RNA, 21 nt, Leptospira interrogans serovar lai str. 56601
cauaaaaucguaguuuuacag

SEQ ID NO: 2767626 - RNA, 23 nt, Leptospira interrogans serovar lai str. 56601
cauaaaggugcaugaaaauaaua

SEQ ID NO: 2767627 - RNA, 21 nt, Leptospira interrogans serovar lai str. 56601
cauaaaguuaauacaaaaaac

SEQ ID NO: 2767628 - RNA, 23 nt, Leptospira interrogans serovar lai str. 56601
cauaaauggcguauaagaauguu

SEQ ID NO: 2767629 - RNA, 18 nt, Leptospira interrogans serovar lai str. 56601
cauaaauuuuuauuacau

SEQ ID NO: 2767630 - RNA, 13 nt, Leptospira interrogans serovar lai str. 56601
cauaacaaaaaua

SEQ ID NO: 2767631 - RNA, 16 nt, Leptospira interrogans serovar lai str. 56601
cauaacaaaaauacuu

SEQ ID NO: 2767632 - RNA, 14 nt, Leptospira interrogans serovar lai str. 56601
cauaacaaauaaaa

SEQ ID NO: 2767633 - RNA, 13 nt, Leptospira interrogans serovar lai str. 56601
cauaacagaauuu

SEQ ID NO: 2767634 - RNA, 22 nt, Leptospira interrogans serovar lai str. 56601
cauaacauuuugcuaauaaaua

SEQ ID NO: 2767635 - RNA, 21 nt, Leptospira interrogans serovar lai str. 56601
cauaacgucuugauuauuuuc

SEQ ID NO: 2767636 - RNA, 20 nt, Leptospira interrogans serovar lai str. 56601
cauaacgugacaaacuaaau

SEQ ID NO: 2767637 - RNA, 13 nt, Leptospira interrogans serovar lai str. 56601
cauaacuaauaaa

SEQ ID NO: 2767638 - RNA, 15 nt, Leptospira interrogans serovar lai str. 56601
cauaagcaaaaauaa

SEQ ID NO: 2767639 - RNA, 23 nt, Leptospira interrogans serovar lai str. 56601
cauaaguucgucugagaaaaacu

SEQ ID NO: 2767640 - RNA, 20 nt, Leptospira interrogans serovar lai str. 56601
cauaaguuguuauaaaccaa

SEQ ID NO: 2767641 - RNA, 13 nt, Leptospira interrogans serovar lai str. 56601
cauaauaaaguac

SEQ ID NO: 2767642 - RNA, 22 nt, Leptospira interrogans serovar lai str. 56601
cauaauaaauuuuucuggaaaa

SEQ ID NO: 2767643 - RNA, 16 nt, Leptospira interrogans serovar lai str. 56601
cauaaucaaccccaca

SEQ ID NO: 2767644 - RNA, 17 nt, Leptospira interrogans serovar lai str. 56601
cauaaucaaccccacac

SEQ ID NO: 2767645 - RNA, 21 nt, Leptospira interrogans serovar lai str. 56601
cauaauguuucaauuccuaaa

SEQ ID NO: 2767646 - RNA, 22 nt, Leptospira interrogans serovar lai str. 56601
cauaauguuucaauuccuaaau

SEQ ID NO: 2767647 - RNA, 19 nt, Leptospira interrogans serovar lai str. 56601
caucuaucuuuucaaaagu

SEQ ID NO: 2767648 - RNA, 19 nt, Leptospira interrogans serovar lai str. 56601
caucuauuccguacuguuu

SEQ ID NO: 2767649 - RNA, 16 nt, Leptospira interrogans serovar lai str. 56601
caucucaaaaacacuu

SEQ ID NO: 2767650 - RNA, 20 nt, Leptospira interrogans serovar lai str. 56601
caucucaaaaauaucuuaga

SEQ ID NO: 2767651 - RNA, 20 nt, Leptospira interrogans serovar lai str. 56601
caucucauccuucaucucag

SEQ ID NO: 2767652 - RNA, 19 nt, Leptospira interrogans serovar lai str. 56601
caucucuucgucucaccaa

SEQ ID NO: 2767653 - RNA, 21 nt, Leptospira interrogans serovar lai str. 56601
caucugaacuaugaaauuuuu

SEQ ID NO: 2767654 - RNA, 15 nt, Leptospira interrogans serovar lai str. 56601
caucuguggagaaaa

SEQ ID NO: 2767655 - RNA, 16 nt, Leptospira interrogans serovar lai str. 56601
caucuguuucuugccc

SEQ ID NO: 2767656 - RNA, 13 nt, Leptospira interrogans serovar lai str. 56601
caucuuaaaaaau

SEQ ID NO: 2767657 - RNA, 14 nt, Leptospira interrogans serovar lai str. 56601
caucuuaaaaaaua

SEQ ID NO: 2767658 - RNA, 14 nt, Leptospira interrogans serovar lai str. 56601
caucuuaaaaacuc

SEQ ID NO: 2767659 - RNA, 13 nt, Leptospira interrogans serovar lai str. 56601
caucuucuucauc

SEQ ID NO: 2767660 - RNA, 15 nt, Leptospira interrogans serovar lai str. 56601
caucuugaaacccca

SEQ ID NO: 2767661 - RNA, 16 nt, Leptospira interrogans serovar lai str. 56601
caucuuuuaaaaucaa

SEQ ID NO: 2767662 - RNA, 21 nt, Leptospira interrogans serovar lai str. 56601
caucuuuuaaaaucaagagcu

SEQ ID NO: 2767663 - RNA, 21 nt, Leptospira interrogans serovar lai str. 56601
caucuuuucuaagguuugucu

SEQ ID NO: 2767664 - RNA, 15 nt, Leptospira interrogans serovar lai str. 56601
caucuuuuuuuucua

SEQ ID NO: 2767665 - RNA, 21 nt, Leptospira interrogans serovar lai str. 56601
caucuuuuuuuucuaaaauau

SEQ ID NO: 2767666 - RNA, 21 nt, Leptospira interrogans serovar lai str. 56601
caugaaauugauguuuuguag

SEQ ID NO: 2767667 - RNA, 21 nt, Leptospira interrogans serovar lai str. 56601
caugaacgaauuuuucaacaa

SEQ ID NO: 2767668 - RNA, 10 nt, Leptospira interrogans serovar lai str. 56601
caugaagaag

SEQ ID NO: 2767669 - RNA, 16 nt, Leptospira interrogans serovar lai str. 56601
caugaaguugauugac

SEQ ID NO: 2767670 - RNA, 18 nt, Leptospira interrogans serovar lai str. 56601
caugaauauuuuccaaaa

SEQ ID NO: 2767671 - RNA, 23 nt, Leptospira interrogans serovar lai str. 56601
caugagauuauuaucuuguguuu

SEQ ID NO: 2767672 - RNA, 16 nt, Leptospira interrogans serovar lai str. 56601
caugagcuugucccaa

SEQ ID NO: 2767673 - RNA, 15 nt, Leptospira interrogans serovar lai str. 56601
caugauaaaaauugu

SEQ ID NO: 2767674 - RNA, 21 nt, Leptospira interrogans serovar lai str. 56601
caugauaaaaauuguuaucgc

SEQ ID NO: 2767675 - RNA, 17 nt, Leptospira interrogans serovar lai str. 56601
caugauaguuaauuuua

SEQ ID NO: 2767676 - RNA, 23 nt, Leptospira interrogans serovar lai str. 56601
caugauccauuuuucugaaaaaa

SEQ ID NO: 2767677 - RNA, 16 nt, Leptospira interrogans serovar lai str. 56601
caugauucauuuaaaa

SEQ ID NO: 2767678 - RNA, 19 nt, Leptospira interrogans serovar lai str. 56601
caugauucauuuaaaaauu

SEQ ID NO: 2767679 - RNA, 20 nt, Leptospira interrogans serovar lai str. 56601
caugauucauuuuucuaaaa

SEQ ID NO: 2767680 - RNA, 22 nt, Leptospira interrogans serovar lai str. 56601
caugauucauuuuucuaaaaaa

SEQ ID NO: 2767681 - RNA, 23 nt, Leptospira interrogans serovar lai str. 56601
caugauucauuuuucugaaaaaa

SEQ ID NO: 2767682 - RNA, 20 nt, Leptospira interrogans serovar lai str. 56601
caugauucauuuuuugaaaa

SEQ ID NO: 2767683 - RNA, 20 nt, Leptospira interrogans serovar lai str. 56601
caugauuuuuuaaucuggaa

SEQ ID NO: 2767684 - RNA, 15 nt, Leptospira interrogans serovar lai str. 56601
caugcaaaaauuuaa

SEQ ID NO: 2767685 - RNA, 18 nt, Leptospira interrogans serovar lai str. 56601
caugcaaaaauuuaauug

SEQ ID NO: 2767686 - RNA, 20 nt, Leptospira interrogans serovar lai str. 56601
caugcaucaacguaaauaaa

SEQ ID NO: 2767687 - RNA, 20 nt, Leptospira interrogans serovar lai str. 56601
cauggaaauuuuuccgucga

SEQ ID NO: 2767688 - RNA, 22 nt, Leptospira interrogans serovar lai str. 56601
cauggagaauaaaacgcugagu

SEQ ID NO: 2767689 - RNA, 22 nt, Leptospira interrogans serovar lai str. 56601
cauggaggcugccgcucuuucu

SEQ ID NO: 2767690 - RNA, 19 nt, Leptospira interrogans serovar lai str. 56601
cauggccuucuggaaaaau

SEQ ID NO: 2767691 - RNA, 20 nt, Leptospira interrogans serovar lai str. 56601
cauguaaaacuuagaucuca

SEQ ID NO: 2767692 - RNA, 24 nt, Leptospira interrogans serovar lai str. 56601
cauguaauauaaguuaagugaaaa

SEQ ID NO: 2767693 - RNA, 16 nt, Leptospira interrogans serovar lai str. 56601
caugucucaguucaaa

SEQ ID NO: 2767694 - RNA, 17 nt, Leptospira interrogans serovar lai str. 56601
caugucucaguucaaaa

SEQ ID NO: 2767695 - RNA, 14 nt, Leptospira interrogans serovar lai str. 56601
caugucuucuaaau

SEQ ID NO: 2767696 - RNA, 21 nt, Leptospira interrogans serovar lai str. 56601
caugucuucuaaaucuaauuc

SEQ ID NO: 2767697 - RNA, 17 nt, Leptospira interrogans serovar lai str. 56601
cauuaaaauuuucaucu

SEQ ID NO: 2767698 - RNA, 21 nt, Leptospira interrogans serovar lai str. 56601
cauuaaaauuuucaucuuuuc

SEQ ID NO: 2767699 - RNA, 19 nt, Leptospira interrogans serovar lai str. 56601
cauuaaaguccaaaucaaa

SEQ ID NO: 2767700 - RNA, 17 nt, Leptospira interrogans serovar lai str. 56601
cauuaauauaaaaaaua

SEQ ID NO: 2767701 - RNA, 16 nt, Leptospira interrogans serovar lai str. 56601
cauuaauuacagaauu

SEQ ID NO: 2767702 - RNA, 19 nt, Leptospira interrogans serovar lai str. 56601
cauuaccaauugauaauuu

SEQ ID NO: 2767703 - RNA, 18 nt, Leptospira interrogans serovar lai str. 56601
cauuacgaauuuuuaaau

SEQ ID NO: 2767704 - RNA, 18 nt, Leptospira interrogans serovar lai str. 56601
cauuacuacagacaaucc

SEQ ID NO: 2767705 - RNA, 14 nt, Leptospira interrogans serovar lai str. 56601
cauuagaacuacuc

SEQ ID NO: 2767706 - RNA, 22 nt, Leptospira interrogans serovar lai str. 56601
cauuagagucguugaaaauucu

SEQ ID NO: 2767707 - RNA, 23 nt, Leptospira interrogans serovar lai str. 56601
cauuagagucguugaaaauucua

SEQ ID NO: 2767708 - RNA, 14 nt, Leptospira interrogans serovar lai str. 56601
cauuauauauuuau

SEQ ID NO: 2767709 - RNA, 19 nt, Leptospira interrogans serovar lai str. 56601
cauuaugaauuuuuaaaca

SEQ ID NO: 2767710 - RNA, 14 nt, Leptospira interrogans serovar lai str. 56601
cauuauuagaguug

SEQ ID NO: 2767711 - RNA, 23 nt, Leptospira interrogans serovar lai str. 56601
cauuauuucaaugcaaaaaauug

SEQ ID NO: 2767712 - RNA, 18 nt, Leptospira interrogans serovar lai str. 56601
cauucaaaauaaauaaua

SEQ ID NO: 2767713 - RNA, 23 nt, Leptospira interrogans serovar lai str. 56601
cauucaacuuagaacuuguccca

SEQ ID NO: 2767714 - RNA, 18 nt, Leptospira interrogans serovar lai str. 56601
cauucauccuaagaauca

SEQ ID NO: 2767715 - RNA, 15 nt, Leptospira interrogans serovar lai str. 56601
cauucauuuuuucua

SEQ ID NO: 2767716 - RNA, 16 nt, Leptospira interrogans serovar lai str. 56601
cauuccauaggcaauu

SEQ ID NO: 2767717 - RNA, 19 nt, Leptospira interrogans serovar lai str. 56601
cauuccgcaaaaauuccuu

SEQ ID NO: 2767718 - RNA, 16 nt, Leptospira interrogans serovar lai str. 56601
cauuccgucaaaucau

SEQ ID NO: 2767719 - RNA, 17 nt, Leptospira interrogans serovar lai str. 56601
cauuccuauaaauaaau

SEQ ID NO: 2767720 - RNA, 22 nt, Leptospira interrogans serovar lai str. 56601
cauucgauacugcgauuucugu

SEQ ID NO: 2767721 - RNA, 15 nt, Leptospira interrogans serovar lai str. 56601
cauucggagacuuga

SEQ ID NO: 2767722 - RNA, 21 nt, Leptospira interrogans serovar lai str. 56601
cauucgggucgauagaaagua

SEQ ID NO: 2767723 - RNA, 14 nt, Leptospira interrogans serovar lai str. 56601
cauucuaaagaagg

SEQ ID NO: 2767724 - RNA, 15 nt, Leptospira interrogans serovar lai str. 56601
cauucuaaagaaggg

SEQ ID NO: 2767725 - RNA, 13 nt, Leptospira interrogans serovar lai str. 56601
cauucuaagaucu

SEQ ID NO: 2767726 - RNA, 19 nt, Leptospira interrogans serovar lai str. 56601
cauucuaguuuguuuaucc

SEQ ID NO: 2767727 - RNA, 22 nt, Leptospira interrogans serovar lai str. 56601
cauucuaguuuguuuauccaua

SEQ ID NO: 2767728 - RNA, 20 nt, Leptospira interrogans serovar lai str. 56601
cauucugaaacuuuucaaaa

SEQ ID NO: 2767729 - RNA, 14 nt, Leptospira interrogans serovar lai str. 56601
cauuuuuuaaauuu

SEQ ID NO: 2767730 - RNA, 13 nt, Leptospira interrogans serovar lai str. 56601
cauuuuuugaaaa

SEQ ID NO: 2767731 - RNA, 19 nt, Leptospira interrogans serovar lai str. 56601
cauuuuuugggcuucugaa

SEQ ID NO: 2767732 - RNA, 17 nt, Leptospira interrogans serovar lai str. 56601
cauuuuuuucgaauuga

SEQ ID NO: 2767733 - RNA, 21 nt, Leptospira interrogans serovar lai str. 56601
ccaaaaaaagucucaaaaccu

SEQ ID NO: 2767734 - RNA, 22 nt, Leptospira interrogans serovar lai str. 56601
ccaaaaaaagucucaaaaccug

SEQ ID NO: 2767735 - RNA, 19 nt, Leptospira interrogans serovar lai str. 56601
ccaaaaacguaagcuugau

SEQ ID NO: 2767736 - RNA, 21 nt, Leptospira interrogans serovar lai str. 56601
ccaaaaauagggaaaacucaa

SEQ ID NO: 2767737 - RNA, 12 nt, Leptospira interrogans serovar lai str. 56601
ccaaaaauucag

SEQ ID NO: 2767738 - RNA, 19 nt, Leptospira interrogans serovar lai str. 56601
ccaaaaauuuaaaaauucg

SEQ ID NO: 2767739 - RNA, 12 nt, Leptospira interrogans serovar lai str. 56601
ccaaaagaacuu

SEQ ID NO: 2767740 - RNA, 20 nt, Leptospira interrogans serovar lai str. 56601
ccaaaaguccaauuuuaaaa

SEQ ID NO: 2767741 - RNA, 17 nt, Leptospira interrogans serovar lai str. 56601
ccaaaauauucagaaac

SEQ ID NO: 2767742 - RNA, 15 nt, Leptospira interrogans serovar lai str. 56601
ccaaaaucauuuaaa

SEQ ID NO: 2767743 - RNA, 17 nt, Leptospira interrogans serovar lai str. 56601
ccaaaaucccagaaagg

SEQ ID NO: 2767744 - RNA, 23 nt, Leptospira interrogans serovar lai str. 56601
ccaaaaucccagaaaggaacuaa

SEQ ID NO: 2767745 - RNA, 16 nt, Leptospira interrogans serovar lai str. 56601
ccaaaaucguccaaug

SEQ ID NO: 2767746 - RNA, 11 nt, Leptospira interrogans serovar lai str. 56601
ccaaaaucuua

SEQ ID NO: 2767747 - RNA, 21 nt, Leptospira interrogans serovar lai str. 56601
ccaaaaucuuuagaauuuuuc

SEQ ID NO: 2767748 - RNA, 17 nt, Leptospira interrogans serovar lai str. 56601
ccaaaaugaauuguaaa

SEQ ID NO: 2767749 - RNA, 22 nt, Leptospira interrogans serovar lai str. 56601
ccaaaauuaacggucaauuuua

SEQ ID NO: 2767750 - RNA, 17 nt, Leptospira interrogans serovar lai str. 56601
ccaaacaauuuuuugaa

SEQ ID NO: 2767751 - RNA, 19 nt, Leptospira interrogans serovar lai str. 56601
ccaaacacaugagcauucu

SEQ ID NO: 2767752 - RNA, 19 nt, Leptospira interrogans serovar lai str. 56601
ccaaacacgaauuccucaa

SEQ ID NO: 2767753 - RNA, 17 nt, Leptospira interrogans serovar lai str. 56601
ccaaacagccaaagaaa

SEQ ID NO: 2767754 - RNA, 21 nt, Leptospira interrogans serovar lai str. 56601
ccaaacauucaaauuucugaa

SEQ ID NO: 2767755 - RNA, 16 nt, Leptospira interrogans serovar lai str. 56601
ccaaaccaaauagaaa

SEQ ID NO: 2767756 - RNA, 14 nt, Leptospira interrogans serovar lai str. 56601
ccaaacccaaugau

SEQ ID NO: 2767757 - RNA, 20 nt, Leptospira interrogans serovar lai str. 56601
ccaaaccccaguaugaaccc

SEQ ID NO: 2767758 - RNA, 17 nt, Leptospira interrogans serovar lai str. 56601
ccaaacccugccaaaau

SEQ ID NO: 2767759 - RNA, 16 nt, Leptospira interrogans serovar lai str. 56601
ccaaaccgauuuuugu

SEQ ID NO: 2767760 - RNA, 13 nt, Leptospira interrogans serovar lai str. 56601
ccaaacucaaugc

SEQ ID NO: 2767761 - RNA, 16 nt, Leptospira interrogans serovar lai str. 56601
ccaaagcuuguuucaa

SEQ ID NO: 2767762 - RNA, 23 nt, Leptospira interrogans serovar lai str. 56601
ccaaagcuuguuucaaaaguuag

SEQ ID NO: 2767763 - RNA, 20 nt, Leptospira interrogans serovar lai str. 56601
ccaaauauacgaaucugacc

SEQ ID NO: 2767764 - RNA, 20 nt, Leptospira interrogans serovar lai str. 56601
ccaaaucgcugguuuuauuu

SEQ ID NO: 2767765 - RNA, 12 nt, Leptospira interrogans serovar lai str. 56601
ccaaauucuuuc

SEQ ID NO: 2767766 - RNA, 15 nt, Leptospira interrogans serovar lai str. 56601
ccaaauugccaaaug

SEQ ID NO: 2767767 - RNA, 18 nt, Leptospira interrogans serovar lai str. 56601
ccaaauuguuuucuaaag

SEQ ID NO: 2767768 - RNA, 19 nt, Leptospira interrogans serovar lai str. 56601
ccaaauuugcgaaaaaaau

SEQ ID NO: 2767769 - RNA, 20 nt, Leptospira interrogans serovar lai str. 56601
ccaaauuugcgaaaaaaaua

SEQ ID NO: 2767770 - RNA, 16 nt, Leptospira interrogans serovar lai str. 56601
ccaacagcuauaaucu

SEQ ID NO: 2767771 - RNA, 20 nt, Leptospira interrogans serovar lai str. 56601
ccaaccauuuaauagaucua

SEQ ID NO: 2767772 - RNA, 22 nt, Leptospira interrogans serovar lai str. 56601
ccaaccccacaaguguuguauc

SEQ ID NO: 2767773 - RNA, 16 nt, Leptospira interrogans serovar lai str. 56601
ccaacgaaguuccaac

SEQ ID NO: 2767774 - RNA, 19 nt, Leptospira interrogans serovar lai str. 56601
ccaacgguaacgagcaucu

SEQ ID NO: 2767775 - RNA, 14 nt, Leptospira interrogans serovar lai str. 56601
ccaacguaccaaaa

SEQ ID NO: 2767776 - RNA, 19 nt, Leptospira interrogans serovar lai str. 56601
ccaacguaccaaaacccau

SEQ ID NO: 2767777 - RNA, 16 nt, Leptospira interrogans serovar lai str. 56601
ccaacuuacauuaaau

SEQ ID NO: 2767778 - RNA, 18 nt, Leptospira interrogans serovar lai str. 56601
ccaacuuacauuaaauaa

SEQ ID NO: 2767779 - RNA, 23 nt, Leptospira interrogans serovar lai str. 56601
ccaacuuuuucagaaaaaugaau

SEQ ID NO: 2767780 - RNA, 21 nt, Leptospira interrogans serovar lai str. 56601
ccaagaguguucaucuucucg

SEQ ID NO: 2767781 - RNA, 16 nt, Leptospira interrogans serovar lai str. 56601
ccaagcaauucuaaga

SEQ ID NO: 2767782 - RNA, 21 nt, Leptospira interrogans serovar lai str. 56601
ccaagcaauucuaagaccuaa

SEQ ID NO: 2767783 - RNA, 22 nt, Leptospira interrogans serovar lai str. 56601
ccaauaauuucccauaaaaaga

SEQ ID NO: 2767784 - RNA, 15 nt, Leptospira interrogans serovar lai str. 56601
ccaauacaaaacaag

SEQ ID NO: 2767785 - RNA, 14 nt, Leptospira interrogans serovar lai str. 56601
ccaauauuuaugcu

SEQ ID NO: 2767786 - RNA, 15 nt, Leptospira interrogans serovar lai str. 56601
ccaaucauagauaca

SEQ ID NO: 2767787 - RNA, 20 nt, Leptospira interrogans serovar lai str. 56601
ccaaucauagucauuuugau

SEQ ID NO: 2767788 - RNA, 20 nt, Leptospira interrogans serovar lai str. 56601
ccaaucaugaauauuuucca

SEQ ID NO: 2767789 - RNA, 23 nt, Leptospira interrogans serovar lai str. 56601
ccaaucaugaauauuuuccaaaa

SEQ ID NO: 2767790 - RNA, 23 nt, Leptospira interrogans serovar lai str. 56601
ccaaucgucuguaaaagaaaaau

SEQ ID NO: 2767791 - RNA, 18 nt, Leptospira interrogans serovar lai str. 56601
ccaaucuuacaaguuaug

SEQ ID NO: 2767792 - RNA, 20 nt, Leptospira interrogans serovar lai str. 56601
ccaaugaugaucgcguaaua

SEQ ID NO: 2767793 - RNA, 17 nt, Leptospira interrogans serovar lai str. 56601
ccaauguaacggaaaua

SEQ ID NO: 2767794 - RNA, 13 nt, Leptospira interrogans serovar lai str. 56601
ccaauuccaaaaa

SEQ ID NO: 2767795 - RNA, 13 nt, Leptospira interrogans serovar lai str. 56601
ccaauuccaaacg

SEQ ID NO: 2767796 - RNA, 23 nt, Leptospira interrogans serovar lai str. 56601
ccaauuccauuucuguaacaucc

SEQ ID NO: 2767797 - RNA, 13 nt, Leptospira interrogans serovar lai str. 56601
ccaauucuaaaau

SEQ ID NO: 2767798 - RNA, 23 nt, Leptospira interrogans serovar lai str. 56601
ccaauugaauauaaaauuuuuau

SEQ ID NO: 2767799 - RNA, 22 nt, Leptospira interrogans serovar lai str. 56601
ccaauuuuuuuguaaaaaaaua

SEQ ID NO: 2767800 - RNA, 17 nt, Leptospira interrogans serovar lai str. 56601
ccacaaguguuguaucu

SEQ ID NO: 2767801 - RNA, 20 nt, Leptospira interrogans serovar lai str. 56601
ccacaaguucgccuacacug

SEQ ID NO: 2767802 - RNA, 18 nt, Leptospira interrogans serovar lai str. 56601
ccacagaaagcuuucucc

SEQ ID NO: 2767803 - RNA, 19 nt, Leptospira interrogans serovar lai str. 56601
ccacagaaagcuuucuccu

SEQ ID NO: 2767804 - RNA, 17 nt, Leptospira interrogans serovar lai str. 56601
ccacagguuuuaaacua

SEQ ID NO: 2767805 - RNA, 12 nt, Leptospira interrogans serovar lai str. 56601
ccacaguuccua

SEQ ID NO: 2767806 - RNA, 16 nt, Leptospira interrogans serovar lai str. 56601
ccacaucuuuuuucgu

SEQ ID NO: 2767807 - RNA, 15 nt, Leptospira interrogans serovar lai str. 56601
ccacauuucaaaguu

SEQ ID NO: 2767808 - RNA, 22 nt, Leptospira interrogans serovar lai str. 56601
ccacauuucaaaguuuugcugu

SEQ ID NO: 2767809 - RNA, 18 nt, Leptospira interrogans serovar lai str. 56601
ccacauuuuaaagguuga

SEQ ID NO: 2767810 - RNA, 16 nt, Leptospira interrogans serovar lai str. 56601
ccacauuuugaagguu

SEQ ID NO: 2767811 - RNA, 20 nt, Leptospira interrogans serovar lai str. 56601
cccacauuuuugugaaacuu

SEQ ID NO: 2767812 - RNA, 19 nt, Leptospira interrogans serovar lai str. 56601
cccacguuuuaaagguuga

SEQ ID NO: 2767813 - RNA, 21 nt, Leptospira interrogans serovar lai str. 56601
cccacguuuugaagguugagc

SEQ ID NO: 2767814 - RNA, 13 nt, Leptospira interrogans serovar lai str. 56601
cccacuuauaaua

SEQ ID NO: 2767815 - RNA, 13 nt, Leptospira interrogans serovar lai str. 56601
cccagaaaggaac

SEQ ID NO: 2767816 - RNA, 22 nt, Leptospira interrogans serovar lai str. 56601
cccagaaaggaacuaaguuuaa

SEQ ID NO: 2767817 - RNA, 16 nt, Leptospira interrogans serovar lai str. 56601
cccagaacaaaacguu

SEQ ID NO: 2767818 - RNA, 20 nt, Leptospira interrogans serovar lai str. 56601
cccaguauuuugcacugaaa

SEQ ID NO: 2767819 - RNA, 12 nt, Leptospira interrogans serovar lai str. 56601
cccagucuucuu

SEQ ID NO: 2767820 - RNA, 13 nt, Leptospira interrogans serovar lai str. 56601
cccagucuucuug

SEQ ID NO: 2767821 - RNA, 18 nt, Leptospira interrogans serovar lai str. 56601
cccauacaaaauuuaaaa

SEQ ID NO: 2767822 - RNA, 15 nt, Leptospira interrogans serovar lai str. 56601
cccauauaauuuuau

SEQ ID NO: 2767823 - RNA, 19 nt, Leptospira interrogans serovar lai str. 56601
cccauccgaaaucccaaaa

SEQ ID NO: 2767824 - RNA, 12 nt, Leptospira interrogans serovar lai str. 56601
ccccaaaaugaa

SEQ ID NO: 2767825 - RNA, 15 nt, Leptospira interrogans serovar lai str. 56601
ccccacaaguguugu

SEQ ID NO: 2767826 - RNA, 21 nt, Leptospira interrogans serovar lai str. 56601
ccccaucucuucgucucacca

SEQ ID NO: 2767827 - RNA, 23 nt, Leptospira interrogans serovar lai str. 56601
ccccuccguuuacaaaaugauuu

SEQ ID NO: 2767828 - RNA, 14 nt, Leptospira interrogans serovar lai str. 56601
cccgauacagaaua

SEQ ID NO: 2767829 - RNA, 18 nt, Leptospira interrogans serovar lai str. 56601
cccgauacagaauaaaua

SEQ ID NO: 2767830 - RNA, 12 nt, Leptospira interrogans serovar lai str. 56601
cccgguagugga

SEQ ID NO: 2767831 - RNA, 15 nt, Leptospira interrogans serovar lai str. 56601
cccuaagcguucuaa

SEQ ID NO: 2767832 - RNA, 17 nt, Leptospira interrogans serovar lai str. 56601
cccuaagcguucuaagu

SEQ ID NO: 2767833 - RNA, 21 nt, Leptospira interrogans serovar lai str. 56601
cccuagaagccugaguuugag

SEQ ID NO: 2767834 - RNA, 22 nt, Leptospira interrogans serovar lai str. 56601
cccuaguuuaugugaguuccca

SEQ ID NO: 2767835 - RNA, 13 nt, Leptospira interrogans serovar lai str. 56601
cccucccguuauu

SEQ ID NO: 2767836 - RNA, 17 nt, Leptospira interrogans serovar lai str. 56601
cccucccguuauuuuuu

SEQ ID NO: 2767837 - RNA, 19 nt, Leptospira interrogans serovar lai str. 56601
cccuccuauguuucuugug

SEQ ID NO: 2767838 - RNA, 20 nt, Leptospira interrogans serovar lai str. 56601
cccuccuauguuucuugugu

SEQ ID NO: 2767839 - RNA, 18 nt, Leptospira interrogans serovar lai str. 56601
cccucgaaaucugaccuc

SEQ ID NO: 2767840 - RNA, 21 nt, Leptospira interrogans serovar lai str. 56601
cccugcaaaggcgggaauaaa

SEQ ID NO: 2767841 - RNA, 18 nt, Leptospira interrogans serovar lai str. 56601
cccugccaaaaucccaga

SEQ ID NO: 2767842 - RNA, 13 nt, Leptospira interrogans serovar lai str. 56601
cccuucuccugca

SEQ ID NO: 2767843 - RNA, 12 nt, Leptospira interrogans serovar lai str. 56601
ccgaaaaaccuu

SEQ ID NO: 2767844 - RNA, 12 nt, Leptospira interrogans serovar lai str. 56601
ccgaaaauguag

SEQ ID NO: 2767845 - RNA, 18 nt, Leptospira interrogans serovar lai str. 56601
ccgaaaccucaaaaaauu

SEQ ID NO: 2767846 - RNA, 19 nt, Leptospira interrogans serovar lai str. 56601
ccgaaacuuucaaaauagg

SEQ ID NO: 2767847 - RNA, 23 nt, Leptospira interrogans serovar lai str. 56601
ccgaaagacuaaucgccucugag

SEQ ID NO: 2767848 - RNA, 21 nt, Leptospira interrogans serovar lai str. 56601
ccgaaagcguuucguucuuuu

SEQ ID NO: 2767849 - RNA, 15 nt, Leptospira interrogans serovar lai str. 56601
ccgaaauuuuuuuaa

SEQ ID NO: 2767850 - RNA, 14 nt, Leptospira interrogans serovar lai str. 56601
ccgaaccuuaccac

SEQ ID NO: 2767851 - RNA, 20 nt, Leptospira interrogans serovar lai str. 56601
ccgaagaauccgaaaaaccu

SEQ ID NO: 2767852 - RNA, 23 nt, Leptospira interrogans serovar lai str. 56601
ccgaauacaggcgguuuaaaagc

SEQ ID NO: 2767853 - RNA, 18 nt, Leptospira interrogans serovar lai str. 56601
ccgaauaggaucagaauu

SEQ ID NO: 2767854 - RNA, 18 nt, Leptospira interrogans serovar lai str. 56601
ccgaaucuggaagccaaa

SEQ ID NO: 2767855 - RNA, 23 nt, Leptospira interrogans serovar lai str. 56601
ccgaaucuggaagccaaaaccaa

SEQ ID NO: 2767856 - RNA, 20 nt, Leptospira interrogans serovar lai str. 56601
ccgaauucacguuauuuaga

SEQ ID NO: 2767857 - RNA, 17 nt, Leptospira interrogans serovar lai str. 56601
ccgaauucuaaaauacu

SEQ ID NO: 2767858 - RNA, 15 nt, Leptospira interrogans serovar lai str. 56601
ccgacagauuuauau

SEQ ID NO: 2767859 - RNA, 15 nt, Leptospira interrogans serovar lai str. 56601
ccgaugcauugaguu

SEQ ID NO: 2767860 - RNA, 21 nt, Leptospira interrogans serovar lai str. 56601
ccgauucacuuccauuggauu

SEQ ID NO: 2767861 - RNA, 20 nt, Leptospira interrogans serovar lai str. 56601
ccgcaaaacgguaauuuuau

SEQ ID NO: 2767862 - RNA, 13 nt, Leptospira interrogans serovar lai str. 56601
ccgcaccuaauac

SEQ ID NO: 2767863 - RNA, 22 nt, Leptospira interrogans serovar lai str. 56601
ccgcagacuguaucauagaaua

SEQ ID NO: 2767864 - RNA, 24 nt, Leptospira interrogans serovar lai str. 56601
ccgcauaaaacucuaaauucagaa

SEQ ID NO: 2767865 - RNA, 19 nt, Leptospira interrogans serovar lai str. 56601
ccgcauucucacaaaucac

SEQ ID NO: 2767866 - RNA, 22 nt, Leptospira interrogans serovar lai str. 56601
ccgccaguuuuuugagaaacaa

SEQ ID NO: 2767867 - RNA, 15 nt, Leptospira interrogans serovar lai str. 56601
ccgccuucacccacc

SEQ ID NO: 2767868 - RNA, 11 nt, Leptospira interrogans serovar lai str. 56601
ccgccuuucca

SEQ ID NO: 2767869 - RNA, 19 nt, Leptospira interrogans serovar lai str. 56601
ccgcuauggaauuuuucaa

SEQ ID NO: 2767870 - RNA, 12 nt, Leptospira interrogans serovar lai str. 56601
ccgcugaaaaaa

SEQ ID NO: 2767871 - RNA, 17 nt, Leptospira interrogans serovar lai str. 56601
ccgcugaaaaaaaaauu

SEQ ID NO: 2767872 - RNA, 18 nt, Leptospira interrogans serovar lai str. 56601
ccgcuggaaaaugaaaac

SEQ ID NO: 2767873 - RNA, 18 nt, Leptospira interrogans serovar lai str. 56601
ccggaccgggcucuucag

SEQ ID NO: 2767874 - RNA, 19 nt, Leptospira interrogans serovar lai str. 56601
ccggauuuguuaauuuuua

SEQ ID NO: 2767875 - RNA, 20 nt, Leptospira interrogans serovar lai str. 56601
ccggauuuguuaauuuuuag

SEQ ID NO: 2767876 - RNA, 21 nt, Leptospira interrogans serovar lai str. 56601
ccggcauuaauauaaaaaaua

SEQ ID NO: 2767877 - RNA, 18 nt, Leptospira interrogans serovar lai str. 56601
ccgggagcgcuugaaaau

SEQ ID NO: 2767878 - RNA, 19 nt, Leptospira interrogans serovar lai str. 56601
ccgggaggaauuuuuaaaa

SEQ ID NO: 2767879 - RNA, 21 nt, Leptospira interrogans serovar lai str. 56601
ccgggauuuuaaaaauuuuga

SEQ ID NO: 2767880 - RNA, 16 nt, Leptospira interrogans serovar lai str. 56601
ccggguuagaaucaac

SEQ ID NO: 2767881 - RNA, 17 nt, Leptospira interrogans serovar lai str. 56601
ccgguucuagguucuug

SEQ ID NO: 2767882 - RNA, 12 nt, Leptospira interrogans serovar lai str. 56601
ccguaaaaaauc

SEQ ID NO: 2767883 - RNA, 13 nt, Leptospira interrogans serovar lai str. 56601
ccguaaaauucaa

SEQ ID NO: 2767884 - RNA, 16 nt, Leptospira interrogans serovar lai str. 56601
ccguaaauauuuuuuu

SEQ ID NO: 2767885 - RNA, 19 nt, Leptospira interrogans serovar lai str. 56601
ccguaaauauuuuuuuuaa

SEQ ID NO: 2767886 - RNA, 22 nt, Leptospira interrogans serovar lai str. 56601
ccguaaauauuuuuuuuaauca

SEQ ID NO: 2767887 - RNA, 18 nt, Leptospira interrogans serovar lai str. 56601
ccguaauaucuccaaaau

SEQ ID NO: 2767888 - RNA, 18 nt, Leptospira interrogans serovar lai str. 56601
ccguauccuuaaaaugac

SEQ ID NO: 2767889 - RNA, 13 nt, Leptospira interrogans serovar lai str. 56601
ccgucauuuacuc

SEQ ID NO: 2767890 - RNA, 13 nt, Leptospira interrogans serovar lai str. 56601
ccgugaaucgaaa

SEQ ID NO: 2767891 - RNA, 13 nt, Leptospira interrogans serovar lai str. 56601
ccguuauuuuuuu

SEQ ID NO: 2767892 - RNA, 22 nt, Leptospira interrogans serovar lai str. 56601
ccguuguuuuacagccaccauc

SEQ ID NO: 2767893 - RNA, 21 nt, Leptospira interrogans serovar lai str. 56601
ccguuuagaaauuaaaguauc

SEQ ID NO: 2767894 - RNA, 21 nt, Leptospira interrogans serovar lai str. 56601
ccuucaggauagguuccaauu

SEQ ID NO: 2767895 - RNA, 19 nt, Leptospira interrogans serovar lai str. 56601
ccuuccaaagauuuuaaaa

SEQ ID NO: 2767896 - RNA, 15 nt, Leptospira interrogans serovar lai str. 56601
ccuuccaaguuuuug

SEQ ID NO: 2767897 - RNA, 16 nt, Leptospira interrogans serovar lai str. 56601
ccuuccaaguuuuugu

SEQ ID NO: 2767898 - RNA, 20 nt, Leptospira interrogans serovar lai str. 56601
ccuuccgauucacuuccauu

SEQ ID NO: 2767899 - RNA, 21 nt, Leptospira interrogans serovar lai str. 56601
ccuucggaauuucugcuacaa

SEQ ID NO: 2767900 - RNA, 12 nt, Leptospira interrogans serovar lai str. 56601
ccuucuggaaaa

SEQ ID NO: 2767901 - RNA, 19 nt, Leptospira interrogans serovar lai str. 56601
ccuucuuuacaguuuuuaa

SEQ ID NO: 2767902 - RNA, 14 nt, Leptospira interrogans serovar lai str. 56601
ccuucuuuucuucu

SEQ ID NO: 2767903 - RNA, 14 nt, Leptospira interrogans serovar lai str. 56601
ccuucuuuuuucua

SEQ ID NO: 2767904 - RNA, 21 nt, Leptospira interrogans serovar lai str. 56601
ccuugaacuuacaaagcacuu

SEQ ID NO: 2767905 - RNA, 15 nt, Leptospira interrogans serovar lai str. 56601
ccuugugacaaucgg

SEQ ID NO: 2767906 - RNA, 13 nt, Leptospira interrogans serovar lai str. 56601
ccuugugcaauaa

SEQ ID NO: 2767907 - RNA, 12 nt, Leptospira interrogans serovar lai str. 56601
ccuuuaaacuua

SEQ ID NO: 2767908 - RNA, 17 nt, Leptospira interrogans serovar lai str. 56601
ccuuuaaauugaauucu

SEQ ID NO: 2767909 - RNA, 21 nt, Leptospira interrogans serovar lai str. 56601
ccuuuaaauugaauucuuccu

SEQ ID NO: 2767910 - RNA, 17 nt, Leptospira interrogans serovar lai str. 56601
ccuuuaauauuuucaga

SEQ ID NO: 2767911 - RNA, 22 nt, Leptospira interrogans serovar lai str. 56601
ccuuuacauaauaauacagaau

SEQ ID NO: 2767912 - RNA, 23 nt, Leptospira interrogans serovar lai str. 56601
ccuuuacauaauaauacagaauu

SEQ ID NO: 2767913 - RNA, 17 nt, Leptospira interrogans serovar lai str. 56601
ccuuuauuuaaaaaccg

SEQ ID NO: 2767914 - RNA, 22 nt, Leptospira interrogans serovar lai str. 56601
ccuuucaagaauuuauuuacaa

SEQ ID NO: 2767915 - RNA, 18 nt, Leptospira interrogans serovar lai str. 56601
ccuuucacaucuccacuu

SEQ ID NO: 2767916 - RNA, 15 nt, Leptospira interrogans serovar lai str. 56601
ccuuucauuuuucca

SEQ ID NO: 2767917 - RNA, 15 nt, Leptospira interrogans serovar lai str. 56601
ccuuuccccccaccc

SEQ ID NO: 2767918 - RNA, 16 nt, Leptospira interrogans serovar lai str. 56601
ccuuuggacgaaucga

SEQ ID NO: 2767919 - RNA, 23 nt, Leptospira interrogans serovar lai str. 56601
ccuuuggacgaaucgaaugguac

SEQ ID NO: 2767920 - RNA, 19 nt, Leptospira interrogans serovar lai str. 56601
ccuuuggcauacaucucua

SEQ ID NO: 2767921 - RNA, 15 nt, Leptospira interrogans serovar lai str. 56601
ccuuuguuuccucuu

SEQ ID NO: 2767922 - RNA, 21 nt, Leptospira interrogans serovar lai str. 56601
ccuuuucgacuauuucuucca

SEQ ID NO: 2767923 - RNA, 17 nt, Leptospira interrogans serovar lai str. 56601
ccuuuucuuuuuuaaac

SEQ ID NO: 2767924 - RNA, 16 nt, Leptospira interrogans serovar lai str. 56601
ccuuuuucauuuuuaa

SEQ ID NO: 2767925 - RNA, 17 nt, Leptospira interrogans serovar lai str. 56601
ccuuuuuccggaauacu

SEQ ID NO: 2767926 - RNA, 16 nt, Leptospira interrogans serovar lai str. 56601
ccuuuuuuacugaucu

SEQ ID NO: 2767927 - RNA, 16 nt, Leptospira interrogans serovar lai str. 56601
ccuuuuuuauuuuaac

SEQ ID NO: 2767928 - RNA, 14 nt, Leptospira interrogans serovar lai str. 56601
ccuuuuuuguaaag

SEQ ID NO: 2767929 - RNA, 17 nt, Leptospira interrogans serovar lai str. 56601
cgaaaagguuaaaaauu

SEQ ID NO: 2767930 - RNA, 19 nt, Leptospira interrogans serovar lai str. 56601
cgaaaaguuugguccuuug

SEQ ID NO: 2767931 - RNA, 19 nt, Leptospira interrogans serovar lai str. 56601
cgaaaaugcagcaaaaccu

SEQ ID NO: 2767932 - RNA, 21 nt, Leptospira interrogans serovar lai str. 56601
cgaaaauguagccaaaaauua

SEQ ID NO: 2767933 - RNA, 22 nt, Leptospira interrogans serovar lai str. 56601
cgaaaauuuaacuacacgagag

SEQ ID NO: 2767934 - RNA, 18 nt, Leptospira interrogans serovar lai str. 56601
cgaaaauuugaaaauuga

SEQ ID NO: 2767935 - RNA, 13 nt, Leptospira interrogans serovar lai str. 56601
cgaaacaaaauca

SEQ ID NO: 2767936 - RNA, 15 nt, Leptospira interrogans serovar lai str. 56601
cgaaaccucaaaaaa

SEQ ID NO: 2767937 - RNA, 16 nt, Leptospira interrogans serovar lai str. 56601
cgaaacuuucaaaaua

SEQ ID NO: 2767938 - RNA, 15 nt, Leptospira interrogans serovar lai str. 56601
cgaaagaauuuuugg

SEQ ID NO: 2767939 - RNA, 17 nt, Leptospira interrogans serovar lai str. 56601
cgaaagaauuuuuggaa

SEQ ID NO: 2767940 - RNA, 15 nt, Leptospira interrogans serovar lai str. 56601
cgaaagauuuuucau

SEQ ID NO: 2767941 - RNA, 17 nt, Leptospira interrogans serovar lai str. 56601
cgaaaguuuacacaaca

SEQ ID NO: 2767942 - RNA, 15 nt, Leptospira interrogans serovar lai str. 56601
cgaaauaucguucua

SEQ ID NO: 2767943 - RNA, 16 nt, Leptospira interrogans serovar lai str. 56601
cgaaaucaauguugca

SEQ ID NO: 2767944 - RNA, 19 nt, Leptospira interrogans serovar lai str. 56601
cgaaauuacgacuguucac

SEQ ID NO: 2767945 - RNA, 16 nt, Leptospira interrogans serovar lai str. 56601
cgaaauuauacaaaac

SEQ ID NO: 2767946 - RNA, 22 nt, Leptospira interrogans serovar lai str. 56601
cgaaauuuguggagcucgauuu

SEQ ID NO: 2767947 - RNA, 19 nt, Leptospira interrogans serovar lai str. 56601
cgaaauuuuacaguaaaau

SEQ ID NO: 2767948 - RNA, 21 nt, Leptospira interrogans serovar lai str. 56601
cgaaauuuuacaguaaaaucu

SEQ ID NO: 2767949 - RNA, 16 nt, Leptospira interrogans serovar lai str. 56601
cgaaauuuuuuuaaaa

SEQ ID NO: 2767950 - RNA, 13 nt, Leptospira interrogans serovar lai str. 56601
cgaacaaauucua

SEQ ID NO: 2767951 - RNA, 22 nt, Leptospira interrogans serovar lai str. 56601
cgaacacaaauucuaaaguugu

SEQ ID NO: 2767952 - RNA, 19 nt, Leptospira interrogans serovar lai str. 56601
cgaaccaauucuaaaauca

SEQ ID NO: 2767953 - RNA, 19 nt, Leptospira interrogans serovar lai str. 56601
cgaacccagucuucuugua

SEQ ID NO: 2767954 - RNA, 14 nt, Leptospira interrogans serovar lai str. 56601
cgaacuacccaaaa

SEQ ID NO: 2767955 - RNA, 17 nt, Leptospira interrogans serovar lai str. 56601
cgaacuauacaaauaga

SEQ ID NO: 2767956 - RNA, 12 nt, Leptospira interrogans serovar lai str. 56601
cgaacucacaag

SEQ ID NO: 2767957 - RNA, 17 nt, Leptospira interrogans serovar lai str. 56601
cgaacuucguuggaaag

SEQ ID NO: 2767958 - RNA, 20 nt, Leptospira interrogans serovar lai str. 56601
cgaacuuuucuauaaaaucu

SEQ ID NO: 2767959 - RNA, 20 nt, Leptospira interrogans serovar lai str. 56601
cgaacuuuuuuauaaaugga

SEQ ID NO: 2767960 - RNA, 22 nt, Leptospira interrogans serovar lai str. 56601
cgaagaauaucugcaaaauaac

SEQ ID NO: 2767961 - RNA, 16 nt, Leptospira interrogans serovar lai str. 56601
cgaagaauuauuuacu

SEQ ID NO: 2767962 - RNA, 23 nt, Leptospira interrogans serovar lai str. 56601
cgaagauaccaaauaaauauuuc

SEQ ID NO: 2767963 - RNA, 14 nt, Leptospira interrogans serovar lai str. 56601
cgaauaagaaauuc

SEQ ID NO: 2767964 - RNA, 15 nt, Leptospira interrogans serovar lai str. 56601
cgaauaagaaauuca

SEQ ID NO: 2767965 - RNA, 13 nt, Leptospira interrogans serovar lai str. 56601
cgaauacauuuaa

SEQ ID NO: 2767966 - RNA, 15 nt, Leptospira interrogans serovar lai str. 56601
cgaauacauuuaaac

SEQ ID NO: 2767967 - RNA, 22 nt, Leptospira interrogans serovar lai str. 56601
cgaauagaguuguuaaaagugg

SEQ ID NO: 2767968 - RNA, 21 nt, Leptospira interrogans serovar lai str. 56601
cgaauauccuugaaguagaua

SEQ ID NO: 2767969 - RNA, 19 nt, Leptospira interrogans serovar lai str. 56601
cgaaucauauuuaacugua

SEQ ID NO: 2767970 - RNA, 15 nt, Leptospira interrogans serovar lai str. 56601
cgaauccuuuuucuu

SEQ ID NO: 2767971 - RNA, 20 nt, Leptospira interrogans serovar lai str. 56601
cgaauggaaaucuuuuaaaa

SEQ ID NO: 2767972 - RNA, 20 nt, Leptospira interrogans serovar lai str. 56601
cgaauuacauaguaaacaca

SEQ ID NO: 2767973 - RNA, 22 nt, Leptospira interrogans serovar lai str. 56601
cgaauuacauaguaaacacaau

SEQ ID NO: 2767974 - RNA, 20 nt, Leptospira interrogans serovar lai str. 56601
cgaauucacguuauuuagau

SEQ ID NO: 2767975 - RNA, 18 nt, Leptospira interrogans serovar lai str. 56601
cgaauucauuuaccuaaa

SEQ ID NO: 2767976 - RNA, 23 nt, Leptospira interrogans serovar lai str. 56601
cgaauucauuuaccuaaaauuca

SEQ ID NO: 2767977 - RNA, 14 nt, Leptospira interrogans serovar lai str. 56601
cgauuuuucaaacg

SEQ ID NO: 2767978 - RNA, 14 nt, Leptospira interrogans serovar lai str. 56601
cgauuuuuccgaug

SEQ ID NO: 2767979 - RNA, 21 nt, Leptospira interrogans serovar lai str. 56601
cgauuuuuugauucauucagg

SEQ ID NO: 2767980 - RNA, 16 nt, Leptospira interrogans serovar lai str. 56601
cgcaaaaauuccuuuu

SEQ ID NO: 2767981 - RNA, 21 nt, Leptospira interrogans serovar lai str. 56601
cgcaaaucacgauuuuacgaa

SEQ ID NO: 2767982 - RNA, 14 nt, Leptospira interrogans serovar lai str. 56601
cgcaaauucuacua

SEQ ID NO: 2767983 - RNA, 22 nt, Leptospira interrogans serovar lai str. 56601
cgcaacauaauguuucaauucc

SEQ ID NO: 2767984 - RNA, 10 nt, Leptospira interrogans serovar lai str. 56601
cgcaaguaau

SEQ ID NO: 2767985 - RNA, 13 nt, Leptospira interrogans serovar lai str. 56601
cgcacaaaccaaa

SEQ ID NO: 2767986 - RNA, 21 nt, Leptospira interrogans serovar lai str. 56601
cgcacaucguuaccagcaagc

SEQ ID NO: 2767987 - RNA, 21 nt, Leptospira interrogans serovar lai str. 56601
cgcagaacuauuaucuuucga

SEQ ID NO: 2767988 - RNA, 14 nt, Leptospira interrogans serovar lai str. 56601
cgcagacucuucuc

SEQ ID NO: 2767989 - RNA, 19 nt, Leptospira interrogans serovar lai str. 56601
cgcagacuguaucauagaa

SEQ ID NO: 2767990 - RNA, 22 nt, Leptospira interrogans serovar lai str. 56601
cgcagaggaaacguauuuuuac

SEQ ID NO: 2767991 - RNA, 20 nt, Leptospira interrogans serovar lai str. 56601
cgcauaaaacucuaaauuca

SEQ ID NO: 2767992 - RNA, 21 nt, Leptospira interrogans serovar lai str. 56601
cgcauaaaacucuaaauucag

SEQ ID NO: 2767993 - RNA, 18 nt, Leptospira interrogans serovar lai str. 56601
cgcauaaaagaaauuuaa

SEQ ID NO: 2767994 - RNA, 22 nt, Leptospira interrogans serovar lai str. 56601
cgcaucgaucccuuucgcuuua

SEQ ID NO: 2767995 - RNA, 11 nt, Leptospira interrogans serovar lai str. 56601
cgcauuuagaa

SEQ ID NO: 2767996 - RNA, 14 nt, Leptospira interrogans serovar lai str. 56601
cgcauuuagaagau

SEQ ID NO: 2767997 - RNA, 14 nt, Leptospira interrogans serovar lai str. 56601
cgcauuuuccuuuu

SEQ ID NO: 2767998 - RNA, 22 nt, Leptospira interrogans serovar lai str. 56601
cgccccaugcgccccagcccuc

SEQ ID NO: 2767999 - RNA, 21 nt, Leptospira interrogans serovar lai str. 56601
cgccguaaaaaauccaugauu

SEQ ID NO: 2768000 - RNA, 20 nt, Leptospira interrogans serovar lai str. 56601
cgccuacacuguguucuuuu

SEQ ID NO: 2768001 - RNA, 12 nt, Leptospira interrogans serovar lai str. 56601
cgccugcauuuu

SEQ ID NO: 2768002 - RNA, 22 nt, Leptospira interrogans serovar lai str. 56601
cgcgaucuaucgaacgaccugc

SEQ ID NO: 2768003 - RNA, 19 nt, Leptospira interrogans serovar lai str. 56601
cgcgaucugucgagcgcuc

SEQ ID NO: 2768004 - RNA, 12 nt, Leptospira interrogans serovar lai str. 56601
cgcgauucauaa

SEQ ID NO: 2768005 - RNA, 22 nt, Leptospira interrogans serovar lai str. 56601
cgcggauuuauuuuaaaauuca

SEQ ID NO: 2768006 - RNA, 12 nt, Leptospira interrogans serovar lai str. 56601
cgcguuaauaua

SEQ ID NO: 2768007 - RNA, 18 nt, Leptospira interrogans serovar lai str. 56601
cgcuaaacucauuuuaaa

SEQ ID NO: 2768008 - RNA, 15 nt, Leptospira interrogans serovar lai str. 56601
cgcuaaacuucuuca

SEQ ID NO: 2768009 - RNA, 14 nt, Leptospira interrogans serovar lai str. 56601
cgcuacaaauucau

SEQ ID NO: 2768010 - RNA, 19 nt, Leptospira interrogans serovar lai str. 56601
cgcuacaaauucaucacuu

SEQ ID NO: 2768011 - RNA, 21 nt, Leptospira interrogans serovar lai str. 56601
cgcuagaaguuauaaugauaa

SEQ ID NO: 2768012 - RNA, 20 nt, Leptospira interrogans serovar lai str. 56601
cgcucaaaauucuuaaaaaa

SEQ ID NO: 2768013 - RNA, 11 nt, Leptospira interrogans serovar lai str. 56601
cgcucauccuu

SEQ ID NO: 2768014 - RNA, 23 nt, Leptospira interrogans serovar lai str. 56601
cgcucauuagaauuguugaaaaa

SEQ ID NO: 2768015 - RNA, 20 nt, Leptospira interrogans serovar lai str. 56601
cgcucugaaguaucucuucu

SEQ ID NO: 2768016 - RNA, 12 nt, Leptospira interrogans serovar lai str. 56601
cgcugauaaauu

SEQ ID NO: 2768017 - RNA, 21 nt, Leptospira interrogans serovar lai str. 56601
cgcugguuuuauuucugcugc

SEQ ID NO: 2768018 - RNA, 23 nt, Leptospira interrogans serovar lai str. 56601
cgcuguuuuguggucaacaucuc

SEQ ID NO: 2768019 - RNA, 16 nt, Leptospira interrogans serovar lai str. 56601
cgcuuacaaagugaug

SEQ ID NO: 2768020 - RNA, 15 nt, Leptospira interrogans serovar lai str. 56601
cgcuuaucuaauuuu

SEQ ID NO: 2768021 - RNA, 14 nt, Leptospira interrogans serovar lai str. 56601
cgcuucacagagua

SEQ ID NO: 2768022 - RNA, 18 nt, Leptospira interrogans serovar lai str. 56601
cgcuucacagaguacaua

SEQ ID NO: 2768023 - RNA, 18 nt, Leptospira interrogans serovar lai str. 56601
cgcuuuuaaauuguaugc

SEQ ID NO: 2768024 - RNA, 19 nt, Leptospira interrogans serovar lai str. 56601
cgcuuuuaaauuguaugca

SEQ ID NO: 2768025 - RNA, 17 nt, Leptospira interrogans serovar lai str. 56601
cggaacuagggaauuuu

SEQ ID NO: 2768026 - RNA, 18 nt, Leptospira interrogans serovar lai str. 56601
cggaacuuaauuuuauag

SEQ ID NO: 2768027 - RNA, 14 nt, Leptospira interrogans serovar lai str. 56601
cggaauaaaacccu

SEQ ID NO: 2768028 - RNA, 15 nt, Leptospira interrogans serovar lai str. 56601
cggaauaacuuucuu

SEQ ID NO: 2768029 - RNA, 18 nt, Leptospira interrogans serovar lai str. 56601
cggaauacuuuucuuccc

SEQ ID NO: 2768030 - RNA, 15 nt, Leptospira interrogans serovar lai str. 56601
cggaaucaauuuuag

SEQ ID NO: 2768031 - RNA, 13 nt, Leptospira interrogans serovar lai str. 56601
cggaauuuccaaa

SEQ ID NO: 2768032 - RNA, 19 nt, Leptospira interrogans serovar lai str. 56601
cggaauuuccaaacucaau

SEQ ID NO: 2768033 - RNA, 22 nt, Leptospira interrogans serovar lai str. 56601
cggaauuuucgcuacaaucgcu

SEQ ID NO: 2768034 - RNA, 18 nt, Leptospira interrogans serovar lai str. 56601
cggacuuuccgaauagga

SEQ ID NO: 2768035 - RNA, 20 nt, Leptospira interrogans serovar lai str. 56601
cggagaucuacgaaaauucu

SEQ ID NO: 2768036 - RNA, 17 nt, Leptospira interrogans serovar lai str. 56601
cggaucaaaauucuuug

SEQ ID NO: 2768037 - RNA, 15 nt, Leptospira interrogans serovar lai str. 56601
cggaucaauucugaa

SEQ ID NO: 2768038 - RNA, 21 nt, Leptospira interrogans serovar lai str. 56601
cggaucgcguuugaaacucag

SEQ ID NO: 2768039 - RNA, 22 nt, Leptospira interrogans serovar lai str. 56601
cggaugcgaguaauauuuuuug

SEQ ID NO: 2768040 - RNA, 15 nt, Leptospira interrogans serovar lai str. 56601
cggaugugaauucuc

SEQ ID NO: 2768041 - RNA, 17 nt, Leptospira interrogans serovar lai str. 56601
cggaugugaauucucua

SEQ ID NO: 2768042 - RNA, 18 nt, Leptospira interrogans serovar lai str. 56601
cggauucucgcauuuucc

SEQ ID NO: 2768043 - RNA, 19 nt, Leptospira interrogans serovar lai str. 56601
cggauucucgcauuuuccu

SEQ ID NO: 2768044 - RNA, 19 nt, Leptospira interrogans serovar lai str. 56601
cggauugccuaaauuccuu

SEQ ID NO: 2768045 - RNA, 20 nt, Leptospira interrogans serovar lai str. 56601
cggauuuauuuuaaaauuca

SEQ ID NO: 2768046 - RNA, 18 nt, Leptospira interrogans serovar lai str. 56601
cggauuucugaaaaaauc

SEQ ID NO: 2768047 - RNA, 14 nt, Leptospira interrogans serovar lai str. 56601
cggauuuguuaauu

SEQ ID NO: 2768048 - RNA, 13 nt, Leptospira interrogans serovar lai str. 56601
cggcauuaauaua

SEQ ID NO: 2768049 - RNA, 14 nt, Leptospira interrogans serovar lai str. 56601
cggcucauaaaaaa

SEQ ID NO: 2768050 - RNA, 16 nt, Leptospira interrogans serovar lai str. 56601
cggcuucaaugaggaa

SEQ ID NO: 2768051 - RNA, 15 nt, Leptospira interrogans serovar lai str. 56601
cggcuuuuuuuacuu

SEQ ID NO: 2768052 - RNA, 18 nt, Leptospira interrogans serovar lai str. 56601
cggcuuuuuuuacuucua

SEQ ID NO: 2768053 - RNA, 20 nt, Leptospira interrogans serovar lai str. 56601
cggcuuuuuuuacuucuaac

SEQ ID NO: 2768054 - RNA, 14 nt, Leptospira interrogans serovar lai str. 56601
cgggaaaaaauucg

SEQ ID NO: 2768055 - RNA, 17 nt, Leptospira interrogans serovar lai str. 56601
cgggaauaaaaacuaca

SEQ ID NO: 2768056 - RNA, 21 nt, Leptospira interrogans serovar lai str. 56601
cgggaauauucguaagaaaaa

SEQ ID NO: 2768057 - RNA, 14 nt, Leptospira interrogans serovar lai str. 56601
cgggacaaaucaua

SEQ ID NO: 2768058 - RNA, 15 nt, Leptospira interrogans serovar lai str. 56601
cgggcccaaauaaaa

SEQ ID NO: 2768059 - RNA, 13 nt, Leptospira interrogans serovar lai str. 56601
cggguaaaaaaua

SEQ ID NO: 2768060 - RNA, 21 nt, Leptospira interrogans serovar lai str. 56601
cguuuccaugaaauagaaaac

SEQ ID NO: 2768061 - RNA, 14 nt, Leptospira interrogans serovar lai str. 56601
cguuucccucuucu

SEQ ID NO: 2768062 - RNA, 20 nt, Leptospira interrogans serovar lai str. 56601
cguuucguucccguuuagaa

SEQ ID NO: 2768063 - RNA, 16 nt, Leptospira interrogans serovar lai str. 56601
cguuucuaauguuugu

SEQ ID NO: 2768064 - RNA, 13 nt, Leptospira interrogans serovar lai str. 56601
cguuucuauaaaa

SEQ ID NO: 2768065 - RNA, 17 nt, Leptospira interrogans serovar lai str. 56601
cguuugaaacucaguaa

SEQ ID NO: 2768066 - RNA, 16 nt, Leptospira interrogans serovar lai str. 56601
cguuugcaaguagaag

SEQ ID NO: 2768067 - RNA, 23 nt, Leptospira interrogans serovar lai str. 56601
cguuugccaauaauucuacgaaa

SEQ ID NO: 2768068 - RNA, 14 nt, Leptospira interrogans serovar lai str. 56601
cguuuuaaaauugc

SEQ ID NO: 2768069 - RNA, 16 nt, Leptospira interrogans serovar lai str. 56601
cguuuuaaugagaaag

SEQ ID NO: 2768070 - RNA, 15 nt, Leptospira interrogans serovar lai str. 56601
cguuuucaaaaaauu

SEQ ID NO: 2768071 - RNA, 16 nt, Leptospira interrogans serovar lai str. 56601
cguuuucaauuauuuu

SEQ ID NO: 2768072 - RNA, 17 nt, Leptospira interrogans serovar lai str. 56601
cguuuugcguuuuuaaa

SEQ ID NO: 2768073 - RNA, 13 nt, Leptospira interrogans serovar lai str. 56601
cguuuugcugagu

SEQ ID NO: 2768074 - RNA, 15 nt, Leptospira interrogans serovar lai str. 56601
cguuuuguugugaac

SEQ ID NO: 2768075 - RNA, 19 nt, Leptospira interrogans serovar lai str. 56601
cguuuuuaagcgauuugag

SEQ ID NO: 2768076 - RNA, 12 nt, Leptospira interrogans serovar lai str. 56601
cuaaaaaaaaug

SEQ ID NO: 2768077 - RNA, 14 nt, Leptospira interrogans serovar lai str. 56601
cuaaaaaaaugaac

SEQ ID NO: 2768078 - RNA, 12 nt, Leptospira interrogans serovar lai str. 56601
cuaaaaaauucu

SEQ ID NO: 2768079 - RNA, 15 nt, Leptospira interrogans serovar lai str. 56601
cuaaaaaauuuuuag

SEQ ID NO: 2768080 - RNA, 13 nt, Leptospira interrogans serovar lai str. 56601
cuaaaaacucaaa

SEQ ID NO: 2768081 - RNA, 11 nt, Leptospira interrogans serovar lai str. 56601
cuaaaaagaaa

SEQ ID NO: 2768082 - RNA, 13 nt, Leptospira interrogans serovar lai str. 56601
cuaaaaaugaaau

SEQ ID NO: 2768083 - RNA, 19 nt, Leptospira interrogans serovar lai str. 56601
cuaaaaauuguugaagaau

SEQ ID NO: 2768084 - RNA, 19 nt, Leptospira interrogans serovar lai str. 56601
cuaaaacacaucuuaaaaa

SEQ ID NO: 2768085 - RNA, 21 nt, Leptospira interrogans serovar lai str. 56601
cuaaaacacaucuuaaaaacu

SEQ ID NO: 2768086 - RNA, 19 nt, Leptospira interrogans serovar lai str. 56601
cuaaaacaccuucucuuuu

SEQ ID NO: 2768087 - RNA, 19 nt, Leptospira interrogans serovar lai str. 56601
cuaaaaccucaaaaaauuu

SEQ ID NO: 2768088 - RNA, 21 nt, Leptospira interrogans serovar lai str. 56601
cuaaaaccuggauuugucucu

SEQ ID NO: 2768089 - RNA, 18 nt, Leptospira interrogans serovar lai str. 56601
cuaaaagauccgcuacaa

SEQ ID NO: 2768090 - RNA, 13 nt, Leptospira interrogans serovar lai str. 56601
cuaaaaguaaaag

SEQ ID NO: 2768091 - RNA, 15 nt, Leptospira interrogans serovar lai str. 56601
cuaaaaguaugaacu

SEQ ID NO: 2768092 - RNA, 18 nt, Leptospira interrogans serovar lai str. 56601
cuaaaagucccaauucca

SEQ ID NO: 2768093 - RNA, 15 nt, Leptospira interrogans serovar lai str. 56601
cuaaaauaaaguauc

SEQ ID NO: 2768094 - RNA, 22 nt, Leptospira interrogans serovar lai str. 56601
cuaaaauaaaguauccaguacu

SEQ ID NO: 2768095 - RNA, 17 nt, Leptospira interrogans serovar lai str. 56601
cuaaaauaauuuuuacu

SEQ ID NO: 2768096 - RNA, 14 nt, Leptospira interrogans serovar lai str. 56601
cuaaaauauaggaa

SEQ ID NO: 2768097 - RNA, 21 nt, Leptospira interrogans serovar lai str. 56601
cuaaaaucauacuuuuaaaaa

SEQ ID NO: 2768098 - RNA, 23 nt, Leptospira interrogans serovar lai str. 56601
cuaaaaucauacuuuuaaaaaau

SEQ ID NO: 2768099 - RNA, 15 nt, Leptospira interrogans serovar lai str. 56601
cuaaaaugaaaaaaa

SEQ ID NO: 2768100 - RNA, 15 nt, Leptospira interrogans serovar lai str. 56601
cuaaaauuaaaaauu

SEQ ID NO: 2768101 - RNA, 15 nt, Leptospira interrogans serovar lai str. 56601
cuaaaauuauaggaa

SEQ ID NO: 2768102 - RNA, 15 nt, Leptospira interrogans serovar lai str. 56601
cuaaaauuuccauga

SEQ ID NO: 2768103 - RNA, 16 nt, Leptospira interrogans serovar lai str. 56601
cuaaaauuuguaggaa

SEQ ID NO: 2768104 - RNA, 18 nt, Leptospira interrogans serovar lai str. 56601
cuaaaauuuuaaaaaauu

SEQ ID NO: 2768105 - RNA, 20 nt, Leptospira interrogans serovar lai str. 56601
cuaaaauuuuaaaaaauuua

SEQ ID NO: 2768106 - RNA, 20 nt, Leptospira interrogans serovar lai str. 56601
cuaaaauuuuauaaaaaucu

SEQ ID NO: 2768107 - RNA, 16 nt, Leptospira interrogans serovar lai str. 56601
cuaaaauuuuuuuaag

SEQ ID NO: 2768108 - RNA, 19 nt, Leptospira interrogans serovar lai str. 56601
cuaaaauuuuuuuaagaau

SEQ ID NO: 2768109 - RNA, 13 nt, Leptospira interrogans serovar lai str. 56601
cuaaacaaaaugu

SEQ ID NO: 2768110 - RNA, 15 nt, Leptospira interrogans serovar lai str. 56601
cuaaacaauuuuauu

SEQ ID NO: 2768111 - RNA, 22 nt, Leptospira interrogans serovar lai str. 56601
cuaaacaauuuuauuugacucu

SEQ ID NO: 2768112 - RNA, 19 nt, Leptospira interrogans serovar lai str. 56601
cuaaacauuuaacuuuuau

SEQ ID NO: 2768113 - RNA, 17 nt, Leptospira interrogans serovar lai str. 56601
cuaaaccaccaaccgaa

SEQ ID NO: 2768114 - RNA, 19 nt, Leptospira interrogans serovar lai str. 56601
cuaaacccugagaauauuu

SEQ ID NO: 2768115 - RNA, 13 nt, Leptospira interrogans serovar lai str. 56601
cuaaacgaguuuu

SEQ ID NO: 2768116 - RNA, 19 nt, Leptospira interrogans serovar lai str. 56601
cuaaacgaguuuuuguuau

SEQ ID NO: 2768117 - RNA, 20 nt, Leptospira interrogans serovar lai str. 56601
cuaaacuuacagauugauuu

SEQ ID NO: 2768118 - RNA, 16 nt, Leptospira interrogans serovar lai str. 56601
cuaaacuucuucaucu

SEQ ID NO: 2768119 - RNA, 14 nt, Leptospira interrogans serovar lai str. 56601
cuaaacuuugcaaa

SEQ ID NO: 2768120 - RNA, 22 nt, Leptospira interrogans serovar lai str. 56601
cuaaagaaugaucgcauaaaau

SEQ ID NO: 2768121 - RNA, 21 nt, Leptospira interrogans serovar lai str. 56601
cuaaagaucggcauucaggga

SEQ ID NO: 2768122 - RNA, 22 nt, Leptospira interrogans serovar lai str. 56601
cuaaagcuauuuucuaggauuu

SEQ ID NO: 2768123 - RNA, 15 nt, Leptospira interrogans serovar lai str. 56601
cuaaaggaaaacgau

SEQ ID NO: 2768124 - RNA, 16 nt, Leptospira interrogans serovar lai str. 56601
cuaaaguuguaggaac

SEQ ID NO: 2768125 - RNA, 16 nt, Leptospira interrogans serovar lai str. 56601
cuaaauauuuauuaca

SEQ ID NO: 2768126 - RNA, 13 nt, Leptospira interrogans serovar lai str. 56601
cuaaauccuucuu

SEQ ID NO: 2768127 - RNA, 22 nt, Leptospira interrogans serovar lai str. 56601
cuaaaucgaaucgaauguauuu

SEQ ID NO: 2768128 - RNA, 18 nt, Leptospira interrogans serovar lai str. 56601
cuaaaucuaauucuucua

SEQ ID NO: 2768129 - RNA, 20 nt, Leptospira interrogans serovar lai str. 56601
cuaaaugacuugcauuuaau

SEQ ID NO: 2768130 - RNA, 23 nt, Leptospira interrogans serovar lai str. 56601
cuaaaugacuugcauuuaauaua

SEQ ID NO: 2768131 - RNA, 23 nt, Leptospira interrogans serovar lai str. 56601
cuaaaugaguuuuagaauauuaa

SEQ ID NO: 2768132 - RNA, 18 nt, Leptospira interrogans serovar lai str. 56601
cuaaauuaaguuuauuca

SEQ ID NO: 2768133 - RNA, 23 nt, Leptospira interrogans serovar lai str. 56601
cuaaauuaauauuuauaaaacaa

SEQ ID NO: 2768134 - RNA, 17 nt, Leptospira interrogans serovar lai str. 56601
cuaaauuccuuccaagu

SEQ ID NO: 2768135 - RNA, 15 nt, Leptospira interrogans serovar lai str. 56601
cuaaauugaaacuaa

SEQ ID NO: 2768136 - RNA, 21 nt, Leptospira interrogans serovar lai str. 56601
cuaaauugagaauuuguuuua

SEQ ID NO: 2768137 - RNA, 14 nt, Leptospira interrogans serovar lai str. 56601
cuaaauuuguaaua

SEQ ID NO: 2768138 - RNA, 18 nt, Leptospira interrogans serovar lai str. 56601
cuaaauuuguaauaguuc

SEQ ID NO: 2768139 - RNA, 13 nt, Leptospira interrogans serovar lai str. 56601
cuaaauuuuacaa

SEQ ID NO: 2768140 - RNA, 20 nt, Leptospira interrogans serovar lai str. 56601
cuaacaaaaaguguuuauaa

SEQ ID NO: 2768141 - RNA, 14 nt, Leptospira interrogans serovar lai str. 56601
cuaacaguaaaacu

SEQ ID NO: 2768142 - RNA, 17 nt, Leptospira interrogans serovar lai str. 56601
cuaacgauuguaaaaaa

SEQ ID NO: 2768143 - RNA, 12 nt, Leptospira interrogans serovar lai str. 56601
cuaccaaagcuu

SEQ ID NO: 2768144 - RNA, 10 nt, Leptospira interrogans serovar lai str. 56601
cuaccacaaa

SEQ ID NO: 2768145 - RNA, 12 nt, Leptospira interrogans serovar lai str. 56601
cuaccacaaaac

SEQ ID NO: 2768146 - RNA, 20 nt, Leptospira interrogans serovar lai str. 56601
cuaccacaaaucuaaauuuu

SEQ ID NO: 2768147 - RNA, 15 nt, Leptospira interrogans serovar lai str. 56601
cuaccacagaaagcu

SEQ ID NO: 2768148 - RNA, 20 nt, Leptospira interrogans serovar lai str. 56601
cuaccaugagcuugucccaa

SEQ ID NO: 2768149 - RNA, 19 nt, Leptospira interrogans serovar lai str. 56601
cuaccgcaaaucaagauuu

SEQ ID NO: 2768150 - RNA, 14 nt, Leptospira interrogans serovar lai str. 56601
cuaccgcaaaucac

SEQ ID NO: 2768151 - RNA, 21 nt, Leptospira interrogans serovar lai str. 56601
cuacgaaacuuuuagaauucu

SEQ ID NO: 2768152 - RNA, 15 nt, Leptospira interrogans serovar lai str. 56601
cuacgacuaacaaaa

SEQ ID NO: 2768153 - RNA, 14 nt, Leptospira interrogans serovar lai str. 56601
cuacggaucgcguu

SEQ ID NO: 2768154 - RNA, 19 nt, Leptospira interrogans serovar lai str. 56601
cuacuaagauuucuuguuu

SEQ ID NO: 2768155 - RNA, 11 nt, Leptospira interrogans serovar lai str. 56601
cuacuaaucuc

SEQ ID NO: 2768156 - RNA, 13 nt, Leptospira interrogans serovar lai str. 56601
cuacuaaucucua

SEQ ID NO: 2768157 - RNA, 13 nt, Leptospira interrogans serovar lai str. 56601
cuacuaauuuauc

SEQ ID NO: 2768158 - RNA, 13 nt, Leptospira interrogans serovar lai str. 56601
cuacuacaaaaau

SEQ ID NO: 2768159 - RNA, 15 nt, Leptospira interrogans serovar lai str. 56601
cuacuacgaaaauuu

SEQ ID NO: 2768160 - RNA, 13 nt, Leptospira interrogans serovar lai str. 56601
cuacuaggaaaau

SEQ ID NO: 2768161 - RNA, 23 nt, Leptospira interrogans serovar lai str. 56601
cuacuaggaaaauuuaacaacau

SEQ ID NO: 2768162 - RNA, 16 nt, Leptospira interrogans serovar lai str. 56601
cuacuauuaauagcuu

SEQ ID NO: 2768163 - RNA, 14 nt, Leptospira interrogans serovar lai str. 56601
cuacuauuauaaua

SEQ ID NO: 2768164 - RNA, 22 nt, Leptospira interrogans serovar lai str. 56601
cuacuccagauuuaauuuuucu

SEQ ID NO: 2768165 - RNA, 17 nt, Leptospira interrogans serovar lai str. 56601
cuacuccccgaacuaua

SEQ ID NO: 2768166 - RNA, 18 nt, Leptospira interrogans serovar lai str. 56601
cuacuccggcuaaaaaac

SEQ ID NO: 2768167 - RNA, 17 nt, Leptospira interrogans serovar lai str. 56601
cuacucgaauuuauaua

SEQ ID NO: 2768168 - RNA, 14 nt, Leptospira interrogans serovar lai str. 56601
cuacugaguuucaa

SEQ ID NO: 2768169 - RNA, 19 nt, Leptospira interrogans serovar lai str. 56601
cuacugcauuuuauuaaaa

SEQ ID NO: 2768170 - RNA, 23 nt, Leptospira interrogans serovar lai str. 56601
cuacugcauuuuauuaaaaauau

SEQ ID NO: 2768171 - RNA, 19 nt, Leptospira interrogans serovar lai str. 56601
cuacuuauuucuauaaaau

SEQ ID NO: 2768172 - RNA, 22 nt, Leptospira interrogans serovar lai str. 56601
cuacuugugagugaacuccauu

SEQ ID NO: 2768173 - RNA, 21 nt, Leptospira interrogans serovar lai str. 56601
cuacuuuccguagaucuuuua

SEQ ID NO: 2768174 - RNA, 13 nt, Leptospira interrogans serovar lai str. 56601
cuacuuuuauaaa

SEQ ID NO: 2768175 - RNA, 16 nt, Leptospira interrogans serovar lai str. 56601
cuagaaagaauuuaau

SEQ ID NO: 2768176 - RNA, 19 nt, Leptospira interrogans serovar lai str. 56601
cuagaaagaauuuaauaaa

SEQ ID NO: 2768177 - RNA, 18 nt, Leptospira interrogans serovar lai str. 56601
cuagaaauguaggaacuc

SEQ ID NO: 2768178 - RNA, 20 nt, Leptospira interrogans serovar lai str. 56601
cuagaaauguaggaacucau

SEQ ID NO: 2768179 - RNA, 22 nt, Leptospira interrogans serovar lai str. 56601
cuagaacaauaaccuucggguu

SEQ ID NO: 2768180 - RNA, 15 nt, Leptospira interrogans serovar lai str. 56601
cuagaaccuggaaaa

SEQ ID NO: 2768181 - RNA, 19 nt, Leptospira interrogans serovar lai str. 56601
cuagaaccuggaaaagaau

SEQ ID NO: 2768182 - RNA, 12 nt, Leptospira interrogans serovar lai str. 56601
cuagaagaguuu

SEQ ID NO: 2768183 - RNA, 19 nt, Leptospira interrogans serovar lai str. 56601
cuagaagaguuuuauccau

SEQ ID NO: 2768184 - RNA, 21 nt, Leptospira interrogans serovar lai str. 56601
cuagacuuucuuugaacuuuu

SEQ ID NO: 2768185 - RNA, 23 nt, Leptospira interrogans serovar lai str. 56601
cuagacuuucuuugaacuuuuuc

SEQ ID NO: 2768186 - RNA, 17 nt, Leptospira interrogans serovar lai str. 56601
cuagauauuucaagaau

SEQ ID NO: 2768187 - RNA, 21 nt, Leptospira interrogans serovar lai str. 56601
cuagauuauugaucucuauaa

SEQ ID NO: 2768188 - RNA, 12 nt, Leptospira interrogans serovar lai str. 56601
cuagauuuagau

SEQ ID NO: 2768189 - RNA, 21 nt, Leptospira interrogans serovar lai str. 56601
cuagauuuagauucuaaaaaa

SEQ ID NO: 2768190 - RNA, 16 nt, Leptospira interrogans serovar lai str. 56601
cuagcgucuaaaaaau

SEQ ID NO: 2768191 - RNA, 17 nt, Leptospira interrogans serovar lai str. 56601
cuagcgucuaaaaaauu

SEQ ID NO: 2768192 - RNA, 14 nt, Leptospira interrogans serovar lai str. 56601
cuaggaaacucaag

SEQ ID NO: 2768193 - RNA, 22 nt, Leptospira interrogans serovar lai str. 56601
cuaggaacugcuuccaaaaaaa

SEQ ID NO: 2768194 - RNA, 22 nt, Leptospira interrogans serovar lai str. 56601
cuaggaauuuccgauaaagaaa

SEQ ID NO: 2768195 - RNA, 19 nt, Leptospira interrogans serovar lai str. 56601
cuaggaucuccuugaauca

SEQ ID NO: 2768196 - RNA, 14 nt, Leptospira interrogans serovar lai str. 56601
cuaggauuuuauau

SEQ ID NO: 2768197 - RNA, 23 nt, Leptospira interrogans serovar lai str. 56601
cuaggauuuuauauauauuuuga

SEQ ID NO: 2768198 - RNA, 16 nt, Leptospira interrogans serovar lai str. 56601
cuagggaaagaugauu

SEQ ID NO: 2768199 - RNA, 19 nt, Leptospira interrogans serovar lai str. 56601
cuagggaaaguuuuuuaaa

SEQ ID NO: 2768200 - RNA, 23 nt, Leptospira interrogans serovar lai str. 56601
cuagggaaaguuuuuuaaaaaau

SEQ ID NO: 2768201 - RNA, 13 nt, Leptospira interrogans serovar lai str. 56601
cuaguaguuccca

SEQ ID NO: 2768202 - RNA, 23 nt, Leptospira interrogans serovar lai str. 56601
cuaguauauucuaauagucucau

SEQ ID NO: 2768203 - RNA, 18 nt, Leptospira interrogans serovar lai str. 56601
cuaguauuauuuuccuuu

SEQ ID NO: 2768204 - RNA, 19 nt, Leptospira interrogans serovar lai str. 56601
cuaguauuauuuuccuuua

SEQ ID NO: 2768205 - RNA, 15 nt, Leptospira interrogans serovar lai str. 56601
cuaguccucuuuuuu

SEQ ID NO: 2768206 - RNA, 16 nt, Leptospira interrogans serovar lai str. 56601
cuaguccucuuuuuug

SEQ ID NO: 2768207 - RNA, 19 nt, Leptospira interrogans serovar lai str. 56601
cuaguucaacguaagaaaa

SEQ ID NO: 2768208 - RNA, 18 nt, Leptospira interrogans serovar lai str. 56601
cuaguuuaugugaguucc

SEQ ID NO: 2768209 - RNA, 14 nt, Leptospira interrogans serovar lai str. 56601
cuaguuuguuuauc

SEQ ID NO: 2768210 - RNA, 13 nt, Leptospira interrogans serovar lai str. 56601
cuaguuuuccuuc

SEQ ID NO: 2768211 - RNA, 23 nt, Leptospira interrogans serovar lai str. 56601
cuauaaaaccuuuauuuaauaaa

SEQ ID NO: 2768212 - RNA, 18 nt, Leptospira interrogans serovar lai str. 56601
cuauaaaauaucuuuaau

SEQ ID NO: 2768213 - RNA, 22 nt, Leptospira interrogans serovar lai str. 56601
cuauaaaaucgggauuuguggg

SEQ ID NO: 2768214 - RNA, 16 nt, Leptospira interrogans serovar lai str. 56601
cuauaaaaucuaaaaa

SEQ ID NO: 2768215 - RNA, 19 nt, Leptospira interrogans serovar lai str. 56601
cuauaaaaucuaaaaaaaa

SEQ ID NO: 2768216 - RNA, 19 nt, Leptospira interrogans serovar lai str. 56601
cuauaaaaucuaaaaaaac

SEQ ID NO: 2768217 - RNA, 19 nt, Leptospira interrogans serovar lai str. 56601
cuauaaaaucuaaaaagaa

SEQ ID NO: 2768218 - RNA, 23 nt, Leptospira interrogans serovar lai str. 56601
cuauaaaauggguuuucauuuuu

SEQ ID NO: 2768219 - RNA, 19 nt, Leptospira interrogans serovar lai str. 56601
cuauaaaauucaaaaagaa

SEQ ID NO: 2768220 - RNA, 21 nt, Leptospira interrogans serovar lai str. 56601
cuauaaaccaucucaaaaaca

SEQ ID NO: 2768221 - RNA, 23 nt, Leptospira interrogans serovar lai str. 56601
cuauaaaccaucucaaaaacacu

SEQ ID NO: 2768222 - RNA, 12 nt, Leptospira interrogans serovar lai str. 56601
cuauaaacucaa

SEQ ID NO: 2768223 - RNA, 18 nt, Leptospira interrogans serovar lai str. 56601
cuauaaauaaauuuaaau

SEQ ID NO: 2768224 - RNA, 19 nt, Leptospira interrogans serovar lai str. 56601
cuauaaaucauucgauacu

SEQ ID NO: 2768225 - RNA, 14 nt, Leptospira interrogans serovar lai str. 56601
cuauaaauucauaa

SEQ ID NO: 2768226 - RNA, 13 nt, Leptospira interrogans serovar lai str. 56601
cucaaaaauacuu

SEQ ID NO: 2768227 - RNA, 19 nt, Leptospira interrogans serovar lai str. 56601
cucaaaagcucauaaucaa

SEQ ID NO: 2768228 - RNA, 18 nt, Leptospira interrogans serovar lai str. 56601
cucaaaaucuuaauaaaa

SEQ ID NO: 2768229 - RNA, 14 nt, Leptospira interrogans serovar lai str. 56601
cucaaaauuaagaa

SEQ ID NO: 2768230 - RNA, 15 nt, Leptospira interrogans serovar lai str. 56601
cucaaaauucuuaaa

SEQ ID NO: 2768231 - RNA, 13 nt, Leptospira interrogans serovar lai str. 56601
cucaaaauuuaag

SEQ ID NO: 2768232 - RNA, 15 nt, Leptospira interrogans serovar lai str. 56601
cucaaaauuucggaa

SEQ ID NO: 2768233 - RNA, 11 nt, Leptospira interrogans serovar lai str. 56601
cucaaaggaaa

SEQ ID NO: 2768234 - RNA, 14 nt, Leptospira interrogans serovar lai str. 56601
cucaaaucuacaaa

SEQ ID NO: 2768235 - RNA, 15 nt, Leptospira interrogans serovar lai str. 56601
cucaaaucuacaaaa

SEQ ID NO: 2768236 - RNA, 22 nt, Leptospira interrogans serovar lai str. 56601
cucaaaucuucgguuuaauaua

SEQ ID NO: 2768237 - RNA, 19 nt, Leptospira interrogans serovar lai str. 56601
cucaacggguucuucauua

SEQ ID NO: 2768238 - RNA, 21 nt, Leptospira interrogans serovar lai str. 56601
cucaacucugguuauuaaauu

SEQ ID NO: 2768239 - RNA, 18 nt, Leptospira interrogans serovar lai str. 56601
cucaagguuucacuuuuu

SEQ ID NO: 2768240 - RNA, 16 nt, Leptospira interrogans serovar lai str. 56601
cucaaguaaaacguag

SEQ ID NO: 2768241 - RNA, 17 nt, Leptospira interrogans serovar lai str. 56601
cucaauagauuuuugau

SEQ ID NO: 2768242 - RNA, 19 nt, Leptospira interrogans serovar lai str. 56601
cucaauauuuaaaaauucu

SEQ ID NO: 2768243 - RNA, 18 nt, Leptospira interrogans serovar lai str. 56601
cucaaucaaaauuuuuuu

SEQ ID NO: 2768244 - RNA, 16 nt, Leptospira interrogans serovar lai str. 56601
cucaaucaaauuuuug

SEQ ID NO: 2768245 - RNA, 16 nt, Leptospira interrogans serovar lai str. 56601
cucaauccaauauuua

SEQ ID NO: 2768246 - RNA, 17 nt, Leptospira interrogans serovar lai str. 56601
cucaaugcaucucuucu

SEQ ID NO: 2768247 - RNA, 12 nt, Leptospira interrogans serovar lai str. 56601
cucaauguugcu

SEQ ID NO: 2768248 - RNA, 15 nt, Leptospira interrogans serovar lai str. 56601
cucaauucaguaaau

SEQ ID NO: 2768249 - RNA, 23 nt, Leptospira interrogans serovar lai str. 56601
cucaauuuugaagacuauaaaac

SEQ ID NO: 2768250 - RNA, 21 nt, Leptospira interrogans serovar lai str. 56601
cucacaaaucagguuuuuaca

SEQ ID NO: 2768251 - RNA, 23 nt, Leptospira interrogans serovar lai str. 56601
cucacaccggauucacauuaaaa

SEQ ID NO: 2768252 - RNA, 15 nt, Leptospira interrogans serovar lai str. 56601
cucacagaaauauau

SEQ ID NO: 2768253 - RNA, 20 nt, Leptospira interrogans serovar lai str. 56601
cucacauuauuuaaugaauc

SEQ ID NO: 2768254 - RNA, 16 nt, Leptospira interrogans serovar lai str. 56601
cucaccaacaacacca

SEQ ID NO: 2768255 - RNA, 19 nt, Leptospira interrogans serovar lai str. 56601
cucacguuaaaaguaauau

SEQ ID NO: 2768256 - RNA, 15 nt, Leptospira interrogans serovar lai str. 56601
cucacguuaauuuag

SEQ ID NO: 2768257 - RNA, 18 nt, Leptospira interrogans serovar lai str. 56601
cucacguuauuuuaacuu

SEQ ID NO: 2768258 - RNA, 21 nt, Leptospira interrogans serovar lai str. 56601
cucacguuauuuuaacuugag

SEQ ID NO: 2768259 - RNA, 18 nt, Leptospira interrogans serovar lai str. 56601
cucacuaccuuauaaaaa

SEQ ID NO: 2768260 - RNA, 14 nt, Leptospira interrogans serovar lai str. 56601
cucacucauuuuua

SEQ ID NO: 2768261 - RNA, 15 nt, Leptospira interrogans serovar lai str. 56601
cucacucauuuuuag

SEQ ID NO: 2768262 - RNA, 13 nt, Leptospira interrogans serovar lai str. 56601
cucacuuuuucgu

SEQ ID NO: 2768263 - RNA, 14 nt, Leptospira interrogans serovar lai str. 56601
cucacuuuuucgug

SEQ ID NO: 2768264 - RNA, 17 nt, Leptospira interrogans serovar lai str. 56601
cucagagaauaucugaa

SEQ ID NO: 2768265 - RNA, 18 nt, Leptospira interrogans serovar lai str. 56601
cucagauuccaacuuuuu

SEQ ID NO: 2768266 - RNA, 15 nt, Leptospira interrogans serovar lai str. 56601
cucagauuuccuuuc

SEQ ID NO: 2768267 - RNA, 13 nt, Leptospira interrogans serovar lai str. 56601
cucagcuauaaaa

SEQ ID NO: 2768268 - RNA, 14 nt, Leptospira interrogans serovar lai str. 56601
cucagcugaacuca

SEQ ID NO: 2768269 - RNA, 20 nt, Leptospira interrogans serovar lai str. 56601
cucaguaaaacgcucucuac

SEQ ID NO: 2768270 - RNA, 21 nt, Leptospira interrogans serovar lai str. 56601
cucaguaaaacgcucucuacg

SEQ ID NO: 2768271 - RNA, 20 nt, Leptospira interrogans serovar lai str. 56601
cucagucaccucuauaaaau

SEQ ID NO: 2768272 - RNA, 23 nt, Leptospira interrogans serovar lai str. 56601
cucagucaccucuauaaaaucua

SEQ ID NO: 2768273 - RNA, 20 nt, Leptospira interrogans serovar lai str. 56601
cucauaacgugacaaacuaa

SEQ ID NO: 2768274 - RNA, 24 nt, Leptospira interrogans serovar lai str. 56601
cucauacuuaauuucaaucuauua

SEQ ID NO: 2768275 - RNA, 16 nt, Leptospira interrogans serovar lai str. 56601
cucauacuucuaaaaa

SEQ ID NO: 2768276 - RNA, 18 nt, Leptospira interrogans serovar lai str. 56601
cucauacuucuaaaaaau

SEQ ID NO: 2768277 - RNA, 16 nt, Leptospira interrogans serovar lai str. 56601
cucauacuuuuagaag

SEQ ID NO: 2768278 - RNA, 22 nt, Leptospira interrogans serovar lai str. 56601
cucauacuuuuagaagauuuuu

SEQ ID NO: 2768279 - RNA, 15 nt, Leptospira interrogans serovar lai str. 56601
cucaucagucauuaa

SEQ ID NO: 2768280 - RNA, 15 nt, Leptospira interrogans serovar lai str. 56601
cucaucauucugaaa

SEQ ID NO: 2768281 - RNA, 18 nt, Leptospira interrogans serovar lai str. 56601
cucaucauucugaaaaaa

SEQ ID NO: 2768282 - RNA, 15 nt, Leptospira interrogans serovar lai str. 56601
cucaucuaguuuuug

SEQ ID NO: 2768283 - RNA, 15 nt, Leptospira interrogans serovar lai str. 56601
cucaugaaaaucuag

SEQ ID NO: 2768284 - RNA, 23 nt, Leptospira interrogans serovar lai str. 56601
cucauuagaguuauugaaaaauu

SEQ ID NO: 2768285 - RNA, 13 nt, Leptospira interrogans serovar lai str. 56601
cucauucaaguaa

SEQ ID NO: 2768286 - RNA, 15 nt, Leptospira interrogans serovar lai str. 56601
cucauuucaaauuua

SEQ ID NO: 2768287 - RNA, 19 nt, Leptospira interrogans serovar lai str. 56601
cucauuuccauaacagaau

SEQ ID NO: 2768288 - RNA, 15 nt, Leptospira interrogans serovar lai str. 56601
cucauuuuucuaaaa

SEQ ID NO: 2768289 - RNA, 13 nt, Leptospira interrogans serovar lai str. 56601
cucauuuuucuua

SEQ ID NO: 2768290 - RNA, 15 nt, Leptospira interrogans serovar lai str. 56601
cucauuuuucuuaaa

SEQ ID NO: 2768291 - RNA, 13 nt, Leptospira interrogans serovar lai str. 56601
cuccaaaaaaaua

SEQ ID NO: 2768292 - RNA, 14 nt, Leptospira interrogans serovar lai str. 56601
cuccaaaaaaauaa

SEQ ID NO: 2768293 - RNA, 19 nt, Leptospira interrogans serovar lai str. 56601
cuccaaaaggcacauuuuu

SEQ ID NO: 2768294 - RNA, 20 nt, Leptospira interrogans serovar lai str. 56601
cuccaaaaggcacauuuuuc

SEQ ID NO: 2768295 - RNA, 14 nt, Leptospira interrogans serovar lai str. 56601
cuccaaacaauuuu

SEQ ID NO: 2768296 - RNA, 17 nt, Leptospira interrogans serovar lai str. 56601
cuccaaacaauuuuuug

SEQ ID NO: 2768297 - RNA, 12 nt, Leptospira interrogans serovar lai str. 56601
cuccaaagugac

SEQ ID NO: 2768298 - RNA, 19 nt, Leptospira interrogans serovar lai str. 56601
cuccacgauugauuuugga

SEQ ID NO: 2768299 - RNA, 17 nt, Leptospira interrogans serovar lai str. 56601
cuccacuauggaauuuu

SEQ ID NO: 2768300 - RNA, 18 nt, Leptospira interrogans serovar lai str. 56601
cuccacuuaauuuuucuu

SEQ ID NO: 2768301 - RNA, 19 nt, Leptospira interrogans serovar lai str. 56601
cuccauauuccagaaguau

SEQ ID NO: 2768302 - RNA, 23 nt, Leptospira interrogans serovar lai str. 56601
cuccauauuccagaaguauuuuc

SEQ ID NO: 2768303 - RNA, 17 nt, Leptospira interrogans serovar lai str. 56601
cuccaucuuuuuuuucu

SEQ ID NO: 2768304 - RNA, 20 nt, Leptospira interrogans serovar lai str. 56601
cuccauuaggugcuacugca

SEQ ID NO: 2768305 - RNA, 12 nt, Leptospira interrogans serovar lai str. 56601
cucccacaauuu

SEQ ID NO: 2768306 - RNA, 16 nt, Leptospira interrogans serovar lai str. 56601
cucccacuuuuaaaga

SEQ ID NO: 2768307 - RNA, 14 nt, Leptospira interrogans serovar lai str. 56601
cucccguuauuuuu

SEQ ID NO: 2768308 - RNA, 22 nt, Leptospira interrogans serovar lai str. 56601
cuccgaaaguaaauggauaaau

SEQ ID NO: 2768309 - RNA, 18 nt, Leptospira interrogans serovar lai str. 56601
cucuuugacccauaaaaa

SEQ ID NO: 2768310 - RNA, 15 nt, Leptospira interrogans serovar lai str. 56601
cucuuuuaccuuacc

SEQ ID NO: 2768311 - RNA, 13 nt, Leptospira interrogans serovar lai str. 56601
cucuuuugagagc

SEQ ID NO: 2768312 - RNA, 16 nt, Leptospira interrogans serovar lai str. 56601
cucuuuuuagacaaaa

SEQ ID NO: 2768313 - RNA, 18 nt, Leptospira interrogans serovar lai str. 56601
cucuuuuucuucugcugc

SEQ ID NO: 2768314 - RNA, 20 nt, Leptospira interrogans serovar lai str. 56601
cucuuuuugggaauuuuuuu

SEQ ID NO: 2768315 - RNA, 22 nt, Leptospira interrogans serovar lai str. 56601
cugaaaaaaacgucuuuaucca

SEQ ID NO: 2768316 - RNA, 17 nt, Leptospira interrogans serovar lai str. 56601
cugaaaaaaauuagaau

SEQ ID NO: 2768317 - RNA, 12 nt, Leptospira interrogans serovar lai str. 56601
cugaaaaaaguu

SEQ ID NO: 2768318 - RNA, 23 nt, Leptospira interrogans serovar lai str. 56601
cugaaaaaaguuagaaucuaaac

SEQ ID NO: 2768319 - RNA, 18 nt, Leptospira interrogans serovar lai str. 56601
cugaaaaaaguugaaauc

SEQ ID NO: 2768320 - RNA, 18 nt, Leptospira interrogans serovar lai str. 56601
cugaaaaaaucuguacuu

SEQ ID NO: 2768321 - RNA, 11 nt, Leptospira interrogans serovar lai str. 56601
cugaaaaaguu

SEQ ID NO: 2768322 - RNA, 15 nt, Leptospira interrogans serovar lai str. 56601
cugaaaaugaccaaa

SEQ ID NO: 2768323 - RNA, 13 nt, Leptospira interrogans serovar lai str. 56601
cugaaaauuuaau

SEQ ID NO: 2768324 - RNA, 15 nt, Leptospira interrogans serovar lai str. 56601
cugaaaauuuaauua

SEQ ID NO: 2768325 - RNA, 16 nt, Leptospira interrogans serovar lai str. 56601
cugaaaauuuuccuuu

SEQ ID NO: 2768326 - RNA, 17 nt, Leptospira interrogans serovar lai str. 56601
cugaaaauuuuccuuua

SEQ ID NO: 2768327 - RNA, 20 nt, Leptospira interrogans serovar lai str. 56601
cugaaaauuuuccuuuaaau

SEQ ID NO: 2768328 - RNA, 22 nt, Leptospira interrogans serovar lai str. 56601
cugaaacuugaacuguuuaauu

SEQ ID NO: 2768329 - RNA, 14 nt, Leptospira interrogans serovar lai str. 56601
cugaaacuuuucaa

SEQ ID NO: 2768330 - RNA, 20 nt, Leptospira interrogans serovar lai str. 56601
cugaaacuuuucaaaaucua

SEQ ID NO: 2768331 - RNA, 11 nt, Leptospira interrogans serovar lai str. 56601
cugaaauaaaa

SEQ ID NO: 2768332 - RNA, 12 nt, Leptospira interrogans serovar lai str. 56601
cugaaauagaau

SEQ ID NO: 2768333 - RNA, 14 nt, Leptospira interrogans serovar lai str. 56601
cugaaauagaauuu

SEQ ID NO: 2768334 - RNA, 15 nt, Leptospira interrogans serovar lai str. 56601
cugaaauuguuuuaa

SEQ ID NO: 2768335 - RNA, 16 nt, Leptospira interrogans serovar lai str. 56601
cugaaauuguuuuaaa

SEQ ID NO: 2768336 - RNA, 21 nt, Leptospira interrogans serovar lai str. 56601
cugaacaaacucuugaacaga

SEQ ID NO: 2768337 - RNA, 17 nt, Leptospira interrogans serovar lai str. 56601
cugaacaagaauuuauu

SEQ ID NO: 2768338 - RNA, 17 nt, Leptospira interrogans serovar lai str. 56601
cugaaccugcaaauuuu

SEQ ID NO: 2768339 - RNA, 15 nt, Leptospira interrogans serovar lai str. 56601
cugaacuuaaaaucu

SEQ ID NO: 2768340 - RNA, 13 nt, Leptospira interrogans serovar lai str. 56601
cugaauaaaaaua

SEQ ID NO: 2768341 - RNA, 13 nt, Leptospira interrogans serovar lai str. 56601
cugaaucucuuuu

SEQ ID NO: 2768342 - RNA, 23 nt, Leptospira interrogans serovar lai str. 56601
cugaauggacucauaacgugaca

SEQ ID NO: 2768343 - RNA, 21 nt, Leptospira interrogans serovar lai str. 56601
cugaauuguuugaucucggga

SEQ ID NO: 2768344 - RNA, 16 nt, Leptospira interrogans serovar lai str. 56601
cugaauuuuaccaaau

SEQ ID NO: 2768345 - RNA, 19 nt, Leptospira interrogans serovar lai str. 56601
cugaauuuuaccaaauugu

SEQ ID NO: 2768346 - RNA, 22 nt, Leptospira interrogans serovar lai str. 56601
cugaauuuuuauaaguuuaauu

SEQ ID NO: 2768347 - RNA, 19 nt, Leptospira interrogans serovar lai str. 56601
cugacauucuaaacauuua

SEQ ID NO: 2768348 - RNA, 15 nt, Leptospira interrogans serovar lai str. 56601
cugacugaaaaaaac

SEQ ID NO: 2768349 - RNA, 12 nt, Leptospira interrogans serovar lai str. 56601
cugagaaccauu

SEQ ID NO: 2768350 - RNA, 11 nt, Leptospira interrogans serovar lai str. 56601
cugaguuucaa

SEQ ID NO: 2768351 - RNA, 16 nt, Leptospira interrogans serovar lai str. 56601
cugauaaagaaaaccu

SEQ ID NO: 2768352 - RNA, 22 nt, Leptospira interrogans serovar lai str. 56601
cugauaaauuucauaucuaaaa

SEQ ID NO: 2768353 - RNA, 21 nt, Leptospira interrogans serovar lai str. 56601
cugauaauuuuuuaaaaaaau

SEQ ID NO: 2768354 - RNA, 17 nt, Leptospira interrogans serovar lai str. 56601
cugauacugaaaccauc

SEQ ID NO: 2768355 - RNA, 17 nt, Leptospira interrogans serovar lai str. 56601
cugauauuuuaaauuga

SEQ ID NO: 2768356 - RNA, 21 nt, Leptospira interrogans serovar lai str. 56601
cugaucaaagcgggaauuccg

SEQ ID NO: 2768357 - RNA, 14 nt, Leptospira interrogans serovar lai str. 56601
cugauccugaucua

SEQ ID NO: 2768358 - RNA, 15 nt, Leptospira interrogans serovar lai str. 56601
cugauucuaaaaucc

SEQ ID NO: 2768359 - RNA, 16 nt, Leptospira interrogans serovar lai str. 56601
cugauucuuuaaaugu

SEQ ID NO: 2768360 - RNA, 14 nt, Leptospira interrogans serovar lai str. 56601
cugauugagaaaau

SEQ ID NO: 2768361 - RNA, 17 nt, Leptospira interrogans serovar lai str. 56601
cugauuucuauaaaauu

SEQ ID NO: 2768362 - RNA, 13 nt, Leptospira interrogans serovar lai str. 56601
cugauuuuuauaa

SEQ ID NO: 2768363 - RNA, 20 nt, Leptospira interrogans serovar lai str. 56601
cugauuuuuauaauuuagag

SEQ ID NO: 2768364 - RNA, 23 nt, Leptospira interrogans serovar lai str. 56601
cugauuuuuccauaaaaaaugaa

SEQ ID NO: 2768365 - RNA, 16 nt, Leptospira interrogans serovar lai str. 56601
cugauuuuucuuuaga

SEQ ID NO: 2768366 - RNA, 14 nt, Leptospira interrogans serovar lai str. 56601
cugauuuuuuaaau

SEQ ID NO: 2768367 - RNA, 16 nt, Leptospira interrogans serovar lai str. 56601
cugauuuuuuaaaugu

SEQ ID NO: 2768368 - RNA, 17 nt, Leptospira interrogans serovar lai str. 56601
cugauuuuuuaaaugug

SEQ ID NO: 2768369 - RNA, 12 nt, Leptospira interrogans serovar lai str. 56601
cugcaaaauaac

SEQ ID NO: 2768370 - RNA, 16 nt, Leptospira interrogans serovar lai str. 56601
cugcaaaauuuaaaaa

SEQ ID NO: 2768371 - RNA, 15 nt, Leptospira interrogans serovar lai str. 56601
cugcaaaguucugaa

SEQ ID NO: 2768372 - RNA, 19 nt, Leptospira interrogans serovar lai str. 56601
cugcaaaucccgaauuuac

SEQ ID NO: 2768373 - RNA, 22 nt, Leptospira interrogans serovar lai str. 56601
cugcaaauuuuuuucuaaaaua

SEQ ID NO: 2768374 - RNA, 15 nt, Leptospira interrogans serovar lai str. 56601
cugcaagaaaccucu

SEQ ID NO: 2768375 - RNA, 13 nt, Leptospira interrogans serovar lai str. 56601
cugcagcugaaag

SEQ ID NO: 2768376 - RNA, 14 nt, Leptospira interrogans serovar lai str. 56601
cugcaguaguuccc

SEQ ID NO: 2768377 - RNA, 16 nt, Leptospira interrogans serovar lai str. 56601
cugcaucaaccaagaa

SEQ ID NO: 2768378 - RNA, 15 nt, Leptospira interrogans serovar lai str. 56601
cugcauuuuauuaaa

SEQ ID NO: 2768379 - RNA, 13 nt, Leptospira interrogans serovar lai str. 56601
cugccaaaauccc

SEQ ID NO: 2768380 - RNA, 14 nt, Leptospira interrogans serovar lai str. 56601
cugccaaaauccca

SEQ ID NO: 2768381 - RNA, 17 nt, Leptospira interrogans serovar lai str. 56601
cugccuuauaaugaaga

SEQ ID NO: 2768382 - RNA, 14 nt, Leptospira interrogans serovar lai str. 56601
cugccuucuuuuuu

SEQ ID NO: 2768383 - RNA, 20 nt, Leptospira interrogans serovar lai str. 56601
cugccuucuuuuuucuaaau

SEQ ID NO: 2768384 - RNA, 22 nt, Leptospira interrogans serovar lai str. 56601
cugcuacaacccaacuuucgca

SEQ ID NO: 2768385 - RNA, 14 nt, Leptospira interrogans serovar lai str. 56601
cugcuauaauuuaa

SEQ ID NO: 2768386 - RNA, 20 nt, Leptospira interrogans serovar lai str. 56601
cugcugaauuuaccuccucc

SEQ ID NO: 2768387 - RNA, 23 nt, Leptospira interrogans serovar lai str. 56601
cugcuggaccuaacggcccucug

SEQ ID NO: 2768388 - RNA, 19 nt, Leptospira interrogans serovar lai str. 56601
cugcuugacaucuuuuaaa

SEQ ID NO: 2768389 - RNA, 23 nt, Leptospira interrogans serovar lai str. 56601
cuggaaaaauuccuaaaacaccu

SEQ ID NO: 2768390 - RNA, 12 nt, Leptospira interrogans serovar lai str. 56601
cuggaaacguca

SEQ ID NO: 2768391 - RNA, 17 nt, Leptospira interrogans serovar lai str. 56601
cuggaacggaaauguua

SEQ ID NO: 2768392 - RNA, 13 nt, Leptospira interrogans serovar lai str. 56601
cuuaauaaacuuu

SEQ ID NO: 2768393 - RNA, 16 nt, Leptospira interrogans serovar lai str. 56601
cuuaauagcagauuuu

SEQ ID NO: 2768394 - RNA, 15 nt, Leptospira interrogans serovar lai str. 56601
cuuaauauaauaauu

SEQ ID NO: 2768395 - RNA, 16 nt, Leptospira interrogans serovar lai str. 56601
cuuaaucucaugaguc

SEQ ID NO: 2768396 - RNA, 13 nt, Leptospira interrogans serovar lai str. 56601
cuuaaucugcuga

SEQ ID NO: 2768397 - RNA, 19 nt, Leptospira interrogans serovar lai str. 56601
cuuaaucugcugaauuuac

SEQ ID NO: 2768398 - RNA, 12 nt, Leptospira interrogans serovar lai str. 56601
cuuaaucugugg

SEQ ID NO: 2768399 - RNA, 18 nt, Leptospira interrogans serovar lai str. 56601
cuuaaucugugggaacuc

SEQ ID NO: 2768400 - RNA, 19 nt, Leptospira interrogans serovar lai str. 56601
cuuaaugagauuaaaacug

SEQ ID NO: 2768401 - RNA, 21 nt, Leptospira interrogans serovar lai str. 56601
cuuaaugagauuaaaacugcu

SEQ ID NO: 2768402 - RNA, 20 nt, Leptospira interrogans serovar lai str. 56601
cuuaauguaaaguucuuuuc

SEQ ID NO: 2768403 - RNA, 18 nt, Leptospira interrogans serovar lai str. 56601
cuuaaugucccagauucg

SEQ ID NO: 2768404 - RNA, 20 nt, Leptospira interrogans serovar lai str. 56601
cuuaauuguggaacaaucuu

SEQ ID NO: 2768405 - RNA, 20 nt, Leptospira interrogans serovar lai str. 56601
cuuaauuguugcuauggaau

SEQ ID NO: 2768406 - RNA, 19 nt, Leptospira interrogans serovar lai str. 56601
cuuaauuucucuuauuaga

SEQ ID NO: 2768407 - RNA, 21 nt, Leptospira interrogans serovar lai str. 56601
cuuaauuucucuuauuagaac

SEQ ID NO: 2768408 - RNA, 19 nt, Leptospira interrogans serovar lai str. 56601
cuuaauuuguaggaacuac

SEQ ID NO: 2768409 - RNA, 17 nt, Leptospira interrogans serovar lai str. 56601
cuuaauuuuacuauaaa

SEQ ID NO: 2768410 - RNA, 18 nt, Leptospira interrogans serovar lai str. 56601
cuuacaaagcacuuuuuu

SEQ ID NO: 2768411 - RNA, 22 nt, Leptospira interrogans serovar lai str. 56601
cuuacaaagugaugaagagaaa

SEQ ID NO: 2768412 - RNA, 20 nt, Leptospira interrogans serovar lai str. 56601
cuuacaauuuuagaauuugu

SEQ ID NO: 2768413 - RNA, 19 nt, Leptospira interrogans serovar lai str. 56601
cuuacagauugauuuuuua

SEQ ID NO: 2768414 - RNA, 21 nt, Leptospira interrogans serovar lai str. 56601
cuuacagccugauaaauuccg

SEQ ID NO: 2768415 - RNA, 22 nt, Leptospira interrogans serovar lai str. 56601
cuuacaucccaaaccucuuuau

SEQ ID NO: 2768416 - RNA, 12 nt, Leptospira interrogans serovar lai str. 56601
cuuacauuagag

SEQ ID NO: 2768417 - RNA, 22 nt, Leptospira interrogans serovar lai str. 56601
cuuaccaacgucccuauuguau

SEQ ID NO: 2768418 - RNA, 15 nt, Leptospira interrogans serovar lai str. 56601
cuuaccacagugaaa

SEQ ID NO: 2768419 - RNA, 23 nt, Leptospira interrogans serovar lai str. 56601
cuuaccgccuucacccaccaaaa

SEQ ID NO: 2768420 - RNA, 16 nt, Leptospira interrogans serovar lai str. 56601
cuuaccuccuuuuuca

SEQ ID NO: 2768421 - RNA, 17 nt, Leptospira interrogans serovar lai str. 56601
cuuaccuccuuuuucaa

SEQ ID NO: 2768422 - RNA, 17 nt, Leptospira interrogans serovar lai str. 56601
cuuacuaugaagucuua

SEQ ID NO: 2768423 - RNA, 20 nt, Leptospira interrogans serovar lai str. 56601
cuuacuaugaagucuuaucu

SEQ ID NO: 2768424 - RNA, 19 nt, Leptospira interrogans serovar lai str. 56601
cuuacugauuucuauaaaa

SEQ ID NO: 2768425 - RNA, 19 nt, Leptospira interrogans serovar lai str. 56601
cuuagaaugugggaacuac

SEQ ID NO: 2768426 - RNA, 21 nt, Leptospira interrogans serovar lai str. 56601
cuuagaauuguugaaaaauua

SEQ ID NO: 2768427 - RNA, 14 nt, Leptospira interrogans serovar lai str. 56601
cuuagaauuuuguu

SEQ ID NO: 2768428 - RNA, 14 nt, Leptospira interrogans serovar lai str. 56601
cuuagaauuuuuuc

SEQ ID NO: 2768429 - RNA, 21 nt, Leptospira interrogans serovar lai str. 56601
cuuagaauuuuuucguuccuu

SEQ ID NO: 2768430 - RNA, 22 nt, Leptospira interrogans serovar lai str. 56601
cuuagaugaacuuuuuuauaua

SEQ ID NO: 2768431 - RNA, 18 nt, Leptospira interrogans serovar lai str. 56601
cuuagauucacuuuugcu

SEQ ID NO: 2768432 - RNA, 19 nt, Leptospira interrogans serovar lai str. 56601
cuuagauucacuuuugcug

SEQ ID NO: 2768433 - RNA, 19 nt, Leptospira interrogans serovar lai str. 56601
cuuagauucgaguccuuuu

SEQ ID NO: 2768434 - RNA, 20 nt, Leptospira interrogans serovar lai str. 56601
cuuagccccaguaaauaaac

SEQ ID NO: 2768435 - RNA, 15 nt, Leptospira interrogans serovar lai str. 56601
cuuagccuuuaaacu

SEQ ID NO: 2768436 - RNA, 23 nt, Leptospira interrogans serovar lai str. 56601
cuuagguuuaucuguaaaaugau

SEQ ID NO: 2768437 - RNA, 17 nt, Leptospira interrogans serovar lai str. 56601
cuuagucugaaauaaau

SEQ ID NO: 2768438 - RNA, 18 nt, Leptospira interrogans serovar lai str. 56601
cuuaguuuuguacuuuac

SEQ ID NO: 2768439 - RNA, 19 nt, Leptospira interrogans serovar lai str. 56601
cuuauaaagaauuuuaaau

SEQ ID NO: 2768440 - RNA, 17 nt, Leptospira interrogans serovar lai str. 56601
cuuauacucuuaaaauu

SEQ ID NO: 2768441 - RNA, 12 nt, Leptospira interrogans serovar lai str. 56601
cuuauauaaaag

SEQ ID NO: 2768442 - RNA, 21 nt, Leptospira interrogans serovar lai str. 56601
cuuaucucaaagccuuaaauc

SEQ ID NO: 2768443 - RNA, 23 nt, Leptospira interrogans serovar lai str. 56601
cuuaucucaaagccuuaaaucaa

SEQ ID NO: 2768444 - RNA, 18 nt, Leptospira interrogans serovar lai str. 56601
cuuaugaaagcaauccau

SEQ ID NO: 2768445 - RNA, 21 nt, Leptospira interrogans serovar lai str. 56601
cuuaugagaguucccacggau

SEQ ID NO: 2768446 - RNA, 15 nt, Leptospira interrogans serovar lai str. 56601
cuuauguggaugaua

SEQ ID NO: 2768447 - RNA, 18 nt, Leptospira interrogans serovar lai str. 56601
cuuauguggaugauaaaa

SEQ ID NO: 2768448 - RNA, 23 nt, Leptospira interrogans serovar lai str. 56601
cuuauguuuuuuauggaaaaaug

SEQ ID NO: 2768449 - RNA, 17 nt, Leptospira interrogans serovar lai str. 56601
cuuauucuuauaagaau

SEQ ID NO: 2768450 - RNA, 18 nt, Leptospira interrogans serovar lai str. 56601
cuuauuuaguuucaauuu

SEQ ID NO: 2768451 - RNA, 23 nt, Leptospira interrogans serovar lai str. 56601
cuuauuuauauuucuaaaagaag

SEQ ID NO: 2768452 - RNA, 14 nt, Leptospira interrogans serovar lai str. 56601
cuuauuuauuaaag

SEQ ID NO: 2768453 - RNA, 19 nt, Leptospira interrogans serovar lai str. 56601
cuuauuucuauaaaauuga

SEQ ID NO: 2768454 - RNA, 20 nt, Leptospira interrogans serovar lai str. 56601
cuucaaaacuaggaucuccu

SEQ ID NO: 2768455 - RNA, 22 nt, Leptospira interrogans serovar lai str. 56601
cuucaaaacuaggaucuccuug

SEQ ID NO: 2768456 - RNA, 19 nt, Leptospira interrogans serovar lai str. 56601
cuucaaaaucguuuuaaaa

SEQ ID NO: 2768457 - RNA, 18 nt, Leptospira interrogans serovar lai str. 56601
cuucaaauaacauuuuuu

SEQ ID NO: 2768458 - RNA, 18 nt, Leptospira interrogans serovar lai str. 56601
cuucaaguuugugagagu

SEQ ID NO: 2768459 - RNA, 16 nt, Leptospira interrogans serovar lai str. 56601
cuucaauaucuuuauu

SEQ ID NO: 2768460 - RNA, 13 nt, Leptospira interrogans serovar lai str. 56601
cuucaaugaggaa

SEQ ID NO: 2768461 - RNA, 13 nt, Leptospira interrogans serovar lai str. 56601
cuucacuucuuuu

SEQ ID NO: 2768462 - RNA, 18 nt, Leptospira interrogans serovar lai str. 56601
cuucagcagucugugauu

SEQ ID NO: 2768463 - RNA, 14 nt, Leptospira interrogans serovar lai str. 56601
cuucagccgcuuca

SEQ ID NO: 2768464 - RNA, 15 nt, Leptospira interrogans serovar lai str. 56601
cuucagccgcuucau

SEQ ID NO: 2768465 - RNA, 16 nt, Leptospira interrogans serovar lai str. 56601
cuucauaucaaauuca

SEQ ID NO: 2768466 - RNA, 15 nt, Leptospira interrogans serovar lai str. 56601
cuucauccagauuca

SEQ ID NO: 2768467 - RNA, 21 nt, Leptospira interrogans serovar lai str. 56601
cuucaucuauuccguacuguu

SEQ ID NO: 2768468 - RNA, 15 nt, Leptospira interrogans serovar lai str. 56601
cuucaugagaaacaa

SEQ ID NO: 2768469 - RNA, 15 nt, Leptospira interrogans serovar lai str. 56601
cuucauuaaacaauu

SEQ ID NO: 2768470 - RNA, 23 nt, Leptospira interrogans serovar lai str. 56601
cuucauuaaacaauuuuucaaga

SEQ ID NO: 2768471 - RNA, 15 nt, Leptospira interrogans serovar lai str. 56601
cuucauuaauuuuug

SEQ ID NO: 2768472 - RNA, 23 nt, Leptospira interrogans serovar lai str. 56601
cuucauuaauuuuugaguagaag

SEQ ID NO: 2768473 - RNA, 13 nt, Leptospira interrogans serovar lai str. 56601
cuucauuuuggga

SEQ ID NO: 2768474 - RNA, 13 nt, Leptospira interrogans serovar lai str. 56601
cuuuaagaaaauu

SEQ ID NO: 2768475 - RNA, 15 nt, Leptospira interrogans serovar lai str. 56601
cuuuaagauauugag

SEQ ID NO: 2768476 - RNA, 14 nt, Leptospira interrogans serovar lai str. 56601
cuuuaagugaacca

SEQ ID NO: 2768477 - RNA, 17 nt, Leptospira interrogans serovar lai str. 56601
cuuuaagugaaccucug

SEQ ID NO: 2768478 - RNA, 18 nt, Leptospira interrogans serovar lai str. 56601
cuuuaaguuugugagagu

SEQ ID NO: 2768479 - RNA, 12 nt, Leptospira interrogans serovar lai str. 56601
cuuuaauauuuu

SEQ ID NO: 2768480 - RNA, 14 nt, Leptospira interrogans serovar lai str. 56601
cuuuaaucauuuuc

SEQ ID NO: 2768481 - RNA, 21 nt, Leptospira interrogans serovar lai str. 56601
cuuuaaugagucugucccaaa

SEQ ID NO: 2768482 - RNA, 21 nt, Leptospira interrogans serovar lai str. 56601
cuuuacaauuugcuaaaauaa

SEQ ID NO: 2768483 - RNA, 16 nt, Leptospira interrogans serovar lai str. 56601
cuuuacacgauaauuu

SEQ ID NO: 2768484 - RNA, 18 nt, Leptospira interrogans serovar lai str. 56601
cuuuacacgauaauuuuu

SEQ ID NO: 2768485 - RNA, 21 nt, Leptospira interrogans serovar lai str. 56601
cuuuacagacugauuuuuuaa

SEQ ID NO: 2768486 - RNA, 15 nt, Leptospira interrogans serovar lai str. 56601
cuuuacagaucaauu

SEQ ID NO: 2768487 - RNA, 20 nt, Leptospira interrogans serovar lai str. 56601
cuuuacagaucaauucuuua

SEQ ID NO: 2768488 - RNA, 21 nt, Leptospira interrogans serovar lai str. 56601
cuuuacauaauaauacagaau

SEQ ID NO: 2768489 - RNA, 18 nt, Leptospira interrogans serovar lai str. 56601
cuuuacaucaauuauuuu

SEQ ID NO: 2768490 - RNA, 21 nt, Leptospira interrogans serovar lai str. 56601
cuuuacauuuuuaucuugauc

SEQ ID NO: 2768491 - RNA, 16 nt, Leptospira interrogans serovar lai str. 56601
cuuuaccauaaauuuu

SEQ ID NO: 2768492 - RNA, 17 nt, Leptospira interrogans serovar lai str. 56601
cuuuaccauaaauuuuu

SEQ ID NO: 2768493 - RNA, 15 nt, Leptospira interrogans serovar lai str. 56601
cuuuaccgaauuuag

SEQ ID NO: 2768494 - RNA, 20 nt, Leptospira interrogans serovar lai str. 56601
cuuuaccgucaauuuuuagu

SEQ ID NO: 2768495 - RNA, 14 nt, Leptospira interrogans serovar lai str. 56601
cuuuagaaauuuuu

SEQ ID NO: 2768496 - RNA, 16 nt, Leptospira interrogans serovar lai str. 56601
cuuuagaaauuuuuaa

SEQ ID NO: 2768497 - RNA, 16 nt, Leptospira interrogans serovar lai str. 56601
cuuuagaauuuuucga

SEQ ID NO: 2768498 - RNA, 15 nt, Leptospira interrogans serovar lai str. 56601
cuuuaguuuccaaaa

SEQ ID NO: 2768499 - RNA, 16 nt, Leptospira interrogans serovar lai str. 56601
cuuuaguuuccaaaaa

SEQ ID NO: 2768500 - RNA, 11 nt, Leptospira interrogans serovar lai str. 56601
cuuuauaaaau

SEQ ID NO: 2768501 - RNA, 19 nt, Leptospira interrogans serovar lai str. 56601
cuuuauagaaaauuuuuuc

SEQ ID NO: 2768502 - RNA, 21 nt, Leptospira interrogans serovar lai str. 56601
cuuuauagaaaauuuuuucuc

SEQ ID NO: 2768503 - RNA, 13 nt, Leptospira interrogans serovar lai str. 56601
cuuuauagaauuc

SEQ ID NO: 2768504 - RNA, 18 nt, Leptospira interrogans serovar lai str. 56601
cuuuauagagauuuccua

SEQ ID NO: 2768505 - RNA, 21 nt, Leptospira interrogans serovar lai str. 56601
cuuuauagguucuggauuuaa

SEQ ID NO: 2768506 - RNA, 16 nt, Leptospira interrogans serovar lai str. 56601
cuuuaucuuuauaaaa

SEQ ID NO: 2768507 - RNA, 17 nt, Leptospira interrogans serovar lai str. 56601
cuuuaucuuuauaaaaa

SEQ ID NO: 2768508 - RNA, 17 nt, Leptospira interrogans serovar lai str. 56601
cuuuauggaaauuucau

SEQ ID NO: 2768509 - RNA, 15 nt, Leptospira interrogans serovar lai str. 56601
cuuuauuaaaaaguu

SEQ ID NO: 2768510 - RNA, 18 nt, Leptospira interrogans serovar lai str. 56601
cuuuauucaaaauagaau

SEQ ID NO: 2768511 - RNA, 21 nt, Leptospira interrogans serovar lai str. 56601
cuuuauucaaaauagaauaaa

SEQ ID NO: 2768512 - RNA, 13 nt, Leptospira interrogans serovar lai str. 56601
cuuuauuuaaaaa

SEQ ID NO: 2768513 - RNA, 14 nt, Leptospira interrogans serovar lai str. 56601
cuuuauuuaaaaac

SEQ ID NO: 2768514 - RNA, 22 nt, Leptospira interrogans serovar lai str. 56601
cuuuauuuaauaaaauuuuuaa

SEQ ID NO: 2768515 - RNA, 14 nt, Leptospira interrogans serovar lai str. 56601
cuuuauuuguauuc

SEQ ID NO: 2768516 - RNA, 18 nt, Leptospira interrogans serovar lai str. 56601
cuuucaaaaauuuaaguc

SEQ ID NO: 2768517 - RNA, 20 nt, Leptospira interrogans serovar lai str. 56601
cuuucaaagaauauaaaauc

SEQ ID NO: 2768518 - RNA, 23 nt, Leptospira interrogans serovar lai str. 56601
cuuucaagaauuuauuuacaauc

SEQ ID NO: 2768519 - RNA, 23 nt, Leptospira interrogans serovar lai str. 56601
cuuucagccccagucuauaaauu

SEQ ID NO: 2768520 - RNA, 16 nt, Leptospira interrogans serovar lai str. 56601
cuuucauaggaugaau

SEQ ID NO: 2768521 - RNA, 22 nt, Leptospira interrogans serovar lai str. 56601
cuuucauuuuuccauaaaaaac

SEQ ID NO: 2768522 - RNA, 17 nt, Leptospira interrogans serovar lai str. 56601
cuuuccagaaagaaguu

SEQ ID NO: 2768523 - RNA, 22 nt, Leptospira interrogans serovar lai str. 56601
cuuuccaucguuuaagaauuuu

SEQ ID NO: 2768524 - RNA, 20 nt, Leptospira interrogans serovar lai str. 56601
cuuuccgggucgauuuugau

SEQ ID NO: 2768525 - RNA, 18 nt, Leptospira interrogans serovar lai str. 56601
cuuuccgucuuuuaggua

SEQ ID NO: 2768526 - RNA, 14 nt, Leptospira interrogans serovar lai str. 56601
cuuuccuauaaaag

SEQ ID NO: 2768527 - RNA, 21 nt, Leptospira interrogans serovar lai str. 56601
cuuuccuuuucgaauuuccuu

SEQ ID NO: 2768528 - RNA, 17 nt, Leptospira interrogans serovar lai str. 56601
cuuucgaccuuaacucu

SEQ ID NO: 2768529 - RNA, 18 nt, Leptospira interrogans serovar lai str. 56601
cuuucgauuuuaaauaaa

SEQ ID NO: 2768530 - RNA, 14 nt, Leptospira interrogans serovar lai str. 56601
cuuucgcauuuguu

SEQ ID NO: 2768531 - RNA, 15 nt, Leptospira interrogans serovar lai str. 56601
cuuucgcauuuguug

SEQ ID NO: 2768532 - RNA, 19 nt, Leptospira interrogans serovar lai str. 56601
cuuucgcuuggaaauaucu

SEQ ID NO: 2768533 - RNA, 20 nt, Leptospira interrogans serovar lai str. 56601
cuuucuaaaugaguuuuaga

SEQ ID NO: 2768534 - RNA, 23 nt, Leptospira interrogans serovar lai str. 56601
cuuucuauagccaaguauaaaag

SEQ ID NO: 2768535 - RNA, 14 nt, Leptospira interrogans serovar lai str. 56601
cuuucuauuuuuuc

SEQ ID NO: 2768536 - RNA, 21 nt, Leptospira interrogans serovar lai str. 56601
cuuucucuuuuuagacaaaaa

SEQ ID NO: 2768537 - RNA, 21 nt, Leptospira interrogans serovar lai str. 56601
cuuucuuaaauuuuuuuucag

SEQ ID NO: 2768538 - RNA, 21 nt, Leptospira interrogans serovar lai str. 56601
cuuucuuccaauuguuccacu

SEQ ID NO: 2768539 - RNA, 22 nt, Leptospira interrogans serovar lai str. 56601
cuuucuuugaacuuuuucaagu

SEQ ID NO: 2768540 - RNA, 13 nt, Leptospira interrogans serovar lai str. 56601
cuuugaaaaaauu

SEQ ID NO: 2768541 - RNA, 16 nt, Leptospira interrogans serovar lai str. 56601
cuuugaaaaaauuuuu

SEQ ID NO: 2768542 - RNA, 17 nt, Leptospira interrogans serovar lai str. 56601
cuuugaaaaaauuuuuu

SEQ ID NO: 2768543 - RNA, 19 nt, Leptospira interrogans serovar lai str. 56601
cuuugaaaaagguuggaau

SEQ ID NO: 2768544 - RNA, 13 nt, Leptospira interrogans serovar lai str. 56601
cuuugaaaauuuu

SEQ ID NO: 2768545 - RNA, 19 nt, Leptospira interrogans serovar lai str. 56601
cuuugaaccacaguuccua

SEQ ID NO: 2768546 - RNA, 22 nt, Leptospira interrogans serovar lai str. 56601
cuuugaacuuguccuaaaauuu

SEQ ID NO: 2768547 - RNA, 15 nt, Leptospira interrogans serovar lai str. 56601
cuuugaacuuuuuca

SEQ ID NO: 2768548 - RNA, 12 nt, Leptospira interrogans serovar lai str. 56601
cuuugaaugaaa

SEQ ID NO: 2768549 - RNA, 22 nt, Leptospira interrogans serovar lai str. 56601
cuuugaaugaaaagauuucaaa

SEQ ID NO: 2768550 - RNA, 19 nt, Leptospira interrogans serovar lai str. 56601
cuuugaaugacacaaaaaa

SEQ ID NO: 2768551 - RNA, 23 nt, Leptospira interrogans serovar lai str. 56601
cuuugaaugcaacgaaaucaaug

SEQ ID NO: 2768552 - RNA, 15 nt, Leptospira interrogans serovar lai str. 56601
cuuugaauugaaaug

SEQ ID NO: 2768553 - RNA, 18 nt, Leptospira interrogans serovar lai str. 56601
cuuugagaaaauuuuuuu

SEQ ID NO: 2768554 - RNA, 22 nt, Leptospira interrogans serovar lai str. 56601
cuuugagaagcggguuuuucuu

SEQ ID NO: 2768555 - RNA, 20 nt, Leptospira interrogans serovar lai str. 56601
cuuugagaugugggaacuac

SEQ ID NO: 2768556 - RNA, 21 nt, Leptospira interrogans serovar lai str. 56601
cuuugcaaaucgauuucuaaa

SEQ ID NO: 2768557 - RNA, 20 nt, Leptospira interrogans serovar lai str. 56601
cuuuuucaaaauaagaauuu

SEQ ID NO: 2768558 - RNA, 14 nt, Leptospira interrogans serovar lai str. 56601
cuuuuucuagguuu

SEQ ID NO: 2768559 - RNA, 23 nt, Leptospira interrogans serovar lai str. 56601
cuuuuucuagguuuaaacuuaua

SEQ ID NO: 2768560 - RNA, 14 nt, Leptospira interrogans serovar lai str. 56601
cuuuuucuucugcu

SEQ ID NO: 2768561 - RNA, 17 nt, Leptospira interrogans serovar lai str. 56601
cuuuuucuuuuuuuaaa

SEQ ID NO: 2768562 - RNA, 18 nt, Leptospira interrogans serovar lai str. 56601
cuuuuugcgauuuugaaa

SEQ ID NO: 2768563 - RNA, 15 nt, Leptospira interrogans serovar lai str. 56601
cuuuuuguaaggauu

SEQ ID NO: 2768564 - RNA, 20 nt, Leptospira interrogans serovar lai str. 56601
cuuuuuguaaggauuccuuu

SEQ ID NO: 2768565 - RNA, 11 nt, Leptospira interrogans serovar lai str. 56601
cuuuuuuaaac

SEQ ID NO: 2768566 - RNA, 12 nt, Leptospira interrogans serovar lai str. 56601
cuuuuuuaaacc

SEQ ID NO: 2768567 - RNA, 15 nt, Leptospira interrogans serovar lai str. 56601
cuuuuuuaaagugau

SEQ ID NO: 2768568 - RNA, 20 nt, Leptospira interrogans serovar lai str. 56601
cuuuuuuaagaaucucaaaa

SEQ ID NO: 2768569 - RNA, 23 nt, Leptospira interrogans serovar lai str. 56601
cuuuuuuaauuauguuugccauu

SEQ ID NO: 2768570 - RNA, 16 nt, Leptospira interrogans serovar lai str. 56601
cuuuuuuauuuuaaca

SEQ ID NO: 2768571 - RNA, 13 nt, Leptospira interrogans serovar lai str. 56601
cuuuuuucagaaa

SEQ ID NO: 2768572 - RNA, 14 nt, Leptospira interrogans serovar lai str. 56601
cuuuuuucagaauc

SEQ ID NO: 2768573 - RNA, 21 nt, Leptospira interrogans serovar lai str. 56601
cuuuuuucguuucgaaaauuu

SEQ ID NO: 2768574 - RNA, 20 nt, Leptospira interrogans serovar lai str. 56601
cuuuuuugacuucggaacau

SEQ ID NO: 2768575 - RNA, 15 nt, Leptospira interrogans serovar lai str. 56601
cuuuuuuguaaguuu

SEQ ID NO: 2768576 - RNA, 15 nt, Leptospira interrogans serovar lai str. 56601
cuuuuuuuaaaaaau

SEQ ID NO: 2768577 - RNA, 12 nt, Leptospira interrogans serovar lai str. 56601
cuuuuuuuacuu

SEQ ID NO: 2768578 - RNA, 15 nt, Leptospira interrogans serovar lai str. 56601
cuuuuuuuacuucua

SEQ ID NO: 2768579 - RNA, 14 nt, Leptospira interrogans serovar lai str. 56601
cuuuuuuucauuug

SEQ ID NO: 2768580 - RNA, 17 nt, Leptospira interrogans serovar lai str. 56601
cuuuuuuucuuuuaaaa

SEQ ID NO: 2768581 - RNA, 15 nt, Leptospira interrogans serovar lai str. 56601
cuuuuuuuucuaaaa

SEQ ID NO: 2768582 - RNA, 19 nt, Leptospira interrogans serovar lai str. 56601
cuuuuuuuucuaaaauauu

SEQ ID NO: 2768583 - RNA, 22 nt, Leptospira interrogans serovar lai str. 56601
gaaaaaaaaagaauuucuaaaa

SEQ ID NO: 2768584 - RNA, 12 nt, Leptospira interrogans serovar lai str. 56601
gaaaaaaaaauu

SEQ ID NO: 2768585 - RNA, 11 nt, Leptospira interrogans serovar lai str. 56601
gaaaaaaagua

SEQ ID NO: 2768586 - RNA, 14 nt, Leptospira interrogans serovar lai str. 56601
gaaaaaaaguauau

SEQ ID NO: 2768587 - RNA, 13 nt, Leptospira interrogans serovar lai str. 56601
gaaaaaaauuaga

SEQ ID NO: 2768588 - RNA, 20 nt, Leptospira interrogans serovar lai str. 56601
gaaaaaaauuagaaucugaa

SEQ ID NO: 2768589 - RNA, 16 nt, Leptospira interrogans serovar lai str. 56601
gaaaaaagcagcuaaa

SEQ ID NO: 2768590 - RNA, 22 nt, Leptospira interrogans serovar lai str. 56601
gaaaaaaguuagaaucuaaacu

SEQ ID NO: 2768591 - RNA, 20 nt, Leptospira interrogans serovar lai str. 56601
gaaaaaaguugaaaucugaa

SEQ ID NO: 2768592 - RNA, 16 nt, Leptospira interrogans serovar lai str. 56601
gaaaaaaguugcuaag

SEQ ID NO: 2768593 - RNA, 20 nt, Leptospira interrogans serovar lai str. 56601
gaaaaaaguuggaaucugaa

SEQ ID NO: 2768594 - RNA, 21 nt, Leptospira interrogans serovar lai str. 56601
gaaaaaaguuggaauuugaau

SEQ ID NO: 2768595 - RNA, 14 nt, Leptospira interrogans serovar lai str. 56601
gaaaaaaguuggga

SEQ ID NO: 2768596 - RNA, 16 nt, Leptospira interrogans serovar lai str. 56601
gaaaaaauccauaucu

SEQ ID NO: 2768597 - RNA, 15 nt, Leptospira interrogans serovar lai str. 56601
gaaaaaauuuuucuu

SEQ ID NO: 2768598 - RNA, 18 nt, Leptospira interrogans serovar lai str. 56601
gaaaaaauuuuucuuaau

SEQ ID NO: 2768599 - RNA, 16 nt, Leptospira interrogans serovar lai str. 56601
gaaaaacucagugaau

SEQ ID NO: 2768600 - RNA, 21 nt, Leptospira interrogans serovar lai str. 56601
gaaaaagaaacggaagaaaau

SEQ ID NO: 2768601 - RNA, 18 nt, Leptospira interrogans serovar lai str. 56601
gaaaaagaauuuuuaaaa

SEQ ID NO: 2768602 - RNA, 22 nt, Leptospira interrogans serovar lai str. 56601
gaaaaagaauuuuuaaaaauau

SEQ ID NO: 2768603 - RNA, 20 nt, Leptospira interrogans serovar lai str. 56601
gaaaaagcgucaacugaaac

SEQ ID NO: 2768604 - RNA, 15 nt, Leptospira interrogans serovar lai str. 56601
gaaaaagggauucua

SEQ ID NO: 2768605 - RNA, 19 nt, Leptospira interrogans serovar lai str. 56601
gaaaaaguuagaaucugaa

SEQ ID NO: 2768606 - RNA, 21 nt, Leptospira interrogans serovar lai str. 56601
gaaaaauaagguuuuauaaaa

SEQ ID NO: 2768607 - RNA, 19 nt, Leptospira interrogans serovar lai str. 56601
gaaaaauauuauauuuuua

SEQ ID NO: 2768608 - RNA, 16 nt, Leptospira interrogans serovar lai str. 56601
gaaaaaucuucaguuc

SEQ ID NO: 2768609 - RNA, 20 nt, Leptospira interrogans serovar lai str. 56601
gaaaaauuaaaauucuagaa

SEQ ID NO: 2768610 - RNA, 14 nt, Leptospira interrogans serovar lai str. 56601
gaaaaauuaaaugg

SEQ ID NO: 2768611 - RNA, 17 nt, Leptospira interrogans serovar lai str. 56601
gaaaaauuaauucucca

SEQ ID NO: 2768612 - RNA, 20 nt, Leptospira interrogans serovar lai str. 56601
gaaaaauuucauaguucaau

SEQ ID NO: 2768613 - RNA, 12 nt, Leptospira interrogans serovar lai str. 56601
gaaaaauuuccc

SEQ ID NO: 2768614 - RNA, 16 nt, Leptospira interrogans serovar lai str. 56601
gaaaaauuucuuuguc

SEQ ID NO: 2768615 - RNA, 16 nt, Leptospira interrogans serovar lai str. 56601
gaaaacagaucaagaa

SEQ ID NO: 2768616 - RNA, 18 nt, Leptospira interrogans serovar lai str. 56601
gaaaaccaaauaauaaaa

SEQ ID NO: 2768617 - RNA, 22 nt, Leptospira interrogans serovar lai str. 56601
gaaaaccaugauucugaaaaaa

SEQ ID NO: 2768618 - RNA, 20 nt, Leptospira interrogans serovar lai str. 56601
gaaaacgagaaagaauuucc

SEQ ID NO: 2768619 - RNA, 15 nt, Leptospira interrogans serovar lai str. 56601
gaaaacgauuuuuca

SEQ ID NO: 2768620 - RNA, 14 nt, Leptospira interrogans serovar lai str. 56601
gaaaacucaacaca

SEQ ID NO: 2768621 - RNA, 20 nt, Leptospira interrogans serovar lai str. 56601
gaaaacucaacacaacggcu

SEQ ID NO: 2768622 - RNA, 15 nt, Leptospira interrogans serovar lai str. 56601
gaaaacucaucacaa

SEQ ID NO: 2768623 - RNA, 19 nt, Leptospira interrogans serovar lai str. 56601
gaaaacuugguuggauucc

SEQ ID NO: 2768624 - RNA, 16 nt, Leptospira interrogans serovar lai str. 56601
gaaaacuuguuuuaga

SEQ ID NO: 2768625 - RNA, 20 nt, Leptospira interrogans serovar lai str. 56601
gaaaagaaacaguauauuau

SEQ ID NO: 2768626 - RNA, 13 nt, Leptospira interrogans serovar lai str. 56601
gaaaagaaauauu

SEQ ID NO: 2768627 - RNA, 20 nt, Leptospira interrogans serovar lai str. 56601
gaaaagaaucguuuuuuuug

SEQ ID NO: 2768628 - RNA, 13 nt, Leptospira interrogans serovar lai str. 56601
gaaaaggaaggag

SEQ ID NO: 2768629 - RNA, 23 nt, Leptospira interrogans serovar lai str. 56601
gaaaaggcugucuucagcagucu

SEQ ID NO: 2768630 - RNA, 19 nt, Leptospira interrogans serovar lai str. 56601
gaaaagguuaaaaauuuaa

SEQ ID NO: 2768631 - RNA, 16 nt, Leptospira interrogans serovar lai str. 56601
gaaaagucgaaagaau

SEQ ID NO: 2768632 - RNA, 15 nt, Leptospira interrogans serovar lai str. 56601
gaaaaguuuuuaaaa

SEQ ID NO: 2768633 - RNA, 13 nt, Leptospira interrogans serovar lai str. 56601
gaaaauaaaaaau

SEQ ID NO: 2768634 - RNA, 15 nt, Leptospira interrogans serovar lai str. 56601
gaaaauaaaaaucau

SEQ ID NO: 2768635 - RNA, 19 nt, Leptospira interrogans serovar lai str. 56601
gaaaauacgcuucucuugc

SEQ ID NO: 2768636 - RNA, 13 nt, Leptospira interrogans serovar lai str. 56601
gaaaauagauaga

SEQ ID NO: 2768637 - RNA, 15 nt, Leptospira interrogans serovar lai str. 56601
gaaaauagauagaga

SEQ ID NO: 2768638 - RNA, 19 nt, Leptospira interrogans serovar lai str. 56601
gaaaauagauagagaauua

SEQ ID NO: 2768639 - RNA, 20 nt, Leptospira interrogans serovar lai str. 56601
gaaaaucgaguguaauauga

SEQ ID NO: 2768640 - RNA, 19 nt, Leptospira interrogans serovar lai str. 56601
gaaauaucguucuagaauu

SEQ ID NO: 2768641 - RNA, 24 nt, Leptospira interrogans serovar lai str. 56601
gaaauauuaaaaaaauaauauauu

SEQ ID NO: 2768642 - RNA, 23 nt, Leptospira interrogans serovar lai str. 56601
gaaauauugaauccaucugagaa

SEQ ID NO: 2768643 - RNA, 15 nt, Leptospira interrogans serovar lai str. 56601
gaaaucaauucuucu

SEQ ID NO: 2768644 - RNA, 23 nt, Leptospira interrogans serovar lai str. 56601
gaaaucaauucuucuuucguuug

SEQ ID NO: 2768645 - RNA, 18 nt, Leptospira interrogans serovar lai str. 56601
gaaaucagagucuauuua

SEQ ID NO: 2768646 - RNA, 19 nt, Leptospira interrogans serovar lai str. 56601
gaaaucauauggauuaucc

SEQ ID NO: 2768647 - RNA, 14 nt, Leptospira interrogans serovar lai str. 56601
gaaaucgaaaacca

SEQ ID NO: 2768648 - RNA, 16 nt, Leptospira interrogans serovar lai str. 56601
gaaaucgauuuguaaa

SEQ ID NO: 2768649 - RNA, 15 nt, Leptospira interrogans serovar lai str. 56601
gaaaucuaaauuugu

SEQ ID NO: 2768650 - RNA, 15 nt, Leptospira interrogans serovar lai str. 56601
gaaaucuaguucaac

SEQ ID NO: 2768651 - RNA, 11 nt, Leptospira interrogans serovar lai str. 56601
gaaaucugaac

SEQ ID NO: 2768652 - RNA, 10 nt, Leptospira interrogans serovar lai str. 56601
gaaaucugac

SEQ ID NO: 2768653 - RNA, 21 nt, Leptospira interrogans serovar lai str. 56601
gaaaucuuaggacggauuuua

SEQ ID NO: 2768654 - RNA, 17 nt, Leptospira interrogans serovar lai str. 56601
gaaaucuuuuaaaaaag

SEQ ID NO: 2768655 - RNA, 18 nt, Leptospira interrogans serovar lai str. 56601
gaaauggauggaaaauga

SEQ ID NO: 2768656 - RNA, 15 nt, Leptospira interrogans serovar lai str. 56601
gaaauguaggaacuc

SEQ ID NO: 2768657 - RNA, 16 nt, Leptospira interrogans serovar lai str. 56601
gaaauguaggaacuca

SEQ ID NO: 2768658 - RNA, 15 nt, Leptospira interrogans serovar lai str. 56601
gaaaugugggaacuc

SEQ ID NO: 2768659 - RNA, 16 nt, Leptospira interrogans serovar lai str. 56601
gaaaugugggaccugg

SEQ ID NO: 2768660 - RNA, 16 nt, Leptospira interrogans serovar lai str. 56601
gaaauuaauuucuaaa

SEQ ID NO: 2768661 - RNA, 12 nt, Leptospira interrogans serovar lai str. 56601
gaaauuauagua

SEQ ID NO: 2768662 - RNA, 15 nt, Leptospira interrogans serovar lai str. 56601
gaaauucaaugacaa

SEQ ID NO: 2768663 - RNA, 19 nt, Leptospira interrogans serovar lai str. 56601
gaaauucaucaaauuugcu

SEQ ID NO: 2768664 - RNA, 21 nt, Leptospira interrogans serovar lai str. 56601
gaaauuccuacaguuuuagaa

SEQ ID NO: 2768665 - RNA, 17 nt, Leptospira interrogans serovar lai str. 56601
gaaauucguuuuaucuu

SEQ ID NO: 2768666 - RNA, 13 nt, Leptospira interrogans serovar lai str. 56601
gaaauucucuuuu

SEQ ID NO: 2768667 - RNA, 21 nt, Leptospira interrogans serovar lai str. 56601
gaaauucuuuuccaaaaacuu

SEQ ID NO: 2768668 - RNA, 17 nt, Leptospira interrogans serovar lai str. 56601
gaaauugugagaacuac

SEQ ID NO: 2768669 - RNA, 23 nt, Leptospira interrogans serovar lai str. 56601
gaaauuuauaauauucuuuuaua

SEQ ID NO: 2768670 - RNA, 21 nt, Leptospira interrogans serovar lai str. 56601
gaaauuuccacuucaaaaaga

SEQ ID NO: 2768671 - RNA, 19 nt, Leptospira interrogans serovar lai str. 56601
gaaauuucuaauaaaauau

SEQ ID NO: 2768672 - RNA, 19 nt, Leptospira interrogans serovar lai str. 56601
gaaauuuuaaucuucuugu

SEQ ID NO: 2768673 - RNA, 18 nt, Leptospira interrogans serovar lai str. 56601
gaaauuuuacacguaauu

SEQ ID NO: 2768674 - RNA, 17 nt, Leptospira interrogans serovar lai str. 56601
gaaauuuuacaguaaaa

SEQ ID NO: 2768675 - RNA, 19 nt, Leptospira interrogans serovar lai str. 56601
gaaauuuucuuagaaaacu

SEQ ID NO: 2768676 - RNA, 14 nt, Leptospira interrogans serovar lai str. 56601
gaaauuuuguuauc

SEQ ID NO: 2768677 - RNA, 16 nt, Leptospira interrogans serovar lai str. 56601
gaaauuuuuaauaaaa

SEQ ID NO: 2768678 - RNA, 17 nt, Leptospira interrogans serovar lai str. 56601
gaaauuuuuaauaacau

SEQ ID NO: 2768679 - RNA, 15 nt, Leptospira interrogans serovar lai str. 56601
gaaauuuuuaaucaa

SEQ ID NO: 2768680 - RNA, 17 nt, Leptospira interrogans serovar lai str. 56601
gaaauuuuuaaucaaau

SEQ ID NO: 2768681 - RNA, 15 nt, Leptospira interrogans serovar lai str. 56601
gaaauuuuuguacaa

SEQ ID NO: 2768682 - RNA, 11 nt, Leptospira interrogans serovar lai str. 56601
gaacaaauucu

SEQ ID NO: 2768683 - RNA, 14 nt, Leptospira interrogans serovar lai str. 56601
gaacaaauucuaaa

SEQ ID NO: 2768684 - RNA, 16 nt, Leptospira interrogans serovar lai str. 56601
gaacaaauucuaaacu

SEQ ID NO: 2768685 - RNA, 19 nt, Leptospira interrogans serovar lai str. 56601
gaacaagaugggcacugaa

SEQ ID NO: 2768686 - RNA, 20 nt, Leptospira interrogans serovar lai str. 56601
gaacaaucuucgguauuuuu

SEQ ID NO: 2768687 - RNA, 21 nt, Leptospira interrogans serovar lai str. 56601
gaacaaugaauuuuuauaaaa

SEQ ID NO: 2768688 - RNA, 16 nt, Leptospira interrogans serovar lai str. 56601
gaacaauuuaaaauaa

SEQ ID NO: 2768689 - RNA, 14 nt, Leptospira interrogans serovar lai str. 56601
gaacacgucuuaaa

SEQ ID NO: 2768690 - RNA, 21 nt, Leptospira interrogans serovar lai str. 56601
gaacacugcauuuuauuaaaa

SEQ ID NO: 2768691 - RNA, 16 nt, Leptospira interrogans serovar lai str. 56601
gaacacuugaaaaaug

SEQ ID NO: 2768692 - RNA, 17 nt, Leptospira interrogans serovar lai str. 56601
gaacacuugaaaaaugu

SEQ ID NO: 2768693 - RNA, 17 nt, Leptospira interrogans serovar lai str. 56601
gaacaguuuggcauuua

SEQ ID NO: 2768694 - RNA, 22 nt, Leptospira interrogans serovar lai str. 56601
gaacauaaguuacucauuucca

SEQ ID NO: 2768695 - RNA, 16 nt, Leptospira interrogans serovar lai str. 56601
gaacauuccauaauga

SEQ ID NO: 2768696 - RNA, 17 nt, Leptospira interrogans serovar lai str. 56601
gaaccaucucaaaaaua

SEQ ID NO: 2768697 - RNA, 18 nt, Leptospira interrogans serovar lai str. 56601
gaaccaucucaaaaauau

SEQ ID NO: 2768698 - RNA, 20 nt, Leptospira interrogans serovar lai str. 56601
gaaccaucucaaaaauaucu

SEQ ID NO: 2768699 - RNA, 12 nt, Leptospira interrogans serovar lai str. 56601
gaaccauuucaa

SEQ ID NO: 2768700 - RNA, 18 nt, Leptospira interrogans serovar lai str. 56601
gaaccauuugaaaaaggg

SEQ ID NO: 2768701 - RNA, 20 nt, Leptospira interrogans serovar lai str. 56601
gaacccagucuucuuguaau

SEQ ID NO: 2768702 - RNA, 23 nt, Leptospira interrogans serovar lai str. 56601
gaacccauggcuuugaaaaaggu

SEQ ID NO: 2768703 - RNA, 19 nt, Leptospira interrogans serovar lai str. 56601
gaaccgggcaauaaugucc

SEQ ID NO: 2768704 - RNA, 15 nt, Leptospira interrogans serovar lai str. 56601
gaaccguaacugaca

SEQ ID NO: 2768705 - RNA, 14 nt, Leptospira interrogans serovar lai str. 56601
gaaccuaaaaauau

SEQ ID NO: 2768706 - RNA, 19 nt, Leptospira interrogans serovar lai str. 56601
gaaccucaaagaaauuuua

SEQ ID NO: 2768707 - RNA, 15 nt, Leptospira interrogans serovar lai str. 56601
gaaccugauuuccaa

SEQ ID NO: 2768708 - RNA, 22 nt, Leptospira interrogans serovar lai str. 56601
gaacgaccccgucauuuacuca

SEQ ID NO: 2768709 - RNA, 17 nt, Leptospira interrogans serovar lai str. 56601
gaacgauccguaaaaau

SEQ ID NO: 2768710 - RNA, 23 nt, Leptospira interrogans serovar lai str. 56601
gaacgcaaucuguugagcgaccc

SEQ ID NO: 2768711 - RNA, 16 nt, Leptospira interrogans serovar lai str. 56601
gaacggauucuaauuu

SEQ ID NO: 2768712 - RNA, 18 nt, Leptospira interrogans serovar lai str. 56601
gaacuacacguuuuccua

SEQ ID NO: 2768713 - RNA, 14 nt, Leptospira interrogans serovar lai str. 56601
gaacuaccacaaaa

SEQ ID NO: 2768714 - RNA, 18 nt, Leptospira interrogans serovar lai str. 56601
gaacuaccacagaaagcu

SEQ ID NO: 2768715 - RNA, 16 nt, Leptospira interrogans serovar lai str. 56601
gaacuacuacaaaaau

SEQ ID NO: 2768716 - RNA, 14 nt, Leptospira interrogans serovar lai str. 56601
gaacuacuacuuuu

SEQ ID NO: 2768717 - RNA, 18 nt, Leptospira interrogans serovar lai str. 56601
gaacuacuauaaauuacu

SEQ ID NO: 2768718 - RNA, 23 nt, Leptospira interrogans serovar lai str. 56601
gaacuacuauaaauuacugauuu

SEQ ID NO: 2768719 - RNA, 13 nt, Leptospira interrogans serovar lai str. 56601
gaacuacuaugaa

SEQ ID NO: 2768720 - RNA, 13 nt, Leptospira interrogans serovar lai str. 56601
gaacuaugaaauu

SEQ ID NO: 2768721 - RNA, 20 nt, Leptospira interrogans serovar lai str. 56601
gaacuauuacaaaaucugaa

SEQ ID NO: 2768722 - RNA, 19 nt, Leptospira interrogans serovar lai str. 56601
gaacuauuauaaaauacaa

SEQ ID NO: 2768723 - RNA, 13 nt, Leptospira interrogans serovar lai str. 56601
gaauauaaaaucu

SEQ ID NO: 2768724 - RNA, 22 nt, Leptospira interrogans serovar lai str. 56601
gaauauaaaaucuuaaauuaga

SEQ ID NO: 2768725 - RNA, 14 nt, Leptospira interrogans serovar lai str. 56601
gaauauaaaauuuu

SEQ ID NO: 2768726 - RNA, 17 nt, Leptospira interrogans serovar lai str. 56601
gaauauaacuuuuucag

SEQ ID NO: 2768727 - RNA, 21 nt, Leptospira interrogans serovar lai str. 56601
gaauauaagaaaguauuaauu

SEQ ID NO: 2768728 - RNA, 15 nt, Leptospira interrogans serovar lai str. 56601
gaauauaagauuaug

SEQ ID NO: 2768729 - RNA, 21 nt, Leptospira interrogans serovar lai str. 56601
gaauauaagauuaugguaaaa

SEQ ID NO: 2768730 - RNA, 17 nt, Leptospira interrogans serovar lai str. 56601
gaauauaauaaaauuau

SEQ ID NO: 2768731 - RNA, 18 nt, Leptospira interrogans serovar lai str. 56601
gaauauagcacaaaugac

SEQ ID NO: 2768732 - RNA, 19 nt, Leptospira interrogans serovar lai str. 56601
gaauaucauaacaaauaaa

SEQ ID NO: 2768733 - RNA, 22 nt, Leptospira interrogans serovar lai str. 56601
gaauaucuaauauuuuuccagc

SEQ ID NO: 2768734 - RNA, 14 nt, Leptospira interrogans serovar lai str. 56601
gaauauuauaaaua

SEQ ID NO: 2768735 - RNA, 17 nt, Leptospira interrogans serovar lai str. 56601
gaauauuaugaaauaaa

SEQ ID NO: 2768736 - RNA, 17 nt, Leptospira interrogans serovar lai str. 56601
gaauauuauuauauuua

SEQ ID NO: 2768737 - RNA, 15 nt, Leptospira interrogans serovar lai str. 56601
gaauauucauucaga

SEQ ID NO: 2768738 - RNA, 13 nt, Leptospira interrogans serovar lai str. 56601
gaauauuccauuu

SEQ ID NO: 2768739 - RNA, 18 nt, Leptospira interrogans serovar lai str. 56601
gaauauucguaagaaaaa

SEQ ID NO: 2768740 - RNA, 19 nt, Leptospira interrogans serovar lai str. 56601
gaauauucguaagaaaaaa

SEQ ID NO: 2768741 - RNA, 18 nt, Leptospira interrogans serovar lai str. 56601
gaauauugagcuaauucu

SEQ ID NO: 2768742 - RNA, 22 nt, Leptospira interrogans serovar lai str. 56601
gaauauuucuucguuauuuuua

SEQ ID NO: 2768743 - RNA, 22 nt, Leptospira interrogans serovar lai str. 56601
gaauauuuucucaguaaaaugg

SEQ ID NO: 2768744 - RNA, 23 nt, Leptospira interrogans serovar lai str. 56601
gaaucaaaacggcagucauggaa

SEQ ID NO: 2768745 - RNA, 17 nt, Leptospira interrogans serovar lai str. 56601
gaaucaacuuuuccagc

SEQ ID NO: 2768746 - RNA, 22 nt, Leptospira interrogans serovar lai str. 56601
gaaucaauuuuagaauaaaucu

SEQ ID NO: 2768747 - RNA, 15 nt, Leptospira interrogans serovar lai str. 56601
gaaucagaaugaacu

SEQ ID NO: 2768748 - RNA, 13 nt, Leptospira interrogans serovar lai str. 56601
gaaucaugaauuc

SEQ ID NO: 2768749 - RNA, 11 nt, Leptospira interrogans serovar lai str. 56601
gaauccaaaag

SEQ ID NO: 2768750 - RNA, 11 nt, Leptospira interrogans serovar lai str. 56601
gaaucccaaau

SEQ ID NO: 2768751 - RNA, 16 nt, Leptospira interrogans serovar lai str. 56601
gaauccgaaaaaccuu

SEQ ID NO: 2768752 - RNA, 21 nt, Leptospira interrogans serovar lai str. 56601
gaauccgaauacaaagaaccg

SEQ ID NO: 2768753 - RNA, 18 nt, Leptospira interrogans serovar lai str. 56601
gaauccugcuaacugauu

SEQ ID NO: 2768754 - RNA, 13 nt, Leptospira interrogans serovar lai str. 56601
gaaucgaaaaguu

SEQ ID NO: 2768755 - RNA, 17 nt, Leptospira interrogans serovar lai str. 56601
gaaucgagcgaaagccg

SEQ ID NO: 2768756 - RNA, 20 nt, Leptospira interrogans serovar lai str. 56601
gaaucgaucuguaaaguuca

SEQ ID NO: 2768757 - RNA, 19 nt, Leptospira interrogans serovar lai str. 56601
gaaucgcucgcgaauuuca

SEQ ID NO: 2768758 - RNA, 17 nt, Leptospira interrogans serovar lai str. 56601
gaaucuaaacuuuguaa

SEQ ID NO: 2768759 - RNA, 13 nt, Leptospira interrogans serovar lai str. 56601
gaaucuaauuuca

SEQ ID NO: 2768760 - RNA, 14 nt, Leptospira interrogans serovar lai str. 56601
gaaucuauuuuuga

SEQ ID NO: 2768761 - RNA, 19 nt, Leptospira interrogans serovar lai str. 56601
gaaucuauuuuugauuuua

SEQ ID NO: 2768762 - RNA, 17 nt, Leptospira interrogans serovar lai str. 56601
gaaucucuuuuucucuu

SEQ ID NO: 2768763 - RNA, 19 nt, Leptospira interrogans serovar lai str. 56601
gaaucucuuuuucucuuug

SEQ ID NO: 2768764 - RNA, 19 nt, Leptospira interrogans serovar lai str. 56601
gaaucugccccaaaauuua

SEQ ID NO: 2768765 - RNA, 21 nt, Leptospira interrogans serovar lai str. 56601
gaaucuuaaaaagaguauuau

SEQ ID NO: 2768766 - RNA, 22 nt, Leptospira interrogans serovar lai str. 56601
gaaucuucauuuugggauuuua

SEQ ID NO: 2768767 - RNA, 18 nt, Leptospira interrogans serovar lai str. 56601
gaaucuuuuuaaaaguau

SEQ ID NO: 2768768 - RNA, 9 nt, Leptospira interrogans serovar lai str. 56601
gaaugaaaa

SEQ ID NO: 2768769 - RNA, 23 nt, Leptospira interrogans serovar lai str. 56601
gaaugaaaaaacuauuuaauaua

SEQ ID NO: 2768770 - RNA, 16 nt, Leptospira interrogans serovar lai str. 56601
gaaugaacucaacaga

SEQ ID NO: 2768771 - RNA, 15 nt, Leptospira interrogans serovar lai str. 56601
gaaugagucuuuuua

SEQ ID NO: 2768772 - RNA, 16 nt, Leptospira interrogans serovar lai str. 56601
gaaugaucaauagaau

SEQ ID NO: 2768773 - RNA, 22 nt, Leptospira interrogans serovar lai str. 56601
gaauguacuaaaauuuuauaaa

SEQ ID NO: 2768774 - RNA, 17 nt, Leptospira interrogans serovar lai str. 56601
gaauguucuuagacuca

SEQ ID NO: 2768775 - RNA, 21 nt, Leptospira interrogans serovar lai str. 56601
gaauguuugagguuuuaaaag

SEQ ID NO: 2768776 - RNA, 14 nt, Leptospira interrogans serovar lai str. 56601
gaauuaauucucca

SEQ ID NO: 2768777 - RNA, 18 nt, Leptospira interrogans serovar lai str. 56601
gaauuaauuuguaauucu

SEQ ID NO: 2768778 - RNA, 18 nt, Leptospira interrogans serovar lai str. 56601
gaauuaauuuuucaacaa

SEQ ID NO: 2768779 - RNA, 22 nt, Leptospira interrogans serovar lai str. 56601
gaauuaauuuuucaauaauucu

SEQ ID NO: 2768780 - RNA, 18 nt, Leptospira interrogans serovar lai str. 56601
gaauuaauuuuuuaaaaa

SEQ ID NO: 2768781 - RNA, 18 nt, Leptospira interrogans serovar lai str. 56601
gaauuacgacaaguccuc

SEQ ID NO: 2768782 - RNA, 13 nt, Leptospira interrogans serovar lai str. 56601
gaauuacuaugga

SEQ ID NO: 2768783 - RNA, 13 nt, Leptospira interrogans serovar lai str. 56601
gaauuaguaauau

SEQ ID NO: 2768784 - RNA, 19 nt, Leptospira interrogans serovar lai str. 56601
gaauucaauuuauaaacgg

SEQ ID NO: 2768785 - RNA, 15 nt, Leptospira interrogans serovar lai str. 56601
gaauucacaugguua

SEQ ID NO: 2768786 - RNA, 18 nt, Leptospira interrogans serovar lai str. 56601
gaauucacguuaaaauaa

SEQ ID NO: 2768787 - RNA, 22 nt, Leptospira interrogans serovar lai str. 56601
gaauucacguuauuuagaucaa

SEQ ID NO: 2768788 - RNA, 14 nt, Leptospira interrogans serovar lai str. 56601
gaauucagaaaaaa

SEQ ID NO: 2768789 - RNA, 22 nt, Leptospira interrogans serovar lai str. 56601
gaauucauuuuucuacaauuau

SEQ ID NO: 2768790 - RNA, 22 nt, Leptospira interrogans serovar lai str. 56601
gaauuccaucguuuauuuuucu

SEQ ID NO: 2768791 - RNA, 20 nt, Leptospira interrogans serovar lai str. 56601
gaauuccgacccagaaaaaa

SEQ ID NO: 2768792 - RNA, 23 nt, Leptospira interrogans serovar lai str. 56601
gaauuccgacccagaaaaaaccu

SEQ ID NO: 2768793 - RNA, 20 nt, Leptospira interrogans serovar lai str. 56601
gaauuccgggaauauucgua

SEQ ID NO: 2768794 - RNA, 13 nt, Leptospira interrogans serovar lai str. 56601
gaauucuaaaauu

SEQ ID NO: 2768795 - RNA, 19 nt, Leptospira interrogans serovar lai str. 56601
gaauucuccaauagaauug

SEQ ID NO: 2768796 - RNA, 20 nt, Leptospira interrogans serovar lai str. 56601
gaauucucuaucuuguuucu

SEQ ID NO: 2768797 - RNA, 11 nt, Leptospira interrogans serovar lai str. 56601
gaauucuuccu

SEQ ID NO: 2768798 - RNA, 19 nt, Leptospira interrogans serovar lai str. 56601
gaauucuuccuucuugaaa

SEQ ID NO: 2768799 - RNA, 22 nt, Leptospira interrogans serovar lai str. 56601
gaauucuuucuauuuuuuccga

SEQ ID NO: 2768800 - RNA, 22 nt, Leptospira interrogans serovar lai str. 56601
gaauucuuugaaccacaguucc

SEQ ID NO: 2768801 - RNA, 22 nt, Leptospira interrogans serovar lai str. 56601
gaauugaauuuuuuaaaugcac

SEQ ID NO: 2768802 - RNA, 23 nt, Leptospira interrogans serovar lai str. 56601
gaauugaucucauaaagacaaua

SEQ ID NO: 2768803 - RNA, 14 nt, Leptospira interrogans serovar lai str. 56601
gaauugccgauucu

SEQ ID NO: 2768804 - RNA, 17 nt, Leptospira interrogans serovar lai str. 56601
gaauuggcuucuuauua

SEQ ID NO: 2768805 - RNA, 19 nt, Leptospira interrogans serovar lai str. 56601
gaauuguguuaguucccac

SEQ ID NO: 2768806 - RNA, 15 nt, Leptospira interrogans serovar lai str. 56601
gacguccuuauaucc

SEQ ID NO: 2768807 - RNA, 13 nt, Leptospira interrogans serovar lai str. 56601
gacguuugaaaau

SEQ ID NO: 2768808 - RNA, 14 nt, Leptospira interrogans serovar lai str. 56601
gacuaaaauugaca

SEQ ID NO: 2768809 - RNA, 19 nt, Leptospira interrogans serovar lai str. 56601
gacuaaaauugacaaagag

SEQ ID NO: 2768810 - RNA, 20 nt, Leptospira interrogans serovar lai str. 56601
gacuaacgauuguaaaaaaa

SEQ ID NO: 2768811 - RNA, 14 nt, Leptospira interrogans serovar lai str. 56601
gacuacagaauaaa

SEQ ID NO: 2768812 - RNA, 17 nt, Leptospira interrogans serovar lai str. 56601
gacuacagaauaaagua

SEQ ID NO: 2768813 - RNA, 14 nt, Leptospira interrogans serovar lai str. 56601
gacuacgauuucau

SEQ ID NO: 2768814 - RNA, 13 nt, Leptospira interrogans serovar lai str. 56601
gacuauaaaguuu

SEQ ID NO: 2768815 - RNA, 22 nt, Leptospira interrogans serovar lai str. 56601
gacuauaaaguuuuaguuuaca

SEQ ID NO: 2768816 - RNA, 15 nt, Leptospira interrogans serovar lai str. 56601
gacuaucacaaaaau

SEQ ID NO: 2768817 - RNA, 17 nt, Leptospira interrogans serovar lai str. 56601
gacuaucgcaaauaaua

SEQ ID NO: 2768818 - RNA, 21 nt, Leptospira interrogans serovar lai str. 56601
gacuauuuuauuacaauuuua

SEQ ID NO: 2768819 - RNA, 16 nt, Leptospira interrogans serovar lai str. 56601
gacucacaccuucuuu

SEQ ID NO: 2768820 - RNA, 23 nt, Leptospira interrogans serovar lai str. 56601
gacucacaccuucuuuuuugcau

SEQ ID NO: 2768821 - RNA, 15 nt, Leptospira interrogans serovar lai str. 56601
gacucagaaaacuca

SEQ ID NO: 2768822 - RNA, 19 nt, Leptospira interrogans serovar lai str. 56601
gacucaguauguuguucuc

SEQ ID NO: 2768823 - RNA, 20 nt, Leptospira interrogans serovar lai str. 56601
gacucaguauguuguucucc

SEQ ID NO: 2768824 - RNA, 18 nt, Leptospira interrogans serovar lai str. 56601
gacucauauuuuuagaaa

SEQ ID NO: 2768825 - RNA, 17 nt, Leptospira interrogans serovar lai str. 56601
gacucauggagaauaaa

SEQ ID NO: 2768826 - RNA, 22 nt, Leptospira interrogans serovar lai str. 56601
gacucggaaauucucaaaaaau

SEQ ID NO: 2768827 - RNA, 20 nt, Leptospira interrogans serovar lai str. 56601
gacucuaguaaagaaacucg

SEQ ID NO: 2768828 - RNA, 13 nt, Leptospira interrogans serovar lai str. 56601
gacucuucuccca

SEQ ID NO: 2768829 - RNA, 17 nt, Leptospira interrogans serovar lai str. 56601
gacugacugaaaaaaac

SEQ ID NO: 2768830 - RNA, 23 nt, Leptospira interrogans serovar lai str. 56601
gacugcccguuucaauuuuugaa

SEQ ID NO: 2768831 - RNA, 24 nt, Leptospira interrogans serovar lai str. 56601
gacuggcuucgagucgcgugccuu

SEQ ID NO: 2768832 - RNA, 21 nt, Leptospira interrogans serovar lai str. 56601
gacuuaaaagaagauuuuucu

SEQ ID NO: 2768833 - RNA, 16 nt, Leptospira interrogans serovar lai str. 56601
gacuuaagaaauagau

SEQ ID NO: 2768834 - RNA, 19 nt, Leptospira interrogans serovar lai str. 56601
gacuuaugagaguucccac

SEQ ID NO: 2768835 - RNA, 15 nt, Leptospira interrogans serovar lai str. 56601
gacuucuauacucuu

SEQ ID NO: 2768836 - RNA, 14 nt, Leptospira interrogans serovar lai str. 56601
gacuucucauucuu

SEQ ID NO: 2768837 - RNA, 19 nt, Leptospira interrogans serovar lai str. 56601
gacuucucuuuucgaaaau

SEQ ID NO: 2768838 - RNA, 20 nt, Leptospira interrogans serovar lai str. 56601
gacuucuuaaguagauaaau

SEQ ID NO: 2768839 - RNA, 13 nt, Leptospira interrogans serovar lai str. 56601
gacuugaaaaagc

SEQ ID NO: 2768840 - RNA, 17 nt, Leptospira interrogans serovar lai str. 56601
gacuuggaguucuuacu

SEQ ID NO: 2768841 - RNA, 21 nt, Leptospira interrogans serovar lai str. 56601
gacuuuaauuuuaguaaaaau

SEQ ID NO: 2768842 - RNA, 13 nt, Leptospira interrogans serovar lai str. 56601
gacuuuaguucuc

SEQ ID NO: 2768843 - RNA, 20 nt, Leptospira interrogans serovar lai str. 56601
gacuuuauucaaaauagaau

SEQ ID NO: 2768844 - RNA, 22 nt, Leptospira interrogans serovar lai str. 56601
gagaaaaacuuuucuaaaagua

SEQ ID NO: 2768845 - RNA, 13 nt, Leptospira interrogans serovar lai str. 56601
gagaaaauccagu

SEQ ID NO: 2768846 - RNA, 18 nt, Leptospira interrogans serovar lai str. 56601
gagaaaauccagucaagu

SEQ ID NO: 2768847 - RNA, 18 nt, Leptospira interrogans serovar lai str. 56601
gagaaaggcggagaaauu

SEQ ID NO: 2768848 - RNA, 22 nt, Leptospira interrogans serovar lai str. 56601
gagaaccucuauaaaaucuaaa

SEQ ID NO: 2768849 - RNA, 23 nt, Leptospira interrogans serovar lai str. 56601
gagaaccucuauaaaaucuaaaa

SEQ ID NO: 2768850 - RNA, 19 nt, Leptospira interrogans serovar lai str. 56601
gagaacgcgaacuuuuuua

SEQ ID NO: 2768851 - RNA, 16 nt, Leptospira interrogans serovar lai str. 56601
gagaacucauucaagu

SEQ ID NO: 2768852 - RNA, 19 nt, Leptospira interrogans serovar lai str. 56601
gagaagggugaauuuuuuc

SEQ ID NO: 2768853 - RNA, 15 nt, Leptospira interrogans serovar lai str. 56601
gagaaguuaaaaaau

SEQ ID NO: 2768854 - RNA, 21 nt, Leptospira interrogans serovar lai str. 56601
gagaauuaauuuuuuaaaaau

SEQ ID NO: 2768855 - RNA, 13 nt, Leptospira interrogans serovar lai str. 56601
gagacaagaagaa

SEQ ID NO: 2768856 - RNA, 18 nt, Leptospira interrogans serovar lai str. 56601
gagacaagaagaaaagaa

SEQ ID NO: 2768857 - RNA, 18 nt, Leptospira interrogans serovar lai str. 56601
gagacauugaagaaaaaa

SEQ ID NO: 2768858 - RNA, 20 nt, Leptospira interrogans serovar lai str. 56601
gagacauugaagaaaaaaag

SEQ ID NO: 2768859 - RNA, 22 nt, Leptospira interrogans serovar lai str. 56601
gagaccgguagcgguaaaagaa

SEQ ID NO: 2768860 - RNA, 15 nt, Leptospira interrogans serovar lai str. 56601
gagacgaaaaacuca

SEQ ID NO: 2768861 - RNA, 21 nt, Leptospira interrogans serovar lai str. 56601
gagacgcuuucguuuagagaa

SEQ ID NO: 2768862 - RNA, 18 nt, Leptospira interrogans serovar lai str. 56601
gagacucuaguaaagaaa

SEQ ID NO: 2768863 - RNA, 20 nt, Leptospira interrogans serovar lai str. 56601
gagacucuaguaaagaaacu

SEQ ID NO: 2768864 - RNA, 21 nt, Leptospira interrogans serovar lai str. 56601
gagagaagccuauauuuugau

SEQ ID NO: 2768865 - RNA, 23 nt, Leptospira interrogans serovar lai str. 56601
gagagaguucuacugaguuucaa

SEQ ID NO: 2768866 - RNA, 20 nt, Leptospira interrogans serovar lai str. 56601
gagagugaccguugugagaa

SEQ ID NO: 2768867 - RNA, 17 nt, Leptospira interrogans serovar lai str. 56601
gagaguucgugaagaaa

SEQ ID NO: 2768868 - RNA, 14 nt, Leptospira interrogans serovar lai str. 56601
gagauaaaaaagga

SEQ ID NO: 2768869 - RNA, 15 nt, Leptospira interrogans serovar lai str. 56601
gagauaaaaaaggau

SEQ ID NO: 2768870 - RNA, 18 nt, Leptospira interrogans serovar lai str. 56601
gagauagaaccuauaucu

SEQ ID NO: 2768871 - RNA, 11 nt, Leptospira interrogans serovar lai str. 56601
gagauaggaau

SEQ ID NO: 2768872 - RNA, 21 nt, Leptospira interrogans serovar lai str. 56601
gagaucaccgcacaaaugaua

SEQ ID NO: 2768873 - RNA, 17 nt, Leptospira interrogans serovar lai str. 56601
gagaucauuaaugcgaa

SEQ ID NO: 2768874 - RNA, 14 nt, Leptospira interrogans serovar lai str. 56601
gagauuaaaacugc

SEQ ID NO: 2768875 - RNA, 13 nt, Leptospira interrogans serovar lai str. 56601
gagauuacuuuuu

SEQ ID NO: 2768876 - RNA, 19 nt, Leptospira interrogans serovar lai str. 56601
gagauuuugcacguaaaca

SEQ ID NO: 2768877 - RNA, 18 nt, Leptospira interrogans serovar lai str. 56601
gagcagauucuaaaaaug

SEQ ID NO: 2768878 - RNA, 13 nt, Leptospira interrogans serovar lai str. 56601
gagcaguaaaaaa

SEQ ID NO: 2768879 - RNA, 14 nt, Leptospira interrogans serovar lai str. 56601
gagcaucuuuagaa

SEQ ID NO: 2768880 - RNA, 15 nt, Leptospira interrogans serovar lai str. 56601
gagcauucuugagaa

SEQ ID NO: 2768881 - RNA, 16 nt, Leptospira interrogans serovar lai str. 56601
gagcauucuugagaaa

SEQ ID NO: 2768882 - RNA, 23 nt, Leptospira interrogans serovar lai str. 56601
gagccauaaauggcguauaagaa

SEQ ID NO: 2768883 - RNA, 21 nt, Leptospira interrogans serovar lai str. 56601
gagccaucuuuuuuugccuuu

SEQ ID NO: 2768884 - RNA, 17 nt, Leptospira interrogans serovar lai str. 56601
gagccuuuuuauuucua

SEQ ID NO: 2768885 - RNA, 13 nt, Leptospira interrogans serovar lai str. 56601
gagcguuuuguug

SEQ ID NO: 2768886 - RNA, 17 nt, Leptospira interrogans serovar lai str. 56601
gagcuaauucuuaaaaa

SEQ ID NO: 2768887 - RNA, 15 nt, Leptospira interrogans serovar lai str. 56601
gagcucaucauucug

SEQ ID NO: 2768888 - RNA, 23 nt, Leptospira interrogans serovar lai str. 56601
gagcucaucauucugaaaaaagu

SEQ ID NO: 2768889 - RNA, 21 nt, Leptospira interrogans serovar lai str. 56601
gauaauuucauuauuagaguu

SEQ ID NO: 2768890 - RNA, 13 nt, Leptospira interrogans serovar lai str. 56601
gauaauuugugaa

SEQ ID NO: 2768891 - RNA, 14 nt, Leptospira interrogans serovar lai str. 56601
gauaauuuucuuua

SEQ ID NO: 2768892 - RNA, 20 nt, Leptospira interrogans serovar lai str. 56601
gauaauuuuuacucaaagaa

SEQ ID NO: 2768893 - RNA, 17 nt, Leptospira interrogans serovar lai str. 56601
gauaauuuuuguuugua

SEQ ID NO: 2768894 - RNA, 23 nt, Leptospira interrogans serovar lai str. 56601
gauacauaaacugucaugaugau

SEQ ID NO: 2768895 - RNA, 20 nt, Leptospira interrogans serovar lai str. 56601
gauacuauacaacucaguuu

SEQ ID NO: 2768896 - RNA, 17 nt, Leptospira interrogans serovar lai str. 56601
gauacugccaaugauga

SEQ ID NO: 2768897 - RNA, 19 nt, Leptospira interrogans serovar lai str. 56601
gauacuuucggacuuuccg

SEQ ID NO: 2768898 - RNA, 17 nt, Leptospira interrogans serovar lai str. 56601
gauagaaauauuuagaa

SEQ ID NO: 2768899 - RNA, 13 nt, Leptospira interrogans serovar lai str. 56601
gauagagaaaaau

SEQ ID NO: 2768900 - RNA, 23 nt, Leptospira interrogans serovar lai str. 56601
gauagauuaauuuuuauagaauu

SEQ ID NO: 2768901 - RNA, 14 nt, Leptospira interrogans serovar lai str. 56601
gauagcaaaaaaau

SEQ ID NO: 2768902 - RNA, 21 nt, Leptospira interrogans serovar lai str. 56601
gauagccaugguaagaagaag

SEQ ID NO: 2768903 - RNA, 18 nt, Leptospira interrogans serovar lai str. 56601
gauaggaauguuucccag

SEQ ID NO: 2768904 - RNA, 17 nt, Leptospira interrogans serovar lai str. 56601
gauagguuuuguaagaa

SEQ ID NO: 2768905 - RNA, 16 nt, Leptospira interrogans serovar lai str. 56601
gauaguaccaaguuau

SEQ ID NO: 2768906 - RNA, 22 nt, Leptospira interrogans serovar lai str. 56601
gauaguuuggguuauaagccaa

SEQ ID NO: 2768907 - RNA, 16 nt, Leptospira interrogans serovar lai str. 56601
gauaucacaaauuuua

SEQ ID NO: 2768908 - RNA, 22 nt, Leptospira interrogans serovar lai str. 56601
gauaugaaucagccauuaaauu

SEQ ID NO: 2768909 - RNA, 13 nt, Leptospira interrogans serovar lai str. 56601
gauauuaacaaau

SEQ ID NO: 2768910 - RNA, 21 nt, Leptospira interrogans serovar lai str. 56601
gauauuaacaaauuuaaaaua

SEQ ID NO: 2768911 - RNA, 19 nt, Leptospira interrogans serovar lai str. 56601
gauauucuauuauauacau

SEQ ID NO: 2768912 - RNA, 14 nt, Leptospira interrogans serovar lai str. 56601
gauauucugaaagu

SEQ ID NO: 2768913 - RNA, 18 nt, Leptospira interrogans serovar lai str. 56601
gauauugagcaagaccuu

SEQ ID NO: 2768914 - RNA, 14 nt, Leptospira interrogans serovar lai str. 56601
gauauuucauucuu

SEQ ID NO: 2768915 - RNA, 17 nt, Leptospira interrogans serovar lai str. 56601
gaucaaagcgggaauuc

SEQ ID NO: 2768916 - RNA, 16 nt, Leptospira interrogans serovar lai str. 56601
gaucaaaucugaaauu

SEQ ID NO: 2768917 - RNA, 18 nt, Leptospira interrogans serovar lai str. 56601
gaucaaaucugaaauuca

SEQ ID NO: 2768918 - RNA, 16 nt, Leptospira interrogans serovar lai str. 56601
gaucaacaaaauuacu

SEQ ID NO: 2768919 - RNA, 21 nt, Leptospira interrogans serovar lai str. 56601
gaucaacaaaauuacuucaau

SEQ ID NO: 2768920 - RNA, 18 nt, Leptospira interrogans serovar lai str. 56601
gaucaauucugaaaaugu

SEQ ID NO: 2768921 - RNA, 22 nt, Leptospira interrogans serovar lai str. 56601
gaucaauucugaaaauguaaaa

SEQ ID NO: 2768922 - RNA, 17 nt, Leptospira interrogans serovar lai str. 56601
gaucaauucuuaaaaug

SEQ ID NO: 2768923 - RNA, 16 nt, Leptospira interrogans serovar lai str. 56601
gaucaauucuuuaaau

SEQ ID NO: 2768924 - RNA, 10 nt, Leptospira interrogans serovar lai str. 56601
gaucacgucg

SEQ ID NO: 2768925 - RNA, 18 nt, Leptospira interrogans serovar lai str. 56601
gaucagaaaaacaaaaaa

SEQ ID NO: 2768926 - RNA, 16 nt, Leptospira interrogans serovar lai str. 56601
gaucagaauuucuuuc

SEQ ID NO: 2768927 - RNA, 22 nt, Leptospira interrogans serovar lai str. 56601
gaucagugauucgaaauuuuca

SEQ ID NO: 2768928 - RNA, 19 nt, Leptospira interrogans serovar lai str. 56601
gaucauaauccuaugaaaa

SEQ ID NO: 2768929 - RNA, 13 nt, Leptospira interrogans serovar lai str. 56601
gaucauuuaaaac

SEQ ID NO: 2768930 - RNA, 20 nt, Leptospira interrogans serovar lai str. 56601
gauccaauacaaaacaagua

SEQ ID NO: 2768931 - RNA, 22 nt, Leptospira interrogans serovar lai str. 56601
gauccacuacggaaggaaaaaa

SEQ ID NO: 2768932 - RNA, 14 nt, Leptospira interrogans serovar lai str. 56601
gauccaggaucaga

SEQ ID NO: 2768933 - RNA, 19 nt, Leptospira interrogans serovar lai str. 56601
gaucccgauacagaauaaa

SEQ ID NO: 2768934 - RNA, 21 nt, Leptospira interrogans serovar lai str. 56601
gauccgaauuuuuacacacuc

SEQ ID NO: 2768935 - RNA, 17 nt, Leptospira interrogans serovar lai str. 56601
gauccguagagagcguu

SEQ ID NO: 2768936 - RNA, 18 nt, Leptospira interrogans serovar lai str. 56601
gauccuuacgaucuaaaa

SEQ ID NO: 2768937 - RNA, 20 nt, Leptospira interrogans serovar lai str. 56601
gauccuuacgaucuaaaagg

SEQ ID NO: 2768938 - RNA, 17 nt, Leptospira interrogans serovar lai str. 56601
gauccuuauacuuuccg

SEQ ID NO: 2768939 - RNA, 14 nt, Leptospira interrogans serovar lai str. 56601
gaucgauuccuacu

SEQ ID NO: 2768940 - RNA, 14 nt, Leptospira interrogans serovar lai str. 56601
gaucgccguucugg

SEQ ID NO: 2768941 - RNA, 18 nt, Leptospira interrogans serovar lai str. 56601
gaucgcguuugaaacuca

SEQ ID NO: 2768942 - RNA, 22 nt, Leptospira interrogans serovar lai str. 56601
gaucgggauggagauuacuuuu

SEQ ID NO: 2768943 - RNA, 16 nt, Leptospira interrogans serovar lai str. 56601
gaucgguuuuagaauu

SEQ ID NO: 2768944 - RNA, 12 nt, Leptospira interrogans serovar lai str. 56601
gaucguauuuua

SEQ ID NO: 2768945 - RNA, 21 nt, Leptospira interrogans serovar lai str. 56601
gaucuaaaaggacgggaaaau

SEQ ID NO: 2768946 - RNA, 14 nt, Leptospira interrogans serovar lai str. 56601
gaucuacaaugucu

SEQ ID NO: 2768947 - RNA, 18 nt, Leptospira interrogans serovar lai str. 56601
gaucuacuaaaucagaau

SEQ ID NO: 2768948 - RNA, 11 nt, Leptospira interrogans serovar lai str. 56601
gaucuacuuug

SEQ ID NO: 2768949 - RNA, 13 nt, Leptospira interrogans serovar lai str. 56601
gaucuauagagag

SEQ ID NO: 2768950 - RNA, 20 nt, Leptospira interrogans serovar lai str. 56601
gaucuauguccuuuuuuucu

SEQ ID NO: 2768951 - RNA, 15 nt, Leptospira interrogans serovar lai str. 56601
gaucucaauauaaac

SEQ ID NO: 2768952 - RNA, 20 nt, Leptospira interrogans serovar lai str. 56601
gaucuccacuuaauuuuucu

SEQ ID NO: 2768953 - RNA, 18 nt, Leptospira interrogans serovar lai str. 56601
gaucuccuaaaauaaaau

SEQ ID NO: 2768954 - RNA, 18 nt, Leptospira interrogans serovar lai str. 56601
gaucucgagugagguuuu

SEQ ID NO: 2768955 - RNA, 17 nt, Leptospira interrogans serovar lai str. 56601
gaucugauauuuuaaau

SEQ ID NO: 2768956 - RNA, 14 nt, Leptospira interrogans serovar lai str. 56601
gaucuguaaaaugu

SEQ ID NO: 2768957 - RNA, 13 nt, Leptospira interrogans serovar lai str. 56601
gaucuguaaaguu

SEQ ID NO: 2768958 - RNA, 18 nt, Leptospira interrogans serovar lai str. 56601
gaucuuaaaaacuugaau

SEQ ID NO: 2768959 - RNA, 20 nt, Leptospira interrogans serovar lai str. 56601
gaucuuauacucuuaaaauu

SEQ ID NO: 2768960 - RNA, 15 nt, Leptospira interrogans serovar lai str. 56601
gaucuuuaaaagagc

SEQ ID NO: 2768961 - RNA, 14 nt, Leptospira interrogans serovar lai str. 56601
gaucuuuuuuucua

SEQ ID NO: 2768962 - RNA, 22 nt, Leptospira interrogans serovar lai str. 56601
gaugaaguuuuacuaaaaguaa

SEQ ID NO: 2768963 - RNA, 17 nt, Leptospira interrogans serovar lai str. 56601
gaugagcuuacuuuaau

SEQ ID NO: 2768964 - RNA, 17 nt, Leptospira interrogans serovar lai str. 56601
gaugagcuuuuuuagaa

SEQ ID NO: 2768965 - RNA, 18 nt, Leptospira interrogans serovar lai str. 56601
gaugagcuuuuuuagaaa

SEQ ID NO: 2768966 - RNA, 20 nt, Leptospira interrogans serovar lai str. 56601
gaugagcuuuuuuagaaaaa

SEQ ID NO: 2768967 - RNA, 21 nt, Leptospira interrogans serovar lai str. 56601
gaugagcuuuuuuagaaaaag

SEQ ID NO: 2768968 - RNA, 19 nt, Leptospira interrogans serovar lai str. 56601
gaugauaaaaaacgaauca

SEQ ID NO: 2768969 - RNA, 19 nt, Leptospira interrogans serovar lai str. 56601
gaugcauacauagauaaau

SEQ ID NO: 2768970 - RNA, 20 nt, Leptospira interrogans serovar lai str. 56601
gaugcauugaguuacgcuga

SEQ ID NO: 2768971 - RNA, 19 nt, Leptospira interrogans serovar lai str. 56601
gaugcgaguaauauuuuuu

SEQ ID NO: 2768972 - RNA, 20 nt, Leptospira interrogans serovar lai str. 56601
gauugaaacguuuucaaaaa

SEQ ID NO: 2768973 - RNA, 18 nt, Leptospira interrogans serovar lai str. 56601
gauugagaauucuacauu

SEQ ID NO: 2768974 - RNA, 17 nt, Leptospira interrogans serovar lai str. 56601
gauugauucuaagguuu

SEQ ID NO: 2768975 - RNA, 16 nt, Leptospira interrogans serovar lai str. 56601
gauugauucuuuaaau

SEQ ID NO: 2768976 - RNA, 14 nt, Leptospira interrogans serovar lai str. 56601
gauugcaaauucaa

SEQ ID NO: 2768977 - RNA, 15 nt, Leptospira interrogans serovar lai str. 56601
gauugccuucggcua

SEQ ID NO: 2768978 - RNA, 15 nt, Leptospira interrogans serovar lai str. 56601
gauugcuuuuuaaaa

SEQ ID NO: 2768979 - RNA, 14 nt, Leptospira interrogans serovar lai str. 56601
gauuggaagaauau

SEQ ID NO: 2768980 - RNA, 19 nt, Leptospira interrogans serovar lai str. 56601
gauuguugaacuugcucaa

SEQ ID NO: 2768981 - RNA, 20 nt, Leptospira interrogans serovar lai str. 56601
gauuuaauuuagaaauuuau

SEQ ID NO: 2768982 - RNA, 16 nt, Leptospira interrogans serovar lai str. 56601
gauuuacuuuaaaauu

SEQ ID NO: 2768983 - RNA, 18 nt, Leptospira interrogans serovar lai str. 56601
gauuuacuuuaaaauuug

SEQ ID NO: 2768984 - RNA, 21 nt, Leptospira interrogans serovar lai str. 56601
gauuuaguaaaauuuaaaauu

SEQ ID NO: 2768985 - RNA, 19 nt, Leptospira interrogans serovar lai str. 56601
gauuuaucaguuaaacuuu

SEQ ID NO: 2768986 - RNA, 16 nt, Leptospira interrogans serovar lai str. 56601
gauuuauuuuaaaauu

SEQ ID NO: 2768987 - RNA, 23 nt, Leptospira interrogans serovar lai str. 56601
gauuucauucggagacuugauuu

SEQ ID NO: 2768988 - RNA, 22 nt, Leptospira interrogans serovar lai str. 56601
gauuucguucggaaaaaauaug

SEQ ID NO: 2768989 - RNA, 20 nt, Leptospira interrogans serovar lai str. 56601
gauuucguucggaaaaagua

SEQ ID NO: 2768990 - RNA, 13 nt, Leptospira interrogans serovar lai str. 56601
gauuucuauaaaa

SEQ ID NO: 2768991 - RNA, 14 nt, Leptospira interrogans serovar lai str. 56601
gauuucuauauuca

SEQ ID NO: 2768992 - RNA, 18 nt, Leptospira interrogans serovar lai str. 56601
gauuucuauauucaaaaa

SEQ ID NO: 2768993 - RNA, 14 nt, Leptospira interrogans serovar lai str. 56601
gauuucuauccauu

SEQ ID NO: 2768994 - RNA, 15 nt, Leptospira interrogans serovar lai str. 56601
gauuucuauccauuc

SEQ ID NO: 2768995 - RNA, 23 nt, Leptospira interrogans serovar lai str. 56601
gauuugauguaaagaaaaccaga

SEQ ID NO: 2768996 - RNA, 16 nt, Leptospira interrogans serovar lai str. 56601
gauuugcaucgacaaa

SEQ ID NO: 2768997 - RNA, 21 nt, Leptospira interrogans serovar lai str. 56601
gauuugcaucgacaaaacuuc

SEQ ID NO: 2768998 - RNA, 21 nt, Leptospira interrogans serovar lai str. 56601
gauuuggaucgggacaaauca

SEQ ID NO: 2768999 - RNA, 16 nt, Leptospira interrogans serovar lai str. 56601
gauuugguuuucauuc

SEQ ID NO: 2769000 - RNA, 13 nt, Leptospira interrogans serovar lai str. 56601
gauuuguaaaauu

SEQ ID NO: 2769001 - RNA, 14 nt, Leptospira interrogans serovar lai str. 56601
gauuuguaaaauug

SEQ ID NO: 2769002 - RNA, 14 nt, Leptospira interrogans serovar lai str. 56601
gauuuguaauaguu

SEQ ID NO: 2769003 - RNA, 16 nt, Leptospira interrogans serovar lai str. 56601
gauuuguaauaguucc

SEQ ID NO: 2769004 - RNA, 19 nt, Leptospira interrogans serovar lai str. 56601
gauuuguaauaguucccac

SEQ ID NO: 2769005 - RNA, 17 nt, Leptospira interrogans serovar lai str. 56601
gauuuguccgaauccaa

SEQ ID NO: 2769006 - RNA, 16 nt, Leptospira interrogans serovar lai str. 56601
gauuugucgaaugcuc

SEQ ID NO: 2769007 - RNA, 19 nt, Leptospira interrogans serovar lai str. 56601
gauuuguguuaguucccac

SEQ ID NO: 2769008 - RNA, 15 nt, Leptospira interrogans serovar lai str. 56601
gauuuuaaaaauuuu

SEQ ID NO: 2769009 - RNA, 18 nt, Leptospira interrogans serovar lai str. 56601
gauuuuaaaaauuuugaa

SEQ ID NO: 2769010 - RNA, 21 nt, Leptospira interrogans serovar lai str. 56601
gauuuuaacuuuuuuuaaaaa

SEQ ID NO: 2769011 - RNA, 14 nt, Leptospira interrogans serovar lai str. 56601
gauuuuaaucuccg

SEQ ID NO: 2769012 - RNA, 13 nt, Leptospira interrogans serovar lai str. 56601
gauuuuacaaaga

SEQ ID NO: 2769013 - RNA, 17 nt, Leptospira interrogans serovar lai str. 56601
gauuuuacgaacaaauu

SEQ ID NO: 2769014 - RNA, 22 nt, Leptospira interrogans serovar lai str. 56601
gauuuuacgaaccaauucuaaa

SEQ ID NO: 2769015 - RNA, 20 nt, Leptospira interrogans serovar lai str. 56601
gauuuuacgauuaaauuuug

SEQ ID NO: 2769016 - RNA, 11 nt, Leptospira interrogans serovar lai str. 56601
gauuuuagaau

SEQ ID NO: 2769017 - RNA, 19 nt, Leptospira interrogans serovar lai str. 56601
gauuuucagggaaaaauaa

SEQ ID NO: 2769018 - RNA, 16 nt, Leptospira interrogans serovar lai str. 56601
gauuuucauuuugcua

SEQ ID NO: 2769019 - RNA, 17 nt, Leptospira interrogans serovar lai str. 56601
gauuuucauuuugcuaa

SEQ ID NO: 2769020 - RNA, 17 nt, Leptospira interrogans serovar lai str. 56601
gauuuucucaaaaaaag

SEQ ID NO: 2769021 - RNA, 22 nt, Leptospira interrogans serovar lai str. 56601
gauuuuuauaauuuagaguugu

SEQ ID NO: 2769022 - RNA, 21 nt, Leptospira interrogans serovar lai str. 56601
gauuuuuauguaauauuucuu

SEQ ID NO: 2769023 - RNA, 13 nt, Leptospira interrogans serovar lai str. 56601
gauuuuucuucuu

SEQ ID NO: 2769024 - RNA, 16 nt, Leptospira interrogans serovar lai str. 56601
gauuuuucuucuucau

SEQ ID NO: 2769025 - RNA, 22 nt, Leptospira interrogans serovar lai str. 56601
gauuuuuguucacuaaggccca

SEQ ID NO: 2769026 - RNA, 12 nt, Leptospira interrogans serovar lai str. 56601
gauuuuuguuuu

SEQ ID NO: 2769027 - RNA, 21 nt, Leptospira interrogans serovar lai str. 56601
gauuuuuuaaucuggaaacgu

SEQ ID NO: 2769028 - RNA, 10 nt, Leptospira interrogans serovar lai str. 56601
gcaaaaagua

SEQ ID NO: 2769029 - RNA, 12 nt, Leptospira interrogans serovar lai str. 56601
gcaaaaaguaug

SEQ ID NO: 2769030 - RNA, 20 nt, Leptospira interrogans serovar lai str. 56601
gcaaaaaguauguuuuucug

SEQ ID NO: 2769031 - RNA, 12 nt, Leptospira interrogans serovar lai str. 56601
gcaaaaauuccu

SEQ ID NO: 2769032 - RNA, 14 nt, Leptospira interrogans serovar lai str. 56601
gcaaaaauuccuuu

SEQ ID NO: 2769033 - RNA, 19 nt, Leptospira interrogans serovar lai str. 56601
gcaaaaucaguuaauacaa

SEQ ID NO: 2769034 - RNA, 17 nt, Leptospira interrogans serovar lai str. 56601
gcaaaaucgauugaucu

SEQ ID NO: 2769035 - RNA, 18 nt, Leptospira interrogans serovar lai str. 56601
gcaaaguuucuuauauaa

SEQ ID NO: 2769036 - RNA, 19 nt, Leptospira interrogans serovar lai str. 56601
gcaaaguuucuuauauaaa

SEQ ID NO: 2769037 - RNA, 20 nt, Leptospira interrogans serovar lai str. 56601
gcaaaucacaauuuuacaaa

SEQ ID NO: 2769038 - RNA, 19 nt, Leptospira interrogans serovar lai str. 56601
gcaaaucacgauuuuacga

SEQ ID NO: 2769039 - RNA, 20 nt, Leptospira interrogans serovar lai str. 56601
gcaaauucuacuauuaauag

SEQ ID NO: 2769040 - RNA, 20 nt, Leptospira interrogans serovar lai str. 56601
gcaaauucugauuuuacaga

SEQ ID NO: 2769041 - RNA, 16 nt, Leptospira interrogans serovar lai str. 56601
gcaaauuuacuucaau

SEQ ID NO: 2769042 - RNA, 19 nt, Leptospira interrogans serovar lai str. 56601
gcaaauuuacuucaauuau

SEQ ID NO: 2769043 - RNA, 21 nt, Leptospira interrogans serovar lai str. 56601
gcaaauuuuuuucuaaaauau

SEQ ID NO: 2769044 - RNA, 19 nt, Leptospira interrogans serovar lai str. 56601
gcaacacacacuuuauaaa

SEQ ID NO: 2769045 - RNA, 23 nt, Leptospira interrogans serovar lai str. 56601
gcaacacacacuuuauaaaagua

SEQ ID NO: 2769046 - RNA, 14 nt, Leptospira interrogans serovar lai str. 56601
gcaacgaaaucaau

SEQ ID NO: 2769047 - RNA, 20 nt, Leptospira interrogans serovar lai str. 56601
gcaacggauuccuccagugc

SEQ ID NO: 2769048 - RNA, 13 nt, Leptospira interrogans serovar lai str. 56601
gcaaguaaaaaga

SEQ ID NO: 2769049 - RNA, 16 nt, Leptospira interrogans serovar lai str. 56601
gcaaguaaaaagacuc

SEQ ID NO: 2769050 - RNA, 18 nt, Leptospira interrogans serovar lai str. 56601
gcaaguaaaaagacucau

SEQ ID NO: 2769051 - RNA, 20 nt, Leptospira interrogans serovar lai str. 56601
gcaaguucuggguaaaaaaa

SEQ ID NO: 2769052 - RNA, 20 nt, Leptospira interrogans serovar lai str. 56601
gcaauacauucuuauaaaga

SEQ ID NO: 2769053 - RNA, 20 nt, Leptospira interrogans serovar lai str. 56601
gcaauauuauuuuaacuuga

SEQ ID NO: 2769054 - RNA, 17 nt, Leptospira interrogans serovar lai str. 56601
gcaaucgaucuguaaaa

SEQ ID NO: 2769055 - RNA, 13 nt, Leptospira interrogans serovar lai str. 56601
gcgaaauaaaaac

SEQ ID NO: 2769056 - RNA, 17 nt, Leptospira interrogans serovar lai str. 56601
gcgaacuuuuuuauaaa

SEQ ID NO: 2769057 - RNA, 22 nt, Leptospira interrogans serovar lai str. 56601
gcgaaucgcucgcgaauuucau

SEQ ID NO: 2769058 - RNA, 18 nt, Leptospira interrogans serovar lai str. 56601
gcgacaaaaggauuccau

SEQ ID NO: 2769059 - RNA, 13 nt, Leptospira interrogans serovar lai str. 56601
gcgaccgcgcuug

SEQ ID NO: 2769060 - RNA, 15 nt, Leptospira interrogans serovar lai str. 56601
gcgacgauagaagcg

SEQ ID NO: 2769061 - RNA, 19 nt, Leptospira interrogans serovar lai str. 56601
gcgacucagaaaacucagc

SEQ ID NO: 2769062 - RNA, 20 nt, Leptospira interrogans serovar lai str. 56601
gcgagugcgacuacgauuuc

SEQ ID NO: 2769063 - RNA, 19 nt, Leptospira interrogans serovar lai str. 56601
gcgauccguagagagcguu

SEQ ID NO: 2769064 - RNA, 14 nt, Leptospira interrogans serovar lai str. 56601
gcgauucauaaaga

SEQ ID NO: 2769065 - RNA, 21 nt, Leptospira interrogans serovar lai str. 56601
gcgauugcgaaagugauccaa

SEQ ID NO: 2769066 - RNA, 22 nt, Leptospira interrogans serovar lai str. 56601
gcgcaaucucaagugaugaagu

SEQ ID NO: 2769067 - RNA, 15 nt, Leptospira interrogans serovar lai str. 56601
gcgcagcucuuguga

SEQ ID NO: 2769068 - RNA, 15 nt, Leptospira interrogans serovar lai str. 56601
gcgccuucuuuucaa

SEQ ID NO: 2769069 - RNA, 20 nt, Leptospira interrogans serovar lai str. 56601
gcgcugaguaguaaguuuuu

SEQ ID NO: 2769070 - RNA, 21 nt, Leptospira interrogans serovar lai str. 56601
gcgcugaguaguaaguuuuuc

SEQ ID NO: 2769071 - RNA, 14 nt, Leptospira interrogans serovar lai str. 56601
gcgcuuuccuuauu

SEQ ID NO: 2769072 - RNA, 18 nt, Leptospira interrogans serovar lai str. 56601
gcggaugagcgacucaga

SEQ ID NO: 2769073 - RNA, 20 nt, Leptospira interrogans serovar lai str. 56601
gcggcgagacauaaaaaaau

SEQ ID NO: 2769074 - RNA, 14 nt, Leptospira interrogans serovar lai str. 56601
gcgguaguucccac

SEQ ID NO: 2769075 - RNA, 13 nt, Leptospira interrogans serovar lai str. 56601
gcguaagaaaguu

SEQ ID NO: 2769076 - RNA, 14 nt, Leptospira interrogans serovar lai str. 56601
gcguaagaaaguuu

SEQ ID NO: 2769077 - RNA, 22 nt, Leptospira interrogans serovar lai str. 56601
gcguaaggcucgaauuuuuuuc

SEQ ID NO: 2769078 - RNA, 14 nt, Leptospira interrogans serovar lai str. 56601
gcguauaagaaugu

SEQ ID NO: 2769079 - RNA, 18 nt, Leptospira interrogans serovar lai str. 56601
gcguguaugguaaaaaua

SEQ ID NO: 2769080 - RNA, 17 nt, Leptospira interrogans serovar lai str. 56601
gcguucuacaaaauuua

SEQ ID NO: 2769081 - RNA, 18 nt, Leptospira interrogans serovar lai str. 56601
gcguuuuguuaauuguug

SEQ ID NO: 2769082 - RNA, 13 nt, Leptospira interrogans serovar lai str. 56601
gcuaaaauugaau

SEQ ID NO: 2769083 - RNA, 20 nt, Leptospira interrogans serovar lai str. 56601
gcuaaaauuuuuuuaagaau

SEQ ID NO: 2769084 - RNA, 17 nt, Leptospira interrogans serovar lai str. 56601
gcuaaacucauuuuaaa

SEQ ID NO: 2769085 - RNA, 15 nt, Leptospira interrogans serovar lai str. 56601
gcuaauacaaaagag

SEQ ID NO: 2769086 - RNA, 20 nt, Leptospira interrogans serovar lai str. 56601
gcuaauucuuaaaaauuuau

SEQ ID NO: 2769087 - RNA, 19 nt, Leptospira interrogans serovar lai str. 56601
gcuacaaucaauaaauugc

SEQ ID NO: 2769088 - RNA, 16 nt, Leptospira interrogans serovar lai str. 56601
gcuacuugugagugaa

SEQ ID NO: 2769089 - RNA, 24 nt, Leptospira interrogans serovar lai str. 56601
gcuauuuucagaaaaaugaauucc

SEQ ID NO: 2769090 - RNA, 23 nt, Leptospira interrogans serovar lai str. 56601
gcucaaaaaggcacauuuuucaa

SEQ ID NO: 2769091 - RNA, 12 nt, Leptospira interrogans serovar lai str. 56601
gcucaaagaagu

SEQ ID NO: 2769092 - RNA, 16 nt, Leptospira interrogans serovar lai str. 56601
gcucaauauuuaaaaa

SEQ ID NO: 2769093 - RNA, 21 nt, Leptospira interrogans serovar lai str. 56601
gcucaauccaauauuuaugcu

SEQ ID NO: 2769094 - RNA, 20 nt, Leptospira interrogans serovar lai str. 56601
gcucacuuaugauuuaguaa

SEQ ID NO: 2769095 - RNA, 21 nt, Leptospira interrogans serovar lai str. 56601
gcucacuuaugauuuaguaaa

SEQ ID NO: 2769096 - RNA, 22 nt, Leptospira interrogans serovar lai str. 56601
gcucauaaaaaaaucaagagcc

SEQ ID NO: 2769097 - RNA, 13 nt, Leptospira interrogans serovar lai str. 56601
gcucauuuuucuu

SEQ ID NO: 2769098 - RNA, 17 nt, Leptospira interrogans serovar lai str. 56601
gcucauuuuucuuaaaa

SEQ ID NO: 2769099 - RNA, 17 nt, Leptospira interrogans serovar lai str. 56601
gcuccaaaaaaauaaau

SEQ ID NO: 2769100 - RNA, 22 nt, Leptospira interrogans serovar lai str. 56601
gcuccaaaaggcacauuuuuca

SEQ ID NO: 2769101 - RNA, 17 nt, Leptospira interrogans serovar lai str. 56601
gcuccagcuuuuuuaaa

SEQ ID NO: 2769102 - RNA, 17 nt, Leptospira interrogans serovar lai str. 56601
gcuccagucuaaguaug

SEQ ID NO: 2769103 - RNA, 17 nt, Leptospira interrogans serovar lai str. 56601
gcuccuccaaccagagc

SEQ ID NO: 2769104 - RNA, 15 nt, Leptospira interrogans serovar lai str. 56601
gcucgaaguaacuca

SEQ ID NO: 2769105 - RNA, 14 nt, Leptospira interrogans serovar lai str. 56601
gcucgcgaccgcgc

SEQ ID NO: 2769106 - RNA, 18 nt, Leptospira interrogans serovar lai str. 56601
gcucuaaaauaauuuuua

SEQ ID NO: 2769107 - RNA, 22 nt, Leptospira interrogans serovar lai str. 56601
gcucuaauauuuuaaagaaacu

SEQ ID NO: 2769108 - RNA, 23 nt, Leptospira interrogans serovar lai str. 56601
gcucuaauauuuuaaagaaacuc

SEQ ID NO: 2769109 - RNA, 22 nt, Leptospira interrogans serovar lai str. 56601
gcucuaggcgauuuuucgaaac

SEQ ID NO: 2769110 - RNA, 18 nt, Leptospira interrogans serovar lai str. 56601
gcucuauguaagaaaauc

SEQ ID NO: 2769111 - RNA, 21 nt, Leptospira interrogans serovar lai str. 56601
gcucuccaucuuuuuuuucua

SEQ ID NO: 2769112 - RNA, 14 nt, Leptospira interrogans serovar lai str. 56601
gcucucgcaaugaa

SEQ ID NO: 2769113 - RNA, 19 nt, Leptospira interrogans serovar lai str. 56601
gcucucguaauaucuaaaa

SEQ ID NO: 2769114 - RNA, 18 nt, Leptospira interrogans serovar lai str. 56601
gcucucguuuuuaggauu

SEQ ID NO: 2769115 - RNA, 14 nt, Leptospira interrogans serovar lai str. 56601
gcucucuccuaugu

SEQ ID NO: 2769116 - RNA, 20 nt, Leptospira interrogans serovar lai str. 56601
gcucucuccuauguuucuug

SEQ ID NO: 2769117 - RNA, 13 nt, Leptospira interrogans serovar lai str. 56601
gcucugaaguauc

SEQ ID NO: 2769118 - RNA, 19 nt, Leptospira interrogans serovar lai str. 56601
gcucugaaguaucucuucu

SEQ ID NO: 2769119 - RNA, 19 nt, Leptospira interrogans serovar lai str. 56601
gcucuggucaauaaauugu

SEQ ID NO: 2769120 - RNA, 15 nt, Leptospira interrogans serovar lai str. 56601
gcucugugaaacuca

SEQ ID NO: 2769121 - RNA, 13 nt, Leptospira interrogans serovar lai str. 56601
gcucuugaauaaa

SEQ ID NO: 2769122 - RNA, 23 nt, Leptospira interrogans serovar lai str. 56601
gcucuuuaugaaucgcguugugg

SEQ ID NO: 2769123 - RNA, 14 nt, Leptospira interrogans serovar lai str. 56601
gcugaaaaaaaaau

SEQ ID NO: 2769124 - RNA, 13 nt, Leptospira interrogans serovar lai str. 56601
gcugaaaauuuuc

SEQ ID NO: 2769125 - RNA, 20 nt, Leptospira interrogans serovar lai str. 56601
gcugaggaguuuuuauaaaa

SEQ ID NO: 2769126 - RNA, 17 nt, Leptospira interrogans serovar lai str. 56601
gcugaugcauccaauca

SEQ ID NO: 2769127 - RNA, 17 nt, Leptospira interrogans serovar lai str. 56601
gcugauucccaguaaau

SEQ ID NO: 2769128 - RNA, 12 nt, Leptospira interrogans serovar lai str. 56601
gcugauuuuucu

SEQ ID NO: 2769129 - RNA, 15 nt, Leptospira interrogans serovar lai str. 56601
gcugcuuuuuugaga

SEQ ID NO: 2769130 - RNA, 15 nt, Leptospira interrogans serovar lai str. 56601
gcuggaaauaucaau

SEQ ID NO: 2769131 - RNA, 13 nt, Leptospira interrogans serovar lai str. 56601
gcuguaaaauuua

SEQ ID NO: 2769132 - RNA, 18 nt, Leptospira interrogans serovar lai str. 56601
gcuguaguuuauuuuucu

SEQ ID NO: 2769133 - RNA, 22 nt, Leptospira interrogans serovar lai str. 56601
gcuguaguuuauuuuucuuuua

SEQ ID NO: 2769134 - RNA, 14 nt, Leptospira interrogans serovar lai str. 56601
gcuguaugaaaacg

SEQ ID NO: 2769135 - RNA, 15 nt, Leptospira interrogans serovar lai str. 56601
gcugucauaaaccga

SEQ ID NO: 2769136 - RNA, 24 nt, Leptospira interrogans serovar lai str. 56601
gcugucgcaacauaaugcugcaau

SEQ ID NO: 2769137 - RNA, 21 nt, Leptospira interrogans serovar lai str. 56601
gcugucgcaacauaauguuuc

SEQ ID NO: 2769138 - RNA, 12 nt, Leptospira interrogans serovar lai str. 56601
gcuuaaaaguga

SEQ ID NO: 2769139 - RNA, 22 nt, Leptospira interrogans serovar lai str. 56601
gcuuaagagaaccucuauaaaa

SEQ ID NO: 2769140 - RNA, 21 nt, Leptospira interrogans serovar lai str. 56601
gcuuaggcccgaauuuuaaau

SEQ ID NO: 2769141 - RNA, 22 nt, Leptospira interrogans serovar lai str. 56601
gcuuauacuuuaagaaaauuua

SEQ ID NO: 2769142 - RNA, 15 nt, Leptospira interrogans serovar lai str. 56601
gcuuaucuaauuuuu

SEQ ID NO: 2769143 - RNA, 14 nt, Leptospira interrogans serovar lai str. 56601
gcuucaaaaagaga

SEQ ID NO: 2769144 - RNA, 23 nt, Leptospira interrogans serovar lai str. 56601
gcuucaauuguccguuucaauac

SEQ ID NO: 2769145 - RNA, 16 nt, Leptospira interrogans serovar lai str. 56601
gcuucauauaauaaaa

SEQ ID NO: 2769146 - RNA, 10 nt, Leptospira interrogans serovar lai str. 56601
gcuuccuuuu

SEQ ID NO: 2769147 - RNA, 19 nt, Leptospira interrogans serovar lai str. 56601
gcuucuucaauguuauaaa

SEQ ID NO: 2769148 - RNA, 13 nt, Leptospira interrogans serovar lai str. 56601
gcuucuuuaaaaa

SEQ ID NO: 2769149 - RNA, 19 nt, Leptospira interrogans serovar lai str. 56601
gcuugcuacgggcuuucag

SEQ ID NO: 2769150 - RNA, 20 nt, Leptospira interrogans serovar lai str. 56601
gcuuguauuuuauuuuugga

SEQ ID NO: 2769151 - RNA, 14 nt, Leptospira interrogans serovar lai str. 56601
gcuugucccagagc

SEQ ID NO: 2769152 - RNA, 15 nt, Leptospira interrogans serovar lai str. 56601
gcuugucccagagcc

SEQ ID NO: 2769153 - RNA, 14 nt, Leptospira interrogans serovar lai str. 56601
gcuuguuuuuaaau

SEQ ID NO: 2769154 - RNA, 18 nt, Leptospira interrogans serovar lai str. 56601
gcuuguuuuuaaauuaau

SEQ ID NO: 2769155 - RNA, 23 nt, Leptospira interrogans serovar lai str. 56601
gcuuuaagaucauuuaaaacuca

SEQ ID NO: 2769156 - RNA, 20 nt, Leptospira interrogans serovar lai str. 56601
gcuuuaagugaaccagagau

SEQ ID NO: 2769157 - RNA, 22 nt, Leptospira interrogans serovar lai str. 56601
gcuuuaaucuuuuuaacgcaga

SEQ ID NO: 2769158 - RNA, 21 nt, Leptospira interrogans serovar lai str. 56601
gcuuuacaauaaaaauuagag

SEQ ID NO: 2769159 - RNA, 21 nt, Leptospira interrogans serovar lai str. 56601
gcuuuauagagauuuccuaaa

SEQ ID NO: 2769160 - RNA, 19 nt, Leptospira interrogans serovar lai str. 56601
gcuuucagcucuggucaau

SEQ ID NO: 2769161 - RNA, 13 nt, Leptospira interrogans serovar lai str. 56601
gcuuucucuuuuu

SEQ ID NO: 2769162 - RNA, 14 nt, Leptospira interrogans serovar lai str. 56601
gcuuuguaauaaaa

SEQ ID NO: 2769163 - RNA, 19 nt, Leptospira interrogans serovar lai str. 56601
gcuuuguagaauaggaucg

SEQ ID NO: 2769164 - RNA, 20 nt, Leptospira interrogans serovar lai str. 56601
gcuuuuaauaauucaaaauu

SEQ ID NO: 2769165 - RNA, 21 nt, Leptospira interrogans serovar lai str. 56601
gcuuuuuuaaaccuuccuuug

SEQ ID NO: 2769166 - RNA, 13 nt, Leptospira interrogans serovar lai str. 56601
ggaaaaaauauga

SEQ ID NO: 2769167 - RNA, 19 nt, Leptospira interrogans serovar lai str. 56601
ggaaaaaauaugauuuaaa

SEQ ID NO: 2769168 - RNA, 12 nt, Leptospira interrogans serovar lai str. 56601
ggaaaaaugaaa

SEQ ID NO: 2769169 - RNA, 21 nt, Leptospira interrogans serovar lai str. 56601
ggaaaaguuuucuuuaucaga

SEQ ID NO: 2769170 - RNA, 11 nt, Leptospira interrogans serovar lai str. 56601
ggaaaaucaga

SEQ ID NO: 2769171 - RNA, 22 nt, Leptospira interrogans serovar lai str. 56601
ggaaaauugaauauucacuuuu

SEQ ID NO: 2769172 - RNA, 13 nt, Leptospira interrogans serovar lai str. 56601
ggaaacauuauau

SEQ ID NO: 2769173 - RNA, 21 nt, Leptospira interrogans serovar lai str. 56601
ggaaacgucauaguucccaca

SEQ ID NO: 2769174 - RNA, 15 nt, Leptospira interrogans serovar lai str. 56601
ggaaagaaggauuga

SEQ ID NO: 2769175 - RNA, 16 nt, Leptospira interrogans serovar lai str. 56601
ggaaauagaaagacuu

SEQ ID NO: 2769176 - RNA, 13 nt, Leptospira interrogans serovar lai str. 56601
ggaaaucuuuuaa

SEQ ID NO: 2769177 - RNA, 22 nt, Leptospira interrogans serovar lai str. 56601
ggaaaucuuuuaaaaaagguau

SEQ ID NO: 2769178 - RNA, 22 nt, Leptospira interrogans serovar lai str. 56601
ggaaauucauuuuucugaaaaa

SEQ ID NO: 2769179 - RNA, 18 nt, Leptospira interrogans serovar lai str. 56601
ggaaauuuauuuuaaaga

SEQ ID NO: 2769180 - RNA, 24 nt, Leptospira interrogans serovar lai str. 56601
ggaacauaaguuacucauuuccau

SEQ ID NO: 2769181 - RNA, 22 nt, Leptospira interrogans serovar lai str. 56601
ggaacccauggcuuugaaaaag

SEQ ID NO: 2769182 - RNA, 20 nt, Leptospira interrogans serovar lai str. 56601
ggaacuaccacaaaacuuaa

SEQ ID NO: 2769183 - RNA, 13 nt, Leptospira interrogans serovar lai str. 56601
ggaacuaccacca

SEQ ID NO: 2769184 - RNA, 17 nt, Leptospira interrogans serovar lai str. 56601
ggaacuacuacaaauca

SEQ ID NO: 2769185 - RNA, 20 nt, Leptospira interrogans serovar lai str. 56601
ggaacuacuacaauuaaaaa

SEQ ID NO: 2769186 - RNA, 23 nt, Leptospira interrogans serovar lai str. 56601
ggaacuacuacuuuuagaaaaaa

SEQ ID NO: 2769187 - RNA, 20 nt, Leptospira interrogans serovar lai str. 56601
ggaacuacugcauuuuauua

SEQ ID NO: 2769188 - RNA, 14 nt, Leptospira interrogans serovar lai str. 56601
ggaacuauuacaaa

SEQ ID NO: 2769189 - RNA, 23 nt, Leptospira interrogans serovar lai str. 56601
ggaacucccacuuuuaaagaaag

SEQ ID NO: 2769190 - RNA, 15 nt, Leptospira interrogans serovar lai str. 56601
ggaacucuauauaaa

SEQ ID NO: 2769191 - RNA, 17 nt, Leptospira interrogans serovar lai str. 56601
ggaacucucacaaauca

SEQ ID NO: 2769192 - RNA, 18 nt, Leptospira interrogans serovar lai str. 56601
ggaacucucacaaaucag

SEQ ID NO: 2769193 - RNA, 16 nt, Leptospira interrogans serovar lai str. 56601
ggaacuuuuauaauuc

SEQ ID NO: 2769194 - RNA, 11 nt, Leptospira interrogans serovar lai str. 56601
ggaagaacaac

SEQ ID NO: 2769195 - RNA, 23 nt, Leptospira interrogans serovar lai str. 56601
ggaagauaaaacguacuuacuga

SEQ ID NO: 2769196 - RNA, 17 nt, Leptospira interrogans serovar lai str. 56601
ggaauacuuuucuuccc

SEQ ID NO: 2769197 - RNA, 14 nt, Leptospira interrogans serovar lai str. 56601
ggaauauuccauuu

SEQ ID NO: 2769198 - RNA, 15 nt, Leptospira interrogans serovar lai str. 56601
ggaauauucuuuuua

SEQ ID NO: 2769199 - RNA, 17 nt, Leptospira interrogans serovar lai str. 56601
ggaaucccaaauucuuu

SEQ ID NO: 2769200 - RNA, 16 nt, Leptospira interrogans serovar lai str. 56601
ggaaucgaucuguaaa

SEQ ID NO: 2769201 - RNA, 21 nt, Leptospira interrogans serovar lai str. 56601
ggaaugacugaccguaaaagc

SEQ ID NO: 2769202 - RNA, 13 nt, Leptospira interrogans serovar lai str. 56601
ggaauucauaauu

SEQ ID NO: 2769203 - RNA, 18 nt, Leptospira interrogans serovar lai str. 56601
ggaauucauacuuuuaaa

SEQ ID NO: 2769204 - RNA, 23 nt, Leptospira interrogans serovar lai str. 56601
ggaauucauacuuuuaaaaaguu

SEQ ID NO: 2769205 - RNA, 20 nt, Leptospira interrogans serovar lai str. 56601
ggaauuccgacccagaaaaa

SEQ ID NO: 2769206 - RNA, 15 nt, Leptospira interrogans serovar lai str. 56601
ggaauuuaaguuauu

SEQ ID NO: 2769207 - RNA, 18 nt, Leptospira interrogans serovar lai str. 56601
ggaauuuccgauaaagaa

SEQ ID NO: 2769208 - RNA, 18 nt, Leptospira interrogans serovar lai str. 56601
ggaauuuuuaaaaagaau

SEQ ID NO: 2769209 - RNA, 19 nt, Leptospira interrogans serovar lai str. 56601
ggaauuuuuaaaaagaauu

SEQ ID NO: 2769210 - RNA, 21 nt, Leptospira interrogans serovar lai str. 56601
ggaauuuuucaacaacucuaa

SEQ ID NO: 2769211 - RNA, 21 nt, Leptospira interrogans serovar lai str. 56601
ggaauuuuuuaacaacucuaa

SEQ ID NO: 2769212 - RNA, 22 nt, Leptospira interrogans serovar lai str. 56601
ggacaaaucauaggauacaaaa

SEQ ID NO: 2769213 - RNA, 20 nt, Leptospira interrogans serovar lai str. 56601
ggacaaugcuuuccaaaagg

SEQ ID NO: 2769214 - RNA, 15 nt, Leptospira interrogans serovar lai str. 56601
ggacaauuuuucucu

SEQ ID NO: 2769215 - RNA, 15 nt, Leptospira interrogans serovar lai str. 56601
ggacauuguuucucg

SEQ ID NO: 2769216 - RNA, 23 nt, Leptospira interrogans serovar lai str. 56601
ggacuauuaggaaauacaaaaag

SEQ ID NO: 2769217 - RNA, 14 nt, Leptospira interrogans serovar lai str. 56601
ggacuuuccgaaua

SEQ ID NO: 2769218 - RNA, 14 nt, Leptospira interrogans serovar lai str. 56601
ggagaaaauuuaaa

SEQ ID NO: 2769219 - RNA, 12 nt, Leptospira interrogans serovar lai str. 56601
ggagaauguuug

SEQ ID NO: 2769220 - RNA, 19 nt, Leptospira interrogans serovar lai str. 56601
ggagaauuaauuuuucaau

SEQ ID NO: 2769221 - RNA, 16 nt, Leptospira interrogans serovar lai str. 56601
gguugaguucuuuuag

SEQ ID NO: 2769222 - RNA, 15 nt, Leptospira interrogans serovar lai str. 56601
gguuggauuccuuuc

SEQ ID NO: 2769223 - RNA, 19 nt, Leptospira interrogans serovar lai str. 56601
gguuguaacucaaaauuuc

SEQ ID NO: 2769224 - RNA, 18 nt, Leptospira interrogans serovar lai str. 56601
gguuucacaaauuuuaua

SEQ ID NO: 2769225 - RNA, 15 nt, Leptospira interrogans serovar lai str. 56601
gguuuguaacuccua

SEQ ID NO: 2769226 - RNA, 21 nt, Leptospira interrogans serovar lai str. 56601
gguuuuuuaauauuagaauug

SEQ ID NO: 2769227 - RNA, 18 nt, Leptospira interrogans serovar lai str. 56601
guaaaaaaacaugaagaa

SEQ ID NO: 2769228 - RNA, 14 nt, Leptospira interrogans serovar lai str. 56601
guaaaaaauccaug

SEQ ID NO: 2769229 - RNA, 16 nt, Leptospira interrogans serovar lai str. 56601
guaaaaagcguuucau

SEQ ID NO: 2769230 - RNA, 21 nt, Leptospira interrogans serovar lai str. 56601
guaaaaauaucaguuucuccg

SEQ ID NO: 2769231 - RNA, 20 nt, Leptospira interrogans serovar lai str. 56601
guaaaaauauuggguauuua

SEQ ID NO: 2769232 - RNA, 20 nt, Leptospira interrogans serovar lai str. 56601
guaaaacccaucguaaacaa

SEQ ID NO: 2769233 - RNA, 15 nt, Leptospira interrogans serovar lai str. 56601
guaaaacuucuuuaa

SEQ ID NO: 2769234 - RNA, 18 nt, Leptospira interrogans serovar lai str. 56601
guaaaagcuuauacuuua

SEQ ID NO: 2769235 - RNA, 13 nt, Leptospira interrogans serovar lai str. 56601
guaaaaggagaau

SEQ ID NO: 2769236 - RNA, 23 nt, Leptospira interrogans serovar lai str. 56601
guaaaaucgaguuucacaaaaau

SEQ ID NO: 2769237 - RNA, 16 nt, Leptospira interrogans serovar lai str. 56601
guaaaaucuuuaaguu

SEQ ID NO: 2769238 - RNA, 17 nt, Leptospira interrogans serovar lai str. 56601
guaaaauggucuuuuag

SEQ ID NO: 2769239 - RNA, 12 nt, Leptospira interrogans serovar lai str. 56601
guaaaauuaaag

SEQ ID NO: 2769240 - RNA, 12 nt, Leptospira interrogans serovar lai str. 56601
guaaaauuuaaa

SEQ ID NO: 2769241 - RNA, 13 nt, Leptospira interrogans serovar lai str. 56601
guaaaauuuaaaa

SEQ ID NO: 2769242 - RNA, 17 nt, Leptospira interrogans serovar lai str. 56601
guaaaauuuaaaauucu

SEQ ID NO: 2769243 - RNA, 13 nt, Leptospira interrogans serovar lai str. 56601
guaaaauuuaaag

SEQ ID NO: 2769244 - RNA, 13 nt, Leptospira interrogans serovar lai str. 56601
guaaacuacuaaa

SEQ ID NO: 2769245 - RNA, 14 nt, Leptospira interrogans serovar lai str. 56601
guaaacuacuaaau

SEQ ID NO: 2769246 - RNA, 19 nt, Leptospira interrogans serovar lai str. 56601
guaaacuaucgaaugcgac

SEQ ID NO: 2769247 - RNA, 14 nt, Leptospira interrogans serovar lai str. 56601
guaaacuugauuaa

SEQ ID NO: 2769248 - RNA, 13 nt, Leptospira interrogans serovar lai str. 56601
guaaagaaaacca

SEQ ID NO: 2769249 - RNA, 23 nt, Leptospira interrogans serovar lai str. 56601
guaaagaacgauuuuuuacaaaa

SEQ ID NO: 2769250 - RNA, 20 nt, Leptospira interrogans serovar lai str. 56601
guaaagacgauccuuuuuug

SEQ ID NO: 2769251 - RNA, 15 nt, Leptospira interrogans serovar lai str. 56601
guaaagauuagaaaa

SEQ ID NO: 2769252 - RNA, 16 nt, Leptospira interrogans serovar lai str. 56601
guaaaggaauccauga

SEQ ID NO: 2769253 - RNA, 12 nt, Leptospira interrogans serovar lai str. 56601
guaaaguucuuu

SEQ ID NO: 2769254 - RNA, 17 nt, Leptospira interrogans serovar lai str. 56601
guaaaguucuuuucuua

SEQ ID NO: 2769255 - RNA, 14 nt, Leptospira interrogans serovar lai str. 56601
guaaaguuuagauu

SEQ ID NO: 2769256 - RNA, 15 nt, Leptospira interrogans serovar lai str. 56601
guaaauaaaaaacga

SEQ ID NO: 2769257 - RNA, 20 nt, Leptospira interrogans serovar lai str. 56601
guaaauaaaccgcauaaaag

SEQ ID NO: 2769258 - RNA, 23 nt, Leptospira interrogans serovar lai str. 56601
guaaauaucaaaugugagaguuc

SEQ ID NO: 2769259 - RNA, 16 nt, Leptospira interrogans serovar lai str. 56601
guaaauauuuuuuuua

SEQ ID NO: 2769260 - RNA, 19 nt, Leptospira interrogans serovar lai str. 56601
guaaaucgaugguuucaau

SEQ ID NO: 2769261 - RNA, 19 nt, Leptospira interrogans serovar lai str. 56601
guaaaucuauucuuaaaau

SEQ ID NO: 2769262 - RNA, 18 nt, Leptospira interrogans serovar lai str. 56601
guaaaugaauuggaaaga

SEQ ID NO: 2769263 - RNA, 20 nt, Leptospira interrogans serovar lai str. 56601
guaaauggauaaauuuuaga

SEQ ID NO: 2769264 - RNA, 19 nt, Leptospira interrogans serovar lai str. 56601
guaaauggugguuccuaua

SEQ ID NO: 2769265 - RNA, 12 nt, Leptospira interrogans serovar lai str. 56601
guaaauuaacag

SEQ ID NO: 2769266 - RNA, 20 nt, Leptospira interrogans serovar lai str. 56601
guaaauuauggacuauuuua

SEQ ID NO: 2769267 - RNA, 16 nt, Leptospira interrogans serovar lai str. 56601
guaaauucaaagcaag

SEQ ID NO: 2769268 - RNA, 21 nt, Leptospira interrogans serovar lai str. 56601
guaaauucacuguuaaaagau

SEQ ID NO: 2769269 - RNA, 21 nt, Leptospira interrogans serovar lai str. 56601
guaaauuuuuaucauaaaaca

SEQ ID NO: 2769270 - RNA, 15 nt, Leptospira interrogans serovar lai str. 56601
guaacagaaaaaugu

SEQ ID NO: 2769271 - RNA, 15 nt, Leptospira interrogans serovar lai str. 56601
guaacaguucucaca

SEQ ID NO: 2769272 - RNA, 10 nt, Leptospira interrogans serovar lai str. 56601
guaaccuuug

SEQ ID NO: 2769273 - RNA, 19 nt, Leptospira interrogans serovar lai str. 56601
guaacuacuauguuuuugg

SEQ ID NO: 2769274 - RNA, 23 nt, Leptospira interrogans serovar lai str. 56601
guaacuacugcauucuuagaauu

SEQ ID NO: 2769275 - RNA, 23 nt, Leptospira interrogans serovar lai str. 56601
guaacuuucuuuuagaaaauuau

SEQ ID NO: 2769276 - RNA, 11 nt, Leptospira interrogans serovar lai str. 56601
guaagaaaaaa

SEQ ID NO: 2769277 - RNA, 15 nt, Leptospira interrogans serovar lai str. 56601
guaagaaaaccauga

SEQ ID NO: 2769278 - RNA, 12 nt, Leptospira interrogans serovar lai str. 56601
guaagaaaauau

SEQ ID NO: 2769279 - RNA, 18 nt, Leptospira interrogans serovar lai str. 56601
guaagaaaauuuggacga

SEQ ID NO: 2769280 - RNA, 13 nt, Leptospira interrogans serovar lai str. 56601
guaagaaauaugg

SEQ ID NO: 2769281 - RNA, 22 nt, Leptospira interrogans serovar lai str. 56601
guaagaauccaugauccauuuu

SEQ ID NO: 2769282 - RNA, 23 nt, Leptospira interrogans serovar lai str. 56601
guaagagcuccuacauuuuauuu

SEQ ID NO: 2769283 - RNA, 24 nt, Leptospira interrogans serovar lai str. 56601
guaagaguuccuacaucauuugua

SEQ ID NO: 2769284 - RNA, 15 nt, Leptospira interrogans serovar lai str. 56601
guaagcguaaauuac

SEQ ID NO: 2769285 - RNA, 16 nt, Leptospira interrogans serovar lai str. 56601
guaaggcaaacuuuuu

SEQ ID NO: 2769286 - RNA, 13 nt, Leptospira interrogans serovar lai str. 56601
guaaguaauauau

SEQ ID NO: 2769287 - RNA, 22 nt, Leptospira interrogans serovar lai str. 56601
guaaguaauuacccuaaagcua

SEQ ID NO: 2769288 - RNA, 13 nt, Leptospira interrogans serovar lai str. 56601
guaaguuaaauau

SEQ ID NO: 2769289 - RNA, 20 nt, Leptospira interrogans serovar lai str. 56601
guaaguuaaauauaaaagau

SEQ ID NO: 2769290 - RNA, 11 nt, Leptospira interrogans serovar lai str. 56601
guaauaaaaau

SEQ ID NO: 2769291 - RNA, 15 nt, Leptospira interrogans serovar lai str. 56601
guaauaguucccaca

SEQ ID NO: 2769292 - RNA, 18 nt, Leptospira interrogans serovar lai str. 56601
guaauaguucccacaguu

SEQ ID NO: 2769293 - RNA, 13 nt, Leptospira interrogans serovar lai str. 56601
guaauauauucaa

SEQ ID NO: 2769294 - RNA, 17 nt, Leptospira interrogans serovar lai str. 56601
guaauauauucaauuuc

SEQ ID NO: 2769295 - RNA, 16 nt, Leptospira interrogans serovar lai str. 56601
guaauaucuaaaaccu

SEQ ID NO: 2769296 - RNA, 19 nt, Leptospira interrogans serovar lai str. 56601
guaaucucgauuucuaaaa

SEQ ID NO: 2769297 - RNA, 18 nt, Leptospira interrogans serovar lai str. 56601
guaaucuuuuuaaaaguu

SEQ ID NO: 2769298 - RNA, 19 nt, Leptospira interrogans serovar lai str. 56601
guaaugacgauuuucuccu

SEQ ID NO: 2769299 - RNA, 14 nt, Leptospira interrogans serovar lai str. 56601
guaauuaaauuuuc

SEQ ID NO: 2769300 - RNA, 14 nt, Leptospira interrogans serovar lai str. 56601
guaauuauaauuga

SEQ ID NO: 2769301 - RNA, 15 nt, Leptospira interrogans serovar lai str. 56601
guaauucguuccaaa

SEQ ID NO: 2769302 - RNA, 14 nt, Leptospira interrogans serovar lai str. 56601
guaauucuuuggaa

SEQ ID NO: 2769303 - RNA, 24 nt, Leptospira interrogans serovar lai str. 56601
guaauuggccguaauaucuccaaa

SEQ ID NO: 2769304 - RNA, 16 nt, Leptospira interrogans serovar lai str. 56601
guauuuuagaaauauu

SEQ ID NO: 2769305 - RNA, 16 nt, Leptospira interrogans serovar lai str. 56601
guauuuuauuauauaa

SEQ ID NO: 2769306 - RNA, 20 nt, Leptospira interrogans serovar lai str. 56601
guauuuucggcauuuuauua

SEQ ID NO: 2769307 - RNA, 23 nt, Leptospira interrogans serovar lai str. 56601
guauuuugauccguuuuaaaauu

SEQ ID NO: 2769308 - RNA, 21 nt, Leptospira interrogans serovar lai str. 56601
guauuuuuacccgaucuuuuu

SEQ ID NO: 2769309 - RNA, 18 nt, Leptospira interrogans serovar lai str. 56601
gucaaaauuuaaauccua

SEQ ID NO: 2769310 - RNA, 15 nt, Leptospira interrogans serovar lai str. 56601
gucaaaauuuuguuu

SEQ ID NO: 2769311 - RNA, 15 nt, Leptospira interrogans serovar lai str. 56601
gucaaacuuacaaaa

SEQ ID NO: 2769312 - RNA, 21 nt, Leptospira interrogans serovar lai str. 56601
gucaaaucaucuaucuuuuca

SEQ ID NO: 2769313 - RNA, 17 nt, Leptospira interrogans serovar lai str. 56601
gucaaaugcgacuuaau

SEQ ID NO: 2769314 - RNA, 19 nt, Leptospira interrogans serovar lai str. 56601
gucaaauuuggaaauugug

SEQ ID NO: 2769315 - RNA, 18 nt, Leptospira interrogans serovar lai str. 56601
gucaaguuauugcguauu

SEQ ID NO: 2769316 - RNA, 16 nt, Leptospira interrogans serovar lai str. 56601
gucaaguuauuguaaa

SEQ ID NO: 2769317 - RNA, 17 nt, Leptospira interrogans serovar lai str. 56601
gucaaguuauuguaaaa

SEQ ID NO: 2769318 - RNA, 22 nt, Leptospira interrogans serovar lai str. 56601
gucaaucuccacuauggaauuu

SEQ ID NO: 2769319 - RNA, 18 nt, Leptospira interrogans serovar lai str. 56601
gucacauuguguuuuuua

SEQ ID NO: 2769320 - RNA, 13 nt, Leptospira interrogans serovar lai str. 56601
gucacuauuuuua

SEQ ID NO: 2769321 - RNA, 14 nt, Leptospira interrogans serovar lai str. 56601
gucagaccuaaaau

SEQ ID NO: 2769322 - RNA, 14 nt, Leptospira interrogans serovar lai str. 56601
gucauaaaccgauu

SEQ ID NO: 2769323 - RNA, 22 nt, Leptospira interrogans serovar lai str. 56601
gucauuaagggaguuuguaaag

SEQ ID NO: 2769324 - RNA, 19 nt, Leptospira interrogans serovar lai str. 56601
gucauugaaggguaacuca

SEQ ID NO: 2769325 - RNA, 14 nt, Leptospira interrogans serovar lai str. 56601
gucauuuacucaaa

SEQ ID NO: 2769326 - RNA, 16 nt, Leptospira interrogans serovar lai str. 56601
gucauuuacucaaauu

SEQ ID NO: 2769327 - RNA, 19 nt, Leptospira interrogans serovar lai str. 56601
guccaaucagauuuuugua

SEQ ID NO: 2769328 - RNA, 23 nt, Leptospira interrogans serovar lai str. 56601
guccacaaauugaauuugcagua

SEQ ID NO: 2769329 - RNA, 14 nt, Leptospira interrogans serovar lai str. 56601
gucccaaaaacuca

SEQ ID NO: 2769330 - RNA, 23 nt, Leptospira interrogans serovar lai str. 56601
gucccaaaaccucaaaaaauuuu

SEQ ID NO: 2769331 - RNA, 15 nt, Leptospira interrogans serovar lai str. 56601
gucccaaaauuucua

SEQ ID NO: 2769332 - RNA, 22 nt, Leptospira interrogans serovar lai str. 56601
gucccauuuagcaauuugugaa

SEQ ID NO: 2769333 - RNA, 19 nt, Leptospira interrogans serovar lai str. 56601
guccgcaauaucccaaauu

SEQ ID NO: 2769334 - RNA, 17 nt, Leptospira interrogans serovar lai str. 56601
guccuaaaaccucaaaa

SEQ ID NO: 2769335 - RNA, 23 nt, Leptospira interrogans serovar lai str. 56601
guccuaaaaccucaaaaaauuuu

SEQ ID NO: 2769336 - RNA, 22 nt, Leptospira interrogans serovar lai str. 56601
guccucaaaucuucgguuuaau

SEQ ID NO: 2769337 - RNA, 22 nt, Leptospira interrogans serovar lai str. 56601
guccuccaaacaauuuuuugaa

SEQ ID NO: 2769338 - RNA, 13 nt, Leptospira interrogans serovar lai str. 56601
guccuccagaacc

SEQ ID NO: 2769339 - RNA, 14 nt, Leptospira interrogans serovar lai str. 56601
guccucuaugaaac

SEQ ID NO: 2769340 - RNA, 22 nt, Leptospira interrogans serovar lai str. 56601
guccuucgaaaaacccagcgcc

SEQ ID NO: 2769341 - RNA, 21 nt, Leptospira interrogans serovar lai str. 56601
gucgaacucacguuacuacuc

SEQ ID NO: 2769342 - RNA, 19 nt, Leptospira interrogans serovar lai str. 56601
gucgacuaucgcaaauaau

SEQ ID NO: 2769343 - RNA, 21 nt, Leptospira interrogans serovar lai str. 56601
gucgacuuugacuugaaaaag

SEQ ID NO: 2769344 - RNA, 15 nt, Leptospira interrogans serovar lai str. 56601
gucgauuagcuuaac

SEQ ID NO: 2769345 - RNA, 13 nt, Leptospira interrogans serovar lai str. 56601
gucgauuucuuuc

SEQ ID NO: 2769346 - RNA, 18 nt, Leptospira interrogans serovar lai str. 56601
gucgcaacauaauguuuc

SEQ ID NO: 2769347 - RNA, 14 nt, Leptospira interrogans serovar lai str. 56601
gucgcauuuagcaa

SEQ ID NO: 2769348 - RNA, 20 nt, Leptospira interrogans serovar lai str. 56601
gucgcgaguaaauccgugaa

SEQ ID NO: 2769349 - RNA, 18 nt, Leptospira interrogans serovar lai str. 56601
gucgcucugugaaacuca

SEQ ID NO: 2769350 - RNA, 14 nt, Leptospira interrogans serovar lai str. 56601
gucggaacacuuga

SEQ ID NO: 2769351 - RNA, 18 nt, Leptospira interrogans serovar lai str. 56601
gucguauauuagauuuau

SEQ ID NO: 2769352 - RNA, 12 nt, Leptospira interrogans serovar lai str. 56601
gucguauuaaag

SEQ ID NO: 2769353 - RNA, 16 nt, Leptospira interrogans serovar lai str. 56601
gucuacgauuucucca

SEQ ID NO: 2769354 - RNA, 21 nt, Leptospira interrogans serovar lai str. 56601
gucuauaaaauucaaaaagaa

SEQ ID NO: 2769355 - RNA, 22 nt, Leptospira interrogans serovar lai str. 56601
gucuauaaauucaucuaaaaaa

SEQ ID NO: 2769356 - RNA, 17 nt, Leptospira interrogans serovar lai str. 56601
gucuaucagcuuucuuc

SEQ ID NO: 2769357 - RNA, 16 nt, Leptospira interrogans serovar lai str. 56601
gucuaucuuuuuuaaa

SEQ ID NO: 2769358 - RNA, 17 nt, Leptospira interrogans serovar lai str. 56601
gucuaucuuuuuuaaaa

SEQ ID NO: 2769359 - RNA, 16 nt, Leptospira interrogans serovar lai str. 56601
gucuaugacgaauugc

SEQ ID NO: 2769360 - RNA, 13 nt, Leptospira interrogans serovar lai str. 56601
gucuauuucccaa

SEQ ID NO: 2769361 - RNA, 13 nt, Leptospira interrogans serovar lai str. 56601
gucucaaaaauau

SEQ ID NO: 2769362 - RNA, 22 nt, Leptospira interrogans serovar lai str. 56601
gucucaaaaccuguaaaugaau

SEQ ID NO: 2769363 - RNA, 22 nt, Leptospira interrogans serovar lai str. 56601
gucucaaaauuaagaaucaaua

SEQ ID NO: 2769364 - RNA, 22 nt, Leptospira interrogans serovar lai str. 56601
gucucaagauuuaauuuagaaa

SEQ ID NO: 2769365 - RNA, 17 nt, Leptospira interrogans serovar lai str. 56601
gucucaccaacaacacc

SEQ ID NO: 2769366 - RNA, 18 nt, Leptospira interrogans serovar lai str. 56601
gucuccagcauuuagaaa

SEQ ID NO: 2769367 - RNA, 22 nt, Leptospira interrogans serovar lai str. 56601
gucuccagcauuuagaaagcga

SEQ ID NO: 2769368 - RNA, 13 nt, Leptospira interrogans serovar lai str. 56601
gucuccauaauac

SEQ ID NO: 2769369 - RNA, 21 nt, Leptospira interrogans serovar lai str. 56601
gucucgaaacccaaaaaugua

SEQ ID NO: 2769370 - RNA, 22 nt, Leptospira interrogans serovar lai str. 56601
gucucuuuauauaaaauuugaa

SEQ ID NO: 2769371 - RNA, 19 nt, Leptospira interrogans serovar lai str. 56601
gucugaaggaauauucauu

SEQ ID NO: 2769372 - RNA, 13 nt, Leptospira interrogans serovar lai str. 56601
gucugugaucgau

SEQ ID NO: 2769373 - RNA, 23 nt, Leptospira interrogans serovar lai str. 56601
gucuucuaaaucuaauucuucua

SEQ ID NO: 2769374 - RNA, 13 nt, Leptospira interrogans serovar lai str. 56601
gucuucuuguaau

SEQ ID NO: 2769375 - RNA, 19 nt, Leptospira interrogans serovar lai str. 56601
gucuucuuuacaauuugcu

SEQ ID NO: 2769376 - RNA, 15 nt, Leptospira interrogans serovar lai str. 56601
gucuuuaaaaaauua

SEQ ID NO: 2769377 - RNA, 17 nt, Leptospira interrogans serovar lai str. 56601
gucuuuaauuucaauuu

SEQ ID NO: 2769378 - RNA, 23 nt, Leptospira interrogans serovar lai str. 56601
gucuuucuacaccaguauucaau

SEQ ID NO: 2769379 - RNA, 11 nt, Leptospira interrogans serovar lai str. 56601
gucuuucuaua

SEQ ID NO: 2769380 - RNA, 21 nt, Leptospira interrogans serovar lai str. 56601
gucuuugaauucgcuuugguc

SEQ ID NO: 2769381 - RNA, 16 nt, Leptospira interrogans serovar lai str. 56601
gucuuuuucuacaagu

SEQ ID NO: 2769382 - RNA, 23 nt, Leptospira interrogans serovar lai str. 56601
gugaaaaacgggcccaaauaaaa

SEQ ID NO: 2769383 - RNA, 14 nt, Leptospira interrogans serovar lai str. 56601
gugaaaguaaucuu

SEQ ID NO: 2769384 - RNA, 16 nt, Leptospira interrogans serovar lai str. 56601
gugaacagucuuuuua

SEQ ID NO: 2769385 - RNA, 16 nt, Leptospira interrogans serovar lai str. 56601
gugaacuauuuauaaa

SEQ ID NO: 2769386 - RNA, 16 nt, Leptospira interrogans serovar lai str. 56601
guuauauuaaaaugua

SEQ ID NO: 2769387 - RNA, 19 nt, Leptospira interrogans serovar lai str. 56601
guuaucaacuuuuggaaca

SEQ ID NO: 2769388 - RNA, 16 nt, Leptospira interrogans serovar lai str. 56601
guuaucaauagaaaua

SEQ ID NO: 2769389 - RNA, 19 nt, Leptospira interrogans serovar lai str. 56601
guuaucaauagaaauacca

SEQ ID NO: 2769390 - RNA, 18 nt, Leptospira interrogans serovar lai str. 56601
guuauccgauuuuuguuu

SEQ ID NO: 2769391 - RNA, 23 nt, Leptospira interrogans serovar lai str. 56601
guuauccuuacgaugucuuuuca

SEQ ID NO: 2769392 - RNA, 23 nt, Leptospira interrogans serovar lai str. 56601
guuaugacccaagauucaaagau

SEQ ID NO: 2769393 - RNA, 16 nt, Leptospira interrogans serovar lai str. 56601
guuaugcaaauacaac

SEQ ID NO: 2769394 - RNA, 16 nt, Leptospira interrogans serovar lai str. 56601
guuauuaaaauuuccc

SEQ ID NO: 2769395 - RNA, 13 nt, Leptospira interrogans serovar lai str. 56601
guuauuggaucgu

SEQ ID NO: 2769396 - RNA, 17 nt, Leptospira interrogans serovar lai str. 56601
guuauuuagaucaaaua

SEQ ID NO: 2769397 - RNA, 16 nt, Leptospira interrogans serovar lai str. 56601
guucaaaauuuaucug

SEQ ID NO: 2769398 - RNA, 21 nt, Leptospira interrogans serovar lai str. 56601
guucaaacaacaaaaaauaua

SEQ ID NO: 2769399 - RNA, 19 nt, Leptospira interrogans serovar lai str. 56601
guucaacaaacaaauagaa

SEQ ID NO: 2769400 - RNA, 15 nt, Leptospira interrogans serovar lai str. 56601
guucacucaaaauac

SEQ ID NO: 2769401 - RNA, 19 nt, Leptospira interrogans serovar lai str. 56601
guucagaugaauugaauuu

SEQ ID NO: 2769402 - RNA, 19 nt, Leptospira interrogans serovar lai str. 56601
guucagauucgaacuuuuu

SEQ ID NO: 2769403 - RNA, 19 nt, Leptospira interrogans serovar lai str. 56601
guucagguaguaguugcac

SEQ ID NO: 2769404 - RNA, 16 nt, Leptospira interrogans serovar lai str. 56601
guuccaaaaccucaaa

SEQ ID NO: 2769405 - RNA, 17 nt, Leptospira interrogans serovar lai str. 56601
guuccaaaaccucaaaa

SEQ ID NO: 2769406 - RNA, 20 nt, Leptospira interrogans serovar lai str. 56601
guuccaaaaccucaaaaaau

SEQ ID NO: 2769407 - RNA, 23 nt, Leptospira interrogans serovar lai str. 56601
guuccaaaaccucaaaaaauuua

SEQ ID NO: 2769408 - RNA, 22 nt, Leptospira interrogans serovar lai str. 56601
guuccaaauuacucuuucuauu

SEQ ID NO: 2769409 - RNA, 19 nt, Leptospira interrogans serovar lai str. 56601
guuccaacguaccaaaacc

SEQ ID NO: 2769410 - RNA, 12 nt, Leptospira interrogans serovar lai str. 56601
guuccauaaaga

SEQ ID NO: 2769411 - RNA, 11 nt, Leptospira interrogans serovar lai str. 56601
guucccacaaa

SEQ ID NO: 2769412 - RNA, 14 nt, Leptospira interrogans serovar lai str. 56601
guucccacaguucc

SEQ ID NO: 2769413 - RNA, 16 nt, Leptospira interrogans serovar lai str. 56601
guucccacauucgauu

SEQ ID NO: 2769414 - RNA, 15 nt, Leptospira interrogans serovar lai str. 56601
guucccgccucacaa

SEQ ID NO: 2769415 - RNA, 15 nt, Leptospira interrogans serovar lai str. 56601
guuccgaaaauuuga

SEQ ID NO: 2769416 - RNA, 22 nt, Leptospira interrogans serovar lai str. 56601
guuccgaaaggaaaagaaaccg

SEQ ID NO: 2769417 - RNA, 20 nt, Leptospira interrogans serovar lai str. 56601
guuccgauacgaguaaaaau

SEQ ID NO: 2769418 - RNA, 21 nt, Leptospira interrogans serovar lai str. 56601
guuccuaacuuugaaaauuuu

SEQ ID NO: 2769419 - RNA, 9 nt, Leptospira interrogans serovar lai str. 56601
guuccuaca

SEQ ID NO: 2769420 - RNA, 12 nt, Leptospira interrogans serovar lai str. 56601
guuccuacaaau

SEQ ID NO: 2769421 - RNA, 14 nt, Leptospira interrogans serovar lai str. 56601
guuccuacaauuca

SEQ ID NO: 2769422 - RNA, 22 nt, Leptospira interrogans serovar lai str. 56601
guuccuacaucauuuguagaga

SEQ ID NO: 2769423 - RNA, 13 nt, Leptospira interrogans serovar lai str. 56601
guuccuacauuuu

SEQ ID NO: 2769424 - RNA, 16 nt, Leptospira interrogans serovar lai str. 56601
guuccuacauuuucag

SEQ ID NO: 2769425 - RNA, 18 nt, Leptospira interrogans serovar lai str. 56601
guuccuauauagauccug

SEQ ID NO: 2769426 - RNA, 14 nt, Leptospira interrogans serovar lai str. 56601
guuccuucuacaau

SEQ ID NO: 2769427 - RNA, 17 nt, Leptospira interrogans serovar lai str. 56601
guuccuuugaauaaaac

SEQ ID NO: 2769428 - RNA, 19 nt, Leptospira interrogans serovar lai str. 56601
guuccuuugaauaaaaccg

SEQ ID NO: 2769429 - RNA, 20 nt, Leptospira interrogans serovar lai str. 56601
guuccuuugaauaaaaccgc

SEQ ID NO: 2769430 - RNA, 14 nt, Leptospira interrogans serovar lai str. 56601
guucggaaaaagua

SEQ ID NO: 2769431 - RNA, 19 nt, Leptospira interrogans serovar lai str. 56601
guucggcuuaagaaaaucu

SEQ ID NO: 2769432 - RNA, 18 nt, Leptospira interrogans serovar lai str. 56601
guucgggauuuuuuuauc

SEQ ID NO: 2769433 - RNA, 18 nt, Leptospira interrogans serovar lai str. 56601
guucguaugaguucccac

SEQ ID NO: 2769434 - RNA, 13 nt, Leptospira interrogans serovar lai str. 56601
guucgugaagaaa

SEQ ID NO: 2769435 - RNA, 20 nt, Leptospira interrogans serovar lai str. 56601
guucuaaccggaauuuccaa

SEQ ID NO: 2769436 - RNA, 12 nt, Leptospira interrogans serovar lai str. 56601
guucuaaucucg

SEQ ID NO: 2769437 - RNA, 18 nt, Leptospira interrogans serovar lai str. 56601
guucuaaugucguuaaau

SEQ ID NO: 2769438 - RNA, 15 nt, Leptospira interrogans serovar lai str. 56601
guucuacaaaauuua

SEQ ID NO: 2769439 - RNA, 21 nt, Leptospira interrogans serovar lai str. 56601
guucuaguauuauuuuccuuu

SEQ ID NO: 2769440 - RNA, 15 nt, Leptospira interrogans serovar lai str. 56601
guucuauaaacucaa

SEQ ID NO: 2769441 - RNA, 23 nt, Leptospira interrogans serovar lai str. 56601
guucuaucgaauuuacaugaaac

SEQ ID NO: 2769442 - RNA, 19 nt, Leptospira interrogans serovar lai str. 56601
guucucuauugucucaaaa

SEQ ID NO: 2769443 - RNA, 19 nt, Leptospira interrogans serovar lai str. 56601
guucugggcucaaaaaggc

SEQ ID NO: 2769444 - RNA, 17 nt, Leptospira interrogans serovar lai str. 56601
guucuggguaaaaaaaa

SEQ ID NO: 2769445 - RNA, 15 nt, Leptospira interrogans serovar lai str. 56601
guucuuaaaauugug

SEQ ID NO: 2769446 - RNA, 13 nt, Leptospira interrogans serovar lai str. 56601
guucuuacaauaa

SEQ ID NO: 2769447 - RNA, 16 nt, Leptospira interrogans serovar lai str. 56601
guucuuagacucagua

SEQ ID NO: 2769448 - RNA, 13 nt, Leptospira interrogans serovar lai str. 56601
guucuuagccuuu

SEQ ID NO: 2769449 - RNA, 19 nt, Leptospira interrogans serovar lai str. 56601
guucuuagucuaaaaacaa

SEQ ID NO: 2769450 - RNA, 12 nt, Leptospira interrogans serovar lai str. 56601
guucuucaaaau

SEQ ID NO: 2769451 - RNA, 21 nt, Leptospira interrogans serovar lai str. 56601
guucuucggcguugaguuuuu

SEQ ID NO: 2769452 - RNA, 15 nt, Leptospira interrogans serovar lai str. 56601
guucuugugggaacu

SEQ ID NO: 2769453 - RNA, 19 nt, Leptospira interrogans serovar lai str. 56601
guucuuuuauauaaucuaa

SEQ ID NO: 2769454 - RNA, 18 nt, Leptospira interrogans serovar lai str. 56601
guucuuuuugagacaaga

SEQ ID NO: 2769455 - RNA, 23 nt, Leptospira interrogans serovar lai str. 56601
guugaaaaucggauaguuuaaau

SEQ ID NO: 2769456 - RNA, 12 nt, Leptospira interrogans serovar lai str. 56601
guugaauaagau

SEQ ID NO: 2769457 - RNA, 23 nt, Leptospira interrogans serovar lai str. 56601
guugaauaagauuuuagaaucag

SEQ ID NO: 2769458 - RNA, 20 nt, Leptospira interrogans serovar lai str. 56601
guugaauaggauuuuagaau

SEQ ID NO: 2769459 - RNA, 16 nt, Leptospira interrogans serovar lai str. 56601
guugaauauuuucauc

SEQ ID NO: 2769460 - RNA, 14 nt, Leptospira interrogans serovar lai str. 56601
guugaaucuuaaau

SEQ ID NO: 2769461 - RNA, 22 nt, Leptospira interrogans serovar lai str. 56601
guugaaucuuaaaucuuuaaaa

SEQ ID NO: 2769462 - RNA, 14 nt, Leptospira interrogans serovar lai str. 56601
guugagcaguaaaa

SEQ ID NO: 2769463 - RNA, 23 nt, Leptospira interrogans serovar lai str. 56601
guugagcaguaaaaucuuuaagu

SEQ ID NO: 2769464 - RNA, 15 nt, Leptospira interrogans serovar lai str. 56601
guugaguaguaaaau

SEQ ID NO: 2769465 - RNA, 16 nt, Leptospira interrogans serovar lai str. 56601
guugaguucauucuga

SEQ ID NO: 2769466 - RNA, 12 nt, Leptospira interrogans serovar lai str. 56601
guugaguuucaa

SEQ ID NO: 2769467 - RNA, 17 nt, Leptospira interrogans serovar lai str. 56601
guugaguuuuuccuauu

SEQ ID NO: 2769468 - RNA, 21 nt, Leptospira interrogans serovar lai str. 56601
guugaguuuuuccuauuuuug

SEQ ID NO: 2769469 - RNA, 17 nt, Leptospira interrogans serovar lai str. 56601
guuucuuacucgacaaa

SEQ ID NO: 2769470 - RNA, 13 nt, Leptospira interrogans serovar lai str. 56601
guuucuuauauaa

SEQ ID NO: 2769471 - RNA, 14 nt, Leptospira interrogans serovar lai str. 56601
guuucuuauauaaa

SEQ ID NO: 2769472 - RNA, 19 nt, Leptospira interrogans serovar lai str. 56601
guuucuuauauaaaaguaa

SEQ ID NO: 2769473 - RNA, 15 nt, Leptospira interrogans serovar lai str. 56601
guuucuugaacucaa

SEQ ID NO: 2769474 - RNA, 11 nt, Leptospira interrogans serovar lai str. 56601
guuucuugugu

SEQ ID NO: 2769475 - RNA, 12 nt, Leptospira interrogans serovar lai str. 56601
guuugaaaaaau

SEQ ID NO: 2769476 - RNA, 16 nt, Leptospira interrogans serovar lai str. 56601
guuugaaaguucccaa

SEQ ID NO: 2769477 - RNA, 19 nt, Leptospira interrogans serovar lai str. 56601
guuugaauuuuacuaaaaa

SEQ ID NO: 2769478 - RNA, 13 nt, Leptospira interrogans serovar lai str. 56601
guuugaauuuuua

SEQ ID NO: 2769479 - RNA, 17 nt, Leptospira interrogans serovar lai str. 56601
guuugacguaaaaaaau

SEQ ID NO: 2769480 - RNA, 16 nt, Leptospira interrogans serovar lai str. 56601
guuugagguuuuaaaa

SEQ ID NO: 2769481 - RNA, 20 nt, Leptospira interrogans serovar lai str. 56601
guuugagugaucauucuuua

SEQ ID NO: 2769482 - RNA, 16 nt, Leptospira interrogans serovar lai str. 56601
guuugaguuucuuuuu

SEQ ID NO: 2769483 - RNA, 22 nt, Leptospira interrogans serovar lai str. 56601
guuugaguuucuuuuugauuag

SEQ ID NO: 2769484 - RNA, 18 nt, Leptospira interrogans serovar lai str. 56601
guuugauaauuugugaac

SEQ ID NO: 2769485 - RNA, 22 nt, Leptospira interrogans serovar lai str. 56601
guuugauuugugcaaaaauuuu

SEQ ID NO: 2769486 - RNA, 16 nt, Leptospira interrogans serovar lai str. 56601
guuugccaauaauucu

SEQ ID NO: 2769487 - RNA, 17 nt, Leptospira interrogans serovar lai str. 56601
guuuggcggaaugcaac

SEQ ID NO: 2769488 - RNA, 20 nt, Leptospira interrogans serovar lai str. 56601
guuugggauauucugaaagu

SEQ ID NO: 2769489 - RNA, 13 nt, Leptospira interrogans serovar lai str. 56601
guuuguaauaguu

SEQ ID NO: 2769490 - RNA, 15 nt, Leptospira interrogans serovar lai str. 56601
guuuguaauaguucc

SEQ ID NO: 2769491 - RNA, 15 nt, Leptospira interrogans serovar lai str. 56601
guuugucuuuuucua

SEQ ID NO: 2769492 - RNA, 16 nt, Leptospira interrogans serovar lai str. 56601
guuuguuccaaaaccu

SEQ ID NO: 2769493 - RNA, 14 nt, Leptospira interrogans serovar lai str. 56601
guuuguuuuuucca

SEQ ID NO: 2769494 - RNA, 18 nt, Leptospira interrogans serovar lai str. 56601
guuuuaaaacggaauuuu

SEQ ID NO: 2769495 - RNA, 13 nt, Leptospira interrogans serovar lai str. 56601
guuuuaaaauuua

SEQ ID NO: 2769496 - RNA, 21 nt, Leptospira interrogans serovar lai str. 56601
guuuuaaacuauagagaaauc

SEQ ID NO: 2769497 - RNA, 14 nt, Leptospira interrogans serovar lai str. 56601
guuuuaaugagaaa

SEQ ID NO: 2769498 - RNA, 16 nt, Leptospira interrogans serovar lai str. 56601
guuuuacgauccuuuu

SEQ ID NO: 2769499 - RNA, 14 nt, Leptospira interrogans serovar lai str. 56601
guuuuacuaaaaaa

SEQ ID NO: 2769500 - RNA, 16 nt, Leptospira interrogans serovar lai str. 56601
guuuuacuaaaaguaa

SEQ ID NO: 2769501 - RNA, 14 nt, Leptospira interrogans serovar lai str. 56601
guuuuacugaguuu

SEQ ID NO: 2769502 - RNA, 23 nt, Leptospira interrogans serovar lai str. 56601
guuuuauaaaaccugauuuuucu

SEQ ID NO: 2769503 - RNA, 16 nt, Leptospira interrogans serovar lai str. 56601
guuuuaucaaauaaag

SEQ ID NO: 2769504 - RNA, 17 nt, Leptospira interrogans serovar lai str. 56601
guuuuaucuaaaauuuc

SEQ ID NO: 2769505 - RNA, 20 nt, Leptospira interrogans serovar lai str. 56601
guuuuaucuaaaauuucauu

SEQ ID NO: 2769506 - RNA, 16 nt, Leptospira interrogans serovar lai str. 56601
guuuucaaaaaauuuc

SEQ ID NO: 2769507 - RNA, 16 nt, Leptospira interrogans serovar lai str. 56601
guuuucauaaauacaa

SEQ ID NO: 2769508 - RNA, 13 nt, Leptospira interrogans serovar lai str. 56601
guuuucauucaaa

SEQ ID NO: 2769509 - RNA, 15 nt, Leptospira interrogans serovar lai str. 56601
guuuuccagaaacca

SEQ ID NO: 2769510 - RNA, 23 nt, Leptospira interrogans serovar lai str. 56601
guuuuccagaaaccauaaaauaa

SEQ ID NO: 2769511 - RNA, 20 nt, Leptospira interrogans serovar lai str. 56601
guuuucccgcuggaaaauga

SEQ ID NO: 2769512 - RNA, 13 nt, Leptospira interrogans serovar lai str. 56601
guuuucguuguau

SEQ ID NO: 2769513 - RNA, 15 nt, Leptospira interrogans serovar lai str. 56601
guuuucuaaaggaaa

SEQ ID NO: 2769514 - RNA, 14 nt, Leptospira interrogans serovar lai str. 56601
guuuucuacaaaua

SEQ ID NO: 2769515 - RNA, 17 nt, Leptospira interrogans serovar lai str. 56601
guuuucucaaaaucuua

SEQ ID NO: 2769516 - RNA, 20 nt, Leptospira interrogans serovar lai str. 56601
guuuucuuuaucagaaaaac

SEQ ID NO: 2769517 - RNA, 15 nt, Leptospira interrogans serovar lai str. 56601
guuuucuuuuuuucu

SEQ ID NO: 2769518 - RNA, 23 nt, Leptospira interrogans serovar lai str. 56601
guuuucuuuuuuucucuucuaau

SEQ ID NO: 2769519 - RNA, 17 nt, Leptospira interrogans serovar lai str. 56601
guuuugagauuacaaaa

SEQ ID NO: 2769520 - RNA, 16 nt, Leptospira interrogans serovar lai str. 56601
guuuugaguaguagaa

SEQ ID NO: 2769521 - RNA, 16 nt, Leptospira interrogans serovar lai str. 56601
guuuugcucuaaaaua

SEQ ID NO: 2769522 - RNA, 20 nt, Leptospira interrogans serovar lai str. 56601
guuuuggcucuugcuaaaau

SEQ ID NO: 2769523 - RNA, 19 nt, Leptospira interrogans serovar lai str. 56601
guuuuguaauaguucccac

SEQ ID NO: 2769524 - RNA, 15 nt, Leptospira interrogans serovar lai str. 56601
guuuuuaaaaauuuc

SEQ ID NO: 2769525 - RNA, 12 nt, Leptospira interrogans serovar lai str. 56601
guuuuuaaaauc

SEQ ID NO: 2769526 - RNA, 17 nt, Leptospira interrogans serovar lai str. 56601
guuuuuaaaaucuucug

SEQ ID NO: 2769527 - RNA, 22 nt, Leptospira interrogans serovar lai str. 56601
guuuuuaaauccaacuuaaaac

SEQ ID NO: 2769528 - RNA, 19 nt, Leptospira interrogans serovar lai str. 56601
guuuuuaaauuaauauuua

SEQ ID NO: 2769529 - RNA, 13 nt, Leptospira interrogans serovar lai str. 56601
guuuuuaauuucg

SEQ ID NO: 2769530 - RNA, 14 nt, Leptospira interrogans serovar lai str. 56601
guuuuuaguuucaa

SEQ ID NO: 2769531 - RNA, 18 nt, Leptospira interrogans serovar lai str. 56601
guuuuuauaaauaaaaga

SEQ ID NO: 2769532 - RNA, 13 nt, Leptospira interrogans serovar lai str. 56601
guuuuuauucacu

SEQ ID NO: 2769533 - RNA, 12 nt, Leptospira interrogans serovar lai str. 56601
guuuuuccuuuu

SEQ ID NO: 2769534 - RNA, 17 nt, Leptospira interrogans serovar lai str. 56601
guuuuucgauaaaguaa

SEQ ID NO: 2769535 - RNA, 20 nt, Leptospira interrogans serovar lai str. 56601
guuuuucuaaauuuuauaaa

SEQ ID NO: 2769536 - RNA, 19 nt, Leptospira interrogans serovar lai str. 56601
guuuuucuuuuuaaauaca

SEQ ID NO: 2769537 - RNA, 19 nt, Leptospira interrogans serovar lai str. 56601
guuuuugaaaaaugaauuc

SEQ ID NO: 2769538 - RNA, 15 nt, Leptospira interrogans serovar lai str. 56601
guuuuuguaugaguu

SEQ ID NO: 2769539 - RNA, 15 nt, Leptospira interrogans serovar lai str. 56601
guuuuuguuuguauc

SEQ ID NO: 2769540 - RNA, 14 nt, Leptospira interrogans serovar lai str. 56601
guuuuuguuuucuu

SEQ ID NO: 2769541 - RNA, 11 nt, Leptospira interrogans serovar lai str. 56601
guuuuuuaaaa

SEQ ID NO: 2769542 - RNA, 17 nt, Leptospira interrogans serovar lai str. 56601
guuuuuuaaaauguagg

SEQ ID NO: 2769543 - RNA, 16 nt, Leptospira interrogans serovar lai str. 56601
guuuuuuaaucggaga

SEQ ID NO: 2769544 - RNA, 21 nt, Leptospira interrogans serovar lai str. 56601
guuuuuuaaucggagaauuua

SEQ ID NO: 2769545 - RNA, 20 nt, Leptospira interrogans serovar lai str. 56601
guuuuuuagaaacuaaaaaa

SEQ ID NO: 2769546 - RNA, 19 nt, Leptospira interrogans serovar lai str. 56601
guuuuuuauggaaaaauga

SEQ ID NO: 2769547 - RNA, 13 nt, Leptospira interrogans serovar lai str. 56601
guuuuuucaaaaa

SEQ ID NO: 2769548 - RNA, 20 nt, Leptospira interrogans serovar lai str. 56601
guuuuuuccagcccauucuu

SEQ ID NO: 2769549 - RNA, 19 nt, Leptospira interrogans serovar lai str. 56601
guuuuuuuggauaacgugu

SEQ ID NO: 2769550 - RNA, 20 nt, Leptospira interrogans serovar lai str. 56601
uaaaaaaacgcgaauuugac

SEQ ID NO: 2769551 - RNA, 12 nt, Leptospira interrogans serovar lai str. 56601
uaaaaaaauaag

SEQ ID NO: 2769552 - RNA, 13 nt, Leptospira interrogans serovar lai str. 56601
uaaaaaaauaaua

SEQ ID NO: 2769553 - RNA, 20 nt, Leptospira interrogans serovar lai str. 56601
uaaaacacgauuuauagaga

SEQ ID NO: 2769554 - RNA, 10 nt, Leptospira interrogans serovar lai str. 56601
uaaaaccaaa

SEQ ID NO: 2769555 - RNA, 13 nt, Leptospira interrogans serovar lai str. 56601
uaaaaccaaaaug

SEQ ID NO: 2769556 - RNA, 22 nt, Leptospira interrogans serovar lai str. 56601
uaaaaccaaucgauaacuugau

SEQ ID NO: 2769557 - RNA, 22 nt, Leptospira interrogans serovar lai str. 56601
uaaaacccaucguaaacaaaag

SEQ ID NO: 2769558 - RNA, 20 nt, Leptospira interrogans serovar lai str. 56601
uaaaaccguuccauaaauuu

SEQ ID NO: 2769559 - RNA, 22 nt, Leptospira interrogans serovar lai str. 56601
uaaaaccguuccauaaauuuug

SEQ ID NO: 2769560 - RNA, 14 nt, Leptospira interrogans serovar lai str. 56601
uaaaaccucaaaaa

SEQ ID NO: 2769561 - RNA, 16 nt, Leptospira interrogans serovar lai str. 56601
uaaaaccucaaaaaau

SEQ ID NO: 2769562 - RNA, 19 nt, Leptospira interrogans serovar lai str. 56601
uaaaaccuccggaaaaaac

SEQ ID NO: 2769563 - RNA, 15 nt, Leptospira interrogans serovar lai str. 56601
uaaaaccugauuuuu

SEQ ID NO: 2769564 - RNA, 18 nt, Leptospira interrogans serovar lai str. 56601
uaaaaccuggauuugucu

SEQ ID NO: 2769565 - RNA, 20 nt, Leptospira interrogans serovar lai str. 56601
uaaaacgaaauuauacaaaa

SEQ ID NO: 2769566 - RNA, 15 nt, Leptospira interrogans serovar lai str. 56601
uaaaacgaauugaua

SEQ ID NO: 2769567 - RNA, 23 nt, Leptospira interrogans serovar lai str. 56601
uaaaacuacuuuccguagaucuu

SEQ ID NO: 2769568 - RNA, 17 nt, Leptospira interrogans serovar lai str. 56601
uaaaacucaaaggaaaa

SEQ ID NO: 2769569 - RNA, 21 nt, Leptospira interrogans serovar lai str. 56601
uaaaacucaaaggaaaaugaa

SEQ ID NO: 2769570 - RNA, 20 nt, Leptospira interrogans serovar lai str. 56601
uaaaacugaguaccguuuau

SEQ ID NO: 2769571 - RNA, 16 nt, Leptospira interrogans serovar lai str. 56601
uaaaacugcgguaaua

SEQ ID NO: 2769572 - RNA, 17 nt, Leptospira interrogans serovar lai str. 56601
uaaaacuguaaauuaga

SEQ ID NO: 2769573 - RNA, 18 nt, Leptospira interrogans serovar lai str. 56601
uaaaacuguacaauagag

SEQ ID NO: 2769574 - RNA, 16 nt, Leptospira interrogans serovar lai str. 56601
uaaaacuucuuuaagg

SEQ ID NO: 2769575 - RNA, 15 nt, Leptospira interrogans serovar lai str. 56601
uaaaacuugucccaa

SEQ ID NO: 2769576 - RNA, 19 nt, Leptospira interrogans serovar lai str. 56601
uaaaacuuugguuuguaau

SEQ ID NO: 2769577 - RNA, 19 nt, Leptospira interrogans serovar lai str. 56601
uaaaacuuuucuaaauuga

SEQ ID NO: 2769578 - RNA, 19 nt, Leptospira interrogans serovar lai str. 56601
uaaaagaaacauuauacau

SEQ ID NO: 2769579 - RNA, 15 nt, Leptospira interrogans serovar lai str. 56601
uaaaagaagaugcuu

SEQ ID NO: 2769580 - RNA, 21 nt, Leptospira interrogans serovar lai str. 56601
uaaaagaauauuucuaaaauu

SEQ ID NO: 2769581 - RNA, 19 nt, Leptospira interrogans serovar lai str. 56601
uaaaagaaucauuaaucag

SEQ ID NO: 2769582 - RNA, 14 nt, Leptospira interrogans serovar lai str. 56601
uaaaagagacauug

SEQ ID NO: 2769583 - RNA, 16 nt, Leptospira interrogans serovar lai str. 56601
uaaaagaguaauucua

SEQ ID NO: 2769584 - RNA, 16 nt, Leptospira interrogans serovar lai str. 56601
uaaaagauucuauuuu

SEQ ID NO: 2769585 - RNA, 21 nt, Leptospira interrogans serovar lai str. 56601
uaaaagauuuguuuuauaaaa

SEQ ID NO: 2769586 - RNA, 18 nt, Leptospira interrogans serovar lai str. 56601
uaaaagccauuucaaaaa

SEQ ID NO: 2769587 - RNA, 19 nt, Leptospira interrogans serovar lai str. 56601
uaaaagccauuucaaaaau

SEQ ID NO: 2769588 - RNA, 23 nt, Leptospira interrogans serovar lai str. 56601
uaaaagccauuucaaaaauauau

SEQ ID NO: 2769589 - RNA, 16 nt, Leptospira interrogans serovar lai str. 56601
uaaaagcuuuugcuuu

SEQ ID NO: 2769590 - RNA, 20 nt, Leptospira interrogans serovar lai str. 56601
uaaaagcuuuugcuuuuaaa

SEQ ID NO: 2769591 - RNA, 22 nt, Leptospira interrogans serovar lai str. 56601
uaaaagcuuuugcuuuuaaagg

SEQ ID NO: 2769592 - RNA, 13 nt, Leptospira interrogans serovar lai str. 56601
uaaaaggagccaa

SEQ ID NO: 2769593 - RNA, 19 nt, Leptospira interrogans serovar lai str. 56601
uaaaaggaguaauucuaaa

SEQ ID NO: 2769594 - RNA, 22 nt, Leptospira interrogans serovar lai str. 56601
uaaaaggcugcuuuuuugagau

SEQ ID NO: 2769595 - RNA, 15 nt, Leptospira interrogans serovar lai str. 56601
uaaaagggacguagu

SEQ ID NO: 2769596 - RNA, 22 nt, Leptospira interrogans serovar lai str. 56601
uaaaaggguuuuuacaauuaaa

SEQ ID NO: 2769597 - RNA, 19 nt, Leptospira interrogans serovar lai str. 56601
uaaaaguaacguaaauuuu

SEQ ID NO: 2769598 - RNA, 14 nt, Leptospira interrogans serovar lai str. 56601
uaaaaguaguaguc

SEQ ID NO: 2769599 - RNA, 18 nt, Leptospira interrogans serovar lai str. 56601
uaaaaguauaauauuuau

SEQ ID NO: 2769600 - RNA, 12 nt, Leptospira interrogans serovar lai str. 56601
uaaaagugaauu

SEQ ID NO: 2769601 - RNA, 19 nt, Leptospira interrogans serovar lai str. 56601
uaaaaguuuuggaagauuc

SEQ ID NO: 2769602 - RNA, 19 nt, Leptospira interrogans serovar lai str. 56601
uaaaaguuuuugaaaugca

SEQ ID NO: 2769603 - RNA, 14 nt, Leptospira interrogans serovar lai str. 56601
uaaaauaaaaaaau

SEQ ID NO: 2769604 - RNA, 20 nt, Leptospira interrogans serovar lai str. 56601
uaaaauaaaaaaauucauuu

SEQ ID NO: 2769605 - RNA, 22 nt, Leptospira interrogans serovar lai str. 56601
uaaaauaaaaauuucagauuuu

SEQ ID NO: 2769606 - RNA, 15 nt, Leptospira interrogans serovar lai str. 56601
uaaaauaaaauuccu

SEQ ID NO: 2769607 - RNA, 15 nt, Leptospira interrogans serovar lai str. 56601
uaaaauaaauuuaua

SEQ ID NO: 2769608 - RNA, 16 nt, Leptospira interrogans serovar lai str. 56601
uaaaauaacgugaguu

SEQ ID NO: 2769609 - RNA, 17 nt, Leptospira interrogans serovar lai str. 56601
uaaaauaacgugaguuu

SEQ ID NO: 2769610 - RNA, 13 nt, Leptospira interrogans serovar lai str. 56601
uaaaauacaaaag

SEQ ID NO: 2769611 - RNA, 14 nt, Leptospira interrogans serovar lai str. 56601
uaaaauacaguacu

SEQ ID NO: 2769612 - RNA, 13 nt, Leptospira interrogans serovar lai str. 56601
uaaaauaccauaa

SEQ ID NO: 2769613 - RNA, 16 nt, Leptospira interrogans serovar lai str. 56601
uaaaauacucaauccg

SEQ ID NO: 2769614 - RNA, 17 nt, Leptospira interrogans serovar lai str. 56601
uaaaauacuuuuagaaa

SEQ ID NO: 2769615 - RNA, 23 nt, Leptospira interrogans serovar lai str. 56601
uaaaauacuuuuagaaaauuaga

SEQ ID NO: 2769616 - RNA, 15 nt, Leptospira interrogans serovar lai str. 56601
uaaaauagaaacaga

SEQ ID NO: 2769617 - RNA, 15 nt, Leptospira interrogans serovar lai str. 56601
uaaaauagaauuguu

SEQ ID NO: 2769618 - RNA, 15 nt, Leptospira interrogans serovar lai str. 56601
uaaaauaggauuuaa

SEQ ID NO: 2769619 - RNA, 16 nt, Leptospira interrogans serovar lai str. 56601
uaaaauaggauuuaaa

SEQ ID NO: 2769620 - RNA, 17 nt, Leptospira interrogans serovar lai str. 56601
uaaaauaggauuuaaau

SEQ ID NO: 2769621 - RNA, 21 nt, Leptospira interrogans serovar lai str. 56601
uaaaauaggauuuaaauuuug

SEQ ID NO: 2769622 - RNA, 19 nt, Leptospira interrogans serovar lai str. 56601
uaaaauagugguuuguagu

SEQ ID NO: 2769623 - RNA, 20 nt, Leptospira interrogans serovar lai str. 56601
uaaaauagugguuuguagua

SEQ ID NO: 2769624 - RNA, 22 nt, Leptospira interrogans serovar lai str. 56601
uaaaauagugguuuguaguagu

SEQ ID NO: 2769625 - RNA, 15 nt, Leptospira interrogans serovar lai str. 56601
uaaaauaucuuuaau

SEQ ID NO: 2769626 - RNA, 16 nt, Leptospira interrogans serovar lai str. 56601
uaaaauaucuuuaauu

SEQ ID NO: 2769627 - RNA, 17 nt, Leptospira interrogans serovar lai str. 56601
uaaaauaucuuuaauug

SEQ ID NO: 2769628 - RNA, 14 nt, Leptospira interrogans serovar lai str. 56601
uaaaauaugaguuu

SEQ ID NO: 2769629 - RNA, 21 nt, Leptospira interrogans serovar lai str. 56601
uaaaauauuugcauaaacuuc

SEQ ID NO: 2769630 - RNA, 18 nt, Leptospira interrogans serovar lai str. 56601
uaaaaucacaaaaaagau

SEQ ID NO: 2769631 - RNA, 23 nt, Leptospira interrogans serovar lai str. 56601
uaaaaucacaaaaaagauaaaaa

SEQ ID NO: 2769632 - RNA, 20 nt, Leptospira interrogans serovar lai str. 56601
uaaaaucauacuuuuaaaaa

SEQ ID NO: 2769633 - RNA, 21 nt, Leptospira interrogans serovar lai str. 56601
uaaaaucauacuuuuaaaaaa

SEQ ID NO: 2769634 - RNA, 22 nt, Leptospira interrogans serovar lai str. 56601
uaaaaucauacuuuuaaaaaau

SEQ ID NO: 2769635 - RNA, 14 nt, Leptospira interrogans serovar lai str. 56601
uaaaaucauauuuu

SEQ ID NO: 2769636 - RNA, 21 nt, Leptospira interrogans serovar lai str. 56601
uaaacauuuauuuuucguaau

SEQ ID NO: 2769637 - RNA, 19 nt, Leptospira interrogans serovar lai str. 56601
uaaaccgaucaaacucuuu

SEQ ID NO: 2769638 - RNA, 13 nt, Leptospira interrogans serovar lai str. 56601
uaaaccuucuuua

SEQ ID NO: 2769639 - RNA, 14 nt, Leptospira interrogans serovar lai str. 56601
uaaacgaguuuuug

SEQ ID NO: 2769640 - RNA, 16 nt, Leptospira interrogans serovar lai str. 56601
uaaacgaucagaaaaa

SEQ ID NO: 2769641 - RNA, 14 nt, Leptospira interrogans serovar lai str. 56601
uaaacgaucauacu

SEQ ID NO: 2769642 - RNA, 20 nt, Leptospira interrogans serovar lai str. 56601
uaaacgauuauuuuuuaaaa

SEQ ID NO: 2769643 - RNA, 13 nt, Leptospira interrogans serovar lai str. 56601
uaaacgauuuuau

SEQ ID NO: 2769644 - RNA, 17 nt, Leptospira interrogans serovar lai str. 56601
uaaacgauuuuauacau

SEQ ID NO: 2769645 - RNA, 18 nt, Leptospira interrogans serovar lai str. 56601
uaaacgauuuuauacauu

SEQ ID NO: 2769646 - RNA, 20 nt, Leptospira interrogans serovar lai str. 56601
uaaacgcgauaaguuuucua

SEQ ID NO: 2769647 - RNA, 14 nt, Leptospira interrogans serovar lai str. 56601
uaaacguauaaaaa

SEQ ID NO: 2769648 - RNA, 19 nt, Leptospira interrogans serovar lai str. 56601
uaaacguuuauuucaaaau

SEQ ID NO: 2769649 - RNA, 15 nt, Leptospira interrogans serovar lai str. 56601
uaaacuauacaaagu

SEQ ID NO: 2769650 - RNA, 13 nt, Leptospira interrogans serovar lai str. 56601
uaaacuaucuauu

SEQ ID NO: 2769651 - RNA, 19 nt, Leptospira interrogans serovar lai str. 56601
uaaacuaucuauuagaaca

SEQ ID NO: 2769652 - RNA, 13 nt, Leptospira interrogans serovar lai str. 56601
uaaacucaaagaa

SEQ ID NO: 2769653 - RNA, 17 nt, Leptospira interrogans serovar lai str. 56601
uaaacucauucuaguuu

SEQ ID NO: 2769654 - RNA, 16 nt, Leptospira interrogans serovar lai str. 56601
uaaacuguaaacuuga

SEQ ID NO: 2769655 - RNA, 18 nt, Leptospira interrogans serovar lai str. 56601
uaaacuguaaacuugauu

SEQ ID NO: 2769656 - RNA, 20 nt, Leptospira interrogans serovar lai str. 56601
uaaacuguaaacuugauuaa

SEQ ID NO: 2769657 - RNA, 13 nt, Leptospira interrogans serovar lai str. 56601
uaaacuuauauug

SEQ ID NO: 2769658 - RNA, 13 nt, Leptospira interrogans serovar lai str. 56601
uaaacuucaaaaa

SEQ ID NO: 2769659 - RNA, 18 nt, Leptospira interrogans serovar lai str. 56601
uaaacuucaaaaaauaua

SEQ ID NO: 2769660 - RNA, 20 nt, Leptospira interrogans serovar lai str. 56601
uaaacuucuauuuuauaaau

SEQ ID NO: 2769661 - RNA, 16 nt, Leptospira interrogans serovar lai str. 56601
uaaacuucuauuuuga

SEQ ID NO: 2769662 - RNA, 17 nt, Leptospira interrogans serovar lai str. 56601
uaaacuucuauuuugag

SEQ ID NO: 2769663 - RNA, 20 nt, Leptospira interrogans serovar lai str. 56601
uaaacuucuauuuuuuaauu

SEQ ID NO: 2769664 - RNA, 21 nt, Leptospira interrogans serovar lai str. 56601
uaaacuucuauuuuuuaauug

SEQ ID NO: 2769665 - RNA, 17 nt, Leptospira interrogans serovar lai str. 56601
uaaacuucucuuaaaau

SEQ ID NO: 2769666 - RNA, 16 nt, Leptospira interrogans serovar lai str. 56601
uaaacuuguaagacuc

SEQ ID NO: 2769667 - RNA, 19 nt, Leptospira interrogans serovar lai str. 56601
uaaacuuuaaucauuuuca

SEQ ID NO: 2769668 - RNA, 12 nt, Leptospira interrogans serovar lai str. 56601
uaaacuuugaaa

SEQ ID NO: 2769669 - RNA, 18 nt, Leptospira interrogans serovar lai str. 56601
uaaacuuugcaaaucgau

SEQ ID NO: 2769670 - RNA, 17 nt, Leptospira interrogans serovar lai str. 56601
uaaacuuuuauaaaauc

SEQ ID NO: 2769671 - RNA, 19 nt, Leptospira interrogans serovar lai str. 56601
uaaacuuuuauaaaaucua

SEQ ID NO: 2769672 - RNA, 11 nt, Leptospira interrogans serovar lai str. 56601
uaaagaaacuc

SEQ ID NO: 2769673 - RNA, 21 nt, Leptospira interrogans serovar lai str. 56601
uaaagaaacucauaaaauaac

SEQ ID NO: 2769674 - RNA, 19 nt, Leptospira interrogans serovar lai str. 56601
uaaagaaaguaauuuugaa

SEQ ID NO: 2769675 - RNA, 18 nt, Leptospira interrogans serovar lai str. 56601
uaaagaaccgacaaucgu

SEQ ID NO: 2769676 - RNA, 19 nt, Leptospira interrogans serovar lai str. 56601
uaaagacaauauucuugau

SEQ ID NO: 2769677 - RNA, 21 nt, Leptospira interrogans serovar lai str. 56601
uaaagacgauuccuaaaaauu

SEQ ID NO: 2769678 - RNA, 19 nt, Leptospira interrogans serovar lai str. 56601
uaaagacgauugauucuaa

SEQ ID NO: 2769679 - RNA, 22 nt, Leptospira interrogans serovar lai str. 56601
uaaagauugaacgguaaaaucu

SEQ ID NO: 2769680 - RNA, 22 nt, Leptospira interrogans serovar lai str. 56601
uaaagauuuccuaauaacuugu

SEQ ID NO: 2769681 - RNA, 16 nt, Leptospira interrogans serovar lai str. 56601
uaaagauuuucuaaga

SEQ ID NO: 2769682 - RNA, 20 nt, Leptospira interrogans serovar lai str. 56601
uaaagauuuucuaagaaucu

SEQ ID NO: 2769683 - RNA, 18 nt, Leptospira interrogans serovar lai str. 56601
uaaagauuuuucuucuuc

SEQ ID NO: 2769684 - RNA, 13 nt, Leptospira interrogans serovar lai str. 56601
uaaagcauuaaaa

SEQ ID NO: 2769685 - RNA, 17 nt, Leptospira interrogans serovar lai str. 56601
uaaagcgggauuuugau

SEQ ID NO: 2769686 - RNA, 15 nt, Leptospira interrogans serovar lai str. 56601
uaaaggaauccauga

SEQ ID NO: 2769687 - RNA, 16 nt, Leptospira interrogans serovar lai str. 56601
uaaaggugcaugaaaa

SEQ ID NO: 2769688 - RNA, 15 nt, Leptospira interrogans serovar lai str. 56601
uaaaguaaaauuaaa

SEQ ID NO: 2769689 - RNA, 14 nt, Leptospira interrogans serovar lai str. 56601
uaaaguaaauucga

SEQ ID NO: 2769690 - RNA, 18 nt, Leptospira interrogans serovar lai str. 56601
uaaaguacuaauucaaua

SEQ ID NO: 2769691 - RNA, 19 nt, Leptospira interrogans serovar lai str. 56601
uaaaguacuaauucaauaa

SEQ ID NO: 2769692 - RNA, 23 nt, Leptospira interrogans serovar lai str. 56601
uaaaguaguuucgccaaucucca

SEQ ID NO: 2769693 - RNA, 13 nt, Leptospira interrogans serovar lai str. 56601
uaaaguauccauu

SEQ ID NO: 2769694 - RNA, 18 nt, Leptospira interrogans serovar lai str. 56601
uaaaguccaaaucaaaaa

SEQ ID NO: 2769695 - RNA, 21 nt, Leptospira interrogans serovar lai str. 56601
uaaaguccaaaucaaaaaagu

SEQ ID NO: 2769696 - RNA, 22 nt, Leptospira interrogans serovar lai str. 56601
uaaagucguuuuuaagcgauuu

SEQ ID NO: 2769697 - RNA, 15 nt, Leptospira interrogans serovar lai str. 56601
uaaagucuauuuccc

SEQ ID NO: 2769698 - RNA, 17 nt, Leptospira interrogans serovar lai str. 56601
uaaagucuauuucccaa

SEQ ID NO: 2769699 - RNA, 19 nt, Leptospira interrogans serovar lai str. 56601
uaaagucuauuucccaaaa

SEQ ID NO: 2769700 - RNA, 13 nt, Leptospira interrogans serovar lai str. 56601
uaaagugaaucuc

SEQ ID NO: 2769701 - RNA, 18 nt, Leptospira interrogans serovar lai str. 56601
uaaagugagcggguaauu

SEQ ID NO: 2769702 - RNA, 16 nt, Leptospira interrogans serovar lai str. 56601
uaaaguguaaacuauu

SEQ ID NO: 2769703 - RNA, 23 nt, Leptospira interrogans serovar lai str. 56601
uaaagugugcaaacggauaaaau

SEQ ID NO: 2769704 - RNA, 20 nt, Leptospira interrogans serovar lai str. 56601
uaaaguuaauacaaaaaacu

SEQ ID NO: 2769705 - RNA, 15 nt, Leptospira interrogans serovar lai str. 56601
uaaaguucuuuucuu

SEQ ID NO: 2769706 - RNA, 22 nt, Leptospira interrogans serovar lai str. 56601
uaaaguucuuuucuuaaaaaaa

SEQ ID NO: 2769707 - RNA, 13 nt, Leptospira interrogans serovar lai str. 56601
uaaaguuuagauu

SEQ ID NO: 2769708 - RNA, 14 nt, Leptospira interrogans serovar lai str. 56601
uaaaguuuagauuu

SEQ ID NO: 2769709 - RNA, 14 nt, Leptospira interrogans serovar lai str. 56601
uaaauaaaaagaag

SEQ ID NO: 2769710 - RNA, 18 nt, Leptospira interrogans serovar lai str. 56601
uaaauaaaccgcauaaaa

SEQ ID NO: 2769711 - RNA, 17 nt, Leptospira interrogans serovar lai str. 56601
uaaauaaagguuuuaua

SEQ ID NO: 2769712 - RNA, 20 nt, Leptospira interrogans serovar lai str. 56601
uaaauaaauuaaaaaaaaau

SEQ ID NO: 2769713 - RNA, 14 nt, Leptospira interrogans serovar lai str. 56601
uaaauaauaugggu

SEQ ID NO: 2769714 - RNA, 16 nt, Leptospira interrogans serovar lai str. 56601
uaaauaaugaaaacuu

SEQ ID NO: 2769715 - RNA, 18 nt, Leptospira interrogans serovar lai str. 56601
uaaauaaugaaaacuugu

SEQ ID NO: 2769716 - RNA, 13 nt, Leptospira interrogans serovar lai str. 56601
uaaauacaaaaau

SEQ ID NO: 2769717 - RNA, 14 nt, Leptospira interrogans serovar lai str. 56601
uaaauacaaaaauu

SEQ ID NO: 2769718 - RNA, 16 nt, Leptospira interrogans serovar lai str. 56601
uaaauacaaaaauucu

SEQ ID NO: 2769719 - RNA, 16 nt, Leptospira interrogans serovar lai str. 56601
uaaauucuacauuuga

SEQ ID NO: 2769720 - RNA, 14 nt, Leptospira interrogans serovar lai str. 56601
uaaauucuuacuaa

SEQ ID NO: 2769721 - RNA, 15 nt, Leptospira interrogans serovar lai str. 56601
uaaauugaaacuaua

SEQ ID NO: 2769722 - RNA, 21 nt, Leptospira interrogans serovar lai str. 56601
uaaauugaauucuuccuucuu

SEQ ID NO: 2769723 - RNA, 21 nt, Leptospira interrogans serovar lai str. 56601
uaaauugagaauuuguuuuaa

SEQ ID NO: 2769724 - RNA, 17 nt, Leptospira interrogans serovar lai str. 56601
uaaauugcacaaaagaa

SEQ ID NO: 2769725 - RNA, 19 nt, Leptospira interrogans serovar lai str. 56601
uaaauugcaucaaagaaac

SEQ ID NO: 2769726 - RNA, 21 nt, Leptospira interrogans serovar lai str. 56601
uaaauuggguaucuaaauauu

SEQ ID NO: 2769727 - RNA, 20 nt, Leptospira interrogans serovar lai str. 56601
uaaauuguauaaaagaaaca

SEQ ID NO: 2769728 - RNA, 15 nt, Leptospira interrogans serovar lai str. 56601
uaaauuguaugcagu

SEQ ID NO: 2769729 - RNA, 16 nt, Leptospira interrogans serovar lai str. 56601
uaaauugugagaacua

SEQ ID NO: 2769730 - RNA, 19 nt, Leptospira interrogans serovar lai str. 56601
uaaauugugggaauuacua

SEQ ID NO: 2769731 - RNA, 12 nt, Leptospira interrogans serovar lai str. 56601
uaaauuguuuca

SEQ ID NO: 2769732 - RNA, 14 nt, Leptospira interrogans serovar lai str. 56601
uaaauuguuucaua

SEQ ID NO: 2769733 - RNA, 15 nt, Leptospira interrogans serovar lai str. 56601
uaaauuuaaaaaacc

SEQ ID NO: 2769734 - RNA, 18 nt, Leptospira interrogans serovar lai str. 56601
uaaauuuacuacucggac

SEQ ID NO: 2769735 - RNA, 16 nt, Leptospira interrogans serovar lai str. 56601
uaaauuuauaaaugua

SEQ ID NO: 2769736 - RNA, 15 nt, Leptospira interrogans serovar lai str. 56601
uaaauuuauaaugaa

SEQ ID NO: 2769737 - RNA, 17 nt, Leptospira interrogans serovar lai str. 56601
uaaauuuaucuauaaaa

SEQ ID NO: 2769738 - RNA, 19 nt, Leptospira interrogans serovar lai str. 56601
uaaauuucauaucuaaaau

SEQ ID NO: 2769739 - RNA, 22 nt, Leptospira interrogans serovar lai str. 56601
uaaauuucauaucuaaaaugga

SEQ ID NO: 2769740 - RNA, 20 nt, Leptospira interrogans serovar lai str. 56601
uaaauuuguaauaguuccca

SEQ ID NO: 2769741 - RNA, 19 nt, Leptospira interrogans serovar lai str. 56601
uaaauuuguugcaauacau

SEQ ID NO: 2769742 - RNA, 20 nt, Leptospira interrogans serovar lai str. 56601
uaaauuuuaaccgcaaaauc

SEQ ID NO: 2769743 - RNA, 17 nt, Leptospira interrogans serovar lai str. 56601
uaaauuuuacaauuaaa

SEQ ID NO: 2769744 - RNA, 19 nt, Leptospira interrogans serovar lai str. 56601
uaaauuuuacaauuaaacu

SEQ ID NO: 2769745 - RNA, 16 nt, Leptospira interrogans serovar lai str. 56601
uaaauuuuauaaaauu

SEQ ID NO: 2769746 - RNA, 22 nt, Leptospira interrogans serovar lai str. 56601
uaaauuuucagugaauaaaaua

SEQ ID NO: 2769747 - RNA, 17 nt, Leptospira interrogans serovar lai str. 56601
uaaauuuucguuuuagu

SEQ ID NO: 2769748 - RNA, 15 nt, Leptospira interrogans serovar lai str. 56601
uaaauuuucuuuauu

SEQ ID NO: 2769749 - RNA, 16 nt, Leptospira interrogans serovar lai str. 56601
uaaauuuugaaaauac

SEQ ID NO: 2769750 - RNA, 19 nt, Leptospira interrogans serovar lai str. 56601
uaaauuuugaaacaaauuc

SEQ ID NO: 2769751 - RNA, 15 nt, Leptospira interrogans serovar lai str. 56601
uaaauuuuuaucaua

SEQ ID NO: 2769752 - RNA, 17 nt, Leptospira interrogans serovar lai str. 56601
uaaauuuuucggaaaua

SEQ ID NO: 2769753 - RNA, 23 nt, Leptospira interrogans serovar lai str. 56601
uaaauuuuucggaaauagaaaga

SEQ ID NO: 2769754 - RNA, 14 nt, Leptospira interrogans serovar lai str. 56601
uaaauuuuuuagaa

SEQ ID NO: 2769755 - RNA, 16 nt, Leptospira interrogans serovar lai str. 56601
uaaauuuuuuagaaau

SEQ ID NO: 2769756 - RNA, 21 nt, Leptospira interrogans serovar lai str. 56601
uaaauuuuuugcaaaaaaaua

SEQ ID NO: 2769757 - RNA, 16 nt, Leptospira interrogans serovar lai str. 56601
uaacaaaaaguguuua

SEQ ID NO: 2769758 - RNA, 14 nt, Leptospira interrogans serovar lai str. 56601
uaacaaaaaucaac

SEQ ID NO: 2769759 - RNA, 16 nt, Leptospira interrogans serovar lai str. 56601
uaacaaaaugauuuua

SEQ ID NO: 2769760 - RNA, 14 nt, Leptospira interrogans serovar lai str. 56601
uaacaaacuuuuau

SEQ ID NO: 2769761 - RNA, 16 nt, Leptospira interrogans serovar lai str. 56601
uaacaaagccgcacaa

SEQ ID NO: 2769762 - RNA, 20 nt, Leptospira interrogans serovar lai str. 56601
uaacaaagccgcacaaacca

SEQ ID NO: 2769763 - RNA, 12 nt, Leptospira interrogans serovar lai str. 56601
uaacaaaguauu

SEQ ID NO: 2769764 - RNA, 16 nt, Leptospira interrogans serovar lai str. 56601
uaacaaauaaaaggag

SEQ ID NO: 2769765 - RNA, 15 nt, Leptospira interrogans serovar lai str. 56601
uaacaaauuuaaaau

SEQ ID NO: 2769766 - RNA, 16 nt, Leptospira interrogans serovar lai str. 56601
uaacaaauuuaaaaua

SEQ ID NO: 2769767 - RNA, 22 nt, Leptospira interrogans serovar lai str. 56601
uaacaauagcuuaaaagugauu

SEQ ID NO: 2769768 - RNA, 16 nt, Leptospira interrogans serovar lai str. 56601
uaacaaucaauugaaa

SEQ ID NO: 2769769 - RNA, 12 nt, Leptospira interrogans serovar lai str. 56601
uaacaauucucg

SEQ ID NO: 2769770 - RNA, 22 nt, Leptospira interrogans serovar lai str. 56601
uaacaauucucgauagaacaau

SEQ ID NO: 2769771 - RNA, 20 nt, Leptospira interrogans serovar lai str. 56601
uaacacgauacucaauauuu

SEQ ID NO: 2769772 - RNA, 20 nt, Leptospira interrogans serovar lai str. 56601
uaacacucaacgauaagaau

SEQ ID NO: 2769773 - RNA, 15 nt, Leptospira interrogans serovar lai str. 56601
uaacagaaaaauguu

SEQ ID NO: 2769774 - RNA, 19 nt, Leptospira interrogans serovar lai str. 56601
uaacagaaaaauguuaaaa

SEQ ID NO: 2769775 - RNA, 15 nt, Leptospira interrogans serovar lai str. 56601
uaacagcuacagcug

SEQ ID NO: 2769776 - RNA, 19 nt, Leptospira interrogans serovar lai str. 56601
uaacaguaagaagaaaagg

SEQ ID NO: 2769777 - RNA, 17 nt, Leptospira interrogans serovar lai str. 56601
uaacaguuauuauuuaa

SEQ ID NO: 2769778 - RNA, 20 nt, Leptospira interrogans serovar lai str. 56601
uaacauccaaacucuuaauc

SEQ ID NO: 2769779 - RNA, 14 nt, Leptospira interrogans serovar lai str. 56601
uaacauuuuauuau

SEQ ID NO: 2769780 - RNA, 16 nt, Leptospira interrogans serovar lai str. 56601
uaacauuuuauuauaa

SEQ ID NO: 2769781 - RNA, 13 nt, Leptospira interrogans serovar lai str. 56601
uaacauuuuuuca

SEQ ID NO: 2769782 - RNA, 14 nt, Leptospira interrogans serovar lai str. 56601
uaacauuuuuucau

SEQ ID NO: 2769783 - RNA, 15 nt, Leptospira interrogans serovar lai str. 56601
uaacauuuuuucaua

SEQ ID NO: 2769784 - RNA, 19 nt, Leptospira interrogans serovar lai str. 56601
uaaccgacuugagauuccu

SEQ ID NO: 2769785 - RNA, 15 nt, Leptospira interrogans serovar lai str. 56601
uaaccgcaaaaucau

SEQ ID NO: 2769786 - RNA, 18 nt, Leptospira interrogans serovar lai str. 56601
uaaccguagauuuuaaca

SEQ ID NO: 2769787 - RNA, 15 nt, Leptospira interrogans serovar lai str. 56601
uaaccuuuaccauaa

SEQ ID NO: 2769788 - RNA, 14 nt, Leptospira interrogans serovar lai str. 56601
uaaccuuuguuucc

SEQ ID NO: 2769789 - RNA, 21 nt, Leptospira interrogans serovar lai str. 56601
uaacgauacuuaaaaauaccg

SEQ ID NO: 2769790 - RNA, 17 nt, Leptospira interrogans serovar lai str. 56601
uaacgauauuagaacug

SEQ ID NO: 2769791 - RNA, 22 nt, Leptospira interrogans serovar lai str. 56601
uaacgauuguaaaaaaacauga

SEQ ID NO: 2769792 - RNA, 20 nt, Leptospira interrogans serovar lai str. 56601
uaacgauuucuauuuuucgu

SEQ ID NO: 2769793 - RNA, 14 nt, Leptospira interrogans serovar lai str. 56601
uaacgcaaaauacu

SEQ ID NO: 2769794 - RNA, 20 nt, Leptospira interrogans serovar lai str. 56601
uaacgcagauuugauguaaa

SEQ ID NO: 2769795 - RNA, 17 nt, Leptospira interrogans serovar lai str. 56601
uaacggaguuucucauu

SEQ ID NO: 2769796 - RNA, 16 nt, Leptospira interrogans serovar lai str. 56601
uaacggcuaaaucuag

SEQ ID NO: 2769797 - RNA, 16 nt, Leptospira interrogans serovar lai str. 56601
uaacgggaauuauaaa

SEQ ID NO: 2769798 - RNA, 21 nt, Leptospira interrogans serovar lai str. 56601
uaacgugagcucuauguaaga

SEQ ID NO: 2769799 - RNA, 15 nt, Leptospira interrogans serovar lai str. 56601
uaacuacacgagagc

SEQ ID NO: 2769800 - RNA, 19 nt, Leptospira interrogans serovar lai str. 56601
uaacuacacgagagcugcu

SEQ ID NO: 2769801 - RNA, 16 nt, Leptospira interrogans serovar lai str. 56601
uaacuaccgcaaacau

SEQ ID NO: 2769802 - RNA, 21 nt, Leptospira interrogans serovar lai str. 56601
uaaggaacucaugauucugaa

SEQ ID NO: 2769803 - RNA, 20 nt, Leptospira interrogans serovar lai str. 56601
uaaggaaguguuugcugagu

SEQ ID NO: 2769804 - RNA, 20 nt, Leptospira interrogans serovar lai str. 56601
uaaggagcucaucauucuga

SEQ ID NO: 2769805 - RNA, 21 nt, Leptospira interrogans serovar lai str. 56601
uaaggagcucaucauucugaa

SEQ ID NO: 2769806 - RNA, 15 nt, Leptospira interrogans serovar lai str. 56601
uaaggcaaaagacuc

SEQ ID NO: 2769807 - RNA, 16 nt, Leptospira interrogans serovar lai str. 56601
uaaggcaaacuuuuuu

SEQ ID NO: 2769808 - RNA, 23 nt, Leptospira interrogans serovar lai str. 56601
uaagggaaaguuauuucuuucaa

SEQ ID NO: 2769809 - RNA, 17 nt, Leptospira interrogans serovar lai str. 56601
uaagguuuuauaaaaug

SEQ ID NO: 2769810 - RNA, 17 nt, Leptospira interrogans serovar lai str. 56601
uaaguaaaaaugcaaau

SEQ ID NO: 2769811 - RNA, 14 nt, Leptospira interrogans serovar lai str. 56601
uaaguaauuuaaaa

SEQ ID NO: 2769812 - RNA, 17 nt, Leptospira interrogans serovar lai str. 56601
uaaguagauaaauucuu

SEQ ID NO: 2769813 - RNA, 18 nt, Leptospira interrogans serovar lai str. 56601
uaaguaucuaaaaguuuu

SEQ ID NO: 2769814 - RNA, 20 nt, Leptospira interrogans serovar lai str. 56601
uaaguauuauaaauuuugag

SEQ ID NO: 2769815 - RNA, 17 nt, Leptospira interrogans serovar lai str. 56601
uaaguauucaauuucag

SEQ ID NO: 2769816 - RNA, 18 nt, Leptospira interrogans serovar lai str. 56601
uaaguauuguuaagauaa

SEQ ID NO: 2769817 - RNA, 17 nt, Leptospira interrogans serovar lai str. 56601
uaaguccuuuucuuaua

SEQ ID NO: 2769818 - RNA, 18 nt, Leptospira interrogans serovar lai str. 56601
uaagucguuguauuuuaa

SEQ ID NO: 2769819 - RNA, 20 nt, Leptospira interrogans serovar lai str. 56601
uaagucguuguauuuuaaac

SEQ ID NO: 2769820 - RNA, 14 nt, Leptospira interrogans serovar lai str. 56601
uaagucuuuaaaaa

SEQ ID NO: 2769821 - RNA, 16 nt, Leptospira interrogans serovar lai str. 56601
uaaguguaaaauuaaa

SEQ ID NO: 2769822 - RNA, 14 nt, Leptospira interrogans serovar lai str. 56601
uaaguguaugaaaa

SEQ ID NO: 2769823 - RNA, 21 nt, Leptospira interrogans serovar lai str. 56601
uaaguguaugaaaagucaaaa

SEQ ID NO: 2769824 - RNA, 14 nt, Leptospira interrogans serovar lai str. 56601
uaaguuacucauuu

SEQ ID NO: 2769825 - RNA, 18 nt, Leptospira interrogans serovar lai str. 56601
uaaguuacucauuuccau

SEQ ID NO: 2769826 - RNA, 15 nt, Leptospira interrogans serovar lai str. 56601
uaaguuauauuagag

SEQ ID NO: 2769827 - RNA, 12 nt, Leptospira interrogans serovar lai str. 56601
uaaguuauuaau

SEQ ID NO: 2769828 - RNA, 13 nt, Leptospira interrogans serovar lai str. 56601
uaaguucaaauuu

SEQ ID NO: 2769829 - RNA, 15 nt, Leptospira interrogans serovar lai str. 56601
uaaguucaaauuuau

SEQ ID NO: 2769830 - RNA, 20 nt, Leptospira interrogans serovar lai str. 56601
uaaguuccccuacgcuucca

SEQ ID NO: 2769831 - RNA, 22 nt, Leptospira interrogans serovar lai str. 56601
uaaguucgguguaaaaaaucau

SEQ ID NO: 2769832 - RNA, 22 nt, Leptospira interrogans serovar lai str. 56601
uaaguucgucgucuauaaauuc

SEQ ID NO: 2769833 - RNA, 20 nt, Leptospira interrogans serovar lai str. 56601
uaaguucgucugagaaaaac

SEQ ID NO: 2769834 - RNA, 20 nt, Leptospira interrogans serovar lai str. 56601
uaaguugagaauauaagaaa

SEQ ID NO: 2769835 - RNA, 20 nt, Leptospira interrogans serovar lai str. 56601
uaaguuguguugaaucuuaa

SEQ ID NO: 2769836 - RNA, 21 nt, Leptospira interrogans serovar lai str. 56601
uaaguuguguugaaucuuaaa

SEQ ID NO: 2769837 - RNA, 22 nt, Leptospira interrogans serovar lai str. 56601
uaaguuguguugaaucuuaaau

SEQ ID NO: 2769838 - RNA, 22 nt, Leptospira interrogans serovar lai str. 56601
uaaguuugugagaguucccacg

SEQ ID NO: 2769839 - RNA, 10 nt, Leptospira interrogans serovar lai str. 56601
uaaguuuuac

SEQ ID NO: 2769840 - RNA, 17 nt, Leptospira interrogans serovar lai str. 56601
uaaguuuugauagaaaa

SEQ ID NO: 2769841 - RNA, 20 nt, Leptospira interrogans serovar lai str. 56601
uaaguuuuucuuaaaaaguu

SEQ ID NO: 2769842 - RNA, 18 nt, Leptospira interrogans serovar lai str. 56601
uaaguuuuuuaaauuuac

SEQ ID NO: 2769843 - RNA, 18 nt, Leptospira interrogans serovar lai str. 56601
uaauaaaaauuuaaaaua

SEQ ID NO: 2769844 - RNA, 17 nt, Leptospira interrogans serovar lai str. 56601
uaauaaaaauuuacaga

SEQ ID NO: 2769845 - RNA, 22 nt, Leptospira interrogans serovar lai str. 56601
uaauaaaacuuuucuaaauuga

SEQ ID NO: 2769846 - RNA, 12 nt, Leptospira interrogans serovar lai str. 56601
uaauaaaaugca

SEQ ID NO: 2769847 - RNA, 13 nt, Leptospira interrogans serovar lai str. 56601
uaauaaaaugcaa

SEQ ID NO: 2769848 - RNA, 13 nt, Leptospira interrogans serovar lai str. 56601
uaauaaaauuauu

SEQ ID NO: 2769849 - RNA, 17 nt, Leptospira interrogans serovar lai str. 56601
uaauaaacaaaauucaa

SEQ ID NO: 2769850 - RNA, 15 nt, Leptospira interrogans serovar lai str. 56601
uaauaaacuuucaaa

SEQ ID NO: 2769851 - RNA, 21 nt, Leptospira interrogans serovar lai str. 56601
uaauaaaguaccuaauauuuu

SEQ ID NO: 2769852 - RNA, 20 nt, Leptospira interrogans serovar lai str. 56601
uaauaaaucaaucuacuuga

SEQ ID NO: 2769853 - RNA, 13 nt, Leptospira interrogans serovar lai str. 56601
uaauaacaaaaaa

SEQ ID NO: 2769854 - RNA, 18 nt, Leptospira interrogans serovar lai str. 56601
uaauaauaugauguaaau

SEQ ID NO: 2769855 - RNA, 20 nt, Leptospira interrogans serovar lai str. 56601
uaauaaucgcuuucgcauug

SEQ ID NO: 2769856 - RNA, 17 nt, Leptospira interrogans serovar lai str. 56601
uaauaaucuaaacuuga

SEQ ID NO: 2769857 - RNA, 21 nt, Leptospira interrogans serovar lai str. 56601
uaauaaucuuuugaguauuua

SEQ ID NO: 2769858 - RNA, 14 nt, Leptospira interrogans serovar lai str. 56601
uaauaauucaaaau

SEQ ID NO: 2769859 - RNA, 13 nt, Leptospira interrogans serovar lai str. 56601
uaauacaaaaaau

SEQ ID NO: 2769860 - RNA, 19 nt, Leptospira interrogans serovar lai str. 56601
uaauacaaaaaauguuuaa

SEQ ID NO: 2769861 - RNA, 11 nt, Leptospira interrogans serovar lai str. 56601
uaauacaaaac

SEQ ID NO: 2769862 - RNA, 17 nt, Leptospira interrogans serovar lai str. 56601
uaauacaugauuacuca

SEQ ID NO: 2769863 - RNA, 15 nt, Leptospira interrogans serovar lai str. 56601
uaauaccaaguuauu

SEQ ID NO: 2769864 - RNA, 16 nt, Leptospira interrogans serovar lai str. 56601
uaauaccuaauucucu

SEQ ID NO: 2769865 - RNA, 14 nt, Leptospira interrogans serovar lai str. 56601
uaauacuaccaaag

SEQ ID NO: 2769866 - RNA, 14 nt, Leptospira interrogans serovar lai str. 56601
uaauagagaaaaau

SEQ ID NO: 2769867 - RNA, 14 nt, Leptospira interrogans serovar lai str. 56601
uaauagauugauaa

SEQ ID NO: 2769868 - RNA, 14 nt, Leptospira interrogans serovar lai str. 56601
uaauaguucccaca

SEQ ID NO: 2769869 - RNA, 21 nt, Leptospira interrogans serovar lai str. 56601
uaauaguucccacaaauuacu

SEQ ID NO: 2769870 - RNA, 20 nt, Leptospira interrogans serovar lai str. 56601
uaauaguuccuauauuuuaa

SEQ ID NO: 2769871 - RNA, 17 nt, Leptospira interrogans serovar lai str. 56601
uaauaguugaaauucac

SEQ ID NO: 2769872 - RNA, 12 nt, Leptospira interrogans serovar lai str. 56601
uaauaguuuuac

SEQ ID NO: 2769873 - RNA, 21 nt, Leptospira interrogans serovar lai str. 56601
uaauaguuuuacaaauuagua

SEQ ID NO: 2769874 - RNA, 12 nt, Leptospira interrogans serovar lai str. 56601
uaauauaaaaaa

SEQ ID NO: 2769875 - RNA, 13 nt, Leptospira interrogans serovar lai str. 56601
uaauauaaaaacc

SEQ ID NO: 2769876 - RNA, 19 nt, Leptospira interrogans serovar lai str. 56601
uaauauaaccucaacauaa

SEQ ID NO: 2769877 - RNA, 20 nt, Leptospira interrogans serovar lai str. 56601
uaauauaaguuaagugaaaa

SEQ ID NO: 2769878 - RNA, 15 nt, Leptospira interrogans serovar lai str. 56601
uaauauacuaaaauu

SEQ ID NO: 2769879 - RNA, 17 nt, Leptospira interrogans serovar lai str. 56601
uaauauaguauaaauuc

SEQ ID NO: 2769880 - RNA, 14 nt, Leptospira interrogans serovar lai str. 56601
uaauauauuaaaau

SEQ ID NO: 2769881 - RNA, 19 nt, Leptospira interrogans serovar lai str. 56601
uaauaucaaaaugaacaau

SEQ ID NO: 2769882 - RNA, 17 nt, Leptospira interrogans serovar lai str. 56601
uaauaugaauuuuuaau

SEQ ID NO: 2769883 - RNA, 21 nt, Leptospira interrogans serovar lai str. 56601
uaauaugaauuuuuaauagac

SEQ ID NO: 2769884 - RNA, 22 nt, Leptospira interrogans serovar lai str. 56601
uaauauguuuagaguauuauaa

SEQ ID NO: 2769885 - RNA, 11 nt, Leptospira interrogans serovar lai str. 56601
uaauucuaaag

SEQ ID NO: 2769886 - RNA, 22 nt, Leptospira interrogans serovar lai str. 56601
uaauucuacgaaacuuuuagaa

SEQ ID NO: 2769887 - RNA, 20 nt, Leptospira interrogans serovar lai str. 56601
uaauucucuucguuuugccc

SEQ ID NO: 2769888 - RNA, 18 nt, Leptospira interrogans serovar lai str. 56601
uaauucugaaaaaguuag

SEQ ID NO: 2769889 - RNA, 18 nt, Leptospira interrogans serovar lai str. 56601
uaauucugaauaauugaa

SEQ ID NO: 2769890 - RNA, 15 nt, Leptospira interrogans serovar lai str. 56601
uaauucuguaaaaau

SEQ ID NO: 2769891 - RNA, 18 nt, Leptospira interrogans serovar lai str. 56601
uaauucuguaaaaauaga

SEQ ID NO: 2769892 - RNA, 15 nt, Leptospira interrogans serovar lai str. 56601
uaauucuuaaaaauu

SEQ ID NO: 2769893 - RNA, 18 nt, Leptospira interrogans serovar lai str. 56601
uaauucuuaaaaauuuau

SEQ ID NO: 2769894 - RNA, 16 nt, Leptospira interrogans serovar lai str. 56601
uaauucuuuaaaauuu

SEQ ID NO: 2769895 - RNA, 21 nt, Leptospira interrogans serovar lai str. 56601
uaauucuuuaaaauuuuuaau

SEQ ID NO: 2769896 - RNA, 19 nt, Leptospira interrogans serovar lai str. 56601
uaauugaaugaagauuacu

SEQ ID NO: 2769897 - RNA, 17 nt, Leptospira interrogans serovar lai str. 56601
uaauugagauuugguga

SEQ ID NO: 2769898 - RNA, 22 nt, Leptospira interrogans serovar lai str. 56601
uaauugagauuuggugauuuaa

SEQ ID NO: 2769899 - RNA, 20 nt, Leptospira interrogans serovar lai str. 56601
uaauuggaauguacuaaaau

SEQ ID NO: 2769900 - RNA, 18 nt, Leptospira interrogans serovar lai str. 56601
uaauuggccguaauaucu

SEQ ID NO: 2769901 - RNA, 17 nt, Leptospira interrogans serovar lai str. 56601
uaauuguaaaaggagaa

SEQ ID NO: 2769902 - RNA, 23 nt, Leptospira interrogans serovar lai str. 56601
uaauuguagauucuuuuagaagu

SEQ ID NO: 2769903 - RNA, 18 nt, Leptospira interrogans serovar lai str. 56601
uaauuguugaauaucuaa

SEQ ID NO: 2769904 - RNA, 14 nt, Leptospira interrogans serovar lai str. 56601
uaauuguugcuaug

SEQ ID NO: 2769905 - RNA, 18 nt, Leptospira interrogans serovar lai str. 56601
uaauuuaaaaaaaucacu

SEQ ID NO: 2769906 - RNA, 12 nt, Leptospira interrogans serovar lai str. 56601
uaauuuaaaaac

SEQ ID NO: 2769907 - RNA, 13 nt, Leptospira interrogans serovar lai str. 56601
uaauuuaaaaucg

SEQ ID NO: 2769908 - RNA, 18 nt, Leptospira interrogans serovar lai str. 56601
uaauuuaauauauuaaaa

SEQ ID NO: 2769909 - RNA, 19 nt, Leptospira interrogans serovar lai str. 56601
uaauuuaauauauuaaaau

SEQ ID NO: 2769910 - RNA, 13 nt, Leptospira interrogans serovar lai str. 56601
uaauuuacuacau

SEQ ID NO: 2769911 - RNA, 22 nt, Leptospira interrogans serovar lai str. 56601
uaauuuacuacaucuaaugauu

SEQ ID NO: 2769912 - RNA, 14 nt, Leptospira interrogans serovar lai str. 56601
uaauuuauaaacuu

SEQ ID NO: 2769913 - RNA, 18 nt, Leptospira interrogans serovar lai str. 56601
uaauuuaucgauuuaaaa

SEQ ID NO: 2769914 - RNA, 18 nt, Leptospira interrogans serovar lai str. 56601
uaauuucaauaacuugac

SEQ ID NO: 2769915 - RNA, 12 nt, Leptospira interrogans serovar lai str. 56601
uaauuucaaucu

SEQ ID NO: 2769916 - RNA, 21 nt, Leptospira interrogans serovar lai str. 56601
uaauuucauuauuagaguugu

SEQ ID NO: 2769917 - RNA, 22 nt, Leptospira interrogans serovar lai str. 56601
uaauuuccaaacuacaaauuca

SEQ ID NO: 2769918 - RNA, 23 nt, Leptospira interrogans serovar lai str. 56601
uaauuucguuuuuuuaauauuac

SEQ ID NO: 2769919 - RNA, 18 nt, Leptospira interrogans serovar lai str. 56601
uaauuucucuuauuagaa

SEQ ID NO: 2769920 - RNA, 16 nt, Leptospira interrogans serovar lai str. 56601
uaauuucuucauauca

SEQ ID NO: 2769921 - RNA, 19 nt, Leptospira interrogans serovar lai str. 56601
uaauuucuucauaucaaau

SEQ ID NO: 2769922 - RNA, 21 nt, Leptospira interrogans serovar lai str. 56601
uaauuucuucauaucaaauuc

SEQ ID NO: 2769923 - RNA, 22 nt, Leptospira interrogans serovar lai str. 56601
uaauuucuucauaucaaauuca

SEQ ID NO: 2769924 - RNA, 23 nt, Leptospira interrogans serovar lai str. 56601
uaauuucuucauaucaaauucau

SEQ ID NO: 2769925 - RNA, 15 nt, Leptospira interrogans serovar lai str. 56601
uaauuucuuuuuaua

SEQ ID NO: 2769926 - RNA, 22 nt, Leptospira interrogans serovar lai str. 56601
uaauuucuuuuuauacucggaa

SEQ ID NO: 2769927 - RNA, 21 nt, Leptospira interrogans serovar lai str. 56601
uaauuugaucaucguuauauu

SEQ ID NO: 2769928 - RNA, 15 nt, Leptospira interrogans serovar lai str. 56601
uaauuugcuuaaagc

SEQ ID NO: 2769929 - RNA, 17 nt, Leptospira interrogans serovar lai str. 56601
uaauuugcuuaaagcau

SEQ ID NO: 2769930 - RNA, 12 nt, Leptospira interrogans serovar lai str. 56601
uaauuuguagga

SEQ ID NO: 2769931 - RNA, 17 nt, Leptospira interrogans serovar lai str. 56601
uaauuuguaggaauuac

SEQ ID NO: 2769932 - RNA, 13 nt, Leptospira interrogans serovar lai str. 56601
uaauuuuaaagaa

SEQ ID NO: 2769933 - RNA, 11 nt, Leptospira interrogans serovar lai str. 56601
uaauuuuagag

SEQ ID NO: 2769934 - RNA, 18 nt, Leptospira interrogans serovar lai str. 56601
uaauuuuauaauauucua

SEQ ID NO: 2769935 - RNA, 14 nt, Leptospira interrogans serovar lai str. 56601
uaauuuuauccaua

SEQ ID NO: 2769936 - RNA, 15 nt, Leptospira interrogans serovar lai str. 56601
uaauuuuauccauaa

SEQ ID NO: 2769937 - RNA, 18 nt, Leptospira interrogans serovar lai str. 56601
uaauuuuaucuuuuucua

SEQ ID NO: 2769938 - RNA, 11 nt, Leptospira interrogans serovar lai str. 56601
uaauuuuaugu

SEQ ID NO: 2769939 - RNA, 19 nt, Leptospira interrogans serovar lai str. 56601
uaauuuucaugaacgaauu

SEQ ID NO: 2769940 - RNA, 14 nt, Leptospira interrogans serovar lai str. 56601
uaauuuuccuauuu

SEQ ID NO: 2769941 - RNA, 17 nt, Leptospira interrogans serovar lai str. 56601
uaauuuucgauuuaaua

SEQ ID NO: 2769942 - RNA, 22 nt, Leptospira interrogans serovar lai str. 56601
uaauuuucuaauauaacucacu

SEQ ID NO: 2769943 - RNA, 15 nt, Leptospira interrogans serovar lai str. 56601
uaauuuucuuaauaa

SEQ ID NO: 2769944 - RNA, 16 nt, Leptospira interrogans serovar lai str. 56601
uaauuuugugaaucaa

SEQ ID NO: 2769945 - RNA, 17 nt, Leptospira interrogans serovar lai str. 56601
uaauuuuuauagaauuu

SEQ ID NO: 2769946 - RNA, 21 nt, Leptospira interrogans serovar lai str. 56601
uaauuuuuauccaaauuaauu

SEQ ID NO: 2769947 - RNA, 14 nt, Leptospira interrogans serovar lai str. 56601
uaauuuuuuaaaaa

SEQ ID NO: 2769948 - RNA, 15 nt, Leptospira interrogans serovar lai str. 56601
uaauuuuuuaaaaaa

SEQ ID NO: 2769949 - RNA, 17 nt, Leptospira interrogans serovar lai str. 56601
uaauuuuuuaaaaauuu

SEQ ID NO: 2769950 - RNA, 15 nt, Leptospira interrogans serovar lai str. 56601
uaauuuuuuauugaa

SEQ ID NO: 2769951 - RNA, 15 nt, Leptospira interrogans serovar lai str. 56601
uacaaaaaaaucagg

SEQ ID NO: 2769952 - RNA, 17 nt, Leptospira interrogans serovar lai str. 56601
uacaaaaaacugaaacu

SEQ ID NO: 2769953 - RNA, 18 nt, Leptospira interrogans serovar lai str. 56601
uacaaaaaacugaaacuu

SEQ ID NO: 2769954 - RNA, 21 nt, Leptospira interrogans serovar lai str. 56601
uacaaaaaauguuuaaagaau

SEQ ID NO: 2769955 - RNA, 18 nt, Leptospira interrogans serovar lai str. 56601
uacaaaaauucuaauaua

SEQ ID NO: 2769956 - RNA, 14 nt, Leptospira interrogans serovar lai str. 56601
uacaaaaauuuaau

SEQ ID NO: 2769957 - RNA, 16 nt, Leptospira interrogans serovar lai str. 56601
uacaaaacacuguuuc

SEQ ID NO: 2769958 - RNA, 17 nt, Leptospira interrogans serovar lai str. 56601
uacaaaacucuuuaaaa

SEQ ID NO: 2769959 - RNA, 18 nt, Leptospira interrogans serovar lai str. 56601
uacaaaacucuuuaaaaa

SEQ ID NO: 2769960 - RNA, 19 nt, Leptospira interrogans serovar lai str. 56601
uacaaaacucuuuaaaaac

SEQ ID NO: 2769961 - RNA, 18 nt, Leptospira interrogans serovar lai str. 56601
uacaaaacuuuacgaguu

SEQ ID NO: 2769962 - RNA, 20 nt, Leptospira interrogans serovar lai str. 56601
uacaaaaguagaaagauuaa

SEQ ID NO: 2769963 - RNA, 22 nt, Leptospira interrogans serovar lai str. 56601
uacaaaauguuuuuauaucuua

SEQ ID NO: 2769964 - RNA, 12 nt, Leptospira interrogans serovar lai str. 56601
uacaaaauuuaa

SEQ ID NO: 2769965 - RNA, 12 nt, Leptospira interrogans serovar lai str. 56601
uacaaaauuuag

SEQ ID NO: 2769966 - RNA, 12 nt, Leptospira interrogans serovar lai str. 56601
uacaaacaaauu

SEQ ID NO: 2769967 - RNA, 18 nt, Leptospira interrogans serovar lai str. 56601
uacaaacaaauucuaaaa

SEQ ID NO: 2769968 - RNA, 15 nt, Leptospira interrogans serovar lai str. 56601
uacaucccaaaccuc

SEQ ID NO: 2769969 - RNA, 21 nt, Leptospira interrogans serovar lai str. 56601
uacaucguuugucgcaacaca

SEQ ID NO: 2769970 - RNA, 16 nt, Leptospira interrogans serovar lai str. 56601
uacaucuaaugauuuc

SEQ ID NO: 2769971 - RNA, 20 nt, Leptospira interrogans serovar lai str. 56601
uacaucuuaaaaaauacaaa

SEQ ID NO: 2769972 - RNA, 14 nt, Leptospira interrogans serovar lai str. 56601
uacauguucaaaau

SEQ ID NO: 2769973 - RNA, 19 nt, Leptospira interrogans serovar lai str. 56601
uacauuagaauuuuaugau

SEQ ID NO: 2769974 - RNA, 23 nt, Leptospira interrogans serovar lai str. 56601
uacauuagaauuuuaugauuuuc

SEQ ID NO: 2769975 - RNA, 18 nt, Leptospira interrogans serovar lai str. 56601
uacauuagaguuguugaa

SEQ ID NO: 2769976 - RNA, 22 nt, Leptospira interrogans serovar lai str. 56601
uacauuaugcgcaaucucaagu

SEQ ID NO: 2769977 - RNA, 14 nt, Leptospira interrogans serovar lai str. 56601
uacauucuuauaaa

SEQ ID NO: 2769978 - RNA, 17 nt, Leptospira interrogans serovar lai str. 56601
uacauuugauuaaaaau

SEQ ID NO: 2769979 - RNA, 12 nt, Leptospira interrogans serovar lai str. 56601
uacauuuuaaaa

SEQ ID NO: 2769980 - RNA, 13 nt, Leptospira interrogans serovar lai str. 56601
uacauuuuaaaaa

SEQ ID NO: 2769981 - RNA, 14 nt, Leptospira interrogans serovar lai str. 56601
uacauuuuaaaaau

SEQ ID NO: 2769982 - RNA, 20 nt, Leptospira interrogans serovar lai str. 56601
uacauuuuuaaauuguucgu

SEQ ID NO: 2769983 - RNA, 13 nt, Leptospira interrogans serovar lai str. 56601
uacauuuuuagaa

SEQ ID NO: 2769984 - RNA, 14 nt, Leptospira interrogans serovar lai str. 56601
uacauuuuuagaau

SEQ ID NO: 2769985 - RNA, 18 nt, Leptospira interrogans serovar lai str. 56601
uacauuuuucuaaauuaa

SEQ ID NO: 2769986 - RNA, 15 nt, Leptospira interrogans serovar lai str. 56601
uacauuuuugugaaa

SEQ ID NO: 2769987 - RNA, 22 nt, Leptospira interrogans serovar lai str. 56601
uacauuuuuuaucaauuacgaa

SEQ ID NO: 2769988 - RNA, 15 nt, Leptospira interrogans serovar lai str. 56601
uacauuuuuuuagaa

SEQ ID NO: 2769989 - RNA, 13 nt, Leptospira interrogans serovar lai str. 56601
uaccaaaaaagua

SEQ ID NO: 2769990 - RNA, 21 nt, Leptospira interrogans serovar lai str. 56601
uaccaaaaaugcaaaaguuuu

SEQ ID NO: 2769991 - RNA, 13 nt, Leptospira interrogans serovar lai str. 56601
uaccaaaacccau

SEQ ID NO: 2769992 - RNA, 14 nt, Leptospira interrogans serovar lai str. 56601
uaccaaauaaauau

SEQ ID NO: 2769993 - RNA, 21 nt, Leptospira interrogans serovar lai str. 56601
uaccaaauaaauauuuccggc

SEQ ID NO: 2769994 - RNA, 20 nt, Leptospira interrogans serovar lai str. 56601
uaccaaauuguuuucuaaag

SEQ ID NO: 2769995 - RNA, 21 nt, Leptospira interrogans serovar lai str. 56601
uaccaaggauguggaaguuuu

SEQ ID NO: 2769996 - RNA, 12 nt, Leptospira interrogans serovar lai str. 56601
uaccaaguuauu

SEQ ID NO: 2769997 - RNA, 15 nt, Leptospira interrogans serovar lai str. 56601
uaccaaguuauuaac

SEQ ID NO: 2769998 - RNA, 23 nt, Leptospira interrogans serovar lai str. 56601
uaccaauaauuucccauaaaaag

SEQ ID NO: 2769999 - RNA, 23 nt, Leptospira interrogans serovar lai str. 56601
uaccaccaaaguaugauuuuacc

SEQ ID NO: 2770000 - RNA, 21 nt, Leptospira interrogans serovar lai str. 56601
uaccaccccacccaaaaauag

SEQ ID NO: 2770001 - RNA, 16 nt, Leptospira interrogans serovar lai str. 56601
uaccacgaauuaaaua

SEQ ID NO: 2770002 - RNA, 16 nt, Leptospira interrogans serovar lai str. 56601
uaccacuuacauccca

SEQ ID NO: 2770003 - RNA, 16 nt, Leptospira interrogans serovar lai str. 56601
uaccaguuaaauucau

SEQ ID NO: 2770004 - RNA, 20 nt, Leptospira interrogans serovar lai str. 56601
uaccauaggcgcggaaaaau

SEQ ID NO: 2770005 - RNA, 16 nt, Leptospira interrogans serovar lai str. 56601
uaccaucaccaacccc

SEQ ID NO: 2770006 - RNA, 20 nt, Leptospira interrogans serovar lai str. 56601
uaccauucauuucauaucca

SEQ ID NO: 2770007 - RNA, 18 nt, Leptospira interrogans serovar lai str. 56601
uacccagucuccauaaua

SEQ ID NO: 2770008 - RNA, 16 nt, Leptospira interrogans serovar lai str. 56601
uacccgauauuaaaau

SEQ ID NO: 2770009 - RNA, 18 nt, Leptospira interrogans serovar lai str. 56601
uaccgcuggaaauaucaa

SEQ ID NO: 2770010 - RNA, 15 nt, Leptospira interrogans serovar lai str. 56601
uaccgggauuuuaaa

SEQ ID NO: 2770011 - RNA, 17 nt, Leptospira interrogans serovar lai str. 56601
uaccgggauuuuaaaaa

SEQ ID NO: 2770012 - RNA, 18 nt, Leptospira interrogans serovar lai str. 56601
uaccgggauuuuaaaaau

SEQ ID NO: 2770013 - RNA, 23 nt, Leptospira interrogans serovar lai str. 56601
uaccguaaagaagaggugaaauu

SEQ ID NO: 2770014 - RNA, 20 nt, Leptospira interrogans serovar lai str. 56601
uaccguuuuuaaaugugcgg

SEQ ID NO: 2770015 - RNA, 22 nt, Leptospira interrogans serovar lai str. 56601
uaccuaaauauuuauuacaaag

SEQ ID NO: 2770016 - RNA, 18 nt, Leptospira interrogans serovar lai str. 56601
uaccuaauucucuucguu

SEQ ID NO: 2770017 - RNA, 17 nt, Leptospira interrogans serovar lai str. 56601
uaccucaauuuuccauu

SEQ ID NO: 2770018 - RNA, 17 nt, Leptospira interrogans serovar lai str. 56601
uaccuccuuuuucaaaa

SEQ ID NO: 2770019 - RNA, 17 nt, Leptospira interrogans serovar lai str. 56601
uaccucuaaaaaucggc

SEQ ID NO: 2770020 - RNA, 18 nt, Leptospira interrogans serovar lai str. 56601
uaccucuauaaaauuaaa

SEQ ID NO: 2770021 - RNA, 22 nt, Leptospira interrogans serovar lai str. 56601
uaccuguucggaguuguauaac

SEQ ID NO: 2770022 - RNA, 17 nt, Leptospira interrogans serovar lai str. 56601
uaccuguuuuaguucaa

SEQ ID NO: 2770023 - RNA, 23 nt, Leptospira interrogans serovar lai str. 56601
uaccuguuuuaguucaaaaacau

SEQ ID NO: 2770024 - RNA, 16 nt, Leptospira interrogans serovar lai str. 56601
uacgaaaaaauugacu

SEQ ID NO: 2770025 - RNA, 22 nt, Leptospira interrogans serovar lai str. 56601
uacgaaaacuuaaugagauuaa

SEQ ID NO: 2770026 - RNA, 13 nt, Leptospira interrogans serovar lai str. 56601
uacgaaaauuuaa

SEQ ID NO: 2770027 - RNA, 18 nt, Leptospira interrogans serovar lai str. 56601
uacgaaaauuuuuuauuu

SEQ ID NO: 2770028 - RNA, 19 nt, Leptospira interrogans serovar lai str. 56601
uacgaacaaauucuaaaau

SEQ ID NO: 2770029 - RNA, 19 nt, Leptospira interrogans serovar lai str. 56601
uacgaacacauucuaaaau

SEQ ID NO: 2770030 - RNA, 20 nt, Leptospira interrogans serovar lai str. 56601
uacgaacacauucuaaaauu

SEQ ID NO: 2770031 - RNA, 20 nt, Leptospira interrogans serovar lai str. 56601
uacgaacgaauucuaaaauu

SEQ ID NO: 2770032 - RNA, 21 nt, Leptospira interrogans serovar lai str. 56601
uacgacaaguccucuaugaaa

SEQ ID NO: 2770033 - RNA, 21 nt, Leptospira interrogans serovar lai str. 56601
uacgacagauucaauuuuuau

SEQ ID NO: 2770034 - RNA, 19 nt, Leptospira interrogans serovar lai str. 56601
uacgacauuuuagagcaga

SEQ ID NO: 2770035 - RNA, 21 nt, Leptospira interrogans serovar lai str. 56601
uacgacuuuauucaaaauaga

SEQ ID NO: 2770036 - RNA, 22 nt, Leptospira interrogans serovar lai str. 56601
uacgauauuuuguuuuuaguua

SEQ ID NO: 2770037 - RNA, 13 nt, Leptospira interrogans serovar lai str. 56601
uacgaucuaaaag

SEQ ID NO: 2770038 - RNA, 16 nt, Leptospira interrogans serovar lai str. 56601
uacgaucuaaaaggac

SEQ ID NO: 2770039 - RNA, 15 nt, Leptospira interrogans serovar lai str. 56601
uacgaugauaaauug

SEQ ID NO: 2770040 - RNA, 17 nt, Leptospira interrogans serovar lai str. 56601
uacgauuaaauuuugaa

SEQ ID NO: 2770041 - RNA, 18 nt, Leptospira interrogans serovar lai str. 56601
uacgauuuaaucuaggau

SEQ ID NO: 2770042 - RNA, 13 nt, Leptospira interrogans serovar lai str. 56601
uacgauuucucca

SEQ ID NO: 2770043 - RNA, 17 nt, Leptospira interrogans serovar lai str. 56601
uacgcugaguuugagag

SEQ ID NO: 2770044 - RNA, 18 nt, Leptospira interrogans serovar lai str. 56601
uacgcuucaaucucuuuc

SEQ ID NO: 2770045 - RNA, 20 nt, Leptospira interrogans serovar lai str. 56601
uacggaucaauucugaaaau

SEQ ID NO: 2770046 - RNA, 23 nt, Leptospira interrogans serovar lai str. 56601
uacggaucgcguuugaaacucag

SEQ ID NO: 2770047 - RNA, 22 nt, Leptospira interrogans serovar lai str. 56601
uacggauucucgcauuuuccuu

SEQ ID NO: 2770048 - RNA, 18 nt, Leptospira interrogans serovar lai str. 56601
uacggauuucuauaaaau

SEQ ID NO: 2770049 - RNA, 17 nt, Leptospira interrogans serovar lai str. 56601
uacggcauuuuuuaaau

SEQ ID NO: 2770050 - RNA, 19 nt, Leptospira interrogans serovar lai str. 56601
uacuuuauagguucuggau

SEQ ID NO: 2770051 - RNA, 13 nt, Leptospira interrogans serovar lai str. 56601
uacuuuauuaaaa

SEQ ID NO: 2770052 - RNA, 14 nt, Leptospira interrogans serovar lai str. 56601
uacuuuauuaaaaa

SEQ ID NO: 2770053 - RNA, 22 nt, Leptospira interrogans serovar lai str. 56601
uacuuuccguagaucuuuuaua

SEQ ID NO: 2770054 - RNA, 19 nt, Leptospira interrogans serovar lai str. 56601
uacuuuccgucuuuuaggu

SEQ ID NO: 2770055 - RNA, 19 nt, Leptospira interrogans serovar lai str. 56601
uacuuugaacuuguccuaa

SEQ ID NO: 2770056 - RNA, 15 nt, Leptospira interrogans serovar lai str. 56601
uacuuugaaugaaaa

SEQ ID NO: 2770057 - RNA, 16 nt, Leptospira interrogans serovar lai str. 56601
uacuuugagaaaauuu

SEQ ID NO: 2770058 - RNA, 12 nt, Leptospira interrogans serovar lai str. 56601
uacuuuuaaaaa

SEQ ID NO: 2770059 - RNA, 13 nt, Leptospira interrogans serovar lai str. 56601
uacuuuuaaaaaa

SEQ ID NO: 2770060 - RNA, 15 nt, Leptospira interrogans serovar lai str. 56601
uacuuuuagaaaaaa

SEQ ID NO: 2770061 - RNA, 18 nt, Leptospira interrogans serovar lai str. 56601
uacuuuuagaaaaaauuu

SEQ ID NO: 2770062 - RNA, 22 nt, Leptospira interrogans serovar lai str. 56601
uacuuuuagaaaauuuuuacuc

SEQ ID NO: 2770063 - RNA, 12 nt, Leptospira interrogans serovar lai str. 56601
uacuuuucuucc

SEQ ID NO: 2770064 - RNA, 16 nt, Leptospira interrogans serovar lai str. 56601
uacuuuugaaauagau

SEQ ID NO: 2770065 - RNA, 19 nt, Leptospira interrogans serovar lai str. 56601
uacuuuugaaauagauucu

SEQ ID NO: 2770066 - RNA, 14 nt, Leptospira interrogans serovar lai str. 56601
uacuuuuuccaaaa

SEQ ID NO: 2770067 - RNA, 11 nt, Leptospira interrogans serovar lai str. 56601
uacuuuuucug

SEQ ID NO: 2770068 - RNA, 12 nt, Leptospira interrogans serovar lai str. 56601
uagaaaaaaagu

SEQ ID NO: 2770069 - RNA, 20 nt, Leptospira interrogans serovar lai str. 56601
uagaaaaaaaguauauauua

SEQ ID NO: 2770070 - RNA, 14 nt, Leptospira interrogans serovar lai str. 56601
uagaaaaaauacau

SEQ ID NO: 2770071 - RNA, 14 nt, Leptospira interrogans serovar lai str. 56601
uagaaaaacugauu

SEQ ID NO: 2770072 - RNA, 20 nt, Leptospira interrogans serovar lai str. 56601
uagaaaaacugauuuaauua

SEQ ID NO: 2770073 - RNA, 19 nt, Leptospira interrogans serovar lai str. 56601
uagaaaauuagaaagaauc

SEQ ID NO: 2770074 - RNA, 13 nt, Leptospira interrogans serovar lai str. 56601
uagaaaauucaaa

SEQ ID NO: 2770075 - RNA, 15 nt, Leptospira interrogans serovar lai str. 56601
uagaaaauuuuuucu

SEQ ID NO: 2770076 - RNA, 14 nt, Leptospira interrogans serovar lai str. 56601
uagaaacaaaugga

SEQ ID NO: 2770077 - RNA, 20 nt, Leptospira interrogans serovar lai str. 56601
uagaaacggugcauuuaaaa

SEQ ID NO: 2770078 - RNA, 22 nt, Leptospira interrogans serovar lai str. 56601
uagaaacggugcauuuaaaaaa

SEQ ID NO: 2770079 - RNA, 19 nt, Leptospira interrogans serovar lai str. 56601
uagaaacuaaugcaaguuc

SEQ ID NO: 2770080 - RNA, 22 nt, Leptospira interrogans serovar lai str. 56601
uagaaacuuauacuuuauagaa

SEQ ID NO: 2770081 - RNA, 22 nt, Leptospira interrogans serovar lai str. 56601
uagaaagaauuuucuaaaagua

SEQ ID NO: 2770082 - RNA, 16 nt, Leptospira interrogans serovar lai str. 56601
uagaaagaccuuuuag

SEQ ID NO: 2770083 - RNA, 23 nt, Leptospira interrogans serovar lai str. 56601
uagaaagacuuuucaucauuccc

SEQ ID NO: 2770084 - RNA, 15 nt, Leptospira interrogans serovar lai str. 56601
uagaaagguauagaa

SEQ ID NO: 2770085 - RNA, 21 nt, Leptospira interrogans serovar lai str. 56601
uagaaagguuauccucugaac

SEQ ID NO: 2770086 - RNA, 17 nt, Leptospira interrogans serovar lai str. 56601
uagaaauacauaaauga

SEQ ID NO: 2770087 - RNA, 17 nt, Leptospira interrogans serovar lai str. 56601
uagaaauacuuaaaaug

SEQ ID NO: 2770088 - RNA, 20 nt, Leptospira interrogans serovar lai str. 56601
uagaaauacuuaaaaugaga

SEQ ID NO: 2770089 - RNA, 18 nt, Leptospira interrogans serovar lai str. 56601
uagaaauauugaauccau

SEQ ID NO: 2770090 - RNA, 17 nt, Leptospira interrogans serovar lai str. 56601
uagaaaucaauggaaaa

SEQ ID NO: 2770091 - RNA, 22 nt, Leptospira interrogans serovar lai str. 56601
uagaaaucaauggaaaauuaau

SEQ ID NO: 2770092 - RNA, 19 nt, Leptospira interrogans serovar lai str. 56601
uagaaaucgauuuguaaaa

SEQ ID NO: 2770093 - RNA, 21 nt, Leptospira interrogans serovar lai str. 56601
uagaaaucgauuuguaaaauu

SEQ ID NO: 2770094 - RNA, 21 nt, Leptospira interrogans serovar lai str. 56601
uagaaaugauuuuuuaaaaua

SEQ ID NO: 2770095 - RNA, 22 nt, Leptospira interrogans serovar lai str. 56601
uagaaaugauuuuuuaaaauaa

SEQ ID NO: 2770096 - RNA, 15 nt, Leptospira interrogans serovar lai str. 56601
uagaaauucuauuuu

SEQ ID NO: 2770097 - RNA, 19 nt, Leptospira interrogans serovar lai str. 56601
uagaaauugugggaacuau

SEQ ID NO: 2770098 - RNA, 18 nt, Leptospira interrogans serovar lai str. 56601
uagaaauuucuaauaaaa

SEQ ID NO: 2770099 - RNA, 13 nt, Leptospira interrogans serovar lai str. 56601
uagaaauuugauu

SEQ ID NO: 2770100 - RNA, 19 nt, Leptospira interrogans serovar lai str. 56601
uagaaauuuucaaaaaaua

SEQ ID NO: 2770101 - RNA, 18 nt, Leptospira interrogans serovar lai str. 56601
uagaaauuuuuaauaaaa

SEQ ID NO: 2770102 - RNA, 20 nt, Leptospira interrogans serovar lai str. 56601
uagaaauuuuuaauaaaaug

SEQ ID NO: 2770103 - RNA, 19 nt, Leptospira interrogans serovar lai str. 56601
uagaaauuuuuaaucaaau

SEQ ID NO: 2770104 - RNA, 23 nt, Leptospira interrogans serovar lai str. 56601
uagaacaaucucggacagauaua

SEQ ID NO: 2770105 - RNA, 16 nt, Leptospira interrogans serovar lai str. 56601
uagaaccaguaucguu

SEQ ID NO: 2770106 - RNA, 17 nt, Leptospira interrogans serovar lai str. 56601
uagaaccaucucaaaaa

SEQ ID NO: 2770107 - RNA, 19 nt, Leptospira interrogans serovar lai str. 56601
uagaacgugucauguuuua

SEQ ID NO: 2770108 - RNA, 16 nt, Leptospira interrogans serovar lai str. 56601
uagaacuagaaagacc

SEQ ID NO: 2770109 - RNA, 17 nt, Leptospira interrogans serovar lai str. 56601
uagaacuuuucuggauu

SEQ ID NO: 2770110 - RNA, 15 nt, Leptospira interrogans serovar lai str. 56601
uagaagaauuguauu

SEQ ID NO: 2770111 - RNA, 20 nt, Leptospira interrogans serovar lai str. 56601
uagaagccugaguuugagag

SEQ ID NO: 2770112 - RNA, 20 nt, Leptospira interrogans serovar lai str. 56601
uagaaguaguaguucccaca

SEQ ID NO: 2770113 - RNA, 19 nt, Leptospira interrogans serovar lai str. 56601
uagaauagagucuuuaaaa

SEQ ID NO: 2770114 - RNA, 14 nt, Leptospira interrogans serovar lai str. 56601
uagaauauaaccgu

SEQ ID NO: 2770115 - RNA, 11 nt, Leptospira interrogans serovar lai str. 56601
uagaauauaca

SEQ ID NO: 2770116 - RNA, 15 nt, Leptospira interrogans serovar lai str. 56601
uagaauauuaugaaa

SEQ ID NO: 2770117 - RNA, 20 nt, Leptospira interrogans serovar lai str. 56601
uagaauauuaugaaauaaag

SEQ ID NO: 2770118 - RNA, 15 nt, Leptospira interrogans serovar lai str. 56601
uagaauauuuucuca

SEQ ID NO: 2770119 - RNA, 18 nt, Leptospira interrogans serovar lai str. 56601
uagaaucaaaaugaacuc

SEQ ID NO: 2770120 - RNA, 23 nt, Leptospira interrogans serovar lai str. 56601
uagaaucaaaaugaacucaacag

SEQ ID NO: 2770121 - RNA, 12 nt, Leptospira interrogans serovar lai str. 56601
uagaaucagaau

SEQ ID NO: 2770122 - RNA, 23 nt, Leptospira interrogans serovar lai str. 56601
uagaaucagaaugaacucaacag

SEQ ID NO: 2770123 - RNA, 15 nt, Leptospira interrogans serovar lai str. 56601
uagaaucaucucaaa

SEQ ID NO: 2770124 - RNA, 17 nt, Leptospira interrogans serovar lai str. 56601
uagaauccaauacaaaa

SEQ ID NO: 2770125 - RNA, 23 nt, Leptospira interrogans serovar lai str. 56601
uagaauccaaugcgaaauagauu

SEQ ID NO: 2770126 - RNA, 13 nt, Leptospira interrogans serovar lai str. 56601
uagaaucccauuu

SEQ ID NO: 2770127 - RNA, 20 nt, Leptospira interrogans serovar lai str. 56601
uagaaucuaaacuuacagau

SEQ ID NO: 2770128 - RNA, 19 nt, Leptospira interrogans serovar lai str. 56601
uagaaucugaacuuuauag

SEQ ID NO: 2770129 - RNA, 20 nt, Leptospira interrogans serovar lai str. 56601
uagaaucugaacuuuauaga

SEQ ID NO: 2770130 - RNA, 21 nt, Leptospira interrogans serovar lai str. 56601
uagaaucugaacuuuauagau

SEQ ID NO: 2770131 - RNA, 21 nt, Leptospira interrogans serovar lai str. 56601
uagaauuggggagaaacacuc

SEQ ID NO: 2770132 - RNA, 18 nt, Leptospira interrogans serovar lai str. 56601
uagaauuguguuaguucc

SEQ ID NO: 2770133 - RNA, 21 nt, Leptospira interrogans serovar lai str. 56601
uagcaguucuacuuuauuaaa

SEQ ID NO: 2770134 - RNA, 23 nt, Leptospira interrogans serovar lai str. 56601
uagcaguucuacuuuauuaaaaa

SEQ ID NO: 2770135 - RNA, 16 nt, Leptospira interrogans serovar lai str. 56601
uagcaugaaauuuucu

SEQ ID NO: 2770136 - RNA, 13 nt, Leptospira interrogans serovar lai str. 56601
uagcauuuuuaag

SEQ ID NO: 2770137 - RNA, 15 nt, Leptospira interrogans serovar lai str. 56601
uagcauuuuuaagau

SEQ ID NO: 2770138 - RNA, 18 nt, Leptospira interrogans serovar lai str. 56601
uagccaaaucugaaaaag

SEQ ID NO: 2770139 - RNA, 15 nt, Leptospira interrogans serovar lai str. 56601
uagccaaguauaaaa

SEQ ID NO: 2770140 - RNA, 17 nt, Leptospira interrogans serovar lai str. 56601
uagccaaguauaaaagu

SEQ ID NO: 2770141 - RNA, 15 nt, Leptospira interrogans serovar lai str. 56601
uagccauaucauauu

SEQ ID NO: 2770142 - RNA, 17 nt, Leptospira interrogans serovar lai str. 56601
uagccaucggaauuccu

SEQ ID NO: 2770143 - RNA, 19 nt, Leptospira interrogans serovar lai str. 56601
uagccaucggaauuccucc

SEQ ID NO: 2770144 - RNA, 18 nt, Leptospira interrogans serovar lai str. 56601
uagccaugguaagaagaa

SEQ ID NO: 2770145 - RNA, 13 nt, Leptospira interrogans serovar lai str. 56601
uagccuaauuuac

SEQ ID NO: 2770146 - RNA, 22 nt, Leptospira interrogans serovar lai str. 56601
uagccuaauuuacuacaucuaa

SEQ ID NO: 2770147 - RNA, 17 nt, Leptospira interrogans serovar lai str. 56601
uagcgauacuuaaaaau

SEQ ID NO: 2770148 - RNA, 14 nt, Leptospira interrogans serovar lai str. 56601
uagcgguaaaagaa

SEQ ID NO: 2770149 - RNA, 16 nt, Leptospira interrogans serovar lai str. 56601
uagcgguaaaagaaua

SEQ ID NO: 2770150 - RNA, 22 nt, Leptospira interrogans serovar lai str. 56601
uagcguaauacgaugauaaauu

SEQ ID NO: 2770151 - RNA, 17 nt, Leptospira interrogans serovar lai str. 56601
uagcuaagucuuuaaaa

SEQ ID NO: 2770152 - RNA, 19 nt, Leptospira interrogans serovar lai str. 56601
uagcuaagucuuuaaaaau

SEQ ID NO: 2770153 - RNA, 19 nt, Leptospira interrogans serovar lai str. 56601
uagcuauuuucagaaaaau

SEQ ID NO: 2770154 - RNA, 15 nt, Leptospira interrogans serovar lai str. 56601
uagcucuugaauaaa

SEQ ID NO: 2770155 - RNA, 12 nt, Leptospira interrogans serovar lai str. 56601
uagcuuaaaagu

SEQ ID NO: 2770156 - RNA, 13 nt, Leptospira interrogans serovar lai str. 56601
uagcuuaaaagug

SEQ ID NO: 2770157 - RNA, 21 nt, Leptospira interrogans serovar lai str. 56601
uagcuuuugagcaguaaaaaa

SEQ ID NO: 2770158 - RNA, 22 nt, Leptospira interrogans serovar lai str. 56601
uagcuuuugagcaguaaaaaag

SEQ ID NO: 2770159 - RNA, 15 nt, Leptospira interrogans serovar lai str. 56601
uaggaaauaauuccu

SEQ ID NO: 2770160 - RNA, 13 nt, Leptospira interrogans serovar lai str. 56601
uaggaaauucuuu

SEQ ID NO: 2770161 - RNA, 15 nt, Leptospira interrogans serovar lai str. 56601
uaggaaauucuuuuc

SEQ ID NO: 2770162 - RNA, 17 nt, Leptospira interrogans serovar lai str. 56601
uaggaaauucuuuucca

SEQ ID NO: 2770163 - RNA, 23 nt, Leptospira interrogans serovar lai str. 56601
uaggaacccauacaaaauuuaaa

SEQ ID NO: 2770164 - RNA, 21 nt, Leptospira interrogans serovar lai str. 56601
uaggaacuaccgcaaaucaag

SEQ ID NO: 2770165 - RNA, 22 nt, Leptospira interrogans serovar lai str. 56601
uaggaacuacuacuuuuagaaa

SEQ ID NO: 2770166 - RNA, 15 nt, Leptospira interrogans serovar lai str. 56601
uaggaacuacugcau

SEQ ID NO: 2770167 - RNA, 21 nt, Leptospira interrogans serovar lai str. 56601
uaggaacucauacuucuaaaa

SEQ ID NO: 2770168 - RNA, 21 nt, Leptospira interrogans serovar lai str. 56601
uaggaacucauacuuuuagaa

SEQ ID NO: 2770169 - RNA, 23 nt, Leptospira interrogans serovar lai str. 56601
uaggaacucauauuuuuagaaaa

SEQ ID NO: 2770170 - RNA, 18 nt, Leptospira interrogans serovar lai str. 56601
uaggaacuccuugguuca

SEQ ID NO: 2770171 - RNA, 15 nt, Leptospira interrogans serovar lai str. 56601
uaggaacugcuucca

SEQ ID NO: 2770172 - RNA, 23 nt, Leptospira interrogans serovar lai str. 56601
uaggaacugcuuccaaaaaaagu

SEQ ID NO: 2770173 - RNA, 15 nt, Leptospira interrogans serovar lai str. 56601
uaggaagaaacaaag

SEQ ID NO: 2770174 - RNA, 22 nt, Leptospira interrogans serovar lai str. 56601
uaggaaucgaucuguaaaguuc

SEQ ID NO: 2770175 - RNA, 14 nt, Leptospira interrogans serovar lai str. 56601
uaggaauucauacu

SEQ ID NO: 2770176 - RNA, 17 nt, Leptospira interrogans serovar lai str. 56601
uaggaauuggaggaaaa

SEQ ID NO: 2770177 - RNA, 20 nt, Leptospira interrogans serovar lai str. 56601
uaggaauuuccgauaaagaa

SEQ ID NO: 2770178 - RNA, 17 nt, Leptospira interrogans serovar lai str. 56601
uaggacggauuuuagau

SEQ ID NO: 2770179 - RNA, 15 nt, Leptospira interrogans serovar lai str. 56601
uaggauaauacaaau

SEQ ID NO: 2770180 - RNA, 18 nt, Leptospira interrogans serovar lai str. 56601
uaggauauuugauauaau

SEQ ID NO: 2770181 - RNA, 18 nt, Leptospira interrogans serovar lai str. 56601
uaggaucagaauuucuuu

SEQ ID NO: 2770182 - RNA, 19 nt, Leptospira interrogans serovar lai str. 56601
uaggaucagaauuucuuuc

SEQ ID NO: 2770183 - RNA, 17 nt, Leptospira interrogans serovar lai str. 56601
uaggaucaguaguucuc

SEQ ID NO: 2770184 - RNA, 18 nt, Leptospira interrogans serovar lai str. 56601
uaggaucguauuuuagaa

SEQ ID NO: 2770185 - RNA, 21 nt, Leptospira interrogans serovar lai str. 56601
uaggaugaauugcuaaaaaag

SEQ ID NO: 2770186 - RNA, 21 nt, Leptospira interrogans serovar lai str. 56601
uaggauuccauugauuuucau

SEQ ID NO: 2770187 - RNA, 19 nt, Leptospira interrogans serovar lai str. 56601
uaggauuuaguuccuauag

SEQ ID NO: 2770188 - RNA, 18 nt, Leptospira interrogans serovar lai str. 56601
uaggauuuuagaaucaga

SEQ ID NO: 2770189 - RNA, 23 nt, Leptospira interrogans serovar lai str. 56601
uaggauuuuagaaucagaaugaa

SEQ ID NO: 2770190 - RNA, 18 nt, Leptospira interrogans serovar lai str. 56601
uaggauuuuagaaugaga

SEQ ID NO: 2770191 - RNA, 20 nt, Leptospira interrogans serovar lai str. 56601
uaggauuuuauauauauuuu

SEQ ID NO: 2770192 - RNA, 22 nt, Leptospira interrogans serovar lai str. 56601
uaggauuuuuggaauaaaauca

SEQ ID NO: 2770193 - RNA, 16 nt, Leptospira interrogans serovar lai str. 56601
uaggcacguggaaaau

SEQ ID NO: 2770194 - RNA, 18 nt, Leptospira interrogans serovar lai str. 56601
uaggcacguggaaaauca

SEQ ID NO: 2770195 - RNA, 13 nt, Leptospira interrogans serovar lai str. 56601
uaggcauuucauu

SEQ ID NO: 2770196 - RNA, 14 nt, Leptospira interrogans serovar lai str. 56601
uaggcgauuuuucg

SEQ ID NO: 2770197 - RNA, 14 nt, Leptospira interrogans serovar lai str. 56601
uaggcuaaucaaau

SEQ ID NO: 2770198 - RNA, 16 nt, Leptospira interrogans serovar lai str. 56601
uaggcuaaucaaauuu

SEQ ID NO: 2770199 - RNA, 15 nt, Leptospira interrogans serovar lai str. 56601
uaggcuauuuuacug

SEQ ID NO: 2770200 - RNA, 18 nt, Leptospira interrogans serovar lai str. 56601
uaggcuuaucuguaaaau

SEQ ID NO: 2770201 - RNA, 15 nt, Leptospira interrogans serovar lai str. 56601
uagggaaaacucaac

SEQ ID NO: 2770202 - RNA, 17 nt, Leptospira interrogans serovar lai str. 56601
uagguaauuuaggaaua

SEQ ID NO: 2770203 - RNA, 14 nt, Leptospira interrogans serovar lai str. 56601
uaggugauuaucuc

SEQ ID NO: 2770204 - RNA, 20 nt, Leptospira interrogans serovar lai str. 56601
uagguucuugcaaaaauaga

SEQ ID NO: 2770205 - RNA, 23 nt, Leptospira interrogans serovar lai str. 56601
uagguuuuguaauaguucccaca

SEQ ID NO: 2770206 - RNA, 12 nt, Leptospira interrogans serovar lai str. 56601
uaguaaaagaaa

SEQ ID NO: 2770207 - RNA, 13 nt, Leptospira interrogans serovar lai str. 56601
uaguaaaaucuuc

SEQ ID NO: 2770208 - RNA, 13 nt, Leptospira interrogans serovar lai str. 56601
uaguaaaauuuaa

SEQ ID NO: 2770209 - RNA, 15 nt, Leptospira interrogans serovar lai str. 56601
uaguaaaauuuaaaa

SEQ ID NO: 2770210 - RNA, 16 nt, Leptospira interrogans serovar lai str. 56601
uaguaaaauuuaaaau

SEQ ID NO: 2770211 - RNA, 16 nt, Leptospira interrogans serovar lai str. 56601
uaguaaacuacuaaau

SEQ ID NO: 2770212 - RNA, 17 nt, Leptospira interrogans serovar lai str. 56601
uaguaaagauuagaaaa

SEQ ID NO: 2770213 - RNA, 19 nt, Leptospira interrogans serovar lai str. 56601
uaguaaagauuagaaaaac

SEQ ID NO: 2770214 - RNA, 14 nt, Leptospira interrogans serovar lai str. 56601
uaguaaauaaaaaa

SEQ ID NO: 2770215 - RNA, 15 nt, Leptospira interrogans serovar lai str. 56601
uaguaaauaaaaaac

SEQ ID NO: 2770216 - RNA, 22 nt, Leptospira interrogans serovar lai str. 56601
uauaaaccaucucaaaaacacu

SEQ ID NO: 2770217 - RNA, 13 nt, Leptospira interrogans serovar lai str. 56601
uauaaagaaaaac

SEQ ID NO: 2770218 - RNA, 14 nt, Leptospira interrogans serovar lai str. 56601
uauaaagaaaaaca

SEQ ID NO: 2770219 - RNA, 14 nt, Leptospira interrogans serovar lai str. 56601
uauaaagauaaauc

SEQ ID NO: 2770220 - RNA, 16 nt, Leptospira interrogans serovar lai str. 56601
uauaaagauaaaucgu

SEQ ID NO: 2770221 - RNA, 23 nt, Leptospira interrogans serovar lai str. 56601
uauaaagauaaaucguuugcuuu

SEQ ID NO: 2770222 - RNA, 14 nt, Leptospira interrogans serovar lai str. 56601
uauaaaguauagaa

SEQ ID NO: 2770223 - RNA, 18 nt, Leptospira interrogans serovar lai str. 56601
uauaaagucguuuuuaag

SEQ ID NO: 2770224 - RNA, 16 nt, Leptospira interrogans serovar lai str. 56601
uauaaaguuuuaguuu

SEQ ID NO: 2770225 - RNA, 23 nt, Leptospira interrogans serovar lai str. 56601
uauaaaguuuuaguuuacaaauu

SEQ ID NO: 2770226 - RNA, 11 nt, Leptospira interrogans serovar lai str. 56601
uauaaauaaau

SEQ ID NO: 2770227 - RNA, 18 nt, Leptospira interrogans serovar lai str. 56601
uauaaauaaauuuaaaug

SEQ ID NO: 2770228 - RNA, 21 nt, Leptospira interrogans serovar lai str. 56601
uauaaaucaaagcaaaguuuc

SEQ ID NO: 2770229 - RNA, 12 nt, Leptospira interrogans serovar lai str. 56601
uauaaaucaauc

SEQ ID NO: 2770230 - RNA, 14 nt, Leptospira interrogans serovar lai str. 56601
uauaaaucauacaa

SEQ ID NO: 2770231 - RNA, 19 nt, Leptospira interrogans serovar lai str. 56601
uauaaaugaauuuuaaauu

SEQ ID NO: 2770232 - RNA, 20 nt, Leptospira interrogans serovar lai str. 56601
uauaaaugaauuuuaaauuu

SEQ ID NO: 2770233 - RNA, 18 nt, Leptospira interrogans serovar lai str. 56601
uauaaauguaggaacuac

SEQ ID NO: 2770234 - RNA, 22 nt, Leptospira interrogans serovar lai str. 56601
uauaaauucaucuaaaaaaaac

SEQ ID NO: 2770235 - RNA, 20 nt, Leptospira interrogans serovar lai str. 56601
uauaaauucgcaaaaaaaau

SEQ ID NO: 2770236 - RNA, 20 nt, Leptospira interrogans serovar lai str. 56601
uauaaauucgccguaaaaaa

SEQ ID NO: 2770237 - RNA, 19 nt, Leptospira interrogans serovar lai str. 56601
uauaaauugcaucaaagaa

SEQ ID NO: 2770238 - RNA, 18 nt, Leptospira interrogans serovar lai str. 56601
uauaacaaaguauuuaau

SEQ ID NO: 2770239 - RNA, 14 nt, Leptospira interrogans serovar lai str. 56601
uauaacaauucucg

SEQ ID NO: 2770240 - RNA, 23 nt, Leptospira interrogans serovar lai str. 56601
uauaacaauucucgauagaacaa

SEQ ID NO: 2770241 - RNA, 24 nt, Leptospira interrogans serovar lai str. 56601
uauaaccacaagacaaacaaacau

SEQ ID NO: 2770242 - RNA, 17 nt, Leptospira interrogans serovar lai str. 56601
uauaaccucaacauaaa

SEQ ID NO: 2770243 - RNA, 18 nt, Leptospira interrogans serovar lai str. 56601
uauaacgaaacuuuaauu

SEQ ID NO: 2770244 - RNA, 19 nt, Leptospira interrogans serovar lai str. 56601
uauaacgaaacuuuaauuu

SEQ ID NO: 2770245 - RNA, 18 nt, Leptospira interrogans serovar lai str. 56601
uauaacgggaauuauaaa

SEQ ID NO: 2770246 - RNA, 22 nt, Leptospira interrogans serovar lai str. 56601
uauaacguagauuacuaugaaa

SEQ ID NO: 2770247 - RNA, 15 nt, Leptospira interrogans serovar lai str. 56601
uauaacguuauaaaa

SEQ ID NO: 2770248 - RNA, 21 nt, Leptospira interrogans serovar lai str. 56601
uauaacuuacugauuucuaua

SEQ ID NO: 2770249 - RNA, 16 nt, Leptospira interrogans serovar lai str. 56601
uauaacuuuaaaaaau

SEQ ID NO: 2770250 - RNA, 18 nt, Leptospira interrogans serovar lai str. 56601
uauaacuuuaaaaaauaa

SEQ ID NO: 2770251 - RNA, 14 nt, Leptospira interrogans serovar lai str. 56601
uauaacuuuuucag

SEQ ID NO: 2770252 - RNA, 19 nt, Leptospira interrogans serovar lai str. 56601
uauaagacauuggcaaaug

SEQ ID NO: 2770253 - RNA, 22 nt, Leptospira interrogans serovar lai str. 56601
uauaagacauuggcaaauguua

SEQ ID NO: 2770254 - RNA, 19 nt, Leptospira interrogans serovar lai str. 56601
uauaaguagaaauuuaauu

SEQ ID NO: 2770255 - RNA, 20 nt, Leptospira interrogans serovar lai str. 56601
uauaagucgaucuacuaaau

SEQ ID NO: 2770256 - RNA, 14 nt, Leptospira interrogans serovar lai str. 56601
uauaaguuaaauuu

SEQ ID NO: 2770257 - RNA, 15 nt, Leptospira interrogans serovar lai str. 56601
uauaaguuuuuauua

SEQ ID NO: 2770258 - RNA, 17 nt, Leptospira interrogans serovar lai str. 56601
uauaaguuuuuauuaua

SEQ ID NO: 2770259 - RNA, 12 nt, Leptospira interrogans serovar lai str. 56601
uauaauaaaauc

SEQ ID NO: 2770260 - RNA, 13 nt, Leptospira interrogans serovar lai str. 56601
uauaauaaaauua

SEQ ID NO: 2770261 - RNA, 21 nt, Leptospira interrogans serovar lai str. 56601
uauaauaaaauuauuaacuaa

SEQ ID NO: 2770262 - RNA, 21 nt, Leptospira interrogans serovar lai str. 56601
uauaauaaaguaccuaauauu

SEQ ID NO: 2770263 - RNA, 13 nt, Leptospira interrogans serovar lai str. 56601
uauaauaaauuga

SEQ ID NO: 2770264 - RNA, 15 nt, Leptospira interrogans serovar lai str. 56601
uauaauaacaaaaaa

SEQ ID NO: 2770265 - RNA, 17 nt, Leptospira interrogans serovar lai str. 56601
uauaauaagauuuguug

SEQ ID NO: 2770266 - RNA, 16 nt, Leptospira interrogans serovar lai str. 56601
uauaauaauuguugaa

SEQ ID NO: 2770267 - RNA, 24 nt, Leptospira interrogans serovar lai str. 56601
uauaauaauuguugaauaucuaau

SEQ ID NO: 2770268 - RNA, 19 nt, Leptospira interrogans serovar lai str. 56601
uauaauagaguuacagaaa

SEQ ID NO: 2770269 - RNA, 21 nt, Leptospira interrogans serovar lai str. 56601
uauaauagaguuacagaaaaa

SEQ ID NO: 2770270 - RNA, 23 nt, Leptospira interrogans serovar lai str. 56601
uauaauagaguuacagaaaaaau

SEQ ID NO: 2770271 - RNA, 18 nt, Leptospira interrogans serovar lai str. 56601
uauaauaguuacgacauu

SEQ ID NO: 2770272 - RNA, 23 nt, Leptospira interrogans serovar lai str. 56601
uauaauaguuacgacauuuuaau

SEQ ID NO: 2770273 - RNA, 21 nt, Leptospira interrogans serovar lai str. 56601
uauaauauacuuauaaagaau

SEQ ID NO: 2770274 - RNA, 22 nt, Leptospira interrogans serovar lai str. 56601
uauaauauucuuauguuuuuua

SEQ ID NO: 2770275 - RNA, 17 nt, Leptospira interrogans serovar lai str. 56601
uauaaucaaauacaaaa

SEQ ID NO: 2770276 - RNA, 18 nt, Leptospira interrogans serovar lai str. 56601
uauaaucaaauacaaaaa

SEQ ID NO: 2770277 - RNA, 19 nt, Leptospira interrogans serovar lai str. 56601
uauaaucaaauacaaaaac

SEQ ID NO: 2770278 - RNA, 17 nt, Leptospira interrogans serovar lai str. 56601
uauaaucgaauuuccau

SEQ ID NO: 2770279 - RNA, 19 nt, Leptospira interrogans serovar lai str. 56601
uauaaucgaauuuccauuu

SEQ ID NO: 2770280 - RNA, 23 nt, Leptospira interrogans serovar lai str. 56601
uauaaucgaauuuccauuucuga

SEQ ID NO: 2770281 - RNA, 16 nt, Leptospira interrogans serovar lai str. 56601
uauaaucuaagauuga

SEQ ID NO: 2770282 - RNA, 14 nt, Leptospira interrogans serovar lai str. 56601
uauaaucugauuga

SEQ ID NO: 2770283 - RNA, 15 nt, Leptospira interrogans serovar lai str. 56601
uauaaucuuaauauu

SEQ ID NO: 2770284 - RNA, 16 nt, Leptospira interrogans serovar lai str. 56601
uauaaucuuaauauuu

SEQ ID NO: 2770285 - RNA, 23 nt, Leptospira interrogans serovar lai str. 56601
uauaaucuuuguaugaguuccca

SEQ ID NO: 2770286 - RNA, 16 nt, Leptospira interrogans serovar lai str. 56601
uauaaugaacucuuuu

SEQ ID NO: 2770287 - RNA, 21 nt, Leptospira interrogans serovar lai str. 56601
uauaaugaacucuuuuuauuu

SEQ ID NO: 2770288 - RNA, 16 nt, Leptospira interrogans serovar lai str. 56601
uauaauguuugaauuu

SEQ ID NO: 2770289 - RNA, 15 nt, Leptospira interrogans serovar lai str. 56601
uauaauuaaaaagau

SEQ ID NO: 2770290 - RNA, 14 nt, Leptospira interrogans serovar lai str. 56601
uauaauuaauaaaa

SEQ ID NO: 2770291 - RNA, 20 nt, Leptospira interrogans serovar lai str. 56601
uauaauucccguuauaaauc

SEQ ID NO: 2770292 - RNA, 20 nt, Leptospira interrogans serovar lai str. 56601
uauaauuccgggguuucuuu

SEQ ID NO: 2770293 - RNA, 19 nt, Leptospira interrogans serovar lai str. 56601
uauaauucguuuuuuaaaa

SEQ ID NO: 2770294 - RNA, 20 nt, Leptospira interrogans serovar lai str. 56601
uauaauucguuuuuuaaaau

SEQ ID NO: 2770295 - RNA, 22 nt, Leptospira interrogans serovar lai str. 56601
uauaauucuguaaaauaaauuu

SEQ ID NO: 2770296 - RNA, 11 nt, Leptospira interrogans serovar lai str. 56601
uauaauucuuu

SEQ ID NO: 2770297 - RNA, 17 nt, Leptospira interrogans serovar lai str. 56601
uauaauugauucgauau

SEQ ID NO: 2770298 - RNA, 14 nt, Leptospira interrogans serovar lai str. 56601
uauauuuuuuuaau

SEQ ID NO: 2770299 - RNA, 18 nt, Leptospira interrogans serovar lai str. 56601
uaucaagaagagucaaac

SEQ ID NO: 2770300 - RNA, 22 nt, Leptospira interrogans serovar lai str. 56601
uaucaauccuguaaauucaaaa

SEQ ID NO: 2770301 - RNA, 20 nt, Leptospira interrogans serovar lai str. 56601
uaucaauucacucuuaaaua

SEQ ID NO: 2770302 - RNA, 22 nt, Leptospira interrogans serovar lai str. 56601
uaucaauucacucuuaaauacu

SEQ ID NO: 2770303 - RNA, 18 nt, Leptospira interrogans serovar lai str. 56601
uaucacaaaaaugaaaaa

SEQ ID NO: 2770304 - RNA, 21 nt, Leptospira interrogans serovar lai str. 56601
uaucacaaaaaugaaaaaacu

SEQ ID NO: 2770305 - RNA, 15 nt, Leptospira interrogans serovar lai str. 56601
uaucacaaauuuuaa

SEQ ID NO: 2770306 - RNA, 17 nt, Leptospira interrogans serovar lai str. 56601
uaucaccguaauucuua

SEQ ID NO: 2770307 - RNA, 20 nt, Leptospira interrogans serovar lai str. 56601
uaucacgaaaauuaaaaaau

SEQ ID NO: 2770308 - RNA, 14 nt, Leptospira interrogans serovar lai str. 56601
uaucagaaaaacau

SEQ ID NO: 2770309 - RNA, 15 nt, Leptospira interrogans serovar lai str. 56601
uaucagaaaaacaua

SEQ ID NO: 2770310 - RNA, 21 nt, Leptospira interrogans serovar lai str. 56601
uaucagaaaaacauacuuuuu

SEQ ID NO: 2770311 - RNA, 18 nt, Leptospira interrogans serovar lai str. 56601
uaucagaaccuuuaguuu

SEQ ID NO: 2770312 - RNA, 22 nt, Leptospira interrogans serovar lai str. 56601
uaucagaaccuuuaguuuccaa

SEQ ID NO: 2770313 - RNA, 23 nt, Leptospira interrogans serovar lai str. 56601
uaucagaaccuuuaguuuccaaa

SEQ ID NO: 2770314 - RNA, 16 nt, Leptospira interrogans serovar lai str. 56601
uaucagauguuuuaaa

SEQ ID NO: 2770315 - RNA, 18 nt, Leptospira interrogans serovar lai str. 56601
uaucagauguuuuaaaag

SEQ ID NO: 2770316 - RNA, 20 nt, Leptospira interrogans serovar lai str. 56601
uaucaggauaaccuaaaauu

SEQ ID NO: 2770317 - RNA, 22 nt, Leptospira interrogans serovar lai str. 56601
uaucaguuuuguuaaccaaaaa

SEQ ID NO: 2770318 - RNA, 19 nt, Leptospira interrogans serovar lai str. 56601
uaucauaaaaauaaagaaa

SEQ ID NO: 2770319 - RNA, 20 nt, Leptospira interrogans serovar lai str. 56601
uaucauaaaaauaaagaaac

SEQ ID NO: 2770320 - RNA, 16 nt, Leptospira interrogans serovar lai str. 56601
uaucauaaauuuuuau

SEQ ID NO: 2770321 - RNA, 14 nt, Leptospira interrogans serovar lai str. 56601
uaucauagaaccug

SEQ ID NO: 2770322 - RNA, 12 nt, Leptospira interrogans serovar lai str. 56601
uaucauagaaua

SEQ ID NO: 2770323 - RNA, 22 nt, Leptospira interrogans serovar lai str. 56601
uaucauucuuuccuauaaaagu

SEQ ID NO: 2770324 - RNA, 15 nt, Leptospira interrogans serovar lai str. 56601
uauccaaaacucuac

SEQ ID NO: 2770325 - RNA, 15 nt, Leptospira interrogans serovar lai str. 56601
uauccaauugaauau

SEQ ID NO: 2770326 - RNA, 20 nt, Leptospira interrogans serovar lai str. 56601
uauccaauugaauauaaaau

SEQ ID NO: 2770327 - RNA, 14 nt, Leptospira interrogans serovar lai str. 56601
uauccacuaaaaua

SEQ ID NO: 2770328 - RNA, 19 nt, Leptospira interrogans serovar lai str. 56601
uauccauaaauucuacaaa

SEQ ID NO: 2770329 - RNA, 13 nt, Leptospira interrogans serovar lai str. 56601
uauccgaaaaauu

SEQ ID NO: 2770330 - RNA, 14 nt, Leptospira interrogans serovar lai str. 56601
uauccguaaaaccu

SEQ ID NO: 2770331 - RNA, 18 nt, Leptospira interrogans serovar lai str. 56601
uauccuuaaaaugaaaau

SEQ ID NO: 2770332 - RNA, 19 nt, Leptospira interrogans serovar lai str. 56601
uauccuuaaaaugaaaauu

SEQ ID NO: 2770333 - RNA, 22 nt, Leptospira interrogans serovar lai str. 56601
uauccuuacgaugucuuuucaa

SEQ ID NO: 2770334 - RNA, 21 nt, Leptospira interrogans serovar lai str. 56601
uauccuuacuuaccucuauaa

SEQ ID NO: 2770335 - RNA, 14 nt, Leptospira interrogans serovar lai str. 56601
uauccuuaugaaag

SEQ ID NO: 2770336 - RNA, 18 nt, Leptospira interrogans serovar lai str. 56601
uauccuugggauaaauau

SEQ ID NO: 2770337 - RNA, 19 nt, Leptospira interrogans serovar lai str. 56601
uauccuugggauaaauauu

SEQ ID NO: 2770338 - RNA, 23 nt, Leptospira interrogans serovar lai str. 56601
uauccuugggauaaauauucucu

SEQ ID NO: 2770339 - RNA, 14 nt, Leptospira interrogans serovar lai str. 56601
uaucgaaaauuaac

SEQ ID NO: 2770340 - RNA, 16 nt, Leptospira interrogans serovar lai str. 56601
uaucgaauaagaaauu

SEQ ID NO: 2770341 - RNA, 22 nt, Leptospira interrogans serovar lai str. 56601
uaucgaauacauuuaaacuuuu

SEQ ID NO: 2770342 - RNA, 23 nt, Leptospira interrogans serovar lai str. 56601
uaucgaauggaaaucuuuuaaaa

SEQ ID NO: 2770343 - RNA, 19 nt, Leptospira interrogans serovar lai str. 56601
uaucgaauucacguuaaaa

SEQ ID NO: 2770344 - RNA, 15 nt, Leptospira interrogans serovar lai str. 56601
uaucgaauuucuuca

SEQ ID NO: 2770345 - RNA, 13 nt, Leptospira interrogans serovar lai str. 56601
uaucgauuuaaaa

SEQ ID NO: 2770346 - RNA, 15 nt, Leptospira interrogans serovar lai str. 56601
uaucgauuuaaaaac

SEQ ID NO: 2770347 - RNA, 21 nt, Leptospira interrogans serovar lai str. 56601
uaucggaaucgaggaaauucu

SEQ ID NO: 2770348 - RNA, 16 nt, Leptospira interrogans serovar lai str. 56601
uaucggcacuuuuguu

SEQ ID NO: 2770349 - RNA, 13 nt, Leptospira interrogans serovar lai str. 56601
uaucgucaaaauu

SEQ ID NO: 2770350 - RNA, 18 nt, Leptospira interrogans serovar lai str. 56601
uaucuaaagcuugauuau

SEQ ID NO: 2770351 - RNA, 14 nt, Leptospira interrogans serovar lai str. 56601
uaucuaauauuuuu

SEQ ID NO: 2770352 - RNA, 23 nt, Leptospira interrogans serovar lai str. 56601
uaucuacaaaagauuuuuaucga

SEQ ID NO: 2770353 - RNA, 13 nt, Leptospira interrogans serovar lai str. 56601
uaucuauugaaac

SEQ ID NO: 2770354 - RNA, 19 nt, Leptospira interrogans serovar lai str. 56601
uaucuauugaaacaaaaau

SEQ ID NO: 2770355 - RNA, 14 nt, Leptospira interrogans serovar lai str. 56601
uaucuccaaaauca

SEQ ID NO: 2770356 - RNA, 19 nt, Leptospira interrogans serovar lai str. 56601
uaucuccaaaauuuuugug

SEQ ID NO: 2770357 - RNA, 21 nt, Leptospira interrogans serovar lai str. 56601
uaucucuugucagaccuaaaa

SEQ ID NO: 2770358 - RNA, 13 nt, Leptospira interrogans serovar lai str. 56601
uaucuguaaaauu

SEQ ID NO: 2770359 - RNA, 18 nt, Leptospira interrogans serovar lai str. 56601
uaucugugaauucuccaa

SEQ ID NO: 2770360 - RNA, 22 nt, Leptospira interrogans serovar lai str. 56601
uaucuuaauguaaaguucuuuu

SEQ ID NO: 2770361 - RNA, 17 nt, Leptospira interrogans serovar lai str. 56601
uaucuuaauuaaaaaau

SEQ ID NO: 2770362 - RNA, 16 nt, Leptospira interrogans serovar lai str. 56601
uaucuuagaauuguug

SEQ ID NO: 2770363 - RNA, 18 nt, Leptospira interrogans serovar lai str. 56601
uaucuuagaauuguugaa

SEQ ID NO: 2770364 - RNA, 19 nt, Leptospira interrogans serovar lai str. 56601
uaucuuauuauuuaacgug

SEQ ID NO: 2770365 - RNA, 13 nt, Leptospira interrogans serovar lai str. 56601
uaucuucuaauua

SEQ ID NO: 2770366 - RNA, 17 nt, Leptospira interrogans serovar lai str. 56601
uaucuucuaauuaaauu

SEQ ID NO: 2770367 - RNA, 15 nt, Leptospira interrogans serovar lai str. 56601
uaucuuguuucuguu

SEQ ID NO: 2770368 - RNA, 15 nt, Leptospira interrogans serovar lai str. 56601
uaucuuuauaaaaau

SEQ ID NO: 2770369 - RNA, 12 nt, Leptospira interrogans serovar lai str. 56601
uaucuuuccagu

SEQ ID NO: 2770370 - RNA, 20 nt, Leptospira interrogans serovar lai str. 56601
uaucuuuuucuaucaagaag

SEQ ID NO: 2770371 - RNA, 18 nt, Leptospira interrogans serovar lai str. 56601
uaucuuuuuuaaaacauc

SEQ ID NO: 2770372 - RNA, 15 nt, Leptospira interrogans serovar lai str. 56601
uaugaaaaacucggu

SEQ ID NO: 2770373 - RNA, 15 nt, Leptospira interrogans serovar lai str. 56601
uaugaaauuuuucaa

SEQ ID NO: 2770374 - RNA, 23 nt, Leptospira interrogans serovar lai str. 56601
uaugaagaaaaccuaaaauagau

SEQ ID NO: 2770375 - RNA, 20 nt, Leptospira interrogans serovar lai str. 56601
uaugaaguaaguuauaacgu

SEQ ID NO: 2770376 - RNA, 17 nt, Leptospira interrogans serovar lai str. 56601
uaugaaguaugaaguaa

SEQ ID NO: 2770377 - RNA, 17 nt, Leptospira interrogans serovar lai str. 56601
uaugaagucuuaucuca

SEQ ID NO: 2770378 - RNA, 13 nt, Leptospira interrogans serovar lai str. 56601
uaugaauaaaaaa

SEQ ID NO: 2770379 - RNA, 13 nt, Leptospira interrogans serovar lai str. 56601
uaugaauuaauuu

SEQ ID NO: 2770380 - RNA, 22 nt, Leptospira interrogans serovar lai str. 56601
uaugaauucauuguaagaaaua

SEQ ID NO: 2770381 - RNA, 19 nt, Leptospira interrogans serovar lai str. 56601
uauuaggaaauacaaaaag

SEQ ID NO: 2770382 - RNA, 14 nt, Leptospira interrogans serovar lai str. 56601
uauuauaaaauaca

SEQ ID NO: 2770383 - RNA, 19 nt, Leptospira interrogans serovar lai str. 56601
uauuauaaaauacaaaaga

SEQ ID NO: 2770384 - RNA, 13 nt, Leptospira interrogans serovar lai str. 56601
uauuauaaacagu

SEQ ID NO: 2770385 - RNA, 13 nt, Leptospira interrogans serovar lai str. 56601
uauuauaaauaca

SEQ ID NO: 2770386 - RNA, 13 nt, Leptospira interrogans serovar lai str. 56601
uauuauaaauauu

SEQ ID NO: 2770387 - RNA, 12 nt, Leptospira interrogans serovar lai str. 56601
uauuauaaauuu

SEQ ID NO: 2770388 - RNA, 14 nt, Leptospira interrogans serovar lai str. 56601
uauuauaaauuuaa

SEQ ID NO: 2770389 - RNA, 13 nt, Leptospira interrogans serovar lai str. 56601
uauuauaaauuuu

SEQ ID NO: 2770390 - RNA, 17 nt, Leptospira interrogans serovar lai str. 56601
uauuauauaauuuuuaa

SEQ ID NO: 2770391 - RNA, 20 nt, Leptospira interrogans serovar lai str. 56601
uauuauauggaguucuaaau

SEQ ID NO: 2770392 - RNA, 17 nt, Leptospira interrogans serovar lai str. 56601
uauuaucaaaauuuaaa

SEQ ID NO: 2770393 - RNA, 22 nt, Leptospira interrogans serovar lai str. 56601
uauuaucaaaauuuaaauccca

SEQ ID NO: 2770394 - RNA, 17 nt, Leptospira interrogans serovar lai str. 56601
uauuaucuuuauauuau

SEQ ID NO: 2770395 - RNA, 17 nt, Leptospira interrogans serovar lai str. 56601
uauuauuaaauuuuuau

SEQ ID NO: 2770396 - RNA, 18 nt, Leptospira interrogans serovar lai str. 56601
uauuauuuguaguuucaa

SEQ ID NO: 2770397 - RNA, 17 nt, Leptospira interrogans serovar lai str. 56601
uauuauuuuaacuugag

SEQ ID NO: 2770398 - RNA, 18 nt, Leptospira interrogans serovar lai str. 56601
uauuauuuugauuuguuu

SEQ ID NO: 2770399 - RNA, 14 nt, Leptospira interrogans serovar lai str. 56601
uauucaaaaaaugg

SEQ ID NO: 2770400 - RNA, 22 nt, Leptospira interrogans serovar lai str. 56601
uauucaaaaaauggaacauucc

SEQ ID NO: 2770401 - RNA, 16 nt, Leptospira interrogans serovar lai str. 56601
uauucaaauuuacucu

SEQ ID NO: 2770402 - RNA, 21 nt, Leptospira interrogans serovar lai str. 56601
uauucaaauuuacucuuauaa

SEQ ID NO: 2770403 - RNA, 12 nt, Leptospira interrogans serovar lai str. 56601
uauucaacuugu

SEQ ID NO: 2770404 - RNA, 19 nt, Leptospira interrogans serovar lai str. 56601
uauucaagagcaaaguuac

SEQ ID NO: 2770405 - RNA, 14 nt, Leptospira interrogans serovar lai str. 56601
uauucaauuucaga

SEQ ID NO: 2770406 - RNA, 13 nt, Leptospira interrogans serovar lai str. 56601
uauucaauuucuu

SEQ ID NO: 2770407 - RNA, 21 nt, Leptospira interrogans serovar lai str. 56601
uauucaauuucuuuaauuuca

SEQ ID NO: 2770408 - RNA, 14 nt, Leptospira interrogans serovar lai str. 56601
uauucaauuuuuau

SEQ ID NO: 2770409 - RNA, 16 nt, Leptospira interrogans serovar lai str. 56601
uauucacugaaaauuu

SEQ ID NO: 2770410 - RNA, 18 nt, Leptospira interrogans serovar lai str. 56601
uauucacuuguuauuaaa

SEQ ID NO: 2770411 - RNA, 15 nt, Leptospira interrogans serovar lai str. 56601
uauucacuuuuccaa

SEQ ID NO: 2770412 - RNA, 17 nt, Leptospira interrogans serovar lai str. 56601
uauucagaaaacagaau

SEQ ID NO: 2770413 - RNA, 19 nt, Leptospira interrogans serovar lai str. 56601
uauucagaaacuggaauau

SEQ ID NO: 2770414 - RNA, 15 nt, Leptospira interrogans serovar lai str. 56601
uauucaguuuccacu

SEQ ID NO: 2770415 - RNA, 15 nt, Leptospira interrogans serovar lai str. 56601
uauucauaacuauau

SEQ ID NO: 2770416 - RNA, 17 nt, Leptospira interrogans serovar lai str. 56601
uauuccagaaguauuuu

SEQ ID NO: 2770417 - RNA, 14 nt, Leptospira interrogans serovar lai str. 56601
uauuccauuuucau

SEQ ID NO: 2770418 - RNA, 13 nt, Leptospira interrogans serovar lai str. 56601
uauuccuaaaaug

SEQ ID NO: 2770419 - RNA, 15 nt, Leptospira interrogans serovar lai str. 56601
uauucguaagaaaaa

SEQ ID NO: 2770420 - RNA, 16 nt, Leptospira interrogans serovar lai str. 56601
uauucguaagaaaaaa

SEQ ID NO: 2770421 - RNA, 18 nt, Leptospira interrogans serovar lai str. 56601
uauucguauuuuauagaa

SEQ ID NO: 2770422 - RNA, 17 nt, Leptospira interrogans serovar lai str. 56601
uauucuaauuuuauaaa

SEQ ID NO: 2770423 - RNA, 15 nt, Leptospira interrogans serovar lai str. 56601
uauucuaauuuuuau

SEQ ID NO: 2770424 - RNA, 18 nt, Leptospira interrogans serovar lai str. 56601
uauucuaauuuuuaucca

SEQ ID NO: 2770425 - RNA, 18 nt, Leptospira interrogans serovar lai str. 56601
uauucuacagauaaaaau

SEQ ID NO: 2770426 - RNA, 16 nt, Leptospira interrogans serovar lai str. 56601
uauucuagaagaguuu

SEQ ID NO: 2770427 - RNA, 22 nt, Leptospira interrogans serovar lai str. 56601
uauucuauaaaauuugaaagua

SEQ ID NO: 2770428 - RNA, 23 nt, Leptospira interrogans serovar lai str. 56601
uauucuauucguauuuuauagaa

SEQ ID NO: 2770429 - RNA, 16 nt, Leptospira interrogans serovar lai str. 56601
uauucuccauucuuga

SEQ ID NO: 2770430 - RNA, 22 nt, Leptospira interrogans serovar lai str. 56601
uauucugaaagugaaaguaauc

SEQ ID NO: 2770431 - RNA, 16 nt, Leptospira interrogans serovar lai str. 56601
uauucuuauaagaauc

SEQ ID NO: 2770432 - RNA, 19 nt, Leptospira interrogans serovar lai str. 56601
uauucuuauauaucuuugg

SEQ ID NO: 2770433 - RNA, 21 nt, Leptospira interrogans serovar lai str. 56601
uauucuuuucugaauaaaaau

SEQ ID NO: 2770434 - RNA, 13 nt, Leptospira interrogans serovar lai str. 56601
uauucuuuuuaga

SEQ ID NO: 2770435 - RNA, 15 nt, Leptospira interrogans serovar lai str. 56601
uauucuuuuuagacu

SEQ ID NO: 2770436 - RNA, 11 nt, Leptospira interrogans serovar lai str. 56601
uauugaaaaau

SEQ ID NO: 2770437 - RNA, 14 nt, Leptospira interrogans serovar lai str. 56601
uauugaaauauuau

SEQ ID NO: 2770438 - RNA, 21 nt, Leptospira interrogans serovar lai str. 56601
uauugaacguaaguuaaauau

SEQ ID NO: 2770439 - RNA, 15 nt, Leptospira interrogans serovar lai str. 56601
uauugaagauauuuu

SEQ ID NO: 2770440 - RNA, 19 nt, Leptospira interrogans serovar lai str. 56601
uauugaucucuauaaaauc

SEQ ID NO: 2770441 - RNA, 20 nt, Leptospira interrogans serovar lai str. 56601
uauugaucucuauaaaauca

SEQ ID NO: 2770442 - RNA, 18 nt, Leptospira interrogans serovar lai str. 56601
uauugauucuauauauug

SEQ ID NO: 2770443 - RNA, 20 nt, Leptospira interrogans serovar lai str. 56601
uauugcugucauaaaccgau

SEQ ID NO: 2770444 - RNA, 23 nt, Leptospira interrogans serovar lai str. 56601
uauugguagauugcuuuuuaaaa

SEQ ID NO: 2770445 - RNA, 14 nt, Leptospira interrogans serovar lai str. 56601
uauugucucaaaau

SEQ ID NO: 2770446 - RNA, 14 nt, Leptospira interrogans serovar lai str. 56601
uauugugaauauuu

SEQ ID NO: 2770447 - RNA, 13 nt, Leptospira interrogans serovar lai str. 56601
uauugugggaacu

SEQ ID NO: 2770448 - RNA, 16 nt, Leptospira interrogans serovar lai str. 56601
uauuguguuuuuucuu

SEQ ID NO: 2770449 - RNA, 15 nt, Leptospira interrogans serovar lai str. 56601
uauuguuaagauaaa

SEQ ID NO: 2770450 - RNA, 18 nt, Leptospira interrogans serovar lai str. 56601
uauuguuaagauaaauuu

SEQ ID NO: 2770451 - RNA, 15 nt, Leptospira interrogans serovar lai str. 56601
uauuuaaaauuaaug

SEQ ID NO: 2770452 - RNA, 12 nt, Leptospira interrogans serovar lai str. 56601
uauuuaaaauuu

SEQ ID NO: 2770453 - RNA, 19 nt, Leptospira interrogans serovar lai str. 56601
uauuuaacuucguugaaaa

SEQ ID NO: 2770454 - RNA, 13 nt, Leptospira interrogans serovar lai str. 56601
uauuuaauaaaau

SEQ ID NO: 2770455 - RNA, 21 nt, Leptospira interrogans serovar lai str. 56601
uauuuaauaaaauuuuuaaaa

SEQ ID NO: 2770456 - RNA, 13 nt, Leptospira interrogans serovar lai str. 56601
uauuuauaaaaua

SEQ ID NO: 2770457 - RNA, 18 nt, Leptospira interrogans serovar lai str. 56601
uauuuauaaaauaaaaaa

SEQ ID NO: 2770458 - RNA, 23 nt, Leptospira interrogans serovar lai str. 56601
uauuuauaaaauaaaaaaauuca

SEQ ID NO: 2770459 - RNA, 16 nt, Leptospira interrogans serovar lai str. 56601
uauuuauaauauucuu

SEQ ID NO: 2770460 - RNA, 15 nt, Leptospira interrogans serovar lai str. 56601
uauuuauauauauuc

SEQ ID NO: 2770461 - RNA, 19 nt, Leptospira interrogans serovar lai str. 56601
uauuuauauauauucacaa

SEQ ID NO: 2770462 - RNA, 14 nt, Leptospira interrogans serovar lai str. 56601
uauuuauucaaaau

SEQ ID NO: 2770463 - RNA, 17 nt, Leptospira interrogans serovar lai str. 56601
uauuuauuuuuuuuaau

SEQ ID NO: 2770464 - RNA, 20 nt, Leptospira interrogans serovar lai str. 56601
uauuucaaaaauuuaaaugu

SEQ ID NO: 2770465 - RNA, 13 nt, Leptospira interrogans serovar lai str. 56601
ucaaaaacucuau

SEQ ID NO: 2770466 - RNA, 12 nt, Leptospira interrogans serovar lai str. 56601
ucaaaaagaauc

SEQ ID NO: 2770467 - RNA, 18 nt, Leptospira interrogans serovar lai str. 56601
ucaaaaagacuauauucu

SEQ ID NO: 2770468 - RNA, 16 nt, Leptospira interrogans serovar lai str. 56601
ucaaaaauaaauuccc

SEQ ID NO: 2770469 - RNA, 21 nt, Leptospira interrogans serovar lai str. 56601
ucaaaaauacuuugaacuugu

SEQ ID NO: 2770470 - RNA, 21 nt, Leptospira interrogans serovar lai str. 56601
ucaaaaauaucuuagaauaau

SEQ ID NO: 2770471 - RNA, 15 nt, Leptospira interrogans serovar lai str. 56601
ucaaaaauuuaaguc

SEQ ID NO: 2770472 - RNA, 21 nt, Leptospira interrogans serovar lai str. 56601
ucaaaaauuuucuguuuauuu

SEQ ID NO: 2770473 - RNA, 14 nt, Leptospira interrogans serovar lai str. 56601
ucaaaacaaaacgu

SEQ ID NO: 2770474 - RNA, 15 nt, Leptospira interrogans serovar lai str. 56601
ucaaaacaaaacgua

SEQ ID NO: 2770475 - RNA, 21 nt, Leptospira interrogans serovar lai str. 56601
ucaaaaccauuuuugcucaga

SEQ ID NO: 2770476 - RNA, 16 nt, Leptospira interrogans serovar lai str. 56601
ucaaaaccgcuuuuag

SEQ ID NO: 2770477 - RNA, 19 nt, Leptospira interrogans serovar lai str. 56601
ucaaaaccuguaaaugaau

SEQ ID NO: 2770478 - RNA, 20 nt, Leptospira interrogans serovar lai str. 56601
ucaaaacgguuuucuaauuu

SEQ ID NO: 2770479 - RNA, 22 nt, Leptospira interrogans serovar lai str. 56601
ucaaaacgguuuucuaauuuau

SEQ ID NO: 2770480 - RNA, 14 nt, Leptospira interrogans serovar lai str. 56601
ucaaaacuuaaaaa

SEQ ID NO: 2770481 - RNA, 16 nt, Leptospira interrogans serovar lai str. 56601
ucaaaacuuaaaaaug

SEQ ID NO: 2770482 - RNA, 13 nt, Leptospira interrogans serovar lai str. 56601
ucaaaacuuaaau

SEQ ID NO: 2770483 - RNA, 15 nt, Leptospira interrogans serovar lai str. 56601
ucaaaacuuuuucga

SEQ ID NO: 2770484 - RNA, 15 nt, Leptospira interrogans serovar lai str. 56601
ucaaaagauugaauu

SEQ ID NO: 2770485 - RNA, 16 nt, Leptospira interrogans serovar lai str. 56601
ucaaaagcucauaauc

SEQ ID NO: 2770486 - RNA, 21 nt, Leptospira interrogans serovar lai str. 56601
ucaaaagcucauaaucaauua

SEQ ID NO: 2770487 - RNA, 15 nt, Leptospira interrogans serovar lai str. 56601
ucaaaagguauaaaa

SEQ ID NO: 2770488 - RNA, 17 nt, Leptospira interrogans serovar lai str. 56601
ucaaaagguauaaaaua

SEQ ID NO: 2770489 - RNA, 18 nt, Leptospira interrogans serovar lai str. 56601
ucaaaagguauaaaauaa

SEQ ID NO: 2770490 - RNA, 12 nt, Leptospira interrogans serovar lai str. 56601
ucaaaagucuau

SEQ ID NO: 2770491 - RNA, 16 nt, Leptospira interrogans serovar lai str. 56601
ucaaaagucuauuucu

SEQ ID NO: 2770492 - RNA, 19 nt, Leptospira interrogans serovar lai str. 56601
ucaaaagucuauuucuaaa

SEQ ID NO: 2770493 - RNA, 22 nt, Leptospira interrogans serovar lai str. 56601
ucaaaauaaauaauacauuggg

SEQ ID NO: 2770494 - RNA, 16 nt, Leptospira interrogans serovar lai str. 56601
ucaaaauaagaaaaua

SEQ ID NO: 2770495 - RNA, 13 nt, Leptospira interrogans serovar lai str. 56601
ucaaaauaagaau

SEQ ID NO: 2770496 - RNA, 18 nt, Leptospira interrogans serovar lai str. 56601
ucaaaauacuuuuaauuu

SEQ ID NO: 2770497 - RNA, 23 nt, Leptospira interrogans serovar lai str. 56601
ucaaaauacuuuuaauuuugcca

SEQ ID NO: 2770498 - RNA, 12 nt, Leptospira interrogans serovar lai str. 56601
ucaaaauagaau

SEQ ID NO: 2770499 - RNA, 15 nt, Leptospira interrogans serovar lai str. 56601
ucaaaauagaauaaa

SEQ ID NO: 2770500 - RNA, 23 nt, Leptospira interrogans serovar lai str. 56601
ucaaaauagaauaaauuauacaa

SEQ ID NO: 2770501 - RNA, 11 nt, Leptospira interrogans serovar lai str. 56601
ucaaaaucgga

SEQ ID NO: 2770502 - RNA, 20 nt, Leptospira interrogans serovar lai str. 56601
ucaaaaugaacaaugaauuu

SEQ ID NO: 2770503 - RNA, 22 nt, Leptospira interrogans serovar lai str. 56601
ucaaaauuaagcgggaauuuaa

SEQ ID NO: 2770504 - RNA, 21 nt, Leptospira interrogans serovar lai str. 56601
ucaaaauuaccuuucauuuuu

SEQ ID NO: 2770505 - RNA, 11 nt, Leptospira interrogans serovar lai str. 56601
ucaaaauucuu

SEQ ID NO: 2770506 - RNA, 16 nt, Leptospira interrogans serovar lai str. 56601
ucaaaauucuuaaaaa

SEQ ID NO: 2770507 - RNA, 17 nt, Leptospira interrogans serovar lai str. 56601
ucaaaauucuuaaaaaa

SEQ ID NO: 2770508 - RNA, 17 nt, Leptospira interrogans serovar lai str. 56601
ucaaaauucuuugucgg

SEQ ID NO: 2770509 - RNA, 23 nt, Leptospira interrogans serovar lai str. 56601
ucaaaauugagcuuguuuuuaaa

SEQ ID NO: 2770510 - RNA, 17 nt, Leptospira interrogans serovar lai str. 56601
ucaaaauuuaaauccca

SEQ ID NO: 2770511 - RNA, 20 nt, Leptospira interrogans serovar lai str. 56601
ucaaaauuuaaaucccauuu

SEQ ID NO: 2770512 - RNA, 13 nt, Leptospira interrogans serovar lai str. 56601
ucaaaauuuaaga

SEQ ID NO: 2770513 - RNA, 18 nt, Leptospira interrogans serovar lai str. 56601
ucaaaauuuaucuguaaa

SEQ ID NO: 2770514 - RNA, 13 nt, Leptospira interrogans serovar lai str. 56601
ucaaaauuucgga

SEQ ID NO: 2770515 - RNA, 16 nt, Leptospira interrogans serovar lai str. 56601
ucaaaauuugauccuc

SEQ ID NO: 2770516 - RNA, 16 nt, Leptospira interrogans serovar lai str. 56601
ucaaaauuuuuuuaag

SEQ ID NO: 2770517 - RNA, 17 nt, Leptospira interrogans serovar lai str. 56601
ucaaacaacaaaaaaua

SEQ ID NO: 2770518 - RNA, 16 nt, Leptospira interrogans serovar lai str. 56601
ucaaacacucuaaauc

SEQ ID NO: 2770519 - RNA, 19 nt, Leptospira interrogans serovar lai str. 56601
ucaaacacucuaaaucuua

SEQ ID NO: 2770520 - RNA, 16 nt, Leptospira interrogans serovar lai str. 56601
ucaaaccuuucuuucu

SEQ ID NO: 2770521 - RNA, 19 nt, Leptospira interrogans serovar lai str. 56601
ucaaaccuuucuuucugau

SEQ ID NO: 2770522 - RNA, 17 nt, Leptospira interrogans serovar lai str. 56601
ucaaacgaaguuuauuu

SEQ ID NO: 2770523 - RNA, 22 nt, Leptospira interrogans serovar lai str. 56601
ucaaacgaaguuuauuucuaaa

SEQ ID NO: 2770524 - RNA, 23 nt, Leptospira interrogans serovar lai str. 56601
ucaaacucacguuggauuaugca

SEQ ID NO: 2770525 - RNA, 15 nt, Leptospira interrogans serovar lai str. 56601
ucaaacucuuuuucu

SEQ ID NO: 2770526 - RNA, 21 nt, Leptospira interrogans serovar lai str. 56601
ucaaacucuuuuucuucugcu

SEQ ID NO: 2770527 - RNA, 13 nt, Leptospira interrogans serovar lai str. 56601
ucaaacuuauaac

SEQ ID NO: 2770528 - RNA, 11 nt, Leptospira interrogans serovar lai str. 56601
ucaaagaaaug

SEQ ID NO: 2770529 - RNA, 14 nt, Leptospira interrogans serovar lai str. 56601
ucaaagaaucauuu

SEQ ID NO: 2770530 - RNA, 12 nt, Leptospira interrogans serovar lai str. 56601
ucaaagaaucga

SEQ ID NO: 2770531 - RNA, 17 nt, Leptospira interrogans serovar lai str. 56601
ucaaagaaucuuaggca

SEQ ID NO: 2770532 - RNA, 13 nt, Leptospira interrogans serovar lai str. 56601
ucaaagauaaaau

SEQ ID NO: 2770533 - RNA, 14 nt, Leptospira interrogans serovar lai str. 56601
ucaaagauaaaaua

SEQ ID NO: 2770534 - RNA, 21 nt, Leptospira interrogans serovar lai str. 56601
ucaaagauauuucaauauaaa

SEQ ID NO: 2770535 - RNA, 15 nt, Leptospira interrogans serovar lai str. 56601
ucaaagauuacauaa

SEQ ID NO: 2770536 - RNA, 20 nt, Leptospira interrogans serovar lai str. 56601
ucaaagcaaaguuucuuaua

SEQ ID NO: 2770537 - RNA, 13 nt, Leptospira interrogans serovar lai str. 56601
ucaaagcaagaaa

SEQ ID NO: 2770538 - RNA, 18 nt, Leptospira interrogans serovar lai str. 56601
ucaaagccuuaaaucaau

SEQ ID NO: 2770539 - RNA, 20 nt, Leptospira interrogans serovar lai str. 56601
ucaaagccuuaaaucaaucc

SEQ ID NO: 2770540 - RNA, 16 nt, Leptospira interrogans serovar lai str. 56601
ucaaagcgggaauucc

SEQ ID NO: 2770541 - RNA, 23 nt, Leptospira interrogans serovar lai str. 56601
ucaaagcuauaguuuuuaacagu

SEQ ID NO: 2770542 - RNA, 14 nt, Leptospira interrogans serovar lai str. 56601
ucaaaggaaaauga

SEQ ID NO: 2770543 - RNA, 21 nt, Leptospira interrogans serovar lai str. 56601
ucaaaggaaaaugaagaaaca

SEQ ID NO: 2770544 - RNA, 17 nt, Leptospira interrogans serovar lai str. 56601
ucaaaggaaauaaaaau

SEQ ID NO: 2770545 - RNA, 21 nt, Leptospira interrogans serovar lai str. 56601
ucaaaggccgcuucuuuauuu

SEQ ID NO: 2770546 - RNA, 14 nt, Leptospira interrogans serovar lai str. 56601
ucaaaguuuucaca

SEQ ID NO: 2770547 - RNA, 18 nt, Leptospira interrogans serovar lai str. 56601
ucaaauaaagaaaaggaa

SEQ ID NO: 2770548 - RNA, 17 nt, Leptospira interrogans serovar lai str. 56601
ucaauaaaauaccauaa

SEQ ID NO: 2770549 - RNA, 11 nt, Leptospira interrogans serovar lai str. 56601
ucaauaaauug

SEQ ID NO: 2770550 - RNA, 13 nt, Leptospira interrogans serovar lai str. 56601
ucaauaaauugaa

SEQ ID NO: 2770551 - RNA, 12 nt, Leptospira interrogans serovar lai str. 56601
ucaauaaauugc

SEQ ID NO: 2770552 - RNA, 13 nt, Leptospira interrogans serovar lai str. 56601
ucaauaacuugac

SEQ ID NO: 2770553 - RNA, 14 nt, Leptospira interrogans serovar lai str. 56601
ucaauaaguuuaca

SEQ ID NO: 2770554 - RNA, 19 nt, Leptospira interrogans serovar lai str. 56601
ucaauaauguggaacucua

SEQ ID NO: 2770555 - RNA, 16 nt, Leptospira interrogans serovar lai str. 56601
ucaauaauucuauuuu

SEQ ID NO: 2770556 - RNA, 13 nt, Leptospira interrogans serovar lai str. 56601
ucaauaauuuuaa

SEQ ID NO: 2770557 - RNA, 17 nt, Leptospira interrogans serovar lai str. 56601
ucaauaauuuuaauauu

SEQ ID NO: 2770558 - RNA, 20 nt, Leptospira interrogans serovar lai str. 56601
ucaauacaacgaaaacagau

SEQ ID NO: 2770559 - RNA, 17 nt, Leptospira interrogans serovar lai str. 56601
ucaauacaauaaaaaca

SEQ ID NO: 2770560 - RNA, 20 nt, Leptospira interrogans serovar lai str. 56601
ucaauacaauaaaaacagau

SEQ ID NO: 2770561 - RNA, 23 nt, Leptospira interrogans serovar lai str. 56601
ucaauacaauaaaaacagaugga

SEQ ID NO: 2770562 - RNA, 17 nt, Leptospira interrogans serovar lai str. 56601
ucaauaccgauuucuau

SEQ ID NO: 2770563 - RNA, 14 nt, Leptospira interrogans serovar lai str. 56601
ucaauagaaauacc

SEQ ID NO: 2770564 - RNA, 22 nt, Leptospira interrogans serovar lai str. 56601
ucaauagaaauaccauucauuu

SEQ ID NO: 2770565 - RNA, 19 nt, Leptospira interrogans serovar lai str. 56601
ucaauagaauuguugaaaa

SEQ ID NO: 2770566 - RNA, 22 nt, Leptospira interrogans serovar lai str. 56601
ucaauagaauuguugaaaaauu

SEQ ID NO: 2770567 - RNA, 14 nt, Leptospira interrogans serovar lai str. 56601
ucaauauaaaaauu

SEQ ID NO: 2770568 - RNA, 14 nt, Leptospira interrogans serovar lai str. 56601
ucaaucaaaauuuu

SEQ ID NO: 2770569 - RNA, 14 nt, Leptospira interrogans serovar lai str. 56601
ucaaucaguaaaau

SEQ ID NO: 2770570 - RNA, 16 nt, Leptospira interrogans serovar lai str. 56601
ucaaucaguaaaaugu

SEQ ID NO: 2770571 - RNA, 13 nt, Leptospira interrogans serovar lai str. 56601
ucaaucauauuuu

SEQ ID NO: 2770572 - RNA, 16 nt, Leptospira interrogans serovar lai str. 56601
ucaauccaauauuuau

SEQ ID NO: 2770573 - RNA, 23 nt, Leptospira interrogans serovar lai str. 56601
ucaaucgaccguuuccauaaaau

SEQ ID NO: 2770574 - RNA, 22 nt, Leptospira interrogans serovar lai str. 56601
ucaaucuaacccauucaacauc

SEQ ID NO: 2770575 - RNA, 19 nt, Leptospira interrogans serovar lai str. 56601
ucaaucuauuaacuuuaca

SEQ ID NO: 2770576 - RNA, 16 nt, Leptospira interrogans serovar lai str. 56601
ucaaucucuuucucau

SEQ ID NO: 2770577 - RNA, 18 nt, Leptospira interrogans serovar lai str. 56601
ucaaucugcaaagcucag

SEQ ID NO: 2770578 - RNA, 20 nt, Leptospira interrogans serovar lai str. 56601
ucaaugaauauccuucgcau

SEQ ID NO: 2770579 - RNA, 14 nt, Leptospira interrogans serovar lai str. 56601
ucaaugguuuuucu

SEQ ID NO: 2770580 - RNA, 15 nt, Leptospira interrogans serovar lai str. 56601
ucaaugguuuuucuu

SEQ ID NO: 2770581 - RNA, 14 nt, Leptospira interrogans serovar lai str. 56601
ucaauguuauaaaa

SEQ ID NO: 2770582 - RNA, 17 nt, Leptospira interrogans serovar lai str. 56601
ucaauguuauaaaaugu

SEQ ID NO: 2770583 - RNA, 16 nt, Leptospira interrogans serovar lai str. 56601
ucaauguuuuucgcuu

SEQ ID NO: 2770584 - RNA, 16 nt, Leptospira interrogans serovar lai str. 56601
ucaauuaaauuguaug

SEQ ID NO: 2770585 - RNA, 15 nt, Leptospira interrogans serovar lai str. 56601
ucaauuaucaaagca

SEQ ID NO: 2770586 - RNA, 18 nt, Leptospira interrogans serovar lai str. 56601
ucaauucugaaaauguaa

SEQ ID NO: 2770587 - RNA, 19 nt, Leptospira interrogans serovar lai str. 56601
ucaauucugaaaauguaaa

SEQ ID NO: 2770588 - RNA, 20 nt, Leptospira interrogans serovar lai str. 56601
ucaauucugaaaauguaaaa

SEQ ID NO: 2770589 - RNA, 16 nt, Leptospira interrogans serovar lai str. 56601
ucaauucuucuuucgu

SEQ ID NO: 2770590 - RNA, 19 nt, Leptospira interrogans serovar lai str. 56601
ucaauuguccauuucaaug

SEQ ID NO: 2770591 - RNA, 19 nt, Leptospira interrogans serovar lai str. 56601
ucaauuguccguuucaaua

SEQ ID NO: 2770592 - RNA, 12 nt, Leptospira interrogans serovar lai str. 56601
ucaauuuaucau

SEQ ID NO: 2770593 - RNA, 15 nt, Leptospira interrogans serovar lai str. 56601
ucaauuucuuuaauu

SEQ ID NO: 2770594 - RNA, 16 nt, Leptospira interrogans serovar lai str. 56601
ucaauuucuuuaauuu

SEQ ID NO: 2770595 - RNA, 19 nt, Leptospira interrogans serovar lai str. 56601
ucaauuucuuuaauuucaa

SEQ ID NO: 2770596 - RNA, 20 nt, Leptospira interrogans serovar lai str. 56601
ucaauuuuaccaaaaaugca

SEQ ID NO: 2770597 - RNA, 21 nt, Leptospira interrogans serovar lai str. 56601
ucaauuuuagaauaaaucuuc

SEQ ID NO: 2770598 - RNA, 16 nt, Leptospira interrogans serovar lai str. 56601
ucaauuuuaguaaacu

SEQ ID NO: 2770599 - RNA, 21 nt, Leptospira interrogans serovar lai str. 56601
ucaauuuuaguaaacuacuaa

SEQ ID NO: 2770600 - RNA, 15 nt, Leptospira interrogans serovar lai str. 56601
ucaauuuuauuucua

SEQ ID NO: 2770601 - RNA, 12 nt, Leptospira interrogans serovar lai str. 56601
ucaauuuuccau

SEQ ID NO: 2770602 - RNA, 18 nt, Leptospira interrogans serovar lai str. 56601
ucaauuuuccauuucaau

SEQ ID NO: 2770603 - RNA, 22 nt, Leptospira interrogans serovar lai str. 56601
ucaauuuucuuucuaaaugagu

SEQ ID NO: 2770604 - RNA, 20 nt, Leptospira interrogans serovar lai str. 56601
ucaauuuugaagacuauaaa

SEQ ID NO: 2770605 - RNA, 21 nt, Leptospira interrogans serovar lai str. 56601
ucaauuuugaagacuauaaaa

SEQ ID NO: 2770606 - RNA, 18 nt, Leptospira interrogans serovar lai str. 56601
ucaauuuuuauaaacuuc

SEQ ID NO: 2770607 - RNA, 12 nt, Leptospira interrogans serovar lai str. 56601
ucacaaaaauau

SEQ ID NO: 2770608 - RNA, 13 nt, Leptospira interrogans serovar lai str. 56601
ucacaaaaaugaa

SEQ ID NO: 2770609 - RNA, 16 nt, Leptospira interrogans serovar lai str. 56601
ucacaaaaaugaaaaa

SEQ ID NO: 2770610 - RNA, 18 nt, Leptospira interrogans serovar lai str. 56601
ucacaaaaaugaaaaaac

SEQ ID NO: 2770611 - RNA, 21 nt, Leptospira interrogans serovar lai str. 56601
ucacaaacgguuuuaguaaaa

SEQ ID NO: 2770612 - RNA, 17 nt, Leptospira interrogans serovar lai str. 56601
ucacaaaucauggauuu

SEQ ID NO: 2770613 - RNA, 19 nt, Leptospira interrogans serovar lai str. 56601
ucacaaauugcaaaauacg

SEQ ID NO: 2770614 - RNA, 20 nt, Leptospira interrogans serovar lai str. 56601
ucacaaauugucaaaugcaa

SEQ ID NO: 2770615 - RNA, 19 nt, Leptospira interrogans serovar lai str. 56601
ucacaauuuuaagaacaau

SEQ ID NO: 2770616 - RNA, 17 nt, Leptospira interrogans serovar lai str. 56601
ucacaauuuuacaaaca

SEQ ID NO: 2770617 - RNA, 20 nt, Leptospira interrogans serovar lai str. 56601
ucacaauuuuacaaacaaau

SEQ ID NO: 2770618 - RNA, 18 nt, Leptospira interrogans serovar lai str. 56601
ucacaauuuuuuuagaau

SEQ ID NO: 2770619 - RNA, 23 nt, Leptospira interrogans serovar lai str. 56601
ucacaauuuuuuuagaaucauga

SEQ ID NO: 2770620 - RNA, 21 nt, Leptospira interrogans serovar lai str. 56601
ucacagacuucuuuuggcauu

SEQ ID NO: 2770621 - RNA, 14 nt, Leptospira interrogans serovar lai str. 56601
ucacagaguacaua

SEQ ID NO: 2770622 - RNA, 21 nt, Leptospira interrogans serovar lai str. 56601
ucacauaaaguuaauacaaaa

SEQ ID NO: 2770623 - RNA, 14 nt, Leptospira interrogans serovar lai str. 56601
ucacauaaccaacc

SEQ ID NO: 2770624 - RNA, 19 nt, Leptospira interrogans serovar lai str. 56601
ucacauccaacccaaacac

SEQ ID NO: 2770625 - RNA, 20 nt, Leptospira interrogans serovar lai str. 56601
ucacauccaacccaaacaca

SEQ ID NO: 2770626 - RNA, 15 nt, Leptospira interrogans serovar lai str. 56601
ucacauuaaaauagg

SEQ ID NO: 2770627 - RNA, 19 nt, Leptospira interrogans serovar lai str. 56601
ucacauuguguuuuuuaac

SEQ ID NO: 2770628 - RNA, 17 nt, Leptospira interrogans serovar lai str. 56601
ucacauuugauaauucg

SEQ ID NO: 2770629 - RNA, 15 nt, Leptospira interrogans serovar lai str. 56601
ucacauuuuaggaau

SEQ ID NO: 2770630 - RNA, 15 nt, Leptospira interrogans serovar lai str. 56601
ucaccaacaacacca

SEQ ID NO: 2770631 - RNA, 20 nt, Leptospira interrogans serovar lai str. 56601
ucaguagguuuuuaauuucg

SEQ ID NO: 2770632 - RNA, 22 nt, Leptospira interrogans serovar lai str. 56601
ucaguauguuguucuccaacuu

SEQ ID NO: 2770633 - RNA, 15 nt, Leptospira interrogans serovar lai str. 56601
ucagucucauuucaa

SEQ ID NO: 2770634 - RNA, 16 nt, Leptospira interrogans serovar lai str. 56601
ucagugaauaaaauaa

SEQ ID NO: 2770635 - RNA, 14 nt, Leptospira interrogans serovar lai str. 56601
ucagugauucgaaa

SEQ ID NO: 2770636 - RNA, 23 nt, Leptospira interrogans serovar lai str. 56601
ucaguguuuugugauaaaauuaa

SEQ ID NO: 2770637 - RNA, 14 nt, Leptospira interrogans serovar lai str. 56601
ucaguuaauacaaa

SEQ ID NO: 2770638 - RNA, 13 nt, Leptospira interrogans serovar lai str. 56601
ucaguuauaagua

SEQ ID NO: 2770639 - RNA, 13 nt, Leptospira interrogans serovar lai str. 56601
ucaguucaaaaua

SEQ ID NO: 2770640 - RNA, 17 nt, Leptospira interrogans serovar lai str. 56601
ucaguucaaaauauuua

SEQ ID NO: 2770641 - RNA, 20 nt, Leptospira interrogans serovar lai str. 56601
ucaguuccgguuugacuuuc

SEQ ID NO: 2770642 - RNA, 13 nt, Leptospira interrogans serovar lai str. 56601
ucaguucugagac

SEQ ID NO: 2770643 - RNA, 22 nt, Leptospira interrogans serovar lai str. 56601
ucaguucuuauagaaacuaaug

SEQ ID NO: 2770644 - RNA, 15 nt, Leptospira interrogans serovar lai str. 56601
ucaguuucaaacuga

SEQ ID NO: 2770645 - RNA, 12 nt, Leptospira interrogans serovar lai str. 56601
ucaguuuuucgg

SEQ ID NO: 2770646 - RNA, 13 nt, Leptospira interrogans serovar lai str. 56601
ucaguuuuuucgu

SEQ ID NO: 2770647 - RNA, 22 nt, Leptospira interrogans serovar lai str. 56601
ucaguuuuuucguaaaaaauag

SEQ ID NO: 2770648 - RNA, 18 nt, Leptospira interrogans serovar lai str. 56601
ucauaacaaauaaaagga

SEQ ID NO: 2770649 - RNA, 19 nt, Leptospira interrogans serovar lai str. 56601
ucauaacaaauaaaaggag

SEQ ID NO: 2770650 - RNA, 16 nt, Leptospira interrogans serovar lai str. 56601
ucauaacgugacaaac

SEQ ID NO: 2770651 - RNA, 13 nt, Leptospira interrogans serovar lai str. 56601
ucauaacuuggcc

SEQ ID NO: 2770652 - RNA, 13 nt, Leptospira interrogans serovar lai str. 56601
ucauacaguaaaa

SEQ ID NO: 2770653 - RNA, 12 nt, Leptospira interrogans serovar lai str. 56601
ucauacauuuug

SEQ ID NO: 2770654 - RNA, 12 nt, Leptospira interrogans serovar lai str. 56601
ucauacauuuuu

SEQ ID NO: 2770655 - RNA, 14 nt, Leptospira interrogans serovar lai str. 56601
ucauacuucuaaaa

SEQ ID NO: 2770656 - RNA, 15 nt, Leptospira interrogans serovar lai str. 56601
ucauacuucuaaaaa

SEQ ID NO: 2770657 - RNA, 19 nt, Leptospira interrogans serovar lai str. 56601
ucauacuuuagaaauuucu

SEQ ID NO: 2770658 - RNA, 23 nt, Leptospira interrogans serovar lai str. 56601
ucauacuuuagaaauuucuaaua

SEQ ID NO: 2770659 - RNA, 16 nt, Leptospira interrogans serovar lai str. 56601
ucauacuuuuaaaaaa

SEQ ID NO: 2770660 - RNA, 21 nt, Leptospira interrogans serovar lai str. 56601
ucauagaggcuuuacauuuuu

SEQ ID NO: 2770661 - RNA, 15 nt, Leptospira interrogans serovar lai str. 56601
ucauagaguuucuuu

SEQ ID NO: 2770662 - RNA, 20 nt, Leptospira interrogans serovar lai str. 56601
ucauaguucagaugaauuga

SEQ ID NO: 2770663 - RNA, 14 nt, Leptospira interrogans serovar lai str. 56601
ucauaguucccaca

SEQ ID NO: 2770664 - RNA, 20 nt, Leptospira interrogans serovar lai str. 56601
ucauaguucccacaaauuga

SEQ ID NO: 2770665 - RNA, 14 nt, Leptospira interrogans serovar lai str. 56601
ucauaguuucuaag

SEQ ID NO: 2770666 - RNA, 16 nt, Leptospira interrogans serovar lai str. 56601
ucauauaauaaaaaua

SEQ ID NO: 2770667 - RNA, 19 nt, Leptospira interrogans serovar lai str. 56601
ucauauaauaaaaauagcc

SEQ ID NO: 2770668 - RNA, 14 nt, Leptospira interrogans serovar lai str. 56601
ucauauauaguuuu

SEQ ID NO: 2770669 - RNA, 17 nt, Leptospira interrogans serovar lai str. 56601
ucauaucaaaaauugua

SEQ ID NO: 2770670 - RNA, 15 nt, Leptospira interrogans serovar lai str. 56601
ucauaucaaauucau

SEQ ID NO: 2770671 - RNA, 16 nt, Leptospira interrogans serovar lai str. 56601
ucauauccgaaagaua

SEQ ID NO: 2770672 - RNA, 20 nt, Leptospira interrogans serovar lai str. 56601
ucauauccgaaagauaaauc

SEQ ID NO: 2770673 - RNA, 14 nt, Leptospira interrogans serovar lai str. 56601
ucauaucuaaaaug

SEQ ID NO: 2770674 - RNA, 21 nt, Leptospira interrogans serovar lai str. 56601
ucauauuauuuguaguuucaa

SEQ ID NO: 2770675 - RNA, 16 nt, Leptospira interrogans serovar lai str. 56601
ucauauugaaaucuga

SEQ ID NO: 2770676 - RNA, 19 nt, Leptospira interrogans serovar lai str. 56601
ucauauugagauaaaaagu

SEQ ID NO: 2770677 - RNA, 14 nt, Leptospira interrogans serovar lai str. 56601
ucauauuuucaaaa

SEQ ID NO: 2770678 - RNA, 17 nt, Leptospira interrogans serovar lai str. 56601
ucauauuuucaaaaaau

SEQ ID NO: 2770679 - RNA, 12 nt, Leptospira interrogans serovar lai str. 56601
ucaucaaaacuu

SEQ ID NO: 2770680 - RNA, 16 nt, Leptospira interrogans serovar lai str. 56601
ucaucaaaacuuaaau

SEQ ID NO: 2770681 - RNA, 17 nt, Leptospira interrogans serovar lai str. 56601
ucaucaaugguuuuucu

SEQ ID NO: 2770682 - RNA, 17 nt, Leptospira interrogans serovar lai str. 56601
ucaucaauuuuggaaag

SEQ ID NO: 2770683 - RNA, 14 nt, Leptospira interrogans serovar lai str. 56601
ucaucauucugaaa

SEQ ID NO: 2770684 - RNA, 17 nt, Leptospira interrogans serovar lai str. 56601
ucaucauucugaaaaaa

SEQ ID NO: 2770685 - RNA, 17 nt, Leptospira interrogans serovar lai str. 56601
ucauccaugucuucuaa

SEQ ID NO: 2770686 - RNA, 20 nt, Leptospira interrogans serovar lai str. 56601
ucauccgggcuuuucuuucg

SEQ ID NO: 2770687 - RNA, 18 nt, Leptospira interrogans serovar lai str. 56601
ucauccuggauauauaga

SEQ ID NO: 2770688 - RNA, 19 nt, Leptospira interrogans serovar lai str. 56601
ucaucgaacagcccaaaaa

SEQ ID NO: 2770689 - RNA, 17 nt, Leptospira interrogans serovar lai str. 56601
ucaucgcuuuuaaauug

SEQ ID NO: 2770690 - RNA, 15 nt, Leptospira interrogans serovar lai str. 56601
ucaucuaaucgaaac

SEQ ID NO: 2770691 - RNA, 19 nt, Leptospira interrogans serovar lai str. 56601
ucaucuacguuucaauuac

SEQ ID NO: 2770692 - RNA, 16 nt, Leptospira interrogans serovar lai str. 56601
ucaucucuauaaauug

SEQ ID NO: 2770693 - RNA, 19 nt, Leptospira interrogans serovar lai str. 56601
ucaucuuugcgauuuuucc

SEQ ID NO: 2770694 - RNA, 14 nt, Leptospira interrogans serovar lai str. 56601
ucaucuuuuccauu

SEQ ID NO: 2770695 - RNA, 15 nt, Leptospira interrogans serovar lai str. 56601
ucaucuuuuccauug

SEQ ID NO: 2770696 - RNA, 21 nt, Leptospira interrogans serovar lai str. 56601
ucaugaaccauggauuuuuac

SEQ ID NO: 2770697 - RNA, 16 nt, Leptospira interrogans serovar lai str. 56601
ucaugaacgaauuuuu

SEQ ID NO: 2770698 - RNA, 13 nt, Leptospira interrogans serovar lai str. 56601
ucaugaauauuuu

SEQ ID NO: 2770699 - RNA, 20 nt, Leptospira interrogans serovar lai str. 56601
ucaugaauauuuuccaaaaa

SEQ ID NO: 2770700 - RNA, 15 nt, Leptospira interrogans serovar lai str. 56601
ucaugaauuaaagaa

SEQ ID NO: 2770701 - RNA, 14 nt, Leptospira interrogans serovar lai str. 56601
ucaugaucaaauuc

SEQ ID NO: 2770702 - RNA, 16 nt, Leptospira interrogans serovar lai str. 56601
ucaugaucaaauucac

SEQ ID NO: 2770703 - RNA, 23 nt, Leptospira interrogans serovar lai str. 56601
ucaugaucccgauacagaauaaa

SEQ ID NO: 2770704 - RNA, 13 nt, Leptospira interrogans serovar lai str. 56601
ucaugauucugaa

SEQ ID NO: 2770705 - RNA, 14 nt, Leptospira interrogans serovar lai str. 56601
ucauggagaauaaa

SEQ ID NO: 2770706 - RNA, 15 nt, Leptospira interrogans serovar lai str. 56601
ucauggagaauaaaa

SEQ ID NO: 2770707 - RNA, 14 nt, Leptospira interrogans serovar lai str. 56601
ucauggccuucugg

SEQ ID NO: 2770708 - RNA, 13 nt, Leptospira interrogans serovar lai str. 56601
ucauguaaaauuu

SEQ ID NO: 2770709 - RNA, 18 nt, Leptospira interrogans serovar lai str. 56601
ucauguaauauaaguuaa

SEQ ID NO: 2770710 - RNA, 15 nt, Leptospira interrogans serovar lai str. 56601
ucauuaaacaauuuu

SEQ ID NO: 2770711 - RNA, 16 nt, Leptospira interrogans serovar lai str. 56601
ucauuaaacaauuuuu

SEQ ID NO: 2770712 - RNA, 18 nt, Leptospira interrogans serovar lai str. 56601
ucauuaaacaauuuuuca

SEQ ID NO: 2770713 - RNA, 20 nt, Leptospira interrogans serovar lai str. 56601
ucauuaaugcgaaaauuuaa

SEQ ID NO: 2770714 - RNA, 18 nt, Leptospira interrogans serovar lai str. 56601
ucauuacguaaagaacuu

SEQ ID NO: 2770715 - RNA, 13 nt, Leptospira interrogans serovar lai str. 56601
uccaauuauaaaa

SEQ ID NO: 2770716 - RNA, 20 nt, Leptospira interrogans serovar lai str. 56601
uccaauuauaaaauuuuucu

SEQ ID NO: 2770717 - RNA, 16 nt, Leptospira interrogans serovar lai str. 56601
uccaauugaauauaaa

SEQ ID NO: 2770718 - RNA, 18 nt, Leptospira interrogans serovar lai str. 56601
uccaauugaauauaaaau

SEQ ID NO: 2770719 - RNA, 20 nt, Leptospira interrogans serovar lai str. 56601
uccaauuguuccacuguauu

SEQ ID NO: 2770720 - RNA, 19 nt, Leptospira interrogans serovar lai str. 56601
uccaauuguuccgaauuaa

SEQ ID NO: 2770721 - RNA, 15 nt, Leptospira interrogans serovar lai str. 56601
uccaauuuccuaaaa

SEQ ID NO: 2770722 - RNA, 14 nt, Leptospira interrogans serovar lai str. 56601
uccaauuuuaaaac

SEQ ID NO: 2770723 - RNA, 16 nt, Leptospira interrogans serovar lai str. 56601
uccaauuuuucugaaa

SEQ ID NO: 2770724 - RNA, 14 nt, Leptospira interrogans serovar lai str. 56601
uccacaucuuuuuu

SEQ ID NO: 2770725 - RNA, 17 nt, Leptospira interrogans serovar lai str. 56601
uccacaucuuuuuucgu

SEQ ID NO: 2770726 - RNA, 19 nt, Leptospira interrogans serovar lai str. 56601
uccacauuuauuuuuacgg

SEQ ID NO: 2770727 - RNA, 22 nt, Leptospira interrogans serovar lai str. 56601
uccacauuuuagggaucaaucu

SEQ ID NO: 2770728 - RNA, 16 nt, Leptospira interrogans serovar lai str. 56601
uccaccuuggaaagaa

SEQ ID NO: 2770729 - RNA, 22 nt, Leptospira interrogans serovar lai str. 56601
uccaccuuggaaagaaaaggug

SEQ ID NO: 2770730 - RNA, 22 nt, Leptospira interrogans serovar lai str. 56601
uccacgauugauuuuggaaaga

SEQ ID NO: 2770731 - RNA, 21 nt, Leptospira interrogans serovar lai str. 56601
uccacuaugaaaguuuuucaa

SEQ ID NO: 2770732 - RNA, 21 nt, Leptospira interrogans serovar lai str. 56601
uccacuauggaauuuuuuaac

SEQ ID NO: 2770733 - RNA, 13 nt, Leptospira interrogans serovar lai str. 56601
uccacucagacca

SEQ ID NO: 2770734 - RNA, 11 nt, Leptospira interrogans serovar lai str. 56601
uccacuuaaaa

SEQ ID NO: 2770735 - RNA, 15 nt, Leptospira interrogans serovar lai str. 56601
uccacuucaaaaaga

SEQ ID NO: 2770736 - RNA, 14 nt, Leptospira interrogans serovar lai str. 56601
uccacuugaauaga

SEQ ID NO: 2770737 - RNA, 13 nt, Leptospira interrogans serovar lai str. 56601
uccacuuuaaaaa

SEQ ID NO: 2770738 - RNA, 14 nt, Leptospira interrogans serovar lai str. 56601
uccagaaccucaaa

SEQ ID NO: 2770739 - RNA, 16 nt, Leptospira interrogans serovar lai str. 56601
uccagaagauugaaag

SEQ ID NO: 2770740 - RNA, 18 nt, Leptospira interrogans serovar lai str. 56601
uccagcccauucuuuccc

SEQ ID NO: 2770741 - RNA, 19 nt, Leptospira interrogans serovar lai str. 56601
uccagcgaucgugauaaga

SEQ ID NO: 2770742 - RNA, 20 nt, Leptospira interrogans serovar lai str. 56601
uccagcugaaacuaauaugu

SEQ ID NO: 2770743 - RNA, 16 nt, Leptospira interrogans serovar lai str. 56601
uccagcuuuuuuaaau

SEQ ID NO: 2770744 - RNA, 15 nt, Leptospira interrogans serovar lai str. 56601
uccaguaggauaaua

SEQ ID NO: 2770745 - RNA, 22 nt, Leptospira interrogans serovar lai str. 56601
uccaguauuuuacgcuuaaaua

SEQ ID NO: 2770746 - RNA, 17 nt, Leptospira interrogans serovar lai str. 56601
uccaguuuacuacccga

SEQ ID NO: 2770747 - RNA, 14 nt, Leptospira interrogans serovar lai str. 56601
uccauaaaaaacau

SEQ ID NO: 2770748 - RNA, 13 nt, Leptospira interrogans serovar lai str. 56601
uccauaaaauaga

SEQ ID NO: 2770749 - RNA, 21 nt, Leptospira interrogans serovar lai str. 56601
uccauaaaauagaaacaaaug

SEQ ID NO: 2770750 - RNA, 22 nt, Leptospira interrogans serovar lai str. 56601
uccauaacagaauuuaggcaau

SEQ ID NO: 2770751 - RNA, 23 nt, Leptospira interrogans serovar lai str. 56601
uccauaacagaauuuaggcaauu

SEQ ID NO: 2770752 - RNA, 12 nt, Leptospira interrogans serovar lai str. 56601
uccauagagaac

SEQ ID NO: 2770753 - RNA, 21 nt, Leptospira interrogans serovar lai str. 56601
uccauagaguguuguguugag

SEQ ID NO: 2770754 - RNA, 22 nt, Leptospira interrogans serovar lai str. 56601
uccauagugaagauuuguaaaa

SEQ ID NO: 2770755 - RNA, 23 nt, Leptospira interrogans serovar lai str. 56601
uccauaucuacgacuaacaaaau

SEQ ID NO: 2770756 - RNA, 16 nt, Leptospira interrogans serovar lai str. 56601
uccaucaaauacaaaa

SEQ ID NO: 2770757 - RNA, 19 nt, Leptospira interrogans serovar lai str. 56601
uccaucguaucuuucaaaa

SEQ ID NO: 2770758 - RNA, 23 nt, Leptospira interrogans serovar lai str. 56601
uccaucguuuaagaauuuuaaaa

SEQ ID NO: 2770759 - RNA, 23 nt, Leptospira interrogans serovar lai str. 56601
uccaucguuuauuuuucuaaaaa

SEQ ID NO: 2770760 - RNA, 16 nt, Leptospira interrogans serovar lai str. 56601
uccaucuguuucuauu

SEQ ID NO: 2770761 - RNA, 19 nt, Leptospira interrogans serovar lai str. 56601
uccaucuuuauaucuugaa

SEQ ID NO: 2770762 - RNA, 17 nt, Leptospira interrogans serovar lai str. 56601
uccaucuuuuuuuucua

SEQ ID NO: 2770763 - RNA, 21 nt, Leptospira interrogans serovar lai str. 56601
uccaucuuuuuuuucuaaaau

SEQ ID NO: 2770764 - RNA, 10 nt, Leptospira interrogans serovar lai str. 56601
uccaugauuc

SEQ ID NO: 2770765 - RNA, 18 nt, Leptospira interrogans serovar lai str. 56601
uccaugauucauuuuucu

SEQ ID NO: 2770766 - RNA, 15 nt, Leptospira interrogans serovar lai str. 56601
uccaugauucugaaa

SEQ ID NO: 2770767 - RNA, 22 nt, Leptospira interrogans serovar lai str. 56601
uccaugauucugaaaaaaguua

SEQ ID NO: 2770768 - RNA, 16 nt, Leptospira interrogans serovar lai str. 56601
uccaugguuuuuucaa

SEQ ID NO: 2770769 - RNA, 14 nt, Leptospira interrogans serovar lai str. 56601
uccaugucuucuaa

SEQ ID NO: 2770770 - RNA, 15 nt, Leptospira interrogans serovar lai str. 56601
uccaugucuucuaaa

SEQ ID NO: 2770771 - RNA, 19 nt, Leptospira interrogans serovar lai str. 56601
uccaugucuucuaaaucua

SEQ ID NO: 2770772 - RNA, 18 nt, Leptospira interrogans serovar lai str. 56601
uccauuauaguuuuuuca

SEQ ID NO: 2770773 - RNA, 12 nt, Leptospira interrogans serovar lai str. 56601
uccauucuaaaa

SEQ ID NO: 2770774 - RNA, 12 nt, Leptospira interrogans serovar lai str. 56601
uccauucuaaga

SEQ ID NO: 2770775 - RNA, 14 nt, Leptospira interrogans serovar lai str. 56601
uccauucuucaaau

SEQ ID NO: 2770776 - RNA, 21 nt, Leptospira interrogans serovar lai str. 56601
uccauucuucaaauaacauuu

SEQ ID NO: 2770777 - RNA, 14 nt, Leptospira interrogans serovar lai str. 56601
uccauugauuuuca

SEQ ID NO: 2770778 - RNA, 23 nt, Leptospira interrogans serovar lai str. 56601
uccauuggauucugcucuucuaa

SEQ ID NO: 2770779 - RNA, 12 nt, Leptospira interrogans serovar lai str. 56601
uccauuucauug

SEQ ID NO: 2770780 - RNA, 14 nt, Leptospira interrogans serovar lai str. 56601
uccauuuuuuagaa

SEQ ID NO: 2770781 - RNA, 18 nt, Leptospira interrogans serovar lai str. 56601
ucccaaaaacucaaagaa

SEQ ID NO: 2770782 - RNA, 21 nt, Leptospira interrogans serovar lai str. 56601
ucccaaaaacucaaagaaauu

SEQ ID NO: 2770783 - RNA, 19 nt, Leptospira interrogans serovar lai str. 56601
ucccaaaaccucaaaaaau

SEQ ID NO: 2770784 - RNA, 20 nt, Leptospira interrogans serovar lai str. 56601
ucccaaaaucuuaaaagaaa

SEQ ID NO: 2770785 - RNA, 16 nt, Leptospira interrogans serovar lai str. 56601
ucccaaaauuucuaaa

SEQ ID NO: 2770786 - RNA, 18 nt, Leptospira interrogans serovar lai str. 56601
ucccaaaauuucuaaagu

SEQ ID NO: 2770787 - RNA, 20 nt, Leptospira interrogans serovar lai str. 56601
ucccaaacaggaaaauuuaa

SEQ ID NO: 2770788 - RNA, 20 nt, Leptospira interrogans serovar lai str. 56601
ucccaaacuuucuuuuucuu

SEQ ID NO: 2770789 - RNA, 17 nt, Leptospira interrogans serovar lai str. 56601
ucccaaauucuuuccuu

SEQ ID NO: 2770790 - RNA, 17 nt, Leptospira interrogans serovar lai str. 56601
ucccacaaauuccugcc

SEQ ID NO: 2770791 - RNA, 22 nt, Leptospira interrogans serovar lai str. 56601
ucccacaaauuccugccuucuc

SEQ ID NO: 2770792 - RNA, 15 nt, Leptospira interrogans serovar lai str. 56601
ucccacaauuuugag

SEQ ID NO: 2770793 - RNA, 16 nt, Leptospira interrogans serovar lai str. 56601
ucccacacauuccgca

SEQ ID NO: 2770794 - RNA, 21 nt, Leptospira interrogans serovar lai str. 56601
ucccacaguuccacuuuaaaa

SEQ ID NO: 2770795 - RNA, 18 nt, Leptospira interrogans serovar lai str. 56601
ucccacauuuaaauuaau

SEQ ID NO: 2770796 - RNA, 16 nt, Leptospira interrogans serovar lai str. 56601
ucccacauuuuaaaga

SEQ ID NO: 2770797 - RNA, 16 nt, Leptospira interrogans serovar lai str. 56601
ucccacauuuuaaagu

SEQ ID NO: 2770798 - RNA, 16 nt, Leptospira interrogans serovar lai str. 56601
uccuacuuauuucuau

SEQ ID NO: 2770799 - RNA, 15 nt, Leptospira interrogans serovar lai str. 56601
uccuauaucaacaau

SEQ ID NO: 2770800 - RNA, 18 nt, Leptospira interrogans serovar lai str. 56601
uccuauauuuuaaauuca

SEQ ID NO: 2770801 - RNA, 23 nt, Leptospira interrogans serovar lai str. 56601
uccuauguuucuugugucaagcc

SEQ ID NO: 2770802 - RNA, 16 nt, Leptospira interrogans serovar lai str. 56601
uccuauucaacuugug

SEQ ID NO: 2770803 - RNA, 15 nt, Leptospira interrogans serovar lai str. 56601
uccuauuuucgaaaa

SEQ ID NO: 2770804 - RNA, 14 nt, Leptospira interrogans serovar lai str. 56601
uccucaacagauac

SEQ ID NO: 2770805 - RNA, 23 nt, Leptospira interrogans serovar lai str. 56601
uccuccaaacaauuuuuugaaaa

SEQ ID NO: 2770806 - RNA, 13 nt, Leptospira interrogans serovar lai str. 56601
uccuccugaaaau

SEQ ID NO: 2770807 - RNA, 22 nt, Leptospira interrogans serovar lai str. 56601
uccuccugaaaauuuuccuuua

SEQ ID NO: 2770808 - RNA, 13 nt, Leptospira interrogans serovar lai str. 56601
uccucuaaaaugc

SEQ ID NO: 2770809 - RNA, 15 nt, Leptospira interrogans serovar lai str. 56601
uccucugaacuucau

SEQ ID NO: 2770810 - RNA, 18 nt, Leptospira interrogans serovar lai str. 56601
uccucugauaaaaucacg

SEQ ID NO: 2770811 - RNA, 14 nt, Leptospira interrogans serovar lai str. 56601
uccucuuccggaag

SEQ ID NO: 2770812 - RNA, 15 nt, Leptospira interrogans serovar lai str. 56601
uccugacugcccguu

SEQ ID NO: 2770813 - RNA, 21 nt, Leptospira interrogans serovar lai str. 56601
uccugaucuauguuauagaca

SEQ ID NO: 2770814 - RNA, 16 nt, Leptospira interrogans serovar lai str. 56601
uccuguaaauucaaaa

SEQ ID NO: 2770815 - RNA, 17 nt, Leptospira interrogans serovar lai str. 56601
uccuguaaauucaaaau

SEQ ID NO: 2770816 - RNA, 16 nt, Leptospira interrogans serovar lai str. 56601
uccugucaauuuucca

SEQ ID NO: 2770817 - RNA, 15 nt, Leptospira interrogans serovar lai str. 56601
uccuuaaauauaucu

SEQ ID NO: 2770818 - RNA, 16 nt, Leptospira interrogans serovar lai str. 56601
uccuuaaauauaucuu

SEQ ID NO: 2770819 - RNA, 20 nt, Leptospira interrogans serovar lai str. 56601
uccuuaagacccuaaaaaau

SEQ ID NO: 2770820 - RNA, 22 nt, Leptospira interrogans serovar lai str. 56601
uccuuaagacccuaaaaaauuu

SEQ ID NO: 2770821 - RNA, 16 nt, Leptospira interrogans serovar lai str. 56601
uccuuacgaucuaaaa

SEQ ID NO: 2770822 - RNA, 19 nt, Leptospira interrogans serovar lai str. 56601
uccuuacgaucuaaaagga

SEQ ID NO: 2770823 - RNA, 15 nt, Leptospira interrogans serovar lai str. 56601
uccuuacucguuuuu

SEQ ID NO: 2770824 - RNA, 21 nt, Leptospira interrogans serovar lai str. 56601
uccuuccgaucccaacugcug

SEQ ID NO: 2770825 - RNA, 14 nt, Leptospira interrogans serovar lai str. 56601
uccuucgaaaaacc

SEQ ID NO: 2770826 - RNA, 16 nt, Leptospira interrogans serovar lai str. 56601
uccuucuugaaauaau

SEQ ID NO: 2770827 - RNA, 20 nt, Leptospira interrogans serovar lai str. 56601
uccuucuuuacaguuuuuaa

SEQ ID NO: 2770828 - RNA, 16 nt, Leptospira interrogans serovar lai str. 56601
uccuucuuuucuucuu

SEQ ID NO: 2770829 - RNA, 20 nt, Leptospira interrogans serovar lai str. 56601
uccuugcugucgcaacauaa

SEQ ID NO: 2770830 - RNA, 16 nt, Leptospira interrogans serovar lai str. 56601
uccuugugcaauaauu

SEQ ID NO: 2770831 - RNA, 17 nt, Leptospira interrogans serovar lai str. 56601
uccuugugcaauaauuu

SEQ ID NO: 2770832 - RNA, 18 nt, Leptospira interrogans serovar lai str. 56601
uccuugugcaauaauuuu

SEQ ID NO: 2770833 - RNA, 23 nt, Leptospira interrogans serovar lai str. 56601
uccuuuaaauugaauucuuccuu

SEQ ID NO: 2770834 - RNA, 20 nt, Leptospira interrogans serovar lai str. 56601
uccuuuaauauuuucagaag

SEQ ID NO: 2770835 - RNA, 20 nt, Leptospira interrogans serovar lai str. 56601
uccuuuccgauuucuuucaa

SEQ ID NO: 2770836 - RNA, 17 nt, Leptospira interrogans serovar lai str. 56601
uccuuugaauaaaaccg

SEQ ID NO: 2770837 - RNA, 11 nt, Leptospira interrogans serovar lai str. 56601
uccuuuuacuu

SEQ ID NO: 2770838 - RNA, 18 nt, Leptospira interrogans serovar lai str. 56601
uccuuuucgaauuuccuu

SEQ ID NO: 2770839 - RNA, 22 nt, Leptospira interrogans serovar lai str. 56601
uccuuuugagcacaauauauuc

SEQ ID NO: 2770840 - RNA, 17 nt, Leptospira interrogans serovar lai str. 56601
uccuuuuuaaaaccaaa

SEQ ID NO: 2770841 - RNA, 19 nt, Leptospira interrogans serovar lai str. 56601
uccuuuuuaaaaccaaaau

SEQ ID NO: 2770842 - RNA, 18 nt, Leptospira interrogans serovar lai str. 56601
uccuuuuucauuuuuaag

SEQ ID NO: 2770843 - RNA, 15 nt, Leptospira interrogans serovar lai str. 56601
uccuuuuucuaaucc

SEQ ID NO: 2770844 - RNA, 23 nt, Leptospira interrogans serovar lai str. 56601
uccuuuuuguaaggauuccuuuc

SEQ ID NO: 2770845 - RNA, 17 nt, Leptospira interrogans serovar lai str. 56601
uccuuuuuuauuuuaac

SEQ ID NO: 2770846 - RNA, 20 nt, Leptospira interrogans serovar lai str. 56601
uccuuuuuuucuuuuaaaag

SEQ ID NO: 2770847 - RNA, 15 nt, Leptospira interrogans serovar lai str. 56601
ucgaaaaaacaaaua

SEQ ID NO: 2770848 - RNA, 12 nt, Leptospira interrogans serovar lai str. 56601
ucgaaaaaauac

SEQ ID NO: 2770849 - RNA, 11 nt, Leptospira interrogans serovar lai str. 56601
ucgaaaaguuu

SEQ ID NO: 2770850 - RNA, 12 nt, Leptospira interrogans serovar lai str. 56601
ucgaaaaguuuu

SEQ ID NO: 2770851 - RNA, 12 nt, Leptospira interrogans serovar lai str. 56601
ucgaaaaucuca

SEQ ID NO: 2770852 - RNA, 16 nt, Leptospira interrogans serovar lai str. 56601
ucgaaaaucucagaaa

SEQ ID NO: 2770853 - RNA, 20 nt, Leptospira interrogans serovar lai str. 56601
ucgaaaauuuuaaguucaga

SEQ ID NO: 2770854 - RNA, 16 nt, Leptospira interrogans serovar lai str. 56601
ucgaaacaaaaucaaa

SEQ ID NO: 2770855 - RNA, 17 nt, Leptospira interrogans serovar lai str. 56601
ucgaaacuguauuauaa

SEQ ID NO: 2770856 - RNA, 22 nt, Leptospira interrogans serovar lai str. 56601
ucgaacgaccccgucauuuacu

SEQ ID NO: 2770857 - RNA, 16 nt, Leptospira interrogans serovar lai str. 56601
ucgaacggauucuaau

SEQ ID NO: 2770858 - RNA, 20 nt, Leptospira interrogans serovar lai str. 56601
ucgaacucacauuauuuaau

SEQ ID NO: 2770859 - RNA, 20 nt, Leptospira interrogans serovar lai str. 56601
ucgaacuuuuuuuagaauca

SEQ ID NO: 2770860 - RNA, 15 nt, Leptospira interrogans serovar lai str. 56601
ucgaagauaccaaau

SEQ ID NO: 2770861 - RNA, 20 nt, Leptospira interrogans serovar lai str. 56601
ucgaagaugguacuuuacga

SEQ ID NO: 2770862 - RNA, 20 nt, Leptospira interrogans serovar lai str. 56601
ucgaauaaaaacaaacuuuu

SEQ ID NO: 2770863 - RNA, 21 nt, Leptospira interrogans serovar lai str. 56601
ucgaauacgacagauucaauu

SEQ ID NO: 2770864 - RNA, 17 nt, Leptospira interrogans serovar lai str. 56601
ucgaaugcucuaaaagc

SEQ ID NO: 2770865 - RNA, 17 nt, Leptospira interrogans serovar lai str. 56601
ucgaauggaauuuauua

SEQ ID NO: 2770866 - RNA, 23 nt, Leptospira interrogans serovar lai str. 56601
ucgaaugguacgaccaaaacaua

SEQ ID NO: 2770867 - RNA, 13 nt, Leptospira interrogans serovar lai str. 56601
ucgaauucuuucu

SEQ ID NO: 2770868 - RNA, 18 nt, Leptospira interrogans serovar lai str. 56601
ucgaauucuuucuauuuu

SEQ ID NO: 2770869 - RNA, 17 nt, Leptospira interrogans serovar lai str. 56601
ucgaauuguauccgaaa

SEQ ID NO: 2770870 - RNA, 13 nt, Leptospira interrogans serovar lai str. 56601
ucgaauuuccauu

SEQ ID NO: 2770871 - RNA, 14 nt, Leptospira interrogans serovar lai str. 56601
ucgaauuuccauuu

SEQ ID NO: 2770872 - RNA, 21 nt, Leptospira interrogans serovar lai str. 56601
ucgaauuuccauuucugacau

SEQ ID NO: 2770873 - RNA, 17 nt, Leptospira interrogans serovar lai str. 56601
ucgaauuuuuuuuauuu

SEQ ID NO: 2770874 - RNA, 22 nt, Leptospira interrogans serovar lai str. 56601
ucgacauuccccaaguaaaauu

SEQ ID NO: 2770875 - RNA, 16 nt, Leptospira interrogans serovar lai str. 56601
ucgaccuuaacucuua

SEQ ID NO: 2770876 - RNA, 21 nt, Leptospira interrogans serovar lai str. 56601
ucgacgauuuuacgaacaaau

SEQ ID NO: 2770877 - RNA, 15 nt, Leptospira interrogans serovar lai str. 56601
ucgacguaaagaauu

SEQ ID NO: 2770878 - RNA, 18 nt, Leptospira interrogans serovar lai str. 56601
ucgacguaaagaauucau

SEQ ID NO: 2770879 - RNA, 18 nt, Leptospira interrogans serovar lai str. 56601
ucgacguaagaauauuug

SEQ ID NO: 2770880 - RNA, 15 nt, Leptospira interrogans serovar lai str. 56601
ucgacguaagaaucc

SEQ ID NO: 2770881 - RNA, 15 nt, Leptospira interrogans serovar lai str. 56601
ucgguuuaaaacuag

SEQ ID NO: 2770882 - RNA, 21 nt, Leptospira interrogans serovar lai str. 56601
ucgguuuucguuguauggaaa

SEQ ID NO: 2770883 - RNA, 20 nt, Leptospira interrogans serovar lai str. 56601
ucguaaaaaagauaaaaaga

SEQ ID NO: 2770884 - RNA, 18 nt, Leptospira interrogans serovar lai str. 56601
ucguaagauaugaauuaa

SEQ ID NO: 2770885 - RNA, 16 nt, Leptospira interrogans serovar lai str. 56601
ucguaauaucuaaaac

SEQ ID NO: 2770886 - RNA, 15 nt, Leptospira interrogans serovar lai str. 56601
ucguaauuaaauuuu

SEQ ID NO: 2770887 - RNA, 19 nt, Leptospira interrogans serovar lai str. 56601
ucguacgaaucagauccuu

SEQ ID NO: 2770888 - RNA, 23 nt, Leptospira interrogans serovar lai str. 56601
ucguacggauugccuaaauuccu

SEQ ID NO: 2770889 - RNA, 19 nt, Leptospira interrogans serovar lai str. 56601
ucguacuaauucuuuugca

SEQ ID NO: 2770890 - RNA, 21 nt, Leptospira interrogans serovar lai str. 56601
ucguaguagucccacauuuuu

SEQ ID NO: 2770891 - RNA, 15 nt, Leptospira interrogans serovar lai str. 56601
ucgucaaaaccaaaa

SEQ ID NO: 2770892 - RNA, 17 nt, Leptospira interrogans serovar lai str. 56601
ucguccaaucucuuucg

SEQ ID NO: 2770893 - RNA, 19 nt, Leptospira interrogans serovar lai str. 56601
ucgucuaucuuuuuuaaaa

SEQ ID NO: 2770894 - RNA, 12 nt, Leptospira interrogans serovar lai str. 56601
ucgucuucuuuu

SEQ ID NO: 2770895 - RNA, 13 nt, Leptospira interrogans serovar lai str. 56601
ucgucuucuuuuu

SEQ ID NO: 2770896 - RNA, 18 nt, Leptospira interrogans serovar lai str. 56601
ucgugauaacaaacuuuu

SEQ ID NO: 2770897 - RNA, 20 nt, Leptospira interrogans serovar lai str. 56601
ucguggagaaauucguuuua

SEQ ID NO: 2770898 - RNA, 18 nt, Leptospira interrogans serovar lai str. 56601
ucguuaagaauaaauaau

SEQ ID NO: 2770899 - RNA, 13 nt, Leptospira interrogans serovar lai str. 56601
ucguuaaguuauc

SEQ ID NO: 2770900 - RNA, 18 nt, Leptospira interrogans serovar lai str. 56601
ucguuauaaacaauauga

SEQ ID NO: 2770901 - RNA, 21 nt, Leptospira interrogans serovar lai str. 56601
ucguuauaaacaauaugaaag

SEQ ID NO: 2770902 - RNA, 17 nt, Leptospira interrogans serovar lai str. 56601
ucguuauuuuuauaaag

SEQ ID NO: 2770903 - RNA, 22 nt, Leptospira interrogans serovar lai str. 56601
ucguuauuuuuauaaagauaaa

SEQ ID NO: 2770904 - RNA, 16 nt, Leptospira interrogans serovar lai str. 56601
ucguucaacuuuccuu

SEQ ID NO: 2770905 - RNA, 11 nt, Leptospira interrogans serovar lai str. 56601
ucguucccaca

SEQ ID NO: 2770906 - RNA, 12 nt, Leptospira interrogans serovar lai str. 56601
ucguucccacaa

SEQ ID NO: 2770907 - RNA, 19 nt, Leptospira interrogans serovar lai str. 56601
ucguucccguuuagaaauu

SEQ ID NO: 2770908 - RNA, 21 nt, Leptospira interrogans serovar lai str. 56601
ucguugaaaaauuaaugucuu

SEQ ID NO: 2770909 - RNA, 14 nt, Leptospira interrogans serovar lai str. 56601
ucguuggaaaguuu

SEQ ID NO: 2770910 - RNA, 14 nt, Leptospira interrogans serovar lai str. 56601
ucguuguauggaaa

SEQ ID NO: 2770911 - RNA, 15 nt, Leptospira interrogans serovar lai str. 56601
ucguuguauuuuaaa

SEQ ID NO: 2770912 - RNA, 14 nt, Leptospira interrogans serovar lai str. 56601
ucguuuagaggaag

SEQ ID NO: 2770913 - RNA, 19 nt, Leptospira interrogans serovar lai str. 56601
ucguuuauuuuucuaaaaa

SEQ ID NO: 2770914 - RNA, 20 nt, Leptospira interrogans serovar lai str. 56601
ucguuuauuuuucuaaaaaa

SEQ ID NO: 2770915 - RNA, 19 nt, Leptospira interrogans serovar lai str. 56601
ucguuucaacuuuagaaaa

SEQ ID NO: 2770916 - RNA, 17 nt, Leptospira interrogans serovar lai str. 56601
ucguuucccauauaauu

SEQ ID NO: 2770917 - RNA, 21 nt, Leptospira interrogans serovar lai str. 56601
ucguuucccauauaauuuuau

SEQ ID NO: 2770918 - RNA, 21 nt, Leptospira interrogans serovar lai str. 56601
ucguuucguucccguuuagaa

SEQ ID NO: 2770919 - RNA, 16 nt, Leptospira interrogans serovar lai str. 56601
ucguuucugaggaauu

SEQ ID NO: 2770920 - RNA, 18 nt, Leptospira interrogans serovar lai str. 56601
ucguuucugaggaauuaa

SEQ ID NO: 2770921 - RNA, 19 nt, Leptospira interrogans serovar lai str. 56601
ucguuucuuaauuuuacua

SEQ ID NO: 2770922 - RNA, 15 nt, Leptospira interrogans serovar lai str. 56601
ucguuugcuuuucua

SEQ ID NO: 2770923 - RNA, 22 nt, Leptospira interrogans serovar lai str. 56601
ucguuuuacugaccucuauaau

SEQ ID NO: 2770924 - RNA, 20 nt, Leptospira interrogans serovar lai str. 56601
ucguuuuuuaaaauguagga

SEQ ID NO: 2770925 - RNA, 17 nt, Leptospira interrogans serovar lai str. 56601
ucguuuuuuuaauauua

SEQ ID NO: 2770926 - RNA, 18 nt, Leptospira interrogans serovar lai str. 56601
ucuaaaaaauucuuucuc

SEQ ID NO: 2770927 - RNA, 16 nt, Leptospira interrogans serovar lai str. 56601
ucuaaaaagaaucaua

SEQ ID NO: 2770928 - RNA, 23 nt, Leptospira interrogans serovar lai str. 56601
ucuaaaaagauuaucuucuaauu

SEQ ID NO: 2770929 - RNA, 18 nt, Leptospira interrogans serovar lai str. 56601
ucuaaaaauuuuuuuaaa

SEQ ID NO: 2770930 - RNA, 22 nt, Leptospira interrogans serovar lai str. 56601
ucuaaaagaagaugcuuucucu

SEQ ID NO: 2770931 - RNA, 16 nt, Leptospira interrogans serovar lai str. 56601
ucuaaaaguaaaagua

SEQ ID NO: 2770932 - RNA, 20 nt, Leptospira interrogans serovar lai str. 56601
ucuaaaauacuuuugaaaua

SEQ ID NO: 2770933 - RNA, 19 nt, Leptospira interrogans serovar lai str. 56601
ucuaaaauauaggaacuac

SEQ ID NO: 2770934 - RNA, 12 nt, Leptospira interrogans serovar lai str. 56601
ucuaaaaucaua

SEQ ID NO: 2770935 - RNA, 20 nt, Leptospira interrogans serovar lai str. 56601
ucuaaaauccuauucaacuu

SEQ ID NO: 2770936 - RNA, 15 nt, Leptospira interrogans serovar lai str. 56601
ucuaaaauucuuccg

SEQ ID NO: 2770937 - RNA, 15 nt, Leptospira interrogans serovar lai str. 56601
ucuaaaauuucauuu

SEQ ID NO: 2770938 - RNA, 13 nt, Leptospira interrogans serovar lai str. 56601
ucuaaaauuugua

SEQ ID NO: 2770939 - RNA, 20 nt, Leptospira interrogans serovar lai str. 56601
ucuaaaauuuguaggaacuc

SEQ ID NO: 2770940 - RNA, 17 nt, Leptospira interrogans serovar lai str. 56601
ucuaaacaauuuuauuu

SEQ ID NO: 2770941 - RNA, 16 nt, Leptospira interrogans serovar lai str. 56601
ucuaaacauuuaacuu

SEQ ID NO: 2770942 - RNA, 19 nt, Leptospira interrogans serovar lai str. 56601
ucuaaacauuuaacuuuua

SEQ ID NO: 2770943 - RNA, 16 nt, Leptospira interrogans serovar lai str. 56601
ucuaaacuaaaaaaaa

SEQ ID NO: 2770944 - RNA, 19 nt, Leptospira interrogans serovar lai str. 56601
ucuaaacuuuacagaucaa

SEQ ID NO: 2770945 - RNA, 15 nt, Leptospira interrogans serovar lai str. 56601
ucuaaagacuaaaaa

SEQ ID NO: 2770946 - RNA, 20 nt, Leptospira interrogans serovar lai str. 56601
ucuaaaguuguaggaacuac

SEQ ID NO: 2770947 - RNA, 17 nt, Leptospira interrogans serovar lai str. 56601
ucuaaaucgaaucgaau

SEQ ID NO: 2770948 - RNA, 23 nt, Leptospira interrogans serovar lai str. 56601
ucuaaaugacuugcauuuaauau

SEQ ID NO: 2770949 - RNA, 20 nt, Leptospira interrogans serovar lai str. 56601
ucuaaauuagaauuuuauug

SEQ ID NO: 2770950 - RNA, 14 nt, Leptospira interrogans serovar lai str. 56601
ucuaaauucagaaa

SEQ ID NO: 2770951 - RNA, 16 nt, Leptospira interrogans serovar lai str. 56601
ucuaaauucagaaaaa

SEQ ID NO: 2770952 - RNA, 16 nt, Leptospira interrogans serovar lai str. 56601
ucuaaauuuuauaaaa

SEQ ID NO: 2770953 - RNA, 17 nt, Leptospira interrogans serovar lai str. 56601
ucuaacaguaaaacuuu

SEQ ID NO: 2770954 - RNA, 15 nt, Leptospira interrogans serovar lai str. 56601
ucuaacauuuuauua

SEQ ID NO: 2770955 - RNA, 19 nt, Leptospira interrogans serovar lai str. 56601
ucuaacccauucaacauca

SEQ ID NO: 2770956 - RNA, 20 nt, Leptospira interrogans serovar lai str. 56601
ucuaacccauucaacaucau

SEQ ID NO: 2770957 - RNA, 18 nt, Leptospira interrogans serovar lai str. 56601
ucuaaccggaauuuccaa

SEQ ID NO: 2770958 - RNA, 19 nt, Leptospira interrogans serovar lai str. 56601
ucuaaccggaauuuccaaa

SEQ ID NO: 2770959 - RNA, 12 nt, Leptospira interrogans serovar lai str. 56601
ucuaacugguuu

SEQ ID NO: 2770960 - RNA, 16 nt, Leptospira interrogans serovar lai str. 56601
ucuaacugguuuuucu

SEQ ID NO: 2770961 - RNA, 14 nt, Leptospira interrogans serovar lai str. 56601
ucuaacuuauaaga

SEQ ID NO: 2770962 - RNA, 22 nt, Leptospira interrogans serovar lai str. 56601
ucuaagaguagaguaagaaaca

SEQ ID NO: 2770963 - RNA, 19 nt, Leptospira interrogans serovar lai str. 56601
ucuaagauugaaugaaauc

SEQ ID NO: 2770964 - RNA, 19 nt, Leptospira interrogans serovar lai str. 56601
ucuauaauguuaauuuaga

SEQ ID NO: 2770965 - RNA, 13 nt, Leptospira interrogans serovar lai str. 56601
ucuauaauuaaua

SEQ ID NO: 2770966 - RNA, 18 nt, Leptospira interrogans serovar lai str. 56601
ucuauagauugauuuaaa

SEQ ID NO: 2770967 - RNA, 20 nt, Leptospira interrogans serovar lai str. 56601
ucuauagccaaguauaaaag

SEQ ID NO: 2770968 - RNA, 23 nt, Leptospira interrogans serovar lai str. 56601
ucuauauucaaaaaauggaacau

SEQ ID NO: 2770969 - RNA, 19 nt, Leptospira interrogans serovar lai str. 56601
ucuauccacuaaaauacuu

SEQ ID NO: 2770970 - RNA, 12 nt, Leptospira interrogans serovar lai str. 56601
ucuaucucaaaa

SEQ ID NO: 2770971 - RNA, 16 nt, Leptospira interrogans serovar lai str. 56601
ucuaucuuuucaaaag

SEQ ID NO: 2770972 - RNA, 16 nt, Leptospira interrogans serovar lai str. 56601
ucuaucuuuuuuaaaa

SEQ ID NO: 2770973 - RNA, 18 nt, Leptospira interrogans serovar lai str. 56601
ucuaucuuuuuuaaaaca

SEQ ID NO: 2770974 - RNA, 15 nt, Leptospira interrogans serovar lai str. 56601
ucuaugauucugaaa

SEQ ID NO: 2770975 - RNA, 19 nt, Leptospira interrogans serovar lai str. 56601
ucuaugauucugaaaaaaa

SEQ ID NO: 2770976 - RNA, 14 nt, Leptospira interrogans serovar lai str. 56601
ucuauggaauuuuu

SEQ ID NO: 2770977 - RNA, 21 nt, Leptospira interrogans serovar lai str. 56601
ucuaugggaauuuuuguaaaa

SEQ ID NO: 2770978 - RNA, 14 nt, Leptospira interrogans serovar lai str. 56601
ucuauguaagaaaa

SEQ ID NO: 2770979 - RNA, 15 nt, Leptospira interrogans serovar lai str. 56601
ucuauguaagaaaau

SEQ ID NO: 2770980 - RNA, 20 nt, Leptospira interrogans serovar lai str. 56601
ucuauuaacuuuacaucaau

SEQ ID NO: 2770981 - RNA, 23 nt, Leptospira interrogans serovar lai str. 56601
ucuauuagaauaguaguuuucac

SEQ ID NO: 2770982 - RNA, 14 nt, Leptospira interrogans serovar lai str. 56601
ucuauuauauaguu

SEQ ID NO: 2770983 - RNA, 15 nt, Leptospira interrogans serovar lai str. 56601
ucuauuaugauucua

SEQ ID NO: 2770984 - RNA, 19 nt, Leptospira interrogans serovar lai str. 56601
ucuauuaugauucuauaau

SEQ ID NO: 2770985 - RNA, 18 nt, Leptospira interrogans serovar lai str. 56601
ucuauucauaaaugauaa

SEQ ID NO: 2770986 - RNA, 21 nt, Leptospira interrogans serovar lai str. 56601
ucuauucauaaaugauaauaa

SEQ ID NO: 2770987 - RNA, 13 nt, Leptospira interrogans serovar lai str. 56601
ucuauuccuaaaa

SEQ ID NO: 2770988 - RNA, 15 nt, Leptospira interrogans serovar lai str. 56601
ucuauuccuaaaaug

SEQ ID NO: 2770989 - RNA, 20 nt, Leptospira interrogans serovar lai str. 56601
ucuauucguauuuuauagaa

SEQ ID NO: 2770990 - RNA, 20 nt, Leptospira interrogans serovar lai str. 56601
ucuauucuuaaaauguagga

SEQ ID NO: 2770991 - RNA, 21 nt, Leptospira interrogans serovar lai str. 56601
ucuauugaaacaaaaaugaga

SEQ ID NO: 2770992 - RNA, 16 nt, Leptospira interrogans serovar lai str. 56601
ucuauuggguuugauu

SEQ ID NO: 2770993 - RNA, 17 nt, Leptospira interrogans serovar lai str. 56601
ucuauuggguuugauuu

SEQ ID NO: 2770994 - RNA, 17 nt, Leptospira interrogans serovar lai str. 56601
ucuauugugggaacuac

SEQ ID NO: 2770995 - RNA, 13 nt, Leptospira interrogans serovar lai str. 56601
ucuauuucccaaa

SEQ ID NO: 2770996 - RNA, 16 nt, Leptospira interrogans serovar lai str. 56601
ucuauuucccaaaauu

SEQ ID NO: 2770997 - RNA, 19 nt, Leptospira interrogans serovar lai str. 56601
ucuauuucccaaaauuuca

SEQ ID NO: 2770998 - RNA, 15 nt, Leptospira interrogans serovar lai str. 56601
ucuauuuuaauauau

SEQ ID NO: 2770999 - RNA, 21 nt, Leptospira interrogans serovar lai str. 56601
ucuauuuuauacuucuauaau

SEQ ID NO: 2771000 - RNA, 14 nt, Leptospira interrogans serovar lai str. 56601
ucuauuuuaucaga

SEQ ID NO: 2771001 - RNA, 13 nt, Leptospira interrogans serovar lai str. 56601
ucuauuuuauuuu

SEQ ID NO: 2771002 - RNA, 20 nt, Leptospira interrogans serovar lai str. 56601
ucuauuuucuuugaaaaaau

SEQ ID NO: 2771003 - RNA, 14 nt, Leptospira interrogans serovar lai str. 56601
ucuauuuuugauuu

SEQ ID NO: 2771004 - RNA, 14 nt, Leptospira interrogans serovar lai str. 56601
ucuauuuuuggaau

SEQ ID NO: 2771005 - RNA, 15 nt, Leptospira interrogans serovar lai str. 56601
ucuauuuuuuaauug

SEQ ID NO: 2771006 - RNA, 12 nt, Leptospira interrogans serovar lai str. 56601
ucucaaaaaaag

SEQ ID NO: 2771007 - RNA, 15 nt, Leptospira interrogans serovar lai str. 56601
ucucaaaaaaugcau

SEQ ID NO: 2771008 - RNA, 12 nt, Leptospira interrogans serovar lai str. 56601
ucucaaaaauag

SEQ ID NO: 2771009 - RNA, 19 nt, Leptospira interrogans serovar lai str. 56601
ucucaaaaauaucuuagaa

SEQ ID NO: 2771010 - RNA, 13 nt, Leptospira interrogans serovar lai str. 56601
ucucaaaaccuau

SEQ ID NO: 2771011 - RNA, 19 nt, Leptospira interrogans serovar lai str. 56601
ucucaaaaucuuaauaaaa

SEQ ID NO: 2771012 - RNA, 21 nt, Leptospira interrogans serovar lai str. 56601
ucucaaaauuaagaaucaaua

SEQ ID NO: 2771013 - RNA, 17 nt, Leptospira interrogans serovar lai str. 56601
ucucaacaacucuaaua

SEQ ID NO: 2771014 - RNA, 19 nt, Leptospira interrogans serovar lai str. 56601
ucucaacaacucuaauaua

SEQ ID NO: 2771015 - RNA, 23 nt, Leptospira interrogans serovar lai str. 56601
ucucaagugaugaaguuuuacua

SEQ ID NO: 2771016 - RNA, 15 nt, Leptospira interrogans serovar lai str. 56601
ucucaaucaaaauuu

SEQ ID NO: 2771017 - RNA, 20 nt, Leptospira interrogans serovar lai str. 56601
ucucacaaaucagguuuuua

SEQ ID NO: 2771018 - RNA, 13 nt, Leptospira interrogans serovar lai str. 56601
ucucacaaaucau

SEQ ID NO: 2771019 - RNA, 23 nt, Leptospira interrogans serovar lai str. 56601
ucucacagaaauauauucuuuuc

SEQ ID NO: 2771020 - RNA, 15 nt, Leptospira interrogans serovar lai str. 56601
ucucacuuccuaugg

SEQ ID NO: 2771021 - RNA, 16 nt, Leptospira interrogans serovar lai str. 56601
ucucagcaagucuauu

SEQ ID NO: 2771022 - RNA, 17 nt, Leptospira interrogans serovar lai str. 56601
ucucagccaaaaguuuu

SEQ ID NO: 2771023 - RNA, 22 nt, Leptospira interrogans serovar lai str. 56601
ucucagcucugguuaauaaauu

SEQ ID NO: 2771024 - RNA, 22 nt, Leptospira interrogans serovar lai str. 56601
ucucagcuucagucaaguuauu

SEQ ID NO: 2771025 - RNA, 23 nt, Leptospira interrogans serovar lai str. 56601
ucucagcuucagucaaguuauug

SEQ ID NO: 2771026 - RNA, 21 nt, Leptospira interrogans serovar lai str. 56601
ucucagucaccucuauaaaau

SEQ ID NO: 2771027 - RNA, 13 nt, Leptospira interrogans serovar lai str. 56601
ucucaguucaaaa

SEQ ID NO: 2771028 - RNA, 15 nt, Leptospira interrogans serovar lai str. 56601
ucucaguucaaaaua

SEQ ID NO: 2771029 - RNA, 18 nt, Leptospira interrogans serovar lai str. 56601
ucucauacuuaauuucaa

SEQ ID NO: 2771030 - RNA, 23 nt, Leptospira interrogans serovar lai str. 56601
ucuccaaaauuuuuguguaaaau

SEQ ID NO: 2771031 - RNA, 22 nt, Leptospira interrogans serovar lai str. 56601
ucuccaagaacguuuccagaaa

SEQ ID NO: 2771032 - RNA, 21 nt, Leptospira interrogans serovar lai str. 56601
ucuccaauagaauuguguuag

SEQ ID NO: 2771033 - RNA, 13 nt, Leptospira interrogans serovar lai str. 56601
ucuccacuugaau

SEQ ID NO: 2771034 - RNA, 23 nt, Leptospira interrogans serovar lai str. 56601
ucuccacuugaauagaaccuuuu

SEQ ID NO: 2771035 - RNA, 15 nt, Leptospira interrogans serovar lai str. 56601
ucuccaucuauuucc

SEQ ID NO: 2771036 - RNA, 20 nt, Leptospira interrogans serovar lai str. 56601
ucucccacacauuccgcaaa

SEQ ID NO: 2771037 - RNA, 23 nt, Leptospira interrogans serovar lai str. 56601
ucucccuuaccuccuuuuucaaa

SEQ ID NO: 2771038 - RNA, 21 nt, Leptospira interrogans serovar lai str. 56601
ucuccggcgaccuuucuaaaa

SEQ ID NO: 2771039 - RNA, 22 nt, Leptospira interrogans serovar lai str. 56601
ucuccggcgaccuuucuaaaaa

SEQ ID NO: 2771040 - RNA, 12 nt, Leptospira interrogans serovar lai str. 56601
ucuccuaaaaua

SEQ ID NO: 2771041 - RNA, 13 nt, Leptospira interrogans serovar lai str. 56601
ucuccuauguuuc

SEQ ID NO: 2771042 - RNA, 12 nt, Leptospira interrogans serovar lai str. 56601
ucuccuccgaaa

SEQ ID NO: 2771043 - RNA, 18 nt, Leptospira interrogans serovar lai str. 56601
ucuccuccugaaaauuuu

SEQ ID NO: 2771044 - RNA, 22 nt, Leptospira interrogans serovar lai str. 56601
ucuccucuucaccaagcuccuc

SEQ ID NO: 2771045 - RNA, 15 nt, Leptospira interrogans serovar lai str. 56601
ucuccuuuuuuacug

SEQ ID NO: 2771046 - RNA, 18 nt, Leptospira interrogans serovar lai str. 56601
ucucgaauuguuuuuaaa

SEQ ID NO: 2771047 - RNA, 15 nt, Leptospira interrogans serovar lai str. 56601
ucuguggacuuauga

SEQ ID NO: 2771048 - RNA, 16 nt, Leptospira interrogans serovar lai str. 56601
ucugugggaacucuca

SEQ ID NO: 2771049 - RNA, 23 nt, Leptospira interrogans serovar lai str. 56601
ucuguucauucuuuaaaauagaa

SEQ ID NO: 2771050 - RNA, 20 nt, Leptospira interrogans serovar lai str. 56601
ucuguuccgcuguaguaucu

SEQ ID NO: 2771051 - RNA, 22 nt, Leptospira interrogans serovar lai str. 56601
ucuguucgucguuuagaggaag

SEQ ID NO: 2771052 - RNA, 15 nt, Leptospira interrogans serovar lai str. 56601
ucuguuuauuuugaa

SEQ ID NO: 2771053 - RNA, 21 nt, Leptospira interrogans serovar lai str. 56601
ucuguuucuauuuuauguaaa

SEQ ID NO: 2771054 - RNA, 12 nt, Leptospira interrogans serovar lai str. 56601
ucuguuuuguuu

SEQ ID NO: 2771055 - RNA, 16 nt, Leptospira interrogans serovar lai str. 56601
ucuguuuuguuuccuu

SEQ ID NO: 2771056 - RNA, 14 nt, Leptospira interrogans serovar lai str. 56601
ucuuaaaaaauaca

SEQ ID NO: 2771057 - RNA, 13 nt, Leptospira interrogans serovar lai str. 56601
ucuuaaaaacucu

SEQ ID NO: 2771058 - RNA, 19 nt, Leptospira interrogans serovar lai str. 56601
ucuuaaaaagaguauuauc

SEQ ID NO: 2771059 - RNA, 14 nt, Leptospira interrogans serovar lai str. 56601
ucuuaaaagaaaau

SEQ ID NO: 2771060 - RNA, 14 nt, Leptospira interrogans serovar lai str. 56601
ucuuaaaauuaaug

SEQ ID NO: 2771061 - RNA, 14 nt, Leptospira interrogans serovar lai str. 56601
ucuuaaaauuguga

SEQ ID NO: 2771062 - RNA, 12 nt, Leptospira interrogans serovar lai str. 56601
ucuuaaaauuua

SEQ ID NO: 2771063 - RNA, 14 nt, Leptospira interrogans serovar lai str. 56601
ucuuaaaauuuaga

SEQ ID NO: 2771064 - RNA, 18 nt, Leptospira interrogans serovar lai str. 56601
ucuuaaaauuuagaaaua

SEQ ID NO: 2771065 - RNA, 13 nt, Leptospira interrogans serovar lai str. 56601
ucuuaaauaaaau

SEQ ID NO: 2771066 - RNA, 16 nt, Leptospira interrogans serovar lai str. 56601
ucuuaaauaaaauuuu

SEQ ID NO: 2771067 - RNA, 11 nt, Leptospira interrogans serovar lai str. 56601
ucuuaaaucuu

SEQ ID NO: 2771068 - RNA, 20 nt, Leptospira interrogans serovar lai str. 56601
ucuuaaaucuuagauucacu

SEQ ID NO: 2771069 - RNA, 16 nt, Leptospira interrogans serovar lai str. 56601
ucuuaaaucuuuaaaa

SEQ ID NO: 2771070 - RNA, 18 nt, Leptospira interrogans serovar lai str. 56601
ucuuaaaucuuuaaaaua

SEQ ID NO: 2771071 - RNA, 14 nt, Leptospira interrogans serovar lai str. 56601
ucuuaaauucuaaa

SEQ ID NO: 2771072 - RNA, 16 nt, Leptospira interrogans serovar lai str. 56601
ucuuaaauucuaauug

SEQ ID NO: 2771073 - RNA, 18 nt, Leptospira interrogans serovar lai str. 56601
ucuuaaauuuuuuuucag

SEQ ID NO: 2771074 - RNA, 19 nt, Leptospira interrogans serovar lai str. 56601
ucuuaacuuuaagcaaaga

SEQ ID NO: 2771075 - RNA, 23 nt, Leptospira interrogans serovar lai str. 56601
ucuuaaguugaguucuucugcaa

SEQ ID NO: 2771076 - RNA, 20 nt, Leptospira interrogans serovar lai str. 56601
ucuuaauaaaauuuucauuu

SEQ ID NO: 2771077 - RNA, 15 nt, Leptospira interrogans serovar lai str. 56601
ucuuaauauaauaau

SEQ ID NO: 2771078 - RNA, 22 nt, Leptospira interrogans serovar lai str. 56601
ucuuaauauacuuaagcucuaa

SEQ ID NO: 2771079 - RNA, 16 nt, Leptospira interrogans serovar lai str. 56601
ucuuaauauuucucuu

SEQ ID NO: 2771080 - RNA, 19 nt, Leptospira interrogans serovar lai str. 56601
ucuuaauggaucaaaagag

SEQ ID NO: 2771081 - RNA, 14 nt, Leptospira interrogans serovar lai str. 56601
ucuuaauuuuacua

SEQ ID NO: 2771082 - RNA, 14 nt, Leptospira interrogans serovar lai str. 56601
ucuuacaacuuuug

SEQ ID NO: 2771083 - RNA, 20 nt, Leptospira interrogans serovar lai str. 56601
ucuuacauugaguccuuucg

SEQ ID NO: 2771084 - RNA, 15 nt, Leptospira interrogans serovar lai str. 56601
ucuuacuccaucugu

SEQ ID NO: 2771085 - RNA, 22 nt, Leptospira interrogans serovar lai str. 56601
ucuuacucgacaaaacacuucu

SEQ ID NO: 2771086 - RNA, 20 nt, Leptospira interrogans serovar lai str. 56601
ucuuacuuugagaaaauuuu

SEQ ID NO: 2771087 - RNA, 23 nt, Leptospira interrogans serovar lai str. 56601
ucuuacuuugagaaaauuuuuuu

SEQ ID NO: 2771088 - RNA, 14 nt, Leptospira interrogans serovar lai str. 56601
ucuuagaaaaccau

SEQ ID NO: 2771089 - RNA, 20 nt, Leptospira interrogans serovar lai str. 56601
ucuuagaaugugggaacuac

SEQ ID NO: 2771090 - RNA, 20 nt, Leptospira interrogans serovar lai str. 56601
ucuuagaauuuuguuucuaa

SEQ ID NO: 2771091 - RNA, 21 nt, Leptospira interrogans serovar lai str. 56601
ucuuagaauuuuguuucuaaa

SEQ ID NO: 2771092 - RNA, 15 nt, Leptospira interrogans serovar lai str. 56601
ucuuagguaauuuag

SEQ ID NO: 2771093 - RNA, 16 nt, Leptospira interrogans serovar lai str. 56601
ucuuagucuaaaaaca

SEQ ID NO: 2771094 - RNA, 21 nt, Leptospira interrogans serovar lai str. 56601
ucuuagucuaaaaacaacuca

SEQ ID NO: 2771095 - RNA, 14 nt, Leptospira interrogans serovar lai str. 56601
ucuuauaaaauuuu

SEQ ID NO: 2771096 - RNA, 18 nt, Leptospira interrogans serovar lai str. 56601
ucuuauaaaauuuuagau

SEQ ID NO: 2771097 - RNA, 19 nt, Leptospira interrogans serovar lai str. 56601
ucuuauguucccaaaugag

SEQ ID NO: 2771098 - RNA, 16 nt, Leptospira interrogans serovar lai str. 56601
ucuuauucaauaaaau

SEQ ID NO: 2771099 - RNA, 22 nt, Leptospira interrogans serovar lai str. 56601
ucuuauucuaggcauuucauuu

SEQ ID NO: 2771100 - RNA, 21 nt, Leptospira interrogans serovar lai str. 56601
ucuuauugaacguaaguuaaa

SEQ ID NO: 2771101 - RNA, 23 nt, Leptospira interrogans serovar lai str. 56601
ucuuauuuauauuucuaaaagaa

SEQ ID NO: 2771102 - RNA, 12 nt, Leptospira interrogans serovar lai str. 56601
ucuuauuuccau

SEQ ID NO: 2771103 - RNA, 20 nt, Leptospira interrogans serovar lai str. 56601
ucuuauuuuuacagaaaaau

SEQ ID NO: 2771104 - RNA, 12 nt, Leptospira interrogans serovar lai str. 56601
ucuuauuuuuua

SEQ ID NO: 2771105 - RNA, 14 nt, Leptospira interrogans serovar lai str. 56601
ucuucaaaauugag

SEQ ID NO: 2771106 - RNA, 16 nt, Leptospira interrogans serovar lai str. 56601
ucuucaaauaacauuu

SEQ ID NO: 2771107 - RNA, 17 nt, Leptospira interrogans serovar lai str. 56601
ucuucaaauaacauuuu

SEQ ID NO: 2771108 - RNA, 20 nt, Leptospira interrogans serovar lai str. 56601
ucuucaaauaacauuuuuuc

SEQ ID NO: 2771109 - RNA, 18 nt, Leptospira interrogans serovar lai str. 56601
ucuucaaguuugugagag

SEQ ID NO: 2771110 - RNA, 21 nt, Leptospira interrogans serovar lai str. 56601
ucuucaauaucuuuauuuaau

SEQ ID NO: 2771111 - RNA, 22 nt, Leptospira interrogans serovar lai str. 56601
ucuucaauguuauaaaauguau

SEQ ID NO: 2771112 - RNA, 13 nt, Leptospira interrogans serovar lai str. 56601
ucuucauaucaaa

SEQ ID NO: 2771113 - RNA, 16 nt, Leptospira interrogans serovar lai str. 56601
ucuucaucauuauuug

SEQ ID NO: 2771114 - RNA, 14 nt, Leptospira interrogans serovar lai str. 56601
ucuucaucuuacca

SEQ ID NO: 2771115 - RNA, 14 nt, Leptospira interrogans serovar lai str. 56601
ucuucauuaaacaa

SEQ ID NO: 2771116 - RNA, 16 nt, Leptospira interrogans serovar lai str. 56601
ucuuccguuuuuaauc

SEQ ID NO: 2771117 - RNA, 15 nt, Leptospira interrogans serovar lai str. 56601
ucuuccuuuuucauu

SEQ ID NO: 2771118 - RNA, 19 nt, Leptospira interrogans serovar lai str. 56601
ucuucgggcuuauuuuuuu

SEQ ID NO: 2771119 - RNA, 13 nt, Leptospira interrogans serovar lai str. 56601
ucuucgucuaaca

SEQ ID NO: 2771120 - RNA, 24 nt, Leptospira interrogans serovar lai str. 56601
ucuucguuauuuuuauaaagauaa

SEQ ID NO: 2771121 - RNA, 13 nt, Leptospira interrogans serovar lai str. 56601
ucuucuaaaucua

SEQ ID NO: 2771122 - RNA, 21 nt, Leptospira interrogans serovar lai str. 56601
ucuucuaaauuuguaaauucu

SEQ ID NO: 2771123 - RNA, 15 nt, Leptospira interrogans serovar lai str. 56601
ucuucuaauugcaac

SEQ ID NO: 2771124 - RNA, 15 nt, Leptospira interrogans serovar lai str. 56601
ucuucuagcaaucuu

SEQ ID NO: 2771125 - RNA, 22 nt, Leptospira interrogans serovar lai str. 56601
ucuucugcaauucgcauuaaaa

SEQ ID NO: 2771126 - RNA, 21 nt, Leptospira interrogans serovar lai str. 56601
ucuucuucaugauuuuuuaau

SEQ ID NO: 2771127 - RNA, 11 nt, Leptospira interrogans serovar lai str. 56601
ucuucuuguaa

SEQ ID NO: 2771128 - RNA, 21 nt, Leptospira interrogans serovar lai str. 56601
ucuucuuuuguuuuuauaaau

SEQ ID NO: 2771129 - RNA, 15 nt, Leptospira interrogans serovar lai str. 56601
ucuugaaaauucaaa

SEQ ID NO: 2771130 - RNA, 19 nt, Leptospira interrogans serovar lai str. 56601
ucuuuuuuaaaacauccuc

SEQ ID NO: 2771131 - RNA, 12 nt, Leptospira interrogans serovar lai str. 56601
ucuuuuuuaaag

SEQ ID NO: 2771132 - RNA, 13 nt, Leptospira interrogans serovar lai str. 56601
ucuuuuuuaauua

SEQ ID NO: 2771133 - RNA, 14 nt, Leptospira interrogans serovar lai str. 56601
ucuuuuuuccuucu

SEQ ID NO: 2771134 - RNA, 19 nt, Leptospira interrogans serovar lai str. 56601
ucuuuuuucuaaauaauac

SEQ ID NO: 2771135 - RNA, 21 nt, Leptospira interrogans serovar lai str. 56601
ucuuuuuugacuucggaacau

SEQ ID NO: 2771136 - RNA, 13 nt, Leptospira interrogans serovar lai str. 56601
ucuuuuuuuaaac

SEQ ID NO: 2771137 - RNA, 14 nt, Leptospira interrogans serovar lai str. 56601
ucuuuuuuuaaaca

SEQ ID NO: 2771138 - RNA, 22 nt, Leptospira interrogans serovar lai str. 56601
ucuuuuuuuaccgaagacgcau

SEQ ID NO: 2771139 - RNA, 20 nt, Leptospira interrogans serovar lai str. 56601
ucuuuuuuuacgcggaacau

SEQ ID NO: 2771140 - RNA, 15 nt, Leptospira interrogans serovar lai str. 56601
ucuuuuuuuucuaaa

SEQ ID NO: 2771141 - RNA, 19 nt, Leptospira interrogans serovar lai str. 56601
ucuuuuuuuucuaaaauau

SEQ ID NO: 2771142 - RNA, 21 nt, Leptospira interrogans serovar lai str. 56601
ucuuuuuuuucuaaaauauuu

SEQ ID NO: 2771143 - RNA, 12 nt, Leptospira interrogans serovar lai str. 56601
ugaaaaaaaaca

SEQ ID NO: 2771144 - RNA, 16 nt, Leptospira interrogans serovar lai str. 56601
ugaaaaaaaacaaaga

SEQ ID NO: 2771145 - RNA, 14 nt, Leptospira interrogans serovar lai str. 56601
ugaaaaaaaacagg

SEQ ID NO: 2771146 - RNA, 14 nt, Leptospira interrogans serovar lai str. 56601
ugaaaaaaauuaga

SEQ ID NO: 2771147 - RNA, 15 nt, Leptospira interrogans serovar lai str. 56601
ugaaaaaaauuagaa

SEQ ID NO: 2771148 - RNA, 19 nt, Leptospira interrogans serovar lai str. 56601
ugaaaaaacggccgacguu

SEQ ID NO: 2771149 - RNA, 16 nt, Leptospira interrogans serovar lai str. 56601
ugaaaaaacuauuuaa

SEQ ID NO: 2771150 - RNA, 14 nt, Leptospira interrogans serovar lai str. 56601
ugaaaaaacuuuuu

SEQ ID NO: 2771151 - RNA, 17 nt, Leptospira interrogans serovar lai str. 56601
ugaaaaaacuuuuuaua

SEQ ID NO: 2771152 - RNA, 10 nt, Leptospira interrogans serovar lai str. 56601
ugaaaaaagu

SEQ ID NO: 2771153 - RNA, 16 nt, Leptospira interrogans serovar lai str. 56601
ugaaaaaaguuagaau

SEQ ID NO: 2771154 - RNA, 12 nt, Leptospira interrogans serovar lai str. 56601
ugaaaaaauuuu

SEQ ID NO: 2771155 - RNA, 22 nt, Leptospira interrogans serovar lai str. 56601
ugaaaaagaaacggaagaaaau

SEQ ID NO: 2771156 - RNA, 18 nt, Leptospira interrogans serovar lai str. 56601
ugaaaaagaauuuuuaaa

SEQ ID NO: 2771157 - RNA, 22 nt, Leptospira interrogans serovar lai str. 56601
ugaaaaagaauuuuuaaaaaua

SEQ ID NO: 2771158 - RNA, 18 nt, Leptospira interrogans serovar lai str. 56601
ugaaaaagcauauaggac

SEQ ID NO: 2771159 - RNA, 12 nt, Leptospira interrogans serovar lai str. 56601
ugaaaaaguugg

SEQ ID NO: 2771160 - RNA, 19 nt, Leptospira interrogans serovar lai str. 56601
ugaaaaaguugggaucuaa

SEQ ID NO: 2771161 - RNA, 13 nt, Leptospira interrogans serovar lai str. 56601
ugaaaaaucgauu

SEQ ID NO: 2771162 - RNA, 12 nt, Leptospira interrogans serovar lai str. 56601
ugaaaaauuaau

SEQ ID NO: 2771163 - RNA, 14 nt, Leptospira interrogans serovar lai str. 56601
ugaaaaauuucaua

SEQ ID NO: 2771164 - RNA, 20 nt, Leptospira interrogans serovar lai str. 56601
ugaaaaauuucuuugucuuu

SEQ ID NO: 2771165 - RNA, 15 nt, Leptospira interrogans serovar lai str. 56601
ugaaaacuaggaacu

SEQ ID NO: 2771166 - RNA, 11 nt, Leptospira interrogans serovar lai str. 56601
ugaaaagugag

SEQ ID NO: 2771167 - RNA, 14 nt, Leptospira interrogans serovar lai str. 56601
ugaaaaguuuauga

SEQ ID NO: 2771168 - RNA, 13 nt, Leptospira interrogans serovar lai str. 56601
ugaaaauguaaaa

SEQ ID NO: 2771169 - RNA, 17 nt, Leptospira interrogans serovar lai str. 56601
ugaaaauucuuucuaua

SEQ ID NO: 2771170 - RNA, 17 nt, Leptospira interrogans serovar lai str. 56601
ugaaaauugaauuuaaa

SEQ ID NO: 2771171 - RNA, 14 nt, Leptospira interrogans serovar lai str. 56601
ugaaaauuuaauua

SEQ ID NO: 2771172 - RNA, 15 nt, Leptospira interrogans serovar lai str. 56601
ugaaaauuuuccuuu

SEQ ID NO: 2771173 - RNA, 15 nt, Leptospira interrogans serovar lai str. 56601
ugaaacaauuuugcc

SEQ ID NO: 2771174 - RNA, 20 nt, Leptospira interrogans serovar lai str. 56601
ugaaacaucacuuccauuuu

SEQ ID NO: 2771175 - RNA, 15 nt, Leptospira interrogans serovar lai str. 56601
ugaaacauuucuaaa

SEQ ID NO: 2771176 - RNA, 23 nt, Leptospira interrogans serovar lai str. 56601
ugaaacguuuucaaaaaauuucu

SEQ ID NO: 2771177 - RNA, 13 nt, Leptospira interrogans serovar lai str. 56601
ugaaacucaguaa

SEQ ID NO: 2771178 - RNA, 19 nt, Leptospira interrogans serovar lai str. 56601
ugaaacucaguaaaacgcu

SEQ ID NO: 2771179 - RNA, 20 nt, Leptospira interrogans serovar lai str. 56601
ugaaacuugaacuguuuaau

SEQ ID NO: 2771180 - RNA, 21 nt, Leptospira interrogans serovar lai str. 56601
ugaaacuugaacuguuuaauu

SEQ ID NO: 2771181 - RNA, 15 nt, Leptospira interrogans serovar lai str. 56601
ugaaacuuuccacuu

SEQ ID NO: 2771182 - RNA, 21 nt, Leptospira interrogans serovar lai str. 56601
ugaaacuuuccacuuuucuca

SEQ ID NO: 2771183 - RNA, 16 nt, Leptospira interrogans serovar lai str. 56601
ugaaacuuuucaaaau

SEQ ID NO: 2771184 - RNA, 19 nt, Leptospira interrogans serovar lai str. 56601
ugaaagaagauagauuuau

SEQ ID NO: 2771185 - RNA, 23 nt, Leptospira interrogans serovar lai str. 56601
ugaaagcaauccauucaaaaaau

SEQ ID NO: 2771186 - RNA, 15 nt, Leptospira interrogans serovar lai str. 56601
ugaaaguaaaaaaga

SEQ ID NO: 2771187 - RNA, 16 nt, Leptospira interrogans serovar lai str. 56601
ugaaaguaaaaaagag

SEQ ID NO: 2771188 - RNA, 14 nt, Leptospira interrogans serovar lai str. 56601
ugaaaguaaucuuu

SEQ ID NO: 2771189 - RNA, 22 nt, Leptospira interrogans serovar lai str. 56601
ugaaaguaauuuaucuguaauu

SEQ ID NO: 2771190 - RNA, 19 nt, Leptospira interrogans serovar lai str. 56601
ugaaagucgcgaguaaauc

SEQ ID NO: 2771191 - RNA, 14 nt, Leptospira interrogans serovar lai str. 56601
ugaaagugaaagua

SEQ ID NO: 2771192 - RNA, 14 nt, Leptospira interrogans serovar lai str. 56601
ugaaaguuuuucaa

SEQ ID NO: 2771193 - RNA, 14 nt, Leptospira interrogans serovar lai str. 56601
ugaaaguuuuucuu

SEQ ID NO: 2771194 - RNA, 21 nt, Leptospira interrogans serovar lai str. 56601
ugaaaguuuuucuuuuuaaga

SEQ ID NO: 2771195 - RNA, 14 nt, Leptospira interrogans serovar lai str. 56601
ugaaauacaaaaag

SEQ ID NO: 2771196 - RNA, 19 nt, Leptospira interrogans serovar lai str. 56601
ugaaauacaaaaagaauca

SEQ ID NO: 2771197 - RNA, 16 nt, Leptospira interrogans serovar lai str. 56601
ugaaauagaaaacaga

SEQ ID NO: 2771198 - RNA, 15 nt, Leptospira interrogans serovar lai str. 56601
ugaaauagaauccua

SEQ ID NO: 2771199 - RNA, 18 nt, Leptospira interrogans serovar lai str. 56601
ugaaauagauucuaauuu

SEQ ID NO: 2771200 - RNA, 18 nt, Leptospira interrogans serovar lai str. 56601
ugaaauauuauaaauuua

SEQ ID NO: 2771201 - RNA, 19 nt, Leptospira interrogans serovar lai str. 56601
ugaaauauuauaaauuuaa

SEQ ID NO: 2771202 - RNA, 22 nt, Leptospira interrogans serovar lai str. 56601
ugaaauauuauaaauuuaaaaa

SEQ ID NO: 2771203 - RNA, 23 nt, Leptospira interrogans serovar lai str. 56601
ugaaaucagagucuauuuaauua

SEQ ID NO: 2771204 - RNA, 19 nt, Leptospira interrogans serovar lai str. 56601
ugaaaucucuaacaaaaag

SEQ ID NO: 2771205 - RNA, 20 nt, Leptospira interrogans serovar lai str. 56601
ugaaaucugaacauaaaauc

SEQ ID NO: 2771206 - RNA, 17 nt, Leptospira interrogans serovar lai str. 56601
ugaaauggaaaauugaa

SEQ ID NO: 2771207 - RNA, 18 nt, Leptospira interrogans serovar lai str. 56601
ugaaauggaaaauugaaa

SEQ ID NO: 2771208 - RNA, 15 nt, Leptospira interrogans serovar lai str. 56601
ugaaauucaucaaau

SEQ ID NO: 2771209 - RNA, 16 nt, Leptospira interrogans serovar lai str. 56601
ugaaauuguuuuaaaa

SEQ ID NO: 2771210 - RNA, 12 nt, Leptospira interrogans serovar lai str. 56601
ugaaauuuccac

SEQ ID NO: 2771211 - RNA, 14 nt, Leptospira interrogans serovar lai str. 56601
ugaaauuuccacuu

SEQ ID NO: 2771212 - RNA, 17 nt, Leptospira interrogans serovar lai str. 56601
ugaaauuuuaaaacccg

SEQ ID NO: 2771213 - RNA, 21 nt, Leptospira interrogans serovar lai str. 56601
ugaaauuuucuuagaaaacuu

SEQ ID NO: 2771214 - RNA, 16 nt, Leptospira interrogans serovar lai str. 56601
ugaauucagaaaaaaa

SEQ ID NO: 2771215 - RNA, 20 nt, Leptospira interrogans serovar lai str. 56601
ugaauucucuagaaauuuau

SEQ ID NO: 2771216 - RNA, 22 nt, Leptospira interrogans serovar lai str. 56601
ugaauucucuagaaauuuauaa

SEQ ID NO: 2771217 - RNA, 12 nt, Leptospira interrogans serovar lai str. 56601
ugaauucuuccu

SEQ ID NO: 2771218 - RNA, 20 nt, Leptospira interrogans serovar lai str. 56601
ugaauugaaauggaaaauug

SEQ ID NO: 2771219 - RNA, 15 nt, Leptospira interrogans serovar lai str. 56601
ugaauugcucaaaga

SEQ ID NO: 2771220 - RNA, 18 nt, Leptospira interrogans serovar lai str. 56601
ugaauuguaaaaaaccgu

SEQ ID NO: 2771221 - RNA, 21 nt, Leptospira interrogans serovar lai str. 56601
ugaauuguggguuguauagaa

SEQ ID NO: 2771222 - RNA, 14 nt, Leptospira interrogans serovar lai str. 56601
ugaauuuaaaacuu

SEQ ID NO: 2771223 - RNA, 12 nt, Leptospira interrogans serovar lai str. 56601
ugaauuuacagu

SEQ ID NO: 2771224 - RNA, 19 nt, Leptospira interrogans serovar lai str. 56601
ugaauuuaggaaauuuuca

SEQ ID NO: 2771225 - RNA, 22 nt, Leptospira interrogans serovar lai str. 56601
ugaauuuaggaaauuuucaaua

SEQ ID NO: 2771226 - RNA, 18 nt, Leptospira interrogans serovar lai str. 56601
ugaauuuauagauauaac

SEQ ID NO: 2771227 - RNA, 13 nt, Leptospira interrogans serovar lai str. 56601
ugaauuuccauua

SEQ ID NO: 2771228 - RNA, 12 nt, Leptospira interrogans serovar lai str. 56601
ugaauuucuucg

SEQ ID NO: 2771229 - RNA, 15 nt, Leptospira interrogans serovar lai str. 56601
ugaauuugaggagaa

SEQ ID NO: 2771230 - RNA, 19 nt, Leptospira interrogans serovar lai str. 56601
ugaauuugaggagaaucua

SEQ ID NO: 2771231 - RNA, 19 nt, Leptospira interrogans serovar lai str. 56601
ugaauuuguaauucuucaa

SEQ ID NO: 2771232 - RNA, 14 nt, Leptospira interrogans serovar lai str. 56601
ugaauuuguuuuuc

SEQ ID NO: 2771233 - RNA, 18 nt, Leptospira interrogans serovar lai str. 56601
ugaauuuuaaauuuacua

SEQ ID NO: 2771234 - RNA, 22 nt, Leptospira interrogans serovar lai str. 56601
ugaauuuuaagaucuauuccua

SEQ ID NO: 2771235 - RNA, 23 nt, Leptospira interrogans serovar lai str. 56601
ugaauuuuauagauugauucuuu

SEQ ID NO: 2771236 - RNA, 16 nt, Leptospira interrogans serovar lai str. 56601
ugaauuuuuaaacauu

SEQ ID NO: 2771237 - RNA, 13 nt, Leptospira interrogans serovar lai str. 56601
ugaauuuuuauaa

SEQ ID NO: 2771238 - RNA, 15 nt, Leptospira interrogans serovar lai str. 56601
ugaauuuuuauaaaa

SEQ ID NO: 2771239 - RNA, 16 nt, Leptospira interrogans serovar lai str. 56601
ugaauuuuuuaaaugc

SEQ ID NO: 2771240 - RNA, 18 nt, Leptospira interrogans serovar lai str. 56601
ugaauuuuuuauuaagaa

SEQ ID NO: 2771241 - RNA, 13 nt, Leptospira interrogans serovar lai str. 56601
ugaauuuuuucgu

SEQ ID NO: 2771242 - RNA, 22 nt, Leptospira interrogans serovar lai str. 56601
ugaauuuuuucugccauuuuua

SEQ ID NO: 2771243 - RNA, 15 nt, Leptospira interrogans serovar lai str. 56601
ugacaaacuaaauuu

SEQ ID NO: 2771244 - RNA, 20 nt, Leptospira interrogans serovar lai str. 56601
ugacaaagaguuguuuaucu

SEQ ID NO: 2771245 - RNA, 19 nt, Leptospira interrogans serovar lai str. 56601
ugacaacagucauucugua

SEQ ID NO: 2771246 - RNA, 22 nt, Leptospira interrogans serovar lai str. 56601
ugacaagcucuuuaagagucau

SEQ ID NO: 2771247 - RNA, 22 nt, Leptospira interrogans serovar lai str. 56601
ugacaauuuaucuaaaacacau

SEQ ID NO: 2771248 - RNA, 15 nt, Leptospira interrogans serovar lai str. 56601
ugacaauuugugaac

SEQ ID NO: 2771249 - RNA, 21 nt, Leptospira interrogans serovar lai str. 56601
ugacacucuaauguacaacau

SEQ ID NO: 2771250 - RNA, 16 nt, Leptospira interrogans serovar lai str. 56601
ugacauucuaaacauu

SEQ ID NO: 2771251 - RNA, 21 nt, Leptospira interrogans serovar lai str. 56601
ugaccaccuauacuagaacaa

SEQ ID NO: 2771252 - RNA, 18 nt, Leptospira interrogans serovar lai str. 56601
ugaccguugugagaaaua

SEQ ID NO: 2771253 - RNA, 17 nt, Leptospira interrogans serovar lai str. 56601
ugaccucauaucaaaaa

SEQ ID NO: 2771254 - RNA, 19 nt, Leptospira interrogans serovar lai str. 56601
ugaccucauaucaaaaauu

SEQ ID NO: 2771255 - RNA, 21 nt, Leptospira interrogans serovar lai str. 56601
ugaccugccuuucuuauuaau

SEQ ID NO: 2771256 - RNA, 14 nt, Leptospira interrogans serovar lai str. 56601
ugacguaaaaaaau

SEQ ID NO: 2771257 - RNA, 22 nt, Leptospira interrogans serovar lai str. 56601
ugacguaaaggaauccaugauu

SEQ ID NO: 2771258 - RNA, 20 nt, Leptospira interrogans serovar lai str. 56601
ugacuaucaacaagaaugaa

SEQ ID NO: 2771259 - RNA, 12 nt, Leptospira interrogans serovar lai str. 56601
ugacuccaaaaa

SEQ ID NO: 2771260 - RNA, 18 nt, Leptospira interrogans serovar lai str. 56601
ugacucuaagcuuuagaa

SEQ ID NO: 2771261 - RNA, 20 nt, Leptospira interrogans serovar lai str. 56601
ugacugaaaaaaacgucuuu

SEQ ID NO: 2771262 - RNA, 14 nt, Leptospira interrogans serovar lai str. 56601
ugacuuaagaaaua

SEQ ID NO: 2771263 - RNA, 16 nt, Leptospira interrogans serovar lai str. 56601
ugacuuaagaaauaga

SEQ ID NO: 2771264 - RNA, 20 nt, Leptospira interrogans serovar lai str. 56601
ugacuuaagaaauagaucug

SEQ ID NO: 2771265 - RNA, 17 nt, Leptospira interrogans serovar lai str. 56601
ugacuuuaauuuuagua

SEQ ID NO: 2771266 - RNA, 17 nt, Leptospira interrogans serovar lai str. 56601
ugacuuucccacuuaua

SEQ ID NO: 2771267 - RNA, 12 nt, Leptospira interrogans serovar lai str. 56601
ugagaaaaucca

SEQ ID NO: 2771268 - RNA, 12 nt, Leptospira interrogans serovar lai str. 56601
ugagaaaauuuu

SEQ ID NO: 2771269 - RNA, 17 nt, Leptospira interrogans serovar lai str. 56601
ugagaaacgauacaaau

SEQ ID NO: 2771270 - RNA, 22 nt, Leptospira interrogans serovar lai str. 56601
ugagaaagaauuucuaaaagua

SEQ ID NO: 2771271 - RNA, 17 nt, Leptospira interrogans serovar lai str. 56601
ugagaaaggagaacuca

SEQ ID NO: 2771272 - RNA, 19 nt, Leptospira interrogans serovar lai str. 56601
ugagaaaggagaacucauu

SEQ ID NO: 2771273 - RNA, 22 nt, Leptospira interrogans serovar lai str. 56601
ugagaaaggagaacucauucaa

SEQ ID NO: 2771274 - RNA, 18 nt, Leptospira interrogans serovar lai str. 56601
ugagaaauacuuugauua

SEQ ID NO: 2771275 - RNA, 12 nt, Leptospira interrogans serovar lai str. 56601
ugagaacuacuu

SEQ ID NO: 2771276 - RNA, 17 nt, Leptospira interrogans serovar lai str. 56601
ugagaacuacuuuuaua

SEQ ID NO: 2771277 - RNA, 21 nt, Leptospira interrogans serovar lai str. 56601
ugagaauauaagaaaguauua

SEQ ID NO: 2771278 - RNA, 23 nt, Leptospira interrogans serovar lai str. 56601
ugagaauuuguuuuaaaauuuau

SEQ ID NO: 2771279 - RNA, 19 nt, Leptospira interrogans serovar lai str. 56601
ugagacgcugaguuugaaa

SEQ ID NO: 2771280 - RNA, 14 nt, Leptospira interrogans serovar lai str. 56601
ugagagccuuuuua

SEQ ID NO: 2771281 - RNA, 22 nt, Leptospira interrogans serovar lai str. 56601
ugagagccuuuuuauuucuaag

SEQ ID NO: 2771282 - RNA, 14 nt, Leptospira interrogans serovar lai str. 56601
ugagaguucccaca

SEQ ID NO: 2771283 - RNA, 14 nt, Leptospira interrogans serovar lai str. 56601
ugagaguucccacg

SEQ ID NO: 2771284 - RNA, 16 nt, Leptospira interrogans serovar lai str. 56601
ugagaguuuuucuaua

SEQ ID NO: 2771285 - RNA, 14 nt, Leptospira interrogans serovar lai str. 56601
ugagauagguuuug

SEQ ID NO: 2771286 - RNA, 22 nt, Leptospira interrogans serovar lai str. 56601
ugagauagguuuuguaagaauu

SEQ ID NO: 2771287 - RNA, 18 nt, Leptospira interrogans serovar lai str. 56601
ugagauaucacaaauuuu

SEQ ID NO: 2771288 - RNA, 22 nt, Leptospira interrogans serovar lai str. 56601
ugagauaucacaaauuuuaaag

SEQ ID NO: 2771289 - RNA, 16 nt, Leptospira interrogans serovar lai str. 56601
ugagauccaauuauuu

SEQ ID NO: 2771290 - RNA, 20 nt, Leptospira interrogans serovar lai str. 56601
ugagaugaggaaguucccgg

SEQ ID NO: 2771291 - RNA, 15 nt, Leptospira interrogans serovar lai str. 56601
ugagaugugggaacu

SEQ ID NO: 2771292 - RNA, 14 nt, Leptospira interrogans serovar lai str. 56601
ugagauuaaaaaga

SEQ ID NO: 2771293 - RNA, 22 nt, Leptospira interrogans serovar lai str. 56601
ugagauuguuuucuaguuuucc

SEQ ID NO: 2771294 - RNA, 16 nt, Leptospira interrogans serovar lai str. 56601
ugagauuugucucaaa

SEQ ID NO: 2771295 - RNA, 18 nt, Leptospira interrogans serovar lai str. 56601
ugagauuugucucaaaau

SEQ ID NO: 2771296 - RNA, 22 nt, Leptospira interrogans serovar lai str. 56601
ugagauuugucucaaaauuuaa

SEQ ID NO: 2771297 - RNA, 18 nt, Leptospira interrogans serovar lai str. 56601
ugaucgcguaauauuuca

SEQ ID NO: 2771298 - RNA, 20 nt, Leptospira interrogans serovar lai str. 56601
ugaucgucaaucaauugacu

SEQ ID NO: 2771299 - RNA, 20 nt, Leptospira interrogans serovar lai str. 56601
ugaucuaauaauauacuaaa

SEQ ID NO: 2771300 - RNA, 22 nt, Leptospira interrogans serovar lai str. 56601
ugaucuaauaauauacuaaauu

SEQ ID NO: 2771301 - RNA, 15 nt, Leptospira interrogans serovar lai str. 56601
ugaucucaauauaaa

SEQ ID NO: 2771302 - RNA, 17 nt, Leptospira interrogans serovar lai str. 56601
ugaucucaauauaaacu

SEQ ID NO: 2771303 - RNA, 22 nt, Leptospira interrogans serovar lai str. 56601
ugaucucgauuccuaaaaugug

SEQ ID NO: 2771304 - RNA, 13 nt, Leptospira interrogans serovar lai str. 56601
ugaucucuauaaa

SEQ ID NO: 2771305 - RNA, 18 nt, Leptospira interrogans serovar lai str. 56601
ugaucucuauaaaaucaa

SEQ ID NO: 2771306 - RNA, 15 nt, Leptospira interrogans serovar lai str. 56601
ugaucuuauacucuu

SEQ ID NO: 2771307 - RNA, 13 nt, Leptospira interrogans serovar lai str. 56601
ugaucuuuaaaag

SEQ ID NO: 2771308 - RNA, 16 nt, Leptospira interrogans serovar lai str. 56601
ugaucuuuaaaagagc

SEQ ID NO: 2771309 - RNA, 16 nt, Leptospira interrogans serovar lai str. 56601
ugaugaauucugggaa

SEQ ID NO: 2771310 - RNA, 22 nt, Leptospira interrogans serovar lai str. 56601
ugauguagaguaaauuuugaaa

SEQ ID NO: 2771311 - RNA, 21 nt, Leptospira interrogans serovar lai str. 56601
ugauguaggaacuacagcaaa

SEQ ID NO: 2771312 - RNA, 16 nt, Leptospira interrogans serovar lai str. 56601
ugauuaaaccgguaaa

SEQ ID NO: 2771313 - RNA, 22 nt, Leptospira interrogans serovar lai str. 56601
ugauuaaaccgguaaaaaguaa

SEQ ID NO: 2771314 - RNA, 13 nt, Leptospira interrogans serovar lai str. 56601
ugauuagaaaaaa

SEQ ID NO: 2771315 - RNA, 16 nt, Leptospira interrogans serovar lai str. 56601
ugauuauuauuuugau

SEQ ID NO: 2771316 - RNA, 11 nt, Leptospira interrogans serovar lai str. 56601
ugauucaaaaa

SEQ ID NO: 2771317 - RNA, 19 nt, Leptospira interrogans serovar lai str. 56601
ugauucaaaaacuaaaaua

SEQ ID NO: 2771318 - RNA, 18 nt, Leptospira interrogans serovar lai str. 56601
ugauucagaguaaggaaa

SEQ ID NO: 2771319 - RNA, 14 nt, Leptospira interrogans serovar lai str. 56601
ugauucauuuuucu

SEQ ID NO: 2771320 - RNA, 22 nt, Leptospira interrogans serovar lai str. 56601
ugauucauuuuucugaaaaaag

SEQ ID NO: 2771321 - RNA, 23 nt, Leptospira interrogans serovar lai str. 56601
ugauuccaaagauaaaaaagaaa

SEQ ID NO: 2771322 - RNA, 20 nt, Leptospira interrogans serovar lai str. 56601
ugauuccaagauuuuuuaau

SEQ ID NO: 2771323 - RNA, 23 nt, Leptospira interrogans serovar lai str. 56601
ugauuccgguaaauuuuuuagaa

SEQ ID NO: 2771324 - RNA, 19 nt, Leptospira interrogans serovar lai str. 56601
ugauucuaacuuuugcaau

SEQ ID NO: 2771325 - RNA, 18 nt, Leptospira interrogans serovar lai str. 56601
ugauucuauccaauugaa

SEQ ID NO: 2771326 - RNA, 12 nt, Leptospira interrogans serovar lai str. 56601
ugauucugaaaa

SEQ ID NO: 2771327 - RNA, 14 nt, Leptospira interrogans serovar lai str. 56601
ugauucugaaaaaa

SEQ ID NO: 2771328 - RNA, 16 nt, Leptospira interrogans serovar lai str. 56601
ugauucugaaaaaagu

SEQ ID NO: 2771329 - RNA, 17 nt, Leptospira interrogans serovar lai str. 56601
ugauucugaaaaaaguu

SEQ ID NO: 2771330 - RNA, 22 nt, Leptospira interrogans serovar lai str. 56601
ugauucugaaaaaaguuagaau

SEQ ID NO: 2771331 - RNA, 14 nt, Leptospira interrogans serovar lai str. 56601
ugauucugcauaua

SEQ ID NO: 2771332 - RNA, 23 nt, Leptospira interrogans serovar lai str. 56601
ugauucugcucauuuuuucuucc

SEQ ID NO: 2771333 - RNA, 16 nt, Leptospira interrogans serovar lai str. 56601
ugauucuuuaaaugug

SEQ ID NO: 2771334 - RNA, 18 nt, Leptospira interrogans serovar lai str. 56601
ugauucuuuaaauguggg

SEQ ID NO: 2771335 - RNA, 21 nt, Leptospira interrogans serovar lai str. 56601
ugauugacguccuuauauccg

SEQ ID NO: 2771336 - RNA, 19 nt, Leptospira interrogans serovar lai str. 56601
ugauugagaaaauaaaaaa

SEQ ID NO: 2771337 - RNA, 15 nt, Leptospira interrogans serovar lai str. 56601
ugauugcuuuuugag

SEQ ID NO: 2771338 - RNA, 19 nt, Leptospira interrogans serovar lai str. 56601
ugauuguggcaagaggaac

SEQ ID NO: 2771339 - RNA, 19 nt, Leptospira interrogans serovar lai str. 56601
ugauuguuuguuuuuucca

SEQ ID NO: 2771340 - RNA, 13 nt, Leptospira interrogans serovar lai str. 56601
ugauuuaaaaaua

SEQ ID NO: 2771341 - RNA, 23 nt, Leptospira interrogans serovar lai str. 56601
ugauuuaaaaauaguauuuugug

SEQ ID NO: 2771342 - RNA, 18 nt, Leptospira interrogans serovar lai str. 56601
ugauuuaaaaucacaaaa

SEQ ID NO: 2771343 - RNA, 22 nt, Leptospira interrogans serovar lai str. 56601
ugauuuaaaaucacaaaaaaga

SEQ ID NO: 2771344 - RNA, 23 nt, Leptospira interrogans serovar lai str. 56601
ugauuuagagagucaaaucaauu

SEQ ID NO: 2771345 - RNA, 15 nt, Leptospira interrogans serovar lai str. 56601
ugauuucaugcaaaa

SEQ ID NO: 2771346 - RNA, 19 nt, Leptospira interrogans serovar lai str. 56601
ugauuucaugcaaaaauuu

SEQ ID NO: 2771347 - RNA, 16 nt, Leptospira interrogans serovar lai str. 56601
ugauuucuauaaaauu

SEQ ID NO: 2771348 - RNA, 21 nt, Leptospira interrogans serovar lai str. 56601
ugauuuggaucgguuuuagaa

SEQ ID NO: 2771349 - RNA, 23 nt, Leptospira interrogans serovar lai str. 56601
ugauuuguaauaguucccacagu

SEQ ID NO: 2771350 - RNA, 19 nt, Leptospira interrogans serovar lai str. 56601
ugauuugugggaguuuuca

SEQ ID NO: 2771351 - RNA, 12 nt, Leptospira interrogans serovar lai str. 56601
ugauuuguuucu

SEQ ID NO: 2771352 - RNA, 22 nt, Leptospira interrogans serovar lai str. 56601
ugauuuuacagacguauuuuua

SEQ ID NO: 2771353 - RNA, 20 nt, Leptospira interrogans serovar lai str. 56601
ugauuuuaccguuuuuaaau

SEQ ID NO: 2771354 - RNA, 22 nt, Leptospira interrogans serovar lai str. 56601
ugauuuuaccguuuuuaaaugu

SEQ ID NO: 2771355 - RNA, 23 nt, Leptospira interrogans serovar lai str. 56601
ugauuuuacgaaccaauucuaaa

SEQ ID NO: 2771356 - RNA, 22 nt, Leptospira interrogans serovar lai str. 56601
ugauuuuagccuggaauucuuu

SEQ ID NO: 2771357 - RNA, 14 nt, Leptospira interrogans serovar lai str. 56601
ugauuuuauaccuu

SEQ ID NO: 2771358 - RNA, 23 nt, Leptospira interrogans serovar lai str. 56601
ugauuuucagggaaaaauaaggu

SEQ ID NO: 2771359 - RNA, 14 nt, Leptospira interrogans serovar lai str. 56601
ugauuuucuuuucc

SEQ ID NO: 2771360 - RNA, 14 nt, Leptospira interrogans serovar lai str. 56601
ugauuuuguuaauu

SEQ ID NO: 2771361 - RNA, 18 nt, Leptospira interrogans serovar lai str. 56601
ugauuuuuccauaaaaaa

SEQ ID NO: 2771362 - RNA, 13 nt, Leptospira interrogans serovar lai str. 56601
ugauuuuucuuua

SEQ ID NO: 2771363 - RNA, 14 nt, Leptospira interrogans serovar lai str. 56601
ugauuuuuuaaaau

SEQ ID NO: 2771364 - RNA, 13 nt, Leptospira interrogans serovar lai str. 56601
ugauuuuuuaaau

SEQ ID NO: 2771365 - RNA, 15 nt, Leptospira interrogans serovar lai str. 56601
ugauuuuuuaaaugu

SEQ ID NO: 2771366 - RNA, 16 nt, Leptospira interrogans serovar lai str. 56601
ugcaaaaaaauaaaau

SEQ ID NO: 2771367 - RNA, 13 nt, Leptospira interrogans serovar lai str. 56601
ugcaaaaaagaaa

SEQ ID NO: 2771368 - RNA, 15 nt, Leptospira interrogans serovar lai str. 56601
ugcaaaaaagaaagc

SEQ ID NO: 2771369 - RNA, 20 nt, Leptospira interrogans serovar lai str. 56601
ugcaaaaaagaaagcagcaa

SEQ ID NO: 2771370 - RNA, 22 nt, Leptospira interrogans serovar lai str. 56601
ugcaaaaaccguuccuuucaag

SEQ ID NO: 2771371 - RNA, 21 nt, Leptospira interrogans serovar lai str. 56601
ugcaaaaaguauguuuuucug

SEQ ID NO: 2771372 - RNA, 13 nt, Leptospira interrogans serovar lai str. 56601
ugcaaaaauagaa

SEQ ID NO: 2771373 - RNA, 15 nt, Leptospira interrogans serovar lai str. 56601
ugcaaaauuuaaaaa

SEQ ID NO: 2771374 - RNA, 14 nt, Leptospira interrogans serovar lai str. 56601
ugcaaagaagaaau

SEQ ID NO: 2771375 - RNA, 15 nt, Leptospira interrogans serovar lai str. 56601
ugcaaagaagaaaua

SEQ ID NO: 2771376 - RNA, 19 nt, Leptospira interrogans serovar lai str. 56601
ugcaaauuacggguauuuu

SEQ ID NO: 2771377 - RNA, 20 nt, Leptospira interrogans serovar lai str. 56601
ugcaaauucaagugauucau

SEQ ID NO: 2771378 - RNA, 19 nt, Leptospira interrogans serovar lai str. 56601
ugcaaauuuuuuucuaaaa

SEQ ID NO: 2771379 - RNA, 19 nt, Leptospira interrogans serovar lai str. 56601
ugcaacgcguuuuaguuuu

SEQ ID NO: 2771380 - RNA, 16 nt, Leptospira interrogans serovar lai str. 56601
ugcuguaaaauuuaga

SEQ ID NO: 2771381 - RNA, 16 nt, Leptospira interrogans serovar lai str. 56601
ugcugucgcaacauaa

SEQ ID NO: 2771382 - RNA, 16 nt, Leptospira interrogans serovar lai str. 56601
ugcuucaaaaagagaa

SEQ ID NO: 2771383 - RNA, 21 nt, Leptospira interrogans serovar lai str. 56601
ugcuucaacacugagucaaca

SEQ ID NO: 2771384 - RNA, 16 nt, Leptospira interrogans serovar lai str. 56601
ugcuucaauuguccgu

SEQ ID NO: 2771385 - RNA, 18 nt, Leptospira interrogans serovar lai str. 56601
ugcuuccauugucuauuu

SEQ ID NO: 2771386 - RNA, 15 nt, Leptospira interrogans serovar lai str. 56601
ugcuucuuuuaaaca

SEQ ID NO: 2771387 - RNA, 19 nt, Leptospira interrogans serovar lai str. 56601
ugcuugagcucccucacgu

SEQ ID NO: 2771388 - RNA, 15 nt, Leptospira interrogans serovar lai str. 56601
ugcuuucucuuuuua

SEQ ID NO: 2771389 - RNA, 17 nt, Leptospira interrogans serovar lai str. 56601
ugcuuugguuuucauaa

SEQ ID NO: 2771390 - RNA, 17 nt, Leptospira interrogans serovar lai str. 56601
ugcuuuguucaaagaaa

SEQ ID NO: 2771391 - RNA, 11 nt, Leptospira interrogans serovar lai str. 56601
uggaaaaguuu

SEQ ID NO: 2771392 - RNA, 20 nt, Leptospira interrogans serovar lai str. 56601
uggaaaaguuuuuaaaaauu

SEQ ID NO: 2771393 - RNA, 11 nt, Leptospira interrogans serovar lai str. 56601
uggaaacguca

SEQ ID NO: 2771394 - RNA, 11 nt, Leptospira interrogans serovar lai str. 56601
uggaaacgucc

SEQ ID NO: 2771395 - RNA, 19 nt, Leptospira interrogans serovar lai str. 56601
uggaaagccccagaacaaa

SEQ ID NO: 2771396 - RNA, 13 nt, Leptospira interrogans serovar lai str. 56601
uggaaaggucuga

SEQ ID NO: 2771397 - RNA, 16 nt, Leptospira interrogans serovar lai str. 56601
uggaaaucuuuuaaaa

SEQ ID NO: 2771398 - RNA, 19 nt, Leptospira interrogans serovar lai str. 56601
uggaaaucuuuuaaaaaag

SEQ ID NO: 2771399 - RNA, 20 nt, Leptospira interrogans serovar lai str. 56601
uggaaaucuuuuaaaaaagg

SEQ ID NO: 2771400 - RNA, 23 nt, Leptospira interrogans serovar lai str. 56601
uggaacuuuaccggguuccauuc

SEQ ID NO: 2771401 - RNA, 17 nt, Leptospira interrogans serovar lai str. 56601
uggaaggacgaacuaca

SEQ ID NO: 2771402 - RNA, 18 nt, Leptospira interrogans serovar lai str. 56601
uggaauauaaaagaauca

SEQ ID NO: 2771403 - RNA, 21 nt, Leptospira interrogans serovar lai str. 56601
uggaauauaauucgauccaaa

SEQ ID NO: 2771404 - RNA, 20 nt, Leptospira interrogans serovar lai str. 56601
uggaaucugaauuuuacaga

SEQ ID NO: 2771405 - RNA, 18 nt, Leptospira interrogans serovar lai str. 56601
uggaaucugcaucuuuuc

SEQ ID NO: 2771406 - RNA, 23 nt, Leptospira interrogans serovar lai str. 56601
uggaauuccgacccagaaaaaac

SEQ ID NO: 2771407 - RNA, 16 nt, Leptospira interrogans serovar lai str. 56601
uggaauucuuuuuuua

SEQ ID NO: 2771408 - RNA, 13 nt, Leptospira interrogans serovar lai str. 56601
uggaauuuuucaa

SEQ ID NO: 2771409 - RNA, 20 nt, Leptospira interrogans serovar lai str. 56601
uggaauuuuucaacaacucu

SEQ ID NO: 2771410 - RNA, 12 nt, Leptospira interrogans serovar lai str. 56601
uggaauuuuuua

SEQ ID NO: 2771411 - RNA, 15 nt, Leptospira interrogans serovar lai str. 56601
uggaauuuuuuaaca

SEQ ID NO: 2771412 - RNA, 20 nt, Leptospira interrogans serovar lai str. 56601
uggacagaauccuuccaaau

SEQ ID NO: 2771413 - RNA, 17 nt, Leptospira interrogans serovar lai str. 56601
uggacagcucuuuugcu

SEQ ID NO: 2771414 - RNA, 19 nt, Leptospira interrogans serovar lai str. 56601
uggacucauaacgugacaa

SEQ ID NO: 2771415 - RNA, 17 nt, Leptospira interrogans serovar lai str. 56601
uggagaaaucuguuuua

SEQ ID NO: 2771416 - RNA, 17 nt, Leptospira interrogans serovar lai str. 56601
uggagaauuaauuuuuc

SEQ ID NO: 2771417 - RNA, 21 nt, Leptospira interrogans serovar lai str. 56601
uggagaauuaauuuuuuaaaa

SEQ ID NO: 2771418 - RNA, 15 nt, Leptospira interrogans serovar lai str. 56601
uggagaauucauuuu

SEQ ID NO: 2771419 - RNA, 17 nt, Leptospira interrogans serovar lai str. 56601
uggagcguucaacagau

SEQ ID NO: 2771420 - RNA, 20 nt, Leptospira interrogans serovar lai str. 56601
uggaggcgguaagguucgga

SEQ ID NO: 2771421 - RNA, 14 nt, Leptospira interrogans serovar lai str. 56601
uggaguuuuuuaaa

SEQ ID NO: 2771422 - RNA, 15 nt, Leptospira interrogans serovar lai str. 56601
uggauaaauuuuaga

SEQ ID NO: 2771423 - RNA, 14 nt, Leptospira interrogans serovar lai str. 56601
uggaucaaaagagu

SEQ ID NO: 2771424 - RNA, 15 nt, Leptospira interrogans serovar lai str. 56601
uggaucaaaagaguu

SEQ ID NO: 2771425 - RNA, 19 nt, Leptospira interrogans serovar lai str. 56601
uggaucggcuccauauucc

SEQ ID NO: 2771426 - RNA, 16 nt, Leptospira interrogans serovar lai str. 56601
uggaucuacuaagauu

SEQ ID NO: 2771427 - RNA, 12 nt, Leptospira interrogans serovar lai str. 56601
uggaugauaaaa

SEQ ID NO: 2771428 - RNA, 17 nt, Leptospira interrogans serovar lai str. 56601
uggaugauaaaaaacga

SEQ ID NO: 2771429 - RNA, 20 nt, Leptospira interrogans serovar lai str. 56601
uggaugauauuucauucuua

SEQ ID NO: 2771430 - RNA, 16 nt, Leptospira interrogans serovar lai str. 56601
uggaugcgcaaacuca

SEQ ID NO: 2771431 - RNA, 19 nt, Leptospira interrogans serovar lai str. 56601
uggaugcgcaaacucagca

SEQ ID NO: 2771432 - RNA, 17 nt, Leptospira interrogans serovar lai str. 56601
uggauucuaucgaacuu

SEQ ID NO: 2771433 - RNA, 22 nt, Leptospira interrogans serovar lai str. 56601
uggauucuuucgacuucuuuuu

SEQ ID NO: 2771434 - RNA, 21 nt, Leptospira interrogans serovar lai str. 56601
uggauugccacgguuaaaugg

SEQ ID NO: 2771435 - RNA, 23 nt, Leptospira interrogans serovar lai str. 56601
uggauugguguuguguuaguucc

SEQ ID NO: 2771436 - RNA, 20 nt, Leptospira interrogans serovar lai str. 56601
uggauuuguaauaguuccca

SEQ ID NO: 2771437 - RNA, 12 nt, Leptospira interrogans serovar lai str. 56601
uggauuuuauuu

SEQ ID NO: 2771438 - RNA, 15 nt, Leptospira interrogans serovar lai str. 56601
uggauuuuauuuuua

SEQ ID NO: 2771439 - RNA, 21 nt, Leptospira interrogans serovar lai str. 56601
uggauuuuuacaccaaacuca

SEQ ID NO: 2771440 - RNA, 14 nt, Leptospira interrogans serovar lai str. 56601
uggauuuuuaugua

SEQ ID NO: 2771441 - RNA, 17 nt, Leptospira interrogans serovar lai str. 56601
uggauuuuuauguaaua

SEQ ID NO: 2771442 - RNA, 23 nt, Leptospira interrogans serovar lai str. 56601
uggcaaaacgauauuuuuuaaaa

SEQ ID NO: 2771443 - RNA, 13 nt, Leptospira interrogans serovar lai str. 56601
uggcaagaggaac

SEQ ID NO: 2771444 - RNA, 19 nt, Leptospira interrogans serovar lai str. 56601
uggcaggaucaaaauccgu

SEQ ID NO: 2771445 - RNA, 15 nt, Leptospira interrogans serovar lai str. 56601
uggccuucuggaaaa

SEQ ID NO: 2771446 - RNA, 17 nt, Leptospira interrogans serovar lai str. 56601
uggccuucuggaaaaau

SEQ ID NO: 2771447 - RNA, 15 nt, Leptospira interrogans serovar lai str. 56601
uggcgacaaaaggau

SEQ ID NO: 2771448 - RNA, 15 nt, Leptospira interrogans serovar lai str. 56601
uggcucaacuuuucc

SEQ ID NO: 2771449 - RNA, 16 nt, Leptospira interrogans serovar lai str. 56601
uggcucaacuuuucca

SEQ ID NO: 2771450 - RNA, 15 nt, Leptospira interrogans serovar lai str. 56601
uggcucauuuuucuu

SEQ ID NO: 2771451 - RNA, 16 nt, Leptospira interrogans serovar lai str. 56601
uggcugagaaccauuu

SEQ ID NO: 2771452 - RNA, 22 nt, Leptospira interrogans serovar lai str. 56601
uggcuucgagucgcgugccuuc

SEQ ID NO: 2771453 - RNA, 23 nt, Leptospira interrogans serovar lai str. 56601
uggcuucuuauuauucucggccu

SEQ ID NO: 2771454 - RNA, 17 nt, Leptospira interrogans serovar lai str. 56601
ugggaacuaccacaaaa

SEQ ID NO: 2771455 - RNA, 15 nt, Leptospira interrogans serovar lai str. 56601
ugggaacuaccacca

SEQ ID NO: 2771456 - RNA, 17 nt, Leptospira interrogans serovar lai str. 56601
ugggaacuacuacaaga

SEQ ID NO: 2771457 - RNA, 18 nt, Leptospira interrogans serovar lai str. 56601
ugggaacuacuauaaauu

SEQ ID NO: 2771458 - RNA, 19 nt, Leptospira interrogans serovar lai str. 56601
ugggaacuacuaugaaaua

SEQ ID NO: 2771459 - RNA, 19 nt, Leptospira interrogans serovar lai str. 56601
ugggaacuauuauaaaaua

SEQ ID NO: 2771460 - RNA, 20 nt, Leptospira interrogans serovar lai str. 56601
ugggaacucucacaaaucau

SEQ ID NO: 2771461 - RNA, 12 nt, Leptospira interrogans serovar lai str. 56601
ugggaaggaauu

SEQ ID NO: 2771462 - RNA, 20 nt, Leptospira interrogans serovar lai str. 56601
ugggaauuacuauggaauau

SEQ ID NO: 2771463 - RNA, 22 nt, Leptospira interrogans serovar lai str. 56601
uguaaucuguggacuuaugaga

SEQ ID NO: 2771464 - RNA, 23 nt, Leptospira interrogans serovar lai str. 56601
uguaaucuuccgcauuuuuauuu

SEQ ID NO: 2771465 - RNA, 13 nt, Leptospira interrogans serovar lai str. 56601
uguaaugaaaucu

SEQ ID NO: 2771466 - RNA, 16 nt, Leptospira interrogans serovar lai str. 56601
uguaaugacgauuuuc

SEQ ID NO: 2771467 - RNA, 18 nt, Leptospira interrogans serovar lai str. 56601
uguaauuagaggauaaac

SEQ ID NO: 2771468 - RNA, 20 nt, Leptospira interrogans serovar lai str. 56601
uguaauuaguguuuaccuuu

SEQ ID NO: 2771469 - RNA, 14 nt, Leptospira interrogans serovar lai str. 56601
uguacaaaaaugug

SEQ ID NO: 2771470 - RNA, 22 nt, Leptospira interrogans serovar lai str. 56601
uguacaacauccuucaaacuuu

SEQ ID NO: 2771471 - RNA, 12 nt, Leptospira interrogans serovar lai str. 56601
uguacaauagag

SEQ ID NO: 2771472 - RNA, 14 nt, Leptospira interrogans serovar lai str. 56601
uguaccauuuugau

SEQ ID NO: 2771473 - RNA, 14 nt, Leptospira interrogans serovar lai str. 56601
uguacgauuccaga

SEQ ID NO: 2771474 - RNA, 14 nt, Leptospira interrogans serovar lai str. 56601
uguacuaaaauuuu

SEQ ID NO: 2771475 - RNA, 16 nt, Leptospira interrogans serovar lai str. 56601
uguacuaaaauuuuau

SEQ ID NO: 2771476 - RNA, 20 nt, Leptospira interrogans serovar lai str. 56601
uguacuaaaauuuuauaaaa

SEQ ID NO: 2771477 - RNA, 13 nt, Leptospira interrogans serovar lai str. 56601
uguacuuaaauuu

SEQ ID NO: 2771478 - RNA, 16 nt, Leptospira interrogans serovar lai str. 56601
uguacuuuuaagaauu

SEQ ID NO: 2771479 - RNA, 13 nt, Leptospira interrogans serovar lai str. 56601
uguagaauaggau

SEQ ID NO: 2771480 - RNA, 13 nt, Leptospira interrogans serovar lai str. 56601
uguagaucaaauc

SEQ ID NO: 2771481 - RNA, 16 nt, Leptospira interrogans serovar lai str. 56601
uguagaucaaaucuga

SEQ ID NO: 2771482 - RNA, 22 nt, Leptospira interrogans serovar lai str. 56601
uguaggaacuacagcaaaucac

SEQ ID NO: 2771483 - RNA, 13 nt, Leptospira interrogans serovar lai str. 56601
uguaggaacuacu

SEQ ID NO: 2771484 - RNA, 20 nt, Leptospira interrogans serovar lai str. 56601
uguaggaacucauacuuuua

SEQ ID NO: 2771485 - RNA, 17 nt, Leptospira interrogans serovar lai str. 56601
uguaguaucucuuguca

SEQ ID NO: 2771486 - RNA, 20 nt, Leptospira interrogans serovar lai str. 56601
uguaguucuacauucaauuu

SEQ ID NO: 2771487 - RNA, 18 nt, Leptospira interrogans serovar lai str. 56601
uguauaaaaauaauacaa

SEQ ID NO: 2771488 - RNA, 19 nt, Leptospira interrogans serovar lai str. 56601
uguauaaaagaaacauaau

SEQ ID NO: 2771489 - RNA, 16 nt, Leptospira interrogans serovar lai str. 56601
uguauaaaguauagaa

SEQ ID NO: 2771490 - RNA, 19 nt, Leptospira interrogans serovar lai str. 56601
uguauacaggaaacauuau

SEQ ID NO: 2771491 - RNA, 21 nt, Leptospira interrogans serovar lai str. 56601
uguauagaaaccgauuuuaau

SEQ ID NO: 2771492 - RNA, 13 nt, Leptospira interrogans serovar lai str. 56601
uguauauaaauuu

SEQ ID NO: 2771493 - RNA, 16 nt, Leptospira interrogans serovar lai str. 56601
uguauauuuuuuuaau

SEQ ID NO: 2771494 - RNA, 16 nt, Leptospira interrogans serovar lai str. 56601
uguaucucaagauuaa

SEQ ID NO: 2771495 - RNA, 20 nt, Leptospira interrogans serovar lai str. 56601
uguaugaguuccuacauguu

SEQ ID NO: 2771496 - RNA, 19 nt, Leptospira interrogans serovar lai str. 56601
uguaugauuuauaguuuuu

SEQ ID NO: 2771497 - RNA, 20 nt, Leptospira interrogans serovar lai str. 56601
uguaugcaggaaacauaaua

SEQ ID NO: 2771498 - RNA, 20 nt, Leptospira interrogans serovar lai str. 56601
uguauggcucauuuuucuua

SEQ ID NO: 2771499 - RNA, 12 nt, Leptospira interrogans serovar lai str. 56601
uguauuaaaaaa

SEQ ID NO: 2771500 - RNA, 15 nt, Leptospira interrogans serovar lai str. 56601
uguauuacucagagu

SEQ ID NO: 2771501 - RNA, 22 nt, Leptospira interrogans serovar lai str. 56601
uguauuacucagaguuauauaa

SEQ ID NO: 2771502 - RNA, 16 nt, Leptospira interrogans serovar lai str. 56601
uguauucuauaaaauu

SEQ ID NO: 2771503 - RNA, 15 nt, Leptospira interrogans serovar lai str. 56601
uguauuuauucaaaa

SEQ ID NO: 2771504 - RNA, 19 nt, Leptospira interrogans serovar lai str. 56601
uguauuugcggaaucaauu

SEQ ID NO: 2771505 - RNA, 21 nt, Leptospira interrogans serovar lai str. 56601
uguauuugcggaaucaauuuu

SEQ ID NO: 2771506 - RNA, 17 nt, Leptospira interrogans serovar lai str. 56601
uguauuuuaaaccaguu

SEQ ID NO: 2771507 - RNA, 18 nt, Leptospira interrogans serovar lai str. 56601
uguauuuuauuuuuggau

SEQ ID NO: 2771508 - RNA, 19 nt, Leptospira interrogans serovar lai str. 56601
uguauuuuauuuuuggauc

SEQ ID NO: 2771509 - RNA, 14 nt, Leptospira interrogans serovar lai str. 56601
uguauuuuuaaguu

SEQ ID NO: 2771510 - RNA, 18 nt, Leptospira interrogans serovar lai str. 56601
ugucaaaugcgacuuaau

SEQ ID NO: 2771511 - RNA, 20 nt, Leptospira interrogans serovar lai str. 56601
ugucaagcgacgauagaagc

SEQ ID NO: 2771512 - RNA, 16 nt, Leptospira interrogans serovar lai str. 56601
ugucaauuuuccagau

SEQ ID NO: 2771513 - RNA, 18 nt, Leptospira interrogans serovar lai str. 56601
ugucauaaaccgauuuuc

SEQ ID NO: 2771514 - RNA, 21 nt, Leptospira interrogans serovar lai str. 56601
ugucauguuuuaaugaaaaau

SEQ ID NO: 2771515 - RNA, 17 nt, Leptospira interrogans serovar lai str. 56601
ugucccaaaaacucaaa

SEQ ID NO: 2771516 - RNA, 15 nt, Leptospira interrogans serovar lai str. 56601
ugucccaaaacuuca

SEQ ID NO: 2771517 - RNA, 19 nt, Leptospira interrogans serovar lai str. 56601
ugucccaaaauuucuaaag

SEQ ID NO: 2771518 - RNA, 21 nt, Leptospira interrogans serovar lai str. 56601
uguccuaaaaccucaaaaaau

SEQ ID NO: 2771519 - RNA, 22 nt, Leptospira interrogans serovar lai str. 56601
uguccuaaaaccucaaaaaauu

SEQ ID NO: 2771520 - RNA, 13 nt, Leptospira interrogans serovar lai str. 56601
uguccuaaaauuu

SEQ ID NO: 2771521 - RNA, 21 nt, Leptospira interrogans serovar lai str. 56601
uguccuaaaauuuuaaaaaau

SEQ ID NO: 2771522 - RNA, 14 nt, Leptospira interrogans serovar lai str. 56601
ugucgcaacauaau

SEQ ID NO: 2771523 - RNA, 18 nt, Leptospira interrogans serovar lai str. 56601
ugucgcaacauaauguuu

SEQ ID NO: 2771524 - RNA, 21 nt, Leptospira interrogans serovar lai str. 56601
ugucggaacacuugaaaaaug

SEQ ID NO: 2771525 - RNA, 22 nt, Leptospira interrogans serovar lai str. 56601
ugucguaacuccgacagauuua

SEQ ID NO: 2771526 - RNA, 15 nt, Leptospira interrogans serovar lai str. 56601
ugucguacuaaaauu

SEQ ID NO: 2771527 - RNA, 21 nt, Leptospira interrogans serovar lai str. 56601
ugucguacuaaaauuaaaaau

SEQ ID NO: 2771528 - RNA, 15 nt, Leptospira interrogans serovar lai str. 56601
ugucguuuaacaaaa

SEQ ID NO: 2771529 - RNA, 21 nt, Leptospira interrogans serovar lai str. 56601
ugucuacgaucgcaacauaau

SEQ ID NO: 2771530 - RNA, 14 nt, Leptospira interrogans serovar lai str. 56601
ugucucaaaauuua

SEQ ID NO: 2771531 - RNA, 19 nt, Leptospira interrogans serovar lai str. 56601
ugucuccugucaauuuucc

SEQ ID NO: 2771532 - RNA, 15 nt, Leptospira interrogans serovar lai str. 56601
ugucucuaauacaug

SEQ ID NO: 2771533 - RNA, 16 nt, Leptospira interrogans serovar lai str. 56601
ugucucuacucuugaa

SEQ ID NO: 2771534 - RNA, 13 nt, Leptospira interrogans serovar lai str. 56601
ugucucuuuauau

SEQ ID NO: 2771535 - RNA, 21 nt, Leptospira interrogans serovar lai str. 56601
ugucucuuuauauaaaauuug

SEQ ID NO: 2771536 - RNA, 16 nt, Leptospira interrogans serovar lai str. 56601
ugucuguaaaaugaug

SEQ ID NO: 2771537 - RNA, 22 nt, Leptospira interrogans serovar lai str. 56601
ugucuguaaaaugaugugggaa

SEQ ID NO: 2771538 - RNA, 12 nt, Leptospira interrogans serovar lai str. 56601
ugucuuaaaauu

SEQ ID NO: 2771539 - RNA, 14 nt, Leptospira interrogans serovar lai str. 56601
ugucuugaaauucu

SEQ ID NO: 2771540 - RNA, 19 nt, Leptospira interrogans serovar lai str. 56601
ugucuugaauuacaauuga

SEQ ID NO: 2771541 - RNA, 18 nt, Leptospira interrogans serovar lai str. 56601
ugucuugccauuuccaau

SEQ ID NO: 2771542 - RNA, 14 nt, Leptospira interrogans serovar lai str. 56601
ugucuuuaaaauug

SEQ ID NO: 2771543 - RNA, 16 nt, Leptospira interrogans serovar lai str. 56601
ugucuuuaauuucaau

SEQ ID NO: 2771544 - RNA, 16 nt, Leptospira interrogans serovar lai str. 56601
ugucuuuucaaucucc

SEQ ID NO: 2771545 - RNA, 16 nt, Leptospira interrogans serovar lai str. 56601
ugugaaccuuuaagca

SEQ ID NO: 2771546 - RNA, 16 nt, Leptospira interrogans serovar lai str. 56601
uguugaaaaauuucau

SEQ ID NO: 2771547 - RNA, 19 nt, Leptospira interrogans serovar lai str. 56601
uguugaaaagugaguuuuc

SEQ ID NO: 2771548 - RNA, 18 nt, Leptospira interrogans serovar lai str. 56601
uguugaauaucuaauauu

SEQ ID NO: 2771549 - RNA, 20 nt, Leptospira interrogans serovar lai str. 56601
uguugagcgacccuagaagc

SEQ ID NO: 2771550 - RNA, 14 nt, Leptospira interrogans serovar lai str. 56601
uguugaguuucuuu

SEQ ID NO: 2771551 - RNA, 16 nt, Leptospira interrogans serovar lai str. 56601
uguugcaauacauucu

SEQ ID NO: 2771552 - RNA, 22 nt, Leptospira interrogans serovar lai str. 56601
uguugcuauggaauuuuucaac

SEQ ID NO: 2771553 - RNA, 19 nt, Leptospira interrogans serovar lai str. 56601
uguuggugaguccuuccgu

SEQ ID NO: 2771554 - RNA, 15 nt, Leptospira interrogans serovar lai str. 56601
uguuguuauggaauu

SEQ ID NO: 2771555 - RNA, 13 nt, Leptospira interrogans serovar lai str. 56601
uguuguuuaaaau

SEQ ID NO: 2771556 - RNA, 16 nt, Leptospira interrogans serovar lai str. 56601
uguuuaauaaagauuc

SEQ ID NO: 2771557 - RNA, 15 nt, Leptospira interrogans serovar lai str. 56601
uguuuaauuuuaaag

SEQ ID NO: 2771558 - RNA, 19 nt, Leptospira interrogans serovar lai str. 56601
uguuuacccgauauuaaaa

SEQ ID NO: 2771559 - RNA, 21 nt, Leptospira interrogans serovar lai str. 56601
uguuuagaacagaaugucuua

SEQ ID NO: 2771560 - RNA, 17 nt, Leptospira interrogans serovar lai str. 56601
uguuuaggaauuuuuua

SEQ ID NO: 2771561 - RNA, 19 nt, Leptospira interrogans serovar lai str. 56601
uguuuaggaauuuuuuaaa

SEQ ID NO: 2771562 - RNA, 20 nt, Leptospira interrogans serovar lai str. 56601
uguuuaggaauuuuuuaaac

SEQ ID NO: 2771563 - RNA, 14 nt, Leptospira interrogans serovar lai str. 56601
uguuuauaaaacug

SEQ ID NO: 2771564 - RNA, 14 nt, Leptospira interrogans serovar lai str. 56601
uguuuauaauuuuu

SEQ ID NO: 2771565 - RNA, 14 nt, Leptospira interrogans serovar lai str. 56601
uguuuauuuugaau

SEQ ID NO: 2771566 - RNA, 14 nt, Leptospira interrogans serovar lai str. 56601
uguuucaaaaguua

SEQ ID NO: 2771567 - RNA, 18 nt, Leptospira interrogans serovar lai str. 56601
uguuucaaaaguuagaau

SEQ ID NO: 2771568 - RNA, 18 nt, Leptospira interrogans serovar lai str. 56601
uguuucaguauucuagaa

SEQ ID NO: 2771569 - RNA, 21 nt, Leptospira interrogans serovar lai str. 56601
uguuucauguccggguuagaa

SEQ ID NO: 2771570 - RNA, 22 nt, Leptospira interrogans serovar lai str. 56601
uguuucauguccggguuagaau

SEQ ID NO: 2771571 - RNA, 21 nt, Leptospira interrogans serovar lai str. 56601
uguuucccaguucuuaaauaa

SEQ ID NO: 2771572 - RNA, 14 nt, Leptospira interrogans serovar lai str. 56601
uguuuccucuugaa

SEQ ID NO: 2771573 - RNA, 20 nt, Leptospira interrogans serovar lai str. 56601
uguuuccuucuuucugaaau

SEQ ID NO: 2771574 - RNA, 18 nt, Leptospira interrogans serovar lai str. 56601
uguuucgacguaaaaaua

SEQ ID NO: 2771575 - RNA, 17 nt, Leptospira interrogans serovar lai str. 56601
uguuucgcuaaagugug

SEQ ID NO: 2771576 - RNA, 12 nt, Leptospira interrogans serovar lai str. 56601
uguuucuaaaac

SEQ ID NO: 2771577 - RNA, 14 nt, Leptospira interrogans serovar lai str. 56601
uguuucuauuuuau

SEQ ID NO: 2771578 - RNA, 15 nt, Leptospira interrogans serovar lai str. 56601
uguuucuauuuuaug

SEQ ID NO: 2771579 - RNA, 19 nt, Leptospira interrogans serovar lai str. 56601
uguuucuauuuuauguaaa

SEQ ID NO: 2771580 - RNA, 20 nt, Leptospira interrogans serovar lai str. 56601
uguuucuugugucaagcccu

SEQ ID NO: 2771581 - RNA, 13 nt, Leptospira interrogans serovar lai str. 56601
uguuucuuuauca

SEQ ID NO: 2771582 - RNA, 16 nt, Leptospira interrogans serovar lai str. 56601
uguuugaaaaaaugua

SEQ ID NO: 2771583 - RNA, 13 nt, Leptospira interrogans serovar lai str. 56601
uguuugaauuuuu

SEQ ID NO: 2771584 - RNA, 17 nt, Leptospira interrogans serovar lai str. 56601
uguuugaauuuuuaaga

SEQ ID NO: 2771585 - RNA, 19 nt, Leptospira interrogans serovar lai str. 56601
uguuugagguuuuaaaagu

SEQ ID NO: 2771586 - RNA, 20 nt, Leptospira interrogans serovar lai str. 56601
uguuugauaauuugugaacu

SEQ ID NO: 2771587 - RNA, 13 nt, Leptospira interrogans serovar lai str. 56601
uguuuguaaaauu

SEQ ID NO: 2771588 - RNA, 14 nt, Leptospira interrogans serovar lai str. 56601
uguuugucuuuuuc

SEQ ID NO: 2771589 - RNA, 17 nt, Leptospira interrogans serovar lai str. 56601
uguuuguuauaagaauu

SEQ ID NO: 2771590 - RNA, 19 nt, Leptospira interrogans serovar lai str. 56601
uguuuuaaugaaaaauuuc

SEQ ID NO: 2771591 - RNA, 19 nt, Leptospira interrogans serovar lai str. 56601
uguuuuagaaucuagacgu

SEQ ID NO: 2771592 - RNA, 14 nt, Leptospira interrogans serovar lai str. 56601
uguuuuaguucaaa

SEQ ID NO: 2771593 - RNA, 20 nt, Leptospira interrogans serovar lai str. 56601
uguuuuaguucaaaaacauc

SEQ ID NO: 2771594 - RNA, 23 nt, Leptospira interrogans serovar lai str. 56601
uguuuuauucuaaacaaaauguc

SEQ ID NO: 2771595 - RNA, 21 nt, Leptospira interrogans serovar lai str. 56601
uguuuucuacaaauaaaacuu

SEQ ID NO: 2771596 - RNA, 16 nt, Leptospira interrogans serovar lai str. 56601
uguuuucuuuucuucu

SEQ ID NO: 2771597 - RNA, 22 nt, Leptospira interrogans serovar lai str. 56601
uguuuugcgauuauuaucaaaa

SEQ ID NO: 2771598 - RNA, 20 nt, Leptospira interrogans serovar lai str. 56601
uguuuugcucuaaaauaauu

SEQ ID NO: 2771599 - RNA, 21 nt, Leptospira interrogans serovar lai str. 56601
uguuuuggcucuugcuaaaau

SEQ ID NO: 2771600 - RNA, 18 nt, Leptospira interrogans serovar lai str. 56601
uguuuuguagagucaaaa

SEQ ID NO: 2771601 - RNA, 13 nt, Leptospira interrogans serovar lai str. 56601
uguuuuuaaaauu

SEQ ID NO: 2771602 - RNA, 14 nt, Leptospira interrogans serovar lai str. 56601
uguuuuuaaaauug

SEQ ID NO: 2771603 - RNA, 18 nt, Leptospira interrogans serovar lai str. 56601
uguuuuuaaauuaauauu

SEQ ID NO: 2771604 - RNA, 13 nt, Leptospira interrogans serovar lai str. 56601
uguuuuuauaaau

SEQ ID NO: 2771605 - RNA, 19 nt, Leptospira interrogans serovar lai str. 56601
uguuuuuauaaauaaaaga

SEQ ID NO: 2771606 - RNA, 21 nt, Leptospira interrogans serovar lai str. 56601
uguuuuuauaucuuaauuaaa

SEQ ID NO: 2771607 - RNA, 12 nt, Leptospira interrogans serovar lai str. 56601
uguuuuucgaau

SEQ ID NO: 2771608 - RNA, 21 nt, Leptospira interrogans serovar lai str. 56601
uguuuuucuugcuaacauccc

SEQ ID NO: 2771609 - RNA, 23 nt, Leptospira interrogans serovar lai str. 56601
uguuuuugaaacauuucuaaaau

SEQ ID NO: 2771610 - RNA, 14 nt, Leptospira interrogans serovar lai str. 56601
uguuuuuuauggaa

SEQ ID NO: 2771611 - RNA, 15 nt, Leptospira interrogans serovar lai str. 56601
uguuuuuuauggaaa

SEQ ID NO: 2771612 - RNA, 14 nt, Leptospira interrogans serovar lai str. 56601
uguuuuuuauuuaa

SEQ ID NO: 2771613 - RNA, 13 nt, Leptospira interrogans serovar lai str. 56601
uguuuuuuccagc

SEQ ID NO: 2771614 - RNA, 14 nt, Leptospira interrogans serovar lai str. 56601
uguuuuuuuggaua

SEQ ID NO: 2771615 - RNA, 17 nt, Leptospira interrogans serovar lai str. 56601
uuaaaaaaaugauuucc

SEQ ID NO: 2771616 - RNA, 12 nt, Leptospira interrogans serovar lai str. 56601
uuaaaaaacuau

SEQ ID NO: 2771617 - RNA, 16 nt, Leptospira interrogans serovar lai str. 56601
uuaaaaaacuuuuuaa

SEQ ID NO: 2771618 - RNA, 17 nt, Leptospira interrogans serovar lai str. 56601
uuaaaaaagagaaagaa

SEQ ID NO: 2771619 - RNA, 21 nt, Leptospira interrogans serovar lai str. 56601
uuaaaaaagagaaagaaaaag

SEQ ID NO: 2771620 - RNA, 23 nt, Leptospira interrogans serovar lai str. 56601
uuaaaaaagauaagucuaacgug

SEQ ID NO: 2771621 - RNA, 23 nt, Leptospira interrogans serovar lai str. 56601
uuaaaaaauuaauucuccaucua

SEQ ID NO: 2771622 - RNA, 21 nt, Leptospira interrogans serovar lai str. 56601
uuaaaaaauucaauucaucug

SEQ ID NO: 2771623 - RNA, 10 nt, Leptospira interrogans serovar lai str. 56601
uuaaaaacaa

SEQ ID NO: 2771624 - RNA, 21 nt, Leptospira interrogans serovar lai str. 56601
uuaaaaacucuaccuuuauuu

SEQ ID NO: 2771625 - RNA, 17 nt, Leptospira interrogans serovar lai str. 56601
uuaaaaacuugaaucga

SEQ ID NO: 2771626 - RNA, 11 nt, Leptospira interrogans serovar lai str. 56601
uuaaaaaguag

SEQ ID NO: 2771627 - RNA, 19 nt, Leptospira interrogans serovar lai str. 56601
uuaaaaaguuuuucuaaau

SEQ ID NO: 2771628 - RNA, 18 nt, Leptospira interrogans serovar lai str. 56601
uuaaaaauaguauuuugu

SEQ ID NO: 2771629 - RNA, 17 nt, Leptospira interrogans serovar lai str. 56601
uuaaaugugggaacuac

SEQ ID NO: 2771630 - RNA, 13 nt, Leptospira interrogans serovar lai str. 56601
uuaaauguucaaa

SEQ ID NO: 2771631 - RNA, 11 nt, Leptospira interrogans serovar lai str. 56601
uuaaauuaaua

SEQ ID NO: 2771632 - RNA, 14 nt, Leptospira interrogans serovar lai str. 56601
uuaaauuagauauu

SEQ ID NO: 2771633 - RNA, 20 nt, Leptospira interrogans serovar lai str. 56601
uuaaauuagcuuaagaauuu

SEQ ID NO: 2771634 - RNA, 13 nt, Leptospira interrogans serovar lai str. 56601
uuaaauuauauuu

SEQ ID NO: 2771635 - RNA, 14 nt, Leptospira interrogans serovar lai str. 56601
uuaaauucaucaau

SEQ ID NO: 2771636 - RNA, 21 nt, Leptospira interrogans serovar lai str. 56601
uuaaauucccucaauaaucca

SEQ ID NO: 2771637 - RNA, 14 nt, Leptospira interrogans serovar lai str. 56601
uuaaauucuaaaaa

SEQ ID NO: 2771638 - RNA, 21 nt, Leptospira interrogans serovar lai str. 56601
uuaaauucuaaaaaaauacga

SEQ ID NO: 2771639 - RNA, 22 nt, Leptospira interrogans serovar lai str. 56601
uuaaauucuagcgucuaaaaaa

SEQ ID NO: 2771640 - RNA, 12 nt, Leptospira interrogans serovar lai str. 56601
uuaaauugaaac

SEQ ID NO: 2771641 - RNA, 15 nt, Leptospira interrogans serovar lai str. 56601
uuaaauuguaugaaa

SEQ ID NO: 2771642 - RNA, 16 nt, Leptospira interrogans serovar lai str. 56601
uuaaauuguaugcagu

SEQ ID NO: 2771643 - RNA, 22 nt, Leptospira interrogans serovar lai str. 56601
uuaaauuguucguuucuuaauu

SEQ ID NO: 2771644 - RNA, 15 nt, Leptospira interrogans serovar lai str. 56601
uuaaauuuauaauga

SEQ ID NO: 2771645 - RNA, 18 nt, Leptospira interrogans serovar lai str. 56601
uuaaauuuuauuuauaua

SEQ ID NO: 2771646 - RNA, 22 nt, Leptospira interrogans serovar lai str. 56601
uuaaauuuugaaaaauuccaua

SEQ ID NO: 2771647 - RNA, 18 nt, Leptospira interrogans serovar lai str. 56601
uuaaauuuuuugcaaaaa

SEQ ID NO: 2771648 - RNA, 19 nt, Leptospira interrogans serovar lai str. 56601
uuaaauuuuuugcaaaaaa

SEQ ID NO: 2771649 - RNA, 20 nt, Leptospira interrogans serovar lai str. 56601
uuaaauuuuuugcaaaaaaa

SEQ ID NO: 2771650 - RNA, 21 nt, Leptospira interrogans serovar lai str. 56601
uuaaauuuuuugcaaaaaaau

SEQ ID NO: 2771651 - RNA, 22 nt, Leptospira interrogans serovar lai str. 56601
uuaaauuuuuugcaaaaaaaua

SEQ ID NO: 2771652 - RNA, 23 nt, Leptospira interrogans serovar lai str. 56601
uuaaauuuuuugcaaaaaaauaa

SEQ ID NO: 2771653 - RNA, 13 nt, Leptospira interrogans serovar lai str. 56601
uuaacaaaacugc

SEQ ID NO: 2771654 - RNA, 13 nt, Leptospira interrogans serovar lai str. 56601
uuaacaaucaauu

SEQ ID NO: 2771655 - RNA, 17 nt, Leptospira interrogans serovar lai str. 56601
uuaacaaucguacgaau

SEQ ID NO: 2771656 - RNA, 13 nt, Leptospira interrogans serovar lai str. 56601
uuaacaguauuca

SEQ ID NO: 2771657 - RNA, 14 nt, Leptospira interrogans serovar lai str. 56601
uuaacaucaaagaa

SEQ ID NO: 2771658 - RNA, 23 nt, Leptospira interrogans serovar lai str. 56601
uuaacauuuguuuuuuauaauuu

SEQ ID NO: 2771659 - RNA, 16 nt, Leptospira interrogans serovar lai str. 56601
uuaacgacauuagaac

SEQ ID NO: 2771660 - RNA, 17 nt, Leptospira interrogans serovar lai str. 56601
uuaacguuuucuaucuu

SEQ ID NO: 2771661 - RNA, 22 nt, Leptospira interrogans serovar lai str. 56601
uuaacuacacgagagcugcuug

SEQ ID NO: 2771662 - RNA, 17 nt, Leptospira interrogans serovar lai str. 56601
uuaacucccugauaacu

SEQ ID NO: 2771663 - RNA, 18 nt, Leptospira interrogans serovar lai str. 56601
uuaacucguuagagaaaa

SEQ ID NO: 2771664 - RNA, 22 nt, Leptospira interrogans serovar lai str. 56601
uuaacuguaauuagaggauaaa

SEQ ID NO: 2771665 - RNA, 13 nt, Leptospira interrogans serovar lai str. 56601
uuaacuuuuauuc

SEQ ID NO: 2771666 - RNA, 23 nt, Leptospira interrogans serovar lai str. 56601
uuaagaaaacucaaaucuacaaa

SEQ ID NO: 2771667 - RNA, 14 nt, Leptospira interrogans serovar lai str. 56601
uuaagaaagacuuu

SEQ ID NO: 2771668 - RNA, 19 nt, Leptospira interrogans serovar lai str. 56601
uuaagaacaauuuaaaaua

SEQ ID NO: 2771669 - RNA, 20 nt, Leptospira interrogans serovar lai str. 56601
uuaagaacaauuuaaaauaa

SEQ ID NO: 2771670 - RNA, 14 nt, Leptospira interrogans serovar lai str. 56601
uuaagaauaaauaa

SEQ ID NO: 2771671 - RNA, 15 nt, Leptospira interrogans serovar lai str. 56601
uuaagacccuaaaaa

SEQ ID NO: 2771672 - RNA, 20 nt, Leptospira interrogans serovar lai str. 56601
uuaagacccuaaaaaauuuu

SEQ ID NO: 2771673 - RNA, 17 nt, Leptospira interrogans serovar lai str. 56601
uuaagagaugugaguuu

SEQ ID NO: 2771674 - RNA, 21 nt, Leptospira interrogans serovar lai str. 56601
uuaagagaugugaguuuuaaa

SEQ ID NO: 2771675 - RNA, 17 nt, Leptospira interrogans serovar lai str. 56601
uuaagagccuacaaauc

SEQ ID NO: 2771676 - RNA, 20 nt, Leptospira interrogans serovar lai str. 56601
uuaagagucauuuuuaaaua

SEQ ID NO: 2771677 - RNA, 15 nt, Leptospira interrogans serovar lai str. 56601
uuaagauuauauuau

SEQ ID NO: 2771678 - RNA, 18 nt, Leptospira interrogans serovar lai str. 56601
uuaagcaaagauuaagua

SEQ ID NO: 2771679 - RNA, 19 nt, Leptospira interrogans serovar lai str. 56601
uuaagcgggaauuuaaguu

SEQ ID NO: 2771680 - RNA, 18 nt, Leptospira interrogans serovar lai str. 56601
uuaagcucgaauaaaaac

SEQ ID NO: 2771681 - RNA, 13 nt, Leptospira interrogans serovar lai str. 56601
uuaaguaggaacu

SEQ ID NO: 2771682 - RNA, 19 nt, Leptospira interrogans serovar lai str. 56601
uuaaguauuguuaagauaa

SEQ ID NO: 2771683 - RNA, 17 nt, Leptospira interrogans serovar lai str. 56601
uuaagucacauuguguu

SEQ ID NO: 2771684 - RNA, 15 nt, Leptospira interrogans serovar lai str. 56601
uuaaguucaaaaaaa

SEQ ID NO: 2771685 - RNA, 15 nt, Leptospira interrogans serovar lai str. 56601
uuaaguucuuuaguu

SEQ ID NO: 2771686 - RNA, 18 nt, Leptospira interrogans serovar lai str. 56601
uuaaguucuuuaguuguu

SEQ ID NO: 2771687 - RNA, 14 nt, Leptospira interrogans serovar lai str. 56601
uuaaguuugugaga

SEQ ID NO: 2771688 - RNA, 21 nt, Leptospira interrogans serovar lai str. 56601
uuaaguuugugagaguuccca

SEQ ID NO: 2771689 - RNA, 13 nt, Leptospira interrogans serovar lai str. 56601
uuaauaaaaaaau

SEQ ID NO: 2771690 - RNA, 15 nt, Leptospira interrogans serovar lai str. 56601
uuaauaaaauacagu

SEQ ID NO: 2771691 - RNA, 16 nt, Leptospira interrogans serovar lai str. 56601
uuaauaaaaugcagua

SEQ ID NO: 2771692 - RNA, 18 nt, Leptospira interrogans serovar lai str. 56601
uuaauaaaauuuuuaaaa

SEQ ID NO: 2771693 - RNA, 19 nt, Leptospira interrogans serovar lai str. 56601
uuaauaaaauuuuuaaaaa

SEQ ID NO: 2771694 - RNA, 20 nt, Leptospira interrogans serovar lai str. 56601
uuaauaaaauuuuuaaaaaa

SEQ ID NO: 2771695 - RNA, 20 nt, Leptospira interrogans serovar lai str. 56601
uuaauaaauugcauaaaaga

SEQ ID NO: 2771696 - RNA, 14 nt, Leptospira interrogans serovar lai str. 56601
uuaauaaauuguau

SEQ ID NO: 2771697 - RNA, 17 nt, Leptospira interrogans serovar lai str. 56601
uuaauaaauuguauaca

SEQ ID NO: 2771698 - RNA, 22 nt, Leptospira interrogans serovar lai str. 56601
uuaauaaauuguauacaggaaa

SEQ ID NO: 2771699 - RNA, 13 nt, Leptospira interrogans serovar lai str. 56601
uuaauaacucuau

SEQ ID NO: 2771700 - RNA, 15 nt, Leptospira interrogans serovar lai str. 56601
uuaauaagcugaaca

SEQ ID NO: 2771701 - RNA, 14 nt, Leptospira interrogans serovar lai str. 56601
uuaauaauucaaaa

SEQ ID NO: 2771702 - RNA, 15 nt, Leptospira interrogans serovar lai str. 56601
uuaauaauucaaaau

SEQ ID NO: 2771703 - RNA, 13 nt, Leptospira interrogans serovar lai str. 56601
uuaauacaaaaaa

SEQ ID NO: 2771704 - RNA, 14 nt, Leptospira interrogans serovar lai str. 56601
uuaauacaaaaaac

SEQ ID NO: 2771705 - RNA, 15 nt, Leptospira interrogans serovar lai str. 56601
uuaauacaaaaaacu

SEQ ID NO: 2771706 - RNA, 17 nt, Leptospira interrogans serovar lai str. 56601
uuaauacaaaaaacuga

SEQ ID NO: 2771707 - RNA, 17 nt, Leptospira interrogans serovar lai str. 56601
uuaauacgaauuuaacu

SEQ ID NO: 2771708 - RNA, 22 nt, Leptospira interrogans serovar lai str. 56601
uuaauaggauuuuagaaugaga

SEQ ID NO: 2771709 - RNA, 15 nt, Leptospira interrogans serovar lai str. 56601
uuaauauaaaaaaua

SEQ ID NO: 2771710 - RNA, 18 nt, Leptospira interrogans serovar lai str. 56601
uuaauauaaaaaauaaua

SEQ ID NO: 2771711 - RNA, 21 nt, Leptospira interrogans serovar lai str. 56601
uuaauauaaaaaauaauauua

SEQ ID NO: 2771712 - RNA, 16 nt, Leptospira interrogans serovar lai str. 56601
uuaccgauaagucuag

SEQ ID NO: 2771713 - RNA, 15 nt, Leptospira interrogans serovar lai str. 56601
uuaccggguuccauu

SEQ ID NO: 2771714 - RNA, 14 nt, Leptospira interrogans serovar lai str. 56601
uuaccguuuuuaaa

SEQ ID NO: 2771715 - RNA, 14 nt, Leptospira interrogans serovar lai str. 56601
uuaccuaaaauuca

SEQ ID NO: 2771716 - RNA, 15 nt, Leptospira interrogans serovar lai str. 56601
uuaccuccuccuucu

SEQ ID NO: 2771717 - RNA, 14 nt, Leptospira interrogans serovar lai str. 56601
uuaccuccuuuuuc

SEQ ID NO: 2771718 - RNA, 16 nt, Leptospira interrogans serovar lai str. 56601
uuaccuugaaacuuuu

SEQ ID NO: 2771719 - RNA, 17 nt, Leptospira interrogans serovar lai str. 56601
uuaccuugaaacuuuua

SEQ ID NO: 2771720 - RNA, 15 nt, Leptospira interrogans serovar lai str. 56601
uuacgaaaacuauuu

SEQ ID NO: 2771721 - RNA, 23 nt, Leptospira interrogans serovar lai str. 56601
uuacgaaaauuuuuuauuuuaug

SEQ ID NO: 2771722 - RNA, 17 nt, Leptospira interrogans serovar lai str. 56601
uuacgacaaguccucua

SEQ ID NO: 2771723 - RNA, 16 nt, Leptospira interrogans serovar lai str. 56601
uuacgacgcgauucau

SEQ ID NO: 2771724 - RNA, 20 nt, Leptospira interrogans serovar lai str. 56601
uuacgacuuuauucaaaaua

SEQ ID NO: 2771725 - RNA, 17 nt, Leptospira interrogans serovar lai str. 56601
uuacgaucuaaaaggac

SEQ ID NO: 2771726 - RNA, 22 nt, Leptospira interrogans serovar lai str. 56601
uuacgcaugauaaaaauuguua

SEQ ID NO: 2771727 - RNA, 16 nt, Leptospira interrogans serovar lai str. 56601
uuacgcugaguuugag

SEQ ID NO: 2771728 - RNA, 16 nt, Leptospira interrogans serovar lai str. 56601
uuacggaucaaaauuc

SEQ ID NO: 2771729 - RNA, 17 nt, Leptospira interrogans serovar lai str. 56601
uuacggcauuuuuuaaa

SEQ ID NO: 2771730 - RNA, 23 nt, Leptospira interrogans serovar lai str. 56601
uuacggggaauuuuuacauuuuc

SEQ ID NO: 2771731 - RNA, 17 nt, Leptospira interrogans serovar lai str. 56601
uuacguaaugugaguuc

SEQ ID NO: 2771732 - RNA, 17 nt, Leptospira interrogans serovar lai str. 56601
uuacgugauaauucuuu

SEQ ID NO: 2771733 - RNA, 20 nt, Leptospira interrogans serovar lai str. 56601
uuacgugauaauucuuuaga

SEQ ID NO: 2771734 - RNA, 12 nt, Leptospira interrogans serovar lai str. 56601
uuacuaaaaaac

SEQ ID NO: 2771735 - RNA, 14 nt, Leptospira interrogans serovar lai str. 56601
uuacuaaaaauuca

SEQ ID NO: 2771736 - RNA, 17 nt, Leptospira interrogans serovar lai str. 56601
uuacuacgucuucuaaa

SEQ ID NO: 2771737 - RNA, 22 nt, Leptospira interrogans serovar lai str. 56601
uuacuacucggaugcauaaaua

SEQ ID NO: 2771738 - RNA, 20 nt, Leptospira interrogans serovar lai str. 56601
uuacuauaaacauauuauuu

SEQ ID NO: 2771739 - RNA, 23 nt, Leptospira interrogans serovar lai str. 56601
uuacuaugaagacgcuuaaaaau

SEQ ID NO: 2771740 - RNA, 20 nt, Leptospira interrogans serovar lai str. 56601
uuacuauggaauauaaaaga

SEQ ID NO: 2771741 - RNA, 12 nt, Leptospira interrogans serovar lai str. 56601
uuacucaaagaa

SEQ ID NO: 2771742 - RNA, 16 nt, Leptospira interrogans serovar lai str. 56601
uuacucaaagaaucga

SEQ ID NO: 2771743 - RNA, 16 nt, Leptospira interrogans serovar lai str. 56601
uuacucgacaaaacac

SEQ ID NO: 2771744 - RNA, 17 nt, Leptospira interrogans serovar lai str. 56601
uuacucgacaaaacacu

SEQ ID NO: 2771745 - RNA, 20 nt, Leptospira interrogans serovar lai str. 56601
uuacucguuucgaacucacg

SEQ ID NO: 2771746 - RNA, 15 nt, Leptospira interrogans serovar lai str. 56601
uuacucuauccauau

SEQ ID NO: 2771747 - RNA, 19 nt, Leptospira interrogans serovar lai str. 56601
uuacugaguuucaaacgcu

SEQ ID NO: 2771748 - RNA, 10 nt, Leptospira interrogans serovar lai str. 56601
uuacugaucu

SEQ ID NO: 2771749 - RNA, 19 nt, Leptospira interrogans serovar lai str. 56601
uuacugauuucaaaaauaa

SEQ ID NO: 2771750 - RNA, 13 nt, Leptospira interrogans serovar lai str. 56601
uuacugcauuuua

SEQ ID NO: 2771751 - RNA, 17 nt, Leptospira interrogans serovar lai str. 56601
uuacugcuugacaucuu

SEQ ID NO: 2771752 - RNA, 15 nt, Leptospira interrogans serovar lai str. 56601
uuacuguaaaauuua

SEQ ID NO: 2771753 - RNA, 14 nt, Leptospira interrogans serovar lai str. 56601
uuacuuauuuuuga

SEQ ID NO: 2771754 - RNA, 20 nt, Leptospira interrogans serovar lai str. 56601
uuacuucguuauaauuuuca

SEQ ID NO: 2771755 - RNA, 13 nt, Leptospira interrogans serovar lai str. 56601
uuacuugcaaaaa

SEQ ID NO: 2771756 - RNA, 13 nt, Leptospira interrogans serovar lai str. 56601
uuacuuuuuccaa

SEQ ID NO: 2771757 - RNA, 15 nt, Leptospira interrogans serovar lai str. 56601
uuacuuuuuccaaaa

SEQ ID NO: 2771758 - RNA, 15 nt, Leptospira interrogans serovar lai str. 56601
uuacuuuuucugguu

SEQ ID NO: 2771759 - RNA, 21 nt, Leptospira interrogans serovar lai str. 56601
uuacuuuuucugguuccauaa

SEQ ID NO: 2771760 - RNA, 17 nt, Leptospira interrogans serovar lai str. 56601
uuagaaaaaauuuuucu

SEQ ID NO: 2771761 - RNA, 12 nt, Leptospira interrogans serovar lai str. 56601
uuagaaaaauau

SEQ ID NO: 2771762 - RNA, 20 nt, Leptospira interrogans serovar lai str. 56601
uuagaaaaauugaauuucuu

SEQ ID NO: 2771763 - RNA, 15 nt, Leptospira interrogans serovar lai str. 56601
uuagaaaauuagaaa

SEQ ID NO: 2771764 - RNA, 22 nt, Leptospira interrogans serovar lai str. 56601
uuagaaauauugaauccaucug

SEQ ID NO: 2771765 - RNA, 19 nt, Leptospira interrogans serovar lai str. 56601
uuagaaaugauuuuuuaaa

SEQ ID NO: 2771766 - RNA, 22 nt, Leptospira interrogans serovar lai str. 56601
uuagaaaugauuuuuuaaaaua

SEQ ID NO: 2771767 - RNA, 14 nt, Leptospira interrogans serovar lai str. 56601
uuagaaauuucuaa

SEQ ID NO: 2771768 - RNA, 18 nt, Leptospira interrogans serovar lai str. 56601
uuagaaauuuuuaauaaa

SEQ ID NO: 2771769 - RNA, 19 nt, Leptospira interrogans serovar lai str. 56601
uuagaaauuuuuaauaaaa

SEQ ID NO: 2771770 - RNA, 16 nt, Leptospira interrogans serovar lai str. 56601
uuagaaauuuuuaauc

SEQ ID NO: 2771771 - RNA, 15 nt, Leptospira interrogans serovar lai str. 56601
uuagaacagacucug

SEQ ID NO: 2771772 - RNA, 12 nt, Leptospira interrogans serovar lai str. 56601
uuagaacucacg

SEQ ID NO: 2771773 - RNA, 17 nt, Leptospira interrogans serovar lai str. 56601
uuagaacuguugaaaaa

SEQ ID NO: 2771774 - RNA, 18 nt, Leptospira interrogans serovar lai str. 56601
uuagaacuguugaaaaaa

SEQ ID NO: 2771775 - RNA, 17 nt, Leptospira interrogans serovar lai str. 56601
uuagaagaauuguauuu

SEQ ID NO: 2771776 - RNA, 23 nt, Leptospira interrogans serovar lai str. 56601
uuagaaguugaucuuauacucuu

SEQ ID NO: 2771777 - RNA, 23 nt, Leptospira interrogans serovar lai str. 56601
uuagaauaguaguuuucacuaau

SEQ ID NO: 2771778 - RNA, 21 nt, Leptospira interrogans serovar lai str. 56601
uuagaauauuuucucaguaaa

SEQ ID NO: 2771779 - RNA, 17 nt, Leptospira interrogans serovar lai str. 56601
uuagaaucagaaugaac

SEQ ID NO: 2771780 - RNA, 14 nt, Leptospira interrogans serovar lai str. 56601
uuagaaucuaaacu

SEQ ID NO: 2771781 - RNA, 21 nt, Leptospira interrogans serovar lai str. 56601
uuagaaucugaaccugcaaau

SEQ ID NO: 2771782 - RNA, 20 nt, Leptospira interrogans serovar lai str. 56601
uuagaaugugggaacuacua

SEQ ID NO: 2771783 - RNA, 23 nt, Leptospira interrogans serovar lai str. 56601
uuagaauuguugaaaaauuuauu

SEQ ID NO: 2771784 - RNA, 19 nt, Leptospira interrogans serovar lai str. 56601
uuagaauuuguuuuuaaaa

SEQ ID NO: 2771785 - RNA, 12 nt, Leptospira interrogans serovar lai str. 56601
uuagaauuuucu

SEQ ID NO: 2771786 - RNA, 16 nt, Leptospira interrogans serovar lai str. 56601
uuagaauuuucuaaag

SEQ ID NO: 2771787 - RNA, 20 nt, Leptospira interrogans serovar lai str. 56601
uuagaauuuucuaaagauuc

SEQ ID NO: 2771788 - RNA, 14 nt, Leptospira interrogans serovar lai str. 56601
uuagacaaaaauac

SEQ ID NO: 2771789 - RNA, 19 nt, Leptospira interrogans serovar lai str. 56601
uuagacguaggaaaugaaa

SEQ ID NO: 2771790 - RNA, 20 nt, Leptospira interrogans serovar lai str. 56601
uuagacguuugaaaaucagg

SEQ ID NO: 2771791 - RNA, 23 nt, Leptospira interrogans serovar lai str. 56601
uuagaguaaaacuuuuaaagaag

SEQ ID NO: 2771792 - RNA, 19 nt, Leptospira interrogans serovar lai str. 56601
uuagagugaauuuguaauu

SEQ ID NO: 2771793 - RNA, 21 nt, Leptospira interrogans serovar lai str. 56601
uuagagugaauuuguaauucu

SEQ ID NO: 2771794 - RNA, 15 nt, Leptospira interrogans serovar lai str. 56601
uuagaguuauugaaa

SEQ ID NO: 2771795 - RNA, 18 nt, Leptospira interrogans serovar lai str. 56601
uuauauaaguuaaauuuu

SEQ ID NO: 2771796 - RNA, 22 nt, Leptospira interrogans serovar lai str. 56601
uuauauaaucugauugagaaaa

SEQ ID NO: 2771797 - RNA, 19 nt, Leptospira interrogans serovar lai str. 56601
uuauauauauucacaaaaa

SEQ ID NO: 2771798 - RNA, 17 nt, Leptospira interrogans serovar lai str. 56601
uuauaucgaauacauuu

SEQ ID NO: 2771799 - RNA, 18 nt, Leptospira interrogans serovar lai str. 56601
uuauaucuuaauuaaaaa

SEQ ID NO: 2771800 - RNA, 15 nt, Leptospira interrogans serovar lai str. 56601
uuauaugaguuccca

SEQ ID NO: 2771801 - RNA, 15 nt, Leptospira interrogans serovar lai str. 56601
uuauauguauuuauu

SEQ ID NO: 2771802 - RNA, 22 nt, Leptospira interrogans serovar lai str. 56601
uuauauguauuuauucaaaaua

SEQ ID NO: 2771803 - RNA, 13 nt, Leptospira interrogans serovar lai str. 56601
uuauauuaaauua

SEQ ID NO: 2771804 - RNA, 15 nt, Leptospira interrogans serovar lai str. 56601
uuauauuagaguuuu

SEQ ID NO: 2771805 - RNA, 13 nt, Leptospira interrogans serovar lai str. 56601
uuauauucuagaa

SEQ ID NO: 2771806 - RNA, 16 nt, Leptospira interrogans serovar lai str. 56601
uuauauuucuaaaaga

SEQ ID NO: 2771807 - RNA, 14 nt, Leptospira interrogans serovar lai str. 56601
uuauauuugaauuu

SEQ ID NO: 2771808 - RNA, 13 nt, Leptospira interrogans serovar lai str. 56601
uuauauuuuaauu

SEQ ID NO: 2771809 - RNA, 15 nt, Leptospira interrogans serovar lai str. 56601
uuauauuuuuaaaaa

SEQ ID NO: 2771810 - RNA, 15 nt, Leptospira interrogans serovar lai str. 56601
uuaucaauagaaaua

SEQ ID NO: 2771811 - RNA, 22 nt, Leptospira interrogans serovar lai str. 56601
uuaucaauucacucuuaaauac

SEQ ID NO: 2771812 - RNA, 19 nt, Leptospira interrogans serovar lai str. 56601
uuaucacgaaaauuaaaaa

SEQ ID NO: 2771813 - RNA, 14 nt, Leptospira interrogans serovar lai str. 56601
uuaucagaaccuuu

SEQ ID NO: 2771814 - RNA, 18 nt, Leptospira interrogans serovar lai str. 56601
uuaucauguuuuauauaa

SEQ ID NO: 2771815 - RNA, 20 nt, Leptospira interrogans serovar lai str. 56601
uuauccauaaguuccuuaaa

SEQ ID NO: 2771816 - RNA, 20 nt, Leptospira interrogans serovar lai str. 56601
uuauccuaaugaaaaagaaa

SEQ ID NO: 2771817 - RNA, 16 nt, Leptospira interrogans serovar lai str. 56601
uuaucgaauggaauuu

SEQ ID NO: 2771818 - RNA, 16 nt, Leptospira interrogans serovar lai str. 56601
uuaucgauuuaaaaac

SEQ ID NO: 2771819 - RNA, 16 nt, Leptospira interrogans serovar lai str. 56601
uuaucgcuaauacaaa

SEQ ID NO: 2771820 - RNA, 21 nt, Leptospira interrogans serovar lai str. 56601
uuaucgggauacucauaaaau

SEQ ID NO: 2771821 - RNA, 15 nt, Leptospira interrogans serovar lai str. 56601
uuaucuaaaauuuca

SEQ ID NO: 2771822 - RNA, 14 nt, Leptospira interrogans serovar lai str. 56601
uuaucuauugaaac

SEQ ID NO: 2771823 - RNA, 16 nt, Leptospira interrogans serovar lai str. 56601
uuaucuauugaaacaa

SEQ ID NO: 2771824 - RNA, 20 nt, Leptospira interrogans serovar lai str. 56601
uuaucugagcacaaaauauu

SEQ ID NO: 2771825 - RNA, 11 nt, Leptospira interrogans serovar lai str. 56601
uuaucuucgaa

SEQ ID NO: 2771826 - RNA, 21 nt, Leptospira interrogans serovar lai str. 56601
uuaucuucucuagaaacugca

SEQ ID NO: 2771827 - RNA, 14 nt, Leptospira interrogans serovar lai str. 56601
uuaugaaagucuuu

SEQ ID NO: 2771828 - RNA, 18 nt, Leptospira interrogans serovar lai str. 56601
uuaugaaauaaagaagag

SEQ ID NO: 2771829 - RNA, 14 nt, Leptospira interrogans serovar lai str. 56601
uuaugaauaaaaaa

SEQ ID NO: 2771830 - RNA, 18 nt, Leptospira interrogans serovar lai str. 56601
uuaugacagcuugaagau

SEQ ID NO: 2771831 - RNA, 21 nt, Leptospira interrogans serovar lai str. 56601
uuaugauagucaaaacucugu

SEQ ID NO: 2771832 - RNA, 20 nt, Leptospira interrogans serovar lai str. 56601
uuaugauaugaacguauucu

SEQ ID NO: 2771833 - RNA, 17 nt, Leptospira interrogans serovar lai str. 56601
uuaugauuucacgaaca

SEQ ID NO: 2771834 - RNA, 13 nt, Leptospira interrogans serovar lai str. 56601
uuaugauuuuuuu

SEQ ID NO: 2771835 - RNA, 18 nt, Leptospira interrogans serovar lai str. 56601
uuaugcaauuuauugacu

SEQ ID NO: 2771836 - RNA, 16 nt, Leptospira interrogans serovar lai str. 56601
uuaugcaguauuuugu

SEQ ID NO: 2771837 - RNA, 20 nt, Leptospira interrogans serovar lai str. 56601
uuaugcaugaauuuguuuuu

SEQ ID NO: 2771838 - RNA, 20 nt, Leptospira interrogans serovar lai str. 56601
uuaugcuauuuaauuuugua

SEQ ID NO: 2771839 - RNA, 14 nt, Leptospira interrogans serovar lai str. 56601
uuauggaaauuuca

SEQ ID NO: 2771840 - RNA, 16 nt, Leptospira interrogans serovar lai str. 56601
uuauggaauuuuucaa

SEQ ID NO: 2771841 - RNA, 22 nt, Leptospira interrogans serovar lai str. 56601
uuauggacucuauuaugauucu

SEQ ID NO: 2771842 - RNA, 17 nt, Leptospira interrogans serovar lai str. 56601
uuaugguuuuuuaauau

SEQ ID NO: 2771843 - RNA, 13 nt, Leptospira interrogans serovar lai str. 56601
uuauguaagaaaa

SEQ ID NO: 2771844 - RNA, 14 nt, Leptospira interrogans serovar lai str. 56601
uuauguaagaaaaa

SEQ ID NO: 2771845 - RNA, 16 nt, Leptospira interrogans serovar lai str. 56601
uuauguagaaauuuga

SEQ ID NO: 2771846 - RNA, 15 nt, Leptospira interrogans serovar lai str. 56601
uuauguucguuccca

SEQ ID NO: 2771847 - RNA, 13 nt, Leptospira interrogans serovar lai str. 56601
uuauuaaaaauau

SEQ ID NO: 2771848 - RNA, 14 nt, Leptospira interrogans serovar lai str. 56601
uuauuaaaaauauc

SEQ ID NO: 2771849 - RNA, 14 nt, Leptospira interrogans serovar lai str. 56601
uuauuaaaauuucc

SEQ ID NO: 2771850 - RNA, 13 nt, Leptospira interrogans serovar lai str. 56601
uuauuaaauugua

SEQ ID NO: 2771851 - RNA, 17 nt, Leptospira interrogans serovar lai str. 56601
uuauuaauucuuauucu

SEQ ID NO: 2771852 - RNA, 22 nt, Leptospira interrogans serovar lai str. 56601
uuauuagaacucacguuaaaua

SEQ ID NO: 2771853 - RNA, 12 nt, Leptospira interrogans serovar lai str. 56601
uuauuauaaaac

SEQ ID NO: 2771854 - RNA, 23 nt, Leptospira interrogans serovar lai str. 56601
uuauuauaaauuuauaaauguag

SEQ ID NO: 2771855 - RNA, 20 nt, Leptospira interrogans serovar lai str. 56601
uuauuauuuuuguuaaacaa

SEQ ID NO: 2771856 - RNA, 19 nt, Leptospira interrogans serovar lai str. 56601
uuauucaauuuuaguaaac

SEQ ID NO: 2771857 - RNA, 13 nt, Leptospira interrogans serovar lai str. 56601
uuauucuaaacaa

SEQ ID NO: 2771858 - RNA, 15 nt, Leptospira interrogans serovar lai str. 56601
uuauucuccauucuu

SEQ ID NO: 2771859 - RNA, 11 nt, Leptospira interrogans serovar lai str. 56601
uuauucuuccg

SEQ ID NO: 2771860 - RNA, 16 nt, Leptospira interrogans serovar lai str. 56601
uuauugaaaaauuuca

SEQ ID NO: 2771861 - RNA, 21 nt, Leptospira interrogans serovar lai str. 56601
uuauugaacguaaguuaaaua

SEQ ID NO: 2771862 - RNA, 15 nt, Leptospira interrogans serovar lai str. 56601
uuauugaugauugaa

SEQ ID NO: 2771863 - RNA, 14 nt, Leptospira interrogans serovar lai str. 56601
uuauuggaaaaagu

SEQ ID NO: 2771864 - RNA, 14 nt, Leptospira interrogans serovar lai str. 56601
uuauugugaauauu

SEQ ID NO: 2771865 - RNA, 18 nt, Leptospira interrogans serovar lai str. 56601
uuauugugaauauuucuu

SEQ ID NO: 2771866 - RNA, 14 nt, Leptospira interrogans serovar lai str. 56601
uuauuguuuauaaa

SEQ ID NO: 2771867 - RNA, 16 nt, Leptospira interrogans serovar lai str. 56601
uuauuuacuuuuucca

SEQ ID NO: 2771868 - RNA, 14 nt, Leptospira interrogans serovar lai str. 56601
uuauuucaaaaauu

SEQ ID NO: 2771869 - RNA, 17 nt, Leptospira interrogans serovar lai str. 56601
uuauuucaaaaauuuaa

SEQ ID NO: 2771870 - RNA, 15 nt, Leptospira interrogans serovar lai str. 56601
uuauuucaaaauuua

SEQ ID NO: 2771871 - RNA, 12 nt, Leptospira interrogans serovar lai str. 56601
uuauuucuaaac

SEQ ID NO: 2771872 - RNA, 13 nt, Leptospira interrogans serovar lai str. 56601
uuauuuguaaauc

SEQ ID NO: 2771873 - RNA, 12 nt, Leptospira interrogans serovar lai str. 56601
uuauuuuaaaaa

SEQ ID NO: 2771874 - RNA, 15 nt, Leptospira interrogans serovar lai str. 56601
uuauuuuaaaaaaau

SEQ ID NO: 2771875 - RNA, 16 nt, Leptospira interrogans serovar lai str. 56601
uuauuuucaaguaaau

SEQ ID NO: 2771876 - RNA, 15 nt, Leptospira interrogans serovar lai str. 56601
uuauuuucagauugu

SEQ ID NO: 2771877 - RNA, 12 nt, Leptospira interrogans serovar lai str. 56601
uuauuuuccuuu

SEQ ID NO: 2771878 - RNA, 17 nt, Leptospira interrogans serovar lai str. 56601
uuauuuuguauaaagua

SEQ ID NO: 2771879 - RNA, 23 nt, Leptospira interrogans serovar lai str. 56601
uucaauuuaaaauaucagaucua

SEQ ID NO: 2771880 - RNA, 12 nt, Leptospira interrogans serovar lai str. 56601
uucaauuuagaa

SEQ ID NO: 2771881 - RNA, 14 nt, Leptospira interrogans serovar lai str. 56601
uucaauuuauaaac

SEQ ID NO: 2771882 - RNA, 17 nt, Leptospira interrogans serovar lai str. 56601
uucaauuuauuauagaa

SEQ ID NO: 2771883 - RNA, 18 nt, Leptospira interrogans serovar lai str. 56601
uucaauuuauuauagaac

SEQ ID NO: 2771884 - RNA, 21 nt, Leptospira interrogans serovar lai str. 56601
uucaauuucuuuaauuucaau

SEQ ID NO: 2771885 - RNA, 23 nt, Leptospira interrogans serovar lai str. 56601
uucaauuucuuuaauuucaauaa

SEQ ID NO: 2771886 - RNA, 14 nt, Leptospira interrogans serovar lai str. 56601
uucaauuuuuauca

SEQ ID NO: 2771887 - RNA, 14 nt, Leptospira interrogans serovar lai str. 56601
uucaauuuuugaaa

SEQ ID NO: 2771888 - RNA, 12 nt, Leptospira interrogans serovar lai str. 56601
uucacaaaaaaa

SEQ ID NO: 2771889 - RNA, 14 nt, Leptospira interrogans serovar lai str. 56601
uucacaaaaaaauu

SEQ ID NO: 2771890 - RNA, 22 nt, Leptospira interrogans serovar lai str. 56601
uucacagaaacccucuccuuga

SEQ ID NO: 2771891 - RNA, 14 nt, Leptospira interrogans serovar lai str. 56601
uucacaucuccacu

SEQ ID NO: 2771892 - RNA, 18 nt, Leptospira interrogans serovar lai str. 56601
uucacaugguuaaagugu

SEQ ID NO: 2771893 - RNA, 17 nt, Leptospira interrogans serovar lai str. 56601
uucaccaagcuccucca

SEQ ID NO: 2771894 - RNA, 17 nt, Leptospira interrogans serovar lai str. 56601
uucacccaccaaaaaua

SEQ ID NO: 2771895 - RNA, 20 nt, Leptospira interrogans serovar lai str. 56601
uucacgaacacaaauucuaa

SEQ ID NO: 2771896 - RNA, 18 nt, Leptospira interrogans serovar lai str. 56601
uucacgacgucuaugacg

SEQ ID NO: 2771897 - RNA, 15 nt, Leptospira interrogans serovar lai str. 56601
uucacguuaacuaac

SEQ ID NO: 2771898 - RNA, 13 nt, Leptospira interrogans serovar lai str. 56601
uucacucaaaaua

SEQ ID NO: 2771899 - RNA, 15 nt, Leptospira interrogans serovar lai str. 56601
uucacucuuaaauac

SEQ ID NO: 2771900 - RNA, 14 nt, Leptospira interrogans serovar lai str. 56601
uucacuuuaaaaca

SEQ ID NO: 2771901 - RNA, 22 nt, Leptospira interrogans serovar lai str. 56601
uucagaaacuggaauauucuuu

SEQ ID NO: 2771902 - RNA, 19 nt, Leptospira interrogans serovar lai str. 56601
uucagacugacugaaaaaa

SEQ ID NO: 2771903 - RNA, 20 nt, Leptospira interrogans serovar lai str. 56601
uucagacugacugaaaaaaa

SEQ ID NO: 2771904 - RNA, 22 nt, Leptospira interrogans serovar lai str. 56601
uucagaugaauugaauuuuuua

SEQ ID NO: 2771905 - RNA, 18 nt, Leptospira interrogans serovar lai str. 56601
uucagauuucaacuuuuu

SEQ ID NO: 2771906 - RNA, 17 nt, Leptospira interrogans serovar lai str. 56601
uucagauuuuauuuuga

SEQ ID NO: 2771907 - RNA, 18 nt, Leptospira interrogans serovar lai str. 56601
uucagccgcgcuuuccuu

SEQ ID NO: 2771908 - RNA, 22 nt, Leptospira interrogans serovar lai str. 56601
uucagccgcgcuuuccuuauua

SEQ ID NO: 2771909 - RNA, 21 nt, Leptospira interrogans serovar lai str. 56601
uucagcgagugcgacuacgau

SEQ ID NO: 2771910 - RNA, 21 nt, Leptospira interrogans serovar lai str. 56601
uucagcuacaaucaauaaauu

SEQ ID NO: 2771911 - RNA, 17 nt, Leptospira interrogans serovar lai str. 56601
uucagcuccaaaaaaau

SEQ ID NO: 2771912 - RNA, 16 nt, Leptospira interrogans serovar lai str. 56601
uucagcucuagucaau

SEQ ID NO: 2771913 - RNA, 18 nt, Leptospira interrogans serovar lai str. 56601
uucaggauagguuccaau

SEQ ID NO: 2771914 - RNA, 15 nt, Leptospira interrogans serovar lai str. 56601
uucaguauucuagaa

SEQ ID NO: 2771915 - RNA, 17 nt, Leptospira interrogans serovar lai str. 56601
uucagucucauugugaa

SEQ ID NO: 2771916 - RNA, 17 nt, Leptospira interrogans serovar lai str. 56601
uucagugaauaaaauaa

SEQ ID NO: 2771917 - RNA, 14 nt, Leptospira interrogans serovar lai str. 56601
uucaguuucaaacu

SEQ ID NO: 2771918 - RNA, 16 nt, Leptospira interrogans serovar lai str. 56601
uucaguuucaaacuga

SEQ ID NO: 2771919 - RNA, 13 nt, Leptospira interrogans serovar lai str. 56601
uucaguuuccacu

SEQ ID NO: 2771920 - RNA, 13 nt, Leptospira interrogans serovar lai str. 56601
uucaguuuuacug

SEQ ID NO: 2771921 - RNA, 17 nt, Leptospira interrogans serovar lai str. 56601
uucauaauaaauuuuuc

SEQ ID NO: 2771922 - RNA, 15 nt, Leptospira interrogans serovar lai str. 56601
uucauaauucugaaa

SEQ ID NO: 2771923 - RNA, 16 nt, Leptospira interrogans serovar lai str. 56601
uucauacuuuuaaaaa

SEQ ID NO: 2771924 - RNA, 21 nt, Leptospira interrogans serovar lai str. 56601
uucauagccguagggaugaac

SEQ ID NO: 2771925 - RNA, 12 nt, Leptospira interrogans serovar lai str. 56601
uucauaggauga

SEQ ID NO: 2771926 - RNA, 14 nt, Leptospira interrogans serovar lai str. 56601
uucauaguucaauu

SEQ ID NO: 2771927 - RNA, 15 nt, Leptospira interrogans serovar lai str. 56601
uucauaucaaauuca

SEQ ID NO: 2771928 - RNA, 13 nt, Leptospira interrogans serovar lai str. 56601
uucauaucuaaaa

SEQ ID NO: 2771929 - RNA, 20 nt, Leptospira interrogans serovar lai str. 56601
uucaucaaacggucuuucuu

SEQ ID NO: 2771930 - RNA, 16 nt, Leptospira interrogans serovar lai str. 56601
uucaucauuauuugaa

SEQ ID NO: 2771931 - RNA, 14 nt, Leptospira interrogans serovar lai str. 56601
uucaucguuccaaa

SEQ ID NO: 2771932 - RNA, 18 nt, Leptospira interrogans serovar lai str. 56601
uucaucuacguuucaauu

SEQ ID NO: 2771933 - RNA, 19 nt, Leptospira interrogans serovar lai str. 56601
uucaucuguggagaaaauu

SEQ ID NO: 2771934 - RNA, 15 nt, Leptospira interrogans serovar lai str. 56601
uucaucuuuuccauu

SEQ ID NO: 2771935 - RNA, 16 nt, Leptospira interrogans serovar lai str. 56601
uucaugaauuaaagaa

SEQ ID NO: 2771936 - RNA, 20 nt, Leptospira interrogans serovar lai str. 56601
uucaugaauuaaagaagagc

SEQ ID NO: 2771937 - RNA, 12 nt, Leptospira interrogans serovar lai str. 56601
uucaugagaaac

SEQ ID NO: 2771938 - RNA, 21 nt, Leptospira interrogans serovar lai str. 56601
uucaugauaguuaauuuuauc

SEQ ID NO: 2771939 - RNA, 13 nt, Leptospira interrogans serovar lai str. 56601
uucauuaaacaau

SEQ ID NO: 2771940 - RNA, 13 nt, Leptospira interrogans serovar lai str. 56601
uucauuacaaaac

SEQ ID NO: 2771941 - RNA, 19 nt, Leptospira interrogans serovar lai str. 56601
uucauucaaaauaaauaau

SEQ ID NO: 2771942 - RNA, 22 nt, Leptospira interrogans serovar lai str. 56601
uucauucaggauuacuaaugca

SEQ ID NO: 2771943 - RNA, 14 nt, Leptospira interrogans serovar lai str. 56601
uucauucuaaagaa

SEQ ID NO: 2771944 - RNA, 16 nt, Leptospira interrogans serovar lai str. 56601
uucauucuaaagaagg

SEQ ID NO: 2771945 - RNA, 17 nt, Leptospira interrogans serovar lai str. 56601
uucauucugauucuaaa

SEQ ID NO: 2771946 - RNA, 19 nt, Leptospira interrogans serovar lai str. 56601
uucauucugauucuaaaau

SEQ ID NO: 2771947 - RNA, 15 nt, Leptospira interrogans serovar lai str. 56601
uucauucuuuaaaau

SEQ ID NO: 2771948 - RNA, 14 nt, Leptospira interrogans serovar lai str. 56601
uucauucuuuccau

SEQ ID NO: 2771949 - RNA, 13 nt, Leptospira interrogans serovar lai str. 56601
uucauuuaaaaau

SEQ ID NO: 2771950 - RNA, 15 nt, Leptospira interrogans serovar lai str. 56601
uucauuuaccuaaaa

SEQ ID NO: 2771951 - RNA, 16 nt, Leptospira interrogans serovar lai str. 56601
uucauuuaccuaaaau

SEQ ID NO: 2771952 - RNA, 19 nt, Leptospira interrogans serovar lai str. 56601
uucauuuaccuaaaauuca

SEQ ID NO: 2771953 - RNA, 13 nt, Leptospira interrogans serovar lai str. 56601
uucauuucgaaaa

SEQ ID NO: 2771954 - RNA, 16 nt, Leptospira interrogans serovar lai str. 56601
uucauuucgaaaacga

SEQ ID NO: 2771955 - RNA, 16 nt, Leptospira interrogans serovar lai str. 56601
uucauuugaauuuaua

SEQ ID NO: 2771956 - RNA, 15 nt, Leptospira interrogans serovar lai str. 56601
uucauuuuacagaau

SEQ ID NO: 2771957 - RNA, 16 nt, Leptospira interrogans serovar lai str. 56601
uucauuuugcuaaggu

SEQ ID NO: 2771958 - RNA, 14 nt, Leptospira interrogans serovar lai str. 56601
uucauuuuuacaau

SEQ ID NO: 2771959 - RNA, 19 nt, Leptospira interrogans serovar lai str. 56601
uucauuuuuccauaaaaaa

SEQ ID NO: 2771960 - RNA, 20 nt, Leptospira interrogans serovar lai str. 56601
uucauuuuuccauaaaaaac

SEQ ID NO: 2771961 - RNA, 14 nt, Leptospira interrogans serovar lai str. 56601
uucauuuuucuaaa

SEQ ID NO: 2771962 - RNA, 19 nt, Leptospira interrogans serovar lai str. 56601
uucauuuuucuaaaaaaac

SEQ ID NO: 2771963 - RNA, 22 nt, Leptospira interrogans serovar lai str. 56601
uuccuaaugcagcuucuuccaa

SEQ ID NO: 2771964 - RNA, 18 nt, Leptospira interrogans serovar lai str. 56601
uuccuacauguucaaaau

SEQ ID NO: 2771965 - RNA, 19 nt, Leptospira interrogans serovar lai str. 56601
uuccuacauuuuaaaaauu

SEQ ID NO: 2771966 - RNA, 16 nt, Leptospira interrogans serovar lai str. 56601
uuccuauaaauaaauu

SEQ ID NO: 2771967 - RNA, 24 nt, Leptospira interrogans serovar lai str. 56601
uuccuauucaguuuccacucuuug

SEQ ID NO: 2771968 - RNA, 15 nt, Leptospira interrogans serovar lai str. 56601
uuccuauuuuugggu

SEQ ID NO: 2771969 - RNA, 17 nt, Leptospira interrogans serovar lai str. 56601
uuccuguaguauuucca

SEQ ID NO: 2771970 - RNA, 18 nt, Leptospira interrogans serovar lai str. 56601
uuccuuaagacccuaaaa

SEQ ID NO: 2771971 - RNA, 22 nt, Leptospira interrogans serovar lai str. 56601
uuccuuaagacccuaaaaaauu

SEQ ID NO: 2771972 - RNA, 23 nt, Leptospira interrogans serovar lai str. 56601
uuccuuaagacccuaaaaaauuu

SEQ ID NO: 2771973 - RNA, 23 nt, Leptospira interrogans serovar lai str. 56601
uuccuuauuaaaaccaucuuuga

SEQ ID NO: 2771974 - RNA, 21 nt, Leptospira interrogans serovar lai str. 56601
uuccuucguuuuuguuuucuu

SEQ ID NO: 2771975 - RNA, 13 nt, Leptospira interrogans serovar lai str. 56601
uuccuucuugaaa

SEQ ID NO: 2771976 - RNA, 17 nt, Leptospira interrogans serovar lai str. 56601
uuccuucuugaaauaau

SEQ ID NO: 2771977 - RNA, 19 nt, Leptospira interrogans serovar lai str. 56601
uuccuucuuuacaguuuuu

SEQ ID NO: 2771978 - RNA, 17 nt, Leptospira interrogans serovar lai str. 56601
uuccuugaaaaaaaaca

SEQ ID NO: 2771979 - RNA, 22 nt, Leptospira interrogans serovar lai str. 56601
uuccuuuaaauugaauucuucc

SEQ ID NO: 2771980 - RNA, 15 nt, Leptospira interrogans serovar lai str. 56601
uuccuuucaagaauu

SEQ ID NO: 2771981 - RNA, 23 nt, Leptospira interrogans serovar lai str. 56601
uuccuuucaagaauuuauuuaca

SEQ ID NO: 2771982 - RNA, 14 nt, Leptospira interrogans serovar lai str. 56601
uuccuuucucugaa

SEQ ID NO: 2771983 - RNA, 14 nt, Leptospira interrogans serovar lai str. 56601
uuccuuugaauaaa

SEQ ID NO: 2771984 - RNA, 18 nt, Leptospira interrogans serovar lai str. 56601
uuccuuuuuaaaaccaaa

SEQ ID NO: 2771985 - RNA, 20 nt, Leptospira interrogans serovar lai str. 56601
uucgaaaacgauuuuucaaa

SEQ ID NO: 2771986 - RNA, 20 nt, Leptospira interrogans serovar lai str. 56601
uucgaaacaaaaucaaagag

SEQ ID NO: 2771987 - RNA, 15 nt, Leptospira interrogans serovar lai str. 56601
uucgaaagauuuuuc

SEQ ID NO: 2771988 - RNA, 22 nt, Leptospira interrogans serovar lai str. 56601
uucgaagauauaaucuaagauu

SEQ ID NO: 2771989 - RNA, 16 nt, Leptospira interrogans serovar lai str. 56601
uucgaauucuuucuau

SEQ ID NO: 2771990 - RNA, 16 nt, Leptospira interrogans serovar lai str. 56601
uucgaauuuuaguucu

SEQ ID NO: 2771991 - RNA, 18 nt, Leptospira interrogans serovar lai str. 56601
uucgaauuuuaguucucu

SEQ ID NO: 2771992 - RNA, 16 nt, Leptospira interrogans serovar lai str. 56601
uucgacaacuuauaau

SEQ ID NO: 2771993 - RNA, 14 nt, Leptospira interrogans serovar lai str. 56601
uucgacguaaaaau

SEQ ID NO: 2771994 - RNA, 14 nt, Leptospira interrogans serovar lai str. 56601
uucgacuauuucuu

SEQ ID NO: 2771995 - RNA, 22 nt, Leptospira interrogans serovar lai str. 56601
uucgacuucuuuuuuguaaguu

SEQ ID NO: 2771996 - RNA, 14 nt, Leptospira interrogans serovar lai str. 56601
uucgaguccuuuuu

SEQ ID NO: 2771997 - RNA, 14 nt, Leptospira interrogans serovar lai str. 56601
uucgaucuaagaaa

SEQ ID NO: 2771998 - RNA, 22 nt, Leptospira interrogans serovar lai str. 56601
uucgauguauggcucauuuuuc

SEQ ID NO: 2771999 - RNA, 13 nt, Leptospira interrogans serovar lai str. 56601
uucgauuuuaaau

SEQ ID NO: 2772000 - RNA, 20 nt, Leptospira interrogans serovar lai str. 56601
uucgcacauucuauaaaguu

SEQ ID NO: 2772001 - RNA, 17 nt, Leptospira interrogans serovar lai str. 56601
uucgcauaacaaaaaua

SEQ ID NO: 2772002 - RNA, 14 nt, Leptospira interrogans serovar lai str. 56601
uucgccgaaacauu

SEQ ID NO: 2772003 - RNA, 19 nt, Leptospira interrogans serovar lai str. 56601
uucggaaauagaaagacuu

SEQ ID NO: 2772004 - RNA, 16 nt, Leptospira interrogans serovar lai str. 56601
uucggagucauacauu

SEQ ID NO: 2772005 - RNA, 17 nt, Leptospira interrogans serovar lai str. 56601
uucggagucauacauuu

SEQ ID NO: 2772006 - RNA, 18 nt, Leptospira interrogans serovar lai str. 56601
uucggauuucugaaaaaa

SEQ ID NO: 2772007 - RNA, 19 nt, Leptospira interrogans serovar lai str. 56601
uucggcagccaauuccaaa

SEQ ID NO: 2772008 - RNA, 15 nt, Leptospira interrogans serovar lai str. 56601
uucggugauacuguc

SEQ ID NO: 2772009 - RNA, 23 nt, Leptospira interrogans serovar lai str. 56601
uucguaaaaaauagaugugggaa

SEQ ID NO: 2772010 - RNA, 14 nt, Leptospira interrogans serovar lai str. 56601
uucguaagaaaaaa

SEQ ID NO: 2772011 - RNA, 16 nt, Leptospira interrogans serovar lai str. 56601
uucguaagaaaaaauu

SEQ ID NO: 2772012 - RNA, 21 nt, Leptospira interrogans serovar lai str. 56601
uucguaguuuuuguuccgaaa

SEQ ID NO: 2772013 - RNA, 16 nt, Leptospira interrogans serovar lai str. 56601
uucguaugaguuccca

SEQ ID NO: 2772014 - RNA, 18 nt, Leptospira interrogans serovar lai str. 56601
uucguauugaauauuuuu

SEQ ID NO: 2772015 - RNA, 22 nt, Leptospira interrogans serovar lai str. 56601
uucguggagaaauucguuuuau

SEQ ID NO: 2772016 - RNA, 14 nt, Leptospira interrogans serovar lai str. 56601
uucguuaaguuauc

SEQ ID NO: 2772017 - RNA, 21 nt, Leptospira interrogans serovar lai str. 56601
uucguuccaaauacaauuuga

SEQ ID NO: 2772018 - RNA, 17 nt, Leptospira interrogans serovar lai str. 56601
uucguuccuuugaauaa

SEQ ID NO: 2772019 - RNA, 12 nt, Leptospira interrogans serovar lai str. 56601
uucguucuuuuu

SEQ ID NO: 2772020 - RNA, 14 nt, Leptospira interrogans serovar lai str. 56601
uucguucuuuuuuc

SEQ ID NO: 2772021 - RNA, 20 nt, Leptospira interrogans serovar lai str. 56601
uucguugccggagccaaauu

SEQ ID NO: 2772022 - RNA, 14 nt, Leptospira interrogans serovar lai str. 56601
uucguuguauggaa

SEQ ID NO: 2772023 - RNA, 13 nt, Leptospira interrogans serovar lai str. 56601
uucguuucuuaau

SEQ ID NO: 2772024 - RNA, 12 nt, Leptospira interrogans serovar lai str. 56601
uucguuuuacuu

SEQ ID NO: 2772025 - RNA, 16 nt, Leptospira interrogans serovar lai str. 56601
uucguuuuauaaaaac

SEQ ID NO: 2772026 - RNA, 17 nt, Leptospira interrogans serovar lai str. 56601
uucguuuuuuaaaaugu

SEQ ID NO: 2772027 - RNA, 16 nt, Leptospira interrogans serovar lai str. 56601
uucguuuuuuuaauau

SEQ ID NO: 2772028 - RNA, 13 nt, Leptospira interrogans serovar lai str. 56601
uucuaaaaaaaau

SEQ ID NO: 2772029 - RNA, 12 nt, Leptospira interrogans serovar lai str. 56601
uucuaaaaaaag

SEQ ID NO: 2772030 - RNA, 12 nt, Leptospira interrogans serovar lai str. 56601
uucuaaaaaaau

SEQ ID NO: 2772031 - RNA, 15 nt, Leptospira interrogans serovar lai str. 56601
uucuaaaaaaauacg

SEQ ID NO: 2772032 - RNA, 13 nt, Leptospira interrogans serovar lai str. 56601
uucuaaaaaaauu

SEQ ID NO: 2772033 - RNA, 14 nt, Leptospira interrogans serovar lai str. 56601
uucuaaaaacucaa

SEQ ID NO: 2772034 - RNA, 13 nt, Leptospira interrogans serovar lai str. 56601
uucuaaaaauaag

SEQ ID NO: 2772035 - RNA, 20 nt, Leptospira interrogans serovar lai str. 56601
uucuaaaaauuuuuuuaaac

SEQ ID NO: 2772036 - RNA, 13 nt, Leptospira interrogans serovar lai str. 56601
uucuaaaagaaga

SEQ ID NO: 2772037 - RNA, 15 nt, Leptospira interrogans serovar lai str. 56601
uucuaaaaguaaaag

SEQ ID NO: 2772038 - RNA, 18 nt, Leptospira interrogans serovar lai str. 56601
uucuaaaauauaggaacu

SEQ ID NO: 2772039 - RNA, 12 nt, Leptospira interrogans serovar lai str. 56601
uucuaaaauauc

SEQ ID NO: 2772040 - RNA, 12 nt, Leptospira interrogans serovar lai str. 56601
uucuaaaauauu

SEQ ID NO: 2772041 - RNA, 20 nt, Leptospira interrogans serovar lai str. 56601
uucuaaaauauuugcauaaa

SEQ ID NO: 2772042 - RNA, 21 nt, Leptospira interrogans serovar lai str. 56601
uucuaaaauauuugcauaaac

SEQ ID NO: 2772043 - RNA, 21 nt, Leptospira interrogans serovar lai str. 56601
uucuaaaaucauacuuuuaaa

SEQ ID NO: 2772044 - RNA, 22 nt, Leptospira interrogans serovar lai str. 56601
uucuaaaaucauacuuuuaaaa

SEQ ID NO: 2772045 - RNA, 21 nt, Leptospira interrogans serovar lai str. 56601
uucuaaaauccuauucaacuu

SEQ ID NO: 2772046 - RNA, 18 nt, Leptospira interrogans serovar lai str. 56601
uucugaacguaguaguuc

SEQ ID NO: 2772047 - RNA, 17 nt, Leptospira interrogans serovar lai str. 56601
uucugaauaaaaauacu

SEQ ID NO: 2772048 - RNA, 20 nt, Leptospira interrogans serovar lai str. 56601
uucugacauucuaaacauuu

SEQ ID NO: 2772049 - RNA, 22 nt, Leptospira interrogans serovar lai str. 56601
uucugaggaggauuagaagaau

SEQ ID NO: 2772050 - RNA, 14 nt, Leptospira interrogans serovar lai str. 56601
uucugauaaagaaa

SEQ ID NO: 2772051 - RNA, 17 nt, Leptospira interrogans serovar lai str. 56601
uucugauaaagaaaacc

SEQ ID NO: 2772052 - RNA, 15 nt, Leptospira interrogans serovar lai str. 56601
uucugauagagaaaa

SEQ ID NO: 2772053 - RNA, 17 nt, Leptospira interrogans serovar lai str. 56601
uucugauagagaaaaau

SEQ ID NO: 2772054 - RNA, 11 nt, Leptospira interrogans serovar lai str. 56601
uucugauauaa

SEQ ID NO: 2772055 - RNA, 22 nt, Leptospira interrogans serovar lai str. 56601
uucugcauauacggauuucuau

SEQ ID NO: 2772056 - RNA, 19 nt, Leptospira interrogans serovar lai str. 56601
uucuggaaaaauuccuaaa

SEQ ID NO: 2772057 - RNA, 19 nt, Leptospira interrogans serovar lai str. 56601
uucuggaaauucuguuuua

SEQ ID NO: 2772058 - RNA, 16 nt, Leptospira interrogans serovar lai str. 56601
uucuggguaaaaaaaa

SEQ ID NO: 2772059 - RNA, 18 nt, Leptospira interrogans serovar lai str. 56601
uucugguuccauaaagac

SEQ ID NO: 2772060 - RNA, 19 nt, Leptospira interrogans serovar lai str. 56601
uucuguaaaaauaaaaugu

SEQ ID NO: 2772061 - RNA, 15 nt, Leptospira interrogans serovar lai str. 56601
uucuguucauucuuu

SEQ ID NO: 2772062 - RNA, 15 nt, Leptospira interrogans serovar lai str. 56601
uucuguugaguucau

SEQ ID NO: 2772063 - RNA, 11 nt, Leptospira interrogans serovar lai str. 56601
uucuuaaaaaa

SEQ ID NO: 2772064 - RNA, 15 nt, Leptospira interrogans serovar lai str. 56601
uucuuaaaaaaauga

SEQ ID NO: 2772065 - RNA, 19 nt, Leptospira interrogans serovar lai str. 56601
uucuuaaaauguaggaacu

SEQ ID NO: 2772066 - RNA, 23 nt, Leptospira interrogans serovar lai str. 56601
uucuuaaaauuccgaauucuaaa

SEQ ID NO: 2772067 - RNA, 14 nt, Leptospira interrogans serovar lai str. 56601
uucuuaaaauugug

SEQ ID NO: 2772068 - RNA, 15 nt, Leptospira interrogans serovar lai str. 56601
uucuuaaauaaaauu

SEQ ID NO: 2772069 - RNA, 18 nt, Leptospira interrogans serovar lai str. 56601
uucuuaaauaaaauuuuc

SEQ ID NO: 2772070 - RNA, 22 nt, Leptospira interrogans serovar lai str. 56601
uucuuaaauaaaauuuuccgga

SEQ ID NO: 2772071 - RNA, 19 nt, Leptospira interrogans serovar lai str. 56601
uucuuaaaucuuagauuca

SEQ ID NO: 2772072 - RNA, 20 nt, Leptospira interrogans serovar lai str. 56601
uucuuaaauucuaaaaaaau

SEQ ID NO: 2772073 - RNA, 15 nt, Leptospira interrogans serovar lai str. 56601
uucuuaauaaacuuu

SEQ ID NO: 2772074 - RNA, 15 nt, Leptospira interrogans serovar lai str. 56601
uucuuaauuuuacua

SEQ ID NO: 2772075 - RNA, 20 nt, Leptospira interrogans serovar lai str. 56601
uucuuacaacuuuugaaacu

SEQ ID NO: 2772076 - RNA, 17 nt, Leptospira interrogans serovar lai str. 56601
uucuuauguggaugaua

SEQ ID NO: 2772077 - RNA, 15 nt, Leptospira interrogans serovar lai str. 56601
uucuuauguuuuuua

SEQ ID NO: 2772078 - RNA, 16 nt, Leptospira interrogans serovar lai str. 56601
uucuuauuaauucuua

SEQ ID NO: 2772079 - RNA, 18 nt, Leptospira interrogans serovar lai str. 56601
uucuucaauaucuuuauu

SEQ ID NO: 2772080 - RNA, 19 nt, Leptospira interrogans serovar lai str. 56601
uucuucagggcucauagaa

SEQ ID NO: 2772081 - RNA, 13 nt, Leptospira interrogans serovar lai str. 56601
uucuucauaaaau

SEQ ID NO: 2772082 - RNA, 21 nt, Leptospira interrogans serovar lai str. 56601
uucuucaugauuuuuuaaucu

SEQ ID NO: 2772083 - RNA, 21 nt, Leptospira interrogans serovar lai str. 56601
uucuuccacaucuuuuuucgu

SEQ ID NO: 2772084 - RNA, 18 nt, Leptospira interrogans serovar lai str. 56601
uucuucccagauucccuu

SEQ ID NO: 2772085 - RNA, 22 nt, Leptospira interrogans serovar lai str. 56601
uucuuccccacacccuugaccu

SEQ ID NO: 2772086 - RNA, 12 nt, Leptospira interrogans serovar lai str. 56601
uucuuccuuuuu

SEQ ID NO: 2772087 - RNA, 17 nt, Leptospira interrogans serovar lai str. 56601
uucuucguuauuuuuau

SEQ ID NO: 2772088 - RNA, 16 nt, Leptospira interrogans serovar lai str. 56601
uucuucuagauuuuaa

SEQ ID NO: 2772089 - RNA, 18 nt, Leptospira interrogans serovar lai str. 56601
uucuucuccucuuccgga

SEQ ID NO: 2772090 - RNA, 17 nt, Leptospira interrogans serovar lai str. 56601
uucuucugcaauucgca

SEQ ID NO: 2772091 - RNA, 12 nt, Leptospira interrogans serovar lai str. 56601
uucuucugcugc

SEQ ID NO: 2772092 - RNA, 11 nt, Leptospira interrogans serovar lai str. 56601
uucuucuuccu

SEQ ID NO: 2772093 - RNA, 13 nt, Leptospira interrogans serovar lai str. 56601
uucuucuucggua

SEQ ID NO: 2772094 - RNA, 18 nt, Leptospira interrogans serovar lai str. 56601
uucuugagaaaggagaac

SEQ ID NO: 2772095 - RNA, 20 nt, Leptospira interrogans serovar lai str. 56601
uucuugagggguuuuuccuu

SEQ ID NO: 2772096 - RNA, 19 nt, Leptospira interrogans serovar lai str. 56601
uucuuggguucaauaaaac

SEQ ID NO: 2772097 - RNA, 12 nt, Leptospira interrogans serovar lai str. 56601
uucuuuaaaauu

SEQ ID NO: 2772098 - RNA, 14 nt, Leptospira interrogans serovar lai str. 56601
uucuuucgacuucu

SEQ ID NO: 2772099 - RNA, 16 nt, Leptospira interrogans serovar lai str. 56601
uucuuucgacuucuuu

SEQ ID NO: 2772100 - RNA, 12 nt, Leptospira interrogans serovar lai str. 56601
uucuuucuaaau

SEQ ID NO: 2772101 - RNA, 12 nt, Leptospira interrogans serovar lai str. 56601
uucuuucuauuu

SEQ ID NO: 2772102 - RNA, 15 nt, Leptospira interrogans serovar lai str. 56601
uucuuucuauuuuuu

SEQ ID NO: 2772103 - RNA, 19 nt, Leptospira interrogans serovar lai str. 56601
uucuuucuauuuuuuccga

SEQ ID NO: 2772104 - RNA, 13 nt, Leptospira interrogans serovar lai str. 56601
uucuuucucguuu

SEQ ID NO: 2772105 - RNA, 20 nt, Leptospira interrogans serovar lai str. 56601
uucuuugaacuuuuucaagu

SEQ ID NO: 2772106 - RNA, 18 nt, Leptospira interrogans serovar lai str. 56601
uucuuugcgauugagaau

SEQ ID NO: 2772107 - RNA, 12 nt, Leptospira interrogans serovar lai str. 56601
uucuuuuaaaag

SEQ ID NO: 2772108 - RNA, 13 nt, Leptospira interrogans serovar lai str. 56601
uucuuuucaaaag

SEQ ID NO: 2772109 - RNA, 15 nt, Leptospira interrogans serovar lai str. 56601
uucuuuuccaaaaac

SEQ ID NO: 2772110 - RNA, 13 nt, Leptospira interrogans serovar lai str. 56601
uucuuuucuuaaa

SEQ ID NO: 2772111 - RNA, 23 nt, Leptospira interrogans serovar lai str. 56601
uucuuuuguaaaacgauucugca

SEQ ID NO: 2772112 - RNA, 15 nt, Leptospira interrogans serovar lai str. 56601
uucuuuuuaaauaca

SEQ ID NO: 2772113 - RNA, 12 nt, Leptospira interrogans serovar lai str. 56601
uucuuuuuucuc

SEQ ID NO: 2772114 - RNA, 23 nt, Leptospira interrogans serovar lai str. 56601
uugaaaaaaaacaggucccaaac

SEQ ID NO: 2772115 - RNA, 22 nt, Leptospira interrogans serovar lai str. 56601
uugaaaaagcggucuugaaaau

SEQ ID NO: 2772116 - RNA, 23 nt, Leptospira interrogans serovar lai str. 56601
uugaaaaaguugggaucuaaacu

SEQ ID NO: 2772117 - RNA, 23 nt, Leptospira interrogans serovar lai str. 56601
uugaaaaauuaauucuccaucug

SEQ ID NO: 2772118 - RNA, 18 nt, Leptospira interrogans serovar lai str. 56601
uugaaaaauuaauucucu

SEQ ID NO: 2772119 - RNA, 13 nt, Leptospira interrogans serovar lai str. 56601
uugaaaaauucca

SEQ ID NO: 2772120 - RNA, 17 nt, Leptospira interrogans serovar lai str. 56601
uugaaaaauuucauagu

SEQ ID NO: 2772121 - RNA, 13 nt, Leptospira interrogans serovar lai str. 56601
uugaaaaauuucc

SEQ ID NO: 2772122 - RNA, 16 nt, Leptospira interrogans serovar lai str. 56601
uugaaaagaaaccaau

SEQ ID NO: 2772123 - RNA, 14 nt, Leptospira interrogans serovar lai str. 56601
uugaaaauaaaaau

SEQ ID NO: 2772124 - RNA, 15 nt, Leptospira interrogans serovar lai str. 56601
uugaaaauucuaaga

SEQ ID NO: 2772125 - RNA, 19 nt, Leptospira interrogans serovar lai str. 56601
uugaaaauucuauaguaaa

SEQ ID NO: 2772126 - RNA, 12 nt, Leptospira interrogans serovar lai str. 56601
uugaaaauugug

SEQ ID NO: 2772127 - RNA, 21 nt, Leptospira interrogans serovar lai str. 56601
uugaaacaaauucucauuuag

SEQ ID NO: 2772128 - RNA, 23 nt, Leptospira interrogans serovar lai str. 56601
uugaaacaucacuuccauuuuuu

SEQ ID NO: 2772129 - RNA, 18 nt, Leptospira interrogans serovar lai str. 56601
uugauagaaaaaaucacg

SEQ ID NO: 2772130 - RNA, 23 nt, Leptospira interrogans serovar lai str. 56601
uugauagaacucuuuuaccuuac

SEQ ID NO: 2772131 - RNA, 15 nt, Leptospira interrogans serovar lai str. 56601
uugauaugaaucagc

SEQ ID NO: 2772132 - RNA, 15 nt, Leptospira interrogans serovar lai str. 56601
uugauauuacuacuc

SEQ ID NO: 2772133 - RNA, 14 nt, Leptospira interrogans serovar lai str. 56601
uugauauucaaauu

SEQ ID NO: 2772134 - RNA, 22 nt, Leptospira interrogans serovar lai str. 56601
uugauauuucuguaaaaaauaa

SEQ ID NO: 2772135 - RNA, 15 nt, Leptospira interrogans serovar lai str. 56601
uugauauuucuuaaa

SEQ ID NO: 2772136 - RNA, 17 nt, Leptospira interrogans serovar lai str. 56601
uugauccguuuuaaaau

SEQ ID NO: 2772137 - RNA, 22 nt, Leptospira interrogans serovar lai str. 56601
uugaucuuguauaagaaaugag

SEQ ID NO: 2772138 - RNA, 15 nt, Leptospira interrogans serovar lai str. 56601
uugaucuuuuagaua

SEQ ID NO: 2772139 - RNA, 13 nt, Leptospira interrogans serovar lai str. 56601
uugauuagaaaaa

SEQ ID NO: 2772140 - RNA, 16 nt, Leptospira interrogans serovar lai str. 56601
uugauucaaaaacuaa

SEQ ID NO: 2772141 - RNA, 23 nt, Leptospira interrogans serovar lai str. 56601
uugauucaaaaacuaaaauacaa

SEQ ID NO: 2772142 - RNA, 13 nt, Leptospira interrogans serovar lai str. 56601
uugauuccaaaga

SEQ ID NO: 2772143 - RNA, 18 nt, Leptospira interrogans serovar lai str. 56601
uugauuccaaagauaaaa

SEQ ID NO: 2772144 - RNA, 23 nt, Leptospira interrogans serovar lai str. 56601
uugauuccaaagauaaaaaagaa

SEQ ID NO: 2772145 - RNA, 19 nt, Leptospira interrogans serovar lai str. 56601
uugauuccuuuuucuaauc

SEQ ID NO: 2772146 - RNA, 12 nt, Leptospira interrogans serovar lai str. 56601
uugauugaagca

SEQ ID NO: 2772147 - RNA, 16 nt, Leptospira interrogans serovar lai str. 56601
uugauuuacauucugg

SEQ ID NO: 2772148 - RNA, 16 nt, Leptospira interrogans serovar lai str. 56601
uugauuuuggaaagaa

SEQ ID NO: 2772149 - RNA, 21 nt, Leptospira interrogans serovar lai str. 56601
uugauuuuggaaagaauacga

SEQ ID NO: 2772150 - RNA, 12 nt, Leptospira interrogans serovar lai str. 56601
uugauuuuucaa

SEQ ID NO: 2772151 - RNA, 13 nt, Leptospira interrogans serovar lai str. 56601
uugauuuuucgaa

SEQ ID NO: 2772152 - RNA, 15 nt, Leptospira interrogans serovar lai str. 56601
uugauuuuugaagua

SEQ ID NO: 2772153 - RNA, 22 nt, Leptospira interrogans serovar lai str. 56601
uugauuuuugaaguaguuccua

SEQ ID NO: 2772154 - RNA, 14 nt, Leptospira interrogans serovar lai str. 56601
uugcaaaaaagaaa

SEQ ID NO: 2772155 - RNA, 19 nt, Leptospira interrogans serovar lai str. 56601
uugcaaaaaguauguuuuu

SEQ ID NO: 2772156 - RNA, 14 nt, Leptospira interrogans serovar lai str. 56601
uugcaaaaauagaa

SEQ ID NO: 2772157 - RNA, 20 nt, Leptospira interrogans serovar lai str. 56601
uugcaaaauacgaucuaauu

SEQ ID NO: 2772158 - RNA, 15 nt, Leptospira interrogans serovar lai str. 56601
uugcaaguaaaaaga

SEQ ID NO: 2772159 - RNA, 20 nt, Leptospira interrogans serovar lai str. 56601
uugcaauacauucuuauaaa

SEQ ID NO: 2772160 - RNA, 13 nt, Leptospira interrogans serovar lai str. 56601
uugcacaaaagaa

SEQ ID NO: 2772161 - RNA, 14 nt, Leptospira interrogans serovar lai str. 56601
uugcacauaaaaga

SEQ ID NO: 2772162 - RNA, 16 nt, Leptospira interrogans serovar lai str. 56601
uugcacauaaaagacc

SEQ ID NO: 2772163 - RNA, 22 nt, Leptospira interrogans serovar lai str. 56601
uugcaccgcauugaugacaaga

SEQ ID NO: 2772164 - RNA, 17 nt, Leptospira interrogans serovar lai str. 56601
uugcacugaaauagaau

SEQ ID NO: 2772165 - RNA, 20 nt, Leptospira interrogans serovar lai str. 56601
uugcauaaaaucguaguuuu

SEQ ID NO: 2772166 - RNA, 17 nt, Leptospira interrogans serovar lai str. 56601
uugccauggaaauuuuu

SEQ ID NO: 2772167 - RNA, 20 nt, Leptospira interrogans serovar lai str. 56601
uugccggagccaaauuguaa

SEQ ID NO: 2772168 - RNA, 21 nt, Leptospira interrogans serovar lai str. 56601
uugccgucccaucaaguuuuu

SEQ ID NO: 2772169 - RNA, 19 nt, Leptospira interrogans serovar lai str. 56601
uugccuuucaccagaauuu

SEQ ID NO: 2772170 - RNA, 15 nt, Leptospira interrogans serovar lai str. 56601
uugcgaaagugaucc

SEQ ID NO: 2772171 - RNA, 14 nt, Leptospira interrogans serovar lai str. 56601
uugcgauuuuuccg

SEQ ID NO: 2772172 - RNA, 21 nt, Leptospira interrogans serovar lai str. 56601
uugcggauuccauucuucaaa

SEQ ID NO: 2772173 - RNA, 20 nt, Leptospira interrogans serovar lai str. 56601
uugcgugaaaaccaauuccg

SEQ ID NO: 2772174 - RNA, 18 nt, Leptospira interrogans serovar lai str. 56601
uugcuaaaauuuuuuuaa

SEQ ID NO: 2772175 - RNA, 14 nt, Leptospira interrogans serovar lai str. 56601
uugcuaagaaaaaa

SEQ ID NO: 2772176 - RNA, 21 nt, Leptospira interrogans serovar lai str. 56601
uugcuauggaauuuuuucaaa

SEQ ID NO: 2772177 - RNA, 22 nt, Leptospira interrogans serovar lai str. 56601
uugcucagagaauaucugaauu

SEQ ID NO: 2772178 - RNA, 13 nt, Leptospira interrogans serovar lai str. 56601
uugcucuaaaaua

SEQ ID NO: 2772179 - RNA, 15 nt, Leptospira interrogans serovar lai str. 56601
uugcucuaaaauaau

SEQ ID NO: 2772180 - RNA, 19 nt, Leptospira interrogans serovar lai str. 56601
uugcucuaaaauaauuuuu

SEQ ID NO: 2772181 - RNA, 21 nt, Leptospira interrogans serovar lai str. 56601
uugcucucgcaaugaaaauuc

SEQ ID NO: 2772182 - RNA, 22 nt, Leptospira interrogans serovar lai str. 56601
uugcucucgcaaugaaaauucc

SEQ ID NO: 2772183 - RNA, 21 nt, Leptospira interrogans serovar lai str. 56601
uugcugguuguaaguaucuaa

SEQ ID NO: 2772184 - RNA, 15 nt, Leptospira interrogans serovar lai str. 56601
uugcugucauaaacc

SEQ ID NO: 2772185 - RNA, 15 nt, Leptospira interrogans serovar lai str. 56601
uugcugucgcaacau

SEQ ID NO: 2772186 - RNA, 20 nt, Leptospira interrogans serovar lai str. 56601
uugcuuugaaugacacaaaa

SEQ ID NO: 2772187 - RNA, 12 nt, Leptospira interrogans serovar lai str. 56601
uugcuuuuuaaa

SEQ ID NO: 2772188 - RNA, 15 nt, Leptospira interrogans serovar lai str. 56601
uuggaaaaaguccuu

SEQ ID NO: 2772189 - RNA, 13 nt, Leptospira interrogans serovar lai str. 56601
uuggaaauuuuua

SEQ ID NO: 2772190 - RNA, 18 nt, Leptospira interrogans serovar lai str. 56601
uuggaaauuuuuaauaaa

SEQ ID NO: 2772191 - RNA, 19 nt, Leptospira interrogans serovar lai str. 56601
uuggaacaagcucaaaauu

SEQ ID NO: 2772192 - RNA, 17 nt, Leptospira interrogans serovar lai str. 56601
uuggaaucuaaacuuug

SEQ ID NO: 2772193 - RNA, 20 nt, Leptospira interrogans serovar lai str. 56601
uuggaaucugcaucuuuucu

SEQ ID NO: 2772194 - RNA, 16 nt, Leptospira interrogans serovar lai str. 56601
uuggaaucuuaaaaag

SEQ ID NO: 2772195 - RNA, 17 nt, Leptospira interrogans serovar lai str. 56601
uuggacgaauccugcua

SEQ ID NO: 2772196 - RNA, 22 nt, Leptospira interrogans serovar lai str. 56601
uuggaggaaaagucgaaagaau

SEQ ID NO: 2772197 - RNA, 21 nt, Leptospira interrogans serovar lai str. 56601
uuggagggcaaucgauuugag

SEQ ID NO: 2772198 - RNA, 14 nt, Leptospira interrogans serovar lai str. 56601
uuggauagcaaaaa

SEQ ID NO: 2772199 - RNA, 18 nt, Leptospira interrogans serovar lai str. 56601
uuggaucgguuuuagaau

SEQ ID NO: 2772200 - RNA, 14 nt, Leptospira interrogans serovar lai str. 56601
uuggaucguguaau

SEQ ID NO: 2772201 - RNA, 13 nt, Leptospira interrogans serovar lai str. 56601
uuggauuccuuuc

SEQ ID NO: 2772202 - RNA, 21 nt, Leptospira interrogans serovar lai str. 56601
uuggauucugcucuucuaauu

SEQ ID NO: 2772203 - RNA, 18 nt, Leptospira interrogans serovar lai str. 56601
uuggcagaugaaacuaau

SEQ ID NO: 2772204 - RNA, 16 nt, Leptospira interrogans serovar lai str. 56601
uuggccucgaaaguuu

SEQ ID NO: 2772205 - RNA, 23 nt, Leptospira interrogans serovar lai str. 56601
uuggccucgaaaguuuacacaac

SEQ ID NO: 2772206 - RNA, 22 nt, Leptospira interrogans serovar lai str. 56601
uuggcgacaaaaggauuccauu

SEQ ID NO: 2772207 - RNA, 18 nt, Leptospira interrogans serovar lai str. 56601
uuggcucaacuuuuccag

SEQ ID NO: 2772208 - RNA, 22 nt, Leptospira interrogans serovar lai str. 56601
uugggagacucuaguaaagaaa

SEQ ID NO: 2772209 - RNA, 16 nt, Leptospira interrogans serovar lai str. 56601
uugggauauucugaaa

SEQ ID NO: 2772210 - RNA, 17 nt, Leptospira interrogans serovar lai str. 56601
uugggaucuaaacuuug

SEQ ID NO: 2772211 - RNA, 14 nt, Leptospira interrogans serovar lai str. 56601
uugggaucugaauu

SEQ ID NO: 2772212 - RNA, 14 nt, Leptospira interrogans serovar lai str. 56601
uugugucaagcccu

SEQ ID NO: 2772213 - RNA, 17 nt, Leptospira interrogans serovar lai str. 56601
uugugucaagcccuccc

SEQ ID NO: 2772214 - RNA, 24 nt, Leptospira interrogans serovar lai str. 56601
uugugucaagcccuccuauguuuc

SEQ ID NO: 2772215 - RNA, 15 nt, Leptospira interrogans serovar lai str. 56601
uuguguuaguuccca

SEQ ID NO: 2772216 - RNA, 19 nt, Leptospira interrogans serovar lai str. 56601
uuguguucaucguuccaaa

SEQ ID NO: 2772217 - RNA, 15 nt, Leptospira interrogans serovar lai str. 56601
uuguuaaacaacgug

SEQ ID NO: 2772218 - RNA, 16 nt, Leptospira interrogans serovar lai str. 56601
uuguuaagauaaauuu

SEQ ID NO: 2772219 - RNA, 18 nt, Leptospira interrogans serovar lai str. 56601
uuguuauaaacuucuauu

SEQ ID NO: 2772220 - RNA, 13 nt, Leptospira interrogans serovar lai str. 56601
uuguuaugcaaau

SEQ ID NO: 2772221 - RNA, 16 nt, Leptospira interrogans serovar lai str. 56601
uuguuaugcaaauaca

SEQ ID NO: 2772222 - RNA, 14 nt, Leptospira interrogans serovar lai str. 56601
uuguuauggaauuu

SEQ ID NO: 2772223 - RNA, 12 nt, Leptospira interrogans serovar lai str. 56601
uuguucaaagaa

SEQ ID NO: 2772224 - RNA, 14 nt, Leptospira interrogans serovar lai str. 56601
uuguucauaaaauc

SEQ ID NO: 2772225 - RNA, 13 nt, Leptospira interrogans serovar lai str. 56601
uuguuccaaaacc

SEQ ID NO: 2772226 - RNA, 21 nt, Leptospira interrogans serovar lai str. 56601
uuguucuggagaaagauuuuc

SEQ ID NO: 2772227 - RNA, 14 nt, Leptospira interrogans serovar lai str. 56601
uuguugaaaaauuc

SEQ ID NO: 2772228 - RNA, 16 nt, Leptospira interrogans serovar lai str. 56601
uuguugaaaagugagu

SEQ ID NO: 2772229 - RNA, 11 nt, Leptospira interrogans serovar lai str. 56601
uuguugugaac

SEQ ID NO: 2772230 - RNA, 13 nt, Leptospira interrogans serovar lai str. 56601
uuguuuccuucuu

SEQ ID NO: 2772231 - RNA, 15 nt, Leptospira interrogans serovar lai str. 56601
uuguuuucuuuucuu

SEQ ID NO: 2772232 - RNA, 15 nt, Leptospira interrogans serovar lai str. 56601
uuguuuugcugaguu

SEQ ID NO: 2772233 - RNA, 12 nt, Leptospira interrogans serovar lai str. 56601
uuguuuuuaaau

SEQ ID NO: 2772234 - RNA, 16 nt, Leptospira interrogans serovar lai str. 56601
uuguuuuuauaaauaa

SEQ ID NO: 2772235 - RNA, 16 nt, Leptospira interrogans serovar lai str. 56601
uuguuuuucuuuaggu

SEQ ID NO: 2772236 - RNA, 13 nt, Leptospira interrogans serovar lai str. 56601
uuguuuuuuccag

SEQ ID NO: 2772237 - RNA, 16 nt, Leptospira interrogans serovar lai str. 56601
uuuaaaaaaaucacua

SEQ ID NO: 2772238 - RNA, 19 nt, Leptospira interrogans serovar lai str. 56601
uuuaaaaaaauuuuuauga

SEQ ID NO: 2772239 - RNA, 23 nt, Leptospira interrogans serovar lai str. 56601
uuuaaaaaauaggaguuccuaca

SEQ ID NO: 2772240 - RNA, 11 nt, Leptospira interrogans serovar lai str. 56601
uuuaaaaacag

SEQ ID NO: 2772241 - RNA, 15 nt, Leptospira interrogans serovar lai str. 56601
uuuaaaaacuaucag

SEQ ID NO: 2772242 - RNA, 21 nt, Leptospira interrogans serovar lai str. 56601
uuuaaaaacuuguuguaccau

SEQ ID NO: 2772243 - RNA, 12 nt, Leptospira interrogans serovar lai str. 56601
uuuaaaaacuuu

SEQ ID NO: 2772244 - RNA, 11 nt, Leptospira interrogans serovar lai str. 56601
uuuaaaaagua

SEQ ID NO: 2772245 - RNA, 12 nt, Leptospira interrogans serovar lai str. 56601
uuuaaaaaguuc

SEQ ID NO: 2772246 - RNA, 12 nt, Leptospira interrogans serovar lai str. 56601
uuuaaaaauaua

SEQ ID NO: 2772247 - RNA, 13 nt, Leptospira interrogans serovar lai str. 56601
uuuaaaaaugaaa

SEQ ID NO: 2772248 - RNA, 16 nt, Leptospira interrogans serovar lai str. 56601
uuuaaaaauuagaacu

SEQ ID NO: 2772249 - RNA, 20 nt, Leptospira interrogans serovar lai str. 56601
uuuaaaaauucguuuuacuu

SEQ ID NO: 2772250 - RNA, 14 nt, Leptospira interrogans serovar lai str. 56601
uuuaaaaauucugu

SEQ ID NO: 2772251 - RNA, 13 nt, Leptospira interrogans serovar lai str. 56601
uuuaaaaauuucc

SEQ ID NO: 2772252 - RNA, 21 nt, Leptospira interrogans serovar lai str. 56601
uuuaaaacgaacuuuucuaua

SEQ ID NO: 2772253 - RNA, 13 nt, Leptospira interrogans serovar lai str. 56601
uuuaaaacuuguc

SEQ ID NO: 2772254 - RNA, 21 nt, Leptospira interrogans serovar lai str. 56601
uuuaaaaucacaaaaaagaua

SEQ ID NO: 2772255 - RNA, 23 nt, Leptospira interrogans serovar lai str. 56601
uuuaaaaucguaaaaaagauaaa

SEQ ID NO: 2772256 - RNA, 17 nt, Leptospira interrogans serovar lai str. 56601
uuuaaaauguaggaacc

SEQ ID NO: 2772257 - RNA, 21 nt, Leptospira interrogans serovar lai str. 56601
uuuaaaauuguguaugaguuc

SEQ ID NO: 2772258 - RNA, 19 nt, Leptospira interrogans serovar lai str. 56601
uuuaaacauccaauuauaa

SEQ ID NO: 2772259 - RNA, 12 nt, Leptospira interrogans serovar lai str. 56601
uuuaaacauuua

SEQ ID NO: 2772260 - RNA, 22 nt, Leptospira interrogans serovar lai str. 56601
uuuaaaccgauuucaauuuucu

SEQ ID NO: 2772261 - RNA, 20 nt, Leptospira interrogans serovar lai str. 56601
uuuaaaccuucuuuaagaua

SEQ ID NO: 2772262 - RNA, 19 nt, Leptospira interrogans serovar lai str. 56601
uuuaaacgaucagaaaaac

SEQ ID NO: 2772263 - RNA, 15 nt, Leptospira interrogans serovar lai str. 56601
uuuaaacguuuauuu

SEQ ID NO: 2772264 - RNA, 12 nt, Leptospira interrogans serovar lai str. 56601
uuuaaacuuuuc

SEQ ID NO: 2772265 - RNA, 20 nt, Leptospira interrogans serovar lai str. 56601
uuuaaagaaccgacaaucgu

SEQ ID NO: 2772266 - RNA, 22 nt, Leptospira interrogans serovar lai str. 56601
uuuaaagaaugaucaacuacua

SEQ ID NO: 2772267 - RNA, 21 nt, Leptospira interrogans serovar lai str. 56601
uuuaaagaauuuuuacagaaa

SEQ ID NO: 2772268 - RNA, 22 nt, Leptospira interrogans serovar lai str. 56601
uuuaaagacgauugauucuaag

SEQ ID NO: 2772269 - RNA, 18 nt, Leptospira interrogans serovar lai str. 56601
uuuaaauaaaaagaagag

SEQ ID NO: 2772270 - RNA, 21 nt, Leptospira interrogans serovar lai str. 56601
uuuaaauaagcuaagcauaaa

SEQ ID NO: 2772271 - RNA, 16 nt, Leptospira interrogans serovar lai str. 56601
uuuaaauagauucaaa

SEQ ID NO: 2772272 - RNA, 12 nt, Leptospira interrogans serovar lai str. 56601
uuuaaauauuaa

SEQ ID NO: 2772273 - RNA, 17 nt, Leptospira interrogans serovar lai str. 56601
uuuaaauccaacuuaaa

SEQ ID NO: 2772274 - RNA, 20 nt, Leptospira interrogans serovar lai str. 56601
uuuaaaucuuaugguuuuuu

SEQ ID NO: 2772275 - RNA, 11 nt, Leptospira interrogans serovar lai str. 56601
uuuaaaugaaa

SEQ ID NO: 2772276 - RNA, 16 nt, Leptospira interrogans serovar lai str. 56601
uuuaaaugaaaugugg

SEQ ID NO: 2772277 - RNA, 21 nt, Leptospira interrogans serovar lai str. 56601
uuuaaaugcagcuauuuuuuu

SEQ ID NO: 2772278 - RNA, 18 nt, Leptospira interrogans serovar lai str. 56601
uuuaaauguagaaacuac

SEQ ID NO: 2772279 - RNA, 19 nt, Leptospira interrogans serovar lai str. 56601
uuuaaauguauguuuacuu

SEQ ID NO: 2772280 - RNA, 23 nt, Leptospira interrogans serovar lai str. 56601
uuuaaauguauguuuacuugaaa

SEQ ID NO: 2772281 - RNA, 16 nt, Leptospira interrogans serovar lai str. 56601
uuuaaaugugggaacu

SEQ ID NO: 2772282 - RNA, 12 nt, Leptospira interrogans serovar lai str. 56601
uuuaaauguuau

SEQ ID NO: 2772283 - RNA, 18 nt, Leptospira interrogans serovar lai str. 56601
uuuaaauuagcuuaagaa

SEQ ID NO: 2772284 - RNA, 15 nt, Leptospira interrogans serovar lai str. 56601
uuuaaauucccucaa

SEQ ID NO: 2772285 - RNA, 19 nt, Leptospira interrogans serovar lai str. 56601
uuuaaauucccucaauaau

SEQ ID NO: 2772286 - RNA, 21 nt, Leptospira interrogans serovar lai str. 56601
uuuaaauucuuucguuuuuug

SEQ ID NO: 2772287 - RNA, 12 nt, Leptospira interrogans serovar lai str. 56601
uuuaaauuugug

SEQ ID NO: 2772288 - RNA, 15 nt, Leptospira interrogans serovar lai str. 56601
uuuaacaacucuaau

SEQ ID NO: 2772289 - RNA, 17 nt, Leptospira interrogans serovar lai str. 56601
uuuaacgcaaaauacug

SEQ ID NO: 2772290 - RNA, 18 nt, Leptospira interrogans serovar lai str. 56601
uuuaacucguuagagaaa

SEQ ID NO: 2772291 - RNA, 11 nt, Leptospira interrogans serovar lai str. 56601
uuuaacuugag

SEQ ID NO: 2772292 - RNA, 20 nt, Leptospira interrogans serovar lai str. 56601
uuuaacuuuuuuuaaaaaau

SEQ ID NO: 2772293 - RNA, 17 nt, Leptospira interrogans serovar lai str. 56601
uuuaagaaacucaguaa

SEQ ID NO: 2772294 - RNA, 15 nt, Leptospira interrogans serovar lai str. 56601
uuuaagaaucaucuu

SEQ ID NO: 2772295 - RNA, 19 nt, Leptospira interrogans serovar lai str. 56601
uuuaagaaucucaaaauaa

SEQ ID NO: 2772296 - RNA, 21 nt, Leptospira interrogans serovar lai str. 56601
uuuagaacagaaugucuuaga

SEQ ID NO: 2772297 - RNA, 13 nt, Leptospira interrogans serovar lai str. 56601
uuuagaauauuaa

SEQ ID NO: 2772298 - RNA, 23 nt, Leptospira interrogans serovar lai str. 56601
uuuagaaucaaaaugaacucaac

SEQ ID NO: 2772299 - RNA, 23 nt, Leptospira interrogans serovar lai str. 56601
uuuagaaucagaaugaacucaac

SEQ ID NO: 2772300 - RNA, 13 nt, Leptospira interrogans serovar lai str. 56601
uuuagaauuuguu

SEQ ID NO: 2772301 - RNA, 15 nt, Leptospira interrogans serovar lai str. 56601
uuuagaauuuucuaa

SEQ ID NO: 2772302 - RNA, 20 nt, Leptospira interrogans serovar lai str. 56601
uuuagacguaggaaaugaaa

SEQ ID NO: 2772303 - RNA, 22 nt, Leptospira interrogans serovar lai str. 56601
uuuagacguaggaaaugaaaaa

SEQ ID NO: 2772304 - RNA, 21 nt, Leptospira interrogans serovar lai str. 56601
uuuagacuucucuuuucgaaa

SEQ ID NO: 2772305 - RNA, 20 nt, Leptospira interrogans serovar lai str. 56601
uuuagagcaguucaauuuuu

SEQ ID NO: 2772306 - RNA, 16 nt, Leptospira interrogans serovar lai str. 56601
uuuagagccaaauuuu

SEQ ID NO: 2772307 - RNA, 17 nt, Leptospira interrogans serovar lai str. 56601
uuuagaguuaagagaau

SEQ ID NO: 2772308 - RNA, 19 nt, Leptospira interrogans serovar lai str. 56601
uuuagaguuaagagaauuu

SEQ ID NO: 2772309 - RNA, 23 nt, Leptospira interrogans serovar lai str. 56601
uuuagauaagagacaaauauuuc

SEQ ID NO: 2772310 - RNA, 20 nt, Leptospira interrogans serovar lai str. 56601
uuuagauaaggcuaaagaau

SEQ ID NO: 2772311 - RNA, 18 nt, Leptospira interrogans serovar lai str. 56601
uuuagauaauuauucuca

SEQ ID NO: 2772312 - RNA, 15 nt, Leptospira interrogans serovar lai str. 56601
uuuagauucuaaaaa

SEQ ID NO: 2772313 - RNA, 16 nt, Leptospira interrogans serovar lai str. 56601
uuuagauuuuaacuuu

SEQ ID NO: 2772314 - RNA, 22 nt, Leptospira interrogans serovar lai str. 56601
uuuagcaaauaacgauuccauu

SEQ ID NO: 2772315 - RNA, 13 nt, Leptospira interrogans serovar lai str. 56601
uuuagcguaaauu

SEQ ID NO: 2772316 - RNA, 17 nt, Leptospira interrogans serovar lai str. 56601
uuuaggaagaaacaaag

SEQ ID NO: 2772317 - RNA, 13 nt, Leptospira interrogans serovar lai str. 56601
uuuaggauuaauu

SEQ ID NO: 2772318 - RNA, 19 nt, Leptospira interrogans serovar lai str. 56601
uuuaggauuuuuggaauaa

SEQ ID NO: 2772319 - RNA, 19 nt, Leptospira interrogans serovar lai str. 56601
uuuaggguuaucuucgaaa

SEQ ID NO: 2772320 - RNA, 17 nt, Leptospira interrogans serovar lai str. 56601
uuuagguaauagaaaac

SEQ ID NO: 2772321 - RNA, 15 nt, Leptospira interrogans serovar lai str. 56601
uuuagguauuucuaa

SEQ ID NO: 2772322 - RNA, 13 nt, Leptospira interrogans serovar lai str. 56601
uuuagguuuuugg

SEQ ID NO: 2772323 - RNA, 15 nt, Leptospira interrogans serovar lai str. 56601
uuuaguaaaauuuaa

SEQ ID NO: 2772324 - RNA, 17 nt, Leptospira interrogans serovar lai str. 56601
uuuaguaaacuacuaaa

SEQ ID NO: 2772325 - RNA, 14 nt, Leptospira interrogans serovar lai str. 56601
uuuaguaguauuua

SEQ ID NO: 2772326 - RNA, 15 nt, Leptospira interrogans serovar lai str. 56601
uuuaguauaaucaaa

SEQ ID NO: 2772327 - RNA, 22 nt, Leptospira interrogans serovar lai str. 56601
uuuaguauaaucaaauacaaaa

SEQ ID NO: 2772328 - RNA, 15 nt, Leptospira interrogans serovar lai str. 56601
uuuaguuguacaaaa

SEQ ID NO: 2772329 - RNA, 13 nt, Leptospira interrogans serovar lai str. 56601
uuuaguuguuccu

SEQ ID NO: 2772330 - RNA, 13 nt, Leptospira interrogans serovar lai str. 56601
uuuaguuuuuccu

SEQ ID NO: 2772331 - RNA, 22 nt, Leptospira interrogans serovar lai str. 56601
uuuauaaaaaccugauuuuucc

SEQ ID NO: 2772332 - RNA, 15 nt, Leptospira interrogans serovar lai str. 56601
uuuauaaaaauacag

SEQ ID NO: 2772333 - RNA, 15 nt, Leptospira interrogans serovar lai str. 56601
uuuauaaaacaaucu

SEQ ID NO: 2772334 - RNA, 22 nt, Leptospira interrogans serovar lai str. 56601
uuuauaaaacaaucuucaaauu

SEQ ID NO: 2772335 - RNA, 21 nt, Leptospira interrogans serovar lai str. 56601
uuuauaaaaccugauuuuucu

SEQ ID NO: 2772336 - RNA, 12 nt, Leptospira interrogans serovar lai str. 56601
uuuauaaaagua

SEQ ID NO: 2772337 - RNA, 15 nt, Leptospira interrogans serovar lai str. 56601
uuuauaaaaguauaa

SEQ ID NO: 2772338 - RNA, 15 nt, Leptospira interrogans serovar lai str. 56601
uuuauaaaauaaaaa

SEQ ID NO: 2772339 - RNA, 13 nt, Leptospira interrogans serovar lai str. 56601
uuuauaaaaucua

SEQ ID NO: 2772340 - RNA, 14 nt, Leptospira interrogans serovar lai str. 56601
uuuauaaaaucuaa

SEQ ID NO: 2772341 - RNA, 14 nt, Leptospira interrogans serovar lai str. 56601
uuuauaaacuucuc

SEQ ID NO: 2772342 - RNA, 16 nt, Leptospira interrogans serovar lai str. 56601
uuuauaaagauaaauc

SEQ ID NO: 2772343 - RNA, 13 nt, Leptospira interrogans serovar lai str. 56601
uuuauaaagauuu

SEQ ID NO: 2772344 - RNA, 18 nt, Leptospira interrogans serovar lai str. 56601
uuuauaaagauuuccuaa

SEQ ID NO: 2772345 - RNA, 14 nt, Leptospira interrogans serovar lai str. 56601
uuuauaaagcaaaa

SEQ ID NO: 2772346 - RNA, 18 nt, Leptospira interrogans serovar lai str. 56601
uuuauaaaguaaagguuu

SEQ ID NO: 2772347 - RNA, 12 nt, Leptospira interrogans serovar lai str. 56601
uuuauaaaugua

SEQ ID NO: 2772348 - RNA, 13 nt, Leptospira interrogans serovar lai str. 56601
uuuauaaauugug

SEQ ID NO: 2772349 - RNA, 19 nt, Leptospira interrogans serovar lai str. 56601
uuuauaacgggaauuauaa

SEQ ID NO: 2772350 - RNA, 19 nt, Leptospira interrogans serovar lai str. 56601
uuuauaagagagauauaca

SEQ ID NO: 2772351 - RNA, 21 nt, Leptospira interrogans serovar lai str. 56601
uuuauaauagaguuacagaaa

SEQ ID NO: 2772352 - RNA, 21 nt, Leptospira interrogans serovar lai str. 56601
uuuauaauucccguuauaaau

SEQ ID NO: 2772353 - RNA, 20 nt, Leptospira interrogans serovar lai str. 56601
uuuauaauugaacauuuuua

SEQ ID NO: 2772354 - RNA, 23 nt, Leptospira interrogans serovar lai str. 56601
uuuauaauugaacauuuuuaaaa

SEQ ID NO: 2772355 - RNA, 13 nt, Leptospira interrogans serovar lai str. 56601
uuuauaauuuuua

SEQ ID NO: 2772356 - RNA, 19 nt, Leptospira interrogans serovar lai str. 56601
uuuauacauucguuuuaau

SEQ ID NO: 2772357 - RNA, 22 nt, Leptospira interrogans serovar lai str. 56601
uuuauacgcccgaguaauaaga

SEQ ID NO: 2772358 - RNA, 22 nt, Leptospira interrogans serovar lai str. 56601
uuuauacggaugugaauucucu

SEQ ID NO: 2772359 - RNA, 13 nt, Leptospira interrogans serovar lai str. 56601
uuuauacucggaa

SEQ ID NO: 2772360 - RNA, 15 nt, Leptospira interrogans serovar lai str. 56601
uuuauagaaaauuuu

SEQ ID NO: 2772361 - RNA, 22 nt, Leptospira interrogans serovar lai str. 56601
uuuauagaucgauucuuuaaau

SEQ ID NO: 2772362 - RNA, 20 nt, Leptospira interrogans serovar lai str. 56601
uuuauaguuuuuaacuguuu

SEQ ID NO: 2772363 - RNA, 15 nt, Leptospira interrogans serovar lai str. 56601
uuuauauaaaauuug

SEQ ID NO: 2772364 - RNA, 17 nt, Leptospira interrogans serovar lai str. 56601
uuuauauagaaccaucu

SEQ ID NO: 2772365 - RNA, 22 nt, Leptospira interrogans serovar lai str. 56601
uuuauauaguaaauaccuguuc

SEQ ID NO: 2772366 - RNA, 20 nt, Leptospira interrogans serovar lai str. 56601
uuuauauauauucacaaaaa

SEQ ID NO: 2772367 - RNA, 18 nt, Leptospira interrogans serovar lai str. 56601
uuuauauuucauugaaau

SEQ ID NO: 2772368 - RNA, 17 nt, Leptospira interrogans serovar lai str. 56601
uuuaucaaauaaaguuu

SEQ ID NO: 2772369 - RNA, 19 nt, Leptospira interrogans serovar lai str. 56601
uuuaucaaauaaaguuuua

SEQ ID NO: 2772370 - RNA, 14 nt, Leptospira interrogans serovar lai str. 56601
uuuaucagaugugu

SEQ ID NO: 2772371 - RNA, 14 nt, Leptospira interrogans serovar lai str. 56601
uuuauccauaaauu

SEQ ID NO: 2772372 - RNA, 17 nt, Leptospira interrogans serovar lai str. 56601
uuuauccauaaauucua

SEQ ID NO: 2772373 - RNA, 14 nt, Leptospira interrogans serovar lai str. 56601
uuuaucgcaaagcu

SEQ ID NO: 2772374 - RNA, 21 nt, Leptospira interrogans serovar lai str. 56601
uuuaucguacaucuucucuaa

SEQ ID NO: 2772375 - RNA, 15 nt, Leptospira interrogans serovar lai str. 56601
uuuaucuaaaacaca

SEQ ID NO: 2772376 - RNA, 16 nt, Leptospira interrogans serovar lai str. 56601
uuuaucuguaaaauuu

SEQ ID NO: 2772377 - RNA, 16 nt, Leptospira interrogans serovar lai str. 56601
uuuaugaaaaaauuca

SEQ ID NO: 2772378 - RNA, 15 nt, Leptospira interrogans serovar lai str. 56601
uuuaugaauaaaaaa

SEQ ID NO: 2772379 - RNA, 16 nt, Leptospira interrogans serovar lai str. 56601
uuucauugaaauauga

SEQ ID NO: 2772380 - RNA, 23 nt, Leptospira interrogans serovar lai str. 56601
uuucauugcgggacuuugcucuc

SEQ ID NO: 2772381 - RNA, 12 nt, Leptospira interrogans serovar lai str. 56601
uuucauuuuucc

SEQ ID NO: 2772382 - RNA, 18 nt, Leptospira interrogans serovar lai str. 56601
uuuccaaaaagaaaaaca

SEQ ID NO: 2772383 - RNA, 21 nt, Leptospira interrogans serovar lai str. 56601
uuuccaaaagcaaaaucgauu

SEQ ID NO: 2772384 - RNA, 14 nt, Leptospira interrogans serovar lai str. 56601
uuuccaaacucaau

SEQ ID NO: 2772385 - RNA, 17 nt, Leptospira interrogans serovar lai str. 56601
uuuccaaacucaaugcu

SEQ ID NO: 2772386 - RNA, 21 nt, Leptospira interrogans serovar lai str. 56601
uuuccaaacucaaugcugcuc

SEQ ID NO: 2772387 - RNA, 17 nt, Leptospira interrogans serovar lai str. 56601
uuuccaacuguuuauau

SEQ ID NO: 2772388 - RNA, 20 nt, Leptospira interrogans serovar lai str. 56601
uuuccaccggaguaaggcaa

SEQ ID NO: 2772389 - RNA, 23 nt, Leptospira interrogans serovar lai str. 56601
uuuccaccggaguaaggcaaacu

SEQ ID NO: 2772390 - RNA, 18 nt, Leptospira interrogans serovar lai str. 56601
uuuccacuacaaucacuu

SEQ ID NO: 2772391 - RNA, 21 nt, Leptospira interrogans serovar lai str. 56601
uuuccagaaaccauaaaauaa

SEQ ID NO: 2772392 - RNA, 14 nt, Leptospira interrogans serovar lai str. 56601
uuuccagaucauuu

SEQ ID NO: 2772393 - RNA, 15 nt, Leptospira interrogans serovar lai str. 56601
uuuccauaaaaaaca

SEQ ID NO: 2772394 - RNA, 20 nt, Leptospira interrogans serovar lai str. 56601
uuuccauaaaauagaaacag

SEQ ID NO: 2772395 - RNA, 13 nt, Leptospira interrogans serovar lai str. 56601
uuuccaugaaaua

SEQ ID NO: 2772396 - RNA, 13 nt, Leptospira interrogans serovar lai str. 56601
uuucccaaaauuu

SEQ ID NO: 2772397 - RNA, 21 nt, Leptospira interrogans serovar lai str. 56601
uuucccaaacaggaaaauuua

SEQ ID NO: 2772398 - RNA, 16 nt, Leptospira interrogans serovar lai str. 56601
uuucccaguucuuaaa

SEQ ID NO: 2772399 - RNA, 19 nt, Leptospira interrogans serovar lai str. 56601
uuucccaguucuuaaauaa

SEQ ID NO: 2772400 - RNA, 19 nt, Leptospira interrogans serovar lai str. 56601
uuuccccaagacgucuaca

SEQ ID NO: 2772401 - RNA, 16 nt, Leptospira interrogans serovar lai str. 56601
uuuccccccacccaaa

SEQ ID NO: 2772402 - RNA, 18 nt, Leptospira interrogans serovar lai str. 56601
uuuccccguuuuacgauc

SEQ ID NO: 2772403 - RNA, 22 nt, Leptospira interrogans serovar lai str. 56601
uuucccgcuggaaaaugaaaac

SEQ ID NO: 2772404 - RNA, 17 nt, Leptospira interrogans serovar lai str. 56601
uuuccgaaccuuaccac

SEQ ID NO: 2772405 - RNA, 20 nt, Leptospira interrogans serovar lai str. 56601
uuuccgaaccuuaccacccc

SEQ ID NO: 2772406 - RNA, 15 nt, Leptospira interrogans serovar lai str. 56601
uuuccgauaaagaaa

SEQ ID NO: 2772407 - RNA, 18 nt, Leptospira interrogans serovar lai str. 56601
uuuccggaauacuuuucu

SEQ ID NO: 2772408 - RNA, 14 nt, Leptospira interrogans serovar lai str. 56601
uuuccggaauccga

SEQ ID NO: 2772409 - RNA, 17 nt, Leptospira interrogans serovar lai str. 56601
uuuccggacuuuccaga

SEQ ID NO: 2772410 - RNA, 19 nt, Leptospira interrogans serovar lai str. 56601
uuuccgggucgauuuugau

SEQ ID NO: 2772411 - RNA, 14 nt, Leptospira interrogans serovar lai str. 56601
uuuccguaccccaa

SEQ ID NO: 2772412 - RNA, 18 nt, Leptospira interrogans serovar lai str. 56601
uuuccguagaucuuuuau

SEQ ID NO: 2772413 - RNA, 14 nt, Leptospira interrogans serovar lai str. 56601
uuuccguuaauaaa

SEQ ID NO: 2772414 - RNA, 14 nt, Leptospira interrogans serovar lai str. 56601
uuuccguuuaacaa

SEQ ID NO: 2772415 - RNA, 12 nt, Leptospira interrogans serovar lai str. 56601
uuuccuaaaauu

SEQ ID NO: 2772416 - RNA, 21 nt, Leptospira interrogans serovar lai str. 56601
uuuccuaaaauuuugcaguaa

SEQ ID NO: 2772417 - RNA, 21 nt, Leptospira interrogans serovar lai str. 56601
uuuccuaauauaucagauuga

SEQ ID NO: 2772418 - RNA, 17 nt, Leptospira interrogans serovar lai str. 56601
uuuccucuugaagauuu

SEQ ID NO: 2772419 - RNA, 22 nt, Leptospira interrogans serovar lai str. 56601
uuuccuuaagacccuaaaaaau

SEQ ID NO: 2772420 - RNA, 21 nt, Leptospira interrogans serovar lai str. 56601
uuuccuucuuucugaaauaaa

SEQ ID NO: 2772421 - RNA, 14 nt, Leptospira interrogans serovar lai str. 56601
uuuccuuuccuuga

SEQ ID NO: 2772422 - RNA, 18 nt, Leptospira interrogans serovar lai str. 56601
uuuccuuuccuugaaaaa

SEQ ID NO: 2772423 - RNA, 16 nt, Leptospira interrogans serovar lai str. 56601
uuuccuuucucugaau

SEQ ID NO: 2772424 - RNA, 21 nt, Leptospira interrogans serovar lai str. 56601
uuuccuuuucgacuauuucuu

SEQ ID NO: 2772425 - RNA, 13 nt, Leptospira interrogans serovar lai str. 56601
uuucgaaaacgau

SEQ ID NO: 2772426 - RNA, 12 nt, Leptospira interrogans serovar lai str. 56601
uuucgaaaacuu

SEQ ID NO: 2772427 - RNA, 13 nt, Leptospira interrogans serovar lai str. 56601
uuucgaaacaaaa

SEQ ID NO: 2772428 - RNA, 15 nt, Leptospira interrogans serovar lai str. 56601
uuucgaaauuuuaca

SEQ ID NO: 2772429 - RNA, 13 nt, Leptospira interrogans serovar lai str. 56601
uuucgaauucuuu

SEQ ID NO: 2772430 - RNA, 18 nt, Leptospira interrogans serovar lai str. 56601
uuucgacaacuuauaauu

SEQ ID NO: 2772431 - RNA, 17 nt, Leptospira interrogans serovar lai str. 56601
uuucgagugguucuaau

SEQ ID NO: 2772432 - RNA, 16 nt, Leptospira interrogans serovar lai str. 56601
uuucgauuuuaaauaa

SEQ ID NO: 2772433 - RNA, 20 nt, Leptospira interrogans serovar lai str. 56601
uuucgcauaccgaacucacg

SEQ ID NO: 2772434 - RNA, 22 nt, Leptospira interrogans serovar lai str. 56601
uuucggcuugauaccuaaugcu

SEQ ID NO: 2772435 - RNA, 15 nt, Leptospira interrogans serovar lai str. 56601
uuucgugauaacaaa

SEQ ID NO: 2772436 - RNA, 16 nt, Leptospira interrogans serovar lai str. 56601
uuucgugauaacaaac

SEQ ID NO: 2772437 - RNA, 20 nt, Leptospira interrogans serovar lai str. 56601
uuucgugauaacaaacuuuu

SEQ ID NO: 2772438 - RNA, 13 nt, Leptospira interrogans serovar lai str. 56601
uuucguucggaaa

SEQ ID NO: 2772439 - RNA, 14 nt, Leptospira interrogans serovar lai str. 56601
uuucguucggaaaa

SEQ ID NO: 2772440 - RNA, 21 nt, Leptospira interrogans serovar lai str. 56601
uuucguucggaaaaaguauaa

SEQ ID NO: 2772441 - RNA, 17 nt, Leptospira interrogans serovar lai str. 56601
uuucguuucccucuucu

SEQ ID NO: 2772442 - RNA, 17 nt, Leptospira interrogans serovar lai str. 56601
uuucguuucgaaaauuu

SEQ ID NO: 2772443 - RNA, 15 nt, Leptospira interrogans serovar lai str. 56601
uuucguuucugagga

SEQ ID NO: 2772444 - RNA, 15 nt, Leptospira interrogans serovar lai str. 56601
uuucuaaaaauuucc

SEQ ID NO: 2772445 - RNA, 11 nt, Leptospira interrogans serovar lai str. 56601
uuucuaaaaua

SEQ ID NO: 2772446 - RNA, 12 nt, Leptospira interrogans serovar lai str. 56601
uuucuaaaauau

SEQ ID NO: 2772447 - RNA, 13 nt, Leptospira interrogans serovar lai str. 56601
uuucuaaaauaua

SEQ ID NO: 2772448 - RNA, 11 nt, Leptospira interrogans serovar lai str. 56601
uuucuaaaaug

SEQ ID NO: 2772449 - RNA, 15 nt, Leptospira interrogans serovar lai str. 56601
uuucuaaaugaguuu

SEQ ID NO: 2772450 - RNA, 18 nt, Leptospira interrogans serovar lai str. 56601
uuucuaaauugagaauuu

SEQ ID NO: 2772451 - RNA, 13 nt, Leptospira interrogans serovar lai str. 56601
uuucuaaauugug

SEQ ID NO: 2772452 - RNA, 21 nt, Leptospira interrogans serovar lai str. 56601
uuucuaaauugugagaacuac

SEQ ID NO: 2772453 - RNA, 22 nt, Leptospira interrogans serovar lai str. 56601
uuucuaagguuugucuacguac

SEQ ID NO: 2772454 - RNA, 21 nt, Leptospira interrogans serovar lai str. 56601
uuucuaauaaaauaugaguuu

SEQ ID NO: 2772455 - RNA, 22 nt, Leptospira interrogans serovar lai str. 56601
uuucuaauagagaaaaauuuuc

SEQ ID NO: 2772456 - RNA, 17 nt, Leptospira interrogans serovar lai str. 56601
uuucuaauaguugaaau

SEQ ID NO: 2772457 - RNA, 12 nt, Leptospira interrogans serovar lai str. 56601
uuucuaauauua

SEQ ID NO: 2772458 - RNA, 16 nt, Leptospira interrogans serovar lai str. 56601
uuucuaauauuaaaaa

SEQ ID NO: 2772459 - RNA, 19 nt, Leptospira interrogans serovar lai str. 56601
uuucuaauauuaaaaacac

SEQ ID NO: 2772460 - RNA, 17 nt, Leptospira interrogans serovar lai str. 56601
uuucuaauauucaaauu

SEQ ID NO: 2772461 - RNA, 23 nt, Leptospira interrogans serovar lai str. 56601
uuucuaaucccgccaaaaaugcc

SEQ ID NO: 2772462 - RNA, 13 nt, Leptospira interrogans serovar lai str. 56601
uuugaaguauuuu

SEQ ID NO: 2772463 - RNA, 22 nt, Leptospira interrogans serovar lai str. 56601
uuugaauaaaaccgcugaaaaa

SEQ ID NO: 2772464 - RNA, 23 nt, Leptospira interrogans serovar lai str. 56601
uuugaauauagcacaaaugacau

SEQ ID NO: 2772465 - RNA, 14 nt, Leptospira interrogans serovar lai str. 56601
uuugaauccaaaag

SEQ ID NO: 2772466 - RNA, 17 nt, Leptospira interrogans serovar lai str. 56601
uuugaaugacacaaaaa

SEQ ID NO: 2772467 - RNA, 20 nt, Leptospira interrogans serovar lai str. 56601
uuugaaugacacaaaaaacu

SEQ ID NO: 2772468 - RNA, 13 nt, Leptospira interrogans serovar lai str. 56601
uuugaauuucuuu

SEQ ID NO: 2772469 - RNA, 14 nt, Leptospira interrogans serovar lai str. 56601
uuugaauuuuacua

SEQ ID NO: 2772470 - RNA, 16 nt, Leptospira interrogans serovar lai str. 56601
uuugaauuuuacuaaa

SEQ ID NO: 2772471 - RNA, 17 nt, Leptospira interrogans serovar lai str. 56601
uuugaauuuuuaagaau

SEQ ID NO: 2772472 - RNA, 13 nt, Leptospira interrogans serovar lai str. 56601
uuugaauuuuucg

SEQ ID NO: 2772473 - RNA, 17 nt, Leptospira interrogans serovar lai str. 56601
uuugacaauuugugaac

SEQ ID NO: 2772474 - RNA, 16 nt, Leptospira interrogans serovar lai str. 56601
uuugacguaaaaaaau

SEQ ID NO: 2772475 - RNA, 20 nt, Leptospira interrogans serovar lai str. 56601
uuugacguaaaaaaaucugg

SEQ ID NO: 2772476 - RNA, 17 nt, Leptospira interrogans serovar lai str. 56601
uuugagaaaauccaguc

SEQ ID NO: 2772477 - RNA, 14 nt, Leptospira interrogans serovar lai str. 56601
uuugagaaacuucg

SEQ ID NO: 2772478 - RNA, 18 nt, Leptospira interrogans serovar lai str. 56601
uuugagaaucuucauuuu

SEQ ID NO: 2772479 - RNA, 19 nt, Leptospira interrogans serovar lai str. 56601
uuugagacagguucugaua

SEQ ID NO: 2772480 - RNA, 23 nt, Leptospira interrogans serovar lai str. 56601
uuugagagccuuuuuauuucuaa

SEQ ID NO: 2772481 - RNA, 15 nt, Leptospira interrogans serovar lai str. 56601
uuugagaugugggaa

SEQ ID NO: 2772482 - RNA, 15 nt, Leptospira interrogans serovar lai str. 56601
uuugagauuaaaaag

SEQ ID NO: 2772483 - RNA, 18 nt, Leptospira interrogans serovar lai str. 56601
uuugagcaguucuaaucu

SEQ ID NO: 2772484 - RNA, 20 nt, Leptospira interrogans serovar lai str. 56601
uuugaguagaagccaaugug

SEQ ID NO: 2772485 - RNA, 21 nt, Leptospira interrogans serovar lai str. 56601
uuugauauaaucuuaauauuu

SEQ ID NO: 2772486 - RNA, 22 nt, Leptospira interrogans serovar lai str. 56601
uuugauauaaucuuaauauuuc

SEQ ID NO: 2772487 - RNA, 23 nt, Leptospira interrogans serovar lai str. 56601
uuugauauacugguuuuggagac

SEQ ID NO: 2772488 - RNA, 17 nt, Leptospira interrogans serovar lai str. 56601
uuugauccguuuuaaaa

SEQ ID NO: 2772489 - RNA, 19 nt, Leptospira interrogans serovar lai str. 56601
uuugaucuuuuugauaaaa

SEQ ID NO: 2772490 - RNA, 13 nt, Leptospira interrogans serovar lai str. 56601
uuugaugaaauag

SEQ ID NO: 2772491 - RNA, 15 nt, Leptospira interrogans serovar lai str. 56601
uuugaugaaauaguc

SEQ ID NO: 2772492 - RNA, 14 nt, Leptospira interrogans serovar lai str. 56601
uuugaugaaugaau

SEQ ID NO: 2772493 - RNA, 20 nt, Leptospira interrogans serovar lai str. 56601
uuugauuaaaaauuucuaaa

SEQ ID NO: 2772494 - RNA, 21 nt, Leptospira interrogans serovar lai str. 56601
uuugauuacaaagcacuguuu

SEQ ID NO: 2772495 - RNA, 13 nt, Leptospira interrogans serovar lai str. 56601
uuugauuagaaaa

SEQ ID NO: 2772496 - RNA, 22 nt, Leptospira interrogans serovar lai str. 56601
uuugauuccaaagauaaaaaag

SEQ ID NO: 2772497 - RNA, 22 nt, Leptospira interrogans serovar lai str. 56601
uuugauucggauuucugaaaaa

SEQ ID NO: 2772498 - RNA, 12 nt, Leptospira interrogans serovar lai str. 56601
uuugauugaauu

SEQ ID NO: 2772499 - RNA, 13 nt, Leptospira interrogans serovar lai str. 56601
uuugcaaaaaaaa

SEQ ID NO: 2772500 - RNA, 17 nt, Leptospira interrogans serovar lai str. 56601
uuugcaaaaaaaauacg

SEQ ID NO: 2772501 - RNA, 14 nt, Leptospira interrogans serovar lai str. 56601
uuugcaaaaaaaua

SEQ ID NO: 2772502 - RNA, 12 nt, Leptospira interrogans serovar lai str. 56601
uuugcaaguaaa

SEQ ID NO: 2772503 - RNA, 21 nt, Leptospira interrogans serovar lai str. 56601
uuugcacguaaacauucaagg

SEQ ID NO: 2772504 - RNA, 14 nt, Leptospira interrogans serovar lai str. 56601
uuugcacugaaaua

SEQ ID NO: 2772505 - RNA, 18 nt, Leptospira interrogans serovar lai str. 56601
uuugcccagaguuuguug

SEQ ID NO: 2772506 - RNA, 14 nt, Leptospira interrogans serovar lai str. 56601
uuugcgaaaaaaau

SEQ ID NO: 2772507 - RNA, 19 nt, Leptospira interrogans serovar lai str. 56601
uuugcgggaacucccacaa

SEQ ID NO: 2772508 - RNA, 21 nt, Leptospira interrogans serovar lai str. 56601
uuugcucacuaccuuauaaaa

SEQ ID NO: 2772509 - RNA, 20 nt, Leptospira interrogans serovar lai str. 56601
uuugcucagagaauaucuga

SEQ ID NO: 2772510 - RNA, 17 nt, Leptospira interrogans serovar lai str. 56601
uuugcuguaaaauuuag

SEQ ID NO: 2772511 - RNA, 19 nt, Leptospira interrogans serovar lai str. 56601
uuugcuuaaagcauuaaaa

SEQ ID NO: 2772512 - RNA, 16 nt, Leptospira interrogans serovar lai str. 56601
uuugcuucaacacuga

SEQ ID NO: 2772513 - RNA, 13 nt, Leptospira interrogans serovar lai str. 56601
uuugcuuuucuau

SEQ ID NO: 2772514 - RNA, 16 nt, Leptospira interrogans serovar lai str. 56601
uuuggaaauuuuuaau

SEQ ID NO: 2772515 - RNA, 19 nt, Leptospira interrogans serovar lai str. 56601
uuuggaaucugcaucuuuu

SEQ ID NO: 2772516 - RNA, 17 nt, Leptospira interrogans serovar lai str. 56601
uuuggagaccaaaaauc

SEQ ID NO: 2772517 - RNA, 20 nt, Leptospira interrogans serovar lai str. 56601
uuuggauuuuauaaaguaaa

SEQ ID NO: 2772518 - RNA, 13 nt, Leptospira interrogans serovar lai str. 56601
uuuggauuuugau

SEQ ID NO: 2772519 - RNA, 22 nt, Leptospira interrogans serovar lai str. 56601
uuuggcauacaucucuaacauc

SEQ ID NO: 2772520 - RNA, 19 nt, Leptospira interrogans serovar lai str. 56601
uuuggcucuugcuaaaauu

SEQ ID NO: 2772521 - RNA, 19 nt, Leptospira interrogans serovar lai str. 56601
uuugggacaaacuuuaauu

SEQ ID NO: 2772522 - RNA, 17 nt, Leptospira interrogans serovar lai str. 56601
uuugggcgaauaaaaaa

SEQ ID NO: 2772523 - RNA, 16 nt, Leptospira interrogans serovar lai str. 56601
uuugggguuguuucau

SEQ ID NO: 2772524 - RNA, 20 nt, Leptospira interrogans serovar lai str. 56601
uuuggguuuggaguauuuuu

SEQ ID NO: 2772525 - RNA, 18 nt, Leptospira interrogans serovar lai str. 56601
uuuggucgaucguuuuuu

SEQ ID NO: 2772526 - RNA, 22 nt, Leptospira interrogans serovar lai str. 56601
uuuggucgaucguuuuuugauc

SEQ ID NO: 2772527 - RNA, 17 nt, Leptospira interrogans serovar lai str. 56601
uuuggugauuuaaaaau

SEQ ID NO: 2772528 - RNA, 23 nt, Leptospira interrogans serovar lai str. 56601
uuuggugcggcgagacauaaaaa

SEQ ID NO: 2772529 - RNA, 22 nt, Leptospira interrogans serovar lai str. 56601
uuugguuaucauaaaaauaaag

SEQ ID NO: 2772530 - RNA, 17 nt, Leptospira interrogans serovar lai str. 56601
uuugguuucaauuuauc

SEQ ID NO: 2772531 - RNA, 16 nt, Leptospira interrogans serovar lai str. 56601
uuuguaaaaauucucc

SEQ ID NO: 2772532 - RNA, 13 nt, Leptospira interrogans serovar lai str. 56601
uuuguaaauaaac

SEQ ID NO: 2772533 - RNA, 18 nt, Leptospira interrogans serovar lai str. 56601
uuuguaaauauguuuuuu

SEQ ID NO: 2772534 - RNA, 22 nt, Leptospira interrogans serovar lai str. 56601
uuuguaaauauguuuuuuuuca

SEQ ID NO: 2772535 - RNA, 19 nt, Leptospira interrogans serovar lai str. 56601
uuuguaaccuuuguuuccu

SEQ ID NO: 2772536 - RNA, 19 nt, Leptospira interrogans serovar lai str. 56601
uuuguaaguuuuccauucu

SEQ ID NO: 2772537 - RNA, 16 nt, Leptospira interrogans serovar lai str. 56601
uuuguaaguuuugaau

SEQ ID NO: 2772538 - RNA, 18 nt, Leptospira interrogans serovar lai str. 56601
uuuguaauaguucccaca

SEQ ID NO: 2772539 - RNA, 22 nt, Leptospira interrogans serovar lai str. 56601
uuuguaauaguucccacaguuc

SEQ ID NO: 2772540 - RNA, 22 nt, Leptospira interrogans serovar lai str. 56601
uuuguaauaguucccacaguuu

SEQ ID NO: 2772541 - RNA, 19 nt, Leptospira interrogans serovar lai str. 56601
uuuguaauaguucccacau

SEQ ID NO: 2772542 - RNA, 16 nt, Leptospira interrogans serovar lai str. 56601
uuuguaaugaaaucua

SEQ ID NO: 2772543 - RNA, 22 nt, Leptospira interrogans serovar lai str. 56601
uuuguacaucuuaaaaaauaca

SEQ ID NO: 2772544 - RNA, 12 nt, Leptospira interrogans serovar lai str. 56601
uuuguauauaaa

SEQ ID NO: 2772545 - RNA, 20 nt, Leptospira interrogans serovar lai str. 56601
uuuuaaaucgacaaaaugag

SEQ ID NO: 2772546 - RNA, 14 nt, Leptospira interrogans serovar lai str. 56601
uuuuaaaugcagcu

SEQ ID NO: 2772547 - RNA, 23 nt, Leptospira interrogans serovar lai str. 56601
uuuuaaauguaagaguuccuaca

SEQ ID NO: 2772548 - RNA, 11 nt, Leptospira interrogans serovar lai str. 56601
uuuuaaaugug

SEQ ID NO: 2772549 - RNA, 18 nt, Leptospira interrogans serovar lai str. 56601
uuuuaaauuuacuauuuu

SEQ ID NO: 2772550 - RNA, 12 nt, Leptospira interrogans serovar lai str. 56601
uuuuaaauuuau

SEQ ID NO: 2772551 - RNA, 15 nt, Leptospira interrogans serovar lai str. 56601
uuuuaaauuuaucua

SEQ ID NO: 2772552 - RNA, 12 nt, Leptospira interrogans serovar lai str. 56601
uuuuaaauuuuu

SEQ ID NO: 2772553 - RNA, 13 nt, Leptospira interrogans serovar lai str. 56601
uuuuaaauuuuua

SEQ ID NO: 2772554 - RNA, 16 nt, Leptospira interrogans serovar lai str. 56601
uuuuaacgcaaaauac

SEQ ID NO: 2772555 - RNA, 17 nt, Leptospira interrogans serovar lai str. 56601
uuuuaacgcaaaauacu

SEQ ID NO: 2772556 - RNA, 17 nt, Leptospira interrogans serovar lai str. 56601
uuuuaagaaaacucaaa

SEQ ID NO: 2772557 - RNA, 22 nt, Leptospira interrogans serovar lai str. 56601
uuuuaagaacaauuuaaaauaa

SEQ ID NO: 2772558 - RNA, 23 nt, Leptospira interrogans serovar lai str. 56601
uuuuaagacucagcaaaaccuuu

SEQ ID NO: 2772559 - RNA, 18 nt, Leptospira interrogans serovar lai str. 56601
uuuuaagagccuacaaau

SEQ ID NO: 2772560 - RNA, 13 nt, Leptospira interrogans serovar lai str. 56601
uuuuaagauuaca

SEQ ID NO: 2772561 - RNA, 16 nt, Leptospira interrogans serovar lai str. 56601
uuuuaaguaauauuuc

SEQ ID NO: 2772562 - RNA, 22 nt, Leptospira interrogans serovar lai str. 56601
uuuuaaguagaaccuaaaaaua

SEQ ID NO: 2772563 - RNA, 14 nt, Leptospira interrogans serovar lai str. 56601
uuuuaauaaaauac

SEQ ID NO: 2772564 - RNA, 21 nt, Leptospira interrogans serovar lai str. 56601
uuuuaauaaaaugcaauaguu

SEQ ID NO: 2772565 - RNA, 18 nt, Leptospira interrogans serovar lai str. 56601
uuuuaauaugacuuaauc

SEQ ID NO: 2772566 - RNA, 15 nt, Leptospira interrogans serovar lai str. 56601
uuuuaauauuacauu

SEQ ID NO: 2772567 - RNA, 23 nt, Leptospira interrogans serovar lai str. 56601
uuuuaauauuacauucaauaauu

SEQ ID NO: 2772568 - RNA, 17 nt, Leptospira interrogans serovar lai str. 56601
uuuuaauauuauuaaau

SEQ ID NO: 2772569 - RNA, 20 nt, Leptospira interrogans serovar lai str. 56601
uuuuaauauuauuaaauuuu

SEQ ID NO: 2772570 - RNA, 22 nt, Leptospira interrogans serovar lai str. 56601
uuuuaaucaagugcaguaguuc

SEQ ID NO: 2772571 - RNA, 19 nt, Leptospira interrogans serovar lai str. 56601
uuuuaaucauccaauaauu

SEQ ID NO: 2772572 - RNA, 18 nt, Leptospira interrogans serovar lai str. 56601
uuuuaaucgcucugaagu

SEQ ID NO: 2772573 - RNA, 22 nt, Leptospira interrogans serovar lai str. 56601
uuuuaaucuccgcucuauuucc

SEQ ID NO: 2772574 - RNA, 15 nt, Leptospira interrogans serovar lai str. 56601
uuuuaauguuacaua

SEQ ID NO: 2772575 - RNA, 14 nt, Leptospira interrogans serovar lai str. 56601
uuuuaauuuguuuu

SEQ ID NO: 2772576 - RNA, 22 nt, Leptospira interrogans serovar lai str. 56601
uuuuacaaacaaauuccgaaau

SEQ ID NO: 2772577 - RNA, 20 nt, Leptospira interrogans serovar lai str. 56601
uuuuacaaacaaauucuaaa

SEQ ID NO: 2772578 - RNA, 22 nt, Leptospira interrogans serovar lai str. 56601
uuuuacaaacaaauucuaaaau

SEQ ID NO: 2772579 - RNA, 20 nt, Leptospira interrogans serovar lai str. 56601
uuuuacaaagacucggaaau

SEQ ID NO: 2772580 - RNA, 16 nt, Leptospira interrogans serovar lai str. 56601
uuuuacagaaaaauca

SEQ ID NO: 2772581 - RNA, 16 nt, Leptospira interrogans serovar lai str. 56601
uuuuacagaagauuuu

SEQ ID NO: 2772582 - RNA, 22 nt, Leptospira interrogans serovar lai str. 56601
uuuuacagacguauuuuuaaau

SEQ ID NO: 2772583 - RNA, 18 nt, Leptospira interrogans serovar lai str. 56601
uuuuacagauugauucuu

SEQ ID NO: 2772584 - RNA, 12 nt, Leptospira interrogans serovar lai str. 56601
uuuuacagauuu

SEQ ID NO: 2772585 - RNA, 22 nt, Leptospira interrogans serovar lai str. 56601
uuuuacagauuuauuuuagaau

SEQ ID NO: 2772586 - RNA, 20 nt, Leptospira interrogans serovar lai str. 56601
uuuuacagccaccaucaaaa

SEQ ID NO: 2772587 - RNA, 13 nt, Leptospira interrogans serovar lai str. 56601
uuuuacaguaaaa

SEQ ID NO: 2772588 - RNA, 14 nt, Leptospira interrogans serovar lai str. 56601
uuuuacauuguuuu

SEQ ID NO: 2772589 - RNA, 22 nt, Leptospira interrogans serovar lai str. 56601
uuuuaccaugagcuaauucaac

SEQ ID NO: 2772590 - RNA, 20 nt, Leptospira interrogans serovar lai str. 56601
uuuuacccugguuucaaaaa

SEQ ID NO: 2772591 - RNA, 21 nt, Leptospira interrogans serovar lai str. 56601
uuuuacccugguuucaaaaaa

SEQ ID NO: 2772592 - RNA, 17 nt, Leptospira interrogans serovar lai str. 56601
uuuuaccguuuuuaaau

SEQ ID NO: 2772593 - RNA, 14 nt, Leptospira interrogans serovar lai str. 56601
uuuuacgaaaaaau

SEQ ID NO: 2772594 - RNA, 20 nt, Leptospira interrogans serovar lai str. 56601
uuuuacgaacaaauucuaaa

SEQ ID NO: 2772595 - RNA, 20 nt, Leptospira interrogans serovar lai str. 56601
uuuuacgaaccaauucuaaa

SEQ ID NO: 2772596 - RNA, 17 nt, Leptospira interrogans serovar lai str. 56601
uuuuacgauuaaauuuu

SEQ ID NO: 2772597 - RNA, 18 nt, Leptospira interrogans serovar lai str. 56601
uuuuacgauuaaauuuug

SEQ ID NO: 2772598 - RNA, 18 nt, Leptospira interrogans serovar lai str. 56601
uuuuacgcguaauuuuuu

SEQ ID NO: 2772599 - RNA, 15 nt, Leptospira interrogans serovar lai str. 56601
uuuuacgugaaguag

SEQ ID NO: 2772600 - RNA, 15 nt, Leptospira interrogans serovar lai str. 56601
uuuuacguuauaauu

SEQ ID NO: 2772601 - RNA, 15 nt, Leptospira interrogans serovar lai str. 56601
uuuuacuaaaaaaca

SEQ ID NO: 2772602 - RNA, 17 nt, Leptospira interrogans serovar lai str. 56601
uuuuacuguuguuaaau

SEQ ID NO: 2772603 - RNA, 19 nt, Leptospira interrogans serovar lai str. 56601
uuuuagaaaaaauuuuucu

SEQ ID NO: 2772604 - RNA, 14 nt, Leptospira interrogans serovar lai str. 56601
uuuuagaaaauuuu

SEQ ID NO: 2772605 - RNA, 19 nt, Leptospira interrogans serovar lai str. 56601
uuuuagaaaauuuuuacuc

SEQ ID NO: 2772606 - RNA, 21 nt, Leptospira interrogans serovar lai str. 56601
uuuuagaaaucaauucuucuu

SEQ ID NO: 2772607 - RNA, 16 nt, Leptospira interrogans serovar lai str. 56601
uuuuagaagauuuuua

SEQ ID NO: 2772608 - RNA, 14 nt, Leptospira interrogans serovar lai str. 56601
uuuuagaauauuau

SEQ ID NO: 2772609 - RNA, 23 nt, Leptospira interrogans serovar lai str. 56601
uuuuagaauauuaugaaauaaag

SEQ ID NO: 2772610 - RNA, 12 nt, Leptospira interrogans serovar lai str. 56601
uuuuagaaugag

SEQ ID NO: 2772611 - RNA, 14 nt, Leptospira interrogans serovar lai str. 56601
uuuuagaauucucc

SEQ ID NO: 2772612 - RNA, 18 nt, Leptospira interrogans serovar lai str. 56601
uuuuagacaaaaaauucu

SEQ ID NO: 2772613 - RNA, 21 nt, Leptospira interrogans serovar lai str. 56601
uuuuagacaaaaauacuaaau

SEQ ID NO: 2772614 - RNA, 19 nt, Leptospira interrogans serovar lai str. 56601
uuuuagacuggcuucgagu

SEQ ID NO: 2772615 - RNA, 15 nt, Leptospira interrogans serovar lai str. 56601
uuuuagagaaacuuu

SEQ ID NO: 2772616 - RNA, 19 nt, Leptospira interrogans serovar lai str. 56601
uuuuagagaaacuuuaaau

SEQ ID NO: 2772617 - RNA, 20 nt, Leptospira interrogans serovar lai str. 56601
uuuuagaguuuguuccaaaa

SEQ ID NO: 2772618 - RNA, 18 nt, Leptospira interrogans serovar lai str. 56601
uuuuagccuggaauucuu

SEQ ID NO: 2772619 - RNA, 13 nt, Leptospira interrogans serovar lai str. 56601
uuuuagguauuuc

SEQ ID NO: 2772620 - RNA, 16 nt, Leptospira interrogans serovar lai str. 56601
uuuuaguaaaauuuaa

SEQ ID NO: 2772621 - RNA, 14 nt, Leptospira interrogans serovar lai str. 56601
uuuuaguaaacuac

SEQ ID NO: 2772622 - RNA, 23 nt, Leptospira interrogans serovar lai str. 56601
uuuuaguaguuccacauuuauuu

SEQ ID NO: 2772623 - RNA, 19 nt, Leptospira interrogans serovar lai str. 56601
uuuuagugcgguauuuuuu

SEQ ID NO: 2772624 - RNA, 14 nt, Leptospira interrogans serovar lai str. 56601
uuuuaguucaaaaa

SEQ ID NO: 2772625 - RNA, 16 nt, Leptospira interrogans serovar lai str. 56601
uuuuaguuguacaaaa

SEQ ID NO: 2772626 - RNA, 19 nt, Leptospira interrogans serovar lai str. 56601
uuuuaguuuauuuuaaaaa

SEQ ID NO: 2772627 - RNA, 17 nt, Leptospira interrogans serovar lai str. 56601
uuuuaguuucaauuuag

SEQ ID NO: 2772628 - RNA, 14 nt, Leptospira interrogans serovar lai str. 56601
uuuucgcacauucu

SEQ ID NO: 2772629 - RNA, 17 nt, Leptospira interrogans serovar lai str. 56601
uuuucgccgaaacauuc

SEQ ID NO: 2772630 - RNA, 11 nt, Leptospira interrogans serovar lai str. 56601
uuuucggaaau

SEQ ID NO: 2772631 - RNA, 15 nt, Leptospira interrogans serovar lai str. 56601
uuuucggaacaagau

SEQ ID NO: 2772632 - RNA, 16 nt, Leptospira interrogans serovar lai str. 56601
uuuucggaauccgaaa

SEQ ID NO: 2772633 - RNA, 20 nt, Leptospira interrogans serovar lai str. 56601
uuuucggaauccgaaaaguu

SEQ ID NO: 2772634 - RNA, 23 nt, Leptospira interrogans serovar lai str. 56601
uuuucgguaaaaucauucuuuug

SEQ ID NO: 2772635 - RNA, 21 nt, Leptospira interrogans serovar lai str. 56601
uuuucgguucgggauuuuuuu

SEQ ID NO: 2772636 - RNA, 18 nt, Leptospira interrogans serovar lai str. 56601
uuuucgucgacuuugacu

SEQ ID NO: 2772637 - RNA, 18 nt, Leptospira interrogans serovar lai str. 56601
uuuucgugauaacaaacu

SEQ ID NO: 2772638 - RNA, 22 nt, Leptospira interrogans serovar lai str. 56601
uuuucgugauaacaaacuuuua

SEQ ID NO: 2772639 - RNA, 17 nt, Leptospira interrogans serovar lai str. 56601
uuuucguuucugaggaa

SEQ ID NO: 2772640 - RNA, 22 nt, Leptospira interrogans serovar lai str. 56601
uuuucguuucugaggaauuaag

SEQ ID NO: 2772641 - RNA, 16 nt, Leptospira interrogans serovar lai str. 56601
uuuucguuuuuuagaa

SEQ ID NO: 2772642 - RNA, 18 nt, Leptospira interrogans serovar lai str. 56601
uuuucuaaaaaaaaugga

SEQ ID NO: 2772643 - RNA, 15 nt, Leptospira interrogans serovar lai str. 56601
uuuucuaaaaaaacg

SEQ ID NO: 2772644 - RNA, 14 nt, Leptospira interrogans serovar lai str. 56601
uuuucuaaaauaua

SEQ ID NO: 2772645 - RNA, 15 nt, Leptospira interrogans serovar lai str. 56601
uuuucuaaaauauag

SEQ ID NO: 2772646 - RNA, 20 nt, Leptospira interrogans serovar lai str. 56601
uuuucuaaauuaauauuuau

SEQ ID NO: 2772647 - RNA, 21 nt, Leptospira interrogans serovar lai str. 56601
uuuucuaaauuuuauaaaauu

SEQ ID NO: 2772648 - RNA, 15 nt, Leptospira interrogans serovar lai str. 56601
uuuucuaaugcauuu

SEQ ID NO: 2772649 - RNA, 14 nt, Leptospira interrogans serovar lai str. 56601
uuuucuaguaguuc

SEQ ID NO: 2772650 - RNA, 13 nt, Leptospira interrogans serovar lai str. 56601
uuuucuaguuuuc

SEQ ID NO: 2772651 - RNA, 18 nt, Leptospira interrogans serovar lai str. 56601
uuuucuauaaucugaaau

SEQ ID NO: 2772652 - RNA, 13 nt, Leptospira interrogans serovar lai str. 56601
uuuucuaucaaga

SEQ ID NO: 2772653 - RNA, 13 nt, Leptospira interrogans serovar lai str. 56601
uuuucuauuuaac

SEQ ID NO: 2772654 - RNA, 19 nt, Leptospira interrogans serovar lai str. 56601
uuuucucagccaaaaguuu

SEQ ID NO: 2772655 - RNA, 20 nt, Leptospira interrogans serovar lai str. 56601
uuuucucaucaaaaaaauga

SEQ ID NO: 2772656 - RNA, 17 nt, Leptospira interrogans serovar lai str. 56601
uuuucuccuuuuuuacu

SEQ ID NO: 2772657 - RNA, 14 nt, Leptospira interrogans serovar lai str. 56601
uuuucucuaucaga

SEQ ID NO: 2772658 - RNA, 16 nt, Leptospira interrogans serovar lai str. 56601
uuuucucuaucagaaa

SEQ ID NO: 2772659 - RNA, 18 nt, Leptospira interrogans serovar lai str. 56601
uuuucucuucuaauucag

SEQ ID NO: 2772660 - RNA, 14 nt, Leptospira interrogans serovar lai str. 56601
uuuucugaaaaaag

SEQ ID NO: 2772661 - RNA, 15 nt, Leptospira interrogans serovar lai str. 56601
uuuucugaaaaaguu

SEQ ID NO: 2772662 - RNA, 15 nt, Leptospira interrogans serovar lai str. 56601
uuuucugaaaaguuu

SEQ ID NO: 2772663 - RNA, 19 nt, Leptospira interrogans serovar lai str. 56601
uuuucugaauaaaaauacu

SEQ ID NO: 2772664 - RNA, 22 nt, Leptospira interrogans serovar lai str. 56601
uuuucugauaaagaaaaccuuu

SEQ ID NO: 2772665 - RNA, 21 nt, Leptospira interrogans serovar lai str. 56601
uuuucugauagagaaaaauuu

SEQ ID NO: 2772666 - RNA, 15 nt, Leptospira interrogans serovar lai str. 56601
uuuucuggaaaaguu

SEQ ID NO: 2772667 - RNA, 16 nt, Leptospira interrogans serovar lai str. 56601
uuuucuggaaaaguuu

SEQ ID NO: 2772668 - RNA, 23 nt, Leptospira interrogans serovar lai str. 56601
uuuucuguaaaaauaaaauguag

SEQ ID NO: 2772669 - RNA, 14 nt, Leptospira interrogans serovar lai str. 56601
uuuucuuaaaaagu

SEQ ID NO: 2772670 - RNA, 24 nt, Leptospira interrogans serovar lai str. 56601
uuuucuuaauuucucuuauuagaa

SEQ ID NO: 2772671 - RNA, 22 nt, Leptospira interrogans serovar lai str. 56601
uuuucuuauaaccuaucacaaa

SEQ ID NO: 2772672 - RNA, 20 nt, Leptospira interrogans serovar lai str. 56601
uuuucuucccagauucccuu

SEQ ID NO: 2772673 - RNA, 11 nt, Leptospira interrogans serovar lai str. 56601
uuuucuucuuc

SEQ ID NO: 2772674 - RNA, 12 nt, Leptospira interrogans serovar lai str. 56601
uuuucuuuagaa

SEQ ID NO: 2772675 - RNA, 15 nt, Leptospira interrogans serovar lai str. 56601
uuuucuuuaucagaa

SEQ ID NO: 2772676 - RNA, 18 nt, Leptospira interrogans serovar lai str. 56601
uuuucuuugaaaaaauuu

SEQ ID NO: 2772677 - RNA, 21 nt, Leptospira interrogans serovar lai str. 56601
uuuucuuugaaaaaauuuuuu

SEQ ID NO: 2772678 - RNA, 18 nt, Leptospira interrogans serovar lai str. 56601
uuuucuuugaauugaaau

SEQ ID NO: 2772679 - RNA, 15 nt, Leptospira interrogans serovar lai str. 56601
uuuucuuugauugaa

SEQ ID NO: 2772680 - RNA, 13 nt, Leptospira interrogans serovar lai str. 56601
uuuucuuuuaaaa

SEQ ID NO: 2772681 - RNA, 14 nt, Leptospira interrogans serovar lai str. 56601
uuuucuuuuuaaau

SEQ ID NO: 2772682 - RNA, 18 nt, Leptospira interrogans serovar lai str. 56601
uuuugaaacauuucuaaa

SEQ ID NO: 2772683 - RNA, 19 nt, Leptospira interrogans serovar lai str. 56601
uuuugaaacauuucuaaaa

SEQ ID NO: 2772684 - RNA, 21 nt, Leptospira interrogans serovar lai str. 56601
uuuugaaauagauucuaauuu

SEQ ID NO: 2772685 - RNA, 22 nt, Leptospira interrogans serovar lai str. 56601
uuuugaacuacagaauuuuuua

SEQ ID NO: 2772686 - RNA, 21 nt, Leptospira interrogans serovar lai str. 56601
uuuugaagaaacaauucuucc

SEQ ID NO: 2772687 - RNA, 13 nt, Leptospira interrogans serovar lai str. 56601
uuuugaauuuuag

SEQ ID NO: 2772688 - RNA, 12 nt, Leptospira interrogans serovar lai str. 56601
uuuugaauuuuu

SEQ ID NO: 2772689 - RNA, 15 nt, Leptospira interrogans serovar lai str. 56601
uuuugagaaaaucca

SEQ ID NO: 2772690 - RNA, 19 nt, Leptospira interrogans serovar lai str. 56601
uuuugagaaaccuuuucua

SEQ ID NO: 2772691 - RNA, 13 nt, Leptospira interrogans serovar lai str. 56601
uuuugagauuaca

SEQ ID NO: 2772692 - RNA, 19 nt, Leptospira interrogans serovar lai str. 56601
uuuugagcacaauauauuc

SEQ ID NO: 2772693 - RNA, 13 nt, Leptospira interrogans serovar lai str. 56601
uuuugaguaauuc

SEQ ID NO: 2772694 - RNA, 17 nt, Leptospira interrogans serovar lai str. 56601
uuuugaguaguagaaaa

SEQ ID NO: 2772695 - RNA, 22 nt, Leptospira interrogans serovar lai str. 56601
uuuugaguccacagguuuuaaa

SEQ ID NO: 2772696 - RNA, 15 nt, Leptospira interrogans serovar lai str. 56601
uuuugauaaaauaua

SEQ ID NO: 2772697 - RNA, 22 nt, Leptospira interrogans serovar lai str. 56601
uuuugauaccgggauuuuaaaa

SEQ ID NO: 2772698 - RNA, 17 nt, Leptospira interrogans serovar lai str. 56601
uuuugauccguuuuaaa

SEQ ID NO: 2772699 - RNA, 16 nt, Leptospira interrogans serovar lai str. 56601
uuuugauuuguuucuu

SEQ ID NO: 2772700 - RNA, 19 nt, Leptospira interrogans serovar lai str. 56601
uuuugcaaguaaaaagacu

SEQ ID NO: 2772701 - RNA, 23 nt, Leptospira interrogans serovar lai str. 56601
uuuugcaaucguccaaucucuuu

SEQ ID NO: 2772702 - RNA, 17 nt, Leptospira interrogans serovar lai str. 56601
uuuugcacaaaaccucu

SEQ ID NO: 2772703 - RNA, 17 nt, Leptospira interrogans serovar lai str. 56601
uuuugcacaaaaucgcu

SEQ ID NO: 2772704 - RNA, 22 nt, Leptospira interrogans serovar lai str. 56601
uuuugccccuccguuuacaaaa

SEQ ID NO: 2772705 - RNA, 22 nt, Leptospira interrogans serovar lai str. 56601
uuuugcucacuaccuuauaaaa

SEQ ID NO: 2772706 - RNA, 14 nt, Leptospira interrogans serovar lai str. 56601
uuuugcucuaaaau

SEQ ID NO: 2772707 - RNA, 18 nt, Leptospira interrogans serovar lai str. 56601
uuuugcugguuguaagua

SEQ ID NO: 2772708 - RNA, 21 nt, Leptospira interrogans serovar lai str. 56601
uuuugcuguaaaauuuagauu

SEQ ID NO: 2772709 - RNA, 15 nt, Leptospira interrogans serovar lai str. 56601
uuuugcuucuaaaaa

SEQ ID NO: 2772710 - RNA, 17 nt, Leptospira interrogans serovar lai str. 56601
uuuuggaagauucuucu

SEQ ID NO: 2772711 - RNA, 16 nt, Leptospira interrogans serovar lai str. 56601
uuuuugauaaaauaua

SEQ ID NO: 2772712 - RNA, 13 nt, Leptospira interrogans serovar lai str. 56601
uuuuugauucaaa

SEQ ID NO: 2772713 - RNA, 14 nt, Leptospira interrogans serovar lai str. 56601
uuuuuggaaaucga

SEQ ID NO: 2772714 - RNA, 23 nt, Leptospira interrogans serovar lai str. 56601
uuuuuggccuaaggauccaauac

SEQ ID NO: 2772715 - RNA, 16 nt, Leptospira interrogans serovar lai str. 56601
uuuuugggaauuuuuu

SEQ ID NO: 2772716 - RNA, 17 nt, Leptospira interrogans serovar lai str. 56601
uuuuuggguuaaaguuu

SEQ ID NO: 2772717 - RNA, 14 nt, Leptospira interrogans serovar lai str. 56601
uuuuuguaaaaaaa

SEQ ID NO: 2772718 - RNA, 22 nt, Leptospira interrogans serovar lai str. 56601
uuuuuguaaugacacuuaucaa

SEQ ID NO: 2772719 - RNA, 12 nt, Leptospira interrogans serovar lai str. 56601
uuuuuguagaau

SEQ ID NO: 2772720 - RNA, 16 nt, Leptospira interrogans serovar lai str. 56601
uuuuuguaugaguucc

SEQ ID NO: 2772721 - RNA, 13 nt, Leptospira interrogans serovar lai str. 56601
uuuuuguuaucaa

SEQ ID NO: 2772722 - RNA, 15 nt, Leptospira interrogans serovar lai str. 56601
uuuuuguucacuaag

SEQ ID NO: 2772723 - RNA, 12 nt, Leptospira interrogans serovar lai str. 56601
uuuuuguuugaa

SEQ ID NO: 2772724 - RNA, 20 nt, Leptospira interrogans serovar lai str. 56601
uuuuuguuuuggcucuugcu

SEQ ID NO: 2772725 - RNA, 12 nt, Leptospira interrogans serovar lai str. 56601
uuuuuuaaaaaa

SEQ ID NO: 2772726 - RNA, 15 nt, Leptospira interrogans serovar lai str. 56601
uuuuuuaaaaaauuc

SEQ ID NO: 2772727 - RNA, 16 nt, Leptospira interrogans serovar lai str. 56601
uuuuuuaaaaaauuuc

SEQ ID NO: 2772728 - RNA, 11 nt, Leptospira interrogans serovar lai str. 56601
uuuuuuaaaac

SEQ ID NO: 2772729 - RNA, 14 nt, Leptospira interrogans serovar lai str. 56601
uuuuuuaaaaugua

SEQ ID NO: 2772730 - RNA, 17 nt, Leptospira interrogans serovar lai str. 56601
uuuuuuaaacuuuguuu

SEQ ID NO: 2772731 - RNA, 13 nt, Leptospira interrogans serovar lai str. 56601
uuuuuuaacaacu

SEQ ID NO: 2772732 - RNA, 16 nt, Leptospira interrogans serovar lai str. 56601
uuuuuuaagaaucuca

SEQ ID NO: 2772733 - RNA, 18 nt, Leptospira interrogans serovar lai str. 56601
uuuuuuaagaauuuguuu

SEQ ID NO: 2772734 - RNA, 23 nt, Leptospira interrogans serovar lai str. 56601
uuuuuuaaguucuuuaguuguuu

SEQ ID NO: 2772735 - RNA, 16 nt, Leptospira interrogans serovar lai str. 56601
uuuuuuaauuauguuu

SEQ ID NO: 2772736 - RNA, 17 nt, Leptospira interrogans serovar lai str. 56601
uuuuuuagaaaucaauu

SEQ ID NO: 2772737 - RNA, 12 nt, Leptospira interrogans serovar lai str. 56601
uuuuuucagaaa

SEQ ID NO: 2772738 - RNA, 11 nt, Leptospira interrogans serovar lai str. 56601
uuuuuuccuuu

SEQ ID NO: 2772739 - RNA, 12 nt, Leptospira interrogans serovar lai str. 56601
uuuuuuguaauc

SEQ ID NO: 2772740 - RNA, 11 nt, Leptospira interrogans serovar lai str. 56601
uuuuuuuaaac

SEQ ID NO: 2772741 - RNA, 14 nt, Leptospira interrogans serovar lai str. 56601
uuuuuuuagaauca

SEQ ID NO: 2772742 - RNA, 11 nt, Leptospira interrogans serovar lai str. 56601
uuuuuuuauga

SEQ ID NO: 2772743 - RNA, 12 nt, Leptospira interrogans serovar lai str. 56601
uuuuuuuuaauc

SEQ ID NO: 2772744 - RNA, 11 nt, Leptospira interrogans serovar lai str. 56601
uuuuuuuucaa

SEQ ID NO: 2772745 - RNA, 19 nt, Leptospira interrogans serovar lai str. 56601
uuaaauacuuaaaaacccc

SEQ ID NO: 2772746 - RNA, 20 nt, Leptospira interrogans serovar lai str. 56601
uuaaauagagcuuuguaaua

SEQ ID NO: 2772747 - RNA, 12 nt, Leptospira interrogans serovar lai str. 56601
uuaaauauuaau

SEQ ID NO: 2772748 - RNA, 19 nt, Leptospira interrogans serovar lai str. 56601
uuaaaucaccuuuuacuuc

SEQ ID NO: 2772749 - RNA, 12 nt, Leptospira interrogans serovar lai str. 56601
uuaaaucucauu

SEQ ID NO: 2772750 - RNA, 20 nt, Leptospira interrogans serovar lai str. 56601
uuaaaucuuaugguuuuuua

SEQ ID NO: 2772751 - RNA, 23 nt, Leptospira interrogans serovar lai str. 56601
uuaaaugaaguguaaaacccauc

SEQ ID NO: 2772752 - RNA, 18 nt, Leptospira interrogans serovar lai str. 56601
uuaaaugugcgggaacuc

SEQ ID NO: 2772753 - RNA, 18 nt, Leptospira interrogans serovar lai str. 56601
uuaaauuagcuuaagaau

SEQ ID NO: 2772754 - RNA, 22 nt, Leptospira interrogans serovar lai str. 56601
uuaaauuagcuuaagaauuucc

SEQ ID NO: 2772755 - RNA, 15 nt, Leptospira interrogans serovar lai str. 56601
uuaaauucuaaaaaa

SEQ ID NO: 2772756 - RNA, 15 nt, Leptospira interrogans serovar lai str. 56601
uuaaauucuacauuu

SEQ ID NO: 2772757 - RNA, 18 nt, Leptospira interrogans serovar lai str. 56601
uuaaauuuaucuauaaaa

SEQ ID NO: 2772758 - RNA, 13 nt, Leptospira interrogans serovar lai str. 56601
uuaaauuuuuaua

SEQ ID NO: 2772759 - RNA, 15 nt, Leptospira interrogans serovar lai str. 56601
uuaaauuuuuugcaa

SEQ ID NO: 2772760 - RNA, 13 nt, Leptospira interrogans serovar lai str. 56601
uuaacaacauuag

SEQ ID NO: 2772761 - RNA, 13 nt, Leptospira interrogans serovar lai str. 56601
uuaacaacucuaa

SEQ ID NO: 2772762 - RNA, 18 nt, Leptospira interrogans serovar lai str. 56601
uuaacaauucuagcaaaa

SEQ ID NO: 2772763 - RNA, 15 nt, Leptospira interrogans serovar lai str. 56601
uuaacaguauucaau

SEQ ID NO: 2772764 - RNA, 15 nt, Leptospira interrogans serovar lai str. 56601
uuaaccaaaaauuca

SEQ ID NO: 2772765 - RNA, 17 nt, Leptospira interrogans serovar lai str. 56601
uuaaccuacagaacacu

SEQ ID NO: 2772766 - RNA, 13 nt, Leptospira interrogans serovar lai str. 56601
uuaacgcaaaaua

SEQ ID NO: 2772767 - RNA, 21 nt, Leptospira interrogans serovar lai str. 56601
uuaacgguacucaauuuuaca

SEQ ID NO: 2772768 - RNA, 13 nt, Leptospira interrogans serovar lai str. 56601
uuaacgugaauuc

SEQ ID NO: 2772769 - RNA, 17 nt, Leptospira interrogans serovar lai str. 56601
uuaacgugaguucgaug

SEQ ID NO: 2772770 - RNA, 15 nt, Leptospira interrogans serovar lai str. 56601
uuaacucaucuaauc

SEQ ID NO: 2772771 - RNA, 15 nt, Leptospira interrogans serovar lai str. 56601
uuaacucuuaaauuu

SEQ ID NO: 2772772 - RNA, 17 nt, Leptospira interrogans serovar lai str. 56601
uuaacucuuaaauuucg

SEQ ID NO: 2772773 - RNA, 16 nt, Leptospira interrogans serovar lai str. 56601
uuaacuuuuauucucu

SEQ ID NO: 2772774 - RNA, 16 nt, Leptospira interrogans serovar lai str. 56601
uuaacuuuuuuuaaaa

SEQ ID NO: 2772775 - RNA, 18 nt, Leptospira interrogans serovar lai str. 56601
uuaacuuuuuuuaaaaaa

SEQ ID NO: 2772776 - RNA, 22 nt, Leptospira interrogans serovar lai str. 56601
uuaacuuuuuuuaaaaaauuca

SEQ ID NO: 2772777 - RNA, 18 nt, Leptospira interrogans serovar lai str. 56601
uuaagaaauagaucugau

SEQ ID NO: 2772778 - RNA, 22 nt, Leptospira interrogans serovar lai str. 56601
uuaagaaauagaucugauauuu

SEQ ID NO: 2772779 - RNA, 23 nt, Leptospira interrogans serovar lai str. 56601
uuacaaucgaacggauucuaauu

SEQ ID NO: 2772780 - RNA, 16 nt, Leptospira interrogans serovar lai str. 56601
uuacaauuaaacuuca

SEQ ID NO: 2772781 - RNA, 24 nt, Leptospira interrogans serovar lai str. 56601
uuacaauuugcuaaaauaagaauc

SEQ ID NO: 2772782 - RNA, 15 nt, Leptospira interrogans serovar lai str. 56601
uuacaccaaacucac

SEQ ID NO: 2772783 - RNA, 17 nt, Leptospira interrogans serovar lai str. 56601
uuacacgauaauuuucu

SEQ ID NO: 2772784 - RNA, 20 nt, Leptospira interrogans serovar lai str. 56601
uuacacgauaauuuucuuua

SEQ ID NO: 2772785 - RNA, 14 nt, Leptospira interrogans serovar lai str. 56601
uuacagaaaaauca

SEQ ID NO: 2772786 - RNA, 20 nt, Leptospira interrogans serovar lai str. 56601
uuacagaucgauuccuacuu

SEQ ID NO: 2772787 - RNA, 23 nt, Leptospira interrogans serovar lai str. 56601
uuacaguaaaaucuaaauuugua

SEQ ID NO: 2772788 - RNA, 20 nt, Leptospira interrogans serovar lai str. 56601
uuacaguuuuuaaucgcucu

SEQ ID NO: 2772789 - RNA, 21 nt, Leptospira interrogans serovar lai str. 56601
uuacauaacuaauaaaaacaa

SEQ ID NO: 2772790 - RNA, 17 nt, Leptospira interrogans serovar lai str. 56601
uuacauaagaccauauu

SEQ ID NO: 2772791 - RNA, 18 nt, Leptospira interrogans serovar lai str. 56601
uuacauauauaauuuauu

SEQ ID NO: 2772792 - RNA, 15 nt, Leptospira interrogans serovar lai str. 56601
uuacaucauguaaua

SEQ ID NO: 2772793 - RNA, 17 nt, Leptospira interrogans serovar lai str. 56601
uuacaucgaauucauuu

SEQ ID NO: 2772794 - RNA, 17 nt, Leptospira interrogans serovar lai str. 56601
uuacauuuuuaaauugu

SEQ ID NO: 2772795 - RNA, 19 nt, Leptospira interrogans serovar lai str. 56601
uuacauuuuuaucuugauc

SEQ ID NO: 2772796 - RNA, 23 nt, Leptospira interrogans serovar lai str. 56601
uuacauuuuucuaaauuaauauu

SEQ ID NO: 2772797 - RNA, 23 nt, Leptospira interrogans serovar lai str. 56601
uuaccaaggauguggaaguuuuc

SEQ ID NO: 2772798 - RNA, 18 nt, Leptospira interrogans serovar lai str. 56601
uuaccaauugauaauuug

SEQ ID NO: 2772799 - RNA, 21 nt, Leptospira interrogans serovar lai str. 56601
uuaccaccccacccaaaaaua

SEQ ID NO: 2772800 - RNA, 18 nt, Leptospira interrogans serovar lai str. 56601
uuaccacgaauuaaauac

SEQ ID NO: 2772801 - RNA, 22 nt, Leptospira interrogans serovar lai str. 56601
uuaccagaccucucuuuuaauu

SEQ ID NO: 2772802 - RNA, 14 nt, Leptospira interrogans serovar lai str. 56601
uuaccaggaugaau

SEQ ID NO: 2772803 - RNA, 14 nt, Leptospira interrogans serovar lai str. 56601
uuaccauaaauuuu

SEQ ID NO: 2772804 - RNA, 15 nt, Leptospira interrogans serovar lai str. 56601
uuaccccgaaauaca

SEQ ID NO: 2772805 - RNA, 19 nt, Leptospira interrogans serovar lai str. 56601
uuacccugguuucaaaaaa

SEQ ID NO: 2772806 - RNA, 15 nt, Leptospira interrogans serovar lai str. 56601
uuaccgucaauuuuu

SEQ ID NO: 2772807 - RNA, 13 nt, Leptospira interrogans serovar lai str. 56601
uuaccuccuccuu

SEQ ID NO: 2772808 - RNA, 14 nt, Leptospira interrogans serovar lai str. 56601
uuaccuccuccuuc

SEQ ID NO: 2772809 - RNA, 22 nt, Leptospira interrogans serovar lai str. 56601
uuaccuugaaacuuuuaauaaa

SEQ ID NO: 2772810 - RNA, 22 nt, Leptospira interrogans serovar lai str. 56601
uuacgaacaaauucuaaaauug

SEQ ID NO: 2772811 - RNA, 17 nt, Leptospira interrogans serovar lai str. 56601
uuacgaacuuucgagca

SEQ ID NO: 2772812 - RNA, 18 nt, Leptospira interrogans serovar lai str. 56601
uuacgaaucuaauuuaua

SEQ ID NO: 2772813 - RNA, 15 nt, Leptospira interrogans serovar lai str. 56601
uuacgaauuuuuaaa

SEQ ID NO: 2772814 - RNA, 13 nt, Leptospira interrogans serovar lai str. 56601
uuacgacauuuua

SEQ ID NO: 2772815 - RNA, 22 nt, Leptospira interrogans serovar lai str. 56601
uuacgacauuuuaauaaucuuu

SEQ ID NO: 2772816 - RNA, 13 nt, Leptospira interrogans serovar lai str. 56601
uuacgaugucuuu

SEQ ID NO: 2772817 - RNA, 15 nt, Leptospira interrogans serovar lai str. 56601
uuacgcggaacaucg

SEQ ID NO: 2772818 - RNA, 17 nt, Leptospira interrogans serovar lai str. 56601
uuacgcugaguuugaga

SEQ ID NO: 2772819 - RNA, 19 nt, Leptospira interrogans serovar lai str. 56601
uuacggaucaauucugaaa

SEQ ID NO: 2772820 - RNA, 15 nt, Leptospira interrogans serovar lai str. 56601
uuacgucgaacucac

SEQ ID NO: 2772821 - RNA, 20 nt, Leptospira interrogans serovar lai str. 56601
uuacgugacgaucacacuuu

SEQ ID NO: 2772822 - RNA, 17 nt, Leptospira interrogans serovar lai str. 56601
uuacguuauaauucuuu

SEQ ID NO: 2772823 - RNA, 14 nt, Leptospira interrogans serovar lai str. 56601
uuacuaaaaaacau

SEQ ID NO: 2772824 - RNA, 18 nt, Leptospira interrogans serovar lai str. 56601
uuacuaaaaauucauauu

SEQ ID NO: 2772825 - RNA, 19 nt, Leptospira interrogans serovar lai str. 56601
uuacuacagacaauccuau

SEQ ID NO: 2772826 - RNA, 22 nt, Leptospira interrogans serovar lai str. 56601
uuacuacaucuaaugauuucuu

SEQ ID NO: 2772827 - RNA, 22 nt, Leptospira interrogans serovar lai str. 56601
uuacuacauuugauuaaaaauu

SEQ ID NO: 2772828 - RNA, 21 nt, Leptospira interrogans serovar lai str. 56601
uuacuacccgacguauaaaaa

SEQ ID NO: 2772829 - RNA, 22 nt, Leptospira interrogans serovar lai str. 56601
uuacuacccgacguauaaaaac

SEQ ID NO: 2772830 - RNA, 19 nt, Leptospira interrogans serovar lai str. 56601
uuacuauggaauauaaaag

SEQ ID NO: 2772831 - RNA, 17 nt, Leptospira interrogans serovar lai str. 56601
uuacucagaguuauaua

SEQ ID NO: 2772832 - RNA, 17 nt, Leptospira interrogans serovar lai str. 56601
uuacucgauaauucuuu

SEQ ID NO: 2772833 - RNA, 22 nt, Leptospira interrogans serovar lai str. 56601
uuacucuacuauaaacuucucu

SEQ ID NO: 2772834 - RNA, 17 nt, Leptospira interrogans serovar lai str. 56601
uuacucuuauaaaauuu

SEQ ID NO: 2772835 - RNA, 15 nt, Leptospira interrogans serovar lai str. 56601
uuacucuuauuuaua

SEQ ID NO: 2772836 - RNA, 23 nt, Leptospira interrogans serovar lai str. 56601
uuacucuuauuuauauuucuaaa

SEQ ID NO: 2772837 - RNA, 16 nt, Leptospira interrogans serovar lai str. 56601
uuacugauucugcaua

SEQ ID NO: 2772838 - RNA, 18 nt, Leptospira interrogans serovar lai str. 56601
uuacugauuucaaaaaua

SEQ ID NO: 2772839 - RNA, 21 nt, Leptospira interrogans serovar lai str. 56601
uuacugauuucaaaaauaaau

SEQ ID NO: 2772840 - RNA, 19 nt, Leptospira interrogans serovar lai str. 56601
uuacugauuucuauaaaau

SEQ ID NO: 2772841 - RNA, 13 nt, Leptospira interrogans serovar lai str. 56601
uuacugauuuuca

SEQ ID NO: 2772842 - RNA, 19 nt, Leptospira interrogans serovar lai str. 56601
uuacuuaccucuauaaaau

SEQ ID NO: 2772843 - RNA, 22 nt, Leptospira interrogans serovar lai str. 56601
uuacuuaccucuauaaaauuaa

SEQ ID NO: 2772844 - RNA, 20 nt, Leptospira interrogans serovar lai str. 56601
uuacuuagaugaacuuuuuu

SEQ ID NO: 2772845 - RNA, 13 nt, Leptospira interrogans serovar lai str. 56601
uuacuuauacaac

SEQ ID NO: 2772846 - RNA, 15 nt, Leptospira interrogans serovar lai str. 56601
uuacuucuguaaucu

SEQ ID NO: 2772847 - RNA, 22 nt, Leptospira interrogans serovar lai str. 56601
uuacuugaucagacgaaaucga

SEQ ID NO: 2772848 - RNA, 16 nt, Leptospira interrogans serovar lai str. 56601
uuacuugcaaaaagua

SEQ ID NO: 2772849 - RNA, 19 nt, Leptospira interrogans serovar lai str. 56601
uuacuugcaaaaaguaugu

SEQ ID NO: 2772850 - RNA, 13 nt, Leptospira interrogans serovar lai str. 56601
uuacuuuaaaauu

SEQ ID NO: 2772851 - RNA, 16 nt, Leptospira interrogans serovar lai str. 56601
uuacuuuugggaaaag

SEQ ID NO: 2772852 - RNA, 14 nt, Leptospira interrogans serovar lai str. 56601
uuacuuuuuccaaa

SEQ ID NO: 2772853 - RNA, 20 nt, Leptospira interrogans serovar lai str. 56601
uuagaaaaaauuuuucuuaa

SEQ ID NO: 2772854 - RNA, 18 nt, Leptospira interrogans serovar lai str. 56601
uuagaaaauuagaaagaa

SEQ ID NO: 2772855 - RNA, 14 nt, Leptospira interrogans serovar lai str. 56601
uuagaaaauuauac

SEQ ID NO: 2772856 - RNA, 21 nt, Leptospira interrogans serovar lai str. 56601
uuagaaagaaucuuuuuaaaa

SEQ ID NO: 2772857 - RNA, 21 nt, Leptospira interrogans serovar lai str. 56601
uuagaaagugcauucgcugag

SEQ ID NO: 2772858 - RNA, 12 nt, Leptospira interrogans serovar lai str. 56601
uuagaaauauug

SEQ ID NO: 2772859 - RNA, 21 nt, Leptospira interrogans serovar lai str. 56601
uuagaaaucgauuuguaaaau

SEQ ID NO: 2772860 - RNA, 17 nt, Leptospira interrogans serovar lai str. 56601
uuagaaaugauuuuuua

SEQ ID NO: 2772861 - RNA, 18 nt, Leptospira interrogans serovar lai str. 56601
uuagaaauuaaaguaucc

SEQ ID NO: 2772862 - RNA, 19 nt, Leptospira interrogans serovar lai str. 56601
uuagaaauuuauacuauaa

SEQ ID NO: 2772863 - RNA, 21 nt, Leptospira interrogans serovar lai str. 56601
uuagaaauuuuuaauaacaug

SEQ ID NO: 2772864 - RNA, 20 nt, Leptospira interrogans serovar lai str. 56601
uuagaaauuuuuaaucaaau

SEQ ID NO: 2772865 - RNA, 22 nt, Leptospira interrogans serovar lai str. 56601
uuagaacagaaugucuuagaau

SEQ ID NO: 2772866 - RNA, 11 nt, Leptospira interrogans serovar lai str. 56601
uuagaacauca

SEQ ID NO: 2772867 - RNA, 14 nt, Leptospira interrogans serovar lai str. 56601
uuagaaccaguauc

SEQ ID NO: 2772868 - RNA, 19 nt, Leptospira interrogans serovar lai str. 56601
uuagaaccaguaucguuuu

SEQ ID NO: 2772869 - RNA, 23 nt, Leptospira interrogans serovar lai str. 56601
uuagaaccaguaucguuuuccau

SEQ ID NO: 2772870 - RNA, 19 nt, Leptospira interrogans serovar lai str. 56601
uuagaacgcaaucuguuga

SEQ ID NO: 2772871 - RNA, 20 nt, Leptospira interrogans serovar lai str. 56601
uuagaacugcucgaaaguuu

SEQ ID NO: 2772872 - RNA, 19 nt, Leptospira interrogans serovar lai str. 56601
uuagaacuguguuucuaau

SEQ ID NO: 2772873 - RNA, 13 nt, Leptospira interrogans serovar lai str. 56601
uuagaauaaaaac

SEQ ID NO: 2772874 - RNA, 15 nt, Leptospira interrogans serovar lai str. 56601
uuagaauaaagagaa

SEQ ID NO: 2772875 - RNA, 13 nt, Leptospira interrogans serovar lai str. 56601
uuagaauauuaag

SEQ ID NO: 2772876 - RNA, 14 nt, Leptospira interrogans serovar lai str. 56601
uuagaauauuuucu

SEQ ID NO: 2772877 - RNA, 13 nt, Leptospira interrogans serovar lai str. 56601
uuagaaucaaaau

SEQ ID NO: 2772878 - RNA, 13 nt, Leptospira interrogans serovar lai str. 56601
uuagaaucagaau

SEQ ID NO: 2772879 - RNA, 15 nt, Leptospira interrogans serovar lai str. 56601
uuagaaucccauuua

SEQ ID NO: 2772880 - RNA, 13 nt, Leptospira interrogans serovar lai str. 56601
uuagaaucuaucu

SEQ ID NO: 2772881 - RNA, 15 nt, Leptospira interrogans serovar lai str. 56601
uuagaaucugaacuu

SEQ ID NO: 2772882 - RNA, 13 nt, Leptospira interrogans serovar lai str. 56601
uuagaauuguuga

SEQ ID NO: 2772883 - RNA, 17 nt, Leptospira interrogans serovar lai str. 56601
uuagaauuguugaaaaa

SEQ ID NO: 2772884 - RNA, 18 nt, Leptospira interrogans serovar lai str. 56601
uuagaauuugaacuuuac

SEQ ID NO: 2772885 - RNA, 19 nt, Leptospira interrogans serovar lai str. 56601
uuagaauuuguucuuaaaa

SEQ ID NO: 2772886 - RNA, 20 nt, Leptospira interrogans serovar lai str. 56601
uuagaauuuuaugauuuucu

SEQ ID NO: 2772887 - RNA, 19 nt, Leptospira interrogans serovar lai str. 56601
uuagaauuuuucgaaacaa

SEQ ID NO: 2772888 - RNA, 13 nt, Leptospira interrogans serovar lai str. 56601
uuagacaaaaaau

SEQ ID NO: 2772889 - RNA, 20 nt, Leptospira interrogans serovar lai str. 56601
uuagacaaaaaauucuuuuu

SEQ ID NO: 2772890 - RNA, 16 nt, Leptospira interrogans serovar lai str. 56601
uuagacaaaaauacua

SEQ ID NO: 2772891 - RNA, 17 nt, Leptospira interrogans serovar lai str. 56601
uuagacaaaaauacuaa

SEQ ID NO: 2772892 - RNA, 16 nt, Leptospira interrogans serovar lai str. 56601
uuagaccgaacucaca

SEQ ID NO: 2772893 - RNA, 21 nt, Leptospira interrogans serovar lai str. 56601
uuagacgccauguuuuuaaaa

SEQ ID NO: 2772894 - RNA, 23 nt, Leptospira interrogans serovar lai str. 56601
uuagacgccauguuuuuaaaauc

SEQ ID NO: 2772895 - RNA, 17 nt, Leptospira interrogans serovar lai str. 56601
uuagacguuugaaaauc

SEQ ID NO: 2772896 - RNA, 22 nt, Leptospira interrogans serovar lai str. 56601
uuagacuucucuuuucgaaaau

SEQ ID NO: 2772897 - RNA, 19 nt, Leptospira interrogans serovar lai str. 56601
uuagagaaacuuuaaauac

SEQ ID NO: 2772898 - RNA, 14 nt, Leptospira interrogans serovar lai str. 56601
uuagaguauuauaa

SEQ ID NO: 2772899 - RNA, 21 nt, Leptospira interrogans serovar lai str. 56601
uuagagugccgcaccuuuugg

SEQ ID NO: 2772900 - RNA, 18 nt, Leptospira interrogans serovar lai str. 56601
uuagaguguugacucuuu

SEQ ID NO: 2772901 - RNA, 16 nt, Leptospira interrogans serovar lai str. 56601
uuagaguuaagagaau

SEQ ID NO: 2772902 - RNA, 18 nt, Leptospira interrogans serovar lai str. 56601
uuagaguuaagagaauuu

SEQ ID NO: 2772903 - RNA, 15 nt, Leptospira interrogans serovar lai str. 56601
uuagaguuucuaaaa

SEQ ID NO: 2772904 - RNA, 22 nt, Leptospira interrogans serovar lai str. 56601
uuagauacguuuuauuauauaa

SEQ ID NO: 2772905 - RNA, 13 nt, Leptospira interrogans serovar lai str. 56601
uuagauauuuaua

SEQ ID NO: 2772906 - RNA, 15 nt, Leptospira interrogans serovar lai str. 56601
uuagaugaacuuuuu

SEQ ID NO: 2772907 - RNA, 13 nt, Leptospira interrogans serovar lai str. 56601
uuagauucuaaaa

SEQ ID NO: 2772908 - RNA, 16 nt, Leptospira interrogans serovar lai str. 56601
uuagauuuguguuagu

SEQ ID NO: 2772909 - RNA, 20 nt, Leptospira interrogans serovar lai str. 56601
uuagcaauuugugaacuuuc

SEQ ID NO: 2772910 - RNA, 15 nt, Leptospira interrogans serovar lai str. 56601
uuagcaguucuacuu

SEQ ID NO: 2772911 - RNA, 17 nt, Leptospira interrogans serovar lai str. 56601
uuagcaugaaauuuucu

SEQ ID NO: 2772912 - RNA, 21 nt, Leptospira interrogans serovar lai str. 56601
uuagcauuuuuaagauuacau

SEQ ID NO: 2772913 - RNA, 17 nt, Leptospira interrogans serovar lai str. 56601
uuagccuggaauucuuu

SEQ ID NO: 2772914 - RNA, 23 nt, Leptospira interrogans serovar lai str. 56601
uuagccuuuaaacuuucuuccaa

SEQ ID NO: 2772915 - RNA, 19 nt, Leptospira interrogans serovar lai str. 56601
uuagcguguaugguaaaaa

SEQ ID NO: 2772916 - RNA, 14 nt, Leptospira interrogans serovar lai str. 56601
uuagcuaagucuuu

SEQ ID NO: 2772917 - RNA, 20 nt, Leptospira interrogans serovar lai str. 56601
uuagcuaagucuuuaaaaau

SEQ ID NO: 2772918 - RNA, 19 nt, Leptospira interrogans serovar lai str. 56601
uuagcugaaauuaauuccu

SEQ ID NO: 2772919 - RNA, 13 nt, Leptospira interrogans serovar lai str. 56601
uuagcuuaagaau

SEQ ID NO: 2772920 - RNA, 14 nt, Leptospira interrogans serovar lai str. 56601
uuaggaagaaacaa

SEQ ID NO: 2772921 - RNA, 20 nt, Leptospira interrogans serovar lai str. 56601
uuaggaaguaaaaucgaguu

SEQ ID NO: 2772922 - RNA, 16 nt, Leptospira interrogans serovar lai str. 56601
uuaggaagugagauug

SEQ ID NO: 2772923 - RNA, 18 nt, Leptospira interrogans serovar lai str. 56601
uuaggaauuuuuuaaacu

SEQ ID NO: 2772924 - RNA, 21 nt, Leptospira interrogans serovar lai str. 56601
uuaggauaaaacggauuucuu

SEQ ID NO: 2772925 - RNA, 19 nt, Leptospira interrogans serovar lai str. 56601
uuagggaucaaucugcaaa

SEQ ID NO: 2772926 - RNA, 15 nt, Leptospira interrogans serovar lai str. 56601
uuagggaucgaucug

SEQ ID NO: 2772927 - RNA, 15 nt, Leptospira interrogans serovar lai str. 56601
uuagguaauagaaaa

SEQ ID NO: 2772928 - RNA, 15 nt, Leptospira interrogans serovar lai str. 56601
uuagguauuucuaau

SEQ ID NO: 2772929 - RNA, 17 nt, Leptospira interrogans serovar lai str. 56601
uuagguccauagagaac

SEQ ID NO: 2772930 - RNA, 15 nt, Leptospira interrogans serovar lai str. 56601
uuaggugauauuuuc

SEQ ID NO: 2772931 - RNA, 13 nt, Leptospira interrogans serovar lai str. 56601
uuaggugcuacug

SEQ ID NO: 2772932 - RNA, 18 nt, Leptospira interrogans serovar lai str. 56601
uuaguaaaauuuaaaauu

SEQ ID NO: 2772933 - RNA, 16 nt, Leptospira interrogans serovar lai str. 56601
uuaguaaaauuuaaau

SEQ ID NO: 2772934 - RNA, 20 nt, Leptospira interrogans serovar lai str. 56601
uuaguacuuuugaauuuacu

SEQ ID NO: 2772935 - RNA, 18 nt, Leptospira interrogans serovar lai str. 56601
uuaguaguauuuaagaau

SEQ ID NO: 2772936 - RNA, 19 nt, Leptospira interrogans serovar lai str. 56601
uuaguauuuuauuauauaa

SEQ ID NO: 2772937 - RNA, 17 nt, Leptospira interrogans serovar lai str. 56601
uuaguauuuuucuuaau

SEQ ID NO: 2772938 - RNA, 13 nt, Leptospira interrogans serovar lai str. 56601
uuagucuaaaaac

SEQ ID NO: 2772939 - RNA, 14 nt, Leptospira interrogans serovar lai str. 56601
uuaguuacuuauuu

SEQ ID NO: 2772940 - RNA, 14 nt, Leptospira interrogans serovar lai str. 56601
uuaguucccacauu

SEQ ID NO: 2772941 - RNA, 12 nt, Leptospira interrogans serovar lai str. 56601
uuaguucuccua

SEQ ID NO: 2772942 - RNA, 16 nt, Leptospira interrogans serovar lai str. 56601
uuaguuguacaaaaau

SEQ ID NO: 2772943 - RNA, 17 nt, Leptospira interrogans serovar lai str. 56601
uuaguuguacaaaaaug

SEQ ID NO: 2772944 - RNA, 13 nt, Leptospira interrogans serovar lai str. 56601
uuaguuuuaauau

SEQ ID NO: 2772945 - RNA, 16 nt, Leptospira interrogans serovar lai str. 56601
uuaguuuuuaugccuu

SEQ ID NO: 2772946 - RNA, 14 nt, Leptospira interrogans serovar lai str. 56601
uuaguuuuuguaug

SEQ ID NO: 2772947 - RNA, 14 nt, Leptospira interrogans serovar lai str. 56601
uuauaaaaacaagu

SEQ ID NO: 2772948 - RNA, 12 nt, Leptospira interrogans serovar lai str. 56601
uuauaaaaacuu

SEQ ID NO: 2772949 - RNA, 12 nt, Leptospira interrogans serovar lai str. 56601
uuauaaaaauac

SEQ ID NO: 2772950 - RNA, 23 nt, Leptospira interrogans serovar lai str. 56601
uuauaaaacgaaauuauacaaaa

SEQ ID NO: 2772951 - RNA, 12 nt, Leptospira interrogans serovar lai str. 56601
uuauaaaauacc

SEQ ID NO: 2772952 - RNA, 13 nt, Leptospira interrogans serovar lai str. 56601
uuauaaaauacca

SEQ ID NO: 2772953 - RNA, 13 nt, Leptospira interrogans serovar lai str. 56601
uuauaaaaugaau

SEQ ID NO: 2772954 - RNA, 22 nt, Leptospira interrogans serovar lai str. 56601
uuauaaaauugaguaccauaaa

SEQ ID NO: 2772955 - RNA, 12 nt, Leptospira interrogans serovar lai str. 56601
uuauaaauaaaa

SEQ ID NO: 2772956 - RNA, 16 nt, Leptospira interrogans serovar lai str. 56601
uuauaaauaaaagaga

SEQ ID NO: 2772957 - RNA, 19 nt, Leptospira interrogans serovar lai str. 56601
uuauaaaucuguacuuaaa

SEQ ID NO: 2772958 - RNA, 13 nt, Leptospira interrogans serovar lai str. 56601
uuauaaauguagg

SEQ ID NO: 2772959 - RNA, 17 nt, Leptospira interrogans serovar lai str. 56601
uuauaaauguaggaacu

SEQ ID NO: 2772960 - RNA, 16 nt, Leptospira interrogans serovar lai str. 56601
uuauaaauuuaaaaaa

SEQ ID NO: 2772961 - RNA, 15 nt, Leptospira interrogans serovar lai str. 56601
uuauaaauuuauaaa

SEQ ID NO: 2772962 - RNA, 21 nt, Leptospira interrogans serovar lai str. 56601
uuauaacgggaauuauaaauc

SEQ ID NO: 2772963 - RNA, 15 nt, Leptospira interrogans serovar lai str. 56601
uuauaacguuauaaa

SEQ ID NO: 2772964 - RNA, 19 nt, Leptospira interrogans serovar lai str. 56601
uuauaagaaucgauucaga

SEQ ID NO: 2772965 - RNA, 11 nt, Leptospira interrogans serovar lai str. 56601
uuauaagacau

SEQ ID NO: 2772966 - RNA, 22 nt, Leptospira interrogans serovar lai str. 56601
uuauaagccaaaccaaauagaa

SEQ ID NO: 2772967 - RNA, 16 nt, Leptospira interrogans serovar lai str. 56601
uuauaaguagaaauuu

SEQ ID NO: 2772968 - RNA, 12 nt, Leptospira interrogans serovar lai str. 56601
uuauaaguuuuu

SEQ ID NO: 2772969 - RNA, 21 nt, Leptospira interrogans serovar lai str. 56601
uuauaaguuuuuauuauaaaa

SEQ ID NO: 2772970 - RNA, 13 nt, Leptospira interrogans serovar lai str. 56601
uuauaauaaauug

SEQ ID NO: 2772971 - RNA, 22 nt, Leptospira interrogans serovar lai str. 56601
uuauaauagaguuacagaaaaa

SEQ ID NO: 2772972 - RNA, 18 nt, Leptospira interrogans serovar lai str. 56601
uuauaauauauauaaauu

SEQ ID NO: 2772973 - RNA, 16 nt, Leptospira interrogans serovar lai str. 56601
uuauaaugauaaagua

SEQ ID NO: 2772974 - RNA, 20 nt, Leptospira interrogans serovar lai str. 56601
uuauaauucguuuuuuaaaa

SEQ ID NO: 2772975 - RNA, 22 nt, Leptospira interrogans serovar lai str. 56601
uuauaauucguuuuuuaaaaug

SEQ ID NO: 2772976 - RNA, 19 nt, Leptospira interrogans serovar lai str. 56601
uuauaauucugaauaauug

SEQ ID NO: 2772977 - RNA, 22 nt, Leptospira interrogans serovar lai str. 56601
uuauaauucugaauaauugaau

SEQ ID NO: 2772978 - RNA, 15 nt, Leptospira interrogans serovar lai str. 56601
uuauaauucuuuaaa

SEQ ID NO: 2772979 - RNA, 21 nt, Leptospira interrogans serovar lai str. 56601
uuauaauuuagaguuguuaaa

SEQ ID NO: 2772980 - RNA, 16 nt, Leptospira interrogans serovar lai str. 56601
uuauaauuuuaaauaa

SEQ ID NO: 2772981 - RNA, 23 nt, Leptospira interrogans serovar lai str. 56601
uuauaccaaguucgauuaaaaua

SEQ ID NO: 2772982 - RNA, 23 nt, Leptospira interrogans serovar lai str. 56601
uuauacgcccgaguaauaagaau

SEQ ID NO: 2772983 - RNA, 15 nt, Leptospira interrogans serovar lai str. 56601
uuauacuuuaauaau

SEQ ID NO: 2772984 - RNA, 18 nt, Leptospira interrogans serovar lai str. 56601
uuauacuuuauagaaaau

SEQ ID NO: 2772985 - RNA, 22 nt, Leptospira interrogans serovar lai str. 56601
uuauagauaauuuuuacucaaa

SEQ ID NO: 2772986 - RNA, 16 nt, Leptospira interrogans serovar lai str. 56601
uuauagauauaacuua

SEQ ID NO: 2772987 - RNA, 16 nt, Leptospira interrogans serovar lai str. 56601
uuauagaugaaauuaa

SEQ ID NO: 2772988 - RNA, 15 nt, Leptospira interrogans serovar lai str. 56601
uuauaguaaaagaaa

SEQ ID NO: 2772989 - RNA, 17 nt, Leptospira interrogans serovar lai str. 56601
uuauaguaaaagaaaau

SEQ ID NO: 2772990 - RNA, 17 nt, Leptospira interrogans serovar lai str. 56601
uuauaguuuuuucaaaa

SEQ ID NO: 2772991 - RNA, 15 nt, Leptospira interrogans serovar lai str. 56601
uuauauaaaauuuga

SEQ ID NO: 2772992 - RNA, 17 nt, Leptospira interrogans serovar lai str. 56601
uuauauaaccaugaaua

SEQ ID NO: 2772993 - RNA, 17 nt, Leptospira interrogans serovar lai str. 56601
uuauauaaguuaaauuu

SEQ ID NO: 2772994 - RNA, 16 nt, Leptospira interrogans serovar lai str. 56601
uuauauaaucugauug

SEQ ID NO: 2772995 - RNA, 19 nt, Leptospira interrogans serovar lai str. 56601
uuauauaauuuacuucauu

SEQ ID NO: 2772996 - RNA, 19 nt, Leptospira interrogans serovar lai str. 56601
uuauauagcucuugaauaa

SEQ ID NO: 2772997 - RNA, 20 nt, Leptospira interrogans serovar lai str. 56601
uuauauauauucacaaaaaa

SEQ ID NO: 2772998 - RNA, 21 nt, Leptospira interrogans serovar lai str. 56601
uuauauauauucacaaaaaaa

SEQ ID NO: 2772999 - RNA, 22 nt, Leptospira interrogans serovar lai str. 56601
uuauauauuuuuaauuugcuua

SEQ ID NO: 2773000 - RNA, 22 nt, Leptospira interrogans serovar lai str. 56601
uuauauccgugauguuuaagcc

SEQ ID NO: 2773001 - RNA, 20 nt, Leptospira interrogans serovar lai str. 56601
uuauauguauuuauucaaaa

SEQ ID NO: 2773002 - RNA, 12 nt, Leptospira interrogans serovar lai str. 56601
uuauauguuucu

SEQ ID NO: 2773003 - RNA, 21 nt, Leptospira interrogans serovar lai str. 56601
uuauauguuucuuuuguaaaa

SEQ ID NO: 2773004 - RNA, 13 nt, Leptospira interrogans serovar lai str. 56601
uuauauuaaaaug

SEQ ID NO: 2773005 - RNA, 12 nt, Leptospira interrogans serovar lai str. 56601
uuauauuaauau

SEQ ID NO: 2773006 - RNA, 17 nt, Leptospira interrogans serovar lai str. 56601
uuauauuauaauucucu

SEQ ID NO: 2773007 - RNA, 13 nt, Leptospira interrogans serovar lai str. 56601
uuauauuauauaa

SEQ ID NO: 2773008 - RNA, 15 nt, Leptospira interrogans serovar lai str. 56601
uuauauucuuauaua

SEQ ID NO: 2773009 - RNA, 17 nt, Leptospira interrogans serovar lai str. 56601
uuauauuucauugaaau

SEQ ID NO: 2773010 - RNA, 17 nt, Leptospira interrogans serovar lai str. 56601
uuaucaacuuuuggaac

SEQ ID NO: 2773011 - RNA, 17 nt, Leptospira interrogans serovar lai str. 56601
uuaucaauucacucuua

SEQ ID NO: 2773012 - RNA, 15 nt, Leptospira interrogans serovar lai str. 56601
uuaucacgaaaauua

SEQ ID NO: 2773013 - RNA, 14 nt, Leptospira interrogans serovar lai str. 56601
uuaucagaaaaaca

SEQ ID NO: 2773014 - RNA, 15 nt, Leptospira interrogans serovar lai str. 56601
uuaucagaaaaacau

SEQ ID NO: 2773015 - RNA, 15 nt, Leptospira interrogans serovar lai str. 56601
uuaucaguuaaacuu

SEQ ID NO: 2773016 - RNA, 12 nt, Leptospira interrogans serovar lai str. 56601
uuaucauaaaaa

SEQ ID NO: 2773017 - RNA, 14 nt, Leptospira interrogans serovar lai str. 56601
uuaucauaaaaaua

SEQ ID NO: 2773018 - RNA, 20 nt, Leptospira interrogans serovar lai str. 56601
uuaucauaaaaauaaagaaa

SEQ ID NO: 2773019 - RNA, 18 nt, Leptospira interrogans serovar lai str. 56601
uuaucauaaaacacuguu

SEQ ID NO: 2773020 - RNA, 16 nt, Leptospira interrogans serovar lai str. 56601
uuaucauguaaaauuu

SEQ ID NO: 2773021 - RNA, 22 nt, Leptospira interrogans serovar lai str. 56601
uuaucauguaaaauuuuuugaa

SEQ ID NO: 2773022 - RNA, 12 nt, Leptospira interrogans serovar lai str. 56601
uuaucauucuuu

SEQ ID NO: 2773023 - RNA, 19 nt, Leptospira interrogans serovar lai str. 56601
uuauccauuucuauaaauu

SEQ ID NO: 2773024 - RNA, 19 nt, Leptospira interrogans serovar lai str. 56601
uuauccgcuuuauauuuca

SEQ ID NO: 2773025 - RNA, 18 nt, Leptospira interrogans serovar lai str. 56601
uuauccguuuauccuaau

SEQ ID NO: 2773026 - RNA, 19 nt, Leptospira interrogans serovar lai str. 56601
uuauccuaaugaaaaagaa

SEQ ID NO: 2773027 - RNA, 14 nt, Leptospira interrogans serovar lai str. 56601
uuauccuuaaaaug

SEQ ID NO: 2773028 - RNA, 19 nt, Leptospira interrogans serovar lai str. 56601
uuaucgaauggaauuuauu

SEQ ID NO: 2773029 - RNA, 15 nt, Leptospira interrogans serovar lai str. 56601
uuaucgacuuuugaa

SEQ ID NO: 2773030 - RNA, 20 nt, Leptospira interrogans serovar lai str. 56601
uuaucgacuuuugaaaaucc

SEQ ID NO: 2773031 - RNA, 20 nt, Leptospira interrogans serovar lai str. 56601
uuaucggcguucuacaaaau

SEQ ID NO: 2773032 - RNA, 16 nt, Leptospira interrogans serovar lai str. 56601
uuaucgggauacucau

SEQ ID NO: 2773033 - RNA, 15 nt, Leptospira interrogans serovar lai str. 56601
uuaucgucaaaauuu

SEQ ID NO: 2773034 - RNA, 13 nt, Leptospira interrogans serovar lai str. 56601
uuaucuaaaauuu

SEQ ID NO: 2773035 - RNA, 14 nt, Leptospira interrogans serovar lai str. 56601
uuaucuaaaauuuc

SEQ ID NO: 2773036 - RNA, 22 nt, Leptospira interrogans serovar lai str. 56601
uuaucuaaaauuucauuucuau

SEQ ID NO: 2773037 - RNA, 13 nt, Leptospira interrogans serovar lai str. 56601
uuaucuauaaaau

SEQ ID NO: 2773038 - RNA, 18 nt, Leptospira interrogans serovar lai str. 56601
uuaucugagcacaaaaua

SEQ ID NO: 2773039 - RNA, 15 nt, Leptospira interrogans serovar lai str. 56601
uuaucuguaaaauga

SEQ ID NO: 2773040 - RNA, 19 nt, Leptospira interrogans serovar lai str. 56601
uuaucuguaaaauuuggau

SEQ ID NO: 2773041 - RNA, 17 nt, Leptospira interrogans serovar lai str. 56601
uuaucuuagaucaauuu

SEQ ID NO: 2773042 - RNA, 13 nt, Leptospira interrogans serovar lai str. 56601
uuaucuucgaaau

SEQ ID NO: 2773043 - RNA, 17 nt, Leptospira interrogans serovar lai str. 56601
uuaucuugauccauuaa

SEQ ID NO: 2773044 - RNA, 22 nt, Leptospira interrogans serovar lai str. 56601
uuaucuuguguuucaucgaaca

SEQ ID NO: 2773045 - RNA, 23 nt, Leptospira interrogans serovar lai str. 56601
uuaugaaucuuucauguauuacu

SEQ ID NO: 2773046 - RNA, 23 nt, Leptospira interrogans serovar lai str. 56601
uuaugacagcuugaagauuagac

SEQ ID NO: 2773047 - RNA, 23 nt, Leptospira interrogans serovar lai str. 56601
uuaugacccaagauucaaagaua

SEQ ID NO: 2773048 - RNA, 13 nt, Leptospira interrogans serovar lai str. 56601
uuaugacuucuua

SEQ ID NO: 2773049 - RNA, 15 nt, Leptospira interrogans serovar lai str. 56601
uuaugagaguuccca

SEQ ID NO: 2773050 - RNA, 19 nt, Leptospira interrogans serovar lai str. 56601
uuaugauuucacgaacaca

SEQ ID NO: 2773051 - RNA, 19 nt, Leptospira interrogans serovar lai str. 56601
uuaugcaaauacaacuuuu

SEQ ID NO: 2773052 - RNA, 21 nt, Leptospira interrogans serovar lai str. 56601
uuaugcaaauacaacuuuuuu

SEQ ID NO: 2773053 - RNA, 17 nt, Leptospira interrogans serovar lai str. 56601
uuaugcaugaauuuguu

SEQ ID NO: 2773054 - RNA, 16 nt, Leptospira interrogans serovar lai str. 56601
uuaugcuauuuaauuu

SEQ ID NO: 2773055 - RNA, 17 nt, Leptospira interrogans serovar lai str. 56601
uuauggacuauuuuauu

SEQ ID NO: 2773056 - RNA, 15 nt, Leptospira interrogans serovar lai str. 56601
uuauggcacuuauuc

SEQ ID NO: 2773057 - RNA, 18 nt, Leptospira interrogans serovar lai str. 56601
uuauggcaggaucaaaau

SEQ ID NO: 2773058 - RNA, 16 nt, Leptospira interrogans serovar lai str. 56601
uuaugguaaaauuuca

SEQ ID NO: 2773059 - RNA, 21 nt, Leptospira interrogans serovar lai str. 56601
uuaugguaguucccacaaguu

SEQ ID NO: 2773060 - RNA, 14 nt, Leptospira interrogans serovar lai str. 56601
uuauguaauauaca

SEQ ID NO: 2773061 - RNA, 21 nt, Leptospira interrogans serovar lai str. 56601
uuauguaauauacaauaaaua

SEQ ID NO: 2773062 - RNA, 13 nt, Leptospira interrogans serovar lai str. 56601
uuauguaauauuu

SEQ ID NO: 2773063 - RNA, 17 nt, Leptospira interrogans serovar lai str. 56601
uuaugugacuuuaauuu

SEQ ID NO: 2773064 - RNA, 15 nt, Leptospira interrogans serovar lai str. 56601
uuaugugaguuccca

SEQ ID NO: 2773065 - RNA, 13 nt, Leptospira interrogans serovar lai str. 56601
uuauuaaaauuuc

SEQ ID NO: 2773066 - RNA, 21 nt, Leptospira interrogans serovar lai str. 56601
uuauuaaaauuucccgauucu

SEQ ID NO: 2773067 - RNA, 21 nt, Leptospira interrogans serovar lai str. 56601
uuauuacauaccuguuuuagu

SEQ ID NO: 2773068 - RNA, 18 nt, Leptospira interrogans serovar lai str. 56601
uuauuauaaauuuauaaa

SEQ ID NO: 2773069 - RNA, 12 nt, Leptospira interrogans serovar lai str. 56601
uuauuauauaau

SEQ ID NO: 2773070 - RNA, 11 nt, Leptospira interrogans serovar lai str. 56601
uuauuauauuu

SEQ ID NO: 2773071 - RNA, 17 nt, Leptospira interrogans serovar lai str. 56601
uuauuaucaaaauuuaa

SEQ ID NO: 2773072 - RNA, 19 nt, Leptospira interrogans serovar lai str. 56601
uuauuaugugacuuaaucu

SEQ ID NO: 2773073 - RNA, 20 nt, Leptospira interrogans serovar lai str. 56601
uuauucaaaauagaauaaau

SEQ ID NO: 2773074 - RNA, 14 nt, Leptospira interrogans serovar lai str. 56601
uuauucaaaauauc

SEQ ID NO: 2773075 - RNA, 15 nt, Leptospira interrogans serovar lai str. 56601
uuauucaauuuuagu

SEQ ID NO: 2773076 - RNA, 17 nt, Leptospira interrogans serovar lai str. 56601
uuauucguaaaaucuua

SEQ ID NO: 2773077 - RNA, 22 nt, Leptospira interrogans serovar lai str. 56601
uuauucuaugaaacgaaauaua

SEQ ID NO: 2773078 - RNA, 17 nt, Leptospira interrogans serovar lai str. 56601
uuauugaaaaauagaau

SEQ ID NO: 2773079 - RNA, 20 nt, Leptospira interrogans serovar lai str. 56601
uuauugagucaagauuauuu

SEQ ID NO: 2773080 - RNA, 13 nt, Leptospira interrogans serovar lai str. 56601
uuauugugaguuu

SEQ ID NO: 2773081 - RNA, 16 nt, Leptospira interrogans serovar lai str. 56601
uuauuguuuauaaaac

SEQ ID NO: 2773082 - RNA, 15 nt, Leptospira interrogans serovar lai str. 56601
uuauuuaaaaaccgu

SEQ ID NO: 2773083 - RNA, 15 nt, Leptospira interrogans serovar lai str. 56601
uuauuuaauaaaauu

SEQ ID NO: 2773084 - RNA, 16 nt, Leptospira interrogans serovar lai str. 56601
uuauuuacauauauaa

SEQ ID NO: 2773085 - RNA, 17 nt, Leptospira interrogans serovar lai str. 56601
uuauuuacgccgaauuc

SEQ ID NO: 2773086 - RNA, 21 nt, Leptospira interrogans serovar lai str. 56601
uuauuuaguccguccacaaau

SEQ ID NO: 2773087 - RNA, 17 nt, Leptospira interrogans serovar lai str. 56601
uuauuuauauuucuaaa

SEQ ID NO: 2773088 - RNA, 21 nt, Leptospira interrogans serovar lai str. 56601
uuauuuauauuucuaaaagaa

SEQ ID NO: 2773089 - RNA, 22 nt, Leptospira interrogans serovar lai str. 56601
uuauuucaaaaauuuaaauguu

SEQ ID NO: 2773090 - RNA, 14 nt, Leptospira interrogans serovar lai str. 56601
uuauuuguaaaauu

SEQ ID NO: 2773091 - RNA, 14 nt, Leptospira interrogans serovar lai str. 56601
uuauuuuaaaauuc

SEQ ID NO: 2773092 - RNA, 10 nt, Leptospira interrogans serovar lai str. 56601
uuauuuuaac

SEQ ID NO: 2773093 - RNA, 22 nt, Leptospira interrogans serovar lai str. 56601
uuauuuuaacagauuaaaugua

SEQ ID NO: 2773094 - RNA, 13 nt, Leptospira interrogans serovar lai str. 56601
uuauuuuaacuug

SEQ ID NO: 2773095 - RNA, 15 nt, Leptospira interrogans serovar lai str. 56601
uuauuuuagaaugug

SEQ ID NO: 2773096 - RNA, 13 nt, Leptospira interrogans serovar lai str. 56601
uuauuuucaagua

SEQ ID NO: 2773097 - RNA, 16 nt, Leptospira interrogans serovar lai str. 56601
uuauuuucauaggaaa

SEQ ID NO: 2773098 - RNA, 19 nt, Leptospira interrogans serovar lai str. 56601
uuauuuuguuuaaguuuuc

SEQ ID NO: 2773099 - RNA, 22 nt, Leptospira interrogans serovar lai str. 56601
uuauuuuuaacgugaauucgac

SEQ ID NO: 2773100 - RNA, 11 nt, Leptospira interrogans serovar lai str. 56601
uuauuuuuaag

SEQ ID NO: 2773101 - RNA, 19 nt, Leptospira interrogans serovar lai str. 56601
uuauuuuuacagaaaaauc

SEQ ID NO: 2773102 - RNA, 14 nt, Leptospira interrogans serovar lai str. 56601
uuauuuuuuuuaau

SEQ ID NO: 2773103 - RNA, 16 nt, Leptospira interrogans serovar lai str. 56601
uuauuuuuuuuacaua

SEQ ID NO: 2773104 - RNA, 13 nt, Leptospira interrogans serovar lai str. 56601
uucaaaaaacuuu

SEQ ID NO: 2773105 - RNA, 20 nt, Leptospira interrogans serovar lai str. 56601
uucaaaaaaucaaauauaca

SEQ ID NO: 2773106 - RNA, 11 nt, Leptospira interrogans serovar lai str. 56601
uucaaaaacau

SEQ ID NO: 2773107 - RNA, 16 nt, Leptospira interrogans serovar lai str. 56601
uucaaaaacuaaaaua

SEQ ID NO: 2773108 - RNA, 18 nt, Leptospira interrogans serovar lai str. 56601
uucaaaaacuaaaauaca

SEQ ID NO: 2773109 - RNA, 16 nt, Leptospira interrogans serovar lai str. 56601
uucaaaaagacuauau

SEQ ID NO: 2773110 - RNA, 13 nt, Leptospira interrogans serovar lai str. 56601
uucaaaaauaaau

SEQ ID NO: 2773111 - RNA, 21 nt, Leptospira interrogans serovar lai str. 56601
uucaaaaauauauuauaauaa

SEQ ID NO: 2773112 - RNA, 20 nt, Leptospira interrogans serovar lai str. 56601
uucaaaaccgcuuuuaguuu

SEQ ID NO: 2773113 - RNA, 17 nt, Leptospira interrogans serovar lai str. 56601
uucaaaacuuugacaga

SEQ ID NO: 2773114 - RNA, 15 nt, Leptospira interrogans serovar lai str. 56601
uucaaaagauugaau

SEQ ID NO: 2773115 - RNA, 15 nt, Leptospira interrogans serovar lai str. 56601
uucaaaauaagaaaa

SEQ ID NO: 2773116 - RNA, 18 nt, Leptospira interrogans serovar lai str. 56601
uucaaaauaagaaaauaa

SEQ ID NO: 2773117 - RNA, 18 nt, Leptospira interrogans serovar lai str. 56601
uucaaaauaagaauuuuc

SEQ ID NO: 2773118 - RNA, 18 nt, Leptospira interrogans serovar lai str. 56601
uucaaaaucguuuuaaaa

SEQ ID NO: 2773119 - RNA, 23 nt, Leptospira interrogans serovar lai str. 56601
uucaaaauuaccuuucauuuuuc

SEQ ID NO: 2773120 - RNA, 19 nt, Leptospira interrogans serovar lai str. 56601
uucaaaauuugauccucua

SEQ ID NO: 2773121 - RNA, 14 nt, Leptospira interrogans serovar lai str. 56601
uucaaacaacaaaa

SEQ ID NO: 2773122 - RNA, 17 nt, Leptospira interrogans serovar lai str. 56601
uucaaacaacaaaaaau

SEQ ID NO: 2773123 - RNA, 19 nt, Leptospira interrogans serovar lai str. 56601
uucaaacguucguaguuuu

SEQ ID NO: 2773124 - RNA, 14 nt, Leptospira interrogans serovar lai str. 56601
uucaaacuugcaau

SEQ ID NO: 2773125 - RNA, 17 nt, Leptospira interrogans serovar lai str. 56601
uucaaagauaaaauaua

SEQ ID NO: 2773126 - RNA, 18 nt, Leptospira interrogans serovar lai str. 56601
uucaaagauaaaauauag

SEQ ID NO: 2773127 - RNA, 19 nt, Leptospira interrogans serovar lai str. 56601
uucaaagaugguggaauaa

SEQ ID NO: 2773128 - RNA, 14 nt, Leptospira interrogans serovar lai str. 56601
uucaaagcaagaaa

SEQ ID NO: 2773129 - RNA, 15 nt, Leptospira interrogans serovar lai str. 56601
uucaaaguuuucaca

SEQ ID NO: 2773130 - RNA, 19 nt, Leptospira interrogans serovar lai str. 56601
uucaaauucaucaauuuug

SEQ ID NO: 2773131 - RNA, 20 nt, Leptospira interrogans serovar lai str. 56601
uucaaauuuacucuuauaaa

SEQ ID NO: 2773132 - RNA, 22 nt, Leptospira interrogans serovar lai str. 56601
uucaaauuuacucuuauaaaau

SEQ ID NO: 2773133 - RNA, 13 nt, Leptospira interrogans serovar lai str. 56601
uucaaauuuaugu

SEQ ID NO: 2773134 - RNA, 15 nt, Leptospira interrogans serovar lai str. 56601
uucaacaaacaaaua

SEQ ID NO: 2773135 - RNA, 20 nt, Leptospira interrogans serovar lai str. 56601
uucaacaaacaaauagaaau

SEQ ID NO: 2773136 - RNA, 21 nt, Leptospira interrogans serovar lai str. 56601
uucaacaaacaaauagaaaua

SEQ ID NO: 2773137 - RNA, 14 nt, Leptospira interrogans serovar lai str. 56601
uucaacaacucuau

SEQ ID NO: 2773138 - RNA, 20 nt, Leptospira interrogans serovar lai str. 56601
uucaacaacucuauuaaaga

SEQ ID NO: 2773139 - RNA, 22 nt, Leptospira interrogans serovar lai str. 56601
uucaacaacucuauuaaagaag

SEQ ID NO: 2773140 - RNA, 21 nt, Leptospira interrogans serovar lai str. 56601
uucaacaacucuauuuuauuu

SEQ ID NO: 2773141 - RNA, 23 nt, Leptospira interrogans serovar lai str. 56601
uucaacaacucucuuguaguuca

SEQ ID NO: 2773142 - RNA, 23 nt, Leptospira interrogans serovar lai str. 56601
uucaacaagcuuuggauuuugau

SEQ ID NO: 2773143 - RNA, 14 nt, Leptospira interrogans serovar lai str. 56601
uucaacuuuagaaa

SEQ ID NO: 2773144 - RNA, 17 nt, Leptospira interrogans serovar lai str. 56601
uucaacuuuagaaaaau

SEQ ID NO: 2773145 - RNA, 14 nt, Leptospira interrogans serovar lai str. 56601
uucaacuuuccuuu

SEQ ID NO: 2773146 - RNA, 20 nt, Leptospira interrogans serovar lai str. 56601
uucaacuuuccuuuucgaau

SEQ ID NO: 2773147 - RNA, 12 nt, Leptospira interrogans serovar lai str. 56601
uucaacuuuuuu

SEQ ID NO: 2773148 - RNA, 18 nt, Leptospira interrogans serovar lai str. 56601
uucaacuuuuuucagaaa

SEQ ID NO: 2773149 - RNA, 20 nt, Leptospira interrogans serovar lai str. 56601
uucaacuuuuuucagaaaaa

SEQ ID NO: 2773150 - RNA, 21 nt, Leptospira interrogans serovar lai str. 56601
uucaacuuuuuucagaaaaag

SEQ ID NO: 2773151 - RNA, 20 nt, Leptospira interrogans serovar lai str. 56601
uucaagacaacagaacaaaa

SEQ ID NO: 2773152 - RNA, 20 nt, Leptospira interrogans serovar lai str. 56601
uucaagacuuuauagucaaa

SEQ ID NO: 2773153 - RNA, 16 nt, Leptospira interrogans serovar lai str. 56601
uucaagguaauuuaua

SEQ ID NO: 2773154 - RNA, 21 nt, Leptospira interrogans serovar lai str. 56601
uucaagugauucauucuaaga

SEQ ID NO: 2773155 - RNA, 14 nt, Leptospira interrogans serovar lai str. 56601
uucaaguuugugag

SEQ ID NO: 2773156 - RNA, 22 nt, Leptospira interrogans serovar lai str. 56601
uucaaguuugugagaguuccca

SEQ ID NO: 2773157 - RNA, 17 nt, Leptospira interrogans serovar lai str. 56601
uucaaguuuucuuuuuu

SEQ ID NO: 2773158 - RNA, 16 nt, Leptospira interrogans serovar lai str. 56601
uucaauaaaacguuuc

SEQ ID NO: 2773159 - RNA, 15 nt, Leptospira interrogans serovar lai str. 56601
uucaauaaaauacca

SEQ ID NO: 2773160 - RNA, 12 nt, Leptospira interrogans serovar lai str. 56601
uucaauaauucu

SEQ ID NO: 2773161 - RNA, 14 nt, Leptospira interrogans serovar lai str. 56601
uucaauaauucuau

SEQ ID NO: 2773162 - RNA, 16 nt, Leptospira interrogans serovar lai str. 56601
uucaauaauuuuaaua

SEQ ID NO: 2773163 - RNA, 18 nt, Leptospira interrogans serovar lai str. 56601
uucaaucacguucaacgu

SEQ ID NO: 2773164 - RNA, 15 nt, Leptospira interrogans serovar lai str. 56601
uucaaucuccccaaa

SEQ ID NO: 2773165 - RNA, 14 nt, Leptospira interrogans serovar lai str. 56601
uucaauguuauaaa

SEQ ID NO: 2773166 - RNA, 18 nt, Leptospira interrogans serovar lai str. 56601
uucaauguuauaaaaugu

SEQ ID NO: 2773167 - RNA, 12 nt, Leptospira interrogans serovar lai str. 56601
uucaauuaacaa

SEQ ID NO: 2773168 - RNA, 24 nt, Leptospira interrogans serovar lai str. 56601
uucaauuaacaaaacuacuucaau

SEQ ID NO: 2773169 - RNA, 21 nt, Leptospira interrogans serovar lai str. 56601
uucaauucuacgaauuucaga

SEQ ID NO: 2773170 - RNA, 17 nt, Leptospira interrogans serovar lai str. 56601
uucaauugauuauagaa

SEQ ID NO: 2773171 - RNA, 19 nt, Leptospira interrogans serovar lai str. 56601
uucaauuguccauuucaau

SEQ ID NO: 2773172 - RNA, 12 nt, Leptospira interrogans serovar lai str. 56601
uucaauuuaaaa

SEQ ID NO: 2773173 - RNA, 17 nt, Leptospira interrogans serovar lai str. 56601
uucaauuuaaaauauca

SEQ ID NO: 2773174 - RNA, 19 nt, Leptospira interrogans serovar lai str. 56601
uucaauuuacaucauguaa

SEQ ID NO: 2773175 - RNA, 15 nt, Leptospira interrogans serovar lai str. 56601
uucaauuuucucaaa

SEQ ID NO: 2773176 - RNA, 16 nt, Leptospira interrogans serovar lai str. 56601
uucaauuuucucaaaa

SEQ ID NO: 2773177 - RNA, 19 nt, Leptospira interrogans serovar lai str. 56601
uucaauuuucucaaaaaau

SEQ ID NO: 2773178 - RNA, 13 nt, Leptospira interrogans serovar lai str. 56601
uucaauuuuuaua

SEQ ID NO: 2773179 - RNA, 15 nt, Leptospira interrogans serovar lai str. 56601
uucaauuuuuauaaa

SEQ ID NO: 2773180 - RNA, 13 nt, Leptospira interrogans serovar lai str. 56601
uucacaaaaaaau

SEQ ID NO: 2773181 - RNA, 21 nt, Leptospira interrogans serovar lai str. 56601
uucacaaaaaaauucauaaua

SEQ ID NO: 2773182 - RNA, 18 nt, Leptospira interrogans serovar lai str. 56601
uucacaaaaaaauucucc

SEQ ID NO: 2773183 - RNA, 13 nt, Leptospira interrogans serovar lai str. 56601
uucacaaaaauau

SEQ ID NO: 2773184 - RNA, 21 nt, Leptospira interrogans serovar lai str. 56601
uucacaaacgguuuuaguaaa

SEQ ID NO: 2773185 - RNA, 14 nt, Leptospira interrogans serovar lai str. 56601
uucacauaaaguua

SEQ ID NO: 2773186 - RNA, 22 nt, Leptospira interrogans serovar lai str. 56601
uucacauaaaguuaauacaaaa

SEQ ID NO: 2773187 - RNA, 22 nt, Leptospira interrogans serovar lai str. 56601
uucacauaaccaaccccacaag

SEQ ID NO: 2773188 - RNA, 14 nt, Leptospira interrogans serovar lai str. 56601
uucacguuaaaaua

SEQ ID NO: 2773189 - RNA, 13 nt, Leptospira interrogans serovar lai str. 56601
uucacugaaaauu

SEQ ID NO: 2773190 - RNA, 15 nt, Leptospira interrogans serovar lai str. 56601
uucacuguuaaaaga

SEQ ID NO: 2773191 - RNA, 20 nt, Leptospira interrogans serovar lai str. 56601
uucacuguuaaaagauuugu

SEQ ID NO: 2773192 - RNA, 23 nt, Leptospira interrogans serovar lai str. 56601
uucacuuccauuggauucugcuc

SEQ ID NO: 2773193 - RNA, 12 nt, Leptospira interrogans serovar lai str. 56601
uucacuuuaaaa

SEQ ID NO: 2773194 - RNA, 14 nt, Leptospira interrogans serovar lai str. 56601
uucacuuuuccaaa

SEQ ID NO: 2773195 - RNA, 18 nt, Leptospira interrogans serovar lai str. 56601
uucacuuuuccaaauaua

SEQ ID NO: 2773196 - RNA, 17 nt, Leptospira interrogans serovar lai str. 56601
uucagaaaaaaaaagaa

SEQ ID NO: 2773197 - RNA, 20 nt, Leptospira interrogans serovar lai str. 56601
uucagaaaaaaaaagaauuu

SEQ ID NO: 2773198 - RNA, 18 nt, Leptospira interrogans serovar lai str. 56601
uucagaaaaagugaauua

SEQ ID NO: 2773199 - RNA, 14 nt, Leptospira interrogans serovar lai str. 56601
uucagaaaaaugaa

SEQ ID NO: 2773200 - RNA, 15 nt, Leptospira interrogans serovar lai str. 56601
uucagaaaaaugaau

SEQ ID NO: 2773201 - RNA, 21 nt, Leptospira interrogans serovar lai str. 56601
uucagacugacugaaaaaaac

SEQ ID NO: 2773202 - RNA, 17 nt, Leptospira interrogans serovar lai str. 56601
uucagagugguuucuua

SEQ ID NO: 2773203 - RNA, 15 nt, Leptospira interrogans serovar lai str. 56601
uucagauuucaacuu

SEQ ID NO: 2773204 - RNA, 22 nt, Leptospira interrogans serovar lai str. 56601
uucagcacaucguaucuugaau

SEQ ID NO: 2773205 - RNA, 16 nt, Leptospira interrogans serovar lai str. 56601
uucagcuccaaaaaaa

SEQ ID NO: 2773206 - RNA, 17 nt, Leptospira interrogans serovar lai str. 56601
uucagggcucaaaguca

SEQ ID NO: 2773207 - RNA, 20 nt, Leptospira interrogans serovar lai str. 56601
uucagguuuuaaaacggaau

SEQ ID NO: 2773208 - RNA, 13 nt, Leptospira interrogans serovar lai str. 56601
uucaguucugaac

SEQ ID NO: 2773209 - RNA, 18 nt, Leptospira interrogans serovar lai str. 56601
uucaguucugagaccgcu

SEQ ID NO: 2773210 - RNA, 14 nt, Leptospira interrogans serovar lai str. 56601
uucaguuuccacuc

SEQ ID NO: 2773211 - RNA, 17 nt, Leptospira interrogans serovar lai str. 56601
uucaguuuccacucuuu

SEQ ID NO: 2773212 - RNA, 14 nt, Leptospira interrogans serovar lai str. 56601
uucaguuuuacugu

SEQ ID NO: 2773213 - RNA, 19 nt, Leptospira interrogans serovar lai str. 56601
uucauaaauacaaaguauu

SEQ ID NO: 2773214 - RNA, 18 nt, Leptospira interrogans serovar lai str. 56601
uucauaaaugauaauaau

SEQ ID NO: 2773215 - RNA, 16 nt, Leptospira interrogans serovar lai str. 56601
uucauaacuauauaau

SEQ ID NO: 2773216 - RNA, 14 nt, Leptospira interrogans serovar lai str. 56601
uucauaacuuugcu

SEQ ID NO: 2773217 - RNA, 15 nt, Leptospira interrogans serovar lai str. 56601
uucauaauaaaacua

SEQ ID NO: 2773218 - RNA, 14 nt, Leptospira interrogans serovar lai str. 56601
uucauaauucugaa

SEQ ID NO: 2773219 - RNA, 14 nt, Leptospira interrogans serovar lai str. 56601
uucauagaaaaaau

SEQ ID NO: 2773220 - RNA, 16 nt, Leptospira interrogans serovar lai str. 56601
uucauauaauaaaaau

SEQ ID NO: 2773221 - RNA, 14 nt, Leptospira interrogans serovar lai str. 56601
uucauauacaagac

SEQ ID NO: 2773222 - RNA, 21 nt, Leptospira interrogans serovar lai str. 56601
uucauauauaguuuugagcau

SEQ ID NO: 2773223 - RNA, 20 nt, Leptospira interrogans serovar lai str. 56601
uucaucaaaguuauuucgau

SEQ ID NO: 2773224 - RNA, 20 nt, Leptospira interrogans serovar lai str. 56601
uucaucaccaaccccacaag

SEQ ID NO: 2773225 - RNA, 20 nt, Leptospira interrogans serovar lai str. 56601
uucaucuacauaaaaaagga

SEQ ID NO: 2773226 - RNA, 17 nt, Leptospira interrogans serovar lai str. 56601
uucaucuacguuucaau

SEQ ID NO: 2773227 - RNA, 21 nt, Leptospira interrogans serovar lai str. 56601
uucaucuccuccgauucugaa

SEQ ID NO: 2773228 - RNA, 20 nt, Leptospira interrogans serovar lai str. 56601
uucaucuuugcgauuuuucc

SEQ ID NO: 2773229 - RNA, 14 nt, Leptospira interrogans serovar lai str. 56601
uucaucuuuuccau

SEQ ID NO: 2773230 - RNA, 16 nt, Leptospira interrogans serovar lai str. 56601
uucaucuuuuccauug

SEQ ID NO: 2773231 - RNA, 15 nt, Leptospira interrogans serovar lai str. 56601
uucaugaaaacgaau

SEQ ID NO: 2773232 - RNA, 22 nt, Leptospira interrogans serovar lai str. 56601
uucaugaacgaauuuuucaaca

SEQ ID NO: 2773233 - RNA, 14 nt, Leptospira interrogans serovar lai str. 56601
uucaugagaaacaa

SEQ ID NO: 2773234 - RNA, 14 nt, Leptospira interrogans serovar lai str. 56601
uucauuaaacaauu

SEQ ID NO: 2773235 - RNA, 20 nt, Leptospira interrogans serovar lai str. 56601
uucauuaaacaauuuuucaa

SEQ ID NO: 2773236 - RNA, 17 nt, Leptospira interrogans serovar lai str. 56601
uucauucagaccuuuuu

SEQ ID NO: 2773237 - RNA, 22 nt, Leptospira interrogans serovar lai str. 56601
uucauucccuuaaucauuuuuu

SEQ ID NO: 2773238 - RNA, 18 nt, Leptospira interrogans serovar lai str. 56601
uucauuccuauaaauaaa

SEQ ID NO: 2773239 - RNA, 14 nt, Leptospira interrogans serovar lai str. 56601
uucauuuaaaaauu

SEQ ID NO: 2773240 - RNA, 20 nt, Leptospira interrogans serovar lai str. 56601
uucauuuaccuaaaauucag

SEQ ID NO: 2773241 - RNA, 12 nt, Leptospira interrogans serovar lai str. 56601
uucauuuccaau

SEQ ID NO: 2773242 - RNA, 12 nt, Leptospira interrogans serovar lai str. 56601
uucauuucgaaa

SEQ ID NO: 2773243 - RNA, 14 nt, Leptospira interrogans serovar lai str. 56601
uucauuucguaaaa

SEQ ID NO: 2773244 - RNA, 13 nt, Leptospira interrogans serovar lai str. 56601
uucauuuucuaua

SEQ ID NO: 2773245 - RNA, 18 nt, Leptospira interrogans serovar lai str. 56601
uucauuuugggauuuuau

SEQ ID NO: 2773246 - RNA, 13 nt, Leptospira interrogans serovar lai str. 56601
uucauuuuuauuu

SEQ ID NO: 2773247 - RNA, 13 nt, Leptospira interrogans serovar lai str. 56601
uucauuuuuccau

SEQ ID NO: 2773248 - RNA, 12 nt, Leptospira interrogans serovar lai str. 56601
uucauuuuucug

SEQ ID NO: 2773249 - RNA, 14 nt, Leptospira interrogans serovar lai str. 56601
uucauuuuucugaa

SEQ ID NO: 2773250 - RNA, 21 nt, Leptospira interrogans serovar lai str. 56601
uuccaaaaacucaaagaauuu

SEQ ID NO: 2773251 - RNA, 15 nt, Leptospira interrogans serovar lai str. 56601
uuccaaaaagaaaaa

SEQ ID NO: 2773252 - RNA, 13 nt, Leptospira interrogans serovar lai str. 56601
uuccaaaaccuca

SEQ ID NO: 2773253 - RNA, 16 nt, Leptospira interrogans serovar lai str. 56601
uuccaaaaccucaaaa

SEQ ID NO: 2773254 - RNA, 20 nt, Leptospira interrogans serovar lai str. 56601
uuccaaaaccucaaaaaauu

SEQ ID NO: 2773255 - RNA, 16 nt, Leptospira interrogans serovar lai str. 56601
uuccaaaucugaaucu

SEQ ID NO: 2773256 - RNA, 20 nt, Leptospira interrogans serovar lai str. 56601
uuccaaauuguaugaagaaa

SEQ ID NO: 2773257 - RNA, 22 nt, Leptospira interrogans serovar lai str. 56601
uuccaaauuguaugaagaaaac

SEQ ID NO: 2773258 - RNA, 22 nt, Leptospira interrogans serovar lai str. 56601
uuccaagaccucaaauaacuuu

SEQ ID NO: 2773259 - RNA, 22 nt, Leptospira interrogans serovar lai str. 56601
uuccaagggaagguuuuguaaa

SEQ ID NO: 2773260 - RNA, 15 nt, Leptospira interrogans serovar lai str. 56601
uuccaauuaacaaaa

SEQ ID NO: 2773261 - RNA, 20 nt, Leptospira interrogans serovar lai str. 56601
uuccaauuuaggguauaauu

SEQ ID NO: 2773262 - RNA, 13 nt, Leptospira interrogans serovar lai str. 56601
uuccacaucuuuu

SEQ ID NO: 2773263 - RNA, 19 nt, Leptospira interrogans serovar lai str. 56601
uuccacauuuuaaagguug

SEQ ID NO: 2773264 - RNA, 20 nt, Leptospira interrogans serovar lai str. 56601
uuccaccuuggaaagaaaag

SEQ ID NO: 2773265 - RNA, 14 nt, Leptospira interrogans serovar lai str. 56601
uuccacuuuaaaaa

SEQ ID NO: 2773266 - RNA, 15 nt, Leptospira interrogans serovar lai str. 56601
uuccacuuuaaaaau

SEQ ID NO: 2773267 - RNA, 22 nt, Leptospira interrogans serovar lai str. 56601
uuccagagauucgcccacuucu

SEQ ID NO: 2773268 - RNA, 12 nt, Leptospira interrogans serovar lai str. 56601
uuccagaucauu

SEQ ID NO: 2773269 - RNA, 21 nt, Leptospira interrogans serovar lai str. 56601
uuccagcgaucgugauaagag

SEQ ID NO: 2773270 - RNA, 15 nt, Leptospira interrogans serovar lai str. 56601
uuccauaaaaaacau

SEQ ID NO: 2773271 - RNA, 18 nt, Leptospira interrogans serovar lai str. 56601
uuccauaaagaccacagu

SEQ ID NO: 2773272 - RNA, 19 nt, Leptospira interrogans serovar lai str. 56601
uuccauaaagaccacagua

SEQ ID NO: 2773273 - RNA, 16 nt, Leptospira interrogans serovar lai str. 56601
uuccaucaaauacaaa

SEQ ID NO: 2773274 - RNA, 17 nt, Leptospira interrogans serovar lai str. 56601
uuccaucaaauacaaaa

SEQ ID NO: 2773275 - RNA, 13 nt, Leptospira interrogans serovar lai str. 56601
uuccauucuucaa

SEQ ID NO: 2773276 - RNA, 17 nt, Leptospira interrogans serovar lai str. 56601
uuccauucuucaaauaa

SEQ ID NO: 2773277 - RNA, 15 nt, Leptospira interrogans serovar lai str. 56601
uuccauugauuuuca

SEQ ID NO: 2773278 - RNA, 17 nt, Leptospira interrogans serovar lai str. 56601
uuccauugccucuacaa

SEQ ID NO: 2773279 - RNA, 22 nt, Leptospira interrogans serovar lai str. 56601
uuccauuggauucugcucuucu

SEQ ID NO: 2773280 - RNA, 14 nt, Leptospira interrogans serovar lai str. 56601
uuccauuucugaca

SEQ ID NO: 2773281 - RNA, 23 nt, Leptospira interrogans serovar lai str. 56601
uuccauuuucauaauaaauuuuu

SEQ ID NO: 2773282 - RNA, 16 nt, Leptospira interrogans serovar lai str. 56601
uuccauuuuuuagaau

SEQ ID NO: 2773283 - RNA, 21 nt, Leptospira interrogans serovar lai str. 56601
uuccauuuuuuagaaucccau

SEQ ID NO: 2773284 - RNA, 14 nt, Leptospira interrogans serovar lai str. 56601
uucccaaaugagag

SEQ ID NO: 2773285 - RNA, 12 nt, Leptospira interrogans serovar lai str. 56601
uucccacagauu

SEQ ID NO: 2773286 - RNA, 13 nt, Leptospira interrogans serovar lai str. 56601
uucccacaucuua

SEQ ID NO: 2773287 - RNA, 21 nt, Leptospira interrogans serovar lai str. 56601
uucccacauuuuaaaguuuug

SEQ ID NO: 2773288 - RNA, 20 nt, Leptospira interrogans serovar lai str. 56601
uucccacauuuugaagguug

SEQ ID NO: 2773289 - RNA, 23 nt, Leptospira interrogans serovar lai str. 56601
uucccacauuuugaagguugagc

SEQ ID NO: 2773290 - RNA, 15 nt, Leptospira interrogans serovar lai str. 56601
uucccacauuuuuca

SEQ ID NO: 2773291 - RNA, 19 nt, Leptospira interrogans serovar lai str. 56601
uucccacauuuuucaaauu

SEQ ID NO: 2773292 - RNA, 20 nt, Leptospira interrogans serovar lai str. 56601
uucccacguuuugaagguug

SEQ ID NO: 2773293 - RNA, 23 nt, Leptospira interrogans serovar lai str. 56601
uucccacguuuugaagguugagc

SEQ ID NO: 2773294 - RNA, 22 nt, Leptospira interrogans serovar lai str. 56601
uucccagacguaucaaaauagu

SEQ ID NO: 2773295 - RNA, 18 nt, Leptospira interrogans serovar lai str. 56601
uucccaguucuuaaauaa

SEQ ID NO: 2773296 - RNA, 12 nt, Leptospira interrogans serovar lai str. 56601
uucccauaaaaa

SEQ ID NO: 2773297 - RNA, 13 nt, Leptospira interrogans serovar lai str. 56601
uucccauccgaaa

SEQ ID NO: 2773298 - RNA, 16 nt, Leptospira interrogans serovar lai str. 56601
uuccccaagacgucua

SEQ ID NO: 2773299 - RNA, 12 nt, Leptospira interrogans serovar lai str. 56601
uucccgauucuc

SEQ ID NO: 2773300 - RNA, 22 nt, Leptospira interrogans serovar lai str. 56601
uucccggucucgaauuguuuuu

SEQ ID NO: 2773301 - RNA, 16 nt, Leptospira interrogans serovar lai str. 56601
uucccguuuagaaauu

SEQ ID NO: 2773302 - RNA, 16 nt, Leptospira interrogans serovar lai str. 56601
uucccuaguuccaauu

SEQ ID NO: 2773303 - RNA, 18 nt, Leptospira interrogans serovar lai str. 56601
uucccuaguuccaauuaa

SEQ ID NO: 2773304 - RNA, 22 nt, Leptospira interrogans serovar lai str. 56601
uucccuaguuccaauuaacaaa

SEQ ID NO: 2773305 - RNA, 22 nt, Leptospira interrogans serovar lai str. 56601
uucccuuuugaucuuuaaaaga

SEQ ID NO: 2773306 - RNA, 16 nt, Leptospira interrogans serovar lai str. 56601
uuccgaaaggaaaaga

SEQ ID NO: 2773307 - RNA, 16 nt, Leptospira interrogans serovar lai str. 56601
uuccgaaccuuaccac

SEQ ID NO: 2773308 - RNA, 15 nt, Leptospira interrogans serovar lai str. 56601
uuccgaauuaaaaau

SEQ ID NO: 2773309 - RNA, 21 nt, Leptospira interrogans serovar lai str. 56601
uuccgacaagaaugagucuuu

SEQ ID NO: 2773310 - RNA, 17 nt, Leptospira interrogans serovar lai str. 56601
uuccgacccagaaaaaa

SEQ ID NO: 2773311 - RNA, 18 nt, Leptospira interrogans serovar lai str. 56601
uuccgauacgaguaaaaa

SEQ ID NO: 2773312 - RNA, 20 nt, Leptospira interrogans serovar lai str. 56601
uuccgauacgaguaaaaauu

SEQ ID NO: 2773313 - RNA, 17 nt, Leptospira interrogans serovar lai str. 56601
uuccgauucacuuccau

SEQ ID NO: 2773314 - RNA, 16 nt, Leptospira interrogans serovar lai str. 56601
uuccgauuucuuucaa

SEQ ID NO: 2773315 - RNA, 13 nt, Leptospira interrogans serovar lai str. 56601
uuccgcaaaaauu

SEQ ID NO: 2773316 - RNA, 19 nt, Leptospira interrogans serovar lai str. 56601
uuccgcgauugaaaauuau

SEQ ID NO: 2773317 - RNA, 15 nt, Leptospira interrogans serovar lai str. 56601
uuccggaaaacgaau

SEQ ID NO: 2773318 - RNA, 20 nt, Leptospira interrogans serovar lai str. 56601
uuccgguaaguaauauauca

SEQ ID NO: 2773319 - RNA, 19 nt, Leptospira interrogans serovar lai str. 56601
uuccgguaauuauaauuga

SEQ ID NO: 2773320 - RNA, 15 nt, Leptospira interrogans serovar lai str. 56601
uuccguaccccaaag

SEQ ID NO: 2773321 - RNA, 19 nt, Leptospira interrogans serovar lai str. 56601
uuccguauccuuaaaauga

SEQ ID NO: 2773322 - RNA, 16 nt, Leptospira interrogans serovar lai str. 56601
uuccgucaaaucaucu

SEQ ID NO: 2773323 - RNA, 14 nt, Leptospira interrogans serovar lai str. 56601
uuccgucguuugca

SEQ ID NO: 2773324 - RNA, 20 nt, Leptospira interrogans serovar lai str. 56601
uuccgucuuuuguaaguuuu

SEQ ID NO: 2773325 - RNA, 21 nt, Leptospira interrogans serovar lai str. 56601
uuccgucuuuuguaaguuuuc

SEQ ID NO: 2773326 - RNA, 18 nt, Leptospira interrogans serovar lai str. 56601
uuccguuuuuauuucuuu

SEQ ID NO: 2773327 - RNA, 23 nt, Leptospira interrogans serovar lai str. 56601
uuccuaaaaaauaaaugugggaa

SEQ ID NO: 2773328 - RNA, 19 nt, Leptospira interrogans serovar lai str. 56601
uuccuaaaacaccuucucu

SEQ ID NO: 2773329 - RNA, 11 nt, Leptospira interrogans serovar lai str. 56601
uuccuaaaauu

SEQ ID NO: 2773330 - RNA, 12 nt, Leptospira interrogans serovar lai str. 56601
uuccuaaaauuu

SEQ ID NO: 2773331 - RNA, 20 nt, Leptospira interrogans serovar lai str. 56601
uuccuaaugcagcuucuucc

SEQ ID NO: 2773332 - RNA, 14 nt, Leptospira interrogans serovar lai str. 56601
uuccuacauuuuca

SEQ ID NO: 2773333 - RNA, 18 nt, Leptospira interrogans serovar lai str. 56601
uuccuacauuuuuuaaau

SEQ ID NO: 2773334 - RNA, 17 nt, Leptospira interrogans serovar lai str. 56601
uuccuacgguuuuaguc

SEQ ID NO: 2773335 - RNA, 21 nt, Leptospira interrogans serovar lai str. 56601
uuccuacuuauuucuauaaaa

SEQ ID NO: 2773336 - RNA, 16 nt, Leptospira interrogans serovar lai str. 56601
uuccuagcaguauuuu

SEQ ID NO: 2773337 - RNA, 21 nt, Leptospira interrogans serovar lai str. 56601
uuccuauucaguuuccacucu

SEQ ID NO: 2773338 - RNA, 23 nt, Leptospira interrogans serovar lai str. 56601
uuccuccagugcaauacauuaga

SEQ ID NO: 2773339 - RNA, 14 nt, Leptospira interrogans serovar lai str. 56601
uuccucuugaagau

SEQ ID NO: 2773340 - RNA, 15 nt, Leptospira interrogans serovar lai str. 56601
uuccucuugaagauu

SEQ ID NO: 2773341 - RNA, 15 nt, Leptospira interrogans serovar lai str. 56601
uuccugauuuggaau

SEQ ID NO: 2773342 - RNA, 21 nt, Leptospira interrogans serovar lai str. 56601
uuccugauuuggaaucugcau

SEQ ID NO: 2773343 - RNA, 18 nt, Leptospira interrogans serovar lai str. 56601
uuccuuaaauauaucuuc

SEQ ID NO: 2773344 - RNA, 21 nt, Leptospira interrogans serovar lai str. 56601
uuccuuaaauauaucuucuuu

SEQ ID NO: 2773345 - RNA, 18 nt, Leptospira interrogans serovar lai str. 56601
uuccuuauuaaaaccauc

SEQ ID NO: 2773346 - RNA, 15 nt, Leptospira interrogans serovar lai str. 56601
uuccuuccaaguuuu

SEQ ID NO: 2773347 - RNA, 22 nt, Leptospira interrogans serovar lai str. 56601
uuccuuccaaguuuuugugacu

SEQ ID NO: 2773348 - RNA, 17 nt, Leptospira interrogans serovar lai str. 56601
uuccuuccgaucccaac

SEQ ID NO: 2773349 - RNA, 16 nt, Leptospira interrogans serovar lai str. 56601
uuccuucuagauaagg

SEQ ID NO: 2773350 - RNA, 12 nt, Leptospira interrogans serovar lai str. 56601
uuccuugaaaaa

SEQ ID NO: 2773351 - RNA, 14 nt, Leptospira interrogans serovar lai str. 56601
uuccuuuaaauuga

SEQ ID NO: 2773352 - RNA, 19 nt, Leptospira interrogans serovar lai str. 56601
uuccuuuccgauuucuuuc

SEQ ID NO: 2773353 - RNA, 16 nt, Leptospira interrogans serovar lai str. 56601
uuccuuugaauaaaac

SEQ ID NO: 2773354 - RNA, 14 nt, Leptospira interrogans serovar lai str. 56601
uuccuuuuuccgga

SEQ ID NO: 2773355 - RNA, 17 nt, Leptospira interrogans serovar lai str. 56601
uucgaaaacgauuuuuc

SEQ ID NO: 2773356 - RNA, 17 nt, Leptospira interrogans serovar lai str. 56601
uucgaaaagaaauauua

SEQ ID NO: 2773357 - RNA, 21 nt, Leptospira interrogans serovar lai str. 56601
uucgaaaagaaauauuaaaaa

SEQ ID NO: 2773358 - RNA, 17 nt, Leptospira interrogans serovar lai str. 56601
uucgaaaauuuuaaguu

SEQ ID NO: 2773359 - RNA, 17 nt, Leptospira interrogans serovar lai str. 56601
uucgaaagauuuuucau

SEQ ID NO: 2773360 - RNA, 21 nt, Leptospira interrogans serovar lai str. 56601
uucgaaauuuuacaguaaaau

SEQ ID NO: 2773361 - RNA, 17 nt, Leptospira interrogans serovar lai str. 56601
uucgaacguauaaaaac

SEQ ID NO: 2773362 - RNA, 12 nt, Leptospira interrogans serovar lai str. 56601
uucgaacuuuuu

SEQ ID NO: 2773363 - RNA, 17 nt, Leptospira interrogans serovar lai str. 56601
uucgaagcccauaaaaa

SEQ ID NO: 2773364 - RNA, 20 nt, Leptospira interrogans serovar lai str. 56601
uucgaauucuuucuauuuuu

SEQ ID NO: 2773365 - RNA, 23 nt, Leptospira interrogans serovar lai str. 56601
uucgacaauuguaacaguucuca

SEQ ID NO: 2773366 - RNA, 20 nt, Leptospira interrogans serovar lai str. 56601
uucgacauaagaaagaauuu

SEQ ID NO: 2773367 - RNA, 20 nt, Leptospira interrogans serovar lai str. 56601
uucgaccuuaacucuuaaau

SEQ ID NO: 2773368 - RNA, 14 nt, Leptospira interrogans serovar lai str. 56601
uucgagauuaaaau

SEQ ID NO: 2773369 - RNA, 17 nt, Leptospira interrogans serovar lai str. 56601
uucgauguaagaaaaua

SEQ ID NO: 2773370 - RNA, 19 nt, Leptospira interrogans serovar lai str. 56601
uucgauguaagaaaauauu

SEQ ID NO: 2773371 - RNA, 23 nt, Leptospira interrogans serovar lai str. 56601
uucgauguauggcucauuuuucu

SEQ ID NO: 2773372 - RNA, 14 nt, Leptospira interrogans serovar lai str. 56601
uucgauuaaaauaa

SEQ ID NO: 2773373 - RNA, 16 nt, Leptospira interrogans serovar lai str. 56601
uucgauuuuaaauaaa

SEQ ID NO: 2773374 - RNA, 15 nt, Leptospira interrogans serovar lai str. 56601
uucgcaaaaaaaauu

SEQ ID NO: 2773375 - RNA, 13 nt, Leptospira interrogans serovar lai str. 56601
uucgcacauucua

SEQ ID NO: 2773376 - RNA, 19 nt, Leptospira interrogans serovar lai str. 56601
uucgcauaacaaaaauacu

SEQ ID NO: 2773377 - RNA, 15 nt, Leptospira interrogans serovar lai str. 56601
uucgccgaacucacg

SEQ ID NO: 2773378 - RNA, 15 nt, Leptospira interrogans serovar lai str. 56601
uucgccguaaaaaau

SEQ ID NO: 2773379 - RNA, 16 nt, Leptospira interrogans serovar lai str. 56601
uucgcguuaauauaau

SEQ ID NO: 2773380 - RNA, 15 nt, Leptospira interrogans serovar lai str. 56601
uucgcuuaucuaauu

SEQ ID NO: 2773381 - RNA, 15 nt, Leptospira interrogans serovar lai str. 56601
uucggaaugauaacg

SEQ ID NO: 2773382 - RNA, 23 nt, Leptospira interrogans serovar lai str. 56601
uucggaguuuuuacuaugaagac

SEQ ID NO: 2773383 - RNA, 12 nt, Leptospira interrogans serovar lai str. 56601
uucggaucgaaa

SEQ ID NO: 2773384 - RNA, 23 nt, Leptospira interrogans serovar lai str. 56601
uucggauggaaucgaauccuuuu

SEQ ID NO: 2773385 - RNA, 16 nt, Leptospira interrogans serovar lai str. 56601
uucggcgcaaaauauc

SEQ ID NO: 2773386 - RNA, 14 nt, Leptospira interrogans serovar lai str. 56601
uucgggaaacaaca

SEQ ID NO: 2773387 - RNA, 21 nt, Leptospira interrogans serovar lai str. 56601
uucggguuccguagaacgaau

SEQ ID NO: 2773388 - RNA, 16 nt, Leptospira interrogans serovar lai str. 56601
uucgguggaaacucag

SEQ ID NO: 2773389 - RNA, 19 nt, Leptospira interrogans serovar lai str. 56601
uucgguguaagaaaaaacu

SEQ ID NO: 2773390 - RNA, 13 nt, Leptospira interrogans serovar lai str. 56601
uucguaagaaaaa

SEQ ID NO: 2773391 - RNA, 15 nt, Leptospira interrogans serovar lai str. 56601
uucguaagaaaaaau

SEQ ID NO: 2773392 - RNA, 18 nt, Leptospira interrogans serovar lai str. 56601
uucguaagaaaaaauuuc

SEQ ID NO: 2773393 - RNA, 17 nt, Leptospira interrogans serovar lai str. 56601
uucguaucuaaagacua

SEQ ID NO: 2773394 - RNA, 18 nt, Leptospira interrogans serovar lai str. 56601
uucgucguuuagaggaag

SEQ ID NO: 2773395 - RNA, 15 nt, Leptospira interrogans serovar lai str. 56601
uucgugaacuuuaga

SEQ ID NO: 2773396 - RNA, 12 nt, Leptospira interrogans serovar lai str. 56601
uucgugaagaaa

SEQ ID NO: 2773397 - RNA, 16 nt, Leptospira interrogans serovar lai str. 56601
uucgugauaacaaacu

SEQ ID NO: 2773398 - RNA, 16 nt, Leptospira interrogans serovar lai str. 56601
uucguggagaaaucug

SEQ ID NO: 2773399 - RNA, 16 nt, Leptospira interrogans serovar lai str. 56601
uucguggagaaauucg

SEQ ID NO: 2773400 - RNA, 15 nt, Leptospira interrogans serovar lai str. 56601
uucguuauaaacaau

SEQ ID NO: 2773401 - RNA, 21 nt, Leptospira interrogans serovar lai str. 56601
uucguuauaauuuucaugaac

SEQ ID NO: 2773402 - RNA, 14 nt, Leptospira interrogans serovar lai str. 56601
uucguucggaaaaa

SEQ ID NO: 2773403 - RNA, 17 nt, Leptospira interrogans serovar lai str. 56601
uucguuggaaaguuuuu

SEQ ID NO: 2773404 - RNA, 13 nt, Leptospira interrogans serovar lai str. 56601
uucguuucaacuu

SEQ ID NO: 2773405 - RNA, 14 nt, Leptospira interrogans serovar lai str. 56601
uucguuugaacucg

SEQ ID NO: 2773406 - RNA, 16 nt, Leptospira interrogans serovar lai str. 56601
uucguuuuaguuccca

SEQ ID NO: 2773407 - RNA, 13 nt, Leptospira interrogans serovar lai str. 56601
uucguuuuuguuu

SEQ ID NO: 2773408 - RNA, 19 nt, Leptospira interrogans serovar lai str. 56601
uucuaaaaaaaguuuuaca

SEQ ID NO: 2773409 - RNA, 14 nt, Leptospira interrogans serovar lai str. 56601
uucuaaaaaugaaa

SEQ ID NO: 2773410 - RNA, 11 nt, Leptospira interrogans serovar lai str. 56601
uucuaaaaauu

SEQ ID NO: 2773411 - RNA, 12 nt, Leptospira interrogans serovar lai str. 56601
uucuaaaaauuu

SEQ ID NO: 2773412 - RNA, 13 nt, Leptospira interrogans serovar lai str. 56601
uucuaaaaauuuc

SEQ ID NO: 2773413 - RNA, 19 nt, Leptospira interrogans serovar lai str. 56601
uucuaaaaauuuuuuuaaa

SEQ ID NO: 2773414 - RNA, 12 nt, Leptospira interrogans serovar lai str. 56601
uucuaaaauaua

SEQ ID NO: 2773415 - RNA, 20 nt, Leptospira interrogans serovar lai str. 56601
uucuaaaauauccguaaaac

SEQ ID NO: 2773416 - RNA, 23 nt, Leptospira interrogans serovar lai str. 56601
uucuaaaauccuauucaacuugu

SEQ ID NO: 2773417 - RNA, 15 nt, Leptospira interrogans serovar lai str. 56601
uucuaaaauugaaua

SEQ ID NO: 2773418 - RNA, 13 nt, Leptospira interrogans serovar lai str. 56601
uucuaaaauugua

SEQ ID NO: 2773419 - RNA, 14 nt, Leptospira interrogans serovar lai str. 56601
uucuaaaauuguag

SEQ ID NO: 2773420 - RNA, 22 nt, Leptospira interrogans serovar lai str. 56601
uucuaaaauuguagaaacuuau

SEQ ID NO: 2773421 - RNA, 13 nt, Leptospira interrogans serovar lai str. 56601
uucuaaacaaaau

SEQ ID NO: 2773422 - RNA, 13 nt, Leptospira interrogans serovar lai str. 56601
uucuaaacacaga

SEQ ID NO: 2773423 - RNA, 14 nt, Leptospira interrogans serovar lai str. 56601
uucuaaagccauuu

SEQ ID NO: 2773424 - RNA, 13 nt, Leptospira interrogans serovar lai str. 56601
uucuaaaucugaa

SEQ ID NO: 2773425 - RNA, 23 nt, Leptospira interrogans serovar lai str. 56601
uucuaaaugaguuuuagaauauu

SEQ ID NO: 2773426 - RNA, 17 nt, Leptospira interrogans serovar lai str. 56601
uucuaaauuccaaaauu

SEQ ID NO: 2773427 - RNA, 15 nt, Leptospira interrogans serovar lai str. 56601
uucuaaauugaaacu

SEQ ID NO: 2773428 - RNA, 17 nt, Leptospira interrogans serovar lai str. 56601
uucuaaauugagaauuu

SEQ ID NO: 2773429 - RNA, 13 nt, Leptospira interrogans serovar lai str. 56601
uucuaaauuguga

SEQ ID NO: 2773430 - RNA, 13 nt, Leptospira interrogans serovar lai str. 56601
uucuaaauuugua

SEQ ID NO: 2773431 - RNA, 18 nt, Leptospira interrogans serovar lai str. 56601
uucuaacugguuuuucuu

SEQ ID NO: 2773432 - RNA, 12 nt, Leptospira interrogans serovar lai str. 56601
uucuaacuuuug

SEQ ID NO: 2773433 - RNA, 15 nt, Leptospira interrogans serovar lai str. 56601
uucuaauauuaaaaa

SEQ ID NO: 2773434 - RNA, 18 nt, Leptospira interrogans serovar lai str. 56601
uucuaauauuaaaaacac

SEQ ID NO: 2773435 - RNA, 18 nt, Leptospira interrogans serovar lai str. 56601
uucuaaucccgccaaaaa

SEQ ID NO: 2773436 - RNA, 23 nt, Leptospira interrogans serovar lai str. 56601
uucuaauguuguuaaauuuuucu

SEQ ID NO: 2773437 - RNA, 14 nt, Leptospira interrogans serovar lai str. 56601
uucuaauucauuga

SEQ ID NO: 2773438 - RNA, 15 nt, Leptospira interrogans serovar lai str. 56601
uucuaauuuuauaaa

SEQ ID NO: 2773439 - RNA, 20 nt, Leptospira interrogans serovar lai str. 56601
uucuaauuuucuuguuuaaa

SEQ ID NO: 2773440 - RNA, 18 nt, Leptospira interrogans serovar lai str. 56601
uucuaauuuuuauccaaa

SEQ ID NO: 2773441 - RNA, 17 nt, Leptospira interrogans serovar lai str. 56601
uucuaauuuuucaaaaa

SEQ ID NO: 2773442 - RNA, 13 nt, Leptospira interrogans serovar lai str. 56601
uucuacaaaauuu

SEQ ID NO: 2773443 - RNA, 16 nt, Leptospira interrogans serovar lai str. 56601
uucuacaaaauuuaga

SEQ ID NO: 2773444 - RNA, 13 nt, Leptospira interrogans serovar lai str. 56601
uucuacaaauaaa

SEQ ID NO: 2773445 - RNA, 13 nt, Leptospira interrogans serovar lai str. 56601
uucuacaaauucu

SEQ ID NO: 2773446 - RNA, 14 nt, Leptospira interrogans serovar lai str. 56601
uucuacaauccucg

SEQ ID NO: 2773447 - RNA, 19 nt, Leptospira interrogans serovar lai str. 56601
uucuacaauuauauuaaau

SEQ ID NO: 2773448 - RNA, 17 nt, Leptospira interrogans serovar lai str. 56601
uucuacaccuucuaaau

SEQ ID NO: 2773449 - RNA, 18 nt, Leptospira interrogans serovar lai str. 56601
uucuacaccuucuaaauc

SEQ ID NO: 2773450 - RNA, 19 nt, Leptospira interrogans serovar lai str. 56601
uucuacauuuuugugaaac

SEQ ID NO: 2773451 - RNA, 23 nt, Leptospira interrogans serovar lai str. 56601
uucuacauuuuugugaaacucaa

SEQ ID NO: 2773452 - RNA, 16 nt, Leptospira interrogans serovar lai str. 56601
uucuacgauugcaaga

SEQ ID NO: 2773453 - RNA, 17 nt, Leptospira interrogans serovar lai str. 56601
uucuacuuuauuaaaaa

SEQ ID NO: 2773454 - RNA, 18 nt, Leptospira interrogans serovar lai str. 56601
uucuagacuuucuuugaa

SEQ ID NO: 2773455 - RNA, 17 nt, Leptospira interrogans serovar lai str. 56601
uucuagauagguucuua

SEQ ID NO: 2773456 - RNA, 16 nt, Leptospira interrogans serovar lai str. 56601
uucuagcaccuaaaac

SEQ ID NO: 2773457 - RNA, 18 nt, Leptospira interrogans serovar lai str. 56601
uucuagcgucuaaaaaau

SEQ ID NO: 2773458 - RNA, 16 nt, Leptospira interrogans serovar lai str. 56601
uucuaggaaacucaag

SEQ ID NO: 2773459 - RNA, 17 nt, Leptospira interrogans serovar lai str. 56601
uucuaguaguucccaca

SEQ ID NO: 2773460 - RNA, 20 nt, Leptospira interrogans serovar lai str. 56601
uucuaguaguucccacauuu

SEQ ID NO: 2773461 - RNA, 12 nt, Leptospira interrogans serovar lai str. 56601
uucuaguauuau

SEQ ID NO: 2773462 - RNA, 14 nt, Leptospira interrogans serovar lai str. 56601
uucuaguauuauuu

SEQ ID NO: 2773463 - RNA, 22 nt, Leptospira interrogans serovar lai str. 56601
uucuagugucuaaacuaaaaaa

SEQ ID NO: 2773464 - RNA, 19 nt, Leptospira interrogans serovar lai str. 56601
uucuaguuugaauuuagga

SEQ ID NO: 2773465 - RNA, 13 nt, Leptospira interrogans serovar lai str. 56601
uucuaguuuguuu

SEQ ID NO: 2773466 - RNA, 14 nt, Leptospira interrogans serovar lai str. 56601
uucuauaaacucaa

SEQ ID NO: 2773467 - RNA, 18 nt, Leptospira interrogans serovar lai str. 56601
uucuauaaacucaaagaa

SEQ ID NO: 2773468 - RNA, 17 nt, Leptospira interrogans serovar lai str. 56601
uucuauaaaguugaaug

SEQ ID NO: 2773469 - RNA, 17 nt, Leptospira interrogans serovar lai str. 56601
uucuauaaccacaagac

SEQ ID NO: 2773470 - RNA, 14 nt, Leptospira interrogans serovar lai str. 56601
uucuaucaaaaaau

SEQ ID NO: 2773471 - RNA, 17 nt, Leptospira interrogans serovar lai str. 56601
uucuauccauucuagaa

SEQ ID NO: 2773472 - RNA, 22 nt, Leptospira interrogans serovar lai str. 56601
uucuaugaaacgaaauauauua

SEQ ID NO: 2773473 - RNA, 22 nt, Leptospira interrogans serovar lai str. 56601
uucuauggucgcucugugaaac

SEQ ID NO: 2773474 - RNA, 14 nt, Leptospira interrogans serovar lai str. 56601
uucuauuuuaaaag

SEQ ID NO: 2773475 - RNA, 16 nt, Leptospira interrogans serovar lai str. 56601
uucuauuuuaauauau

SEQ ID NO: 2773476 - RNA, 15 nt, Leptospira interrogans serovar lai str. 56601
uucuauuuuaucaga

SEQ ID NO: 2773477 - RNA, 22 nt, Leptospira interrogans serovar lai str. 56601
uucuauuuucuuugaaaaaauu

SEQ ID NO: 2773478 - RNA, 21 nt, Leptospira interrogans serovar lai str. 56601
uucucaaaaaaugcauucaaa

SEQ ID NO: 2773479 - RNA, 13 nt, Leptospira interrogans serovar lai str. 56601
uucucaaaaaauu

SEQ ID NO: 2773480 - RNA, 13 nt, Leptospira interrogans serovar lai str. 56601
uucucaaaaucuu

SEQ ID NO: 2773481 - RNA, 21 nt, Leptospira interrogans serovar lai str. 56601
uucucaaaaucuuaauaaaau

SEQ ID NO: 2773482 - RNA, 23 nt, Leptospira interrogans serovar lai str. 56601
uucucaagaucauucuauuugga

SEQ ID NO: 2773483 - RNA, 18 nt, Leptospira interrogans serovar lai str. 56601
uucucacagaaauauauu

SEQ ID NO: 2773484 - RNA, 14 nt, Leptospira interrogans serovar lai str. 56601
uucucauauugaaa

SEQ ID NO: 2773485 - RNA, 12 nt, Leptospira interrogans serovar lai str. 56601
uucucauucuug

SEQ ID NO: 2773486 - RNA, 22 nt, Leptospira interrogans serovar lai str. 56601
uucuccacuuaaaaaguuuuuc

SEQ ID NO: 2773487 - RNA, 14 nt, Leptospira interrogans serovar lai str. 56601
uucuccaucuguuu

SEQ ID NO: 2773488 - RNA, 20 nt, Leptospira interrogans serovar lai str. 56601
uucuccauuuguuucuauuu

SEQ ID NO: 2773489 - RNA, 17 nt, Leptospira interrogans serovar lai str. 56601
uucuccuccgaaaguaa

SEQ ID NO: 2773490 - RNA, 18 nt, Leptospira interrogans serovar lai str. 56601
uucuccuucccucgaaau

SEQ ID NO: 2773491 - RNA, 19 nt, Leptospira interrogans serovar lai str. 56601
uucucgcauuuuccuuuuu

SEQ ID NO: 2773492 - RNA, 14 nt, Leptospira interrogans serovar lai str. 56601
uucucguucaacuu

SEQ ID NO: 2773493 - RNA, 16 nt, Leptospira interrogans serovar lai str. 56601
uucucuagaaacugca

SEQ ID NO: 2773494 - RNA, 22 nt, Leptospira interrogans serovar lai str. 56601
uucucuagaaauuuauaauauu

SEQ ID NO: 2773495 - RNA, 21 nt, Leptospira interrogans serovar lai str. 56601
uucucucaaauucuucagggc

SEQ ID NO: 2773496 - RNA, 15 nt, Leptospira interrogans serovar lai str. 56601
uucucucgaaaugag

SEQ ID NO: 2773497 - RNA, 21 nt, Leptospira interrogans serovar lai str. 56601
uucucugcuauuauaaucuuu

SEQ ID NO: 2773498 - RNA, 14 nt, Leptospira interrogans serovar lai str. 56601
uucucuuaaaauuu

SEQ ID NO: 2773499 - RNA, 15 nt, Leptospira interrogans serovar lai str. 56601
uucucuuaaaauuua

SEQ ID NO: 2773500 - RNA, 23 nt, Leptospira interrogans serovar lai str. 56601
uucucuuuugaccaaaagagguc

SEQ ID NO: 2773501 - RNA, 19 nt, Leptospira interrogans serovar lai str. 56601
uucucuuuuuagacaaaaa

SEQ ID NO: 2773502 - RNA, 23 nt, Leptospira interrogans serovar lai str. 56601
uucucuuuuuagacaaaaauacu

SEQ ID NO: 2773503 - RNA, 15 nt, Leptospira interrogans serovar lai str. 56601
uucugaaaaaaguug

SEQ ID NO: 2773504 - RNA, 20 nt, Leptospira interrogans serovar lai str. 56601
uucugaaaaaaguuggaauu

SEQ ID NO: 2773505 - RNA, 21 nt, Leptospira interrogans serovar lai str. 56601
uucugaaaaaaguuggaauuu

SEQ ID NO: 2773506 - RNA, 14 nt, Leptospira interrogans serovar lai str. 56601
uucugaaaaaguua

SEQ ID NO: 2773507 - RNA, 23 nt, Leptospira interrogans serovar lai str. 56601
uucugaaaaaguuggaaucuaaa

SEQ ID NO: 2773508 - RNA, 21 nt, Leptospira interrogans serovar lai str. 56601
uucugaaaaguuuaugaauuu

SEQ ID NO: 2773509 - RNA, 13 nt, Leptospira interrogans serovar lai str. 56601
uucugaaacuuuu

SEQ ID NO: 2773510 - RNA, 17 nt, Leptospira interrogans serovar lai str. 56601
uucugaaaguaguauuc

SEQ ID NO: 2773511 - RNA, 16 nt, Leptospira interrogans serovar lai str. 56601
uucugaaauaaaaaag

SEQ ID NO: 2773512 - RNA, 22 nt, Leptospira interrogans serovar lai str. 56601
uucugaaauuguuuuaaaacuu

SEQ ID NO: 2773513 - RNA, 16 nt, Leptospira interrogans serovar lai str. 56601
uucugaacaagaauuu

SEQ ID NO: 2773514 - RNA, 17 nt, Leptospira interrogans serovar lai str. 56601
uucugaaccaaauacuu

SEQ ID NO: 2773515 - RNA, 18 nt, Leptospira interrogans serovar lai str. 56601
uucugaauauuuuauccg

SEQ ID NO: 2773516 - RNA, 19 nt, Leptospira interrogans serovar lai str. 56601
uucugauaaagaaaaccuu

SEQ ID NO: 2773517 - RNA, 14 nt, Leptospira interrogans serovar lai str. 56601
uucugcuaaguuca

SEQ ID NO: 2773518 - RNA, 14 nt, Leptospira interrogans serovar lai str. 56601
uucugcucuucuaa

SEQ ID NO: 2773519 - RNA, 22 nt, Leptospira interrogans serovar lai str. 56601
uucugcuuaagagaaccucuau

SEQ ID NO: 2773520 - RNA, 16 nt, Leptospira interrogans serovar lai str. 56601
uucuggaaaaguuuuu

SEQ ID NO: 2773521 - RNA, 19 nt, Leptospira interrogans serovar lai str. 56601
uucugguuccauaaagacc

SEQ ID NO: 2773522 - RNA, 13 nt, Leptospira interrogans serovar lai str. 56601
uucuguaaaaaua

SEQ ID NO: 2773523 - RNA, 13 nt, Leptospira interrogans serovar lai str. 56601
uucuguaaaacuu

SEQ ID NO: 2773524 - RNA, 21 nt, Leptospira interrogans serovar lai str. 56601
uucuguugaguucauucugau

SEQ ID NO: 2773525 - RNA, 20 nt, Leptospira interrogans serovar lai str. 56601
uucuguuugaugaaauaguc

SEQ ID NO: 2773526 - RNA, 17 nt, Leptospira interrogans serovar lai str. 56601
uucuuaaaaaaaugauu

SEQ ID NO: 2773527 - RNA, 14 nt, Leptospira interrogans serovar lai str. 56601
uucuuaaaaaauau

SEQ ID NO: 2773528 - RNA, 15 nt, Leptospira interrogans serovar lai str. 56601
uucuuaaaagauucu

SEQ ID NO: 2773529 - RNA, 19 nt, Leptospira interrogans serovar lai str. 56601
uucuuaaaaugugggaauu

SEQ ID NO: 2773530 - RNA, 21 nt, Leptospira interrogans serovar lai str. 56601
uucuuaauuguugcuauggaa

SEQ ID NO: 2773531 - RNA, 14 nt, Leptospira interrogans serovar lai str. 56601
uucuuaauuucucu

SEQ ID NO: 2773532 - RNA, 16 nt, Leptospira interrogans serovar lai str. 56601
uucuuaauuuuacuau

SEQ ID NO: 2773533 - RNA, 15 nt, Leptospira interrogans serovar lai str. 56601
uucuuacaacuuuug

SEQ ID NO: 2773534 - RNA, 20 nt, Leptospira interrogans serovar lai str. 56601
uucuuacaauaaaaacuuau

SEQ ID NO: 2773535 - RNA, 18 nt, Leptospira interrogans serovar lai str. 56601
uucuuacucgacaaaaca

SEQ ID NO: 2773536 - RNA, 17 nt, Leptospira interrogans serovar lai str. 56601
uucuuacuuuuugagua

SEQ ID NO: 2773537 - RNA, 13 nt, Leptospira interrogans serovar lai str. 56601
uucuuagaaaacu

SEQ ID NO: 2773538 - RNA, 21 nt, Leptospira interrogans serovar lai str. 56601
uucuuagaccgaacucacaag

SEQ ID NO: 2773539 - RNA, 14 nt, Leptospira interrogans serovar lai str. 56601
uucuuauagaaacu

SEQ ID NO: 2773540 - RNA, 12 nt, Leptospira interrogans serovar lai str. 56601
uucuuauauaaa

SEQ ID NO: 2773541 - RNA, 18 nt, Leptospira interrogans serovar lai str. 56601
uucuuauaucaaacuuau

SEQ ID NO: 2773542 - RNA, 16 nt, Leptospira interrogans serovar lai str. 56601
uucuuaugagauuuuu

SEQ ID NO: 2773543 - RNA, 17 nt, Leptospira interrogans serovar lai str. 56601
uucuucaauguuauaaa

SEQ ID NO: 2773544 - RNA, 14 nt, Leptospira interrogans serovar lai str. 56601
uucuucauaaaauc

SEQ ID NO: 2773545 - RNA, 15 nt, Leptospira interrogans serovar lai str. 56601
uucuucaugauuuuu

SEQ ID NO: 2773546 - RNA, 13 nt, Leptospira interrogans serovar lai str. 56601
uucuuccaaaguc

SEQ ID NO: 2773547 - RNA, 15 nt, Leptospira interrogans serovar lai str. 56601
uucuuccaaagucaa

SEQ ID NO: 2773548 - RNA, 14 nt, Leptospira interrogans serovar lai str. 56601
uucuuccagagauu

SEQ ID NO: 2773549 - RNA, 22 nt, Leptospira interrogans serovar lai str. 56601
uucuucccagauucccuuuuga

SEQ ID NO: 2773550 - RNA, 19 nt, Leptospira interrogans serovar lai str. 56601
uucuuccggauuaaaaagg

SEQ ID NO: 2773551 - RNA, 12 nt, Leptospira interrogans serovar lai str. 56601
uucuuccuucuu

SEQ ID NO: 2773552 - RNA, 13 nt, Leptospira interrogans serovar lai str. 56601
uucuuccuucuug

SEQ ID NO: 2773553 - RNA, 15 nt, Leptospira interrogans serovar lai str. 56601
uucuucuaaugaagu

SEQ ID NO: 2773554 - RNA, 17 nt, Leptospira interrogans serovar lai str. 56601
uucuucuauuucuuauu

SEQ ID NO: 2773555 - RNA, 15 nt, Leptospira interrogans serovar lai str. 56601
uucuucuuccuuuuu

SEQ ID NO: 2773556 - RNA, 14 nt, Leptospira interrogans serovar lai str. 56601
uucuugaacucaau

SEQ ID NO: 2773557 - RNA, 19 nt, Leptospira interrogans serovar lai str. 56601
uucuugagggguuuuuccu

SEQ ID NO: 2773558 - RNA, 22 nt, Leptospira interrogans serovar lai str. 56601
uucuugagggguuuuuccuuuu

SEQ ID NO: 2773559 - RNA, 15 nt, Leptospira interrogans serovar lai str. 56601
uucuugcaaaaauag

SEQ ID NO: 2773560 - RNA, 18 nt, Leptospira interrogans serovar lai str. 56601
uucuugcaaaaauagaau

SEQ ID NO: 2773561 - RNA, 18 nt, Leptospira interrogans serovar lai str. 56601
uucuugcuucaaaaagag

SEQ ID NO: 2773562 - RNA, 15 nt, Leptospira interrogans serovar lai str. 56601
uucuuguaaguugug

SEQ ID NO: 2773563 - RNA, 15 nt, Leptospira interrogans serovar lai str. 56601
uucuugucggaacac

SEQ ID NO: 2773564 - RNA, 20 nt, Leptospira interrogans serovar lai str. 56601
uucuugucggaacacuugaa

SEQ ID NO: 2773565 - RNA, 18 nt, Leptospira interrogans serovar lai str. 56601
uucuugugucaagcccuc

SEQ ID NO: 2773566 - RNA, 12 nt, Leptospira interrogans serovar lai str. 56601
uucuuuaaaaac

SEQ ID NO: 2773567 - RNA, 19 nt, Leptospira interrogans serovar lai str. 56601
uucuuuaaugcugauuuuu

SEQ ID NO: 2773568 - RNA, 22 nt, Leptospira interrogans serovar lai str. 56601
uucuuuagaaauuuuuaaucaa

SEQ ID NO: 2773569 - RNA, 15 nt, Leptospira interrogans serovar lai str. 56601
uucuuuccaaccauu

SEQ ID NO: 2773570 - RNA, 14 nt, Leptospira interrogans serovar lai str. 56601
uucuuugaacuuuu

SEQ ID NO: 2773571 - RNA, 16 nt, Leptospira interrogans serovar lai str. 56601
uucuuugaacuuuuuc

SEQ ID NO: 2773572 - RNA, 18 nt, Leptospira interrogans serovar lai str. 56601
uucuuuguaaccuuuguu

SEQ ID NO: 2773573 - RNA, 19 nt, Leptospira interrogans serovar lai str. 56601
uucuuuguaaccuuuguuu

SEQ ID NO: 2773574 - RNA, 22 nt, Leptospira interrogans serovar lai str. 56601
uucuuuguaaccuuuguuuccu

SEQ ID NO: 2773575 - RNA, 14 nt, Leptospira interrogans serovar lai str. 56601
uucuuuuaaaauuc

SEQ ID NO: 2773576 - RNA, 17 nt, Leptospira interrogans serovar lai str. 56601
uucuuuuaaacaauuga

SEQ ID NO: 2773577 - RNA, 14 nt, Leptospira interrogans serovar lai str. 56601
uucuuuuagaaaau

SEQ ID NO: 2773578 - RNA, 15 nt, Leptospira interrogans serovar lai str. 56601
uucuuuucagguuga

SEQ ID NO: 2773579 - RNA, 22 nt, Leptospira interrogans serovar lai str. 56601
uucuuuuccaaaaacuuucgga

SEQ ID NO: 2773580 - RNA, 16 nt, Leptospira interrogans serovar lai str. 56601
uucuuuucugaauaaa

SEQ ID NO: 2773581 - RNA, 14 nt, Leptospira interrogans serovar lai str. 56601
uucuuuuuaaauac

SEQ ID NO: 2773582 - RNA, 11 nt, Leptospira interrogans serovar lai str. 56601
uucuuuuuaag

SEQ ID NO: 2773583 - RNA, 12 nt, Leptospira interrogans serovar lai str. 56601
uucuuuuuauuu

SEQ ID NO: 2773584 - RNA, 18 nt, Leptospira interrogans serovar lai str. 56601
uucuuuuuccagacucuu

SEQ ID NO: 2773585 - RNA, 16 nt, Leptospira interrogans serovar lai str. 56601
uucuuuuuuccuucuu

SEQ ID NO: 2773586 - RNA, 18 nt, Leptospira interrogans serovar lai str. 56601
uucuuuuuuuaaacagag

SEQ ID NO: 2773587 - RNA, 14 nt, Leptospira interrogans serovar lai str. 56601
uugaaaaaaaacag

SEQ ID NO: 2773588 - RNA, 23 nt, Leptospira interrogans serovar lai str. 56601
uugaaaaaauccauaucuacaaa

SEQ ID NO: 2773589 - RNA, 19 nt, Leptospira interrogans serovar lai str. 56601
uugaaaaauagaauuguug

SEQ ID NO: 2773590 - RNA, 14 nt, Leptospira interrogans serovar lai str. 56601
uugaaaaaugaauu

SEQ ID NO: 2773591 - RNA, 18 nt, Leptospira interrogans serovar lai str. 56601
uugaaaaauuaauucucc

SEQ ID NO: 2773592 - RNA, 22 nt, Leptospira interrogans serovar lai str. 56601
uugaaaaauuucauaguucaau

SEQ ID NO: 2773593 - RNA, 18 nt, Leptospira interrogans serovar lai str. 56601
uugaaaauaaaaaucaua

SEQ ID NO: 2773594 - RNA, 16 nt, Leptospira interrogans serovar lai str. 56601
uugaaaauuauagaua

SEQ ID NO: 2773595 - RNA, 12 nt, Leptospira interrogans serovar lai str. 56601
uugaaaauucua

SEQ ID NO: 2773596 - RNA, 23 nt, Leptospira interrogans serovar lai str. 56601
uugaaaauugaauuuaaaaguuu

SEQ ID NO: 2773597 - RNA, 17 nt, Leptospira interrogans serovar lai str. 56601
uugaaacauuucuaaaa

SEQ ID NO: 2773598 - RNA, 19 nt, Leptospira interrogans serovar lai str. 56601
uugaaacauuucuaaaaua

SEQ ID NO: 2773599 - RNA, 12 nt, Leptospira interrogans serovar lai str. 56601
uugaaacucagu

SEQ ID NO: 2773600 - RNA, 16 nt, Leptospira interrogans serovar lai str. 56601
uugaaacuuuuaauaa

SEQ ID NO: 2773601 - RNA, 19 nt, Leptospira interrogans serovar lai str. 56601
uugaaacuuuuaauaaaac

SEQ ID NO: 2773602 - RNA, 19 nt, Leptospira interrogans serovar lai str. 56601
uugaaaggugauuccggua

SEQ ID NO: 2773603 - RNA, 24 nt, Leptospira interrogans serovar lai str. 56601
uugaaaguaauuuaucuguaauuu

SEQ ID NO: 2773604 - RNA, 16 nt, Leptospira interrogans serovar lai str. 56601
uugaaaguaucagaau

SEQ ID NO: 2773605 - RNA, 21 nt, Leptospira interrogans serovar lai str. 56601
uugaaaguaucagaaucaaag

SEQ ID NO: 2773606 - RNA, 12 nt, Leptospira interrogans serovar lai str. 56601
uugaaaguuuuu

SEQ ID NO: 2773607 - RNA, 15 nt, Leptospira interrogans serovar lai str. 56601
uugaaaguuuuuuua

SEQ ID NO: 2773608 - RNA, 22 nt, Leptospira interrogans serovar lai str. 56601
uugaaauauuauaaauuuaaaa

SEQ ID NO: 2773609 - RNA, 19 nt, Leptospira interrogans serovar lai str. 56601
uugaaaucugaacauaaaa

SEQ ID NO: 2773610 - RNA, 15 nt, Leptospira interrogans serovar lai str. 56601
uugaaauucagaucu

SEQ ID NO: 2773611 - RNA, 17 nt, Leptospira interrogans serovar lai str. 56601
uugaacaaguucuaaau

SEQ ID NO: 2773612 - RNA, 20 nt, Leptospira interrogans serovar lai str. 56601
uugaacaaguucuaaaucga

SEQ ID NO: 2773613 - RNA, 23 nt, Leptospira interrogans serovar lai str. 56601
uugaacagaaagaucaugaauca

SEQ ID NO: 2773614 - RNA, 17 nt, Leptospira interrogans serovar lai str. 56601
uugaacauuuuuaaaaa

SEQ ID NO: 2773615 - RNA, 21 nt, Leptospira interrogans serovar lai str. 56601
uugaacggacuguuuuaauuu

SEQ ID NO: 2773616 - RNA, 20 nt, Leptospira interrogans serovar lai str. 56601
uugaacuacuacuuuaacgu

SEQ ID NO: 2773617 - RNA, 11 nt, Leptospira interrogans serovar lai str. 56601
uugaacucaau

SEQ ID NO: 2773618 - RNA, 21 nt, Leptospira interrogans serovar lai str. 56601
uugaacucggcucauaaaaaa

SEQ ID NO: 2773619 - RNA, 14 nt, Leptospira interrogans serovar lai str. 56601
uugaagaaaaaaag

SEQ ID NO: 2773620 - RNA, 16 nt, Leptospira interrogans serovar lai str. 56601
uugaagaaaaaaagau

SEQ ID NO: 2773621 - RNA, 22 nt, Leptospira interrogans serovar lai str. 56601
uugaagaaacaauucuuccuuu

SEQ ID NO: 2773622 - RNA, 15 nt, Leptospira interrogans serovar lai str. 56601
uugaagacuauaaaa

SEQ ID NO: 2773623 - RNA, 17 nt, Leptospira interrogans serovar lai str. 56601
uugaagauauuuuccuu

SEQ ID NO: 2773624 - RNA, 16 nt, Leptospira interrogans serovar lai str. 56601
uugaagcguuuucuua

SEQ ID NO: 2773625 - RNA, 16 nt, Leptospira interrogans serovar lai str. 56601
uugaagcguuuuguua

SEQ ID NO: 2773626 - RNA, 23 nt, Leptospira interrogans serovar lai str. 56601
uugaagcguuuuguuaauuguug

SEQ ID NO: 2773627 - RNA, 19 nt, Leptospira interrogans serovar lai str. 56601
uugaaguagucauauaaaa

SEQ ID NO: 2773628 - RNA, 14 nt, Leptospira interrogans serovar lai str. 56601
uugaaguaguuccu

SEQ ID NO: 2773629 - RNA, 22 nt, Leptospira interrogans serovar lai str. 56601
uugaaguguagagaaacuuagc

SEQ ID NO: 2773630 - RNA, 19 nt, Leptospira interrogans serovar lai str. 56601
uugaauaaagagaaaacaa

SEQ ID NO: 2773631 - RNA, 16 nt, Leptospira interrogans serovar lai str. 56601
uugaauaaguuuuaua

SEQ ID NO: 2773632 - RNA, 22 nt, Leptospira interrogans serovar lai str. 56601
uugaauacgacagguuuaauug

SEQ ID NO: 2773633 - RNA, 15 nt, Leptospira interrogans serovar lai str. 56601
uugaauauaauaaaa

SEQ ID NO: 2773634 - RNA, 19 nt, Leptospira interrogans serovar lai str. 56601
uugaauauagcacaaauga

SEQ ID NO: 2773635 - RNA, 15 nt, Leptospira interrogans serovar lai str. 56601
uugaauaucuaauau

SEQ ID NO: 2773636 - RNA, 12 nt, Leptospira interrogans serovar lai str. 56601
uugaaucaaaua

SEQ ID NO: 2773637 - RNA, 17 nt, Leptospira interrogans serovar lai str. 56601
uugaauccgaauacaaa

SEQ ID NO: 2773638 - RNA, 12 nt, Leptospira interrogans serovar lai str. 56601
uugaaucuuaaa

SEQ ID NO: 2773639 - RNA, 15 nt, Leptospira interrogans serovar lai str. 56601
uugaaugaaaucuaa

SEQ ID NO: 2773640 - RNA, 17 nt, Leptospira interrogans serovar lai str. 56601
uugaaugaaaucuaaau

SEQ ID NO: 2773641 - RNA, 23 nt, Leptospira interrogans serovar lai str. 56601
uugaaugaaaucuaaauuuguug

SEQ ID NO: 2773642 - RNA, 21 nt, Leptospira interrogans serovar lai str. 56601
uugaauuacucccaaaccgau

SEQ ID NO: 2773643 - RNA, 13 nt, Leptospira interrogans serovar lai str. 56601
uugaauucuuccu

SEQ ID NO: 2773644 - RNA, 13 nt, Leptospira interrogans serovar lai str. 56601
uugaauuuaaaac

SEQ ID NO: 2773645 - RNA, 18 nt, Leptospira interrogans serovar lai str. 56601
uugaauuuaggaaauuuu

SEQ ID NO: 2773646 - RNA, 18 nt, Leptospira interrogans serovar lai str. 56601
uugaauuuauagauauaa

SEQ ID NO: 2773647 - RNA, 13 nt, Leptospira interrogans serovar lai str. 56601
uugaauuuuacua

SEQ ID NO: 2773648 - RNA, 14 nt, Leptospira interrogans serovar lai str. 56601
uugaauuuuacuaa

SEQ ID NO: 2773649 - RNA, 14 nt, Leptospira interrogans serovar lai str. 56601
uugaauuuuaguua

SEQ ID NO: 2773650 - RNA, 12 nt, Leptospira interrogans serovar lai str. 56601
uugaauuuuaua

SEQ ID NO: 2773651 - RNA, 12 nt, Leptospira interrogans serovar lai str. 56601
uugaauuuuucg

SEQ ID NO: 2773652 - RNA, 12 nt, Leptospira interrogans serovar lai str. 56601
uugaauuuuuua

SEQ ID NO: 2773653 - RNA, 15 nt, Leptospira interrogans serovar lai str. 56601
uugaauuuuuuaaau

SEQ ID NO: 2773654 - RNA, 15 nt, Leptospira interrogans serovar lai str. 56601
uugacaauuugugaa

SEQ ID NO: 2773655 - RNA, 12 nt, Leptospira interrogans serovar lai str. 56601
uugacaucuuuu

SEQ ID NO: 2773656 - RNA, 12 nt, Leptospira interrogans serovar lai str. 56601
uugaccagagcu

SEQ ID NO: 2773657 - RNA, 17 nt, Leptospira interrogans serovar lai str. 56601
uugaccucauaucaaaa

SEQ ID NO: 2773658 - RNA, 18 nt, Leptospira interrogans serovar lai str. 56601
uugaccucauaucaaaaa

SEQ ID NO: 2773659 - RNA, 13 nt, Leptospira interrogans serovar lai str. 56601
uugacguaagaaa

SEQ ID NO: 2773660 - RNA, 18 nt, Leptospira interrogans serovar lai str. 56601
uugacugcagcugaaagc

SEQ ID NO: 2773661 - RNA, 17 nt, Leptospira interrogans serovar lai str. 56601
uugacuuucccacuuau

SEQ ID NO: 2773662 - RNA, 17 nt, Leptospira interrogans serovar lai str. 56601
uugagaaaauaaaaaau

SEQ ID NO: 2773663 - RNA, 11 nt, Leptospira interrogans serovar lai str. 56601
uugagaaacaa

SEQ ID NO: 2773664 - RNA, 23 nt, Leptospira interrogans serovar lai str. 56601
uugagaaaccuuuucuagacuuu

SEQ ID NO: 2773665 - RNA, 22 nt, Leptospira interrogans serovar lai str. 56601
uugagaauucuacauucugaaa

SEQ ID NO: 2773666 - RNA, 14 nt, Leptospira interrogans serovar lai str. 56601
uugagacaagaaga

SEQ ID NO: 2773667 - RNA, 23 nt, Leptospira interrogans serovar lai str. 56601
uugagacaagaagaaaagaaucu

SEQ ID NO: 2773668 - RNA, 21 nt, Leptospira interrogans serovar lai str. 56601
uugagacagguucugauauaa

SEQ ID NO: 2773669 - RNA, 22 nt, Leptospira interrogans serovar lai str. 56601
uugagacagguucugauauaau

SEQ ID NO: 2773670 - RNA, 12 nt, Leptospira interrogans serovar lai str. 56601
uugagagccuuu

SEQ ID NO: 2773671 - RNA, 15 nt, Leptospira interrogans serovar lai str. 56601
uugagauuacaaaaa

SEQ ID NO: 2773672 - RNA, 17 nt, Leptospira interrogans serovar lai str. 56601
uugagcaagaccuugug

SEQ ID NO: 2773673 - RNA, 17 nt, Leptospira interrogans serovar lai str. 56601
uugagcacagcaaaaaa

SEQ ID NO: 2773674 - RNA, 23 nt, Leptospira interrogans serovar lai str. 56601
uugagcaguaaaaucuuuaaguu

SEQ ID NO: 2773675 - RNA, 15 nt, Leptospira interrogans serovar lai str. 56601
uugagcauaaaaaaa

SEQ ID NO: 2773676 - RNA, 20 nt, Leptospira interrogans serovar lai str. 56601
uugagggguuuuuccuuuua

SEQ ID NO: 2773677 - RNA, 16 nt, Leptospira interrogans serovar lai str. 56601
uugagguuuuaaaagu

SEQ ID NO: 2773678 - RNA, 14 nt, Leptospira interrogans serovar lai str. 56601
uugaguaauuccac

SEQ ID NO: 2773679 - RNA, 16 nt, Leptospira interrogans serovar lai str. 56601
uugaguucuucugcaa

SEQ ID NO: 2773680 - RNA, 18 nt, Leptospira interrogans serovar lai str. 56601
uugaguuucacaaaaaua

SEQ ID NO: 2773681 - RNA, 20 nt, Leptospira interrogans serovar lai str. 56601
uugaguuucacaaaaauaug

SEQ ID NO: 2773682 - RNA, 19 nt, Leptospira interrogans serovar lai str. 56601
uugaguuucuuuuugauua

SEQ ID NO: 2773683 - RNA, 14 nt, Leptospira interrogans serovar lai str. 56601
uugaguuuuuccua

SEQ ID NO: 2773684 - RNA, 14 nt, Leptospira interrogans serovar lai str. 56601
uugaguuuuuguuu

SEQ ID NO: 2773685 - RNA, 16 nt, Leptospira interrogans serovar lai str. 56601
uugaguuuuuuaaaac

SEQ ID NO: 2773686 - RNA, 15 nt, Leptospira interrogans serovar lai str. 56601
uugaguuuuuuauuc

SEQ ID NO: 2773687 - RNA, 21 nt, Leptospira interrogans serovar lai str. 56601
uugauaaauagggaauauucc

SEQ ID NO: 2773688 - RNA, 13 nt, Leptospira interrogans serovar lai str. 56601
uugauaauuucau

SEQ ID NO: 2773689 - RNA, 15 nt, Leptospira interrogans serovar lai str. 56601
uugauaauuugugaa

SEQ ID NO: 2773690 - RNA, 21 nt, Leptospira interrogans serovar lai str. 56601
uugauaccgggauuuuaaaaa

SEQ ID NO: 2773691 - RNA, 14 nt, Leptospira interrogans serovar lai str. 56601
uugauacugcauca

SEQ ID NO: 2773692 - RNA, 17 nt, Leptospira interrogans serovar lai str. 56601
uugauagaaaaacucug

SEQ ID NO: 2773693 - RNA, 16 nt, Leptospira interrogans serovar lai str. 56601
uugauauaaucuuaau

SEQ ID NO: 2773694 - RNA, 16 nt, Leptospira interrogans serovar lai str. 56601
uugauauucucugaau

SEQ ID NO: 2773695 - RNA, 13 nt, Leptospira interrogans serovar lai str. 56601
uugauccauuaau

SEQ ID NO: 2773696 - RNA, 23 nt, Leptospira interrogans serovar lai str. 56601
uugaucuacaaugucuaucaaag

SEQ ID NO: 2773697 - RNA, 17 nt, Leptospira interrogans serovar lai str. 56601
uugaucucauaaagaca

SEQ ID NO: 2773698 - RNA, 13 nt, Leptospira interrogans serovar lai str. 56601
uugaucuuuaaaa

SEQ ID NO: 2773699 - RNA, 14 nt, Leptospira interrogans serovar lai str. 56601
uugauguaaagaaa

SEQ ID NO: 2773700 - RNA, 18 nt, Leptospira interrogans serovar lai str. 56601
uugauuaaacaggacaau

SEQ ID NO: 2773701 - RNA, 19 nt, Leptospira interrogans serovar lai str. 56601
uugauuagaguuaaauuga

SEQ ID NO: 2773702 - RNA, 17 nt, Leptospira interrogans serovar lai str. 56601
uugauuauaaccugcaa

SEQ ID NO: 2773703 - RNA, 13 nt, Leptospira interrogans serovar lai str. 56601
uugauuauagaac

SEQ ID NO: 2773704 - RNA, 12 nt, Leptospira interrogans serovar lai str. 56601
uugauucaaaaa

SEQ ID NO: 2773705 - RNA, 21 nt, Leptospira interrogans serovar lai str. 56601
uugauucaaaaacuaaaauac

SEQ ID NO: 2773706 - RNA, 19 nt, Leptospira interrogans serovar lai str. 56601
uugauuccaagauuuuuua

SEQ ID NO: 2773707 - RNA, 16 nt, Leptospira interrogans serovar lai str. 56601
uugauuccaagcaauu

SEQ ID NO: 2773708 - RNA, 16 nt, Leptospira interrogans serovar lai str. 56601
uugauucuaagguuuu

SEQ ID NO: 2773709 - RNA, 12 nt, Leptospira interrogans serovar lai str. 56601
uugauucugcuc

SEQ ID NO: 2773710 - RNA, 20 nt, Leptospira interrogans serovar lai str. 56601
uugauuguggcaagaggaac

SEQ ID NO: 2773711 - RNA, 13 nt, Leptospira interrogans serovar lai str. 56601
uugauuuaaaaac

SEQ ID NO: 2773712 - RNA, 18 nt, Leptospira interrogans serovar lai str. 56601
uugauuucagaucauaaa

SEQ ID NO: 2773713 - RNA, 15 nt, Leptospira interrogans serovar lai str. 56601
uugcaaaaaaaauac

SEQ ID NO: 2773714 - RNA, 14 nt, Leptospira interrogans serovar lai str. 56601
uugcaaaaaaauaa

SEQ ID NO: 2773715 - RNA, 13 nt, Leptospira interrogans serovar lai str. 56601
uugcaaaaaagaa

SEQ ID NO: 2773716 - RNA, 17 nt, Leptospira interrogans serovar lai str. 56601
uugcaaaaaguauguuu

SEQ ID NO: 2773717 - RNA, 12 nt, Leptospira interrogans serovar lai str. 56601
uugcaaagaaga

SEQ ID NO: 2773718 - RNA, 22 nt, Leptospira interrogans serovar lai str. 56601
uugcaaagaagaaauaaguaaa

SEQ ID NO: 2773719 - RNA, 20 nt, Leptospira interrogans serovar lai str. 56601
uugcaacuuugguuaucaua

SEQ ID NO: 2773720 - RNA, 16 nt, Leptospira interrogans serovar lai str. 56601
uugcaaguaaaaagac

SEQ ID NO: 2773721 - RNA, 17 nt, Leptospira interrogans serovar lai str. 56601
uugcaaguaaaaagacu

SEQ ID NO: 2773722 - RNA, 14 nt, Leptospira interrogans serovar lai str. 56601
uugcaauuuuacuu

SEQ ID NO: 2773723 - RNA, 11 nt, Leptospira interrogans serovar lai str. 56601
uugcacaaaac

SEQ ID NO: 2773724 - RNA, 16 nt, Leptospira interrogans serovar lai str. 56601
uugcacaaaagaaacg

SEQ ID NO: 2773725 - RNA, 11 nt, Leptospira interrogans serovar lai str. 56601
uugcacaaaau

SEQ ID NO: 2773726 - RNA, 16 nt, Leptospira interrogans serovar lai str. 56601
uugcacguaaacauuc

SEQ ID NO: 2773727 - RNA, 18 nt, Leptospira interrogans serovar lai str. 56601
uugcacugaaauagaauu

SEQ ID NO: 2773728 - RNA, 18 nt, Leptospira interrogans serovar lai str. 56601
uugcaguaaggauucuuu

SEQ ID NO: 2773729 - RNA, 12 nt, Leptospira interrogans serovar lai str. 56601
uugcauaaaauc

SEQ ID NO: 2773730 - RNA, 20 nt, Leptospira interrogans serovar lai str. 56601
uugcauauuccuugagaaaa

SEQ ID NO: 2773731 - RNA, 13 nt, Leptospira interrogans serovar lai str. 56601
uugcaucaaagaa

SEQ ID NO: 2773732 - RNA, 13 nt, Leptospira interrogans serovar lai str. 56601
uugcaugaaauca

SEQ ID NO: 2773733 - RNA, 21 nt, Leptospira interrogans serovar lai str. 56601
uugcauuuaauauauucaaaa

SEQ ID NO: 2773734 - RNA, 23 nt, Leptospira interrogans serovar lai str. 56601
uugccagcguccgcaauauccca

SEQ ID NO: 2773735 - RNA, 14 nt, Leptospira interrogans serovar lai str. 56601
uugcguuuaaaaac

SEQ ID NO: 2773736 - RNA, 18 nt, Leptospira interrogans serovar lai str. 56601
uugcuauggaauuuuuca

SEQ ID NO: 2773737 - RNA, 23 nt, Leptospira interrogans serovar lai str. 56601
uugcuauggaauuuuuucaaaaa

SEQ ID NO: 2773738 - RNA, 21 nt, Leptospira interrogans serovar lai str. 56601
uugcucagagaauaucugaau

SEQ ID NO: 2773739 - RNA, 13 nt, Leptospira interrogans serovar lai str. 56601
uugcucucgcaau

SEQ ID NO: 2773740 - RNA, 20 nt, Leptospira interrogans serovar lai str. 56601
uugcucucgcaaugaaaauu

SEQ ID NO: 2773741 - RNA, 18 nt, Leptospira interrogans serovar lai str. 56601
uugcuguaaaauuuagau

SEQ ID NO: 2773742 - RNA, 19 nt, Leptospira interrogans serovar lai str. 56601
uugcugucauaaaccgauu

SEQ ID NO: 2773743 - RNA, 19 nt, Leptospira interrogans serovar lai str. 56601
uugcuuaaagcauuaaaaa

SEQ ID NO: 2773744 - RNA, 22 nt, Leptospira interrogans serovar lai str. 56601
uuggaaaaaguccuuuugagca

SEQ ID NO: 2773745 - RNA, 21 nt, Leptospira interrogans serovar lai str. 56601
uuggaaagccccagaacaaau

SEQ ID NO: 2773746 - RNA, 14 nt, Leptospira interrogans serovar lai str. 56601
uuggaaaucgaaaa

SEQ ID NO: 2773747 - RNA, 14 nt, Leptospira interrogans serovar lai str. 56601
uuggaaauugacuu

SEQ ID NO: 2773748 - RNA, 20 nt, Leptospira interrogans serovar lai str. 56601
uuggaacuuuuuaucauuag

SEQ ID NO: 2773749 - RNA, 16 nt, Leptospira interrogans serovar lai str. 56601
uuggaauaaaaucaua

SEQ ID NO: 2773750 - RNA, 14 nt, Leptospira interrogans serovar lai str. 56601
uuggaaucuaaacu

SEQ ID NO: 2773751 - RNA, 13 nt, Leptospira interrogans serovar lai str. 56601
uuggaaucugaau

SEQ ID NO: 2773752 - RNA, 14 nt, Leptospira interrogans serovar lai str. 56601
uuggaaucugaauu

SEQ ID NO: 2773753 - RNA, 22 nt, Leptospira interrogans serovar lai str. 56601
uuggaauguacuaaaauuuuau

SEQ ID NO: 2773754 - RNA, 22 nt, Leptospira interrogans serovar lai str. 56601
uuggagaccaaaaaucaaauuu

SEQ ID NO: 2773755 - RNA, 21 nt, Leptospira interrogans serovar lai str. 56601
uuggaucuacuaagauuucuu

SEQ ID NO: 2773756 - RNA, 13 nt, Leptospira interrogans serovar lai str. 56601
uuggaucuguaau

SEQ ID NO: 2773757 - RNA, 22 nt, Leptospira interrogans serovar lai str. 56601
uuggauuuauguucguucccac

SEQ ID NO: 2773758 - RNA, 19 nt, Leptospira interrogans serovar lai str. 56601
uuggcaauuugugaacuuu

SEQ ID NO: 2773759 - RNA, 19 nt, Leptospira interrogans serovar lai str. 56601
uuggcgacaaaaggauucc

SEQ ID NO: 2773760 - RNA, 14 nt, Leptospira interrogans serovar lai str. 56601
uuggcucagauuuc

SEQ ID NO: 2773761 - RNA, 23 nt, Leptospira interrogans serovar lai str. 56601
uugggaacaauccgcggauguuu

SEQ ID NO: 2773762 - RNA, 20 nt, Leptospira interrogans serovar lai str. 56601
uugggauaaauauucucuau

SEQ ID NO: 2773763 - RNA, 12 nt, Leptospira interrogans serovar lai str. 56601
uuggggaaguaa

SEQ ID NO: 2773764 - RNA, 23 nt, Leptospira interrogans serovar lai str. 56601
uuggggcuuacggggaauuuuua

SEQ ID NO: 2773765 - RNA, 14 nt, Leptospira interrogans serovar lai str. 56601
uuggguuucuuaaa

SEQ ID NO: 2773766 - RNA, 15 nt, Leptospira interrogans serovar lai str. 56601
uugguaauuugugaa

SEQ ID NO: 2773767 - RNA, 13 nt, Leptospira interrogans serovar lai str. 56601
uuggugauuuaaa

SEQ ID NO: 2773768 - RNA, 16 nt, Leptospira interrogans serovar lai str. 56601
uugguuaucauaaaaa

SEQ ID NO: 2773769 - RNA, 18 nt, Leptospira interrogans serovar lai str. 56601
uugguuggauuccuuucu

SEQ ID NO: 2773770 - RNA, 20 nt, Leptospira interrogans serovar lai str. 56601
uugguuuguaauaguuccca

SEQ ID NO: 2773771 - RNA, 18 nt, Leptospira interrogans serovar lai str. 56601
uugguuuucauaaauaca

SEQ ID NO: 2773772 - RNA, 14 nt, Leptospira interrogans serovar lai str. 56601
uuguaaaaaaacau

SEQ ID NO: 2773773 - RNA, 12 nt, Leptospira interrogans serovar lai str. 56601
uuguaaaaaacc

SEQ ID NO: 2773774 - RNA, 13 nt, Leptospira interrogans serovar lai str. 56601
uuguaaaauugcu

SEQ ID NO: 2773775 - RNA, 19 nt, Leptospira interrogans serovar lai str. 56601
uuguaaaauuuaaagauuu

SEQ ID NO: 2773776 - RNA, 17 nt, Leptospira interrogans serovar lai str. 56601
uuguaaagcaacugugg

SEQ ID NO: 2773777 - RNA, 22 nt, Leptospira interrogans serovar lai str. 56601
uuguaagggaaaguuauuucuu

SEQ ID NO: 2773778 - RNA, 12 nt, Leptospira interrogans serovar lai str. 56601
uuguaaguuuuc

SEQ ID NO: 2773779 - RNA, 12 nt, Leptospira interrogans serovar lai str. 56601
uuguaaguuuuu

SEQ ID NO: 2773780 - RNA, 13 nt, Leptospira interrogans serovar lai str. 56601
uuguaauaaaaau

SEQ ID NO: 2773781 - RNA, 22 nt, Leptospira interrogans serovar lai str. 56601
uuguaaucuguggacuuaugag

SEQ ID NO: 2773782 - RNA, 14 nt, Leptospira interrogans serovar lai str. 56601
uuguacaaaaccgu

SEQ ID NO: 2773783 - RNA, 16 nt, Leptospira interrogans serovar lai str. 56601
uuguacccuuaaaauc

SEQ ID NO: 2773784 - RNA, 13 nt, Leptospira interrogans serovar lai str. 56601
uuguagagauuga

SEQ ID NO: 2773785 - RNA, 16 nt, Leptospira interrogans serovar lai str. 56601
uuguagauaaagguaa

SEQ ID NO: 2773786 - RNA, 15 nt, Leptospira interrogans serovar lai str. 56601
uuguaggaacuacua

SEQ ID NO: 2773787 - RNA, 14 nt, Leptospira interrogans serovar lai str. 56601
uuguauaagaaaug

SEQ ID NO: 2773788 - RNA, 16 nt, Leptospira interrogans serovar lai str. 56601
uuguauagaaaccgau

SEQ ID NO: 2773789 - RNA, 17 nt, Leptospira interrogans serovar lai str. 56601
uuguauagaaaccgauu

SEQ ID NO: 2773790 - RNA, 19 nt, Leptospira interrogans serovar lai str. 56601
uuguaucagauguuuuaaa

SEQ ID NO: 2773791 - RNA, 14 nt, Leptospira interrogans serovar lai str. 56601
uuguaucauuguuu

SEQ ID NO: 2773792 - RNA, 23 nt, Leptospira interrogans serovar lai str. 56601
uuguauccauuucguuucccucu

SEQ ID NO: 2773793 - RNA, 18 nt, Leptospira interrogans serovar lai str. 56601
uuguauccgaaaaauucc

SEQ ID NO: 2773794 - RNA, 19 nt, Leptospira interrogans serovar lai str. 56601
uuguauccgaaaaauucca

SEQ ID NO: 2773795 - RNA, 19 nt, Leptospira interrogans serovar lai str. 56601
uuguaugauuuauaguuuu

SEQ ID NO: 2773796 - RNA, 20 nt, Leptospira interrogans serovar lai str. 56601
uugucagaccuaaaauugca

SEQ ID NO: 2773797 - RNA, 11 nt, Leptospira interrogans serovar lai str. 56601
uugucccaaaa

SEQ ID NO: 2773798 - RNA, 17 nt, Leptospira interrogans serovar lai str. 56601
uugucccaaaaacucaa

SEQ ID NO: 2773799 - RNA, 22 nt, Leptospira interrogans serovar lai str. 56601
uugucccaaaaccucaaaaaau

SEQ ID NO: 2773800 - RNA, 15 nt, Leptospira interrogans serovar lai str. 56601
uuguccgaauccaag

SEQ ID NO: 2773801 - RNA, 16 nt, Leptospira interrogans serovar lai str. 56601
uuguccuaaaauuuua

SEQ ID NO: 2773802 - RNA, 16 nt, Leptospira interrogans serovar lai str. 56601
uugucuacgaucgcaa

SEQ ID NO: 2773803 - RNA, 19 nt, Leptospira interrogans serovar lai str. 56601
uugucuacgauuucuccaa

SEQ ID NO: 2773804 - RNA, 15 nt, Leptospira interrogans serovar lai str. 56601
uugucucaaaauuua

SEQ ID NO: 2773805 - RNA, 22 nt, Leptospira interrogans serovar lai str. 56601
uugucuccugucaauuuuccag

SEQ ID NO: 2773806 - RNA, 12 nt, Leptospira interrogans serovar lai str. 56601
uugucuuuaugc

SEQ ID NO: 2773807 - RNA, 18 nt, Leptospira interrogans serovar lai str. 56601
uugucuuugagaaaauuc

SEQ ID NO: 2773808 - RNA, 17 nt, Leptospira interrogans serovar lai str. 56601
uugugaaaaucuagauu

SEQ ID NO: 2773809 - RNA, 22 nt, Leptospira interrogans serovar lai str. 56601
uugugaaacuuaaucucaugag

SEQ ID NO: 2773810 - RNA, 16 nt, Leptospira interrogans serovar lai str. 56601
uugugaauauuucuuc

SEQ ID NO: 2773811 - RNA, 15 nt, Leptospira interrogans serovar lai str. 56601
uugugaaucaaaagg

SEQ ID NO: 2773812 - RNA, 23 nt, Leptospira interrogans serovar lai str. 56601
uugugaaucaaaagguauaaaau

SEQ ID NO: 2773813 - RNA, 16 nt, Leptospira interrogans serovar lai str. 56601
uugugagaaauacuuu

SEQ ID NO: 2773814 - RNA, 22 nt, Leptospira interrogans serovar lai str. 56601
uugugagaaauacuuugauuau

SEQ ID NO: 2773815 - RNA, 15 nt, Leptospira interrogans serovar lai str. 56601
uugugagaguuccca

SEQ ID NO: 2773816 - RNA, 13 nt, Leptospira interrogans serovar lai str. 56601
uugugauaaaauu

SEQ ID NO: 2773817 - RNA, 22 nt, Leptospira interrogans serovar lai str. 56601
uugugaucagugauucgaaauu

SEQ ID NO: 2773818 - RNA, 14 nt, Leptospira interrogans serovar lai str. 56601
uugugaucucgauu

SEQ ID NO: 2773819 - RNA, 13 nt, Leptospira interrogans serovar lai str. 56601
uugugcaauaauu

SEQ ID NO: 2773820 - RNA, 16 nt, Leptospira interrogans serovar lai str. 56601
uugugcuauauucaaa

SEQ ID NO: 2773821 - RNA, 16 nt, Leptospira interrogans serovar lai str. 56601
uuguggcaagaggaac

SEQ ID NO: 2773822 - RNA, 19 nt, Leptospira interrogans serovar lai str. 56601
uugugggaacuauuacaaa

SEQ ID NO: 2773823 - RNA, 15 nt, Leptospira interrogans serovar lai str. 56601
uugugucaagcccuc

SEQ ID NO: 2773824 - RNA, 17 nt, Leptospira interrogans serovar lai str. 56601
uugugucaagcccuccu

SEQ ID NO: 2773825 - RNA, 17 nt, Leptospira interrogans serovar lai str. 56601
uuguguuaguucccaca

SEQ ID NO: 2773826 - RNA, 20 nt, Leptospira interrogans serovar lai str. 56601
uuguguucaucguuccaaac

SEQ ID NO: 2773827 - RNA, 18 nt, Leptospira interrogans serovar lai str. 56601
uuguguugaguuuuuccu

SEQ ID NO: 2773828 - RNA, 19 nt, Leptospira interrogans serovar lai str. 56601
uuguguuugauaauuugug

SEQ ID NO: 2773829 - RNA, 16 nt, Leptospira interrogans serovar lai str. 56601
uuguuaaaaaauuaau

SEQ ID NO: 2773830 - RNA, 12 nt, Leptospira interrogans serovar lai str. 56601
uuguuaaauuuu

SEQ ID NO: 2773831 - RNA, 22 nt, Leptospira interrogans serovar lai str. 56601
uuguuaucugugaauucuccaa

SEQ ID NO: 2773832 - RNA, 15 nt, Leptospira interrogans serovar lai str. 56601
uuguuccuaaaaaau

SEQ ID NO: 2773833 - RNA, 15 nt, Leptospira interrogans serovar lai str. 56601
uuguucuccaacuua

SEQ ID NO: 2773834 - RNA, 15 nt, Leptospira interrogans serovar lai str. 56601
uuguucuggagaaag

SEQ ID NO: 2773835 - RNA, 16 nt, Leptospira interrogans serovar lai str. 56601
uuguugaaaaauuaau

SEQ ID NO: 2773836 - RNA, 23 nt, Leptospira interrogans serovar lai str. 56601
uuguugaaaaauuaauucucuau

SEQ ID NO: 2773837 - RNA, 17 nt, Leptospira interrogans serovar lai str. 56601
uuguugaaaaauuuccc

SEQ ID NO: 2773838 - RNA, 18 nt, Leptospira interrogans serovar lai str. 56601
uuguugaaaaauuucccu

SEQ ID NO: 2773839 - RNA, 17 nt, Leptospira interrogans serovar lai str. 56601
uuguuguuauggaauuu

SEQ ID NO: 2773840 - RNA, 23 nt, Leptospira interrogans serovar lai str. 56601
uuguuuaaaaugcggaaacuuuu

SEQ ID NO: 2773841 - RNA, 15 nt, Leptospira interrogans serovar lai str. 56601
uuguuuacaaacuua

SEQ ID NO: 2773842 - RNA, 23 nt, Leptospira interrogans serovar lai str. 56601
uuguuuacccgauauuaaaauga

SEQ ID NO: 2773843 - RNA, 15 nt, Leptospira interrogans serovar lai str. 56601
uuguuucauaaaauu

SEQ ID NO: 2773844 - RNA, 16 nt, Leptospira interrogans serovar lai str. 56601
uuguuucauaaaauuc

SEQ ID NO: 2773845 - RNA, 16 nt, Leptospira interrogans serovar lai str. 56601
uuguuuccucuugaag

SEQ ID NO: 2773846 - RNA, 11 nt, Leptospira interrogans serovar lai str. 56601
uuguuuccuuc

SEQ ID NO: 2773847 - RNA, 20 nt, Leptospira interrogans serovar lai str. 56601
uuguuucuaauucauuugga

SEQ ID NO: 2773848 - RNA, 17 nt, Leptospira interrogans serovar lai str. 56601
uuguuugaaaguuccca

SEQ ID NO: 2773849 - RNA, 12 nt, Leptospira interrogans serovar lai str. 56601
uuguuuguaaaa

SEQ ID NO: 2773850 - RNA, 13 nt, Leptospira interrogans serovar lai str. 56601
uuguuuuaaaauu

SEQ ID NO: 2773851 - RNA, 14 nt, Leptospira interrogans serovar lai str. 56601
uuguuuuauaaaac

SEQ ID NO: 2773852 - RNA, 14 nt, Leptospira interrogans serovar lai str. 56601
uuguuuuauagaaa

SEQ ID NO: 2773853 - RNA, 14 nt, Leptospira interrogans serovar lai str. 56601
uuguuuuauucuaa

SEQ ID NO: 2773854 - RNA, 12 nt, Leptospira interrogans serovar lai str. 56601
uuguuuucuaaa

SEQ ID NO: 2773855 - RNA, 16 nt, Leptospira interrogans serovar lai str. 56601
uuguuuucuaaaggaa

SEQ ID NO: 2773856 - RNA, 14 nt, Leptospira interrogans serovar lai str. 56601
uuguuuuuaaauua

SEQ ID NO: 2773857 - RNA, 18 nt, Leptospira interrogans serovar lai str. 56601
uuguuuuuuagaaaauuc

SEQ ID NO: 2773858 - RNA, 18 nt, Leptospira interrogans serovar lai str. 56601
uuuaaaaaaaucacuaau

SEQ ID NO: 2773859 - RNA, 11 nt, Leptospira interrogans serovar lai str. 56601
uuuaaaaaacc

SEQ ID NO: 2773860 - RNA, 13 nt, Leptospira interrogans serovar lai str. 56601
uuuaaaaaauauc

SEQ ID NO: 2773861 - RNA, 13 nt, Leptospira interrogans serovar lai str. 56601
uuuaaaaaauuaa

SEQ ID NO: 2773862 - RNA, 13 nt, Leptospira interrogans serovar lai str. 56601
uuuaaaaaauuuc

SEQ ID NO: 2773863 - RNA, 13 nt, Leptospira interrogans serovar lai str. 56601
uuuaaaaauauaa

SEQ ID NO: 2773864 - RNA, 16 nt, Leptospira interrogans serovar lai str. 56601
uuuaaaaauucaacuu

SEQ ID NO: 2773865 - RNA, 22 nt, Leptospira interrogans serovar lai str. 56601
uuuaaaaauucugucguaaaaa

SEQ ID NO: 2773866 - RNA, 16 nt, Leptospira interrogans serovar lai str. 56601
uuuaaaaauuuccuuu

SEQ ID NO: 2773867 - RNA, 12 nt, Leptospira interrogans serovar lai str. 56601
uuuaaaaauuuu

SEQ ID NO: 2773868 - RNA, 21 nt, Leptospira interrogans serovar lai str. 56601
uuuaaaacuugucccaaaauu

SEQ ID NO: 2773869 - RNA, 11 nt, Leptospira interrogans serovar lai str. 56601
uuuaaaaguuu

SEQ ID NO: 2773870 - RNA, 18 nt, Leptospira interrogans serovar lai str. 56601
uuuaaaaguuugauuuca

SEQ ID NO: 2773871 - RNA, 20 nt, Leptospira interrogans serovar lai str. 56601
uuuaaaaucguaaaaaagau

SEQ ID NO: 2773872 - RNA, 21 nt, Leptospira interrogans serovar lai str. 56601
uuuaaaaucguaaaaaagaua

SEQ ID NO: 2773873 - RNA, 18 nt, Leptospira interrogans serovar lai str. 56601
uuuaaaauuaaugaauaa

SEQ ID NO: 2773874 - RNA, 17 nt, Leptospira interrogans serovar lai str. 56601
uuuaaaauucuaauauu

SEQ ID NO: 2773875 - RNA, 13 nt, Leptospira interrogans serovar lai str. 56601
uuuaaaauuguga

SEQ ID NO: 2773876 - RNA, 13 nt, Leptospira interrogans serovar lai str. 56601
uuuaaaauugugu

SEQ ID NO: 2773877 - RNA, 19 nt, Leptospira interrogans serovar lai str. 56601
uuuaaaauuguguaugagu

SEQ ID NO: 2773878 - RNA, 23 nt, Leptospira interrogans serovar lai str. 56601
uuuaaacaaagacaaaguauuuu

SEQ ID NO: 2773879 - RNA, 15 nt, Leptospira interrogans serovar lai str. 56601
uuuaaacaacaguac

SEQ ID NO: 2773880 - RNA, 21 nt, Leptospira interrogans serovar lai str. 56601
uuuaaacaacaguacaagaau

SEQ ID NO: 2773881 - RNA, 23 nt, Leptospira interrogans serovar lai str. 56601
uuuaaacaacaguacaagaauca

SEQ ID NO: 2773882 - RNA, 23 nt, Leptospira interrogans serovar lai str. 56601
uuuaaacauuuauuuuucguaau

SEQ ID NO: 2773883 - RNA, 17 nt, Leptospira interrogans serovar lai str. 56601
uuuaaaccaguuuguuu

SEQ ID NO: 2773884 - RNA, 23 nt, Leptospira interrogans serovar lai str. 56601
uuuaaacgaucagaaaaacaaaa

SEQ ID NO: 2773885 - RNA, 20 nt, Leptospira interrogans serovar lai str. 56601
uuuaaacgauuuaaaagaau

SEQ ID NO: 2773886 - RNA, 19 nt, Leptospira interrogans serovar lai str. 56601
uuuaaacguuuauuucaaa

SEQ ID NO: 2773887 - RNA, 24 nt, Leptospira interrogans serovar lai str. 56601
uuuaaacuauagagaaauccaauc

SEQ ID NO: 2773888 - RNA, 21 nt, Leptospira interrogans serovar lai str. 56601
uuuaaacuuagauucgagucc

SEQ ID NO: 2773889 - RNA, 20 nt, Leptospira interrogans serovar lai str. 56601
uuuaaacuuucuuccaauug

SEQ ID NO: 2773890 - RNA, 21 nt, Leptospira interrogans serovar lai str. 56601
uuuaaacuuuguuuuugcuca

SEQ ID NO: 2773891 - RNA, 22 nt, Leptospira interrogans serovar lai str. 56601
uuuaaagaaacucauaaaauaa

SEQ ID NO: 2773892 - RNA, 22 nt, Leptospira interrogans serovar lai str. 56601
uuuaaagccucaugaaaaucua

SEQ ID NO: 2773893 - RNA, 11 nt, Leptospira interrogans serovar lai str. 56601
uuuaaagguaa

SEQ ID NO: 2773894 - RNA, 22 nt, Leptospira interrogans serovar lai str. 56601
uuuaaaguaaucguuuaaagau

SEQ ID NO: 2773895 - RNA, 10 nt, Leptospira interrogans serovar lai str. 56601
uuuaaauaca

SEQ ID NO: 2773896 - RNA, 20 nt, Leptospira interrogans serovar lai str. 56601
uuuaaauacucuaauuuuuu

SEQ ID NO: 2773897 - RNA, 17 nt, Leptospira interrogans serovar lai str. 56601
uuuaaauacuuuauaau

SEQ ID NO: 2773898 - RNA, 17 nt, Leptospira interrogans serovar lai str. 56601
uuuaaauacuuuuaugg

SEQ ID NO: 2773899 - RNA, 17 nt, Leptospira interrogans serovar lai str. 56601
uuuaaauagauucaaaa

SEQ ID NO: 2773900 - RNA, 16 nt, Leptospira interrogans serovar lai str. 56601
uuuaaauccaacuuaa

SEQ ID NO: 2773901 - RNA, 22 nt, Leptospira interrogans serovar lai str. 56601
uuuaaauccaacuuaaaacugu

SEQ ID NO: 2773902 - RNA, 20 nt, Leptospira interrogans serovar lai str. 56601
uuuaaauuaauauuuauaau

SEQ ID NO: 2773903 - RNA, 13 nt, Leptospira interrogans serovar lai str. 56601
uuuaaauucccuc

SEQ ID NO: 2773904 - RNA, 16 nt, Leptospira interrogans serovar lai str. 56601
uuuaaauugaauucuu

SEQ ID NO: 2773905 - RNA, 20 nt, Leptospira interrogans serovar lai str. 56601
uuuaaauuuacuacucggac

SEQ ID NO: 2773906 - RNA, 14 nt, Leptospira interrogans serovar lai str. 56601
uuuaaauuuacuau

SEQ ID NO: 2773907 - RNA, 19 nt, Leptospira interrogans serovar lai str. 56601
uuuaacaacaucugaaguu

SEQ ID NO: 2773908 - RNA, 22 nt, Leptospira interrogans serovar lai str. 56601
uuuaacauuuguuuuuuauaau

SEQ ID NO: 2773909 - RNA, 14 nt, Leptospira interrogans serovar lai str. 56601
uuuaaccuuuacca

SEQ ID NO: 2773910 - RNA, 19 nt, Leptospira interrogans serovar lai str. 56601
uuuaacucguuagagaaaa

SEQ ID NO: 2773911 - RNA, 23 nt, Leptospira interrogans serovar lai str. 56601
uuuaacuguaauuagaggauaaa

SEQ ID NO: 2773912 - RNA, 20 nt, Leptospira interrogans serovar lai str. 56601
uuuaacuugccguuuuucua

SEQ ID NO: 2773913 - RNA, 18 nt, Leptospira interrogans serovar lai str. 56601
uuuaacuuuuauucucuu

SEQ ID NO: 2773914 - RNA, 15 nt, Leptospira interrogans serovar lai str. 56601
uuuaagaaaauuuaa

SEQ ID NO: 2773915 - RNA, 21 nt, Leptospira interrogans serovar lai str. 56601
uuuaagaacaauuuaaaauaa

SEQ ID NO: 2773916 - RNA, 22 nt, Leptospira interrogans serovar lai str. 56601
uuuaagaauuuaucauuucuuu

SEQ ID NO: 2773917 - RNA, 23 nt, Leptospira interrogans serovar lai str. 56601
uuuaagaauuuguuugucuuuuu

SEQ ID NO: 2773918 - RNA, 18 nt, Leptospira interrogans serovar lai str. 56601
uuuaagaauuuuaaaaaa

SEQ ID NO: 2773919 - RNA, 14 nt, Leptospira interrogans serovar lai str. 56601
uuuaagacucagca

SEQ ID NO: 2773920 - RNA, 18 nt, Leptospira interrogans serovar lai str. 56601
uuuaagcaguuuuacugu

SEQ ID NO: 2773921 - RNA, 15 nt, Leptospira interrogans serovar lai str. 56601
uuuaagcgauuugag

SEQ ID NO: 2773922 - RNA, 20 nt, Leptospira interrogans serovar lai str. 56601
uuuaaguaauauuucucuca

SEQ ID NO: 2773923 - RNA, 19 nt, Leptospira interrogans serovar lai str. 56601
uuuaaguagaaccuaaaaa

SEQ ID NO: 2773924 - RNA, 21 nt, Leptospira interrogans serovar lai str. 56601
uuuaaguagaaccuaaaaaua

SEQ ID NO: 2773925 - RNA, 15 nt, Leptospira interrogans serovar lai str. 56601
uuuaaguucaaaaaa

SEQ ID NO: 2773926 - RNA, 13 nt, Leptospira interrogans serovar lai str. 56601
uuuaaguuuguga

SEQ ID NO: 2773927 - RNA, 13 nt, Leptospira interrogans serovar lai str. 56601
uuuaaguuuucuu

SEQ ID NO: 2773928 - RNA, 14 nt, Leptospira interrogans serovar lai str. 56601
uuuaaguuuucuuu

SEQ ID NO: 2773929 - RNA, 21 nt, Leptospira interrogans serovar lai str. 56601
uuuaaguuuucuuuuuuauca

SEQ ID NO: 2773930 - RNA, 19 nt, Leptospira interrogans serovar lai str. 56601
uuuaaguuuuucuuaaaaa

SEQ ID NO: 2773931 - RNA, 13 nt, Leptospira interrogans serovar lai str. 56601
uuuaauaauauaa

SEQ ID NO: 2773932 - RNA, 18 nt, Leptospira interrogans serovar lai str. 56601
uuuaauaccuaauucucu

SEQ ID NO: 2773933 - RNA, 18 nt, Leptospira interrogans serovar lai str. 56601
uuuaauaguuuauacuuu

SEQ ID NO: 2773934 - RNA, 19 nt, Leptospira interrogans serovar lai str. 56601
uuuaauauacaaaacauuc

SEQ ID NO: 2773935 - RNA, 13 nt, Leptospira interrogans serovar lai str. 56601
uuuaauauuucga

SEQ ID NO: 2773936 - RNA, 14 nt, Leptospira interrogans serovar lai str. 56601
uuuaauauuucgau

SEQ ID NO: 2773937 - RNA, 17 nt, Leptospira interrogans serovar lai str. 56601
uuuaaucaaaauuucuu

SEQ ID NO: 2773938 - RNA, 18 nt, Leptospira interrogans serovar lai str. 56601
uuuaaucaaaauuucuuu

SEQ ID NO: 2773939 - RNA, 14 nt, Leptospira interrogans serovar lai str. 56601
uuuaaucaaaugca

SEQ ID NO: 2773940 - RNA, 20 nt, Leptospira interrogans serovar lai str. 56601
uuuaaucaugugaauucaga

SEQ ID NO: 2773941 - RNA, 12 nt, Leptospira interrogans serovar lai str. 56601
uuuaaugaaaaa

SEQ ID NO: 2773942 - RNA, 18 nt, Leptospira interrogans serovar lai str. 56601
uuuaaugaaaaauuucuu

SEQ ID NO: 2773943 - RNA, 12 nt, Leptospira interrogans serovar lai str. 56601
uuuaaugagaaa

SEQ ID NO: 2773944 - RNA, 19 nt, Leptospira interrogans serovar lai str. 56601
uuuaauuauguuugccauu

SEQ ID NO: 2773945 - RNA, 22 nt, Leptospira interrogans serovar lai str. 56601
uuuaauugcgguaguucccaca

SEQ ID NO: 2773946 - RNA, 19 nt, Leptospira interrogans serovar lai str. 56601
uuuaauuuauaauucguuu

SEQ ID NO: 2773947 - RNA, 18 nt, Leptospira interrogans serovar lai str. 56601
uuuaauuucaauaacuug

SEQ ID NO: 2773948 - RNA, 16 nt, Leptospira interrogans serovar lai str. 56601
uuuaauuucuucauau

SEQ ID NO: 2773949 - RNA, 11 nt, Leptospira interrogans serovar lai str. 56601
uuuaauuugua

SEQ ID NO: 2773950 - RNA, 18 nt, Leptospira interrogans serovar lai str. 56601
uuuaauuuguuauuguuu

SEQ ID NO: 2773951 - RNA, 14 nt, Leptospira interrogans serovar lai str. 56601
uuuaauuuuucuga

SEQ ID NO: 2773952 - RNA, 13 nt, Leptospira interrogans serovar lai str. 56601
uuuacaaaaaugu

SEQ ID NO: 2773953 - RNA, 16 nt, Leptospira interrogans serovar lai str. 56601
uuuacaaacuuacauu

SEQ ID NO: 2773954 - RNA, 19 nt, Leptospira interrogans serovar lai str. 56601
uuuacaaacuuacauuagu

SEQ ID NO: 2773955 - RNA, 23 nt, Leptospira interrogans serovar lai str. 56601
uuuacaaagacucggaaauucuc

SEQ ID NO: 2773956 - RNA, 18 nt, Leptospira interrogans serovar lai str. 56601
uuuacaaauuaguauuuu

SEQ ID NO: 2773957 - RNA, 13 nt, Leptospira interrogans serovar lai str. 56601
uuuacaagauuuc

SEQ ID NO: 2773958 - RNA, 17 nt, Leptospira interrogans serovar lai str. 56601
uuuacaauaaaaauuag

SEQ ID NO: 2773959 - RNA, 20 nt, Leptospira interrogans serovar lai str. 56601
uuuacaauggaaaguguuag

SEQ ID NO: 2773960 - RNA, 19 nt, Leptospira interrogans serovar lai str. 56601
uuuacaauuaaacuucaaa

SEQ ID NO: 2773961 - RNA, 13 nt, Leptospira interrogans serovar lai str. 56601
uuuacaauuugcu

SEQ ID NO: 2773962 - RNA, 20 nt, Leptospira interrogans serovar lai str. 56601
uuuacaauuugcuaaaauaa

SEQ ID NO: 2773963 - RNA, 21 nt, Leptospira interrogans serovar lai str. 56601
uuuacaauuugcuaaaauaag

SEQ ID NO: 2773964 - RNA, 18 nt, Leptospira interrogans serovar lai str. 56601
uuuacacaacauuaugaa

SEQ ID NO: 2773965 - RNA, 20 nt, Leptospira interrogans serovar lai str. 56601
uuuacacgauaauuuucuuu

SEQ ID NO: 2773966 - RNA, 13 nt, Leptospira interrogans serovar lai str. 56601
uuuacagaaaaau

SEQ ID NO: 2773967 - RNA, 15 nt, Leptospira interrogans serovar lai str. 56601
uuuacagauuuauuu

SEQ ID NO: 2773968 - RNA, 23 nt, Leptospira interrogans serovar lai str. 56601
uuuacagccaccaucaaaauuua

SEQ ID NO: 2773969 - RNA, 12 nt, Leptospira interrogans serovar lai str. 56601
uuuacaguaaaa

SEQ ID NO: 2773970 - RNA, 16 nt, Leptospira interrogans serovar lai str. 56601
uuuacauaauaauaca

SEQ ID NO: 2773971 - RNA, 22 nt, Leptospira interrogans serovar lai str. 56601
uuuacaugagacuauaaaguuu

SEQ ID NO: 2773972 - RNA, 15 nt, Leptospira interrogans serovar lai str. 56601
uuuacauuuuuaaau

SEQ ID NO: 2773973 - RNA, 15 nt, Leptospira interrogans serovar lai str. 56601
uuuaccaaaaaugca

SEQ ID NO: 2773974 - RNA, 13 nt, Leptospira interrogans serovar lai str. 56601
uuuaccaaauugu

SEQ ID NO: 2773975 - RNA, 18 nt, Leptospira interrogans serovar lai str. 56601
uuuaccaaggauguggaa

SEQ ID NO: 2773976 - RNA, 20 nt, Leptospira interrogans serovar lai str. 56601
uuuaccagaucaauucuuaa

SEQ ID NO: 2773977 - RNA, 21 nt, Leptospira interrogans serovar lai str. 56601
uuuaccagaucaauucuuaaa

SEQ ID NO: 2773978 - RNA, 17 nt, Leptospira interrogans serovar lai str. 56601
uuuaccaguuaaacuuu

SEQ ID NO: 2773979 - RNA, 20 nt, Leptospira interrogans serovar lai str. 56601
uuuaccaugagcuaauucaa

SEQ ID NO: 2773980 - RNA, 16 nt, Leptospira interrogans serovar lai str. 56601
uuuacccgauauuaaa

SEQ ID NO: 2773981 - RNA, 15 nt, Leptospira interrogans serovar lai str. 56601
uuuacccgaucuuuu

SEQ ID NO: 2773982 - RNA, 22 nt, Leptospira interrogans serovar lai str. 56601
uuuaccgaagacgcauacuuuu

SEQ ID NO: 2773983 - RNA, 16 nt, Leptospira interrogans serovar lai str. 56601
uuuaccggguuccauu

SEQ ID NO: 2773984 - RNA, 18 nt, Leptospira interrogans serovar lai str. 56601
uuuaccggguuccauucu

SEQ ID NO: 2773985 - RNA, 19 nt, Leptospira interrogans serovar lai str. 56601
uuuaccguuuuuaaaugug

SEQ ID NO: 2773986 - RNA, 15 nt, Leptospira interrogans serovar lai str. 56601
uuuaccuaaaauuca

SEQ ID NO: 2773987 - RNA, 18 nt, Leptospira interrogans serovar lai str. 56601
uuuaccuccuccuucucu

SEQ ID NO: 2773988 - RNA, 21 nt, Leptospira interrogans serovar lai str. 56601
uuuacgaaaguugaaaguuuu

SEQ ID NO: 2773989 - RNA, 20 nt, Leptospira interrogans serovar lai str. 56601
uuuacgaacacauucuaaaa

SEQ ID NO: 2773990 - RNA, 22 nt, Leptospira interrogans serovar lai str. 56601
uuuacgaacacauucuaaaauu

SEQ ID NO: 2773991 - RNA, 18 nt, Leptospira interrogans serovar lai str. 56601
uuuacgaacgaauucuaa

SEQ ID NO: 2773992 - RNA, 20 nt, Leptospira interrogans serovar lai str. 56601
uuuacgaacgaauucuaaaa

SEQ ID NO: 2773993 - RNA, 14 nt, Leptospira interrogans serovar lai str. 56601
uuuacgauccuuuu

SEQ ID NO: 2773994 - RNA, 14 nt, Leptospira interrogans serovar lai str. 56601
uuuacgauuaaauu

SEQ ID NO: 2773995 - RNA, 14 nt, Leptospira interrogans serovar lai str. 56601
uuuacgauucaauu

SEQ ID NO: 2773996 - RNA, 13 nt, Leptospira interrogans serovar lai str. 56601
uuuacgauucuaa

SEQ ID NO: 2773997 - RNA, 19 nt, Leptospira interrogans serovar lai str. 56601
uuuacggaucaaaauucuu

SEQ ID NO: 2773998 - RNA, 16 nt, Leptospira interrogans serovar lai str. 56601
uuuacgugauaauucu

SEQ ID NO: 2773999 - RNA, 16 nt, Leptospira interrogans serovar lai str. 56601
uuuacuaaaaaacaua

SEQ ID NO: 2774000 - RNA, 13 nt, Leptospira interrogans serovar lai str. 56601
uuuacuaaaagua

SEQ ID NO: 2774001 - RNA, 22 nt, Leptospira interrogans serovar lai str. 56601
uuuacuacccgacguauaaaaa

SEQ ID NO: 2774002 - RNA, 15 nt, Leptospira interrogans serovar lai str. 56601
uuuacuacgucuucu

SEQ ID NO: 2774003 - RNA, 22 nt, Leptospira interrogans serovar lai str. 56601
uuuacuauaaacauauuauuuu

SEQ ID NO: 2774004 - RNA, 12 nt, Leptospira interrogans serovar lai str. 56601
uuuacucaaaga

SEQ ID NO: 2774005 - RNA, 17 nt, Leptospira interrogans serovar lai str. 56601
uuuacucgauaauucuu

SEQ ID NO: 2774006 - RNA, 21 nt, Leptospira interrogans serovar lai str. 56601
uuuacucgugcacaaguuuuu

SEQ ID NO: 2774007 - RNA, 21 nt, Leptospira interrogans serovar lai str. 56601
uuuacucuauccauauacgua

SEQ ID NO: 2774008 - RNA, 14 nt, Leptospira interrogans serovar lai str. 56601
uuuacucuuauuua

SEQ ID NO: 2774009 - RNA, 16 nt, Leptospira interrogans serovar lai str. 56601
uuuacugaguuucaaa

SEQ ID NO: 2774010 - RNA, 19 nt, Leptospira interrogans serovar lai str. 56601
uuuacugcuugacaucuuu

SEQ ID NO: 2774011 - RNA, 13 nt, Leptospira interrogans serovar lai str. 56601
uuuacuucaauua

SEQ ID NO: 2774012 - RNA, 22 nt, Leptospira interrogans serovar lai str. 56601
uuuacuucauccgggcuuuucu

SEQ ID NO: 2774013 - RNA, 23 nt, Leptospira interrogans serovar lai str. 56601
uuuacuucauccgggcuuuucuu

SEQ ID NO: 2774014 - RNA, 23 nt, Leptospira interrogans serovar lai str. 56601
uuuacuucccagacguaucaaaa

SEQ ID NO: 2774015 - RNA, 17 nt, Leptospira interrogans serovar lai str. 56601
uuuacuucuaacgcaag

SEQ ID NO: 2774016 - RNA, 15 nt, Leptospira interrogans serovar lai str. 56601
uuuacuugaaaauaa

SEQ ID NO: 2774017 - RNA, 13 nt, Leptospira interrogans serovar lai str. 56601
uuuacuugcaaaa

SEQ ID NO: 2774018 - RNA, 21 nt, Leptospira interrogans serovar lai str. 56601
uuuacuugcaaaaaguauguu

SEQ ID NO: 2774019 - RNA, 15 nt, Leptospira interrogans serovar lai str. 56601
uuuacuuuaaaauuu

SEQ ID NO: 2774020 - RNA, 15 nt, Leptospira interrogans serovar lai str. 56601
uuuagaaaaaauuuu

SEQ ID NO: 2774021 - RNA, 14 nt, Leptospira interrogans serovar lai str. 56601
uuuagaaaaagcac

SEQ ID NO: 2774022 - RNA, 22 nt, Leptospira interrogans serovar lai str. 56601
uuuagaaaaagcacaaaacgau

SEQ ID NO: 2774023 - RNA, 20 nt, Leptospira interrogans serovar lai str. 56601
uuuagaaaauaauaauauuu

SEQ ID NO: 2774024 - RNA, 13 nt, Leptospira interrogans serovar lai str. 56601
uuuagaaaauuuu

SEQ ID NO: 2774025 - RNA, 20 nt, Leptospira interrogans serovar lai str. 56601
uuuagaaaucaauucuucuu

SEQ ID NO: 2774026 - RNA, 22 nt, Leptospira interrogans serovar lai str. 56601
uuuagaaaucaauucuucuuuc

SEQ ID NO: 2774027 - RNA, 19 nt, Leptospira interrogans serovar lai str. 56601
uuuagaaaucgauuuguaa

SEQ ID NO: 2774028 - RNA, 13 nt, Leptospira interrogans serovar lai str. 56601
uuuagaaauuucu

SEQ ID NO: 2774029 - RNA, 20 nt, Leptospira interrogans serovar lai str. 56601
uuuagaaauuucuaauaaaa

SEQ ID NO: 2774030 - RNA, 15 nt, Leptospira interrogans serovar lai str. 56601
uuuagaaauuuuuaa

SEQ ID NO: 2774031 - RNA, 20 nt, Leptospira interrogans serovar lai str. 56601
uuuagaaauuuuuaauaaaa

SEQ ID NO: 2774032 - RNA, 17 nt, Leptospira interrogans serovar lai str. 56601
uuuagaacgcaaucugu

SEQ ID NO: 2774033 - RNA, 16 nt, Leptospira interrogans serovar lai str. 56601
uuuagaacuugucuca

SEQ ID NO: 2774034 - RNA, 17 nt, Leptospira interrogans serovar lai str. 56601
uuuagaagaaggucuca

SEQ ID NO: 2774035 - RNA, 13 nt, Leptospira interrogans serovar lai str. 56601
uuuagaagauuga

SEQ ID NO: 2774036 - RNA, 16 nt, Leptospira interrogans serovar lai str. 56601
uuuagaauaaaauuug

SEQ ID NO: 2774037 - RNA, 20 nt, Leptospira interrogans serovar lai str. 56601
uuuagaauaucuuaauauaa

SEQ ID NO: 2774038 - RNA, 20 nt, Leptospira interrogans serovar lai str. 56601
uuuagaauauuaugaaauaa

SEQ ID NO: 2774039 - RNA, 21 nt, Leptospira interrogans serovar lai str. 56601
uuuagaaucagaaugaacuca

SEQ ID NO: 2774040 - RNA, 20 nt, Leptospira interrogans serovar lai str. 56601
uuuagaauuuguucgugaaa

SEQ ID NO: 2774041 - RNA, 16 nt, Leptospira interrogans serovar lai str. 56601
uuuagaauuuucuaaa

SEQ ID NO: 2774042 - RNA, 17 nt, Leptospira interrogans serovar lai str. 56601
uuuagaauuuuucgaaa

SEQ ID NO: 2774043 - RNA, 22 nt, Leptospira interrogans serovar lai str. 56601
uuuagaauuuuucgaaacaaaa

SEQ ID NO: 2774044 - RNA, 18 nt, Leptospira interrogans serovar lai str. 56601
uuuagacaaaaaauucuu

SEQ ID NO: 2774045 - RNA, 16 nt, Leptospira interrogans serovar lai str. 56601
uuuagacaaaaauacu

SEQ ID NO: 2774046 - RNA, 14 nt, Leptospira interrogans serovar lai str. 56601
uuuagagugaauuu

SEQ ID NO: 2774047 - RNA, 15 nt, Leptospira interrogans serovar lai str. 56601
uuuagaguuaagaga

SEQ ID NO: 2774048 - RNA, 19 nt, Leptospira interrogans serovar lai str. 56601
uuuagaguucguuaagaau

SEQ ID NO: 2774049 - RNA, 18 nt, Leptospira interrogans serovar lai str. 56601
uuuagaguuguuaaaaaa

SEQ ID NO: 2774050 - RNA, 22 nt, Leptospira interrogans serovar lai str. 56601
uuuagauaagagacaaauauuu

SEQ ID NO: 2774051 - RNA, 15 nt, Leptospira interrogans serovar lai str. 56601
uuuagauaauuauuc

SEQ ID NO: 2774052 - RNA, 20 nt, Leptospira interrogans serovar lai str. 56601
uuuagauauuuauaaugaau

SEQ ID NO: 2774053 - RNA, 14 nt, Leptospira interrogans serovar lai str. 56601
uuuagaucuaaauu

SEQ ID NO: 2774054 - RNA, 15 nt, Leptospira interrogans serovar lai str. 56601
uuuagaucuaaauuu

SEQ ID NO: 2774055 - RNA, 13 nt, Leptospira interrogans serovar lai str. 56601
uuuagauucuaaa

SEQ ID NO: 2774056 - RNA, 16 nt, Leptospira interrogans serovar lai str. 56601
uuuagauucuaaaaaa

SEQ ID NO: 2774057 - RNA, 14 nt, Leptospira interrogans serovar lai str. 56601
uuuagauuucgaaa

SEQ ID NO: 2774058 - RNA, 22 nt, Leptospira interrogans serovar lai str. 56601
uuuagauuuguguuaguuccca

SEQ ID NO: 2774059 - RNA, 14 nt, Leptospira interrogans serovar lai str. 56601
uuuagcaauuugug

SEQ ID NO: 2774060 - RNA, 17 nt, Leptospira interrogans serovar lai str. 56601
uuuagcaauuugugaac

SEQ ID NO: 2774061 - RNA, 14 nt, Leptospira interrogans serovar lai str. 56601
uuuagcauuuuuaa

SEQ ID NO: 2774062 - RNA, 21 nt, Leptospira interrogans serovar lai str. 56601
uuuagcucuagucaaguuaau

SEQ ID NO: 2774063 - RNA, 14 nt, Leptospira interrogans serovar lai str. 56601
uuuaggaguucuaa

SEQ ID NO: 2774064 - RNA, 15 nt, Leptospira interrogans serovar lai str. 56601
uuuaggauuuaguuc

SEQ ID NO: 2774065 - RNA, 15 nt, Leptospira interrogans serovar lai str. 56601
uuuaggauuuuauga

SEQ ID NO: 2774066 - RNA, 14 nt, Leptospira interrogans serovar lai str. 56601
uuuaguaaaauuua

SEQ ID NO: 2774067 - RNA, 16 nt, Leptospira interrogans serovar lai str. 56601
uuuaguaguaaauaaa

SEQ ID NO: 2774068 - RNA, 19 nt, Leptospira interrogans serovar lai str. 56601
uuuaguaguaaauaaaaaa

SEQ ID NO: 2774069 - RNA, 21 nt, Leptospira interrogans serovar lai str. 56601
uuuagucauuuccuccaaaca

SEQ ID NO: 2774070 - RNA, 16 nt, Leptospira interrogans serovar lai str. 56601
uuuaguucaaaaacau

SEQ ID NO: 2774071 - RNA, 14 nt, Leptospira interrogans serovar lai str. 56601
uuuauaaaaaguuu

SEQ ID NO: 2774072 - RNA, 24 nt, Leptospira interrogans serovar lai str. 56601
uuuauaaaacgaaauuauacaaaa

SEQ ID NO: 2774073 - RNA, 16 nt, Leptospira interrogans serovar lai str. 56601
uuuauaaaacuguaaa

SEQ ID NO: 2774074 - RNA, 21 nt, Leptospira interrogans serovar lai str. 56601
uuuauaaaaguauaauauuua

SEQ ID NO: 2774075 - RNA, 21 nt, Leptospira interrogans serovar lai str. 56601
uuuauaaaauaaaaaaauuca

SEQ ID NO: 2774076 - RNA, 11 nt, Leptospira interrogans serovar lai str. 56601
uuuauaaaauu

SEQ ID NO: 2774077 - RNA, 12 nt, Leptospira interrogans serovar lai str. 56601
uuuauaaaauua

SEQ ID NO: 2774078 - RNA, 18 nt, Leptospira interrogans serovar lai str. 56601
uuuauaaagacuuuaaau

SEQ ID NO: 2774079 - RNA, 13 nt, Leptospira interrogans serovar lai str. 56601
uuuauaaagauaa

SEQ ID NO: 2774080 - RNA, 12 nt, Leptospira interrogans serovar lai str. 56601
uuuauaaaguuu

SEQ ID NO: 2774081 - RNA, 13 nt, Leptospira interrogans serovar lai str. 56601
uuuauaaaguuua

SEQ ID NO: 2774082 - RNA, 12 nt, Leptospira interrogans serovar lai str. 56601
uuuauaaauaaa

SEQ ID NO: 2774083 - RNA, 22 nt, Leptospira interrogans serovar lai str. 56601
uuuauaaauguaggaacuacua

SEQ ID NO: 2774084 - RNA, 12 nt, Leptospira interrogans serovar lai str. 56601
uuuauaaauugc

SEQ ID NO: 2774085 - RNA, 21 nt, Leptospira interrogans serovar lai str. 56601
uuuauaacgggaauuauaaau

SEQ ID NO: 2774086 - RNA, 22 nt, Leptospira interrogans serovar lai str. 56601
uuuauaacuuacugauuucuau

SEQ ID NO: 2774087 - RNA, 20 nt, Leptospira interrogans serovar lai str. 56601
uuuauaauauucuuuuauau

SEQ ID NO: 2774088 - RNA, 21 nt, Leptospira interrogans serovar lai str. 56601
uuuauaauguuugaauuuuua

SEQ ID NO: 2774089 - RNA, 11 nt, Leptospira interrogans serovar lai str. 56601
uuuauaauuca

SEQ ID NO: 2774090 - RNA, 14 nt, Leptospira interrogans serovar lai str. 56601
uuuauaauucaaag

SEQ ID NO: 2774091 - RNA, 21 nt, Leptospira interrogans serovar lai str. 56601
uuuauaauucguuuuuuaaaa

SEQ ID NO: 2774092 - RNA, 14 nt, Leptospira interrogans serovar lai str. 56601
uuuauaauucugaa

SEQ ID NO: 2774093 - RNA, 15 nt, Leptospira interrogans serovar lai str. 56601
uuuauaauucugaau

SEQ ID NO: 2774094 - RNA, 16 nt, Leptospira interrogans serovar lai str. 56601
uuuauaauugaacauu

SEQ ID NO: 2774095 - RNA, 22 nt, Leptospira interrogans serovar lai str. 56601
uuuauacuauaacuuuaaaaaa

SEQ ID NO: 2774096 - RNA, 22 nt, Leptospira interrogans serovar lai str. 56601
uuuauacuuaucacgaaaauua

SEQ ID NO: 2774097 - RNA, 13 nt, Leptospira interrogans serovar lai str. 56601
uuuauagaauuua

SEQ ID NO: 2774098 - RNA, 16 nt, Leptospira interrogans serovar lai str. 56601
uuuauagucaaauuug

SEQ ID NO: 2774099 - RNA, 16 nt, Leptospira interrogans serovar lai str. 56601
uuuauaguuuuuaacu

SEQ ID NO: 2774100 - RNA, 13 nt, Leptospira interrogans serovar lai str. 56601
uuuauauaauuua

SEQ ID NO: 2774101 - RNA, 19 nt, Leptospira interrogans serovar lai str. 56601
uuuauauauauucacaaaa

SEQ ID NO: 2774102 - RNA, 13 nt, Leptospira interrogans serovar lai str. 56601
uuuauauauauuu

SEQ ID NO: 2774103 - RNA, 14 nt, Leptospira interrogans serovar lai str. 56601
uuuauauauauuuu

SEQ ID NO: 2774104 - RNA, 20 nt, Leptospira interrogans serovar lai str. 56601
uuuauaucuuaauuaaaaaa

SEQ ID NO: 2774105 - RNA, 23 nt, Leptospira interrogans serovar lai str. 56601
uuuauauucgcuccguuuugaau

SEQ ID NO: 2774106 - RNA, 14 nt, Leptospira interrogans serovar lai str. 56601
uuuauauuuuaauu

SEQ ID NO: 2774107 - RNA, 13 nt, Leptospira interrogans serovar lai str. 56601
uuuaucaaauaaa

SEQ ID NO: 2774108 - RNA, 20 nt, Leptospira interrogans serovar lai str. 56601
uuuaucaauuacgaaaacua

SEQ ID NO: 2774109 - RNA, 13 nt, Leptospira interrogans serovar lai str. 56601
uuuaucagaaaaa

SEQ ID NO: 2774110 - RNA, 13 nt, Leptospira interrogans serovar lai str. 56601
uuuaucauuucuu

SEQ ID NO: 2774111 - RNA, 14 nt, Leptospira interrogans serovar lai str. 56601
uuuauccauaaauc

SEQ ID NO: 2774112 - RNA, 22 nt, Leptospira interrogans serovar lai str. 56601
uuuauccauccauacaacuuuc

SEQ ID NO: 2774113 - RNA, 19 nt, Leptospira interrogans serovar lai str. 56601
uuuaucgauuuaaaaacua

SEQ ID NO: 2774114 - RNA, 16 nt, Leptospira interrogans serovar lai str. 56601
uuuaucgcaaaacauu

SEQ ID NO: 2774115 - RNA, 20 nt, Leptospira interrogans serovar lai str. 56601
uuuaucgcaaaacauuauuu

SEQ ID NO: 2774116 - RNA, 19 nt, Leptospira interrogans serovar lai str. 56601
uuuaucggcguucuacaaa

SEQ ID NO: 2774117 - RNA, 17 nt, Leptospira interrogans serovar lai str. 56601
uuuaucuauugaaacaa

SEQ ID NO: 2774118 - RNA, 16 nt, Leptospira interrogans serovar lai str. 56601
uuuaucuuagaguugu

SEQ ID NO: 2774119 - RNA, 16 nt, Leptospira interrogans serovar lai str. 56601
uuuaucuuuauaaaaa

SEQ ID NO: 2774120 - RNA, 19 nt, Leptospira interrogans serovar lai str. 56601
uuuaugaccuaauuuauuu

SEQ ID NO: 2774121 - RNA, 23 nt, Leptospira interrogans serovar lai str. 56601
uuuaugaccuaauuuauuuguaa

SEQ ID NO: 2774122 - RNA, 16 nt, Leptospira interrogans serovar lai str. 56601
uuuauguaagaaaaac

SEQ ID NO: 2774123 - RNA, 15 nt, Leptospira interrogans serovar lai str. 56601
uuuauuaaaaauauc

SEQ ID NO: 2774124 - RNA, 17 nt, Leptospira interrogans serovar lai str. 56601
uuuauuaaaaauaucua

SEQ ID NO: 2774125 - RNA, 13 nt, Leptospira interrogans serovar lai str. 56601
uuuauuaaauaaa

SEQ ID NO: 2774126 - RNA, 12 nt, Leptospira interrogans serovar lai str. 56601
uuuauuaagaac

SEQ ID NO: 2774127 - RNA, 19 nt, Leptospira interrogans serovar lai str. 56601
uuuauuaagaauuucuaaa

SEQ ID NO: 2774128 - RNA, 16 nt, Leptospira interrogans serovar lai str. 56601
uuuauuacaauuuuau

SEQ ID NO: 2774129 - RNA, 15 nt, Leptospira interrogans serovar lai str. 56601
uuuauuauaaauuua

SEQ ID NO: 2774130 - RNA, 21 nt, Leptospira interrogans serovar lai str. 56601
uuuauuauaaauuuauaaaug

SEQ ID NO: 2774131 - RNA, 23 nt, Leptospira interrogans serovar lai str. 56601
uuuauuauguagccaaaucugaa

SEQ ID NO: 2774132 - RNA, 20 nt, Leptospira interrogans serovar lai str. 56601
uuuauucacugaaaauuuaa

SEQ ID NO: 2774133 - RNA, 22 nt, Leptospira interrogans serovar lai str. 56601
uuuauucauagaccaauuuuuu

SEQ ID NO: 2774134 - RNA, 12 nt, Leptospira interrogans serovar lai str. 56601
uuuauucuaaac

SEQ ID NO: 2774135 - RNA, 15 nt, Leptospira interrogans serovar lai str. 56601
uuuauucuccauucu

SEQ ID NO: 2774136 - RNA, 18 nt, Leptospira interrogans serovar lai str. 56601
uuuauugaaaaauagaau

SEQ ID NO: 2774137 - RNA, 20 nt, Leptospira interrogans serovar lai str. 56601
uuuauugaagauauuuuccu

SEQ ID NO: 2774138 - RNA, 22 nt, Leptospira interrogans serovar lai str. 56601
uuuauugagucaagauuauuuu

SEQ ID NO: 2774139 - RNA, 20 nt, Leptospira interrogans serovar lai str. 56601
uuuauugggucuacaauaaa

SEQ ID NO: 2774140 - RNA, 17 nt, Leptospira interrogans serovar lai str. 56601
uuuauugugaguuuaaa

SEQ ID NO: 2774141 - RNA, 13 nt, Leptospira interrogans serovar lai str. 56601
uuuauuuaaaaac

SEQ ID NO: 2774142 - RNA, 16 nt, Leptospira interrogans serovar lai str. 56601
uuuauuucaaaauuua

SEQ ID NO: 2774143 - RNA, 18 nt, Leptospira interrogans serovar lai str. 56601
uuuauuucaaaauuuuuu

SEQ ID NO: 2774144 - RNA, 22 nt, Leptospira interrogans serovar lai str. 56601
uuuauuucggaucgaaaaugca

SEQ ID NO: 2774145 - RNA, 13 nt, Leptospira interrogans serovar lai str. 56601
uuuauuucugaga

SEQ ID NO: 2774146 - RNA, 17 nt, Leptospira interrogans serovar lai str. 56601
uuuauuucugagaguaa

SEQ ID NO: 2774147 - RNA, 12 nt, Leptospira interrogans serovar lai str. 56601
uuuauuuuaaaa

SEQ ID NO: 2774148 - RNA, 14 nt, Leptospira interrogans serovar lai str. 56601
uuuauuuuucuaaa

SEQ ID NO: 2774149 - RNA, 11 nt, Leptospira interrogans serovar lai str. 56601
uuucaaaaaac

SEQ ID NO: 2774150 - RNA, 20 nt, Leptospira interrogans serovar lai str. 56601
uuucaaaaaacuuucuuaaa

SEQ ID NO: 2774151 - RNA, 20 nt, Leptospira interrogans serovar lai str. 56601
uuucaaaaaauaaaauuuua

SEQ ID NO: 2774152 - RNA, 14 nt, Leptospira interrogans serovar lai str. 56601
uuucaaaaaauauc

SEQ ID NO: 2774153 - RNA, 17 nt, Leptospira interrogans serovar lai str. 56601
uuucaaaaaaucgacuu

SEQ ID NO: 2774154 - RNA, 13 nt, Leptospira interrogans serovar lai str. 56601
uuucaaaaaauuu

SEQ ID NO: 2774155 - RNA, 12 nt, Leptospira interrogans serovar lai str. 56601
uuucaaaaauau

SEQ ID NO: 2774156 - RNA, 13 nt, Leptospira interrogans serovar lai str. 56601
uuucaaaaauaua

SEQ ID NO: 2774157 - RNA, 12 nt, Leptospira interrogans serovar lai str. 56601
uuucaaaaauuu

SEQ ID NO: 2774158 - RNA, 17 nt, Leptospira interrogans serovar lai str. 56601
uuucaaaaguuagaaua

SEQ ID NO: 2774159 - RNA, 19 nt, Leptospira interrogans serovar lai str. 56601
uuucaaaauaagaauuuuc

SEQ ID NO: 2774160 - RNA, 21 nt, Leptospira interrogans serovar lai str. 56601
uuucaaaauaagaauuuucua

SEQ ID NO: 2774161 - RNA, 16 nt, Leptospira interrogans serovar lai str. 56601
uuucaaaaucuucaaa

SEQ ID NO: 2774162 - RNA, 17 nt, Leptospira interrogans serovar lai str. 56601
uuucaaacacaaucugu

SEQ ID NO: 2774163 - RNA, 21 nt, Leptospira interrogans serovar lai str. 56601
uuucaaagaauauaaaaucuu

SEQ ID NO: 2774164 - RNA, 17 nt, Leptospira interrogans serovar lai str. 56601
uuucaacaacucuaauu

SEQ ID NO: 2774165 - RNA, 16 nt, Leptospira interrogans serovar lai str. 56601
uuucaacaauucuauu

SEQ ID NO: 2774166 - RNA, 19 nt, Leptospira interrogans serovar lai str. 56601
uuucaacuuuuuucagaaa

SEQ ID NO: 2774167 - RNA, 20 nt, Leptospira interrogans serovar lai str. 56601
uuucaacuuuuuucagaaaa

SEQ ID NO: 2774168 - RNA, 21 nt, Leptospira interrogans serovar lai str. 56601
uuucaacuuuuuucagaaaaa

SEQ ID NO: 2774169 - RNA, 15 nt, Leptospira interrogans serovar lai str. 56601
uuucaagauugucuu

SEQ ID NO: 2774170 - RNA, 12 nt, Leptospira interrogans serovar lai str. 56601
uuucaaguuuuc

SEQ ID NO: 2774171 - RNA, 14 nt, Leptospira interrogans serovar lai str. 56601
uuucaaguuuucuu

SEQ ID NO: 2774172 - RNA, 14 nt, Leptospira interrogans serovar lai str. 56601
uuucaauauaaaaa

SEQ ID NO: 2774173 - RNA, 21 nt, Leptospira interrogans serovar lai str. 56601
uuucaaucgaagaaauacacg

SEQ ID NO: 2774174 - RNA, 20 nt, Leptospira interrogans serovar lai str. 56601
uuucaaucuauuaacuuuac

SEQ ID NO: 2774175 - RNA, 21 nt, Leptospira interrogans serovar lai str. 56601
uuucaaucuccccaaaaucuu

SEQ ID NO: 2774176 - RNA, 17 nt, Leptospira interrogans serovar lai str. 56601
uuucaaugcaaaaaauu

SEQ ID NO: 2774177 - RNA, 15 nt, Leptospira interrogans serovar lai str. 56601
uuucaauuuaaaaua

SEQ ID NO: 2774178 - RNA, 16 nt, Leptospira interrogans serovar lai str. 56601
uuucaauuuaaaauau

SEQ ID NO: 2774179 - RNA, 14 nt, Leptospira interrogans serovar lai str. 56601
uuucaauuuucuca

SEQ ID NO: 2774180 - RNA, 17 nt, Leptospira interrogans serovar lai str. 56601
uuucaauuuucucaaaa

SEQ ID NO: 2774181 - RNA, 13 nt, Leptospira interrogans serovar lai str. 56601
uuucaauuuuuga

SEQ ID NO: 2774182 - RNA, 14 nt, Leptospira interrogans serovar lai str. 56601
uuucaauuuuugaa

SEQ ID NO: 2774183 - RNA, 17 nt, Leptospira interrogans serovar lai str. 56601
uuucacaaaaaaauucu

SEQ ID NO: 2774184 - RNA, 12 nt, Leptospira interrogans serovar lai str. 56601
uuucacaaaaau

SEQ ID NO: 2774185 - RNA, 13 nt, Leptospira interrogans serovar lai str. 56601
uuucagauuuuau

SEQ ID NO: 2774186 - RNA, 14 nt, Leptospira interrogans serovar lai str. 56601
uuucagcuccaaaa

SEQ ID NO: 2774187 - RNA, 16 nt, Leptospira interrogans serovar lai str. 56601
uuucagcuccaaaaaa

SEQ ID NO: 2774188 - RNA, 22 nt, Leptospira interrogans serovar lai str. 56601
uuucagugaauaaaauaaaaaa

SEQ ID NO: 2774189 - RNA, 14 nt, Leptospira interrogans serovar lai str. 56601
uuucaguucugaga

SEQ ID NO: 2774190 - RNA, 16 nt, Leptospira interrogans serovar lai str. 56601
uuucaguucugagacc

SEQ ID NO: 2774191 - RNA, 17 nt, Leptospira interrogans serovar lai str. 56601
uuucauaaauacaaagu

SEQ ID NO: 2774192 - RNA, 22 nt, Leptospira interrogans serovar lai str. 56601
uuucauaggaaauucuuuucca

SEQ ID NO: 2774193 - RNA, 22 nt, Leptospira interrogans serovar lai str. 56601
uuucauaguucaauuaacaaaa

SEQ ID NO: 2774194 - RNA, 13 nt, Leptospira interrogans serovar lai str. 56601
uuucauauccaaa

SEQ ID NO: 2774195 - RNA, 14 nt, Leptospira interrogans serovar lai str. 56601
uuucauauccaaaa

SEQ ID NO: 2774196 - RNA, 22 nt, Leptospira interrogans serovar lai str. 56601
uuucauccaugucuucuaaauc

SEQ ID NO: 2774197 - RNA, 18 nt, Leptospira interrogans serovar lai str. 56601
uuucaucucuauaaauug

SEQ ID NO: 2774198 - RNA, 23 nt, Leptospira interrogans serovar lai str. 56601
uuucaucuguggagaaaauuccu

SEQ ID NO: 2774199 - RNA, 14 nt, Leptospira interrogans serovar lai str. 56601
uuucaucuuuucca

SEQ ID NO: 2774200 - RNA, 16 nt, Leptospira interrogans serovar lai str. 56601
uuucaucuuuuccauu

SEQ ID NO: 2774201 - RNA, 16 nt, Leptospira interrogans serovar lai str. 56601
uuucaugaacgaauuu

SEQ ID NO: 2774202 - RNA, 17 nt, Leptospira interrogans serovar lai str. 56601
uuucaugcaaaaauuua

SEQ ID NO: 2774203 - RNA, 23 nt, Leptospira interrogans serovar lai str. 56601
uuucauguccggguuagaaucaa

SEQ ID NO: 2774204 - RNA, 12 nt, Leptospira interrogans serovar lai str. 56601
uuucauuaaaac

SEQ ID NO: 2774205 - RNA, 13 nt, Leptospira interrogans serovar lai str. 56601
uuucauuacaaaa

SEQ ID NO: 2774206 - RNA, 23 nt, Leptospira interrogans serovar lai str. 56601
uuucauucaaaauaaauaauaca

SEQ ID NO: 2774207 - RNA, 13 nt, Leptospira interrogans serovar lai str. 56601
uuucauugaguuu

SEQ ID NO: 2774208 - RNA, 13 nt, Leptospira interrogans serovar lai str. 56601
uuucauuuuguuu

SEQ ID NO: 2774209 - RNA, 18 nt, Leptospira interrogans serovar lai str. 56601
uuucauuuuguuucuguu

SEQ ID NO: 2774210 - RNA, 20 nt, Leptospira interrogans serovar lai str. 56601
uuucauuuuuccauaaaaaa

SEQ ID NO: 2774211 - RNA, 18 nt, Leptospira interrogans serovar lai str. 56601
uuucauuuuuuucgaauu

SEQ ID NO: 2774212 - RNA, 13 nt, Leptospira interrogans serovar lai str. 56601
uuuccaaaaauuu

SEQ ID NO: 2774213 - RNA, 21 nt, Leptospira interrogans serovar lai str. 56601
uuuccaaccauuuaauagauc

SEQ ID NO: 2774214 - RNA, 22 nt, Leptospira interrogans serovar lai str. 56601
uuuccaacgaaguuccaacgua

SEQ ID NO: 2774215 - RNA, 12 nt, Leptospira interrogans serovar lai str. 56601
uuuccacucuuu

SEQ ID NO: 2774216 - RNA, 15 nt, Leptospira interrogans serovar lai str. 56601
uuuccacucuuugac

SEQ ID NO: 2774217 - RNA, 15 nt, Leptospira interrogans serovar lai str. 56601
uuuccacuucaaaaa

SEQ ID NO: 2774218 - RNA, 19 nt, Leptospira interrogans serovar lai str. 56601
uuuccacuuuucucaucaa

SEQ ID NO: 2774219 - RNA, 14 nt, Leptospira interrogans serovar lai str. 56601
uuuccagaaaccau

SEQ ID NO: 2774220 - RNA, 17 nt, Leptospira interrogans serovar lai str. 56601
uuuccagaaaccauaaa

SEQ ID NO: 2774221 - RNA, 20 nt, Leptospira interrogans serovar lai str. 56601
uuuccagaaaccauaaaaua

SEQ ID NO: 2774222 - RNA, 16 nt, Leptospira interrogans serovar lai str. 56601
uuuccagaaagaaguu

SEQ ID NO: 2774223 - RNA, 13 nt, Leptospira interrogans serovar lai str. 56601
uuuccauaaaaaa

SEQ ID NO: 2774224 - RNA, 16 nt, Leptospira interrogans serovar lai str. 56601
uuuccauaaaaaacau

SEQ ID NO: 2774225 - RNA, 18 nt, Leptospira interrogans serovar lai str. 56601
uuuccauaaaaaacauaa

SEQ ID NO: 2774226 - RNA, 15 nt, Leptospira interrogans serovar lai str. 56601
uuuccauaaaauaga

SEQ ID NO: 2774227 - RNA, 18 nt, Leptospira interrogans serovar lai str. 56601
uuuccaucuuuauaucuu

SEQ ID NO: 2774228 - RNA, 14 nt, Leptospira interrogans serovar lai str. 56601
uuuccaugaaauag

SEQ ID NO: 2774229 - RNA, 16 nt, Leptospira interrogans serovar lai str. 56601
uuucccauaaaaagag

SEQ ID NO: 2774230 - RNA, 15 nt, Leptospira interrogans serovar lai str. 56601
uuuccccaagacuuu

SEQ ID NO: 2774231 - RNA, 15 nt, Leptospira interrogans serovar lai str. 56601
uuucccgauucucaa

SEQ ID NO: 2774232 - RNA, 16 nt, Leptospira interrogans serovar lai str. 56601
uuuccgaaccuuacca

SEQ ID NO: 2774233 - RNA, 18 nt, Leptospira interrogans serovar lai str. 56601
uuuccgaaccuuaccacc

SEQ ID NO: 2774234 - RNA, 22 nt, Leptospira interrogans serovar lai str. 56601
uuuccgaauaggaucagaauuu

SEQ ID NO: 2774235 - RNA, 23 nt, Leptospira interrogans serovar lai str. 56601
uuuccgaauaggaucagaauuuc

SEQ ID NO: 2774236 - RNA, 17 nt, Leptospira interrogans serovar lai str. 56601
uuuccgauuucuuucaa

SEQ ID NO: 2774237 - RNA, 16 nt, Leptospira interrogans serovar lai str. 56601
uuuccggaauacuuuu

SEQ ID NO: 2774238 - RNA, 13 nt, Leptospira interrogans serovar lai str. 56601
uuuccggacuuuc

SEQ ID NO: 2774239 - RNA, 16 nt, Leptospira interrogans serovar lai str. 56601
uuuccguaaaaaguua

SEQ ID NO: 2774240 - RNA, 21 nt, Leptospira interrogans serovar lai str. 56601
uuuccguaccccaaagauuuc

SEQ ID NO: 2774241 - RNA, 17 nt, Leptospira interrogans serovar lai str. 56601
uuuccguagaucuuuua

SEQ ID NO: 2774242 - RNA, 21 nt, Leptospira interrogans serovar lai str. 56601
uuuccuaaaauugugggaacu

SEQ ID NO: 2774243 - RNA, 19 nt, Leptospira interrogans serovar lai str. 56601
uuuccuaauauaucagauu

SEQ ID NO: 2774244 - RNA, 14 nt, Leptospira interrogans serovar lai str. 56601
uuuccucgaauuca

SEQ ID NO: 2774245 - RNA, 21 nt, Leptospira interrogans serovar lai str. 56601
uuuccuuaagacccuaaaaaa

SEQ ID NO: 2774246 - RNA, 23 nt, Leptospira interrogans serovar lai str. 56601
uuuccuuauuaaaaccaucuuug

SEQ ID NO: 2774247 - RNA, 15 nt, Leptospira interrogans serovar lai str. 56601
uuuccuucuuuacag

SEQ ID NO: 2774248 - RNA, 17 nt, Leptospira interrogans serovar lai str. 56601
uuuccuucuuucugaaa

SEQ ID NO: 2774249 - RNA, 18 nt, Leptospira interrogans serovar lai str. 56601
uuuccuucuuucugaaau

SEQ ID NO: 2774250 - RNA, 16 nt, Leptospira interrogans serovar lai str. 56601
uuuccuugagauuaca

SEQ ID NO: 2774251 - RNA, 22 nt, Leptospira interrogans serovar lai str. 56601
uuuccuuuaaacuuagauucga

SEQ ID NO: 2774252 - RNA, 20 nt, Leptospira interrogans serovar lai str. 56601
uuuccuuuuguuuuucuuua

SEQ ID NO: 2774253 - RNA, 23 nt, Leptospira interrogans serovar lai str. 56601
uuucgaaaagaaauauuaaaaaa

SEQ ID NO: 2774254 - RNA, 14 nt, Leptospira interrogans serovar lai str. 56601
uuucgaacuauuuu

SEQ ID NO: 2774255 - RNA, 16 nt, Leptospira interrogans serovar lai str. 56601
uuucgaauucuuucua

SEQ ID NO: 2774256 - RNA, 17 nt, Leptospira interrogans serovar lai str. 56601
uuucgaccuuaacucuu

SEQ ID NO: 2774257 - RNA, 14 nt, Leptospira interrogans serovar lai str. 56601
uuucgauugcucuc

SEQ ID NO: 2774258 - RNA, 13 nt, Leptospira interrogans serovar lai str. 56601
uuucgcaaauucu

SEQ ID NO: 2774259 - RNA, 21 nt, Leptospira interrogans serovar lai str. 56601
uuucgcauaccgaacucacgu

SEQ ID NO: 2774260 - RNA, 23 nt, Leptospira interrogans serovar lai str. 56601
uuucgcauuuguuguaucgaacu

SEQ ID NO: 2774261 - RNA, 15 nt, Leptospira interrogans serovar lai str. 56601
uuucgcgguuuucuu

SEQ ID NO: 2774262 - RNA, 22 nt, Leptospira interrogans serovar lai str. 56601
uuucggcccggauauuuucuca

SEQ ID NO: 2774263 - RNA, 23 nt, Leptospira interrogans serovar lai str. 56601
uuucgguuguuuugcucuaaaau

SEQ ID NO: 2774264 - RNA, 21 nt, Leptospira interrogans serovar lai str. 56601
uuucguucggaaaaaauauga

SEQ ID NO: 2774265 - RNA, 19 nt, Leptospira interrogans serovar lai str. 56601
uuucguucggaaaaaguau

SEQ ID NO: 2774266 - RNA, 22 nt, Leptospira interrogans serovar lai str. 56601
uuucguuucaacuuuagaaaaa

SEQ ID NO: 2774267 - RNA, 16 nt, Leptospira interrogans serovar lai str. 56601
uuucuaaaaaaaaugg

SEQ ID NO: 2774268 - RNA, 17 nt, Leptospira interrogans serovar lai str. 56601
uuucuaaaaaaaaugua

SEQ ID NO: 2774269 - RNA, 17 nt, Leptospira interrogans serovar lai str. 56601
uuucuaaaaaaauuaau

SEQ ID NO: 2774270 - RNA, 13 nt, Leptospira interrogans serovar lai str. 56601
uuucuaaaaauaa

SEQ ID NO: 2774271 - RNA, 14 nt, Leptospira interrogans serovar lai str. 56601
uuucuaaaaauuuc

SEQ ID NO: 2774272 - RNA, 22 nt, Leptospira interrogans serovar lai str. 56601
uuucuaaaagaagaugcuuucu

SEQ ID NO: 2774273 - RNA, 19 nt, Leptospira interrogans serovar lai str. 56601
uuucuaaaaguaaaaguac

SEQ ID NO: 2774274 - RNA, 13 nt, Leptospira interrogans serovar lai str. 56601
uuucuaaaauauc

SEQ ID NO: 2774275 - RNA, 13 nt, Leptospira interrogans serovar lai str. 56601
uuucuaaaaugua

SEQ ID NO: 2774276 - RNA, 21 nt, Leptospira interrogans serovar lai str. 56601
uuucuaaaugaguuuuagaau

SEQ ID NO: 2774277 - RNA, 18 nt, Leptospira interrogans serovar lai str. 56601
uuucuaaauuaauauuua

SEQ ID NO: 2774278 - RNA, 13 nt, Leptospira interrogans serovar lai str. 56601
uuucuaaauuuua

SEQ ID NO: 2774279 - RNA, 17 nt, Leptospira interrogans serovar lai str. 56601
uuucuaaguccuuuucu

SEQ ID NO: 2774280 - RNA, 20 nt, Leptospira interrogans serovar lai str. 56601
uuucuaauagagaaaaauuu

SEQ ID NO: 2774281 - RNA, 22 nt, Leptospira interrogans serovar lai str. 56601
uuucuaauuuucuuguuuaaau

SEQ ID NO: 2774282 - RNA, 23 nt, Leptospira interrogans serovar lai str. 56601
uuucuacaauggaggauccuuuc

SEQ ID NO: 2774283 - RNA, 14 nt, Leptospira interrogans serovar lai str. 56601
uuucuacaauuaua

SEQ ID NO: 2774284 - RNA, 22 nt, Leptospira interrogans serovar lai str. 56601
uuucuagugucuaaacuaaaaa

SEQ ID NO: 2774285 - RNA, 19 nt, Leptospira interrogans serovar lai str. 56601
uuucuaguuuuccuucuag

SEQ ID NO: 2774286 - RNA, 16 nt, Leptospira interrogans serovar lai str. 56601
uuucuauaaaacaaaa

SEQ ID NO: 2774287 - RNA, 14 nt, Leptospira interrogans serovar lai str. 56601
uuucuauaaaauug

SEQ ID NO: 2774288 - RNA, 16 nt, Leptospira interrogans serovar lai str. 56601
uuucuauaaucugaaa

SEQ ID NO: 2774289 - RNA, 22 nt, Leptospira interrogans serovar lai str. 56601
uuucuauaaucugaaauagaau

SEQ ID NO: 2774290 - RNA, 18 nt, Leptospira interrogans serovar lai str. 56601
uuucuauagggaucagug

SEQ ID NO: 2774291 - RNA, 14 nt, Leptospira interrogans serovar lai str. 56601
uuucuauauucaaa

SEQ ID NO: 2774292 - RNA, 21 nt, Leptospira interrogans serovar lai str. 56601
uuucuauauucaaaaaaugga

SEQ ID NO: 2774293 - RNA, 14 nt, Leptospira interrogans serovar lai str. 56601
uuucuaucaaaaaa

SEQ ID NO: 2774294 - RNA, 20 nt, Leptospira interrogans serovar lai str. 56601
uuucuauggaucgccguucu

SEQ ID NO: 2774295 - RNA, 14 nt, Leptospira interrogans serovar lai str. 56601
uuucuauuuuaaaa

SEQ ID NO: 2774296 - RNA, 13 nt, Leptospira interrogans serovar lai str. 56601
uuucuauuuuaau

SEQ ID NO: 2774297 - RNA, 18 nt, Leptospira interrogans serovar lai str. 56601
uuucucaguaaaauggga

SEQ ID NO: 2774298 - RNA, 15 nt, Leptospira interrogans serovar lai str. 56601
uuucucaucaaaaaa

SEQ ID NO: 2774299 - RNA, 19 nt, Leptospira interrogans serovar lai str. 56601
uuucucaucaaaaaaauga

SEQ ID NO: 2774300 - RNA, 13 nt, Leptospira interrogans serovar lai str. 56601
uuucucauucuac

SEQ ID NO: 2774301 - RNA, 19 nt, Leptospira interrogans serovar lai str. 56601
uuucuccggcgaccuuucu

SEQ ID NO: 2774302 - RNA, 17 nt, Leptospira interrogans serovar lai str. 56601
uuucucgaaaucgauuu

SEQ ID NO: 2774303 - RNA, 14 nt, Leptospira interrogans serovar lai str. 56601
uuucucguuuucuu

SEQ ID NO: 2774304 - RNA, 13 nt, Leptospira interrogans serovar lai str. 56601
uuucucuaauucu

SEQ ID NO: 2774305 - RNA, 14 nt, Leptospira interrogans serovar lai str. 56601
uuucugaaaaaagu

SEQ ID NO: 2774306 - RNA, 20 nt, Leptospira interrogans serovar lai str. 56601
uuucugaaaaaaguuggaau

SEQ ID NO: 2774307 - RNA, 14 nt, Leptospira interrogans serovar lai str. 56601
uuucugaaaaaguu

SEQ ID NO: 2774308 - RNA, 14 nt, Leptospira interrogans serovar lai str. 56601
uuucugaaaaguuu

SEQ ID NO: 2774309 - RNA, 13 nt, Leptospira interrogans serovar lai str. 56601
uuucugaaacaau

SEQ ID NO: 2774310 - RNA, 22 nt, Leptospira interrogans serovar lai str. 56601
uuucugaaacaaucuaaccaag

SEQ ID NO: 2774311 - RNA, 16 nt, Leptospira interrogans serovar lai str. 56601
uuucugacauucuaaa

SEQ ID NO: 2774312 - RNA, 17 nt, Leptospira interrogans serovar lai str. 56601
uuucugagaauuucucu

SEQ ID NO: 2774313 - RNA, 13 nt, Leptospira interrogans serovar lai str. 56601
uuucugauuuuua

SEQ ID NO: 2774314 - RNA, 18 nt, Leptospira interrogans serovar lai str. 56601
uuucugauuuuuauaauu

SEQ ID NO: 2774315 - RNA, 15 nt, Leptospira interrogans serovar lai str. 56601
uuucugccauuuuua

SEQ ID NO: 2774316 - RNA, 22 nt, Leptospira interrogans serovar lai str. 56601
uuucugcuacaacccaacuuuc

SEQ ID NO: 2774317 - RNA, 21 nt, Leptospira interrogans serovar lai str. 56601
uuucuguaaaaauaaaaugua

SEQ ID NO: 2774318 - RNA, 12 nt, Leptospira interrogans serovar lai str. 56601
uuucuguauuuu

SEQ ID NO: 2774319 - RNA, 13 nt, Leptospira interrogans serovar lai str. 56601
uuucuguauuuuu

SEQ ID NO: 2774320 - RNA, 22 nt, Leptospira interrogans serovar lai str. 56601
uuucuguucauucuuuaaaaua

SEQ ID NO: 2774321 - RNA, 12 nt, Leptospira interrogans serovar lai str. 56601
uuucuguuuauu

SEQ ID NO: 2774322 - RNA, 16 nt, Leptospira interrogans serovar lai str. 56601
uuucuguuucaugaaa

SEQ ID NO: 2774323 - RNA, 12 nt, Leptospira interrogans serovar lai str. 56601
uuucuuaaaaaa

SEQ ID NO: 2774324 - RNA, 13 nt, Leptospira interrogans serovar lai str. 56601
uuucuuaaaaaaa

SEQ ID NO: 2774325 - RNA, 12 nt, Leptospira interrogans serovar lai str. 56601
uuucuuaaaaga

SEQ ID NO: 2774326 - RNA, 13 nt, Leptospira interrogans serovar lai str. 56601
uuucuuaaauuaa

SEQ ID NO: 2774327 - RNA, 16 nt, Leptospira interrogans serovar lai str. 56601
uuucuuaaauucuaaa

SEQ ID NO: 2774328 - RNA, 18 nt, Leptospira interrogans serovar lai str. 56601
uuucuuacaccgaauuca

SEQ ID NO: 2774329 - RNA, 20 nt, Leptospira interrogans serovar lai str. 56601
uuucuuacucgacaaaacac

SEQ ID NO: 2774330 - RNA, 16 nt, Leptospira interrogans serovar lai str. 56601
uuucuuauuaauucuu

SEQ ID NO: 2774331 - RNA, 21 nt, Leptospira interrogans serovar lai str. 56601
uuucuuauuaauucuuauucu

SEQ ID NO: 2774332 - RNA, 14 nt, Leptospira interrogans serovar lai str. 56601
uuucuucauaaaau

SEQ ID NO: 2774333 - RNA, 15 nt, Leptospira interrogans serovar lai str. 56601
uuucuucauaaaauc

SEQ ID NO: 2774334 - RNA, 19 nt, Leptospira interrogans serovar lai str. 56601
uuucuucccagauucccuu

SEQ ID NO: 2774335 - RNA, 19 nt, Leptospira interrogans serovar lai str. 56601
uuucuuccggauuaaaaag

SEQ ID NO: 2774336 - RNA, 16 nt, Leptospira interrogans serovar lai str. 56601
uuucuucgauuucuuu

SEQ ID NO: 2774337 - RNA, 20 nt, Leptospira interrogans serovar lai str. 56601
uuucuucggauucacaaacg

SEQ ID NO: 2774338 - RNA, 13 nt, Leptospira interrogans serovar lai str. 56601
uuucuucugcugc

SEQ ID NO: 2774339 - RNA, 19 nt, Leptospira interrogans serovar lai str. 56601
uuucuugaacucaauguug

SEQ ID NO: 2774340 - RNA, 22 nt, Leptospira interrogans serovar lai str. 56601
uuucuugagggguuuuuccuuu

SEQ ID NO: 2774341 - RNA, 16 nt, Leptospira interrogans serovar lai str. 56601
uuucuugguucaaaug

SEQ ID NO: 2774342 - RNA, 12 nt, Leptospira interrogans serovar lai str. 56601
uuucuuguguca

SEQ ID NO: 2774343 - RNA, 13 nt, Leptospira interrogans serovar lai str. 56601
uuucuuuaaaauc

SEQ ID NO: 2774344 - RNA, 13 nt, Leptospira interrogans serovar lai str. 56601
uuucuuucaaaaa

SEQ ID NO: 2774345 - RNA, 13 nt, Leptospira interrogans serovar lai str. 56601
uuucuuucuaaau

SEQ ID NO: 2774346 - RNA, 13 nt, Leptospira interrogans serovar lai str. 56601
uuucuuugaaaaa

SEQ ID NO: 2774347 - RNA, 18 nt, Leptospira interrogans serovar lai str. 56601
uuucuuugaacuuuuuca

SEQ ID NO: 2774348 - RNA, 20 nt, Leptospira interrogans serovar lai str. 56601
uuucuuugaaggaucuuaga

SEQ ID NO: 2774349 - RNA, 22 nt, Leptospira interrogans serovar lai str. 56601
uuucuuugauugaauuaaaaaa

SEQ ID NO: 2774350 - RNA, 15 nt, Leptospira interrogans serovar lai str. 56601
uuucuuugucuuuau

SEQ ID NO: 2774351 - RNA, 12 nt, Leptospira interrogans serovar lai str. 56601
uuucuuuuuaaa

SEQ ID NO: 2774352 - RNA, 13 nt, Leptospira interrogans serovar lai str. 56601
uuucuuuuuaaau

SEQ ID NO: 2774353 - RNA, 20 nt, Leptospira interrogans serovar lai str. 56601
uuucuuuuucuagguuuaaa

SEQ ID NO: 2774354 - RNA, 14 nt, Leptospira interrogans serovar lai str. 56601
uuucuuuuuuaaac

SEQ ID NO: 2774355 - RNA, 22 nt, Leptospira interrogans serovar lai str. 56601
uuugaaaaagggauucuauucu

SEQ ID NO: 2774356 - RNA, 21 nt, Leptospira interrogans serovar lai str. 56601
uuugaaaauccauaugaguuc

SEQ ID NO: 2774357 - RNA, 17 nt, Leptospira interrogans serovar lai str. 56601
uuugaaacucaguaaaa

SEQ ID NO: 2774358 - RNA, 18 nt, Leptospira interrogans serovar lai str. 56601
uuugaaaguaaaaaagag

SEQ ID NO: 2774359 - RNA, 21 nt, Leptospira interrogans serovar lai str. 56601
uuugaaaguaaaaaagagcuu

SEQ ID NO: 2774360 - RNA, 17 nt, Leptospira interrogans serovar lai str. 56601
uuugaaaguucccaaau

SEQ ID NO: 2774361 - RNA, 22 nt, Leptospira interrogans serovar lai str. 56601
uuugaaauagauucuaauuuuu

SEQ ID NO: 2774362 - RNA, 18 nt, Leptospira interrogans serovar lai str. 56601
uuugaacaaguucuaaau

SEQ ID NO: 2774363 - RNA, 15 nt, Leptospira interrogans serovar lai str. 56601
uuugaacuacagaau

SEQ ID NO: 2774364 - RNA, 21 nt, Leptospira interrogans serovar lai str. 56601
uuugaacuuguuccaaaacua

SEQ ID NO: 2774365 - RNA, 23 nt, Leptospira interrogans serovar lai str. 56601
uuugaagaauaaaagugguugaa

SEQ ID NO: 2774366 - RNA, 22 nt, Leptospira interrogans serovar lai str. 56601
uuugaauacgacagguuuaauu

SEQ ID NO: 2774367 - RNA, 11 nt, Leptospira interrogans serovar lai str. 56601
uuugaauagag

SEQ ID NO: 2774368 - RNA, 20 nt, Leptospira interrogans serovar lai str. 56601
uuugaauauagcacaaauga

SEQ ID NO: 2774369 - RNA, 18 nt, Leptospira interrogans serovar lai str. 56601
uuugaaugaaaagauuuc

SEQ ID NO: 2774370 - RNA, 13 nt, Leptospira interrogans serovar lai str. 56601
uuugaauugaaau

SEQ ID NO: 2774371 - RNA, 23 nt, Leptospira interrogans serovar lai str. 56601
uuugaauuuaggaaauuuucaau

SEQ ID NO: 2774372 - RNA, 19 nt, Leptospira interrogans serovar lai str. 56601
uuugaauuuuacuaaaaau

SEQ ID NO: 2774373 - RNA, 20 nt, Leptospira interrogans serovar lai str. 56601
uuugacacucuaauguacaa

SEQ ID NO: 2774374 - RNA, 20 nt, Leptospira interrogans serovar lai str. 56601
uuugaccugccuuucuuauu

SEQ ID NO: 2774375 - RNA, 22 nt, Leptospira interrogans serovar lai str. 56601
uuugacucuaagcuuuagaaaa

SEQ ID NO: 2774376 - RNA, 22 nt, Leptospira interrogans serovar lai str. 56601
uuugagaaaagagauuucugag

SEQ ID NO: 2774377 - RNA, 23 nt, Leptospira interrogans serovar lai str. 56601
uuugagaaaagagauuucugaga

SEQ ID NO: 2774378 - RNA, 14 nt, Leptospira interrogans serovar lai str. 56601
uuugagaaaaucca

SEQ ID NO: 2774379 - RNA, 15 nt, Leptospira interrogans serovar lai str. 56601
uuugagaaaccuuuu

SEQ ID NO: 2774380 - RNA, 21 nt, Leptospira interrogans serovar lai str. 56601
uuugagaaaccuuuucuagac

SEQ ID NO: 2774381 - RNA, 21 nt, Leptospira interrogans serovar lai str. 56601
uuugagaagcggguuuuucuu

SEQ ID NO: 2774382 - RNA, 14 nt, Leptospira interrogans serovar lai str. 56601
uuugagacaagaag

SEQ ID NO: 2774383 - RNA, 22 nt, Leptospira interrogans serovar lai str. 56601
uuugagacaagaagaaaagaau

SEQ ID NO: 2774384 - RNA, 20 nt, Leptospira interrogans serovar lai str. 56601
uuugagacaggcucaauauu

SEQ ID NO: 2774385 - RNA, 22 nt, Leptospira interrogans serovar lai str. 56601
uuugagacagguucugauauaa

SEQ ID NO: 2774386 - RNA, 21 nt, Leptospira interrogans serovar lai str. 56601
uuugagagagaguucuacuga

SEQ ID NO: 2774387 - RNA, 20 nt, Leptospira interrogans serovar lai str. 56601
uuugagagagcguucugcua

SEQ ID NO: 2774388 - RNA, 22 nt, Leptospira interrogans serovar lai str. 56601
uuugagaugugggaacuaccac

SEQ ID NO: 2774389 - RNA, 17 nt, Leptospira interrogans serovar lai str. 56601
uuugagauuaaaaagaa

SEQ ID NO: 2774390 - RNA, 15 nt, Leptospira interrogans serovar lai str. 56601
uuugagauuacaaaa

SEQ ID NO: 2774391 - RNA, 17 nt, Leptospira interrogans serovar lai str. 56601
uuugagcaguaaaaaag

SEQ ID NO: 2774392 - RNA, 18 nt, Leptospira interrogans serovar lai str. 56601
uuugagcgcagcucuugu

SEQ ID NO: 2774393 - RNA, 15 nt, Leptospira interrogans serovar lai str. 56601
uuugagcgguagaaa

SEQ ID NO: 2774394 - RNA, 17 nt, Leptospira interrogans serovar lai str. 56601
uuugaggucccacaauc

SEQ ID NO: 2774395 - RNA, 18 nt, Leptospira interrogans serovar lai str. 56601
uuugaggucccacaauca

SEQ ID NO: 2774396 - RNA, 14 nt, Leptospira interrogans serovar lai str. 56601
uuugagguuuuaaa

SEQ ID NO: 2774397 - RNA, 15 nt, Leptospira interrogans serovar lai str. 56601
uuugagguuuuaaaa

SEQ ID NO: 2774398 - RNA, 16 nt, Leptospira interrogans serovar lai str. 56601
uuugaguagaagccaa

SEQ ID NO: 2774399 - RNA, 21 nt, Leptospira interrogans serovar lai str. 56601
uuugaguagccaauugaauau

SEQ ID NO: 2774400 - RNA, 22 nt, Leptospira interrogans serovar lai str. 56601
uuugaguccacagguuuuaaac

SEQ ID NO: 2774401 - RNA, 14 nt, Leptospira interrogans serovar lai str. 56601
uuugauaaaauaua

SEQ ID NO: 2774402 - RNA, 13 nt, Leptospira interrogans serovar lai str. 56601
uuugauaaagaau

SEQ ID NO: 2774403 - RNA, 21 nt, Leptospira interrogans serovar lai str. 56601
uuugauaccgggauuuuaaaa

SEQ ID NO: 2774404 - RNA, 21 nt, Leptospira interrogans serovar lai str. 56601
uuugauauauuagaauauaca

SEQ ID NO: 2774405 - RNA, 18 nt, Leptospira interrogans serovar lai str. 56601
uuugauauauuuuuaaag

SEQ ID NO: 2774406 - RNA, 15 nt, Leptospira interrogans serovar lai str. 56601
uuugauaugaaucag

SEQ ID NO: 2774407 - RNA, 13 nt, Leptospira interrogans serovar lai str. 56601
uuugaucgguuua

SEQ ID NO: 2774408 - RNA, 16 nt, Leptospira interrogans serovar lai str. 56601
uuugaucucaauauaa

SEQ ID NO: 2774409 - RNA, 22 nt, Leptospira interrogans serovar lai str. 56601
uuugaucuuuuuuucuagauau

SEQ ID NO: 2774410 - RNA, 13 nt, Leptospira interrogans serovar lai str. 56601
uuugauuaaaaau

SEQ ID NO: 2774411 - RNA, 19 nt, Leptospira interrogans serovar lai str. 56601
uuugauuagaaaaaaagua

SEQ ID NO: 2774412 - RNA, 14 nt, Leptospira interrogans serovar lai str. 56601
uuugauucauucag

SEQ ID NO: 2774413 - RNA, 17 nt, Leptospira interrogans serovar lai str. 56601
uuugauuccaagauuuu

SEQ ID NO: 2774414 - RNA, 20 nt, Leptospira interrogans serovar lai str. 56601
uuugauuccuuuuucuaauc

SEQ ID NO: 2774415 - RNA, 14 nt, Leptospira interrogans serovar lai str. 56601
uuugauuggauucu

SEQ ID NO: 2774416 - RNA, 22 nt, Leptospira interrogans serovar lai str. 56601
uuugauuggauucuuucgacuu

SEQ ID NO: 2774417 - RNA, 14 nt, Leptospira interrogans serovar lai str. 56601
uuugauuuuagaaa

SEQ ID NO: 2774418 - RNA, 20 nt, Leptospira interrogans serovar lai str. 56601
uuugauuuuucgaaaauuaa

SEQ ID NO: 2774419 - RNA, 12 nt, Leptospira interrogans serovar lai str. 56601
uuugcaaaaaaa

SEQ ID NO: 2774420 - RNA, 15 nt, Leptospira interrogans serovar lai str. 56601
uuugcaaaaaaauaa

SEQ ID NO: 2774421 - RNA, 20 nt, Leptospira interrogans serovar lai str. 56601
uuugcaaguaaaaagacuca

SEQ ID NO: 2774422 - RNA, 18 nt, Leptospira interrogans serovar lai str. 56601
uuugcaauuaaaacgaua

SEQ ID NO: 2774423 - RNA, 18 nt, Leptospira interrogans serovar lai str. 56601
uuugcagaaguauuccau

SEQ ID NO: 2774424 - RNA, 20 nt, Leptospira interrogans serovar lai str. 56601
uuugcaguaaggauucuuuu

SEQ ID NO: 2774425 - RNA, 14 nt, Leptospira interrogans serovar lai str. 56601
uuugccauuuuuuu

SEQ ID NO: 2774426 - RNA, 22 nt, Leptospira interrogans serovar lai str. 56601
uuugccauuuuuuucuccuuuu

SEQ ID NO: 2774427 - RNA, 17 nt, Leptospira interrogans serovar lai str. 56601
uuugccuuguucauaaa

SEQ ID NO: 2774428 - RNA, 23 nt, Leptospira interrogans serovar lai str. 56601
uuugcgaccaucaucaaaacuua

SEQ ID NO: 2774429 - RNA, 18 nt, Leptospira interrogans serovar lai str. 56601
uuugcggaaucaauuuua

SEQ ID NO: 2774430 - RNA, 15 nt, Leptospira interrogans serovar lai str. 56601
uuugcggaucguuuu

SEQ ID NO: 2774431 - RNA, 20 nt, Leptospira interrogans serovar lai str. 56601
uuugcggaucguuuuuauuc

SEQ ID NO: 2774432 - RNA, 23 nt, Leptospira interrogans serovar lai str. 56601
uuugcucagagaauaucugaauu

SEQ ID NO: 2774433 - RNA, 11 nt, Leptospira interrogans serovar lai str. 56601
uuugcuuccau

SEQ ID NO: 2774434 - RNA, 18 nt, Leptospira interrogans serovar lai str. 56601
uuugcuuccauugucuau

SEQ ID NO: 2774435 - RNA, 20 nt, Leptospira interrogans serovar lai str. 56601
uuugcuucugaacaagaauu

SEQ ID NO: 2774436 - RNA, 13 nt, Leptospira interrogans serovar lai str. 56601
uuugcuucuuuua

SEQ ID NO: 2774437 - RNA, 18 nt, Leptospira interrogans serovar lai str. 56601
uuugcuuugucauuucag

SEQ ID NO: 2774438 - RNA, 13 nt, Leptospira interrogans serovar lai str. 56601
uuugcuuuuaaag

SEQ ID NO: 2774439 - RNA, 23 nt, Leptospira interrogans serovar lai str. 56601
uuuggaaagaauacgauuuaauc

SEQ ID NO: 2774440 - RNA, 14 nt, Leptospira interrogans serovar lai str. 56601
uuuggaaauuuuua

SEQ ID NO: 2774441 - RNA, 16 nt, Leptospira interrogans serovar lai str. 56601
uuuggaacaaguugaa

SEQ ID NO: 2774442 - RNA, 21 nt, Leptospira interrogans serovar lai str. 56601
uuuggaauaaaaucauauuuu

SEQ ID NO: 2774443 - RNA, 19 nt, Leptospira interrogans serovar lai str. 56601
uuuggacgaauccugcuaa

SEQ ID NO: 2774444 - RNA, 19 nt, Leptospira interrogans serovar lai str. 56601
uuuggaucgguuuuagaau

SEQ ID NO: 2774445 - RNA, 20 nt, Leptospira interrogans serovar lai str. 56601
uuuggaucuacuaagauuuc

SEQ ID NO: 2774446 - RNA, 12 nt, Leptospira interrogans serovar lai str. 56601
uuugggaauuuu

SEQ ID NO: 2774447 - RNA, 23 nt, Leptospira interrogans serovar lai str. 56601
uuugggcgaauaaaaaacucaau

SEQ ID NO: 2774448 - RNA, 15 nt, Leptospira interrogans serovar lai str. 56601
uuugggcuucugaac

SEQ ID NO: 2774449 - RNA, 23 nt, Leptospira interrogans serovar lai str. 56601
uuuggggcaugcuguaguuuauu

SEQ ID NO: 2774450 - RNA, 14 nt, Leptospira interrogans serovar lai str. 56601
uuugguaauuugug

SEQ ID NO: 2774451 - RNA, 16 nt, Leptospira interrogans serovar lai str. 56601
uuuggucgaucguuuu

SEQ ID NO: 2774452 - RNA, 21 nt, Leptospira interrogans serovar lai str. 56601
uuuggucugucguuugcaucc

SEQ ID NO: 2774453 - RNA, 18 nt, Leptospira interrogans serovar lai str. 56601
uuugguuaucauaaaaau

SEQ ID NO: 2774454 - RNA, 20 nt, Leptospira interrogans serovar lai str. 56601
uuugguuaucauaaaaauaa

SEQ ID NO: 2774455 - RNA, 14 nt, Leptospira interrogans serovar lai str. 56601
uuugguuuguaaua

SEQ ID NO: 2774456 - RNA, 14 nt, Leptospira interrogans serovar lai str. 56601
uuuguaaaaaaaua

SEQ ID NO: 2774457 - RNA, 17 nt, Leptospira interrogans serovar lai str. 56601
uuuguaaaaaaauagau

SEQ ID NO: 2774458 - RNA, 23 nt, Leptospira interrogans serovar lai str. 56601
uuuguaaaauagugguuuguagu

SEQ ID NO: 2774459 - RNA, 15 nt, Leptospira interrogans serovar lai str. 56601
uuuguaaaauccaga

SEQ ID NO: 2774460 - RNA, 12 nt, Leptospira interrogans serovar lai str. 56601
uuuguaaaucua

SEQ ID NO: 2774461 - RNA, 20 nt, Leptospira interrogans serovar lai str. 56601
uuuguaaaucuauucuuaaa

SEQ ID NO: 2774462 - RNA, 17 nt, Leptospira interrogans serovar lai str. 56601
uuuguaaauugugggaa

SEQ ID NO: 2774463 - RNA, 13 nt, Leptospira interrogans serovar lai str. 56601
uuuguaacuuuua

SEQ ID NO: 2774464 - RNA, 16 nt, Leptospira interrogans serovar lai str. 56601
uuuguaacuuuuacug

SEQ ID NO: 2774465 - RNA, 16 nt, Leptospira interrogans serovar lai str. 56601
uuuguaaguuuuccau

SEQ ID NO: 2774466 - RNA, 15 nt, Leptospira interrogans serovar lai str. 56601
uuuguaaguuuugaa

SEQ ID NO: 2774467 - RNA, 21 nt, Leptospira interrogans serovar lai str. 56601
uuuguaauaaaaauuuaaaau

SEQ ID NO: 2774468 - RNA, 16 nt, Leptospira interrogans serovar lai str. 56601
uuuguaauaguuccca

SEQ ID NO: 2774469 - RNA, 21 nt, Leptospira interrogans serovar lai str. 56601
uuuguaauaguucccacaguu

SEQ ID NO: 2774470 - RNA, 20 nt, Leptospira interrogans serovar lai str. 56601
uuuguacaucuuaaaaaaua

SEQ ID NO: 2774471 - RNA, 17 nt, Leptospira interrogans serovar lai str. 56601
uuuguaguaacuccuac

SEQ ID NO: 2774472 - RNA, 22 nt, Leptospira interrogans serovar lai str. 56601
uuugucccaaaaccucaaaaaa

SEQ ID NO: 2774473 - RNA, 15 nt, Leptospira interrogans serovar lai str. 56601
uuugucggaaucuuu

SEQ ID NO: 2774474 - RNA, 20 nt, Leptospira interrogans serovar lai str. 56601
uuugucguaacuccgacaga

SEQ ID NO: 2774475 - RNA, 14 nt, Leptospira interrogans serovar lai str. 56601
uuugucguaauucc

SEQ ID NO: 2774476 - RNA, 18 nt, Leptospira interrogans serovar lai str. 56601
uuugucucaaaacuuaaa

SEQ ID NO: 2774477 - RNA, 22 nt, Leptospira interrogans serovar lai str. 56601
uuugucuccugucaauuuucca

SEQ ID NO: 2774478 - RNA, 15 nt, Leptospira interrogans serovar lai str. 56601
uuugugaaacuuaau

SEQ ID NO: 2774479 - RNA, 14 nt, Leptospira interrogans serovar lai str. 56601
uuugugaacuuuua

SEQ ID NO: 2774480 - RNA, 14 nt, Leptospira interrogans serovar lai str. 56601
uuugugaacuuuug

SEQ ID NO: 2774481 - RNA, 20 nt, Leptospira interrogans serovar lai str. 56601
uuugugacacugaaaacauu

SEQ ID NO: 2774482 - RNA, 21 nt, Leptospira interrogans serovar lai str. 56601
uuugugacuaucaacaagaau

SEQ ID NO: 2774483 - RNA, 19 nt, Leptospira interrogans serovar lai str. 56601
uuugugagaguucccacau

SEQ ID NO: 2774484 - RNA, 22 nt, Leptospira interrogans serovar lai str. 56601
uuugugagaguucccacauuuu

SEQ ID NO: 2774485 - RNA, 19 nt, Leptospira interrogans serovar lai str. 56601
uuugugagaguucccacgu

SEQ ID NO: 2774486 - RNA, 21 nt, Leptospira interrogans serovar lai str. 56601
uuugugcuauauucaaaaaag

SEQ ID NO: 2774487 - RNA, 16 nt, Leptospira interrogans serovar lai str. 56601
uuugugggaacucuua

SEQ ID NO: 2774488 - RNA, 13 nt, Leptospira interrogans serovar lai str. 56601
uuuguguuguaug

SEQ ID NO: 2774489 - RNA, 15 nt, Leptospira interrogans serovar lai str. 56601
uuuguuaaccaaaaa

SEQ ID NO: 2774490 - RNA, 14 nt, Leptospira interrogans serovar lai str. 56601
uuuguuauaagaau

SEQ ID NO: 2774491 - RNA, 16 nt, Leptospira interrogans serovar lai str. 56601
uuuguuccaaaaccuc

SEQ ID NO: 2774492 - RNA, 22 nt, Leptospira interrogans serovar lai str. 56601
uuuguuccaaaaccucaaaaaa

SEQ ID NO: 2774493 - RNA, 18 nt, Leptospira interrogans serovar lai str. 56601
uuuguuccuaaaaaauaa

SEQ ID NO: 2774494 - RNA, 19 nt, Leptospira interrogans serovar lai str. 56601
uuuguucuaaaaacucaaa

SEQ ID NO: 2774495 - RNA, 21 nt, Leptospira interrogans serovar lai str. 56601
uuuguugcguuuaaaaacaga

SEQ ID NO: 2774496 - RNA, 20 nt, Leptospira interrogans serovar lai str. 56601
uuuguuguaucgaacucacg

SEQ ID NO: 2774497 - RNA, 15 nt, Leptospira interrogans serovar lai str. 56601
uuuuaaaaaaauuac

SEQ ID NO: 2774498 - RNA, 14 nt, Leptospira interrogans serovar lai str. 56601
uuuuaaaaaaugug

SEQ ID NO: 2774499 - RNA, 13 nt, Leptospira interrogans serovar lai str. 56601
uuuuaaaaaauuu

SEQ ID NO: 2774500 - RNA, 13 nt, Leptospira interrogans serovar lai str. 56601
uuuuaaaaaccua

SEQ ID NO: 2774501 - RNA, 20 nt, Leptospira interrogans serovar lai str. 56601
uuuuaaaaagaauuguucgu

SEQ ID NO: 2774502 - RNA, 14 nt, Leptospira interrogans serovar lai str. 56601
uuuuaaaaauauag

SEQ ID NO: 2774503 - RNA, 14 nt, Leptospira interrogans serovar lai str. 56601
uuuuaaaaaugucu

SEQ ID NO: 2774504 - RNA, 13 nt, Leptospira interrogans serovar lai str. 56601
uuuuaaaaauuag

SEQ ID NO: 2774505 - RNA, 13 nt, Leptospira interrogans serovar lai str. 56601
uuuuaaaaauuca

SEQ ID NO: 2774506 - RNA, 20 nt, Leptospira interrogans serovar lai str. 56601
uuuuaaaaauucaacuaaau

SEQ ID NO: 2774507 - RNA, 23 nt, Leptospira interrogans serovar lai str. 56601
uuuuaaaaauucaacuaaauccu

SEQ ID NO: 2774508 - RNA, 14 nt, Leptospira interrogans serovar lai str. 56601
uuuuaaaaccaaaa

SEQ ID NO: 2774509 - RNA, 15 nt, Leptospira interrogans serovar lai str. 56601
uuuuaaaacuuaaaa

SEQ ID NO: 2774510 - RNA, 20 nt, Leptospira interrogans serovar lai str. 56601
uuuuaaaaguuugauuucac

SEQ ID NO: 2774511 - RNA, 23 nt, Leptospira interrogans serovar lai str. 56601
uuuuaaaaguuuuggaagauucu

SEQ ID NO: 2774512 - RNA, 13 nt, Leptospira interrogans serovar lai str. 56601
uuuuaaaauguag

SEQ ID NO: 2774513 - RNA, 16 nt, Leptospira interrogans serovar lai str. 56601
uuuuaaacuuuguuuu

SEQ ID NO: 2774514 - RNA, 18 nt, Leptospira interrogans serovar lai str. 56601
uuuuaaauacucuaauuu

SEQ ID NO: 2774515 - RNA, 19 nt, Leptospira interrogans serovar lai str. 56601
uuuuaaauccaacuuaaaa

SEQ ID NO: 2774516 - RNA, 16 nt, Leptospira interrogans serovar lai str. 56601
uuuuaaaugcaccguu

SEQ ID NO: 2774517 - RNA, 16 nt, Leptospira interrogans serovar lai str. 56601
uuuuaaaugugggaac

SEQ ID NO: 2774518 - RNA, 16 nt, Leptospira interrogans serovar lai str. 56601
uuuuaaauuaauauuu

SEQ ID NO: 2774519 - RNA, 23 nt, Leptospira interrogans serovar lai str. 56601
uuuuaaauuagcuuaagaauuuc

SEQ ID NO: 2774520 - RNA, 15 nt, Leptospira interrogans serovar lai str. 56601
uuuuaaauuguucgu

SEQ ID NO: 2774521 - RNA, 20 nt, Leptospira interrogans serovar lai str. 56601
uuuuaaauuuaucuauaaaa

SEQ ID NO: 2774522 - RNA, 17 nt, Leptospira interrogans serovar lai str. 56601
uuuuaacaacucuaauu

SEQ ID NO: 2774523 - RNA, 17 nt, Leptospira interrogans serovar lai str. 56601
uuuuaaccgcaaaauca

SEQ ID NO: 2774524 - RNA, 17 nt, Leptospira interrogans serovar lai str. 56601
uuuuaacuuuuuuuaaa

SEQ ID NO: 2774525 - RNA, 13 nt, Leptospira interrogans serovar lai str. 56601
uuuuaagaaucuc

SEQ ID NO: 2774526 - RNA, 17 nt, Leptospira interrogans serovar lai str. 56601
uuuuaagaaucucaaaa

SEQ ID NO: 2774527 - RNA, 21 nt, Leptospira interrogans serovar lai str. 56601
uuuuaagaauuuguuugucuu

SEQ ID NO: 2774528 - RNA, 16 nt, Leptospira interrogans serovar lai str. 56601
uuuuaagacaaacuuu

SEQ ID NO: 2774529 - RNA, 18 nt, Leptospira interrogans serovar lai str. 56601
uuuuaagacaaacuuuua

SEQ ID NO: 2774530 - RNA, 21 nt, Leptospira interrogans serovar lai str. 56601
uuuuaagacaaacuuuuagau

SEQ ID NO: 2774531 - RNA, 23 nt, Leptospira interrogans serovar lai str. 56601
uuuuaagacaaacuuuuagauaa

SEQ ID NO: 2774532 - RNA, 15 nt, Leptospira interrogans serovar lai str. 56601
uuuuaagauuacauu

SEQ ID NO: 2774533 - RNA, 18 nt, Leptospira interrogans serovar lai str. 56601
uuuuaaguaauauuucuc

SEQ ID NO: 2774534 - RNA, 14 nt, Leptospira interrogans serovar lai str. 56601
uuuuaaguucaaaa

SEQ ID NO: 2774535 - RNA, 20 nt, Leptospira interrogans serovar lai str. 56601
uuuuaaguucagauucaauu

SEQ ID NO: 2774536 - RNA, 17 nt, Leptospira interrogans serovar lai str. 56601
uuuuaauaaaauacagu

SEQ ID NO: 2774537 - RNA, 14 nt, Leptospira interrogans serovar lai str. 56601
uuuuaauaaaaugc

SEQ ID NO: 2774538 - RNA, 15 nt, Leptospira interrogans serovar lai str. 56601
uuuuaauaaaaugca

SEQ ID NO: 2774539 - RNA, 15 nt, Leptospira interrogans serovar lai str. 56601
uuuuaauaauucaaa

SEQ ID NO: 2774540 - RNA, 17 nt, Leptospira interrogans serovar lai str. 56601
uuuuaauauacugcaau

SEQ ID NO: 2774541 - RNA, 21 nt, Leptospira interrogans serovar lai str. 56601
uuuuaauauacugcaauaguu

SEQ ID NO: 2774542 - RNA, 22 nt, Leptospira interrogans serovar lai str. 56601
uuuuaauauacugcaauaguuu

SEQ ID NO: 2774543 - RNA, 12 nt, Leptospira interrogans serovar lai str. 56601
uuuuaauauuuc

SEQ ID NO: 2774544 - RNA, 15 nt, Leptospira interrogans serovar lai str. 56601
uuuuaaucaaaugca

SEQ ID NO: 2774545 - RNA, 16 nt, Leptospira interrogans serovar lai str. 56601
uuuuaaucaaaugcag

SEQ ID NO: 2774546 - RNA, 20 nt, Leptospira interrogans serovar lai str. 56601
uuuuaaucaugugaauucag

SEQ ID NO: 2774547 - RNA, 23 nt, Leptospira interrogans serovar lai str. 56601
uuuuaaucaugugaauucagaaa

SEQ ID NO: 2774548 - RNA, 12 nt, Leptospira interrogans serovar lai str. 56601
uuuuaaugaaaa

SEQ ID NO: 2774549 - RNA, 20 nt, Leptospira interrogans serovar lai str. 56601
uuuuaaugaaaaauuucuuu

SEQ ID NO: 2774550 - RNA, 21 nt, Leptospira interrogans serovar lai str. 56601
uuuuaauuucgggauauucuu

SEQ ID NO: 2774551 - RNA, 19 nt, Leptospira interrogans serovar lai str. 56601
uuuuaauuuucuaauauaa

SEQ ID NO: 2774552 - RNA, 14 nt, Leptospira interrogans serovar lai str. 56601
uuuuacaaaaaaau

SEQ ID NO: 2774553 - RNA, 17 nt, Leptospira interrogans serovar lai str. 56601
uuuuacaaaaguagaaa

SEQ ID NO: 2774554 - RNA, 23 nt, Leptospira interrogans serovar lai str. 56601
uuuuacaaacaaauucuaaaauu

SEQ ID NO: 2774555 - RNA, 15 nt, Leptospira interrogans serovar lai str. 56601
uuuuacaauuaaacu

SEQ ID NO: 2774556 - RNA, 21 nt, Leptospira interrogans serovar lai str. 56601
uuuuacaauuaaacuucaaaa

SEQ ID NO: 2774557 - RNA, 23 nt, Leptospira interrogans serovar lai str. 56601
uuuuacaauuaaacuucaaaaaa

SEQ ID NO: 2774558 - RNA, 16 nt, Leptospira interrogans serovar lai str. 56601
uuuuacacguaauucu

SEQ ID NO: 2774559 - RNA, 18 nt, Leptospira interrogans serovar lai str. 56601
uuuuacagaauauuaaau

SEQ ID NO: 2774560 - RNA, 21 nt, Leptospira interrogans serovar lai str. 56601
uuuuacagacguauuuuuaaa

SEQ ID NO: 2774561 - RNA, 19 nt, Leptospira interrogans serovar lai str. 56601
uuuuaccagaucaauucuu

SEQ ID NO: 2774562 - RNA, 22 nt, Leptospira interrogans serovar lai str. 56601
uuuuacccgaucuuuuuuaauu

SEQ ID NO: 2774563 - RNA, 18 nt, Leptospira interrogans serovar lai str. 56601
uuuuacccugguuucaaa

SEQ ID NO: 2774564 - RNA, 21 nt, Leptospira interrogans serovar lai str. 56601
uuuuaccgauaagucuagaaa

SEQ ID NO: 2774565 - RNA, 23 nt, Leptospira interrogans serovar lai str. 56601
uuuuaccgauaagucuagaaaug

SEQ ID NO: 2774566 - RNA, 15 nt, Leptospira interrogans serovar lai str. 56601
uuuuaccguuuuuaa

SEQ ID NO: 2774567 - RNA, 22 nt, Leptospira interrogans serovar lai str. 56601
uuuuaccugccuuauaaugaag

SEQ ID NO: 2774568 - RNA, 17 nt, Leptospira interrogans serovar lai str. 56601
uuuuacgaacaaauucu

SEQ ID NO: 2774569 - RNA, 18 nt, Leptospira interrogans serovar lai str. 56601
uuuuacgaacaaauucua

SEQ ID NO: 2774570 - RNA, 20 nt, Leptospira interrogans serovar lai str. 56601
uuuuacgaacacauucuaaa

SEQ ID NO: 2774571 - RNA, 20 nt, Leptospira interrogans serovar lai str. 56601
uuuuacgaacgaauucuaaa

SEQ ID NO: 2774572 - RNA, 23 nt, Leptospira interrogans serovar lai str. 56601
uuuuacgaacgaauucuaaaauu

SEQ ID NO: 2774573 - RNA, 20 nt, Leptospira interrogans serovar lai str. 56601
uuuuacgacuuuauucaaaa

SEQ ID NO: 2774574 - RNA, 15 nt, Leptospira interrogans serovar lai str. 56601
uuuuacgcaaucauu

SEQ ID NO: 2774575 - RNA, 17 nt, Leptospira interrogans serovar lai str. 56601
uuuuacggaucaaaauu

SEQ ID NO: 2774576 - RNA, 19 nt, Leptospira interrogans serovar lai str. 56601
uuuuacggaucaaaauucu

SEQ ID NO: 2774577 - RNA, 23 nt, Leptospira interrogans serovar lai str. 56601
uuuuacggaucaaaauucuuugu

SEQ ID NO: 2774578 - RNA, 17 nt, Leptospira interrogans serovar lai str. 56601
uuuuacggaucaauucu

SEQ ID NO: 2774579 - RNA, 22 nt, Leptospira interrogans serovar lai str. 56601
uuuuacggaucaauucugaaaa

SEQ ID NO: 2774580 - RNA, 22 nt, Leptospira interrogans serovar lai str. 56601
uuuuacggauucucgcauuuuc

SEQ ID NO: 2774581 - RNA, 12 nt, Leptospira interrogans serovar lai str. 56601
uuuuacuaaaaa

SEQ ID NO: 2774582 - RNA, 13 nt, Leptospira interrogans serovar lai str. 56601
uuuuacuaaaaaa

SEQ ID NO: 2774583 - RNA, 16 nt, Leptospira interrogans serovar lai str. 56601
uuuuacuaaaaaacau

SEQ ID NO: 2774584 - RNA, 23 nt, Leptospira interrogans serovar lai str. 56601
uuuuacuauaaacauauuauuuu

SEQ ID NO: 2774585 - RNA, 14 nt, Leptospira interrogans serovar lai str. 56601
uuuuacucaugacu

SEQ ID NO: 2774586 - RNA, 20 nt, Leptospira interrogans serovar lai str. 56601
uuuuacucgugcacaaguuu

SEQ ID NO: 2774587 - RNA, 13 nt, Leptospira interrogans serovar lai str. 56601
uuuuacugaguuu

SEQ ID NO: 2774588 - RNA, 16 nt, Leptospira interrogans serovar lai str. 56601
uuuuacuguaaaauuu

SEQ ID NO: 2774589 - RNA, 21 nt, Leptospira interrogans serovar lai str. 56601
uuuuacuguaaaauuuaaauu

SEQ ID NO: 2774590 - RNA, 18 nt, Leptospira interrogans serovar lai str. 56601
uuuuacuguaaaauuuag

SEQ ID NO: 2774591 - RNA, 20 nt, Leptospira interrogans serovar lai str. 56601
uuuuacuguuguuaaauuuu

SEQ ID NO: 2774592 - RNA, 21 nt, Leptospira interrogans serovar lai str. 56601
uuuuacuucauauacaagacu

SEQ ID NO: 2774593 - RNA, 22 nt, Leptospira interrogans serovar lai str. 56601
uuuuacuucguuauaauuuuca

SEQ ID NO: 2774594 - RNA, 17 nt, Leptospira interrogans serovar lai str. 56601
uuuuacuugcaaaaagu

SEQ ID NO: 2774595 - RNA, 19 nt, Leptospira interrogans serovar lai str. 56601
uuuuacuugcaaaaaguau

SEQ ID NO: 2774596 - RNA, 14 nt, Leptospira interrogans serovar lai str. 56601
uuuuagaaaauuag

SEQ ID NO: 2774597 - RNA, 16 nt, Leptospira interrogans serovar lai str. 56601
uuuuagaaaauuuuua

SEQ ID NO: 2774598 - RNA, 17 nt, Leptospira interrogans serovar lai str. 56601
uuuuagaaacuaaaaaa

SEQ ID NO: 2774599 - RNA, 20 nt, Leptospira interrogans serovar lai str. 56601
uuuuagaacugcaguaguuc

SEQ ID NO: 2774600 - RNA, 19 nt, Leptospira interrogans serovar lai str. 56601
uuuuagaagauuuuuacuc

SEQ ID NO: 2774601 - RNA, 14 nt, Leptospira interrogans serovar lai str. 56601
uuuuagaauaucuu

SEQ ID NO: 2774602 - RNA, 20 nt, Leptospira interrogans serovar lai str. 56601
uuuuagaauauuaugaaaua

SEQ ID NO: 2774603 - RNA, 17 nt, Leptospira interrogans serovar lai str. 56601
uuuuagaaucaaaauga

SEQ ID NO: 2774604 - RNA, 14 nt, Leptospira interrogans serovar lai str. 56601
uuuuagaauuuguu

SEQ ID NO: 2774605 - RNA, 15 nt, Leptospira interrogans serovar lai str. 56601
uuuuagaauuuguuu

SEQ ID NO: 2774606 - RNA, 20 nt, Leptospira interrogans serovar lai str. 56601
uuuuagaauuuguuuguaaa

SEQ ID NO: 2774607 - RNA, 16 nt, Leptospira interrogans serovar lai str. 56601
uuuuagacaaaaauac

SEQ ID NO: 2774608 - RNA, 22 nt, Leptospira interrogans serovar lai str. 56601
uuuuagaguucguuaagaauaa

SEQ ID NO: 2774609 - RNA, 15 nt, Leptospira interrogans serovar lai str. 56601
uuuuagauaaauaca

SEQ ID NO: 2774610 - RNA, 15 nt, Leptospira interrogans serovar lai str. 56601
uuuuaguaaacuacu

SEQ ID NO: 2774611 - RNA, 19 nt, Leptospira interrogans serovar lai str. 56601
uuuuaguaaacuacuaaau

SEQ ID NO: 2774612 - RNA, 20 nt, Leptospira interrogans serovar lai str. 56601
uuuuagugcgguauuuuuuu

SEQ ID NO: 2774613 - RNA, 17 nt, Leptospira interrogans serovar lai str. 56601
uuuuaguucaaaaacau

SEQ ID NO: 2774614 - RNA, 18 nt, Leptospira interrogans serovar lai str. 56601
uuuuaguucaaaaacauc

SEQ ID NO: 2774615 - RNA, 15 nt, Leptospira interrogans serovar lai str. 56601
uuuuaguucucuauu

SEQ ID NO: 2774616 - RNA, 20 nt, Leptospira interrogans serovar lai str. 56601
uuuuaguuucuuuuuuagau

SEQ ID NO: 2774617 - RNA, 13 nt, Leptospira interrogans serovar lai str. 56601
uuuuaguuuuaau

SEQ ID NO: 2774618 - RNA, 14 nt, Leptospira interrogans serovar lai str. 56601
uuuuaguuuuuccu

SEQ ID NO: 2774619 - RNA, 11 nt, Leptospira interrogans serovar lai str. 56601
uuuuauaaaaa

SEQ ID NO: 2774620 - RNA, 13 nt, Leptospira interrogans serovar lai str. 56601
uuuuauaaaaagc

SEQ ID NO: 2774621 - RNA, 13 nt, Leptospira interrogans serovar lai str. 56601
uuuuauaaaaagu

SEQ ID NO: 2774622 - RNA, 14 nt, Leptospira interrogans serovar lai str. 56601
uuuuauaaaaauac

SEQ ID NO: 2774623 - RNA, 16 nt, Leptospira interrogans serovar lai str. 56601
uuuuauaaaaaucuag

SEQ ID NO: 2774624 - RNA, 13 nt, Leptospira interrogans serovar lai str. 56601
uuuuauaaaauac

SEQ ID NO: 2774625 - RNA, 15 nt, Leptospira interrogans serovar lai str. 56601
uuuuauaaaauuaag

SEQ ID NO: 2774626 - RNA, 17 nt, Leptospira interrogans serovar lai str. 56601
uuuuauaaagauaaauc

SEQ ID NO: 2774627 - RNA, 16 nt, Leptospira interrogans serovar lai str. 56601
uuuuauaaauuauuuu

SEQ ID NO: 2774628 - RNA, 18 nt, Leptospira interrogans serovar lai str. 56601
uuuuauaaauuauuuuuu

SEQ ID NO: 2774629 - RNA, 19 nt, Leptospira interrogans serovar lai str. 56601
uuuuauacauucguuuuaa

SEQ ID NO: 2774630 - RNA, 14 nt, Leptospira interrogans serovar lai str. 56601
uuuuauacuuuaau

SEQ ID NO: 2774631 - RNA, 21 nt, Leptospira interrogans serovar lai str. 56601
uuuuauacuuuaauaauauaa

SEQ ID NO: 2774632 - RNA, 20 nt, Leptospira interrogans serovar lai str. 56601
uuuuauauaaguuaaauuuu

SEQ ID NO: 2774633 - RNA, 23 nt, Leptospira interrogans serovar lai str. 56601
uuuuauaucuuaauuaaaaaauc

SEQ ID NO: 2774634 - RNA, 15 nt, Leptospira interrogans serovar lai str. 56601
uuuuauauuuuaauu

SEQ ID NO: 2774635 - RNA, 15 nt, Leptospira interrogans serovar lai str. 56601
uuuuaucaaauaaag

SEQ ID NO: 2774636 - RNA, 18 nt, Leptospira interrogans serovar lai str. 56601
uuuuaucauguuuuauau

SEQ ID NO: 2774637 - RNA, 16 nt, Leptospira interrogans serovar lai str. 56601
uuuuauccauaaauuc

SEQ ID NO: 2774638 - RNA, 19 nt, Leptospira interrogans serovar lai str. 56601
uuuuaucgaauaagaaauu

SEQ ID NO: 2774639 - RNA, 13 nt, Leptospira interrogans serovar lai str. 56601
uuuuaucgcaaag

SEQ ID NO: 2774640 - RNA, 18 nt, Leptospira interrogans serovar lai str. 56601
uuuuaucggcguucuaca

SEQ ID NO: 2774641 - RNA, 21 nt, Leptospira interrogans serovar lai str. 56601
uuuuaucggcguucuacaaaa

SEQ ID NO: 2774642 - RNA, 22 nt, Leptospira interrogans serovar lai str. 56601
uuuuaucuuaauguaaaguucu

SEQ ID NO: 2774643 - RNA, 17 nt, Leptospira interrogans serovar lai str. 56601
uuuuaugaaaaaauuca

SEQ ID NO: 2774644 - RNA, 19 nt, Leptospira interrogans serovar lai str. 56601
uuuuaugacuucuuaagua

SEQ ID NO: 2774645 - RNA, 21 nt, Leptospira interrogans serovar lai str. 56601
uuuuaugagcuuuguagaaua

SEQ ID NO: 2774646 - RNA, 15 nt, Leptospira interrogans serovar lai str. 56601
uuuuaugauuuucuu

SEQ ID NO: 2774647 - RNA, 21 nt, Leptospira interrogans serovar lai str. 56601
uuuuaugccuuugguauuuua

SEQ ID NO: 2774648 - RNA, 18 nt, Leptospira interrogans serovar lai str. 56601
uuuuauggaaaaaugaaa

SEQ ID NO: 2774649 - RNA, 15 nt, Leptospira interrogans serovar lai str. 56601
uuuuauguaauauuu

SEQ ID NO: 2774650 - RNA, 20 nt, Leptospira interrogans serovar lai str. 56601
uuuuauguagaaauuugauu

SEQ ID NO: 2774651 - RNA, 12 nt, Leptospira interrogans serovar lai str. 56601
uuuuauuaaaaa

SEQ ID NO: 2774652 - RNA, 13 nt, Leptospira interrogans serovar lai str. 56601
uuuuauuaaaaau

SEQ ID NO: 2774653 - RNA, 15 nt, Leptospira interrogans serovar lai str. 56601
uuuuauuaaauaaag

SEQ ID NO: 2774654 - RNA, 13 nt, Leptospira interrogans serovar lai str. 56601
uuuuauuauaaaa

SEQ ID NO: 2774655 - RNA, 13 nt, Leptospira interrogans serovar lai str. 56601
uuuuauuauauaa

SEQ ID NO: 2774656 - RNA, 14 nt, Leptospira interrogans serovar lai str. 56601
uuuuauuauauaau

SEQ ID NO: 2774657 - RNA, 18 nt, Leptospira interrogans serovar lai str. 56601
uuuuauugugaguuuaaa

SEQ ID NO: 2774658 - RNA, 11 nt, Leptospira interrogans serovar lai str. 56601
uuuuauuucua

SEQ ID NO: 2774659 - RNA, 14 nt, Leptospira interrogans serovar lai str. 56601
uuuuauuucuaagu

SEQ ID NO: 2774660 - RNA, 22 nt, Leptospira interrogans serovar lai str. 56601
uuuuauuugauuagaaaaaaag

SEQ ID NO: 2774661 - RNA, 12 nt, Leptospira interrogans serovar lai str. 56601
uuuucaaaaaau

SEQ ID NO: 2774662 - RNA, 16 nt, Leptospira interrogans serovar lai str. 56601
uuuucaaaaaauauca

SEQ ID NO: 2774663 - RNA, 19 nt, Leptospira interrogans serovar lai str. 56601
uuuucaaaaguauuuugau

SEQ ID NO: 2774664 - RNA, 13 nt, Leptospira interrogans serovar lai str. 56601
uuuucaaaauaag

SEQ ID NO: 2774665 - RNA, 23 nt, Leptospira interrogans serovar lai str. 56601
uuuucaaaaucuaacuguagaac

SEQ ID NO: 2774666 - RNA, 13 nt, Leptospira interrogans serovar lai str. 56601
uuuucaaauauuu

SEQ ID NO: 2774667 - RNA, 19 nt, Leptospira interrogans serovar lai str. 56601
uuuucaacaacucuaauuu

SEQ ID NO: 2774668 - RNA, 21 nt, Leptospira interrogans serovar lai str. 56601
uuuucaacaacucuaauuuag

SEQ ID NO: 2774669 - RNA, 18 nt, Leptospira interrogans serovar lai str. 56601
uuuucaacaacucuauuu

SEQ ID NO: 2774670 - RNA, 17 nt, Leptospira interrogans serovar lai str. 56601
uuuucaacaacucucuu

SEQ ID NO: 2774671 - RNA, 18 nt, Leptospira interrogans serovar lai str. 56601
uuuucaauaauucuauuu

SEQ ID NO: 2774672 - RNA, 16 nt, Leptospira interrogans serovar lai str. 56601
uuuucaaucuaaccca

SEQ ID NO: 2774673 - RNA, 23 nt, Leptospira interrogans serovar lai str. 56601
uuuucaaucuaacccauucaaca

SEQ ID NO: 2774674 - RNA, 14 nt, Leptospira interrogans serovar lai str. 56601
uuuucaauuauuuu

SEQ ID NO: 2774675 - RNA, 22 nt, Leptospira interrogans serovar lai str. 56601
uuuucacauuuuaggaaucaag

SEQ ID NO: 2774676 - RNA, 17 nt, Leptospira interrogans serovar lai str. 56601
uuuucagaaaaaugaau

SEQ ID NO: 2774677 - RNA, 13 nt, Leptospira interrogans serovar lai str. 56601
uuuucagguugaa

SEQ ID NO: 2774678 - RNA, 17 nt, Leptospira interrogans serovar lai str. 56601
uuuucagucuaucaaac

SEQ ID NO: 2774679 - RNA, 19 nt, Leptospira interrogans serovar lai str. 56601
uuuucagugaauaaaauaa

SEQ ID NO: 2774680 - RNA, 20 nt, Leptospira interrogans serovar lai str. 56601
uuuucauacguagcaagaac

SEQ ID NO: 2774681 - RNA, 16 nt, Leptospira interrogans serovar lai str. 56601
uuuucaugaauuaaag

SEQ ID NO: 2774682 - RNA, 19 nt, Leptospira interrogans serovar lai str. 56601
uuuucaugaauuaaagaag

SEQ ID NO: 2774683 - RNA, 10 nt, Leptospira interrogans serovar lai str. 56601
uuuucauuug

SEQ ID NO: 2774684 - RNA, 19 nt, Leptospira interrogans serovar lai str. 56601
uuuuccaaaaagaaaaaca

SEQ ID NO: 2774685 - RNA, 14 nt, Leptospira interrogans serovar lai str. 56601
uuuuccaaaaauuu

SEQ ID NO: 2774686 - RNA, 18 nt, Leptospira interrogans serovar lai str. 56601
uuuuccaaaaauuuaaaa

SEQ ID NO: 2774687 - RNA, 22 nt, Leptospira interrogans serovar lai str. 56601
uuuucccaaacaggaaaauuua

SEQ ID NO: 2774688 - RNA, 16 nt, Leptospira interrogans serovar lai str. 56601
uuuucccgcuaaaagu

SEQ ID NO: 2774689 - RNA, 18 nt, Leptospira interrogans serovar lai str. 56601
uuuuccgaaccuuaccac

SEQ ID NO: 2774690 - RNA, 13 nt, Leptospira interrogans serovar lai str. 56601
uuuuccuaaaauu

SEQ ID NO: 2774691 - RNA, 14 nt, Leptospira interrogans serovar lai str. 56601
uuuuccuaaaauuu

SEQ ID NO: 2774692 - RNA, 14 nt, Leptospira interrogans serovar lai str. 56601
uuuuccuauuuuug

SEQ ID NO: 2774693 - RNA, 15 nt, Leptospira interrogans serovar lai str. 56601
uuuuccucgaauuca

SEQ ID NO: 2774694 - RNA, 17 nt, Leptospira interrogans serovar lai str. 56601
uuuuccuucuuuacagu

SEQ ID NO: 2774695 - RNA, 19 nt, Leptospira interrogans serovar lai str. 56601
uuuuccuuuaaacuuagau

SEQ ID NO: 2774696 - RNA, 12 nt, Leptospira interrogans serovar lai str. 56601
uuuuccuuuuac

SEQ ID NO: 2774697 - RNA, 14 nt, Leptospira interrogans serovar lai str. 56601
uuuucgaaaagaaa

SEQ ID NO: 2774698 - RNA, 21 nt, Leptospira interrogans serovar lai str. 56601
uuuucgaaacaaaaucaaaga

SEQ ID NO: 2774699 - RNA, 14 nt, Leptospira interrogans serovar lai str. 56601
uuuucguauuguuu

SEQ ID NO: 2774700 - RNA, 23 nt, Leptospira interrogans serovar lai str. 56601
uuuucgucgacuuugacuugaaa

SEQ ID NO: 2774701 - RNA, 15 nt, Leptospira interrogans serovar lai str. 56601
uuuucuaaaaaaaau

SEQ ID NO: 2774702 - RNA, 20 nt, Leptospira interrogans serovar lai str. 56601
uuuucuaaaaguaaaaguau

SEQ ID NO: 2774703 - RNA, 12 nt, Leptospira interrogans serovar lai str. 56601
uuuucuaaaaua

SEQ ID NO: 2774704 - RNA, 14 nt, Leptospira interrogans serovar lai str. 56601
uuuucuaaauuuua

SEQ ID NO: 2774705 - RNA, 13 nt, Leptospira interrogans serovar lai str. 56601
uuuucuaagaauc

SEQ ID NO: 2774706 - RNA, 19 nt, Leptospira interrogans serovar lai str. 56601
uuuucuaaguggagaggaa

SEQ ID NO: 2774707 - RNA, 21 nt, Leptospira interrogans serovar lai str. 56601
uuuucuaauagagaaaaauuu

SEQ ID NO: 2774708 - RNA, 22 nt, Leptospira interrogans serovar lai str. 56601
uuuucuacaaauaaaacuucuc

SEQ ID NO: 2774709 - RNA, 16 nt, Leptospira interrogans serovar lai str. 56601
uuuucuagacuuucuu

SEQ ID NO: 2774710 - RNA, 12 nt, Leptospira interrogans serovar lai str. 56601
uuuucuauaaaa

SEQ ID NO: 2774711 - RNA, 15 nt, Leptospira interrogans serovar lai str. 56601
uuuucuauaaccaca

SEQ ID NO: 2774712 - RNA, 19 nt, Leptospira interrogans serovar lai str. 56601
uuuucuauaaucugaaaua

SEQ ID NO: 2774713 - RNA, 12 nt, Leptospira interrogans serovar lai str. 56601
uuuucuaucaaa

SEQ ID NO: 2774714 - RNA, 16 nt, Leptospira interrogans serovar lai str. 56601
uuuucucaaaaaaagu

SEQ ID NO: 2774715 - RNA, 17 nt, Leptospira interrogans serovar lai str. 56601
uuuucucaaaaaaugca

SEQ ID NO: 2774716 - RNA, 22 nt, Leptospira interrogans serovar lai str. 56601
uuuucucaaaaaaugcauucaa

SEQ ID NO: 2774717 - RNA, 22 nt, Leptospira interrogans serovar lai str. 56601
uuuucucagccaaaaguuuuug

SEQ ID NO: 2774718 - RNA, 13 nt, Leptospira interrogans serovar lai str. 56601
uuuucugaaaaaa

SEQ ID NO: 2774719 - RNA, 16 nt, Leptospira interrogans serovar lai str. 56601
uuuucugaaaaaagcu

SEQ ID NO: 2774720 - RNA, 16 nt, Leptospira interrogans serovar lai str. 56601
uuuucugaaaaaaguu

SEQ ID NO: 2774721 - RNA, 21 nt, Leptospira interrogans serovar lai str. 56601
uuuucugaaaaaaguugaaau

SEQ ID NO: 2774722 - RNA, 13 nt, Leptospira interrogans serovar lai str. 56601
uuuucugaaaaac

SEQ ID NO: 2774723 - RNA, 14 nt, Leptospira interrogans serovar lai str. 56601
uuuucugaaaaguu

SEQ ID NO: 2774724 - RNA, 17 nt, Leptospira interrogans serovar lai str. 56601
uuuucugguuccauaaa

SEQ ID NO: 2774725 - RNA, 15 nt, Leptospira interrogans serovar lai str. 56601
uuuucuuaaaaaaau

SEQ ID NO: 2774726 - RNA, 15 nt, Leptospira interrogans serovar lai str. 56601
uuuucuuaaaaaguu

SEQ ID NO: 2774727 - RNA, 17 nt, Leptospira interrogans serovar lai str. 56601
uuuucuuaauaaacuuu

SEQ ID NO: 2774728 - RNA, 19 nt, Leptospira interrogans serovar lai str. 56601
uuuucuuaauaaacuuuca

SEQ ID NO: 2774729 - RNA, 11 nt, Leptospira interrogans serovar lai str. 56601
uuuucuuaggu

SEQ ID NO: 2774730 - RNA, 17 nt, Leptospira interrogans serovar lai str. 56601
uuuucuuaguuuuguac

SEQ ID NO: 2774731 - RNA, 14 nt, Leptospira interrogans serovar lai str. 56601
uuuucuucuggaau

SEQ ID NO: 2774732 - RNA, 15 nt, Leptospira interrogans serovar lai str. 56601
uuuucuucuuuguaa

SEQ ID NO: 2774733 - RNA, 16 nt, Leptospira interrogans serovar lai str. 56601
uuuucuuuaucagaaa

SEQ ID NO: 2774734 - RNA, 14 nt, Leptospira interrogans serovar lai str. 56601
uuuugaaaaagaau

SEQ ID NO: 2774735 - RNA, 22 nt, Leptospira interrogans serovar lai str. 56601
uuuugaaaauuuacgauucuaa

SEQ ID NO: 2774736 - RNA, 19 nt, Leptospira interrogans serovar lai str. 56601
uuuugaaacuauccaaaag

SEQ ID NO: 2774737 - RNA, 19 nt, Leptospira interrogans serovar lai str. 56601
uuuugaaauagauucuaau

SEQ ID NO: 2774738 - RNA, 18 nt, Leptospira interrogans serovar lai str. 56601
uuuugaacuacagaauuu

SEQ ID NO: 2774739 - RNA, 18 nt, Leptospira interrogans serovar lai str. 56601
uuuugaagacuauaaaac

SEQ ID NO: 2774740 - RNA, 19 nt, Leptospira interrogans serovar lai str. 56601
uuuugaaguaguuccuaca

SEQ ID NO: 2774741 - RNA, 13 nt, Leptospira interrogans serovar lai str. 56601
uuuugaauauuau

SEQ ID NO: 2774742 - RNA, 14 nt, Leptospira interrogans serovar lai str. 56601
uuuugaauuuuuua

SEQ ID NO: 2774743 - RNA, 11 nt, Leptospira interrogans serovar lai str. 56601
uuuugagaaac

SEQ ID NO: 2774744 - RNA, 15 nt, Leptospira interrogans serovar lai str. 56601
uuuugagaaaccuuu

SEQ ID NO: 2774745 - RNA, 23 nt, Leptospira interrogans serovar lai str. 56601
uuuugagacaagaagaaaagaau

SEQ ID NO: 2774746 - RNA, 22 nt, Leptospira interrogans serovar lai str. 56601
uuuugagagaagccuauauuuu

SEQ ID NO: 2774747 - RNA, 18 nt, Leptospira interrogans serovar lai str. 56601
uuuugagcacaauauauu

SEQ ID NO: 2774748 - RNA, 18 nt, Leptospira interrogans serovar lai str. 56601
uuuugagcaguaaaaaag

SEQ ID NO: 2774749 - RNA, 12 nt, Leptospira interrogans serovar lai str. 56601
uuuugauaaaau

SEQ ID NO: 2774750 - RNA, 13 nt, Leptospira interrogans serovar lai str. 56601
uuuugauaaaaua

SEQ ID NO: 2774751 - RNA, 16 nt, Leptospira interrogans serovar lai str. 56601
uuuugauaaaauauag

SEQ ID NO: 2774752 - RNA, 21 nt, Leptospira interrogans serovar lai str. 56601
uuuugauaccgggauuuuaaa

SEQ ID NO: 2774753 - RNA, 22 nt, Leptospira interrogans serovar lai str. 56601
uuuugaucguaacuuucuuuua

SEQ ID NO: 2774754 - RNA, 16 nt, Leptospira interrogans serovar lai str. 56601
uuuugaucuaauaaua

SEQ ID NO: 2774755 - RNA, 20 nt, Leptospira interrogans serovar lai str. 56601
uuuugaucuaauaauauacu

SEQ ID NO: 2774756 - RNA, 18 nt, Leptospira interrogans serovar lai str. 56601
uuuugaucuuuaaaagag

SEQ ID NO: 2774757 - RNA, 19 nt, Leptospira interrogans serovar lai str. 56601
uuuugauucauucaggauu

SEQ ID NO: 2774758 - RNA, 19 nt, Leptospira interrogans serovar lai str. 56601
uuuugauuguggcaagagg

SEQ ID NO: 2774759 - RNA, 14 nt, Leptospira interrogans serovar lai str. 56601
uuuugauuuuagaa

SEQ ID NO: 2774760 - RNA, 15 nt, Leptospira interrogans serovar lai str. 56601
uuuugcaaaaaaaau

SEQ ID NO: 2774761 - RNA, 17 nt, Leptospira interrogans serovar lai str. 56601
uuuugcaaguaaaaaga

SEQ ID NO: 2774762 - RNA, 21 nt, Leptospira interrogans serovar lai str. 56601
uuuugcaaucguccaaucucu

SEQ ID NO: 2774763 - RNA, 14 nt, Leptospira interrogans serovar lai str. 56601
uuuugcacugaaau

SEQ ID NO: 2774764 - RNA, 17 nt, Leptospira interrogans serovar lai str. 56601
uuuugcagauagugcac

SEQ ID NO: 2774765 - RNA, 13 nt, Leptospira interrogans serovar lai str. 56601
uuuugcauaaaau

SEQ ID NO: 2774766 - RNA, 14 nt, Leptospira interrogans serovar lai str. 56601
uuuugccaauucag

SEQ ID NO: 2774767 - RNA, 13 nt, Leptospira interrogans serovar lai str. 56601
uuuugccuuguuc

SEQ ID NO: 2774768 - RNA, 19 nt, Leptospira interrogans serovar lai str. 56601
uuuugcucuaaaauaauuu

SEQ ID NO: 2774769 - RNA, 13 nt, Leptospira interrogans serovar lai str. 56601
uuuugcugaguuu

SEQ ID NO: 2774770 - RNA, 16 nt, Leptospira interrogans serovar lai str. 56601
uuuugcuguaaaauuu

SEQ ID NO: 2774771 - RNA, 15 nt, Leptospira interrogans serovar lai str. 56601
uuuuggaaauuccaa

SEQ ID NO: 2774772 - RNA, 14 nt, Leptospira interrogans serovar lai str. 56601
uuuuggcauuccca

SEQ ID NO: 2774773 - RNA, 14 nt, Leptospira interrogans serovar lai str. 56601
uuuugggaauuuuu

SEQ ID NO: 2774774 - RNA, 13 nt, Leptospira interrogans serovar lai str. 56601
uuuugggacaaac

SEQ ID NO: 2774775 - RNA, 23 nt, Leptospira interrogans serovar lai str. 56601
uuuuggguuuggaguauuuuuuc

SEQ ID NO: 2774776 - RNA, 16 nt, Leptospira interrogans serovar lai str. 56601
uuuuguaaaaauucuc

SEQ ID NO: 2774777 - RNA, 14 nt, Leptospira interrogans serovar lai str. 56601
uuuuguaaguuuuc

SEQ ID NO: 2774778 - RNA, 20 nt, Leptospira interrogans serovar lai str. 56601
uuuuguaaguuuuccauucu

SEQ ID NO: 2774779 - RNA, 17 nt, Leptospira interrogans serovar lai str. 56601
uuuuguaaguuuugaau

SEQ ID NO: 2774780 - RNA, 11 nt, Leptospira interrogans serovar lai str. 56601
uuuuguagaau

SEQ ID NO: 2774781 - RNA, 19 nt, Leptospira interrogans serovar lai str. 56601
uuuuguagagucaaaaguu

SEQ ID NO: 2774782 - RNA, 14 nt, Leptospira interrogans serovar lai str. 56601
uuuuguaguaguuc

SEQ ID NO: 2774783 - RNA, 13 nt, Leptospira interrogans serovar lai str. 56601
uuuuguauugaaa

SEQ ID NO: 2774784 - RNA, 23 nt, Leptospira interrogans serovar lai str. 56601
uuuugucuccugucaauuuucca

SEQ ID NO: 2774785 - RNA, 16 nt, Leptospira interrogans serovar lai str. 56601
uuuugugaaacucaau

SEQ ID NO: 2774786 - RNA, 19 nt, Leptospira interrogans serovar lai str. 56601
uuuugugaaguuaaaacau

SEQ ID NO: 2774787 - RNA, 16 nt, Leptospira interrogans serovar lai str. 56601
uuuuguuagauucuau

SEQ ID NO: 2774788 - RNA, 17 nt, Leptospira interrogans serovar lai str. 56601
uuuuguuuguaaaauuu

SEQ ID NO: 2774789 - RNA, 19 nt, Leptospira interrogans serovar lai str. 56601
uuuuuaaaaauuuuauuaa

SEQ ID NO: 2774790 - RNA, 21 nt, Leptospira interrogans serovar lai str. 56601
uuuuuaaaaauuuuauuaaau

SEQ ID NO: 2774791 - RNA, 12 nt, Leptospira interrogans serovar lai str. 56601
uuuuuaaacauu

SEQ ID NO: 2774792 - RNA, 21 nt, Leptospira interrogans serovar lai str. 56601
uuuuuaaacuuuguuuuugcu

SEQ ID NO: 2774793 - RNA, 19 nt, Leptospira interrogans serovar lai str. 56601
uuuuuaaauuaauauuuau

SEQ ID NO: 2774794 - RNA, 11 nt, Leptospira interrogans serovar lai str. 56601
uuuuuaacaau

SEQ ID NO: 2774795 - RNA, 22 nt, Leptospira interrogans serovar lai str. 56601
uuuuuaagaaaacucaaaucua

SEQ ID NO: 2774796 - RNA, 22 nt, Leptospira interrogans serovar lai str. 56601
uuuuuaagagccuacaaaucga

SEQ ID NO: 2774797 - RNA, 15 nt, Leptospira interrogans serovar lai str. 56601
uuuuuaaguucaaaa

SEQ ID NO: 2774798 - RNA, 18 nt, Leptospira interrogans serovar lai str. 56601
uuuuuaauaaaaugcaau

SEQ ID NO: 2774799 - RNA, 18 nt, Leptospira interrogans serovar lai str. 56601
uuuuuaauauacugcaau

SEQ ID NO: 2774800 - RNA, 21 nt, Leptospira interrogans serovar lai str. 56601
uuuuuaauauuacauucaaua

SEQ ID NO: 2774801 - RNA, 23 nt, Leptospira interrogans serovar lai str. 56601
uuuuuaauauuacauucaauaau

SEQ ID NO: 2774802 - RNA, 14 nt, Leptospira interrogans serovar lai str. 56601
uuuuuaauauucaa

SEQ ID NO: 2774803 - RNA, 20 nt, Leptospira interrogans serovar lai str. 56601
uuuuuaaucaaaugcaguaa

SEQ ID NO: 2774804 - RNA, 15 nt, Leptospira interrogans serovar lai str. 56601
uuuuuaauuucggga

SEQ ID NO: 2774805 - RNA, 12 nt, Leptospira interrogans serovar lai str. 56601
uuuuuacagaaa

SEQ ID NO: 2774806 - RNA, 13 nt, Leptospira interrogans serovar lai str. 56601
uuuuuacagaaaa

SEQ ID NO: 2774807 - RNA, 14 nt, Leptospira interrogans serovar lai str. 56601
uuuuuacagaaaaa

SEQ ID NO: 2774808 - RNA, 24 nt, Leptospira interrogans serovar lai str. 56601
uuuuuacagaaaaccaaauaauaa

SEQ ID NO: 2774809 - RNA, 22 nt, Leptospira interrogans serovar lai str. 56601
uuuuuacauaagaccauauuga

SEQ ID NO: 2774810 - RNA, 13 nt, Leptospira interrogans serovar lai str. 56601
uuuuuacgaaaaa

SEQ ID NO: 2774811 - RNA, 18 nt, Leptospira interrogans serovar lai str. 56601
uuuuuacgaaaaaauuga

SEQ ID NO: 2774812 - RNA, 22 nt, Leptospira interrogans serovar lai str. 56601
uuuuuagaagcacggacauugu

SEQ ID NO: 2774813 - RNA, 16 nt, Leptospira interrogans serovar lai str. 56601
uuuuuauaaaaauaca

SEQ ID NO: 2774814 - RNA, 18 nt, Leptospira interrogans serovar lai str. 56601
uuuuuauaaaaauacagu

SEQ ID NO: 2774815 - RNA, 12 nt, Leptospira interrogans serovar lai str. 56601
uuuuuauaaaau

SEQ ID NO: 2774816 - RNA, 22 nt, Leptospira interrogans serovar lai str. 56601
uuuuuauaaaauaccaauaacu

SEQ ID NO: 2774817 - RNA, 13 nt, Leptospira interrogans serovar lai str. 56601
uuuuuaucauaaa

SEQ ID NO: 2774818 - RNA, 12 nt, Leptospira interrogans serovar lai str. 56601
uuuuuaugaaaa

SEQ ID NO: 2774819 - RNA, 13 nt, Leptospira interrogans serovar lai str. 56601
uuuuuauuauaua

SEQ ID NO: 2774820 - RNA, 12 nt, Leptospira interrogans serovar lai str. 56601
uuuuuauuucua

SEQ ID NO: 2774821 - RNA, 14 nt, Leptospira interrogans serovar lai str. 56601
uuuuucaaaaacuc

SEQ ID NO: 2774822 - RNA, 20 nt, Leptospira interrogans serovar lai str. 56601
uuuuucaaaaauuccaauaa

SEQ ID NO: 2774823 - RNA, 13 nt, Leptospira interrogans serovar lai str. 56601
uuuuucaaaauaa

SEQ ID NO: 2774824 - RNA, 13 nt, Leptospira interrogans serovar lai str. 56601
uuuuucaacaacu

SEQ ID NO: 2774825 - RNA, 19 nt, Leptospira interrogans serovar lai str. 56601
uuuuucaaucuaacccauu

SEQ ID NO: 2774826 - RNA, 16 nt, Leptospira interrogans serovar lai str. 56601
uuuuucacaaguuaaa

SEQ ID NO: 2774827 - RNA, 13 nt, Leptospira interrogans serovar lai str. 56601
uuuuucagaaaaa

SEQ ID NO: 2774828 - RNA, 16 nt, Leptospira interrogans serovar lai str. 56601
uuuuucagaaaaauga

SEQ ID NO: 2774829 - RNA, 16 nt, Leptospira interrogans serovar lai str. 56601
uuuuucauucuuucca

SEQ ID NO: 2774830 - RNA, 21 nt, Leptospira interrogans serovar lai str. 56601
uuuuuccaaaagcaaaaucga

SEQ ID NO: 2774831 - RNA, 18 nt, Leptospira interrogans serovar lai str. 56601
uuuuuccagcccauucuu

SEQ ID NO: 2774832 - RNA, 14 nt, Leptospira interrogans serovar lai str. 56601
uuuuuccauaaaaa

SEQ ID NO: 2774833 - RNA, 20 nt, Leptospira interrogans serovar lai str. 56601
uuuuuccauaaaaaacauaa

SEQ ID NO: 2774834 - RNA, 13 nt, Leptospira interrogans serovar lai str. 56601
uuuuuccguaaau

SEQ ID NO: 2774835 - RNA, 18 nt, Leptospira interrogans serovar lai str. 56601
uuuuucgaacuauuuuuu

SEQ ID NO: 2774836 - RNA, 15 nt, Leptospira interrogans serovar lai str. 56601
uuuuucggagucaua

SEQ ID NO: 2774837 - RNA, 21 nt, Leptospira interrogans serovar lai str. 56601
uuuuucgguucgggauuuuuu

SEQ ID NO: 2774838 - RNA, 19 nt, Leptospira interrogans serovar lai str. 56601
uuuuucuaaauuuuauaaa

SEQ ID NO: 2774839 - RNA, 18 nt, Leptospira interrogans serovar lai str. 56601
uuuuucuaguaguuccca

SEQ ID NO: 2774840 - RNA, 12 nt, Leptospira interrogans serovar lai str. 56601
uuuuucugaaaa

SEQ ID NO: 2774841 - RNA, 20 nt, Leptospira interrogans serovar lai str. 56601
uuuuucugaaaaaagcugaa

SEQ ID NO: 2774842 - RNA, 20 nt, Leptospira interrogans serovar lai str. 56601
uuuuucugaaaaaaguugaa

SEQ ID NO: 2774843 - RNA, 15 nt, Leptospira interrogans serovar lai str. 56601
uuuuucugaaaaagu

SEQ ID NO: 2774844 - RNA, 14 nt, Leptospira interrogans serovar lai str. 56601
uuuuugaaacauuu

SEQ ID NO: 2774845 - RNA, 21 nt, Leptospira interrogans serovar lai str. 56601
uuuuugaaacauuucuaaaau

SEQ ID NO: 2774846 - RNA, 13 nt, Leptospira interrogans serovar lai str. 56601
uuuuugaaaugca

SEQ ID NO: 2774847 - RNA, 16 nt, Leptospira interrogans serovar lai str. 56601
uuuuugagcccagaac

SEQ ID NO: 2774848 - RNA, 15 nt, Leptospira interrogans serovar lai str. 56601
uuuuugauuuuagaa

SEQ ID NO: 2774849 - RNA, 13 nt, Leptospira interrogans serovar lai str. 56601
uuuuugcaaaaaa

SEQ ID NO: 2774850 - RNA, 22 nt, Leptospira interrogans serovar lai str. 56601
uuuuugcaaguaaaaagacuca

SEQ ID NO: 2774851 - RNA, 19 nt, Leptospira interrogans serovar lai str. 56601
uuuuuggaaaucgaaaacc

SEQ ID NO: 2774852 - RNA, 15 nt, Leptospira interrogans serovar lai str. 56601
uuuuuguaaaaucca

SEQ ID NO: 2774853 - RNA, 18 nt, Leptospira interrogans serovar lai str. 56601
uuuuuguaaaauccagaa

SEQ ID NO: 2774854 - RNA, 20 nt, Leptospira interrogans serovar lai str. 56601
uuuuuguaaaggaagauaaa

SEQ ID NO: 2774855 - RNA, 21 nt, Leptospira interrogans serovar lai str. 56601
uuuuuguaaggauuccuuucc

SEQ ID NO: 2774856 - RNA, 12 nt, Leptospira interrogans serovar lai str. 56601
uuuuuguauaua

SEQ ID NO: 2774857 - RNA, 18 nt, Leptospira interrogans serovar lai str. 56601
uuuuuguaugaguuccua

SEQ ID NO: 2774858 - RNA, 17 nt, Leptospira interrogans serovar lai str. 56601
uuuuugugaaacucaau

SEQ ID NO: 2774859 - RNA, 13 nt, Leptospira interrogans serovar lai str. 56601
uuuuuuaaaugca

SEQ ID NO: 2774860 - RNA, 17 nt, Leptospira interrogans serovar lai str. 56601
uuuuuuaacauuuguuu

SEQ ID NO: 2774861 - RNA, 13 nt, Leptospira interrogans serovar lai str. 56601
uuuuuuaagaauc

SEQ ID NO: 2774862 - RNA, 14 nt, Leptospira interrogans serovar lai str. 56601
uuuuuuaagaaucu

SEQ ID NO: 2774863 - RNA, 23 nt, Leptospira interrogans serovar lai str. 56601
uuuuuuacgaaaaaauugacuua

SEQ ID NO: 2774864 - RNA, 20 nt, Leptospira interrogans serovar lai str. 56601
uuuuuuagaguuaagagaau

SEQ ID NO: 2774865 - RNA, 13 nt, Leptospira interrogans serovar lai str. 56601
uuuuuuauuuaaa

SEQ ID NO: 2774866 - RNA, 12 nt, Leptospira interrogans serovar lai str. 56601
uuuuuuauuucu

SEQ ID NO: 2774867 - RNA, 13 nt, Leptospira interrogans serovar lai str. 56601
uuuuuuauuuuau

SEQ ID NO: 2774868 - RNA, 13 nt, Leptospira interrogans serovar lai str. 56601
uuuuuucuaaaau

SEQ ID NO: 2774869 - RNA, 16 nt, Leptospira interrogans serovar lai str. 56601
uuuuuucuaaaauauu

SEQ ID NO: 2774870 - RNA, 12 nt, Leptospira interrogans serovar lai str. 56601
uuuuuucuaaau

SEQ ID NO: 2774871 - RNA, 13 nt, Leptospira interrogans serovar lai str. 56601
uuuuuucuuagac

SEQ ID NO: 2774872 - RNA, 17 nt, Leptospira interrogans serovar lai str. 56601
uuuuuuuaaaaaauuca

SEQ ID NO: 2774873 - RNA, 20 nt, Leptospira interrogans serovar lai str. 56601
uuuuuuuaugaaaaaauuca

SEQ ID NO: 2774874 - RNA, 14 nt, Leptospira interrogans serovar lai str. 56601
aaaaaaaaagaauu

SEQ ID NO: 2774875 - RNA, 13 nt, Leptospira interrogans serovar lai str. 56601
aaaaaaaaaugag

SEQ ID NO: 2774876 - RNA, 14 nt, Leptospira interrogans serovar lai str. 56601
aaaaaaaacaaaga

SEQ ID NO: 2774877 - RNA, 11 nt, Leptospira interrogans serovar lai str. 56601
aaaaaaaaugu

SEQ ID NO: 2774878 - RNA, 13 nt, Leptospira interrogans serovar lai str. 56601
aaaaaaacaaaga

SEQ ID NO: 2774879 - RNA, 12 nt, Leptospira interrogans serovar lai str. 56601
aaaaaaacauga

SEQ ID NO: 2774880 - RNA, 13 nt, Leptospira interrogans serovar lai str. 56601
aaaaaaaguaauu

SEQ ID NO: 2774881 - RNA, 13 nt, Leptospira interrogans serovar lai str. 56601
aaaaaaauaaaau

SEQ ID NO: 2774882 - RNA, 20 nt, Leptospira interrogans serovar lai str. 56601
aaaaaaauaauauauuuaua

SEQ ID NO: 2774883 - RNA, 21 nt, Leptospira interrogans serovar lai str. 56601
aaaaaaauagcgauacuuaaa

SEQ ID NO: 2774884 - RNA, 15 nt, Leptospira interrogans serovar lai str. 56601
aaaaaaauauuucaa

SEQ ID NO: 2774885 - RNA, 20 nt, Leptospira interrogans serovar lai str. 56601
aaaaaaaucaggcuuuauaa

SEQ ID NO: 2774886 - RNA, 13 nt, Leptospira interrogans serovar lai str. 56601
aaaaaaaugauuu

SEQ ID NO: 2774887 - RNA, 13 nt, Leptospira interrogans serovar lai str. 56601
aaaaaaauguuua

SEQ ID NO: 2774888 - RNA, 13 nt, Leptospira interrogans serovar lai str. 56601
aaaaaaauuaaaa

SEQ ID NO: 2774889 - RNA, 12 nt, Leptospira interrogans serovar lai str. 56601
aaaaaaauuaga

SEQ ID NO: 2774890 - RNA, 13 nt, Leptospira interrogans serovar lai str. 56601
aaaaaaauuuuua

SEQ ID NO: 2774891 - RNA, 21 nt, Leptospira interrogans serovar lai str. 56601
aaaaaacgaaucauauuuaac

SEQ ID NO: 2774892 - RNA, 17 nt, Leptospira interrogans serovar lai str. 56601
aaaaaacuuucuuaaau

SEQ ID NO: 2774893 - RNA, 13 nt, Leptospira interrogans serovar lai str. 56601
aaaaaacuuuuua

SEQ ID NO: 2774894 - RNA, 16 nt, Leptospira interrogans serovar lai str. 56601
aaaaaacuuuuuaaaa

SEQ ID NO: 2774895 - RNA, 13 nt, Leptospira interrogans serovar lai str. 56601
aaaaaagacuuaa

SEQ ID NO: 2774896 - RNA, 13 nt, Leptospira interrogans serovar lai str. 56601
aaaaaagauaaaa

SEQ ID NO: 2774897 - RNA, 18 nt, Leptospira interrogans serovar lai str. 56601
aaaaaagcauauugauaa

SEQ ID NO: 2774898 - RNA, 15 nt, Leptospira interrogans serovar lai str. 56601
aaaaaagcgaaagaa

SEQ ID NO: 2774899 - RNA, 15 nt, Leptospira interrogans serovar lai str. 56601
aaaaaagcugaacuu

SEQ ID NO: 2774900 - RNA, 16 nt, Leptospira interrogans serovar lai str. 56601
aaaaaaguaauuacuc

SEQ ID NO: 2774901 - RNA, 17 nt, Leptospira interrogans serovar lai str. 56601
aaaaaaguauauauuaa

SEQ ID NO: 2774902 - RNA, 19 nt, Leptospira interrogans serovar lai str. 56601
aaaaaaguauauauuaaag

SEQ ID NO: 2774903 - RNA, 13 nt, Leptospira interrogans serovar lai str. 56601
aaaaaaguuagaa

SEQ ID NO: 2774904 - RNA, 23 nt, Leptospira interrogans serovar lai str. 56601
aaaaaaguuagaauuugaacuuu

SEQ ID NO: 2774905 - RNA, 22 nt, Leptospira interrogans serovar lai str. 56601
aaaaaaguugaaaucugaauuu

SEQ ID NO: 2774906 - RNA, 13 nt, Leptospira interrogans serovar lai str. 56601
aaaaaaguuggaa

SEQ ID NO: 2774907 - RNA, 21 nt, Leptospira interrogans serovar lai str. 56601
aaaaaaguuggaaucugaauu

SEQ ID NO: 2774908 - RNA, 22 nt, Leptospira interrogans serovar lai str. 56601
aaaaaaguuggaaucugaauuu

SEQ ID NO: 2774909 - RNA, 22 nt, Leptospira interrogans serovar lai str. 56601
aaaaaaguuggaauuugaauuu

SEQ ID NO: 2774910 - RNA, 22 nt, Leptospira interrogans serovar lai str. 56601
aaaaaaguugggaucugaauuu

SEQ ID NO: 2774911 - RNA, 20 nt, Leptospira interrogans serovar lai str. 56601
aaaaaaguuuauacuucaaa

SEQ ID NO: 2774912 - RNA, 12 nt, Leptospira interrogans serovar lai str. 56601
aaaaaauaaaau

SEQ ID NO: 2774913 - RNA, 17 nt, Leptospira interrogans serovar lai str. 56601
aaaaaauaaaucaugau

SEQ ID NO: 2774914 - RNA, 21 nt, Leptospira interrogans serovar lai str. 56601
aaaaaauaacgauacuuaaaa

SEQ ID NO: 2774915 - RNA, 15 nt, Leptospira interrogans serovar lai str. 56601
aaaaaauaauauuau

SEQ ID NO: 2774916 - RNA, 22 nt, Leptospira interrogans serovar lai str. 56601
aaaaaauacgauucgaaagauu

SEQ ID NO: 2774917 - RNA, 21 nt, Leptospira interrogans serovar lai str. 56601
aaaaaauacggcacucaauuu

SEQ ID NO: 2774918 - RNA, 14 nt, Leptospira interrogans serovar lai str. 56601
aaaaaauauuaaaa

SEQ ID NO: 2774919 - RNA, 20 nt, Leptospira interrogans serovar lai str. 56601
aaaaaauauuucaaaaauuu

SEQ ID NO: 2774920 - RNA, 14 nt, Leptospira interrogans serovar lai str. 56601
aaaaaauccccuuu

SEQ ID NO: 2774921 - RNA, 15 nt, Leptospira interrogans serovar lai str. 56601
aaaaaaugaauuuag

SEQ ID NO: 2774922 - RNA, 22 nt, Leptospira interrogans serovar lai str. 56601
aaaaaaugcauucaaaaaguuu

SEQ ID NO: 2774923 - RNA, 13 nt, Leptospira interrogans serovar lai str. 56601
aaaaaauggaaca

SEQ ID NO: 2774924 - RNA, 19 nt, Leptospira interrogans serovar lai str. 56601
aaaaaauguuuaaagaauu

SEQ ID NO: 2774925 - RNA, 17 nt, Leptospira interrogans serovar lai str. 56601
aaaaaauuauaucuuau

SEQ ID NO: 2774926 - RNA, 10 nt, Leptospira interrogans serovar lai str. 56601
aaaaaauuca

SEQ ID NO: 2774927 - RNA, 13 nt, Leptospira interrogans serovar lai str. 56601
aaaaaauucaauu

SEQ ID NO: 2774928 - RNA, 21 nt, Leptospira interrogans serovar lai str. 56601
aaaaaauucgauuucuacaau

SEQ ID NO: 2774929 - RNA, 14 nt, Leptospira interrogans serovar lai str. 56601
aaaaaauucuuucu

SEQ ID NO: 2774930 - RNA, 20 nt, Leptospira interrogans serovar lai str. 56601
aaaaaauuucuuaaaagauu

SEQ ID NO: 2774931 - RNA, 16 nt, Leptospira interrogans serovar lai str. 56601
aaaaaauuucuucaau

SEQ ID NO: 2774932 - RNA, 22 nt, Leptospira interrogans serovar lai str. 56601
aaaaaauuucuucaauuguuuu

SEQ ID NO: 2774933 - RNA, 12 nt, Leptospira interrogans serovar lai str. 56601
aaaaaauuuuac

SEQ ID NO: 2774934 - RNA, 23 nt, Leptospira interrogans serovar lai str. 56601
aaaaaauuuuacgcaaucauucu

SEQ ID NO: 2774935 - RNA, 19 nt, Leptospira interrogans serovar lai str. 56601
aaaaaauuuuacguuauaa

SEQ ID NO: 2774936 - RNA, 12 nt, Leptospira interrogans serovar lai str. 56601
aaaaaauuuuua

SEQ ID NO: 2774937 - RNA, 19 nt, Leptospira interrogans serovar lai str. 56601
aaaaaauuuuucuuaauuu

SEQ ID NO: 2774938 - RNA, 12 nt, Leptospira interrogans serovar lai str. 56601
aaaaaauuuuuu

SEQ ID NO: 2774939 - RNA, 14 nt, Leptospira interrogans serovar lai str. 56601
aaaaacaaaaucaa

SEQ ID NO: 2774940 - RNA, 16 nt, Leptospira interrogans serovar lai str. 56601
aaaaacaaauuaaguu

SEQ ID NO: 2774941 - RNA, 17 nt, Leptospira interrogans serovar lai str. 56601
aaaaacaaauuaaguuu

SEQ ID NO: 2774942 - RNA, 20 nt, Leptospira interrogans serovar lai str. 56601
aaaaacaaauuaaguuuaaa

SEQ ID NO: 2774943 - RNA, 18 nt, Leptospira interrogans serovar lai str. 56601
aaaaacaacucuucuucu

SEQ ID NO: 2774944 - RNA, 21 nt, Leptospira interrogans serovar lai str. 56601
aaaaacaagcucaauuuugaa

SEQ ID NO: 2774945 - RNA, 14 nt, Leptospira interrogans serovar lai str. 56601
aaaaacaauauucu

SEQ ID NO: 2774946 - RNA, 18 nt, Leptospira interrogans serovar lai str. 56601
aaaaacagcacuaaaagc

SEQ ID NO: 2774947 - RNA, 23 nt, Leptospira interrogans serovar lai str. 56601
aaaaacaguaucgaaaauuaaca

SEQ ID NO: 2774948 - RNA, 15 nt, Leptospira interrogans serovar lai str. 56601
aaaaacauaagaaua

SEQ ID NO: 2774949 - RNA, 23 nt, Leptospira interrogans serovar lai str. 56601
aaaaacaucagguacuuuauuua

SEQ ID NO: 2774950 - RNA, 18 nt, Leptospira interrogans serovar lai str. 56601
aaaaaccacaaaaacaaa

SEQ ID NO: 2774951 - RNA, 16 nt, Leptospira interrogans serovar lai str. 56601
aaaaaccccauuaaaa

SEQ ID NO: 2774952 - RNA, 24 nt, Leptospira interrogans serovar lai str. 56601
aaaaaccgcaaauuuuacauuguu

SEQ ID NO: 2774953 - RNA, 22 nt, Leptospira interrogans serovar lai str. 56601
aaaaaccgcucgcucaaagaag

SEQ ID NO: 2774954 - RNA, 21 nt, Leptospira interrogans serovar lai str. 56601
aaaaaccgucccaaaacaaua

SEQ ID NO: 2774955 - RNA, 22 nt, Leptospira interrogans serovar lai str. 56601
aaaaaccgucccaaaacaauag

SEQ ID NO: 2774956 - RNA, 18 nt, Leptospira interrogans serovar lai str. 56601
aaaaaccgucccaaaauc

SEQ ID NO: 2774957 - RNA, 19 nt, Leptospira interrogans serovar lai str. 56601
aaaaaccgucccaaaaucu

SEQ ID NO: 2774958 - RNA, 19 nt, Leptospira interrogans serovar lai str. 56601
aaaaaccguuccuuucaag

SEQ ID NO: 2774959 - RNA, 22 nt, Leptospira interrogans serovar lai str. 56601
aaaaacgaugagccaucuuuuu

SEQ ID NO: 2774960 - RNA, 20 nt, Leptospira interrogans serovar lai str. 56601
aaaaacgggcccaaauaaaa

SEQ ID NO: 2774961 - RNA, 21 nt, Leptospira interrogans serovar lai str. 56601
aaaaacgggcccaaauaaaaa

SEQ ID NO: 2774962 - RNA, 18 nt, Leptospira interrogans serovar lai str. 56601
aaaaacgguauuuaaaau

SEQ ID NO: 2774963 - RNA, 20 nt, Leptospira interrogans serovar lai str. 56601
aaaaacgguauuuaaaauua

SEQ ID NO: 2774964 - RNA, 16 nt, Leptospira interrogans serovar lai str. 56601
aaaaacgucaaaauuu

SEQ ID NO: 2774965 - RNA, 22 nt, Leptospira interrogans serovar lai str. 56601
aaaaacgucuaguccucuuuuu

SEQ ID NO: 2774966 - RNA, 20 nt, Leptospira interrogans serovar lai str. 56601
aaaaacguuuuguugaguuu

SEQ ID NO: 2774967 - RNA, 22 nt, Leptospira interrogans serovar lai str. 56601
aaaaacuaaaauacaaaauguu

SEQ ID NO: 2774968 - RNA, 17 nt, Leptospira interrogans serovar lai str. 56601
aaaaacuauaaaucauu

SEQ ID NO: 2774969 - RNA, 18 nt, Leptospira interrogans serovar lai str. 56601
aaaaacuauuuaauauag

SEQ ID NO: 2774970 - RNA, 19 nt, Leptospira interrogans serovar lai str. 56601
aaaaacuauuuaauauagg

SEQ ID NO: 2774971 - RNA, 19 nt, Leptospira interrogans serovar lai str. 56601
aaaaacucuaccuuuauuu

SEQ ID NO: 2774972 - RNA, 21 nt, Leptospira interrogans serovar lai str. 56601
aaaaacucuauuagaauuguu

SEQ ID NO: 2774973 - RNA, 22 nt, Leptospira interrogans serovar lai str. 56601
aaaaacuuaugcuauuuaauuu

SEQ ID NO: 2774974 - RNA, 23 nt, Leptospira interrogans serovar lai str. 56601
aaaaacuuucggaauaaaacccu

SEQ ID NO: 2774975 - RNA, 18 nt, Leptospira interrogans serovar lai str. 56601
aaaaacuuucuaaaaaua

SEQ ID NO: 2774976 - RNA, 20 nt, Leptospira interrogans serovar lai str. 56601
aaaaacuuucuaaaaauaag

SEQ ID NO: 2774977 - RNA, 21 nt, Leptospira interrogans serovar lai str. 56601
aaaaacuuuuuaaaacgauuu

SEQ ID NO: 2774978 - RNA, 22 nt, Leptospira interrogans serovar lai str. 56601
aaaaaucaccguccaaucaaau

SEQ ID NO: 2774979 - RNA, 22 nt, Leptospira interrogans serovar lai str. 56601
aaaaaucaggcuuuauaaaaug

SEQ ID NO: 2774980 - RNA, 21 nt, Leptospira interrogans serovar lai str. 56601
aaaaaucagguuuuauaaagu

SEQ ID NO: 2774981 - RNA, 13 nt, Leptospira interrogans serovar lai str. 56601
aaaaaucauaaaa

SEQ ID NO: 2774982 - RNA, 12 nt, Leptospira interrogans serovar lai str. 56601
aaaaauccauga

SEQ ID NO: 2774983 - RNA, 14 nt, Leptospira interrogans serovar lai str. 56601
aaaaauccaugauu

SEQ ID NO: 2774984 - RNA, 10 nt, Leptospira interrogans serovar lai str. 56601
aaaaaucgau

SEQ ID NO: 2774985 - RNA, 18 nt, Leptospira interrogans serovar lai str. 56601
aaaaaucggcauucaauu

SEQ ID NO: 2774986 - RNA, 14 nt, Leptospira interrogans serovar lai str. 56601
aaaaaucucuuuua

SEQ ID NO: 2774987 - RNA, 23 nt, Leptospira interrogans serovar lai str. 56601
aaaaaugaaagguaauuuugaag

SEQ ID NO: 2774988 - RNA, 23 nt, Leptospira interrogans serovar lai str. 56601
aaaaaugaaucaugaauuccuua

SEQ ID NO: 2774989 - RNA, 15 nt, Leptospira interrogans serovar lai str. 56601
aaaaaugaauuuuuc

SEQ ID NO: 2774990 - RNA, 15 nt, Leptospira interrogans serovar lai str. 56601
aaaaaugaauuuuuu

SEQ ID NO: 2774991 - RNA, 19 nt, Leptospira interrogans serovar lai str. 56601
aaaaaugaauuuuuuauua

SEQ ID NO: 2774992 - RNA, 16 nt, Leptospira interrogans serovar lai str. 56601
aaaaaugaguaaacua

SEQ ID NO: 2774993 - RNA, 17 nt, Leptospira interrogans serovar lai str. 56601
aaaaaugaugcaaauuc

SEQ ID NO: 2774994 - RNA, 20 nt, Leptospira interrogans serovar lai str. 56601
aaaaaugcaaaaguuuucaa

SEQ ID NO: 2774995 - RNA, 18 nt, Leptospira interrogans serovar lai str. 56601
aaaaauguaaaaaaauau

SEQ ID NO: 2774996 - RNA, 22 nt, Leptospira interrogans serovar lai str. 56601
aaaaauguaaaaaaauauuaaa

SEQ ID NO: 2774997 - RNA, 23 nt, Leptospira interrogans serovar lai str. 56601
aaaaauguaaucucgauuucuaa

SEQ ID NO: 2774998 - RNA, 24 nt, Leptospira interrogans serovar lai str. 56601
aaaaauguaaucucgauuucuaaa

SEQ ID NO: 2774999 - RNA, 21 nt, Leptospira interrogans serovar lai str. 56601
aaaaauguauccaauccaaaa

SEQ ID NO: 2775000 - RNA, 21 nt, Leptospira interrogans serovar lai str. 56601
aaaaauguauucuauaaaauu

SEQ ID NO: 2775001 - RNA, 22 nt, Leptospira interrogans serovar lai str. 56601
aaaaauguauucuauaaaauuu

SEQ ID NO: 2775002 - RNA, 16 nt, Leptospira interrogans serovar lai str. 56601
aaaaaugugccuuuuu

SEQ ID NO: 2775003 - RNA, 19 nt, Leptospira interrogans serovar lai str. 56601
aaaaaugugccuuuuugag

SEQ ID NO: 2775004 - RNA, 18 nt, Leptospira interrogans serovar lai str. 56601
aaaaaugugggaauucuu

SEQ ID NO: 2775005 - RNA, 22 nt, Leptospira interrogans serovar lai str. 56601
aaaaauguuuagacuucucuuu

SEQ ID NO: 2775006 - RNA, 15 nt, Leptospira interrogans serovar lai str. 56601
aaaaauuaaaauucu

SEQ ID NO: 2775007 - RNA, 19 nt, Leptospira interrogans serovar lai str. 56601
aaaaauuaaaauucuagaa

SEQ ID NO: 2775008 - RNA, 21 nt, Leptospira interrogans serovar lai str. 56601
aaaaauuaaacccauuuuaga

SEQ ID NO: 2775009 - RNA, 21 nt, Leptospira interrogans serovar lai str. 56601
aaaaauuaacuuucuucgauu

SEQ ID NO: 2775010 - RNA, 14 nt, Leptospira interrogans serovar lai str. 56601
aaaaauuaauuuua

SEQ ID NO: 2775011 - RNA, 12 nt, Leptospira interrogans serovar lai str. 56601
aaaaauuagaac

SEQ ID NO: 2775012 - RNA, 20 nt, Leptospira interrogans serovar lai str. 56601
aaaaauuagaaucugaaccu

SEQ ID NO: 2775013 - RNA, 20 nt, Leptospira interrogans serovar lai str. 56601
aaaaauuagagaaguuaaaa

SEQ ID NO: 2775014 - RNA, 19 nt, Leptospira interrogans serovar lai str. 56601
aaaaauucaacuaaauccu

SEQ ID NO: 2775015 - RNA, 24 nt, Leptospira interrogans serovar lai str. 56601
aaaaauucaacuaaauccuucuuu

SEQ ID NO: 2775016 - RNA, 23 nt, Leptospira interrogans serovar lai str. 56601
aaaaauucaacuuguaaaacagc

SEQ ID NO: 2775017 - RNA, 12 nt, Leptospira interrogans serovar lai str. 56601
aaaaauucaauu

SEQ ID NO: 2775018 - RNA, 18 nt, Leptospira interrogans serovar lai str. 56601
aaaaauucauaauaaaac

SEQ ID NO: 2775019 - RNA, 20 nt, Leptospira interrogans serovar lai str. 56601
aaaaauuccacuucucacaa

SEQ ID NO: 2775020 - RNA, 22 nt, Leptospira interrogans serovar lai str. 56601
aaaaauuccauagugaagauuu

SEQ ID NO: 2775021 - RNA, 22 nt, Leptospira interrogans serovar lai str. 56601
aaaaauucguuuuacuucgucu

SEQ ID NO: 2775022 - RNA, 14 nt, Leptospira interrogans serovar lai str. 56601
aaaaauucuaauau

SEQ ID NO: 2775023 - RNA, 16 nt, Leptospira interrogans serovar lai str. 56601
aaaaauucuaauauaa

SEQ ID NO: 2775024 - RNA, 13 nt, Leptospira interrogans serovar lai str. 56601
aaaaauucuuaau

SEQ ID NO: 2775025 - RNA, 18 nt, Leptospira interrogans serovar lai str. 56601
aaaaauucuuaauauacu

SEQ ID NO: 2775026 - RNA, 19 nt, Leptospira interrogans serovar lai str. 56601
aaaaauucuuaauauacuu

SEQ ID NO: 2775027 - RNA, 22 nt, Leptospira interrogans serovar lai str. 56601
aaaaauucuuucucguuuucuu

SEQ ID NO: 2775028 - RNA, 16 nt, Leptospira interrogans serovar lai str. 56601
aaaaauugagauaggu

SEQ ID NO: 2775029 - RNA, 24 nt, Leptospira interrogans serovar lai str. 56601
aaaaauugaucucgauucugauaa

SEQ ID NO: 2775030 - RNA, 16 nt, Leptospira interrogans serovar lai str. 56601
aaaaauuguaaacuuc

SEQ ID NO: 2775031 - RNA, 17 nt, Leptospira interrogans serovar lai str. 56601
aaaaauuguaaacuucu

SEQ ID NO: 2775032 - RNA, 15 nt, Leptospira interrogans serovar lai str. 56601
aaaaauuguugaaga

SEQ ID NO: 2775033 - RNA, 19 nt, Leptospira interrogans serovar lai str. 56601
aaaaauuguugaagaauua

SEQ ID NO: 2775034 - RNA, 13 nt, Leptospira interrogans serovar lai str. 56601
aaaaauuuaauuu

SEQ ID NO: 2775035 - RNA, 16 nt, Leptospira interrogans serovar lai str. 56601
aaaaauuuaauuuuuu

SEQ ID NO: 2775036 - RNA, 18 nt, Leptospira interrogans serovar lai str. 56601
aaaaauuuaauuuuuuag

SEQ ID NO: 2775037 - RNA, 15 nt, Leptospira interrogans serovar lai str. 56601
aaaaauuuauucucu

SEQ ID NO: 2775038 - RNA, 18 nt, Leptospira interrogans serovar lai str. 56601
aaaaauuuauucucuauc

SEQ ID NO: 2775039 - RNA, 20 nt, Leptospira interrogans serovar lai str. 56601
aaaaauuucccuaguuccaa

SEQ ID NO: 2775040 - RNA, 20 nt, Leptospira interrogans serovar lai str. 56601
aaaaauuuccggaaaacgaa

SEQ ID NO: 2775041 - RNA, 16 nt, Leptospira interrogans serovar lai str. 56601
aaaaauuucuucaauu

SEQ ID NO: 2775042 - RNA, 20 nt, Leptospira interrogans serovar lai str. 56601
aaaaauuucuuugucuuuau

SEQ ID NO: 2775043 - RNA, 23 nt, Leptospira interrogans serovar lai str. 56601
aaaaauuugauauauuuuuaaag

SEQ ID NO: 2775044 - RNA, 15 nt, Leptospira interrogans serovar lai str. 56601
aaaaauuuuauuaaa

SEQ ID NO: 2775045 - RNA, 16 nt, Leptospira interrogans serovar lai str. 56601
aaaaauuuuauuaaau

SEQ ID NO: 2775046 - RNA, 17 nt, Leptospira interrogans serovar lai str. 56601
aaaaauuuuauuaaaua

SEQ ID NO: 2775047 - RNA, 19 nt, Leptospira interrogans serovar lai str. 56601
aaaaauuuuauuaaauaaa

SEQ ID NO: 2775048 - RNA, 14 nt, Leptospira interrogans serovar lai str. 56601
aaaaauuuuccgaa

SEQ ID NO: 2775049 - RNA, 21 nt, Leptospira interrogans serovar lai str. 56601
aaaaauuuuuacgcguaauuu

SEQ ID NO: 2775050 - RNA, 16 nt, Leptospira interrogans serovar lai str. 56601
aaaaauuuuucuuaau

SEQ ID NO: 2775051 - RNA, 22 nt, Leptospira interrogans serovar lai str. 56601
aaaaauuuuucuuaauuucucu

SEQ ID NO: 2775052 - RNA, 14 nt, Leptospira interrogans serovar lai str. 56601
aaaaauuuuuuaaa

SEQ ID NO: 2775053 - RNA, 18 nt, Leptospira interrogans serovar lai str. 56601
aaaaauuuuuuaaacuua

SEQ ID NO: 2775054 - RNA, 15 nt, Leptospira interrogans serovar lai str. 56601
aaaaauuuuuuuaaa

SEQ ID NO: 2775055 - RNA, 13 nt, Leptospira interrogans serovar lai str. 56601
aaaacaaaaucaa

SEQ ID NO: 2775056 - RNA, 17 nt, Leptospira interrogans serovar lai str. 56601
aaaacaaacuuuuguaa

SEQ ID NO: 2775057 - RNA, 12 nt, Leptospira interrogans serovar lai str. 56601
aaaacaaauuaa

SEQ ID NO: 2775058 - RNA, 21 nt, Leptospira interrogans serovar lai str. 56601
aaaacaaauuaaguuuaaaaa

SEQ ID NO: 2775059 - RNA, 20 nt, Leptospira interrogans serovar lai str. 56601
aaaacaagcucaauuuugaa

SEQ ID NO: 2775060 - RNA, 18 nt, Leptospira interrogans serovar lai str. 56601
aaaagaaaaaucuucagu

SEQ ID NO: 2775061 - RNA, 14 nt, Leptospira interrogans serovar lai str. 56601
aaaagaaaaucaca

SEQ ID NO: 2775062 - RNA, 12 nt, Leptospira interrogans serovar lai str. 56601
aaaagaaaauua

SEQ ID NO: 2775063 - RNA, 14 nt, Leptospira interrogans serovar lai str. 56601
aaaagaaaauuauc

SEQ ID NO: 2775064 - RNA, 22 nt, Leptospira interrogans serovar lai str. 56601
aaaagaaaccuuuauagaauuc

SEQ ID NO: 2775065 - RNA, 19 nt, Leptospira interrogans serovar lai str. 56601
aaaagaaacggaagaaaau

SEQ ID NO: 2775066 - RNA, 21 nt, Leptospira interrogans serovar lai str. 56601
aaaagaaacggaagaaaauua

SEQ ID NO: 2775067 - RNA, 15 nt, Leptospira interrogans serovar lai str. 56601
aaaagaaacuuaaua

SEQ ID NO: 2775068 - RNA, 19 nt, Leptospira interrogans serovar lai str. 56601
aaaagaaagcagcaaagaa

SEQ ID NO: 2775069 - RNA, 19 nt, Leptospira interrogans serovar lai str. 56601
aaaagaaaguugcaaagaa

SEQ ID NO: 2775070 - RNA, 20 nt, Leptospira interrogans serovar lai str. 56601
aaaagaaauauuaaaaaaau

SEQ ID NO: 2775071 - RNA, 19 nt, Leptospira interrogans serovar lai str. 56601
aaaagaaauuuaauacaau

SEQ ID NO: 2775072 - RNA, 19 nt, Leptospira interrogans serovar lai str. 56601
aaaagaacuuugagaugag

SEQ ID NO: 2775073 - RNA, 18 nt, Leptospira interrogans serovar lai str. 56601
aaaagaagaaugaaaaaa

SEQ ID NO: 2775074 - RNA, 13 nt, Leptospira interrogans serovar lai str. 56601
aaaagaagaugcu

SEQ ID NO: 2775075 - RNA, 23 nt, Leptospira interrogans serovar lai str. 56601
aaaagaauauuauuauauuuaaa

SEQ ID NO: 2775076 - RNA, 14 nt, Leptospira interrogans serovar lai str. 56601
aaaagaauauuucu

SEQ ID NO: 2775077 - RNA, 21 nt, Leptospira interrogans serovar lai str. 56601
aaaagaaucaucgucuaauca

SEQ ID NO: 2775078 - RNA, 12 nt, Leptospira interrogans serovar lai str. 56601
aaaagaauugaa

SEQ ID NO: 2775079 - RNA, 17 nt, Leptospira interrogans serovar lai str. 56601
aaaagaauuucuaaaau

SEQ ID NO: 2775080 - RNA, 20 nt, Leptospira interrogans serovar lai str. 56601
aaaagaauuucuaaaauucu

SEQ ID NO: 2775081 - RNA, 21 nt, Leptospira interrogans serovar lai str. 56601
aaaagaauuucuaaaauucuu

SEQ ID NO: 2775082 - RNA, 15 nt, Leptospira interrogans serovar lai str. 56601
aaaagaauuuuuaaa

SEQ ID NO: 2775083 - RNA, 19 nt, Leptospira interrogans serovar lai str. 56601
aaaagacuauauucuucgc

SEQ ID NO: 2775084 - RNA, 13 nt, Leptospira interrogans serovar lai str. 56601
aaaagacucacac

SEQ ID NO: 2775085 - RNA, 20 nt, Leptospira interrogans serovar lai str. 56601
aaaagagacauugaagaaaa

SEQ ID NO: 2775086 - RNA, 16 nt, Leptospira interrogans serovar lai str. 56601
aaaagagccauaaaug

SEQ ID NO: 2775087 - RNA, 16 nt, Leptospira interrogans serovar lai str. 56601
aaaagaguaauucuaa

SEQ ID NO: 2775088 - RNA, 17 nt, Leptospira interrogans serovar lai str. 56601
aaaagaguauuaucuuu

SEQ ID NO: 2775089 - RNA, 12 nt, Leptospira interrogans serovar lai str. 56601
aaaagauaaaaa

SEQ ID NO: 2775090 - RNA, 16 nt, Leptospira interrogans serovar lai str. 56601
aaaagauaaaaagaga

SEQ ID NO: 2775091 - RNA, 20 nt, Leptospira interrogans serovar lai str. 56601
aaaagauaccgggccuuuuu

SEQ ID NO: 2775092 - RNA, 14 nt, Leptospira interrogans serovar lai str. 56601
aaaagauagaaguu

SEQ ID NO: 2775093 - RNA, 23 nt, Leptospira interrogans serovar lai str. 56601
aaaagauuaucuucuaauuaaau

SEQ ID NO: 2775094 - RNA, 13 nt, Leptospira interrogans serovar lai str. 56601
aaaagauuucaaa

SEQ ID NO: 2775095 - RNA, 13 nt, Leptospira interrogans serovar lai str. 56601
aaaagauuuguuu

SEQ ID NO: 2775096 - RNA, 12 nt, Leptospira interrogans serovar lai str. 56601
aaaagcacaaaa

SEQ ID NO: 2775097 - RNA, 22 nt, Leptospira interrogans serovar lai str. 56601
aaaagcaccuucuaaauuccaa

SEQ ID NO: 2775098 - RNA, 17 nt, Leptospira interrogans serovar lai str. 56601
aaaagcagcuaaaaaga

SEQ ID NO: 2775099 - RNA, 20 nt, Leptospira interrogans serovar lai str. 56601
aaaagcagcuaaaaagaaag

SEQ ID NO: 2775100 - RNA, 23 nt, Leptospira interrogans serovar lai str. 56601
aaaagccauuucaaaaauauauu

SEQ ID NO: 2775101 - RNA, 17 nt, Leptospira interrogans serovar lai str. 56601
aaaagccgcgaucuaac

SEQ ID NO: 2775102 - RNA, 23 nt, Leptospira interrogans serovar lai str. 56601
aaaagcgucaacugaaacucuau

SEQ ID NO: 2775103 - RNA, 18 nt, Leptospira interrogans serovar lai str. 56601
aaaagcugaacuuaaaau

SEQ ID NO: 2775104 - RNA, 20 nt, Leptospira interrogans serovar lai str. 56601
aaaagcugaacuuaaaaucu

SEQ ID NO: 2775105 - RNA, 23 nt, Leptospira interrogans serovar lai str. 56601
aaaagcuuauacuuuaagaaaau

SEQ ID NO: 2775106 - RNA, 19 nt, Leptospira interrogans serovar lai str. 56601
aaaagcuuuugcuuuuaaa

SEQ ID NO: 2775107 - RNA, 20 nt, Leptospira interrogans serovar lai str. 56601
aaaagcuuuugcuuuuaaag

SEQ ID NO: 2775108 - RNA, 14 nt, Leptospira interrogans serovar lai str. 56601
aaaaggaauacaau

SEQ ID NO: 2775109 - RNA, 22 nt, Leptospira interrogans serovar lai str. 56601
aaaaggagaauucaauuuauaa

SEQ ID NO: 2775110 - RNA, 20 nt, Leptospira interrogans serovar lai str. 56601
aaaaggagccaacacauucc

SEQ ID NO: 2775111 - RNA, 17 nt, Leptospira interrogans serovar lai str. 56601
aaaaggaguaauucuaa

SEQ ID NO: 2775112 - RNA, 15 nt, Leptospira interrogans serovar lai str. 56601
aaaaggcucucuuuu

SEQ ID NO: 2775113 - RNA, 15 nt, Leptospira interrogans serovar lai str. 56601
aaaaggguuuuuaca

SEQ ID NO: 2775114 - RNA, 19 nt, Leptospira interrogans serovar lai str. 56601
aaaagguauaaaauaaaaa

SEQ ID NO: 2775115 - RNA, 13 nt, Leptospira interrogans serovar lai str. 56601
aaaagguuaaaaa

SEQ ID NO: 2775116 - RNA, 16 nt, Leptospira interrogans serovar lai str. 56601
aaaagguuaaaaauuu

SEQ ID NO: 2775117 - RNA, 17 nt, Leptospira interrogans serovar lai str. 56601
aaaagguuaaaaauuua

SEQ ID NO: 2775118 - RNA, 21 nt, Leptospira interrogans serovar lai str. 56601
aaaaguaaaacccaauaccaa

SEQ ID NO: 2775119 - RNA, 14 nt, Leptospira interrogans serovar lai str. 56601
aaaaguaacguaaa

SEQ ID NO: 2775120 - RNA, 22 nt, Leptospira interrogans serovar lai str. 56601
aaaaguaauuacuccuaggcau

SEQ ID NO: 2775121 - RNA, 14 nt, Leptospira interrogans serovar lai str. 56601
aaaaguagaaagau

SEQ ID NO: 2775122 - RNA, 17 nt, Leptospira interrogans serovar lai str. 56601
aaaaguauaauuuaaaa

SEQ ID NO: 2775123 - RNA, 16 nt, Leptospira interrogans serovar lai str. 56601
aaaaguauguuuuucu

SEQ ID NO: 2775124 - RNA, 18 nt, Leptospira interrogans serovar lai str. 56601
aaaaguauguuuuucuaa

SEQ ID NO: 2775125 - RNA, 18 nt, Leptospira interrogans serovar lai str. 56601
aaaaguauguuuuucuga

SEQ ID NO: 2775126 - RNA, 13 nt, Leptospira interrogans serovar lai str. 56601
aaaagucaaaaaa

SEQ ID NO: 2775127 - RNA, 14 nt, Leptospira interrogans serovar lai str. 56601
aaaagucaaaaaau

SEQ ID NO: 2775128 - RNA, 17 nt, Leptospira interrogans serovar lai str. 56601
aaaaguccaaaacaaag

SEQ ID NO: 2775129 - RNA, 15 nt, Leptospira interrogans serovar lai str. 56601
aaaaguccaauuuua

SEQ ID NO: 2775130 - RNA, 18 nt, Leptospira interrogans serovar lai str. 56601
aaaaguccaauuuuaaaa

SEQ ID NO: 2775131 - RNA, 22 nt, Leptospira interrogans serovar lai str. 56601
aaaaguccaauuuuaaaaccaa

SEQ ID NO: 2775132 - RNA, 23 nt, Leptospira interrogans serovar lai str. 56601
aaaagucccaauuccaccuugga

SEQ ID NO: 2775133 - RNA, 17 nt, Leptospira interrogans serovar lai str. 56601
aaaaguccuuuugagca

SEQ ID NO: 2775134 - RNA, 15 nt, Leptospira interrogans serovar lai str. 56601
aaaagucgaaagaau

SEQ ID NO: 2775135 - RNA, 16 nt, Leptospira interrogans serovar lai str. 56601
aaaagucgaaagaauu

SEQ ID NO: 2775136 - RNA, 16 nt, Leptospira interrogans serovar lai str. 56601
aaaagucugucuuaaa

SEQ ID NO: 2775137 - RNA, 23 nt, Leptospira interrogans serovar lai str. 56601
aaaagucugucuuaaaauuugaa

SEQ ID NO: 2775138 - RNA, 12 nt, Leptospira interrogans serovar lai str. 56601
aaaagugaauua

SEQ ID NO: 2775139 - RNA, 21 nt, Leptospira interrogans serovar lai str. 56601
aaaagugaguuuucuuccguu

SEQ ID NO: 2775140 - RNA, 14 nt, Leptospira interrogans serovar lai str. 56601
aaaaguuagaaucu

SEQ ID NO: 2775141 - RNA, 18 nt, Leptospira interrogans serovar lai str. 56601
aaaaguugcuaagaaaaa

SEQ ID NO: 2775142 - RNA, 14 nt, Leptospira interrogans serovar lai str. 56601
aaaaguuggaauuu

SEQ ID NO: 2775143 - RNA, 23 nt, Leptospira interrogans serovar lai str. 56601
aaaaucauauccaauuucaauuu

SEQ ID NO: 2775144 - RNA, 13 nt, Leptospira interrogans serovar lai str. 56601
aaaaucaugauuc

SEQ ID NO: 2775145 - RNA, 14 nt, Leptospira interrogans serovar lai str. 56601
aaaaucaugucuca

SEQ ID NO: 2775146 - RNA, 17 nt, Leptospira interrogans serovar lai str. 56601
aaaauccagaauaauaa

SEQ ID NO: 2775147 - RNA, 19 nt, Leptospira interrogans serovar lai str. 56601
aaaauccauaucuacaaaa

SEQ ID NO: 2775148 - RNA, 18 nt, Leptospira interrogans serovar lai str. 56601
aaaaucccagaaaggaac

SEQ ID NO: 2775149 - RNA, 20 nt, Leptospira interrogans serovar lai str. 56601
aaaauccccaguauuuugca

SEQ ID NO: 2775150 - RNA, 23 nt, Leptospira interrogans serovar lai str. 56601
aaaauccguagccgcuucaaagu

SEQ ID NO: 2775151 - RNA, 19 nt, Leptospira interrogans serovar lai str. 56601
aaaauccucaacagauacg

SEQ ID NO: 2775152 - RNA, 18 nt, Leptospira interrogans serovar lai str. 56601
aaaaucggauaguuuaaa

SEQ ID NO: 2775153 - RNA, 21 nt, Leptospira interrogans serovar lai str. 56601
aaaaucggauaguuuaaauuc

SEQ ID NO: 2775154 - RNA, 14 nt, Leptospira interrogans serovar lai str. 56601
aaaaucguaaaaaa

SEQ ID NO: 2775155 - RNA, 17 nt, Leptospira interrogans serovar lai str. 56601
aaaaucguaaaaaagau

SEQ ID NO: 2775156 - RNA, 22 nt, Leptospira interrogans serovar lai str. 56601
aaaaucgugauuugugggaguu

SEQ ID NO: 2775157 - RNA, 13 nt, Leptospira interrogans serovar lai str. 56601
aaaaucuaaaaaa

SEQ ID NO: 2775158 - RNA, 16 nt, Leptospira interrogans serovar lai str. 56601
aaaaucuaaaaaaaau

SEQ ID NO: 2775159 - RNA, 15 nt, Leptospira interrogans serovar lai str. 56601
aaaaucuaaaaaaac

SEQ ID NO: 2775160 - RNA, 17 nt, Leptospira interrogans serovar lai str. 56601
aaaaucuaaaaaaacaa

SEQ ID NO: 2775161 - RNA, 18 nt, Leptospira interrogans serovar lai str. 56601
aaaaucuaaaaaaacaau

SEQ ID NO: 2775162 - RNA, 14 nt, Leptospira interrogans serovar lai str. 56601
aaaaucuaaaaaga

SEQ ID NO: 2775163 - RNA, 15 nt, Leptospira interrogans serovar lai str. 56601
aaaaucuaaaaauaa

SEQ ID NO: 2775164 - RNA, 15 nt, Leptospira interrogans serovar lai str. 56601
aaaaucuaaauuugu

SEQ ID NO: 2775165 - RNA, 19 nt, Leptospira interrogans serovar lai str. 56601
aaaaucuaaauuuguaaua

SEQ ID NO: 2775166 - RNA, 16 nt, Leptospira interrogans serovar lai str. 56601
aaaaucucagaaaauu

SEQ ID NO: 2775167 - RNA, 17 nt, Leptospira interrogans serovar lai str. 56601
aaaaucucagaaaauuu

SEQ ID NO: 2775168 - RNA, 13 nt, Leptospira interrogans serovar lai str. 56601
aaaaucucuuuua

SEQ ID NO: 2775169 - RNA, 20 nt, Leptospira interrogans serovar lai str. 56601
aaaaucugaauuuuaccaaa

SEQ ID NO: 2775170 - RNA, 19 nt, Leptospira interrogans serovar lai str. 56601
aaaaucuggauuuugaucu

SEQ ID NO: 2775171 - RNA, 15 nt, Leptospira interrogans serovar lai str. 56601
aaaaucuuaaaagaa

SEQ ID NO: 2775172 - RNA, 19 nt, Leptospira interrogans serovar lai str. 56601
aaaaucuuaaaagaaaauc

SEQ ID NO: 2775173 - RNA, 18 nt, Leptospira interrogans serovar lai str. 56601
aaaaucuuaauaaaauuu

SEQ ID NO: 2775174 - RNA, 16 nt, Leptospira interrogans serovar lai str. 56601
aaaaucuucaaguuug

SEQ ID NO: 2775175 - RNA, 17 nt, Leptospira interrogans serovar lai str. 56601
aaaaucuucaaguuugu

SEQ ID NO: 2775176 - RNA, 15 nt, Leptospira interrogans serovar lai str. 56601
aaaaucuuuaaguuu

SEQ ID NO: 2775177 - RNA, 16 nt, Leptospira interrogans serovar lai str. 56601
aaaaucuuuaaguuug

SEQ ID NO: 2775178 - RNA, 15 nt, Leptospira interrogans serovar lai str. 56601
aaaaucuuuagaauu

SEQ ID NO: 2775179 - RNA, 18 nt, Leptospira interrogans serovar lai str. 56601
aaaaucuuuucuauaauc

SEQ ID NO: 2775180 - RNA, 22 nt, Leptospira interrogans serovar lai str. 56601
aaaaucuuuucuauaaucugaa

SEQ ID NO: 2775181 - RNA, 13 nt, Leptospira interrogans serovar lai str. 56601
aaaaugaaaaaaa

SEQ ID NO: 2775182 - RNA, 17 nt, Leptospira interrogans serovar lai str. 56601
aaaaugaaaaaaaacaa

SEQ ID NO: 2775183 - RNA, 19 nt, Leptospira interrogans serovar lai str. 56601
aaaaugaaaaaaaacaaag

SEQ ID NO: 2775184 - RNA, 11 nt, Leptospira interrogans serovar lai str. 56601
aaaaugaaaac

SEQ ID NO: 2775185 - RNA, 13 nt, Leptospira interrogans serovar lai str. 56601
aaaaugaaaauua

SEQ ID NO: 2775186 - RNA, 16 nt, Leptospira interrogans serovar lai str. 56601
aaaaugaaaucuacaa

SEQ ID NO: 2775187 - RNA, 14 nt, Leptospira interrogans serovar lai str. 56601
aaaaugaacucaac

SEQ ID NO: 2775188 - RNA, 16 nt, Leptospira interrogans serovar lai str. 56601
aaaaugaagaaacacu

SEQ ID NO: 2775189 - RNA, 20 nt, Leptospira interrogans serovar lai str. 56601
aaaaugaaucaugaauuccu

SEQ ID NO: 2775190 - RNA, 14 nt, Leptospira interrogans serovar lai str. 56601
aaaaugaaugauag

SEQ ID NO: 2775191 - RNA, 21 nt, Leptospira interrogans serovar lai str. 56601
aaaaugaauguuuaaaauuua

SEQ ID NO: 2775192 - RNA, 14 nt, Leptospira interrogans serovar lai str. 56601
aaaaugaauucucu

SEQ ID NO: 2775193 - RNA, 16 nt, Leptospira interrogans serovar lai str. 56601
aaaaugaauucucuau

SEQ ID NO: 2775194 - RNA, 15 nt, Leptospira interrogans serovar lai str. 56601
aaaaugaauuguaaa

SEQ ID NO: 2775195 - RNA, 13 nt, Leptospira interrogans serovar lai str. 56601
aaaaugaccaaaa

SEQ ID NO: 2775196 - RNA, 20 nt, Leptospira interrogans serovar lai str. 56601
aaaaugagaaagaauuucua

SEQ ID NO: 2775197 - RNA, 19 nt, Leptospira interrogans serovar lai str. 56601
aaaaugaguuauaguaaaa

SEQ ID NO: 2775198 - RNA, 15 nt, Leptospira interrogans serovar lai str. 56601
aaaaugauguaggaa

SEQ ID NO: 2775199 - RNA, 17 nt, Leptospira interrogans serovar lai str. 56601
aaaaugcagcaaaaccu

SEQ ID NO: 2775200 - RNA, 21 nt, Leptospira interrogans serovar lai str. 56601
aaaaugcagcaaaaccuucgu

SEQ ID NO: 2775201 - RNA, 22 nt, Leptospira interrogans serovar lai str. 56601
aaaaugcaguaguuccuacaau

SEQ ID NO: 2775202 - RNA, 20 nt, Leptospira interrogans serovar lai str. 56601
aaaaugcauucaaaaaguuu

SEQ ID NO: 2775203 - RNA, 13 nt, Leptospira interrogans serovar lai str. 56601
aaaaugcucaaaa

SEQ ID NO: 2775204 - RNA, 14 nt, Leptospira interrogans serovar lai str. 56601
aaaaugcuguaacu

SEQ ID NO: 2775205 - RNA, 17 nt, Leptospira interrogans serovar lai str. 56601
aaaaugcuguaacucau

SEQ ID NO: 2775206 - RNA, 16 nt, Leptospira interrogans serovar lai str. 56601
aaaauggaaaaaagau

SEQ ID NO: 2775207 - RNA, 14 nt, Leptospira interrogans serovar lai str. 56601
aaaauggagaacuu

SEQ ID NO: 2775208 - RNA, 18 nt, Leptospira interrogans serovar lai str. 56601
aaaauggauacuuauuau

SEQ ID NO: 2775209 - RNA, 15 nt, Leptospira interrogans serovar lai str. 56601
aaaauggauuuauaa

SEQ ID NO: 2775210 - RNA, 21 nt, Leptospira interrogans serovar lai str. 56601
aaaauggguuuucauuuuuac

SEQ ID NO: 2775211 - RNA, 21 nt, Leptospira interrogans serovar lai str. 56601
aaaaugguuuucuauuuuugg

SEQ ID NO: 2775212 - RNA, 13 nt, Leptospira interrogans serovar lai str. 56601
aaaaugguuuuuu

SEQ ID NO: 2775213 - RNA, 14 nt, Leptospira interrogans serovar lai str. 56601
aaaauguaaaaaaa

SEQ ID NO: 2775214 - RNA, 14 nt, Leptospira interrogans serovar lai str. 56601
aaaauguaaaaacu

SEQ ID NO: 2775215 - RNA, 21 nt, Leptospira interrogans serovar lai str. 56601
aaaauguagccaaaaauuaga

SEQ ID NO: 2775216 - RNA, 18 nt, Leptospira interrogans serovar lai str. 56601
aaaauguauccaauccaa

SEQ ID NO: 2775217 - RNA, 21 nt, Leptospira interrogans serovar lai str. 56601
aaaauguauccaauccaaaau

SEQ ID NO: 2775218 - RNA, 16 nt, Leptospira interrogans serovar lai str. 56601
aaaauguggaaacuau

SEQ ID NO: 2775219 - RNA, 11 nt, Leptospira interrogans serovar lai str. 56601
aaaauguggga

SEQ ID NO: 2775220 - RNA, 13 nt, Leptospira interrogans serovar lai str. 56601
aaaauguuaaaaa

SEQ ID NO: 2775221 - RNA, 14 nt, Leptospira interrogans serovar lai str. 56601
aaaauguuaaaaaa

SEQ ID NO: 2775222 - RNA, 18 nt, Leptospira interrogans serovar lai str. 56601
aaaauguuaaaaaacuau

SEQ ID NO: 2775223 - RNA, 14 nt, Leptospira interrogans serovar lai str. 56601
aaaauguuuaaaga

SEQ ID NO: 2775224 - RNA, 14 nt, Leptospira interrogans serovar lai str. 56601
aaaauguuuuauuu

SEQ ID NO: 2775225 - RNA, 12 nt, Leptospira interrogans serovar lai str. 56601
aaaauuaaaaaa

SEQ ID NO: 2775226 - RNA, 14 nt, Leptospira interrogans serovar lai str. 56601
aaaauuaaaaaaga

SEQ ID NO: 2775227 - RNA, 15 nt, Leptospira interrogans serovar lai str. 56601
aaaauuuuauaaaaa

SEQ ID NO: 2775228 - RNA, 16 nt, Leptospira interrogans serovar lai str. 56601
aaaauuuuauaaaaau

SEQ ID NO: 2775229 - RNA, 18 nt, Leptospira interrogans serovar lai str. 56601
aaaauuuuauaaaaaucu

SEQ ID NO: 2775230 - RNA, 20 nt, Leptospira interrogans serovar lai str. 56601
aaaauuuuauaauagaguua

SEQ ID NO: 2775231 - RNA, 18 nt, Leptospira interrogans serovar lai str. 56601
aaaauuuucauuuuauac

SEQ ID NO: 2775232 - RNA, 13 nt, Leptospira interrogans serovar lai str. 56601
aaaauuuuccgaa

SEQ ID NO: 2775233 - RNA, 19 nt, Leptospira interrogans serovar lai str. 56601
aaaauuuucuaaaaguagu

SEQ ID NO: 2775234 - RNA, 11 nt, Leptospira interrogans serovar lai str. 56601
aaaauuuuuaa

SEQ ID NO: 2775235 - RNA, 16 nt, Leptospira interrogans serovar lai str. 56601
aaaauuuuuaaaaaau

SEQ ID NO: 2775236 - RNA, 16 nt, Leptospira interrogans serovar lai str. 56601
aaaauuuuuaauaaaa

SEQ ID NO: 2775237 - RNA, 18 nt, Leptospira interrogans serovar lai str. 56601
aaaauuuuuaauaaaaug

SEQ ID NO: 2775238 - RNA, 15 nt, Leptospira interrogans serovar lai str. 56601
aaaauuuuuaugacu

SEQ ID NO: 2775239 - RNA, 21 nt, Leptospira interrogans serovar lai str. 56601
aaaauuuuuaugacuucuuaa

SEQ ID NO: 2775240 - RNA, 11 nt, Leptospira interrogans serovar lai str. 56601
aaaauuuuucu

SEQ ID NO: 2775241 - RNA, 15 nt, Leptospira interrogans serovar lai str. 56601
aaaauuuuucucccu

SEQ ID NO: 2775242 - RNA, 16 nt, Leptospira interrogans serovar lai str. 56601
aaaauuuuucucccuu

SEQ ID NO: 2775243 - RNA, 15 nt, Leptospira interrogans serovar lai str. 56601
aaaauuuuuguguaa

SEQ ID NO: 2775244 - RNA, 17 nt, Leptospira interrogans serovar lai str. 56601
aaaauuuuuucuuuuua

SEQ ID NO: 2775245 - RNA, 21 nt, Leptospira interrogans serovar lai str. 56601
aaaauuuuuucuuuuuaggaa

SEQ ID NO: 2775246 - RNA, 21 nt, Leptospira interrogans serovar lai str. 56601
aaaauuuuuuugauucaaaaa

SEQ ID NO: 2775247 - RNA, 14 nt, Leptospira interrogans serovar lai str. 56601
aaaauuuuuuugua

SEQ ID NO: 2775248 - RNA, 23 nt, Leptospira interrogans serovar lai str. 56601
aaacaaaaucggcgccugcauuu

SEQ ID NO: 2775249 - RNA, 16 nt, Leptospira interrogans serovar lai str. 56601
aaacaaagaauaaauc

SEQ ID NO: 2775250 - RNA, 12 nt, Leptospira interrogans serovar lai str. 56601
aaacaaagagcc

SEQ ID NO: 2775251 - RNA, 15 nt, Leptospira interrogans serovar lai str. 56601
aaacaaauggagaau

SEQ ID NO: 2775252 - RNA, 19 nt, Leptospira interrogans serovar lai str. 56601
aaacaaauuaaguuuaaaa

SEQ ID NO: 2775253 - RNA, 22 nt, Leptospira interrogans serovar lai str. 56601
aaacaaauuaaguuuaaaaaca

SEQ ID NO: 2775254 - RNA, 11 nt, Leptospira interrogans serovar lai str. 56601
aaacaaauuca

SEQ ID NO: 2775255 - RNA, 11 nt, Leptospira interrogans serovar lai str. 56601
aaacaaauucu

SEQ ID NO: 2775256 - RNA, 20 nt, Leptospira interrogans serovar lai str. 56601
aaacaagcucaauuuugaag

SEQ ID NO: 2775257 - RNA, 23 nt, Leptospira interrogans serovar lai str. 56601
aaacaauagcuucuuuaaaaacu

SEQ ID NO: 2775258 - RNA, 22 nt, Leptospira interrogans serovar lai str. 56601
aaacaauauucuaauuuuauaa

SEQ ID NO: 2775259 - RNA, 16 nt, Leptospira interrogans serovar lai str. 56601
aaacaaucuuagaaug

SEQ ID NO: 2775260 - RNA, 22 nt, Leptospira interrogans serovar lai str. 56601
aaacaaucuuagaaugugggaa

SEQ ID NO: 2775261 - RNA, 11 nt, Leptospira interrogans serovar lai str. 56601
aaacaauuuuu

SEQ ID NO: 2775262 - RNA, 12 nt, Leptospira interrogans serovar lai str. 56601
aaacaauuuuuc

SEQ ID NO: 2775263 - RNA, 15 nt, Leptospira interrogans serovar lai str. 56601
aaacaauuuuucaag

SEQ ID NO: 2775264 - RNA, 12 nt, Leptospira interrogans serovar lai str. 56601
aaacaauuuuuu

SEQ ID NO: 2775265 - RNA, 17 nt, Leptospira interrogans serovar lai str. 56601
aaacaauuuuuugaaaa

SEQ ID NO: 2775266 - RNA, 18 nt, Leptospira interrogans serovar lai str. 56601
aaacaccacaauuuacaa

SEQ ID NO: 2775267 - RNA, 21 nt, Leptospira interrogans serovar lai str. 56601
aaacaccuucucuuuuaaaaa

SEQ ID NO: 2775268 - RNA, 14 nt, Leptospira interrogans serovar lai str. 56601
aaacacgaauuccu

SEQ ID NO: 2775269 - RNA, 16 nt, Leptospira interrogans serovar lai str. 56601
aaacacucuaaaucuu

SEQ ID NO: 2775270 - RNA, 14 nt, Leptospira interrogans serovar lai str. 56601
aaacacuuugagaa

SEQ ID NO: 2775271 - RNA, 20 nt, Leptospira interrogans serovar lai str. 56601
aaacacuuugagaaagaaca

SEQ ID NO: 2775272 - RNA, 15 nt, Leptospira interrogans serovar lai str. 56601
aaacagagauaggaa

SEQ ID NO: 2775273 - RNA, 20 nt, Leptospira interrogans serovar lai str. 56601
aaacagagauaggaauguuu

SEQ ID NO: 2775274 - RNA, 20 nt, Leptospira interrogans serovar lai str. 56601
aaacagagcuuuacaauaaa

SEQ ID NO: 2775275 - RNA, 23 nt, Leptospira interrogans serovar lai str. 56601
aaacagagcuuuacaauaaaaau

SEQ ID NO: 2775276 - RNA, 13 nt, Leptospira interrogans serovar lai str. 56601
aaacaggaaaauu

SEQ ID NO: 2775277 - RNA, 15 nt, Leptospira interrogans serovar lai str. 56601
aaacagguaaaccug

SEQ ID NO: 2775278 - RNA, 18 nt, Leptospira interrogans serovar lai str. 56601
aaacagucgcuaaacuca

SEQ ID NO: 2775279 - RNA, 13 nt, Leptospira interrogans serovar lai str. 56601
aaacauaaaaauu

SEQ ID NO: 2775280 - RNA, 21 nt, Leptospira interrogans serovar lai str. 56601
aaacauaaaaauuuuuuaaac

SEQ ID NO: 2775281 - RNA, 14 nt, Leptospira interrogans serovar lai str. 56601
aaacauaagaauau

SEQ ID NO: 2775282 - RNA, 21 nt, Leptospira interrogans serovar lai str. 56601
aaacauaagaauauuauaaau

SEQ ID NO: 2775283 - RNA, 20 nt, Leptospira interrogans serovar lai str. 56601
aaacauaauacgauaauauu

SEQ ID NO: 2775284 - RNA, 22 nt, Leptospira interrogans serovar lai str. 56601
aaacauacuuuuugcaaguaaa

SEQ ID NO: 2775285 - RNA, 12 nt, Leptospira interrogans serovar lai str. 56601
aaacaucuagau

SEQ ID NO: 2775286 - RNA, 20 nt, Leptospira interrogans serovar lai str. 56601
aaacauuagaguuguugaaa

SEQ ID NO: 2775287 - RNA, 12 nt, Leptospira interrogans serovar lai str. 56601
aaacauuauauc

SEQ ID NO: 2775288 - RNA, 23 nt, Leptospira interrogans serovar lai str. 56601
aaacauuauuucaaugcaaaaaa

SEQ ID NO: 2775289 - RNA, 15 nt, Leptospira interrogans serovar lai str. 56601
aaacauucaaauuuc

SEQ ID NO: 2775290 - RNA, 14 nt, Leptospira interrogans serovar lai str. 56601
aaacauuccaauuu

SEQ ID NO: 2775291 - RNA, 18 nt, Leptospira interrogans serovar lai str. 56601
aaacauuggaacuuuuua

SEQ ID NO: 2775292 - RNA, 22 nt, Leptospira interrogans serovar lai str. 56601
aaacauuggaacuuuuuaucau

SEQ ID NO: 2775293 - RNA, 14 nt, Leptospira interrogans serovar lai str. 56601
aaaccaaauaauaa

SEQ ID NO: 2775294 - RNA, 12 nt, Leptospira interrogans serovar lai str. 56601
aaaccaauuccg

SEQ ID NO: 2775295 - RNA, 16 nt, Leptospira interrogans serovar lai str. 56601
aaaccaccaaccgaaa

SEQ ID NO: 2775296 - RNA, 20 nt, Leptospira interrogans serovar lai str. 56601
aaaccacccccaccaaaaau

SEQ ID NO: 2775297 - RNA, 14 nt, Leptospira interrogans serovar lai str. 56601
aaaccauaaaauaa

SEQ ID NO: 2775298 - RNA, 15 nt, Leptospira interrogans serovar lai str. 56601
aaaccauaaaauaaa

SEQ ID NO: 2775299 - RNA, 17 nt, Leptospira interrogans serovar lai str. 56601
aaaccauaaaauaaaaa

SEQ ID NO: 2775300 - RNA, 19 nt, Leptospira interrogans serovar lai str. 56601
aaaccaucgauuuacuuua

SEQ ID NO: 2775301 - RNA, 17 nt, Leptospira interrogans serovar lai str. 56601
aaaccaucucaaaaaca

SEQ ID NO: 2775302 - RNA, 18 nt, Leptospira interrogans serovar lai str. 56601
aaacccaucguaaacaaa

SEQ ID NO: 2775303 - RNA, 17 nt, Leptospira interrogans serovar lai str. 56601
aaaccccaguaugaacc

SEQ ID NO: 2775304 - RNA, 17 nt, Leptospira interrogans serovar lai str. 56601
aaaccccauuaaaaagc

SEQ ID NO: 2775305 - RNA, 14 nt, Leptospira interrogans serovar lai str. 56601
aaacccugccaaaa

SEQ ID NO: 2775306 - RNA, 16 nt, Leptospira interrogans serovar lai str. 56601
aaacccugccaaaauc

SEQ ID NO: 2775307 - RNA, 19 nt, Leptospira interrogans serovar lai str. 56601
aaacccugccaaaauccca

SEQ ID NO: 2775308 - RNA, 13 nt, Leptospira interrogans serovar lai str. 56601
aaacccuuucuuu

SEQ ID NO: 2775309 - RNA, 19 nt, Leptospira interrogans serovar lai str. 56601
aaacccuuucuuugaagaa

SEQ ID NO: 2775310 - RNA, 17 nt, Leptospira interrogans serovar lai str. 56601
aaacucaguaaacucaa

SEQ ID NO: 2775311 - RNA, 15 nt, Leptospira interrogans serovar lai str. 56601
aaacucauaaaauaa

SEQ ID NO: 2775312 - RNA, 16 nt, Leptospira interrogans serovar lai str. 56601
aaacucauaaaauaac

SEQ ID NO: 2775313 - RNA, 15 nt, Leptospira interrogans serovar lai str. 56601
aaacucauuuuaaac

SEQ ID NO: 2775314 - RNA, 21 nt, Leptospira interrogans serovar lai str. 56601
aaacucauuuuucuaaaaaaa

SEQ ID NO: 2775315 - RNA, 22 nt, Leptospira interrogans serovar lai str. 56601
aaacucuauuagaauuguugaa

SEQ ID NO: 2775316 - RNA, 22 nt, Leptospira interrogans serovar lai str. 56601
aaacucuuaaucugcugaauuu

SEQ ID NO: 2775317 - RNA, 16 nt, Leptospira interrogans serovar lai str. 56601
aaacucuuuaaaaacu

SEQ ID NO: 2775318 - RNA, 17 nt, Leptospira interrogans serovar lai str. 56601
aaacucuuuauuuuuaa

SEQ ID NO: 2775319 - RNA, 19 nt, Leptospira interrogans serovar lai str. 56601
aaacucuuuauuuuuaacg

SEQ ID NO: 2775320 - RNA, 15 nt, Leptospira interrogans serovar lai str. 56601
aaacugauuaaaauc

SEQ ID NO: 2775321 - RNA, 16 nt, Leptospira interrogans serovar lai str. 56601
aaacugauuaaaauca

SEQ ID NO: 2775322 - RNA, 14 nt, Leptospira interrogans serovar lai str. 56601
aaacugauuuaauu

SEQ ID NO: 2775323 - RNA, 18 nt, Leptospira interrogans serovar lai str. 56601
aaacugucaugaugauug

SEQ ID NO: 2775324 - RNA, 15 nt, Leptospira interrogans serovar lai str. 56601
aaacugucggaauua

SEQ ID NO: 2775325 - RNA, 13 nt, Leptospira interrogans serovar lai str. 56601
aaacuuaaaaugu

SEQ ID NO: 2775326 - RNA, 13 nt, Leptospira interrogans serovar lai str. 56601
aaacuuaaaucuc

SEQ ID NO: 2775327 - RNA, 14 nt, Leptospira interrogans serovar lai str. 56601
aaacuuaaauucgg

SEQ ID NO: 2775328 - RNA, 16 nt, Leptospira interrogans serovar lai str. 56601
aaacuuaaauucggaa

SEQ ID NO: 2775329 - RNA, 15 nt, Leptospira interrogans serovar lai str. 56601
aaacuuaaucucaug

SEQ ID NO: 2775330 - RNA, 19 nt, Leptospira interrogans serovar lai str. 56601
aaacuuaaugagauuaaaa

SEQ ID NO: 2775331 - RNA, 23 nt, Leptospira interrogans serovar lai str. 56601
aaacuuagcagaacgcucucuca

SEQ ID NO: 2775332 - RNA, 16 nt, Leptospira interrogans serovar lai str. 56601
aaacuuagguuuugua

SEQ ID NO: 2775333 - RNA, 14 nt, Leptospira interrogans serovar lai str. 56601
aaacuuauacuuua

SEQ ID NO: 2775334 - RNA, 16 nt, Leptospira interrogans serovar lai str. 56601
aaacuucaaaaaauau

SEQ ID NO: 2775335 - RNA, 18 nt, Leptospira interrogans serovar lai str. 56601
aaacuucucuuaaaauuu

SEQ ID NO: 2775336 - RNA, 22 nt, Leptospira interrogans serovar lai str. 56601
aaacuucucuuaaaauuuagaa

SEQ ID NO: 2775337 - RNA, 19 nt, Leptospira interrogans serovar lai str. 56601
aaacuucuucaucuuacca

SEQ ID NO: 2775338 - RNA, 16 nt, Leptospira interrogans serovar lai str. 56601
aaacuugauauuucug

SEQ ID NO: 2775339 - RNA, 15 nt, Leptospira interrogans serovar lai str. 56601
aaacuuguaagacuc

SEQ ID NO: 2775340 - RNA, 15 nt, Leptospira interrogans serovar lai str. 56601
aaacuugucccaaaa

SEQ ID NO: 2775341 - RNA, 17 nt, Leptospira interrogans serovar lai str. 56601
aaacuugucccaaaauu

SEQ ID NO: 2775342 - RNA, 22 nt, Leptospira interrogans serovar lai str. 56601
aaacuuguuguaccauuuugau

SEQ ID NO: 2775343 - RNA, 13 nt, Leptospira interrogans serovar lai str. 56601
aaacuuguuuuag

SEQ ID NO: 2775344 - RNA, 22 nt, Leptospira interrogans serovar lai str. 56601
aaacuuuagaauguaaaagcuu

SEQ ID NO: 2775345 - RNA, 18 nt, Leptospira interrogans serovar lai str. 56601
aaacuuucaaaauaggaa

SEQ ID NO: 2775346 - RNA, 18 nt, Leptospira interrogans serovar lai str. 56601
aaacuuuccacuuuucuc

SEQ ID NO: 2775347 - RNA, 11 nt, Leptospira interrogans serovar lai str. 56601
aaacuuucuuc

SEQ ID NO: 2775348 - RNA, 22 nt, Leptospira interrogans serovar lai str. 56601
aaacuuucuuccaauuguucca

SEQ ID NO: 2775349 - RNA, 16 nt, Leptospira interrogans serovar lai str. 56601
aaacuuucuuuuucuu

SEQ ID NO: 2775350 - RNA, 16 nt, Leptospira interrogans serovar lai str. 56601
aaacuuugaaaauugu

SEQ ID NO: 2775351 - RNA, 18 nt, Leptospira interrogans serovar lai str. 56601
aaacuuugagauguggga

SEQ ID NO: 2775352 - RNA, 13 nt, Leptospira interrogans serovar lai str. 56601
aaacuuuguaaau

SEQ ID NO: 2775353 - RNA, 12 nt, Leptospira interrogans serovar lai str. 56601
aaacuuuuaaag

SEQ ID NO: 2775354 - RNA, 16 nt, Leptospira interrogans serovar lai str. 56601
aaacuuuuaauaaaac

SEQ ID NO: 2775355 - RNA, 18 nt, Leptospira interrogans serovar lai str. 56601
aaacuuuuaauaaaacgu

SEQ ID NO: 2775356 - RNA, 15 nt, Leptospira interrogans serovar lai str. 56601
aaacuuuuagaauuc

SEQ ID NO: 2775357 - RNA, 15 nt, Leptospira interrogans serovar lai str. 56601
aaacuuuuaguaacu

SEQ ID NO: 2775358 - RNA, 16 nt, Leptospira interrogans serovar lai str. 56601
aaacuuuuauaaaauc

SEQ ID NO: 2775359 - RNA, 19 nt, Leptospira interrogans serovar lai str. 56601
aaacuuuucaucggaucua

SEQ ID NO: 2775360 - RNA, 12 nt, Leptospira interrogans serovar lai str. 56601
aaacuuuucuaa

SEQ ID NO: 2775361 - RNA, 14 nt, Leptospira interrogans serovar lai str. 56601
aaacuuuuuauaaa

SEQ ID NO: 2775362 - RNA, 20 nt, Leptospira interrogans serovar lai str. 56601
aaacuuuuuuagcaaauaac

SEQ ID NO: 2775363 - RNA, 20 nt, Leptospira interrogans serovar lai str. 56601
aaagaaaaacaggcgaauuu

SEQ ID NO: 2775364 - RNA, 12 nt, Leptospira interrogans serovar lai str. 56601
aaagaaaaccuu

SEQ ID NO: 2775365 - RNA, 19 nt, Leptospira interrogans serovar lai str. 56601
aaagaaacauaaugcaaua

SEQ ID NO: 2775366 - RNA, 13 nt, Leptospira interrogans serovar lai str. 56601
aaagaaacauuau

SEQ ID NO: 2775367 - RNA, 20 nt, Leptospira interrogans serovar lai str. 56601
aaagaaaccaaucauaguca

SEQ ID NO: 2775368 - RNA, 19 nt, Leptospira interrogans serovar lai str. 56601
aaagaaaccgaucuuaaaa

SEQ ID NO: 2775369 - RNA, 16 nt, Leptospira interrogans serovar lai str. 56601
aaagaaaccuuuauag

SEQ ID NO: 2775370 - RNA, 22 nt, Leptospira interrogans serovar lai str. 56601
aaagaaaccuuuauagaauuca

SEQ ID NO: 2775371 - RNA, 17 nt, Leptospira interrogans serovar lai str. 56601
aaagaaacggaagaaaa

SEQ ID NO: 2775372 - RNA, 15 nt, Leptospira interrogans serovar lai str. 56601
aaagaaacucauaaa

SEQ ID NO: 2775373 - RNA, 22 nt, Leptospira interrogans serovar lai str. 56601
aaagaaagcaaacuuuuuauaa

SEQ ID NO: 2775374 - RNA, 17 nt, Leptospira interrogans serovar lai str. 56601
aaagaaaguaauuuuga

SEQ ID NO: 2775375 - RNA, 18 nt, Leptospira interrogans serovar lai str. 56601
aaagaaccgguucagcua

SEQ ID NO: 2775376 - RNA, 15 nt, Leptospira interrogans serovar lai str. 56601
aaagaacgauuuuuu

SEQ ID NO: 2775377 - RNA, 17 nt, Leptospira interrogans serovar lai str. 56601
aaagaacguuuugcuaa

SEQ ID NO: 2775378 - RNA, 12 nt, Leptospira interrogans serovar lai str. 56601
aaagaacugccu

SEQ ID NO: 2775379 - RNA, 12 nt, Leptospira interrogans serovar lai str. 56601
aaagaagaaaua

SEQ ID NO: 2775380 - RNA, 23 nt, Leptospira interrogans serovar lai str. 56601
aaagaagauaaaacucaaaggaa

SEQ ID NO: 2775381 - RNA, 22 nt, Leptospira interrogans serovar lai str. 56601
aaagaaggcagcuaagaaaaaa

SEQ ID NO: 2775382 - RNA, 20 nt, Leptospira interrogans serovar lai str. 56601
aaagaagggaugaaauuuua

SEQ ID NO: 2775383 - RNA, 22 nt, Leptospira interrogans serovar lai str. 56601
aaagaagggaugaaauuuuaaa

SEQ ID NO: 2775384 - RNA, 23 nt, Leptospira interrogans serovar lai str. 56601
aaagaagucugguuuauuuuuga

SEQ ID NO: 2775385 - RNA, 23 nt, Leptospira interrogans serovar lai str. 56601
aaagaaguuguaucagauguuuu

SEQ ID NO: 2775386 - RNA, 16 nt, Leptospira interrogans serovar lai str. 56601
aaagaauaauauuuua

SEQ ID NO: 2775387 - RNA, 22 nt, Leptospira interrogans serovar lai str. 56601
aaagaauauuauuauauuuaaa

SEQ ID NO: 2775388 - RNA, 21 nt, Leptospira interrogans serovar lai str. 56601
aaagaaucauacaaucaaauu

SEQ ID NO: 2775389 - RNA, 20 nt, Leptospira interrogans serovar lai str. 56601
aaagaaucauuaaucagauu

SEQ ID NO: 2775390 - RNA, 19 nt, Leptospira interrogans serovar lai str. 56601
aaagaaucguuuuuuuugu

SEQ ID NO: 2775391 - RNA, 14 nt, Leptospira interrogans serovar lai str. 56601
aaagaaucuaauuu

SEQ ID NO: 2775392 - RNA, 15 nt, Leptospira interrogans serovar lai str. 56601
aaagaaucuuuuuaa

SEQ ID NO: 2775393 - RNA, 22 nt, Leptospira interrogans serovar lai str. 56601
aaaguaaucguuuaaagauuaa

SEQ ID NO: 2775394 - RNA, 13 nt, Leptospira interrogans serovar lai str. 56601
aaaguaaucuuuu

SEQ ID NO: 2775395 - RNA, 16 nt, Leptospira interrogans serovar lai str. 56601
aaaguaaucuuuuuaa

SEQ ID NO: 2775396 - RNA, 22 nt, Leptospira interrogans serovar lai str. 56601
aaaguaaucuuuuuaaaaguuu

SEQ ID NO: 2775397 - RNA, 21 nt, Leptospira interrogans serovar lai str. 56601
aaaguaauuuaucuguaauuu

SEQ ID NO: 2775398 - RNA, 13 nt, Leptospira interrogans serovar lai str. 56601
aaaguaauuuuga

SEQ ID NO: 2775399 - RNA, 14 nt, Leptospira interrogans serovar lai str. 56601
aaaguaauuuugaa

SEQ ID NO: 2775400 - RNA, 22 nt, Leptospira interrogans serovar lai str. 56601
aaaguagacauuuaaaugucua

SEQ ID NO: 2775401 - RNA, 14 nt, Leptospira interrogans serovar lai str. 56601
aaaguauaauauuu

SEQ ID NO: 2775402 - RNA, 16 nt, Leptospira interrogans serovar lai str. 56601
aaaguauaauuuaaaa

SEQ ID NO: 2775403 - RNA, 18 nt, Leptospira interrogans serovar lai str. 56601
aaaguauaauuuaaaauc

SEQ ID NO: 2775404 - RNA, 14 nt, Leptospira interrogans serovar lai str. 56601
aaaguaucagaauc

SEQ ID NO: 2775405 - RNA, 20 nt, Leptospira interrogans serovar lai str. 56601
aaaguaucagaaucaaagga

SEQ ID NO: 2775406 - RNA, 22 nt, Leptospira interrogans serovar lai str. 56601
aaaguaucuuagaauuguugaa

SEQ ID NO: 2775407 - RNA, 23 nt, Leptospira interrogans serovar lai str. 56601
aaaguauguuuuucugauaaaga

SEQ ID NO: 2775408 - RNA, 21 nt, Leptospira interrogans serovar lai str. 56601
aaaguauguuuuucugauaga

SEQ ID NO: 2775409 - RNA, 18 nt, Leptospira interrogans serovar lai str. 56601
aaaguauuaauuuaauca

SEQ ID NO: 2775410 - RNA, 22 nt, Leptospira interrogans serovar lai str. 56601
aaaguauucuuuccaaccauuu

SEQ ID NO: 2775411 - RNA, 22 nt, Leptospira interrogans serovar lai str. 56601
aaaguauuuuuaagauaaauua

SEQ ID NO: 2775412 - RNA, 16 nt, Leptospira interrogans serovar lai str. 56601
aaaguccaaaacaaag

SEQ ID NO: 2775413 - RNA, 16 nt, Leptospira interrogans serovar lai str. 56601
aaagucuauuucccaa

SEQ ID NO: 2775414 - RNA, 18 nt, Leptospira interrogans serovar lai str. 56601
aaagucugucuuaaaauu

SEQ ID NO: 2775415 - RNA, 22 nt, Leptospira interrogans serovar lai str. 56601
aaagucugucuuaaaauuugaa

SEQ ID NO: 2775416 - RNA, 12 nt, Leptospira interrogans serovar lai str. 56601
aaagugaauuuu

SEQ ID NO: 2775417 - RNA, 17 nt, Leptospira interrogans serovar lai str. 56601
aaagugaugaagagaaa

SEQ ID NO: 2775418 - RNA, 14 nt, Leptospira interrogans serovar lai str. 56601
aaagugguugaagu

SEQ ID NO: 2775419 - RNA, 13 nt, Leptospira interrogans serovar lai str. 56601
aaaguguaaacua

SEQ ID NO: 2775420 - RNA, 16 nt, Leptospira interrogans serovar lai str. 56601
aaaguguuaguuccca

SEQ ID NO: 2775421 - RNA, 18 nt, Leptospira interrogans serovar lai str. 56601
aaaguguuaguucccaca

SEQ ID NO: 2775422 - RNA, 15 nt, Leptospira interrogans serovar lai str. 56601
aaaguguucugcuaa

SEQ ID NO: 2775423 - RNA, 13 nt, Leptospira interrogans serovar lai str. 56601
aaaguguuuauaa

SEQ ID NO: 2775424 - RNA, 12 nt, Leptospira interrogans serovar lai str. 56601
aaaguuagaaua

SEQ ID NO: 2775425 - RNA, 12 nt, Leptospira interrogans serovar lai str. 56601
aaaguuagaauc

SEQ ID NO: 2775426 - RNA, 21 nt, Leptospira interrogans serovar lai str. 56601
aaaguuagaaucugaacuuua

SEQ ID NO: 2775427 - RNA, 18 nt, Leptospira interrogans serovar lai str. 56601
aaaguuauugaauagaau

SEQ ID NO: 2775428 - RNA, 14 nt, Leptospira interrogans serovar lai str. 56601
aaaguuauuucuuu

SEQ ID NO: 2775429 - RNA, 14 nt, Leptospira interrogans serovar lai str. 56601
aaaguucacaaauu

SEQ ID NO: 2775430 - RNA, 19 nt, Leptospira interrogans serovar lai str. 56601
aaaguucagauucgaacuu

SEQ ID NO: 2775431 - RNA, 22 nt, Leptospira interrogans serovar lai str. 56601
aaaguucucuucauccagauuc

SEQ ID NO: 2775432 - RNA, 13 nt, Leptospira interrogans serovar lai str. 56601
aaaguucuuuucu

SEQ ID NO: 2775433 - RNA, 21 nt, Leptospira interrogans serovar lai str. 56601
aaaguucuuuucuuaaaaaaa

SEQ ID NO: 2775434 - RNA, 22 nt, Leptospira interrogans serovar lai str. 56601
aaaguucuuuucuuaaaaaaau

SEQ ID NO: 2775435 - RNA, 13 nt, Leptospira interrogans serovar lai str. 56601
aaaguugaaaucu

SEQ ID NO: 2775436 - RNA, 20 nt, Leptospira interrogans serovar lai str. 56601
aaaguugagugccuaaauuu

SEQ ID NO: 2775437 - RNA, 16 nt, Leptospira interrogans serovar lai str. 56601
aaaguugauucuuccu

SEQ ID NO: 2775438 - RNA, 22 nt, Leptospira interrogans serovar lai str. 56601
aaaguugcaaagaagaaauaag

SEQ ID NO: 2775439 - RNA, 13 nt, Leptospira interrogans serovar lai str. 56601
aaaguugcuaaga

SEQ ID NO: 2775440 - RNA, 14 nt, Leptospira interrogans serovar lai str. 56601
aaaguuggaaucug

SEQ ID NO: 2775441 - RNA, 20 nt, Leptospira interrogans serovar lai str. 56601
aaaguuggaaucugaauuuu

SEQ ID NO: 2775442 - RNA, 20 nt, Leptospira interrogans serovar lai str. 56601
aaaguugggaucugaauuuu

SEQ ID NO: 2775443 - RNA, 15 nt, Leptospira interrogans serovar lai str. 56601
aaaguuuacacaaca

SEQ ID NO: 2775444 - RNA, 17 nt, Leptospira interrogans serovar lai str. 56601
aaaguuuagauuuuaac

SEQ ID NO: 2775445 - RNA, 20 nt, Leptospira interrogans serovar lai str. 56601
aaaguuuagauuuuaacuuu

SEQ ID NO: 2775446 - RNA, 22 nt, Leptospira interrogans serovar lai str. 56601
aaaguuuauaaacuucucaaau

SEQ ID NO: 2775447 - RNA, 16 nt, Leptospira interrogans serovar lai str. 56601
aaaguuucaucuuuga

SEQ ID NO: 2775448 - RNA, 20 nt, Leptospira interrogans serovar lai str. 56601
aaaguuucaucuuugaacuu

SEQ ID NO: 2775449 - RNA, 22 nt, Leptospira interrogans serovar lai str. 56601
aaaguuuccccaagacuuugaa

SEQ ID NO: 2775450 - RNA, 20 nt, Leptospira interrogans serovar lai str. 56601
aaaguuugggauauucugaa

SEQ ID NO: 2775451 - RNA, 23 nt, Leptospira interrogans serovar lai str. 56601
aaaguuugggauauucugaaagu

SEQ ID NO: 2775452 - RNA, 20 nt, Leptospira interrogans serovar lai str. 56601
aaaguuugggcgaauaaaaa

SEQ ID NO: 2775453 - RNA, 21 nt, Leptospira interrogans serovar lai str. 56601
aaaguuugggcgaauaaaaaa

SEQ ID NO: 2775454 - RNA, 17 nt, Leptospira interrogans serovar lai str. 56601
aaaguuuguaguaacuc

SEQ ID NO: 2775455 - RNA, 13 nt, Leptospira interrogans serovar lai str. 56601
aaaguuuucacaa

SEQ ID NO: 2775456 - RNA, 19 nt, Leptospira interrogans serovar lai str. 56601
aaaguuuucacaaaaaaau

SEQ ID NO: 2775457 - RNA, 18 nt, Leptospira interrogans serovar lai str. 56601
aaaguuuucucaaaaucu

SEQ ID NO: 2775458 - RNA, 22 nt, Leptospira interrogans serovar lai str. 56601
aaaguuuugcuguaaaauuuag

SEQ ID NO: 2775459 - RNA, 13 nt, Leptospira interrogans serovar lai str. 56601
aaaguuuuuaaaa

SEQ ID NO: 2775460 - RNA, 14 nt, Leptospira interrogans serovar lai str. 56601
aaaguuuuugacaa

SEQ ID NO: 2775461 - RNA, 14 nt, Leptospira interrogans serovar lai str. 56601
aaaguuuuuuaaaa

SEQ ID NO: 2775462 - RNA, 15 nt, Leptospira interrogans serovar lai str. 56601
aaaguuuuuuaaaaa

SEQ ID NO: 2775463 - RNA, 22 nt, Leptospira interrogans serovar lai str. 56601
aaaguuuuuuuauaaaauuaga

SEQ ID NO: 2775464 - RNA, 13 nt, Leptospira interrogans serovar lai str. 56601
aaauaaaaaacaa

SEQ ID NO: 2775465 - RNA, 16 nt, Leptospira interrogans serovar lai str. 56601
aaauaaaaaacaaaca

SEQ ID NO: 2775466 - RNA, 18 nt, Leptospira interrogans serovar lai str. 56601
aaauaaaaauuucagauu

SEQ ID NO: 2775467 - RNA, 13 nt, Leptospira interrogans serovar lai str. 56601
aaauaaaacuucu

SEQ ID NO: 2775468 - RNA, 15 nt, Leptospira interrogans serovar lai str. 56601
aaauaaaauguaaaa

SEQ ID NO: 2775469 - RNA, 21 nt, Leptospira interrogans serovar lai str. 56601
aaauaaaauguaaaaacuacc

SEQ ID NO: 2775470 - RNA, 12 nt, Leptospira interrogans serovar lai str. 56601
aaauaaagaaaa

SEQ ID NO: 2775471 - RNA, 13 nt, Leptospira interrogans serovar lai str. 56601
aaauaaagaaacu

SEQ ID NO: 2775472 - RNA, 20 nt, Leptospira interrogans serovar lai str. 56601
aaauaaagguuuuauagucu

SEQ ID NO: 2775473 - RNA, 16 nt, Leptospira interrogans serovar lai str. 56601
aaauaaaguauuuuua

SEQ ID NO: 2775474 - RNA, 13 nt, Leptospira interrogans serovar lai str. 56601
aaauaaaguuuua

SEQ ID NO: 2775475 - RNA, 15 nt, Leptospira interrogans serovar lai str. 56601
aaauaaauaauacau

SEQ ID NO: 2775476 - RNA, 15 nt, Leptospira interrogans serovar lai str. 56601
aaauaguauuuugug

SEQ ID NO: 2775477 - RNA, 19 nt, Leptospira interrogans serovar lai str. 56601
aaauagugguuuguaguag

SEQ ID NO: 2775478 - RNA, 19 nt, Leptospira interrogans serovar lai str. 56601
aaauauaacaauucucgau

SEQ ID NO: 2775479 - RNA, 13 nt, Leptospira interrogans serovar lai str. 56601
aaauauaauauac

SEQ ID NO: 2775480 - RNA, 13 nt, Leptospira interrogans serovar lai str. 56601
aaauauacaauaa

SEQ ID NO: 2775481 - RNA, 16 nt, Leptospira interrogans serovar lai str. 56601
aaauauacuuuucaaa

SEQ ID NO: 2775482 - RNA, 16 nt, Leptospira interrogans serovar lai str. 56601
aaauauaucuucuuug

SEQ ID NO: 2775483 - RNA, 22 nt, Leptospira interrogans serovar lai str. 56601
aaauauauucagaaaacagaau

SEQ ID NO: 2775484 - RNA, 18 nt, Leptospira interrogans serovar lai str. 56601
aaauauccguaaaaccuc

SEQ ID NO: 2775485 - RNA, 20 nt, Leptospira interrogans serovar lai str. 56601
aaauaucguauaauguuuau

SEQ ID NO: 2775486 - RNA, 13 nt, Leptospira interrogans serovar lai str. 56601
aaauaucuaaucu

SEQ ID NO: 2775487 - RNA, 19 nt, Leptospira interrogans serovar lai str. 56601
aaauaucuaaucuuuugaa

SEQ ID NO: 2775488 - RNA, 21 nt, Leptospira interrogans serovar lai str. 56601
aaauaucuggaacuuuaauua

SEQ ID NO: 2775489 - RNA, 14 nt, Leptospira interrogans serovar lai str. 56601
aaauaucuuagaau

SEQ ID NO: 2775490 - RNA, 15 nt, Leptospira interrogans serovar lai str. 56601
aaauaugauuuaaaa

SEQ ID NO: 2775491 - RNA, 20 nt, Leptospira interrogans serovar lai str. 56601
aaauauggaagcuaacacaa

SEQ ID NO: 2775492 - RNA, 14 nt, Leptospira interrogans serovar lai str. 56601
aaauauggauuuuu

SEQ ID NO: 2775493 - RNA, 15 nt, Leptospira interrogans serovar lai str. 56601
aaauauuaaaaaaau

SEQ ID NO: 2775494 - RNA, 17 nt, Leptospira interrogans serovar lai str. 56601
aaauauuaaaaaaauaa

SEQ ID NO: 2775495 - RNA, 13 nt, Leptospira interrogans serovar lai str. 56601
aaauauuaaaaca

SEQ ID NO: 2775496 - RNA, 15 nt, Leptospira interrogans serovar lai str. 56601
aaauauuaaaacacu

SEQ ID NO: 2775497 - RNA, 15 nt, Leptospira interrogans serovar lai str. 56601
aaauauuaauuauau

SEQ ID NO: 2775498 - RNA, 16 nt, Leptospira interrogans serovar lai str. 56601
aaauauuaauuuaaaa

SEQ ID NO: 2775499 - RNA, 16 nt, Leptospira interrogans serovar lai str. 56601
aaauauuauauuuuua

SEQ ID NO: 2775500 - RNA, 22 nt, Leptospira interrogans serovar lai str. 56601
aaauauuauauuuuuaaaaagu

SEQ ID NO: 2775501 - RNA, 17 nt, Leptospira interrogans serovar lai str. 56601
aaauauucagaaacugg

SEQ ID NO: 2775502 - RNA, 22 nt, Leptospira interrogans serovar lai str. 56601
aaauauucgaucaaguaagaau

SEQ ID NO: 2775503 - RNA, 19 nt, Leptospira interrogans serovar lai str. 56601
aaauauucguguucuauua

SEQ ID NO: 2775504 - RNA, 17 nt, Leptospira interrogans serovar lai str. 56601
aaauauugaucuaaacu

SEQ ID NO: 2775505 - RNA, 18 nt, Leptospira interrogans serovar lai str. 56601
aaauauuuagaauaaaau

SEQ ID NO: 2775506 - RNA, 19 nt, Leptospira interrogans serovar lai str. 56601
aaauauuuagaauaaaauu

SEQ ID NO: 2775507 - RNA, 13 nt, Leptospira interrogans serovar lai str. 56601
aaauauuucaaaa

SEQ ID NO: 2775508 - RNA, 24 nt, Leptospira interrogans serovar lai str. 56601
aaauauuuugagcagauucuaaaa

SEQ ID NO: 2775509 - RNA, 19 nt, Leptospira interrogans serovar lai str. 56601
aaauauuuuuuuuaaucau

SEQ ID NO: 2775510 - RNA, 15 nt, Leptospira interrogans serovar lai str. 56601
aaaucaaaaggaaua

SEQ ID NO: 2775511 - RNA, 20 nt, Leptospira interrogans serovar lai str. 56601
aaaucaaaaggaauacaauu

SEQ ID NO: 2775512 - RNA, 22 nt, Leptospira interrogans serovar lai str. 56601
aaaucaacuuggaaucuuaaaa

SEQ ID NO: 2775513 - RNA, 23 nt, Leptospira interrogans serovar lai str. 56601
aaaucaagagcuggaugaagcua

SEQ ID NO: 2775514 - RNA, 23 nt, Leptospira interrogans serovar lai str. 56601
aaaucaaguaccauaaauuuuga

SEQ ID NO: 2775515 - RNA, 16 nt, Leptospira interrogans serovar lai str. 56601
aaaucaauaggaaagg

SEQ ID NO: 2775516 - RNA, 19 nt, Leptospira interrogans serovar lai str. 56601
aaaucaauccucuuugaaa

SEQ ID NO: 2775517 - RNA, 22 nt, Leptospira interrogans serovar lai str. 56601
aaaucaaucuacuugaauuaag

SEQ ID NO: 2775518 - RNA, 17 nt, Leptospira interrogans serovar lai str. 56601
aaaucaauucuucuuuc

SEQ ID NO: 2775519 - RNA, 14 nt, Leptospira interrogans serovar lai str. 56601
aaaucaauuuuaaa

SEQ ID NO: 2775520 - RNA, 16 nt, Leptospira interrogans serovar lai str. 56601
aaaucaauuuucuuuc

SEQ ID NO: 2775521 - RNA, 17 nt, Leptospira interrogans serovar lai str. 56601
aaaucaauuuucuuucu

SEQ ID NO: 2775522 - RNA, 23 nt, Leptospira interrogans serovar lai str. 56601
aaaucacaaaaaagauaaaaaga

SEQ ID NO: 2775523 - RNA, 14 nt, Leptospira interrogans serovar lai str. 56601
aaaucacaauuuua

SEQ ID NO: 2775524 - RNA, 16 nt, Leptospira interrogans serovar lai str. 56601
aaaucacaauuuuaag

SEQ ID NO: 2775525 - RNA, 15 nt, Leptospira interrogans serovar lai str. 56601
aaaucacaauuuuac

SEQ ID NO: 2775526 - RNA, 19 nt, Leptospira interrogans serovar lai str. 56601
aaaucaggcuuuauaaaau

SEQ ID NO: 2775527 - RNA, 17 nt, Leptospira interrogans serovar lai str. 56601
aaaucagggccggagaa

SEQ ID NO: 2775528 - RNA, 19 nt, Leptospira interrogans serovar lai str. 56601
aaaucagguuuuauaaagu

SEQ ID NO: 2775529 - RNA, 21 nt, Leptospira interrogans serovar lai str. 56601
aaaucagguuuuauaaaguga

SEQ ID NO: 2775530 - RNA, 16 nt, Leptospira interrogans serovar lai str. 56601
aaaucagguuuuuaca

SEQ ID NO: 2775531 - RNA, 18 nt, Leptospira interrogans serovar lai str. 56601
aaaucauacuuuuaaaaa

SEQ ID NO: 2775532 - RNA, 20 nt, Leptospira interrogans serovar lai str. 56601
aaaucauacuuuuaaaaaau

SEQ ID NO: 2775533 - RNA, 21 nt, Leptospira interrogans serovar lai str. 56601
aaaucauacuuuuaaaaaauu

SEQ ID NO: 2775534 - RNA, 23 nt, Leptospira interrogans serovar lai str. 56601
aaaucauagaguuucuuuaaagu

SEQ ID NO: 2775535 - RNA, 19 nt, Leptospira interrogans serovar lai str. 56601
aaaucauaggauacaaaac

SEQ ID NO: 2775536 - RNA, 17 nt, Leptospira interrogans serovar lai str. 56601
aaaucauauuuucaaaa

SEQ ID NO: 2775537 - RNA, 19 nt, Leptospira interrogans serovar lai str. 56601
aaaucauauuuucaaaaaa

SEQ ID NO: 2775538 - RNA, 20 nt, Leptospira interrogans serovar lai str. 56601
aaaucauauuuucaaaaaau

SEQ ID NO: 2775539 - RNA, 21 nt, Leptospira interrogans serovar lai str. 56601
aaaucauauuuucaaaaaaua

SEQ ID NO: 2775540 - RNA, 20 nt, Leptospira interrogans serovar lai str. 56601
aaaucaucuaucuuuucaaa

SEQ ID NO: 2775541 - RNA, 17 nt, Leptospira interrogans serovar lai str. 56601
aaaucaugaucaaauuc

SEQ ID NO: 2775542 - RNA, 18 nt, Leptospira interrogans serovar lai str. 56601
aaaucaugaucaaauuca

SEQ ID NO: 2775543 - RNA, 23 nt, Leptospira interrogans serovar lai str. 56601
aaaucaugauucauuuuucugaa

SEQ ID NO: 2775544 - RNA, 21 nt, Leptospira interrogans serovar lai str. 56601
aaaucauggauuuacaguuaa

SEQ ID NO: 2775545 - RNA, 21 nt, Leptospira interrogans serovar lai str. 56601
aaaucauucuuuugugacuau

SEQ ID NO: 2775546 - RNA, 16 nt, Leptospira interrogans serovar lai str. 56601
aaauccaacuuaaaac

SEQ ID NO: 2775547 - RNA, 18 nt, Leptospira interrogans serovar lai str. 56601
aaauccaugauucauuuu

SEQ ID NO: 2775548 - RNA, 17 nt, Leptospira interrogans serovar lai str. 56601
aaauccaugauuuguaa

SEQ ID NO: 2775549 - RNA, 15 nt, Leptospira interrogans serovar lai str. 56601
aaaucccaaaaccga

SEQ ID NO: 2775550 - RNA, 14 nt, Leptospira interrogans serovar lai str. 56601
aaaucccauuuuaa

SEQ ID NO: 2775551 - RNA, 15 nt, Leptospira interrogans serovar lai str. 56601
aaauccccaguauuu

SEQ ID NO: 2775552 - RNA, 20 nt, Leptospira interrogans serovar lai str. 56601
aaauccgaugucguuuaaca

SEQ ID NO: 2775553 - RNA, 16 nt, Leptospira interrogans serovar lai str. 56601
aaauccguauacuuua

SEQ ID NO: 2775554 - RNA, 21 nt, Leptospira interrogans serovar lai str. 56601
aaauccguauacuuuaaaaaa

SEQ ID NO: 2775555 - RNA, 15 nt, Leptospira interrogans serovar lai str. 56601
aaauccuauuuuaac

SEQ ID NO: 2775556 - RNA, 16 nt, Leptospira interrogans serovar lai str. 56601
aaauccucaacagaua

SEQ ID NO: 2775557 - RNA, 12 nt, Leptospira interrogans serovar lai str. 56601
aaauccuucuuu

SEQ ID NO: 2775558 - RNA, 20 nt, Leptospira interrogans serovar lai str. 56601
aaaugaguuuuagaauauua

SEQ ID NO: 2775559 - RNA, 13 nt, Leptospira interrogans serovar lai str. 56601
aaaugauagaaac

SEQ ID NO: 2775560 - RNA, 17 nt, Leptospira interrogans serovar lai str. 56601
aaaugauagaaacuaau

SEQ ID NO: 2775561 - RNA, 13 nt, Leptospira interrogans serovar lai str. 56601
aaaugauguagga

SEQ ID NO: 2775562 - RNA, 13 nt, Leptospira interrogans serovar lai str. 56601
aaaugauguggga

SEQ ID NO: 2775563 - RNA, 18 nt, Leptospira interrogans serovar lai str. 56601
aaaugaugugggaacucu

SEQ ID NO: 2775564 - RNA, 14 nt, Leptospira interrogans serovar lai str. 56601
aaaugauuuugccg

SEQ ID NO: 2775565 - RNA, 16 nt, Leptospira interrogans serovar lai str. 56601
aaaugauuuuuuaaaa

SEQ ID NO: 2775566 - RNA, 19 nt, Leptospira interrogans serovar lai str. 56601
aaaugauuuuuuaaaauaa

SEQ ID NO: 2775567 - RNA, 23 nt, Leptospira interrogans serovar lai str. 56601
aaaugcaaaaguuuucaaaaaug

SEQ ID NO: 2775568 - RNA, 21 nt, Leptospira interrogans serovar lai str. 56601
aaaugcauucaaaaaguuuua

SEQ ID NO: 2775569 - RNA, 18 nt, Leptospira interrogans serovar lai str. 56601
aaaugcuguaacucauau

SEQ ID NO: 2775570 - RNA, 20 nt, Leptospira interrogans serovar lai str. 56601
aaauggagaauuaauuuuuc

SEQ ID NO: 2775571 - RNA, 17 nt, Leptospira interrogans serovar lai str. 56601
aaauggauaaauuuuag

SEQ ID NO: 2775572 - RNA, 22 nt, Leptospira interrogans serovar lai str. 56601
aaauggauaaauuuuagaauau

SEQ ID NO: 2775573 - RNA, 16 nt, Leptospira interrogans serovar lai str. 56601
aaauggauacuuauua

SEQ ID NO: 2775574 - RNA, 16 nt, Leptospira interrogans serovar lai str. 56601
aaauggauggaaaaug

SEQ ID NO: 2775575 - RNA, 13 nt, Leptospira interrogans serovar lai str. 56601
aaauggguuuuca

SEQ ID NO: 2775576 - RNA, 20 nt, Leptospira interrogans serovar lai str. 56601
aaauggguuuucauuuuuac

SEQ ID NO: 2775577 - RNA, 19 nt, Leptospira interrogans serovar lai str. 56601
aaauguaaaaaaauauuaa

SEQ ID NO: 2775578 - RNA, 22 nt, Leptospira interrogans serovar lai str. 56601
aaauguaaaaaaauauuaaaac

SEQ ID NO: 2775579 - RNA, 13 nt, Leptospira interrogans serovar lai str. 56601
aaauguaaaaacu

SEQ ID NO: 2775580 - RNA, 13 nt, Leptospira interrogans serovar lai str. 56601
aaauguacaauua

SEQ ID NO: 2775581 - RNA, 12 nt, Leptospira interrogans serovar lai str. 56601
aaauguagaaac

SEQ ID NO: 2775582 - RNA, 14 nt, Leptospira interrogans serovar lai str. 56601
aaauguaggaaccc

SEQ ID NO: 2775583 - RNA, 23 nt, Leptospira interrogans serovar lai str. 56601
aaauguaggaacuacuaauuuau

SEQ ID NO: 2775584 - RNA, 21 nt, Leptospira interrogans serovar lai str. 56601
aaauguaggaacuacuacuuu

SEQ ID NO: 2775585 - RNA, 18 nt, Leptospira interrogans serovar lai str. 56601
aaauguaggaacucauac

SEQ ID NO: 2775586 - RNA, 18 nt, Leptospira interrogans serovar lai str. 56601
aaauguauccaauccaaa

SEQ ID NO: 2775587 - RNA, 21 nt, Leptospira interrogans serovar lai str. 56601
aaauguauguuuacuugaaaa

SEQ ID NO: 2775588 - RNA, 21 nt, Leptospira interrogans serovar lai str. 56601
aaaugucuaugauuaaagccg

SEQ ID NO: 2775589 - RNA, 15 nt, Leptospira interrogans serovar lai str. 56601
aaaugugagaguucc

SEQ ID NO: 2775590 - RNA, 16 nt, Leptospira interrogans serovar lai str. 56601
aaaugugcgggaacuc

SEQ ID NO: 2775591 - RNA, 20 nt, Leptospira interrogans serovar lai str. 56601
aaaugugggaacuaccacaa

SEQ ID NO: 2775592 - RNA, 15 nt, Leptospira interrogans serovar lai str. 56601
aaaugugggaacucc

SEQ ID NO: 2775593 - RNA, 21 nt, Leptospira interrogans serovar lai str. 56601
aaaugugggaacucccacuuu

SEQ ID NO: 2775594 - RNA, 21 nt, Leptospira interrogans serovar lai str. 56601
aaaugugggaauucuuacaac

SEQ ID NO: 2775595 - RNA, 15 nt, Leptospira interrogans serovar lai str. 56601
aaauguuauuuugua

SEQ ID NO: 2775596 - RNA, 22 nt, Leptospira interrogans serovar lai str. 56601
aaauguuauuuuguauaaagua

SEQ ID NO: 2775597 - RNA, 15 nt, Leptospira interrogans serovar lai str. 56601
aaauguucaaauuca

SEQ ID NO: 2775598 - RNA, 15 nt, Leptospira interrogans serovar lai str. 56601
aaauguuuaaagaau

SEQ ID NO: 2775599 - RNA, 16 nt, Leptospira interrogans serovar lai str. 56601
aaauguuuuuauaucu

SEQ ID NO: 2775600 - RNA, 12 nt, Leptospira interrogans serovar lai str. 56601
aaauguuuuuuu

SEQ ID NO: 2775601 - RNA, 21 nt, Leptospira interrogans serovar lai str. 56601
aaauuaaaaaaaaauguaaaa

SEQ ID NO: 2775602 - RNA, 17 nt, Leptospira interrogans serovar lai str. 56601
aaauuaaaaaagagaaa

SEQ ID NO: 2775603 - RNA, 20 nt, Leptospira interrogans serovar lai str. 56601
aaauuaaaaaagagaaagaa

SEQ ID NO: 2775604 - RNA, 14 nt, Leptospira interrogans serovar lai str. 56601
aaauuaaaaaaucu

SEQ ID NO: 2775605 - RNA, 13 nt, Leptospira interrogans serovar lai str. 56601
aaauuaaaauaaa

SEQ ID NO: 2775606 - RNA, 16 nt, Leptospira interrogans serovar lai str. 56601
aaauuaaaauccucaa

SEQ ID NO: 2775607 - RNA, 14 nt, Leptospira interrogans serovar lai str. 56601
aaauuaaacaguaa

SEQ ID NO: 2775608 - RNA, 18 nt, Leptospira interrogans serovar lai str. 56601
aaauuaaacccauuuuag

SEQ ID NO: 2775609 - RNA, 17 nt, Leptospira interrogans serovar lai str. 56601
aaauuaacgguacucaa

SEQ ID NO: 2775610 - RNA, 13 nt, Leptospira interrogans serovar lai str. 56601
aaauuaacucuuu

SEQ ID NO: 2775611 - RNA, 14 nt, Leptospira interrogans serovar lai str. 56601
aaauuaagaaucaa

SEQ ID NO: 2775612 - RNA, 20 nt, Leptospira interrogans serovar lai str. 56601
aaauuaagcauuauaaguuu

SEQ ID NO: 2775613 - RNA, 13 nt, Leptospira interrogans serovar lai str. 56601
aaauuaauauuua

SEQ ID NO: 2775614 - RNA, 15 nt, Leptospira interrogans serovar lai str. 56601
aaauuaauauuuaua

SEQ ID NO: 2775615 - RNA, 22 nt, Leptospira interrogans serovar lai str. 56601
aaauuaauauuuauaauauucu

SEQ ID NO: 2775616 - RNA, 21 nt, Leptospira interrogans serovar lai str. 56601
aaauuaaugaauaacuuuaca

SEQ ID NO: 2775617 - RNA, 20 nt, Leptospira interrogans serovar lai str. 56601
aaauuaauuccuaacuaaua

SEQ ID NO: 2775618 - RNA, 21 nt, Leptospira interrogans serovar lai str. 56601
aaauuaauucuccauuuguuu

SEQ ID NO: 2775619 - RNA, 15 nt, Leptospira interrogans serovar lai str. 56601
aaauuaauuucuaaa

SEQ ID NO: 2775620 - RNA, 19 nt, Leptospira interrogans serovar lai str. 56601
aaauuaauuucuaaacaau

SEQ ID NO: 2775621 - RNA, 13 nt, Leptospira interrogans serovar lai str. 56601
aaauuaauuuuuc

SEQ ID NO: 2775622 - RNA, 20 nt, Leptospira interrogans serovar lai str. 56601
aaauuaauuuuucaacaacu

SEQ ID NO: 2775623 - RNA, 16 nt, Leptospira interrogans serovar lai str. 56601
aaauuacuacuuaaac

SEQ ID NO: 2775624 - RNA, 17 nt, Leptospira interrogans serovar lai str. 56601
aaauuacugauuucaaa

SEQ ID NO: 2775625 - RNA, 22 nt, Leptospira interrogans serovar lai str. 56601
aaauuacugauuucaaaaauaa

SEQ ID NO: 2775626 - RNA, 23 nt, Leptospira interrogans serovar lai str. 56601
aaauuacugauuucaaaaauaaa

SEQ ID NO: 2775627 - RNA, 14 nt, Leptospira interrogans serovar lai str. 56601
aaauuagaaaauua

SEQ ID NO: 2775628 - RNA, 12 nt, Leptospira interrogans serovar lai str. 56601
aaauuagaaaug

SEQ ID NO: 2775629 - RNA, 15 nt, Leptospira interrogans serovar lai str. 56601
aaauuagaaaugauu

SEQ ID NO: 2775630 - RNA, 12 nt, Leptospira interrogans serovar lai str. 56601
aaauuagaaucu

SEQ ID NO: 2775631 - RNA, 15 nt, Leptospira interrogans serovar lai str. 56601
aaauuagauuauuua

SEQ ID NO: 2775632 - RNA, 18 nt, Leptospira interrogans serovar lai str. 56601
aaauuagauuuauugaaa

SEQ ID NO: 2775633 - RNA, 12 nt, Leptospira interrogans serovar lai str. 56601
aaauuagcuuaa

SEQ ID NO: 2775634 - RNA, 16 nt, Leptospira interrogans serovar lai str. 56601
aaauuagcuuaagaau

SEQ ID NO: 2775635 - RNA, 18 nt, Leptospira interrogans serovar lai str. 56601
aaauuagcuuaagaauuu

SEQ ID NO: 2775636 - RNA, 20 nt, Leptospira interrogans serovar lai str. 56601
aaauuaggcuuaucuguaaa

SEQ ID NO: 2775637 - RNA, 17 nt, Leptospira interrogans serovar lai str. 56601
aaauuaguaauuuaaua

SEQ ID NO: 2775638 - RNA, 14 nt, Leptospira interrogans serovar lai str. 56601
aaauuaguuuucuu

SEQ ID NO: 2775639 - RNA, 20 nt, Leptospira interrogans serovar lai str. 56601
aaauuauaaguagaaauuua

SEQ ID NO: 2775640 - RNA, 16 nt, Leptospira interrogans serovar lai str. 56601
aaauuauacaaaacuc

SEQ ID NO: 2775641 - RNA, 20 nt, Leptospira interrogans serovar lai str. 56601
aaauugaguaccauaaauuu

SEQ ID NO: 2775642 - RNA, 17 nt, Leptospira interrogans serovar lai str. 56601
aaauugaguuucacaaa

SEQ ID NO: 2775643 - RNA, 16 nt, Leptospira interrogans serovar lai str. 56601
aaauugauaauuuuug

SEQ ID NO: 2775644 - RNA, 14 nt, Leptospira interrogans serovar lai str. 56601
aaauugaucucgau

SEQ ID NO: 2775645 - RNA, 20 nt, Leptospira interrogans serovar lai str. 56601
aaauugaucucgauucugau

SEQ ID NO: 2775646 - RNA, 20 nt, Leptospira interrogans serovar lai str. 56601
aaauugcauaaaagaaacau

SEQ ID NO: 2775647 - RNA, 15 nt, Leptospira interrogans serovar lai str. 56601
aaauuggaaagaacu

SEQ ID NO: 2775648 - RNA, 20 nt, Leptospira interrogans serovar lai str. 56601
aaauuggcgcguaagaccag

SEQ ID NO: 2775649 - RNA, 18 nt, Leptospira interrogans serovar lai str. 56601
aaauuggguaucuaaaua

SEQ ID NO: 2775650 - RNA, 13 nt, Leptospira interrogans serovar lai str. 56601
aaauuguagaaac

SEQ ID NO: 2775651 - RNA, 22 nt, Leptospira interrogans serovar lai str. 56601
aaauuguauaaaagaaacauaa

SEQ ID NO: 2775652 - RNA, 17 nt, Leptospira interrogans serovar lai str. 56601
aaauuguauacaggaaa

SEQ ID NO: 2775653 - RNA, 22 nt, Leptospira interrogans serovar lai str. 56601
aaauugugagaacuacagcaaa

SEQ ID NO: 2775654 - RNA, 15 nt, Leptospira interrogans serovar lai str. 56601
aaauuguguaugagu

SEQ ID NO: 2775655 - RNA, 22 nt, Leptospira interrogans serovar lai str. 56601
aaauuguuaucgcuaauacaaa

SEQ ID NO: 2775656 - RNA, 20 nt, Leptospira interrogans serovar lai str. 56601
aaauuguucguuucuuaauu

SEQ ID NO: 2775657 - RNA, 17 nt, Leptospira interrogans serovar lai str. 56601
aaauuguugaagaauua

SEQ ID NO: 2775658 - RNA, 21 nt, Leptospira interrogans serovar lai str. 56601
aaauuguuuucuaaaggaaaa

SEQ ID NO: 2775659 - RNA, 14 nt, Leptospira interrogans serovar lai str. 56601
aaauuuaaaauaac

SEQ ID NO: 2775660 - RNA, 16 nt, Leptospira interrogans serovar lai str. 56601
aaauuuaaaauacuca

SEQ ID NO: 2775661 - RNA, 11 nt, Leptospira interrogans serovar lai str. 56601
aaauuuaaauu

SEQ ID NO: 2775662 - RNA, 13 nt, Leptospira interrogans serovar lai str. 56601
aaauuuaacgaca

SEQ ID NO: 2775663 - RNA, 23 nt, Leptospira interrogans serovar lai str. 56601
aaauuuaacgacauuagaacuac

SEQ ID NO: 2775664 - RNA, 14 nt, Leptospira interrogans serovar lai str. 56601
aaauuuaauuuuua

SEQ ID NO: 2775665 - RNA, 15 nt, Leptospira interrogans serovar lai str. 56601
aaauuuaauuuuuac

SEQ ID NO: 2775666 - RNA, 17 nt, Leptospira interrogans serovar lai str. 56601
aaauuuacacgauaauu

SEQ ID NO: 2775667 - RNA, 22 nt, Leptospira interrogans serovar lai str. 56601
aaauuuacacgauaauuuucuu

SEQ ID NO: 2775668 - RNA, 19 nt, Leptospira interrogans serovar lai str. 56601
aaauuuacgaaaauuuuuu

SEQ ID NO: 2775669 - RNA, 22 nt, Leptospira interrogans serovar lai str. 56601
aaauuuacggaacuuaauuuua

SEQ ID NO: 2775670 - RNA, 16 nt, Leptospira interrogans serovar lai str. 56601
aaauuuacucuuauaa

SEQ ID NO: 2775671 - RNA, 16 nt, Leptospira interrogans serovar lai str. 56601
aaauuuacuucaauua

SEQ ID NO: 2775672 - RNA, 18 nt, Leptospira interrogans serovar lai str. 56601
aaauuuauaaauguagga

SEQ ID NO: 2775673 - RNA, 20 nt, Leptospira interrogans serovar lai str. 56601
aaauuuauaauauucuuuua

SEQ ID NO: 2775674 - RNA, 23 nt, Leptospira interrogans serovar lai str. 56601
aaauuuauacuauaacuuuaaaa

SEQ ID NO: 2775675 - RNA, 22 nt, Leptospira interrogans serovar lai str. 56601
aaauuuauaugauuuuauaccu

SEQ ID NO: 2775676 - RNA, 19 nt, Leptospira interrogans serovar lai str. 56601
aaauuuaucuguaaaauuu

SEQ ID NO: 2775677 - RNA, 21 nt, Leptospira interrogans serovar lai str. 56601
aaauuucagauuuuauuuuga

SEQ ID NO: 2775678 - RNA, 15 nt, Leptospira interrogans serovar lai str. 56601
aaauuuccacuucaa

SEQ ID NO: 2775679 - RNA, 18 nt, Leptospira interrogans serovar lai str. 56601
aaauuuccacuucaaaaa

SEQ ID NO: 2775680 - RNA, 18 nt, Leptospira interrogans serovar lai str. 56601
aaauuucccgauucucaa

SEQ ID NO: 2775681 - RNA, 23 nt, Leptospira interrogans serovar lai str. 56601
aaauuucccgauucucaaaaugg

SEQ ID NO: 2775682 - RNA, 17 nt, Leptospira interrogans serovar lai str. 56601
aaauuucccuaguucca

SEQ ID NO: 2775683 - RNA, 13 nt, Leptospira interrogans serovar lai str. 56601
aaauuuccggaaa

SEQ ID NO: 2775684 - RNA, 12 nt, Leptospira interrogans serovar lai str. 56601
aaauuucggaac

SEQ ID NO: 2775685 - RNA, 15 nt, Leptospira interrogans serovar lai str. 56601
aaauuucuaaagaau

SEQ ID NO: 2775686 - RNA, 17 nt, Leptospira interrogans serovar lai str. 56601
aaauuucuaaagaauua

SEQ ID NO: 2775687 - RNA, 18 nt, Leptospira interrogans serovar lai str. 56601
aaauuucuaaagaauuau

SEQ ID NO: 2775688 - RNA, 20 nt, Leptospira interrogans serovar lai str. 56601
aaauuucuaaagaauuauca

SEQ ID NO: 2775689 - RNA, 19 nt, Leptospira interrogans serovar lai str. 56601
aaauuucuaugaaaauucu

SEQ ID NO: 2775690 - RNA, 15 nt, Leptospira interrogans serovar lai str. 56601
aaauuugaaaguaaa

SEQ ID NO: 2775691 - RNA, 14 nt, Leptospira interrogans serovar lai str. 56601
aaauuugaauuuaa

SEQ ID NO: 2775692 - RNA, 23 nt, Leptospira interrogans serovar lai str. 56601
aaauuugauuccaagauuuuuua

SEQ ID NO: 2775693 - RNA, 20 nt, Leptospira interrogans serovar lai str. 56601
aaauuugcgaaaaaaauaac

SEQ ID NO: 2775694 - RNA, 15 nt, Leptospira interrogans serovar lai str. 56601
aaauuuguaauaguu

SEQ ID NO: 2775695 - RNA, 19 nt, Leptospira interrogans serovar lai str. 56601
aaauuuguaauaguuccca

SEQ ID NO: 2775696 - RNA, 17 nt, Leptospira interrogans serovar lai str. 56601
aaauuuguaggaacuca

SEQ ID NO: 2775697 - RNA, 20 nt, Leptospira interrogans serovar lai str. 56601
aaauuuguaggaacucauac

SEQ ID NO: 2775698 - RNA, 21 nt, Leptospira interrogans serovar lai str. 56601
aaauuuuaaccgcaaaaucau

SEQ ID NO: 2775699 - RNA, 19 nt, Leptospira interrogans serovar lai str. 56601
aaauuuuaaguucagauuc

SEQ ID NO: 2775700 - RNA, 22 nt, Leptospira interrogans serovar lai str. 56601
aaauuuuacacguaauucuuug

SEQ ID NO: 2775701 - RNA, 21 nt, Leptospira interrogans serovar lai str. 56601
aaauuuuacccugguuucaaa

SEQ ID NO: 2775702 - RNA, 13 nt, Leptospira interrogans serovar lai str. 56601
aaauuuuagaaua

SEQ ID NO: 2775703 - RNA, 21 nt, Leptospira interrogans serovar lai str. 56601
aaauuuuauuuauauauauuc

SEQ ID NO: 2775704 - RNA, 17 nt, Leptospira interrogans serovar lai str. 56601
aaauuuucaaaaaauau

SEQ ID NO: 2775705 - RNA, 16 nt, Leptospira interrogans serovar lai str. 56601
aaauuuuccguuaaua

SEQ ID NO: 2775706 - RNA, 17 nt, Leptospira interrogans serovar lai str. 56601
aaauuuuccuuuaaauu

SEQ ID NO: 2775707 - RNA, 21 nt, Leptospira interrogans serovar lai str. 56601
aaauuuucguuuuaguuccca

SEQ ID NO: 2775708 - RNA, 16 nt, Leptospira interrogans serovar lai str. 56601
aaauuuucuaaaagua

SEQ ID NO: 2775709 - RNA, 20 nt, Leptospira interrogans serovar lai str. 56601
aaauuuucuaaaaguaguag

SEQ ID NO: 2775710 - RNA, 23 nt, Leptospira interrogans serovar lai str. 56601
aaauuuucuguuuauuuugaaua

SEQ ID NO: 2775711 - RNA, 12 nt, Leptospira interrogans serovar lai str. 56601
aaauuuucuuua

SEQ ID NO: 2775712 - RNA, 12 nt, Leptospira interrogans serovar lai str. 56601
aaauuuugaaaa

SEQ ID NO: 2775713 - RNA, 18 nt, Leptospira interrogans serovar lai str. 56601
aaauuuugaaggaaauuu

SEQ ID NO: 2775714 - RNA, 21 nt, Leptospira interrogans serovar lai str. 56601
aaauuuugcaguaaggauucu

SEQ ID NO: 2775715 - RNA, 22 nt, Leptospira interrogans serovar lai str. 56601
aaauuuugcuucugaacaagaa

SEQ ID NO: 2775716 - RNA, 16 nt, Leptospira interrogans serovar lai str. 56601
aaauuuuuaauaaaau

SEQ ID NO: 2775717 - RNA, 16 nt, Leptospira interrogans serovar lai str. 56601
aaauuuuuauaaaaua

SEQ ID NO: 2775718 - RNA, 18 nt, Leptospira interrogans serovar lai str. 56601
aaauuuuuauaaaauacc

SEQ ID NO: 2775719 - RNA, 16 nt, Leptospira interrogans serovar lai str. 56601
aaauuuuuauacuuuu

SEQ ID NO: 2775720 - RNA, 22 nt, Leptospira interrogans serovar lai str. 56601
aaauuuuuauacuuuuuugaua

SEQ ID NO: 2775721 - RNA, 16 nt, Leptospira interrogans serovar lai str. 56601
aaauuuuuauugcaaa

SEQ ID NO: 2775722 - RNA, 13 nt, Leptospira interrogans serovar lai str. 56601
aaauuuuucaaua

SEQ ID NO: 2775723 - RNA, 15 nt, Leptospira interrogans serovar lai str. 56601
aacagaacaaaauuu

SEQ ID NO: 2775724 - RNA, 18 nt, Leptospira interrogans serovar lai str. 56601
aacagaacgggcuuucua

SEQ ID NO: 2775725 - RNA, 21 nt, Leptospira interrogans serovar lai str. 56601
aacagaauguucuuagacuca

SEQ ID NO: 2775726 - RNA, 14 nt, Leptospira interrogans serovar lai str. 56601
aacagaucaagaau

SEQ ID NO: 2775727 - RNA, 16 nt, Leptospira interrogans serovar lai str. 56601
aacagaucaagaauua

SEQ ID NO: 2775728 - RNA, 19 nt, Leptospira interrogans serovar lai str. 56601
aacagaucaagaauuaauu

SEQ ID NO: 2775729 - RNA, 13 nt, Leptospira interrogans serovar lai str. 56601
aacagcaucaaca

SEQ ID NO: 2775730 - RNA, 22 nt, Leptospira interrogans serovar lai str. 56601
aacaguacuuuguaauuaaaau

SEQ ID NO: 2775731 - RNA, 22 nt, Leptospira interrogans serovar lai str. 56601
aacaguauauuauaauuuuaaa

SEQ ID NO: 2775732 - RNA, 18 nt, Leptospira interrogans serovar lai str. 56601
aacaguaucgaaaauuaa

SEQ ID NO: 2775733 - RNA, 13 nt, Leptospira interrogans serovar lai str. 56601
aacaguauuugua

SEQ ID NO: 2775734 - RNA, 20 nt, Leptospira interrogans serovar lai str. 56601
aacaguauuuguaaaaauga

SEQ ID NO: 2775735 - RNA, 15 nt, Leptospira interrogans serovar lai str. 56601
aacagucauucugua

SEQ ID NO: 2775736 - RNA, 17 nt, Leptospira interrogans serovar lai str. 56601
aacaguuauuauuuaac

SEQ ID NO: 2775737 - RNA, 17 nt, Leptospira interrogans serovar lai str. 56601
aacaguuccuaacaauu

SEQ ID NO: 2775738 - RNA, 12 nt, Leptospira interrogans serovar lai str. 56601
aacauaaaaauu

SEQ ID NO: 2775739 - RNA, 22 nt, Leptospira interrogans serovar lai str. 56601
aacauaaguuacucauuuccau

SEQ ID NO: 2775740 - RNA, 19 nt, Leptospira interrogans serovar lai str. 56601
aacauauuggauaauucca

SEQ ID NO: 2775741 - RNA, 13 nt, Leptospira interrogans serovar lai str. 56601
aacaucaauuuua

SEQ ID NO: 2775742 - RNA, 13 nt, Leptospira interrogans serovar lai str. 56601
aacaucacgcaca

SEQ ID NO: 2775743 - RNA, 22 nt, Leptospira interrogans serovar lai str. 56601
aacaucauucucauauugaaau

SEQ ID NO: 2775744 - RNA, 15 nt, Leptospira interrogans serovar lai str. 56601
aacauccuucaaacu

SEQ ID NO: 2775745 - RNA, 16 nt, Leptospira interrogans serovar lai str. 56601
aacaucucaaucaaaa

SEQ ID NO: 2775746 - RNA, 18 nt, Leptospira interrogans serovar lai str. 56601
aacaugaagaagcuaaaa

SEQ ID NO: 2775747 - RNA, 13 nt, Leptospira interrogans serovar lai str. 56601
aacaugagaagcu

SEQ ID NO: 2775748 - RNA, 16 nt, Leptospira interrogans serovar lai str. 56601
aacauuccaauuuccu

SEQ ID NO: 2775749 - RNA, 17 nt, Leptospira interrogans serovar lai str. 56601
aacauuccauaaugaag

SEQ ID NO: 2775750 - RNA, 22 nt, Leptospira interrogans serovar lai str. 56601
aacauucccauccgaaauccca

SEQ ID NO: 2775751 - RNA, 23 nt, Leptospira interrogans serovar lai str. 56601
aacauucccauccgaaaucccaa

SEQ ID NO: 2775752 - RNA, 20 nt, Leptospira interrogans serovar lai str. 56601
aacauugaguuugagaaacu

SEQ ID NO: 2775753 - RNA, 19 nt, Leptospira interrogans serovar lai str. 56601
aacauugcgagauuuuaag

SEQ ID NO: 2775754 - RNA, 23 nt, Leptospira interrogans serovar lai str. 56601
aacauuuuauuauaaauuuauaa

SEQ ID NO: 2775755 - RNA, 16 nt, Leptospira interrogans serovar lai str. 56601
aacauuuucauauaua

SEQ ID NO: 2775756 - RNA, 18 nt, Leptospira interrogans serovar lai str. 56601
aacauuuucauauauagu

SEQ ID NO: 2775757 - RNA, 16 nt, Leptospira interrogans serovar lai str. 56601
aacauuuuuaaaaauu

SEQ ID NO: 2775758 - RNA, 17 nt, Leptospira interrogans serovar lai str. 56601
aacauuuuuaaaaauua

SEQ ID NO: 2775759 - RNA, 13 nt, Leptospira interrogans serovar lai str. 56601
aaccaaacagcua

SEQ ID NO: 2775760 - RNA, 15 nt, Leptospira interrogans serovar lai str. 56601
aaccaaauaauaaaa

SEQ ID NO: 2775761 - RNA, 20 nt, Leptospira interrogans serovar lai str. 56601
aaccaaauaauaaaacuuuu

SEQ ID NO: 2775762 - RNA, 20 nt, Leptospira interrogans serovar lai str. 56601
aaccacccccaccaaaaaua

SEQ ID NO: 2775763 - RNA, 16 nt, Leptospira interrogans serovar lai str. 56601
aaccaccuuuacauaa

SEQ ID NO: 2775764 - RNA, 19 nt, Leptospira interrogans serovar lai str. 56601
aaccaccuuuacauaauaa

SEQ ID NO: 2775765 - RNA, 22 nt, Leptospira interrogans serovar lai str. 56601
aaccaccuuuacauaauaauac

SEQ ID NO: 2775766 - RNA, 21 nt, Leptospira interrogans serovar lai str. 56601
aaccacgucccguauaaaagu

SEQ ID NO: 2775767 - RNA, 23 nt, Leptospira interrogans serovar lai str. 56601
aaccagaaaguuaguaguuccca

SEQ ID NO: 2775768 - RNA, 20 nt, Leptospira interrogans serovar lai str. 56601
aaccagagauuccgauucuc

SEQ ID NO: 2775769 - RNA, 18 nt, Leptospira interrogans serovar lai str. 56601
aaccaguaauaguuugua

SEQ ID NO: 2775770 - RNA, 19 nt, Leptospira interrogans serovar lai str. 56601
aaccaguaucguuuuccau

SEQ ID NO: 2775771 - RNA, 18 nt, Leptospira interrogans serovar lai str. 56601
aaccaguuuguuuuuuau

SEQ ID NO: 2775772 - RNA, 12 nt, Leptospira interrogans serovar lai str. 56601
aaccaucaccaa

SEQ ID NO: 2775773 - RNA, 14 nt, Leptospira interrogans serovar lai str. 56601
aaccaucucaaaaa

SEQ ID NO: 2775774 - RNA, 22 nt, Leptospira interrogans serovar lai str. 56601
aaccaucuuugauauuuggauc

SEQ ID NO: 2775775 - RNA, 19 nt, Leptospira interrogans serovar lai str. 56601
aaccaugauucugaaaaaa

SEQ ID NO: 2775776 - RNA, 16 nt, Leptospira interrogans serovar lai str. 56601
aaccauggauuuuuac

SEQ ID NO: 2775777 - RNA, 14 nt, Leptospira interrogans serovar lai str. 56601
aaccauuucaaguu

SEQ ID NO: 2775778 - RNA, 21 nt, Leptospira interrogans serovar lai str. 56601
aaccauuucaaguuuucuuuu

SEQ ID NO: 2775779 - RNA, 13 nt, Leptospira interrogans serovar lai str. 56601
aacccaaaaaugu

SEQ ID NO: 2775780 - RNA, 14 nt, Leptospira interrogans serovar lai str. 56601
aacccaaacacaug

SEQ ID NO: 2775781 - RNA, 23 nt, Leptospira interrogans serovar lai str. 56601
aacccaacuuucgcauuuguugu

SEQ ID NO: 2775782 - RNA, 23 nt, Leptospira interrogans serovar lai str. 56601
aacccaucgcacgucccacaaau

SEQ ID NO: 2775783 - RNA, 16 nt, Leptospira interrogans serovar lai str. 56601
aacccaucguaaacaa

SEQ ID NO: 2775784 - RNA, 23 nt, Leptospira interrogans serovar lai str. 56601
aacccgccccgauuuuuacugau

SEQ ID NO: 2775785 - RNA, 23 nt, Leptospira interrogans serovar lai str. 56601
aacccggauuuguugauuuuuga

SEQ ID NO: 2775786 - RNA, 15 nt, Leptospira interrogans serovar lai str. 56601
aacccugccaaaauc

SEQ ID NO: 2775787 - RNA, 16 nt, Leptospira interrogans serovar lai str. 56601
aaccgaaauagaaaua

SEQ ID NO: 2775788 - RNA, 13 nt, Leptospira interrogans serovar lai str. 56601
aaccgacuugaga

SEQ ID NO: 2775789 - RNA, 12 nt, Leptospira interrogans serovar lai str. 56601
aaccgcaaauuu

SEQ ID NO: 2775790 - RNA, 17 nt, Leptospira interrogans serovar lai str. 56601
aaccgcaccaucuaaag

SEQ ID NO: 2775791 - RNA, 18 nt, Leptospira interrogans serovar lai str. 56601
aaccgcauaaaagaaauu

SEQ ID NO: 2775792 - RNA, 15 nt, Leptospira interrogans serovar lai str. 56601
aaccgcugaaaaaaa

SEQ ID NO: 2775793 - RNA, 17 nt, Leptospira interrogans serovar lai str. 56601
aaccguuguuuuacagc

SEQ ID NO: 2775794 - RNA, 15 nt, Leptospira interrogans serovar lai str. 56601
aaccuaaaauuucca

SEQ ID NO: 2775795 - RNA, 21 nt, Leptospira interrogans serovar lai str. 56601
aaccuaauaaacaaaauucaa

SEQ ID NO: 2775796 - RNA, 19 nt, Leptospira interrogans serovar lai str. 56601
aaccuaauguugaaugaaa

SEQ ID NO: 2775797 - RNA, 20 nt, Leptospira interrogans serovar lai str. 56601
aaccuagaauagagucuuua

SEQ ID NO: 2775798 - RNA, 23 nt, Leptospira interrogans serovar lai str. 56601
aaccuagaauagagucuuuaaaa

SEQ ID NO: 2775799 - RNA, 20 nt, Leptospira interrogans serovar lai str. 56601
aaccuaguguuuaauuuuaa

SEQ ID NO: 2775800 - RNA, 20 nt, Leptospira interrogans serovar lai str. 56601
aaccucaaagaaauuuuacu

SEQ ID NO: 2775801 - RNA, 21 nt, Leptospira interrogans serovar lai str. 56601
aaccucaaagaaauuuuacuc

SEQ ID NO: 2775802 - RNA, 20 nt, Leptospira interrogans serovar lai str. 56601
aaccucaacagaauguucuu

SEQ ID NO: 2775803 - RNA, 17 nt, Leptospira interrogans serovar lai str. 56601
aaccucggaguauauaa

SEQ ID NO: 2775804 - RNA, 18 nt, Leptospira interrogans serovar lai str. 56601
aaccucguacuaauucuu

SEQ ID NO: 2775805 - RNA, 19 nt, Leptospira interrogans serovar lai str. 56601
aacuaauaccgguuucaua

SEQ ID NO: 2775806 - RNA, 15 nt, Leptospira interrogans serovar lai str. 56601
aacuaauauguuuag

SEQ ID NO: 2775807 - RNA, 19 nt, Leptospira interrogans serovar lai str. 56601
aacuaauuuuaguuuauuu

SEQ ID NO: 2775808 - RNA, 16 nt, Leptospira interrogans serovar lai str. 56601
aacuacacguuuuccu

SEQ ID NO: 2775809 - RNA, 16 nt, Leptospira interrogans serovar lai str. 56601
aacuacagaauuuuuu

SEQ ID NO: 2775810 - RNA, 21 nt, Leptospira interrogans serovar lai str. 56601
aacuacagaauuuuuuaacaa

SEQ ID NO: 2775811 - RNA, 22 nt, Leptospira interrogans serovar lai str. 56601
aacuacagaauuuuuuaacaau

SEQ ID NO: 2775812 - RNA, 14 nt, Leptospira interrogans serovar lai str. 56601
aacuacagcaaauu

SEQ ID NO: 2775813 - RNA, 23 nt, Leptospira interrogans serovar lai str. 56601
aacuacagcaaauucugauuuua

SEQ ID NO: 2775814 - RNA, 12 nt, Leptospira interrogans serovar lai str. 56601
aacuaccacaaa

SEQ ID NO: 2775815 - RNA, 16 nt, Leptospira interrogans serovar lai str. 56601
aacuaccacaaaucua

SEQ ID NO: 2775816 - RNA, 18 nt, Leptospira interrogans serovar lai str. 56601
aacuaccacagaaagcuu

SEQ ID NO: 2775817 - RNA, 22 nt, Leptospira interrogans serovar lai str. 56601
aacuaccaccaaaguaugauuu

SEQ ID NO: 2775818 - RNA, 21 nt, Leptospira interrogans serovar lai str. 56601
aacuacccauuaacuauauaa

SEQ ID NO: 2775819 - RNA, 16 nt, Leptospira interrogans serovar lai str. 56601
aacuaccgcaaaucaa

SEQ ID NO: 2775820 - RNA, 16 nt, Leptospira interrogans serovar lai str. 56601
aacuaccucaauuuuc

SEQ ID NO: 2775821 - RNA, 20 nt, Leptospira interrogans serovar lai str. 56601
aacuacuaaucucuauaaaa

SEQ ID NO: 2775822 - RNA, 14 nt, Leptospira interrogans serovar lai str. 56601
aacuacuaauuuau

SEQ ID NO: 2775823 - RNA, 15 nt, Leptospira interrogans serovar lai str. 56601
aacuacuaauuuauc

SEQ ID NO: 2775824 - RNA, 15 nt, Leptospira interrogans serovar lai str. 56601
aacuacuacaaaaau

SEQ ID NO: 2775825 - RNA, 17 nt, Leptospira interrogans serovar lai str. 56601
aacuacuacgaaaacuu

SEQ ID NO: 2775826 - RNA, 18 nt, Leptospira interrogans serovar lai str. 56601
aacuacuacuuuuagaaa

SEQ ID NO: 2775827 - RNA, 21 nt, Leptospira interrogans serovar lai str. 56601
aacuacuacuuuuagaaaauu

SEQ ID NO: 2775828 - RNA, 15 nt, Leptospira interrogans serovar lai str. 56601
aacuacuauaaauua

SEQ ID NO: 2775829 - RNA, 17 nt, Leptospira interrogans serovar lai str. 56601
aacuacuauaaauuacu

SEQ ID NO: 2775830 - RNA, 22 nt, Leptospira interrogans serovar lai str. 56601
aacuacuccccgaacuauacaa

SEQ ID NO: 2775831 - RNA, 17 nt, Leptospira interrogans serovar lai str. 56601
aacuacugcauucuuag

SEQ ID NO: 2775832 - RNA, 21 nt, Leptospira interrogans serovar lai str. 56601
aacuacuuccgucuuuuguaa

SEQ ID NO: 2775833 - RNA, 19 nt, Leptospira interrogans serovar lai str. 56601
aacuacuuuuauaaaaagu

SEQ ID NO: 2775834 - RNA, 16 nt, Leptospira interrogans serovar lai str. 56601
aacuagggaauuuuuc

SEQ ID NO: 2775835 - RNA, 22 nt, Leptospira interrogans serovar lai str. 56601
aacuaggucgcauuuagcaauu

SEQ ID NO: 2775836 - RNA, 19 nt, Leptospira interrogans serovar lai str. 56601
aacuaguuccuuaaauaua

SEQ ID NO: 2775837 - RNA, 15 nt, Leptospira interrogans serovar lai str. 56601
aacuauaauaacaaa

SEQ ID NO: 2775838 - RNA, 16 nt, Leptospira interrogans serovar lai str. 56601
aacuauaauaacaaaa

SEQ ID NO: 2775839 - RNA, 13 nt, Leptospira interrogans serovar lai str. 56601
aacuauacuuguu

SEQ ID NO: 2775840 - RNA, 17 nt, Leptospira interrogans serovar lai str. 56601
aacuauacuuucaaaaa

SEQ ID NO: 2775841 - RNA, 20 nt, Leptospira interrogans serovar lai str. 56601
aacuauacuuucaaaaaaua

SEQ ID NO: 2775842 - RNA, 21 nt, Leptospira interrogans serovar lai str. 56601
aacuauacuuucaaaaaauau

SEQ ID NO: 2775843 - RNA, 16 nt, Leptospira interrogans serovar lai str. 56601
aacuauauaacaaagu

SEQ ID NO: 2775844 - RNA, 17 nt, Leptospira interrogans serovar lai str. 56601
aacuauauaauaaagua

SEQ ID NO: 2775845 - RNA, 15 nt, Leptospira interrogans serovar lai str. 56601
aacuaucacaaaucu

SEQ ID NO: 2775846 - RNA, 16 nt, Leptospira interrogans serovar lai str. 56601
aacuaucuuaaaauga

SEQ ID NO: 2775847 - RNA, 16 nt, Leptospira interrogans serovar lai str. 56601
aacuaugaaauuuuuc

SEQ ID NO: 2775848 - RNA, 17 nt, Leptospira interrogans serovar lai str. 56601
aacuauuacaaauaggu

SEQ ID NO: 2775849 - RNA, 14 nt, Leptospira interrogans serovar lai str. 56601
aacuauuauaauau

SEQ ID NO: 2775850 - RNA, 22 nt, Leptospira interrogans serovar lai str. 56601
aacuauuauacuuuauuaagaa

SEQ ID NO: 2775851 - RNA, 16 nt, Leptospira interrogans serovar lai str. 56601
aacuauuuauaaaaua

SEQ ID NO: 2775852 - RNA, 17 nt, Leptospira interrogans serovar lai str. 56601
aacucaaaaaauuuuua

SEQ ID NO: 2775853 - RNA, 14 nt, Leptospira interrogans serovar lai str. 56601
aacucaaaauuucg

SEQ ID NO: 2775854 - RNA, 15 nt, Leptospira interrogans serovar lai str. 56601
aacucaaagaaauuu

SEQ ID NO: 2775855 - RNA, 17 nt, Leptospira interrogans serovar lai str. 56601
aacucaaagaaauuuua

SEQ ID NO: 2775856 - RNA, 16 nt, Leptospira interrogans serovar lai str. 56601
aacucaaagaauuuua

SEQ ID NO: 2775857 - RNA, 18 nt, Leptospira interrogans serovar lai str. 56601
aacucaaaggaaaaugaa

SEQ ID NO: 2775858 - RNA, 21 nt, Leptospira interrogans serovar lai str. 56601
aacucaaaggaaaaugaagaa

SEQ ID NO: 2775859 - RNA, 19 nt, Leptospira interrogans serovar lai str. 56601
aacucaaaucuacaaaacu

SEQ ID NO: 2775860 - RNA, 21 nt, Leptospira interrogans serovar lai str. 56601
aacucaacacaacgcucucua

SEQ ID NO: 2775861 - RNA, 22 nt, Leptospira interrogans serovar lai str. 56601
aacucaacacaacgcucuuuau

SEQ ID NO: 2775862 - RNA, 19 nt, Leptospira interrogans serovar lai str. 56601
aacucaacguuaguaacac

SEQ ID NO: 2775863 - RNA, 15 nt, Leptospira interrogans serovar lai str. 56601
aacucaauguugcuc

SEQ ID NO: 2775864 - RNA, 16 nt, Leptospira interrogans serovar lai str. 56601
aacucacaaguugaau

SEQ ID NO: 2775865 - RNA, 16 nt, Leptospira interrogans serovar lai str. 56601
aacucacgcuaaaaua

SEQ ID NO: 2775866 - RNA, 14 nt, Leptospira interrogans serovar lai str. 56601
aacucacguuaaau

SEQ ID NO: 2775867 - RNA, 17 nt, Leptospira interrogans serovar lai str. 56601
aacucacguuacuacuc

SEQ ID NO: 2775868 - RNA, 18 nt, Leptospira interrogans serovar lai str. 56601
aacucacguuauauuaau

SEQ ID NO: 2775869 - RNA, 18 nt, Leptospira interrogans serovar lai str. 56601
aacucacguuauuuuaac

SEQ ID NO: 2775870 - RNA, 23 nt, Leptospira interrogans serovar lai str. 56601
aacucacguuauuuuaacuugag

SEQ ID NO: 2775871 - RNA, 21 nt, Leptospira interrogans serovar lai str. 56601
aacucaguaaaacgcucucua

SEQ ID NO: 2775872 - RNA, 23 nt, Leptospira interrogans serovar lai str. 56601
aacucauaaaauaacuuccauca

SEQ ID NO: 2775873 - RNA, 20 nt, Leptospira interrogans serovar lai str. 56601
aacucauacuucuaaaaaau

SEQ ID NO: 2775874 - RNA, 22 nt, Leptospira interrogans serovar lai str. 56601
aacucauacuuuuagauaauua

SEQ ID NO: 2775875 - RNA, 16 nt, Leptospira interrogans serovar lai str. 56601
aacucauauagaaauu

SEQ ID NO: 2775876 - RNA, 14 nt, Leptospira interrogans serovar lai str. 56601
aacucauauuuuua

SEQ ID NO: 2775877 - RNA, 18 nt, Leptospira interrogans serovar lai str. 56601
aacucauauuuuuagaaa

SEQ ID NO: 2775878 - RNA, 19 nt, Leptospira interrogans serovar lai str. 56601
aacucauauuuuuagaaaa

SEQ ID NO: 2775879 - RNA, 22 nt, Leptospira interrogans serovar lai str. 56601
aacucaucacaacgcucuuuau

SEQ ID NO: 2775880 - RNA, 16 nt, Leptospira interrogans serovar lai str. 56601
aacucaugcaauuuuu

SEQ ID NO: 2775881 - RNA, 15 nt, Leptospira interrogans serovar lai str. 56601
aacucauucuaguuu

SEQ ID NO: 2775882 - RNA, 19 nt, Leptospira interrogans serovar lai str. 56601
aacucauuuuucuaaaaaa

SEQ ID NO: 2775883 - RNA, 23 nt, Leptospira interrogans serovar lai str. 56601
aacuccauaguucaauuaacaaa

SEQ ID NO: 2775884 - RNA, 23 nt, Leptospira interrogans serovar lai str. 56601
aacucccacaauuuauaaaguuu

SEQ ID NO: 2775885 - RNA, 18 nt, Leptospira interrogans serovar lai str. 56601
aacucccacaauuuugaa

SEQ ID NO: 2775886 - RNA, 19 nt, Leptospira interrogans serovar lai str. 56601
aacucccacuuuuaaagaa

SEQ ID NO: 2775887 - RNA, 19 nt, Leptospira interrogans serovar lai str. 56601
aacuccgacagauuuauau

SEQ ID NO: 2775888 - RNA, 21 nt, Leptospira interrogans serovar lai str. 56601
aacuccgccgcgauuucucuc

SEQ ID NO: 2775889 - RNA, 17 nt, Leptospira interrogans serovar lai str. 56601
aacucgguguaaaaaaa

SEQ ID NO: 2775890 - RNA, 16 nt, Leptospira interrogans serovar lai str. 56601
aacucgguuucuuaua

SEQ ID NO: 2775891 - RNA, 14 nt, Leptospira interrogans serovar lai str. 56601
aacucuaaauucag

SEQ ID NO: 2775892 - RNA, 18 nt, Leptospira interrogans serovar lai str. 56601
aacucuaauacaaaaaau

SEQ ID NO: 2775893 - RNA, 20 nt, Leptospira interrogans serovar lai str. 56601
aacucuaauacaaaaaaugu

SEQ ID NO: 2775894 - RNA, 17 nt, Leptospira interrogans serovar lai str. 56601
aacucuauauaaagaaa

SEQ ID NO: 2775895 - RNA, 22 nt, Leptospira interrogans serovar lai str. 56601
aacucuauuucaguucauuccc

SEQ ID NO: 2775896 - RNA, 19 nt, Leptospira interrogans serovar lai str. 56601
aacucuauuuuauuuuucu

SEQ ID NO: 2775897 - RNA, 16 nt, Leptospira interrogans serovar lai str. 56601
aacucucacaaaucau

SEQ ID NO: 2775898 - RNA, 21 nt, Leptospira interrogans serovar lai str. 56601
aacucucacaaaucaugauuu

SEQ ID NO: 2775899 - RNA, 16 nt, Leptospira interrogans serovar lai str. 56601
aacucucguuguaacu

SEQ ID NO: 2775900 - RNA, 19 nt, Leptospira interrogans serovar lai str. 56601
aacucucuuguaguucaau

SEQ ID NO: 2775901 - RNA, 14 nt, Leptospira interrogans serovar lai str. 56601
aacucugucagguu

SEQ ID NO: 2775902 - RNA, 20 nt, Leptospira interrogans serovar lai str. 56601
aacucuguucaguguaagau

SEQ ID NO: 2775903 - RNA, 22 nt, Leptospira interrogans serovar lai str. 56601
aacucuguucaguguaagauua

SEQ ID NO: 2775904 - RNA, 12 nt, Leptospira interrogans serovar lai str. 56601
aacucuuuaaaa

SEQ ID NO: 2775905 - RNA, 16 nt, Leptospira interrogans serovar lai str. 56601
aacucuuuaaaaacuu

SEQ ID NO: 2775906 - RNA, 18 nt, Leptospira interrogans serovar lai str. 56601
aacucuuuuaccuuacca

SEQ ID NO: 2775907 - RNA, 20 nt, Leptospira interrogans serovar lai str. 56601
aacugaaaaugaccaaaauu

SEQ ID NO: 2775908 - RNA, 12 nt, Leptospira interrogans serovar lai str. 56601
aacugaaacuug

SEQ ID NO: 2775909 - RNA, 23 nt, Leptospira interrogans serovar lai str. 56601
aacugaguaccguuuauuuuuau

SEQ ID NO: 2775910 - RNA, 14 nt, Leptospira interrogans serovar lai str. 56601
aacugauuaaaauc

SEQ ID NO: 2775911 - RNA, 17 nt, Leptospira interrogans serovar lai str. 56601
aacugcuucaauugucc

SEQ ID NO: 2775912 - RNA, 14 nt, Leptospira interrogans serovar lai str. 56601
aacugcuuccaaaa

SEQ ID NO: 2775913 - RNA, 15 nt, Leptospira interrogans serovar lai str. 56601
aacuguaaacuugau

SEQ ID NO: 2775914 - RNA, 19 nt, Leptospira interrogans serovar lai str. 56601
aacuguaaauuagauuauu

SEQ ID NO: 2775915 - RNA, 20 nt, Leptospira interrogans serovar lai str. 56601
aacuguguuucuaauuuucu

SEQ ID NO: 2775916 - RNA, 19 nt, Leptospira interrogans serovar lai str. 56601
aacuguugaaaaaauccau

SEQ ID NO: 2775917 - RNA, 13 nt, Leptospira interrogans serovar lai str. 56601
aacuuaaaaaugu

SEQ ID NO: 2775918 - RNA, 13 nt, Leptospira interrogans serovar lai str. 56601
aacuuaaaacugu

SEQ ID NO: 2775919 - RNA, 16 nt, Leptospira interrogans serovar lai str. 56601
aacuuaaaucucacgg

SEQ ID NO: 2775920 - RNA, 22 nt, Leptospira interrogans serovar lai str. 56601
aacuuaaguuugucuguaaaau

SEQ ID NO: 2775921 - RNA, 17 nt, Leptospira interrogans serovar lai str. 56601
aacuuaaugagauuaaa

SEQ ID NO: 2775922 - RNA, 23 nt, Leptospira interrogans serovar lai str. 56601
aacuuacaaagcacuuuuuuccu

SEQ ID NO: 2775923 - RNA, 15 nt, Leptospira interrogans serovar lai str. 56601
aacuuacauuaaaua

SEQ ID NO: 2775924 - RNA, 22 nt, Leptospira interrogans serovar lai str. 56601
aacuuacugauuucuauaaaau

SEQ ID NO: 2775925 - RNA, 23 nt, Leptospira interrogans serovar lai str. 56601
aacuuacugauuucuauaaaauu

SEQ ID NO: 2775926 - RNA, 19 nt, Leptospira interrogans serovar lai str. 56601
aacuuagguuuaucuguaa

SEQ ID NO: 2775927 - RNA, 23 nt, Leptospira interrogans serovar lai str. 56601
aacuuagguuuguacguaaaaau

SEQ ID NO: 2775928 - RNA, 15 nt, Leptospira interrogans serovar lai str. 56601
aacuuagguuuugua

SEQ ID NO: 2775929 - RNA, 15 nt, Leptospira interrogans serovar lai str. 56601
aacuuauaacugcaa

SEQ ID NO: 2775930 - RNA, 16 nt, Leptospira interrogans serovar lai str. 56601
aacuucaaaaaauaua

SEQ ID NO: 2775931 - RNA, 20 nt, Leptospira interrogans serovar lai str. 56601
aacuucaaaaaauauaggaa

SEQ ID NO: 2775932 - RNA, 14 nt, Leptospira interrogans serovar lai str. 56601
aacuucguuggaaa

SEQ ID NO: 2775933 - RNA, 15 nt, Leptospira interrogans serovar lai str. 56601
aacuucuauuuugag

SEQ ID NO: 2775934 - RNA, 14 nt, Leptospira interrogans serovar lai str. 56601
aacuucuccuuucg

SEQ ID NO: 2775935 - RNA, 20 nt, Leptospira interrogans serovar lai str. 56601
aacuucucuuaaaauuuaga

SEQ ID NO: 2775936 - RNA, 14 nt, Leptospira interrogans serovar lai str. 56601
aacuugagcaaauc

SEQ ID NO: 2775937 - RNA, 20 nt, Leptospira interrogans serovar lai str. 56601
aacuugcaauuuuacuuaua

SEQ ID NO: 2775938 - RNA, 22 nt, Leptospira interrogans serovar lai str. 56601
aacuugcucaaaagcucauaau

SEQ ID NO: 2775939 - RNA, 13 nt, Leptospira interrogans serovar lai str. 56601
aacuuguaagacu

SEQ ID NO: 2775940 - RNA, 20 nt, Leptospira interrogans serovar lai str. 56601
aacuugucccaaaauuucua

SEQ ID NO: 2775941 - RNA, 16 nt, Leptospira interrogans serovar lai str. 56601
aacuuguccuaaaauu

SEQ ID NO: 2775942 - RNA, 20 nt, Leptospira interrogans serovar lai str. 56601
aacuuguuguaccauuuuga

SEQ ID NO: 2775943 - RNA, 16 nt, Leptospira interrogans serovar lai str. 56601
aacuuuaaaaaauaag

SEQ ID NO: 2775944 - RNA, 23 nt, Leptospira interrogans serovar lai str. 56601
aacuuuaauuauugauauuacua

SEQ ID NO: 2775945 - RNA, 14 nt, Leptospira interrogans serovar lai str. 56601
aacuuuacaaaaau

SEQ ID NO: 2775946 - RNA, 21 nt, Leptospira interrogans serovar lai str. 56601
aacuuuauagaucgauucuuu

SEQ ID NO: 2775947 - RNA, 14 nt, Leptospira interrogans serovar lai str. 56601
aacuuucaaagaau

SEQ ID NO: 2775948 - RNA, 12 nt, Leptospira interrogans serovar lai str. 56601
aacuuucagauu

SEQ ID NO: 2775949 - RNA, 17 nt, Leptospira interrogans serovar lai str. 56601
aacuuucagauuaaaac

SEQ ID NO: 2775950 - RNA, 20 nt, Leptospira interrogans serovar lai str. 56601
aacuuuccacuuuucucauc

SEQ ID NO: 2775951 - RNA, 14 nt, Leptospira interrogans serovar lai str. 56601
aacuuucuucgauc

SEQ ID NO: 2775952 - RNA, 18 nt, Leptospira interrogans serovar lai str. 56601
aacuuucuuuuagaaaau

SEQ ID NO: 2775953 - RNA, 19 nt, Leptospira interrogans serovar lai str. 56601
aacuuugaccauucuuugu

SEQ ID NO: 2775954 - RNA, 21 nt, Leptospira interrogans serovar lai str. 56601
aacuuugguuaucauaaaaau

SEQ ID NO: 2775955 - RNA, 18 nt, Leptospira interrogans serovar lai str. 56601
aacuuuuaaagaagauaa

SEQ ID NO: 2775956 - RNA, 17 nt, Leptospira interrogans serovar lai str. 56601
aacuuuuacuguaaaau

SEQ ID NO: 2775957 - RNA, 20 nt, Leptospira interrogans serovar lai str. 56601
aacuuuuauaauucaagacu

SEQ ID NO: 2775958 - RNA, 20 nt, Leptospira interrogans serovar lai str. 56601
aacuuuucuaaauugagaau

SEQ ID NO: 2775959 - RNA, 17 nt, Leptospira interrogans serovar lai str. 56601
aacuuuuuauaaagauu

SEQ ID NO: 2775960 - RNA, 13 nt, Leptospira interrogans serovar lai str. 56601
aacuuuuucagaa

SEQ ID NO: 2775961 - RNA, 17 nt, Leptospira interrogans serovar lai str. 56601
aacuuuuucagaaucau

SEQ ID NO: 2775962 - RNA, 14 nt, Leptospira interrogans serovar lai str. 56601
aacuuuuucguuuu

SEQ ID NO: 2775963 - RNA, 18 nt, Leptospira interrogans serovar lai str. 56601
aacuuuuucguuuuuuag

SEQ ID NO: 2775964 - RNA, 18 nt, Leptospira interrogans serovar lai str. 56601
aacuuuuuucagaaaaag

SEQ ID NO: 2775965 - RNA, 15 nt, Leptospira interrogans serovar lai str. 56601
aacuuuuuuuagaau

SEQ ID NO: 2775966 - RNA, 19 nt, Leptospira interrogans serovar lai str. 56601
aagaaaaaagcagcuaaaa

SEQ ID NO: 2775967 - RNA, 20 nt, Leptospira interrogans serovar lai str. 56601
aagaaaaagagaugguuuag

SEQ ID NO: 2775968 - RNA, 16 nt, Leptospira interrogans serovar lai str. 56601
aagaaaaccuaaaaua

SEQ ID NO: 2775969 - RNA, 20 nt, Leptospira interrogans serovar lai str. 56601
aagaaaauacauaggaaccu

SEQ ID NO: 2775970 - RNA, 14 nt, Leptospira interrogans serovar lai str. 56601
aagaauuuuuaaaa

SEQ ID NO: 2775971 - RNA, 12 nt, Leptospira interrogans serovar lai str. 56601
aagaauuuuuac

SEQ ID NO: 2775972 - RNA, 20 nt, Leptospira interrogans serovar lai str. 56601
aagaccagugccauuuuucu

SEQ ID NO: 2775973 - RNA, 14 nt, Leptospira interrogans serovar lai str. 56601
aagaccuaaacccu

SEQ ID NO: 2775974 - RNA, 16 nt, Leptospira interrogans serovar lai str. 56601
aagaccuaaacccuga

SEQ ID NO: 2775975 - RNA, 17 nt, Leptospira interrogans serovar lai str. 56601
aagaccucaaauaacuu

SEQ ID NO: 2775976 - RNA, 22 nt, Leptospira interrogans serovar lai str. 56601
aagaccuuguguuucagacuga

SEQ ID NO: 2775977 - RNA, 21 nt, Leptospira interrogans serovar lai str. 56601
aagaccuuuuagauaaauaca

SEQ ID NO: 2775978 - RNA, 22 nt, Leptospira interrogans serovar lai str. 56601
aagacgauccuuuuuuguaaag

SEQ ID NO: 2775979 - RNA, 19 nt, Leptospira interrogans serovar lai str. 56601
aagacgauuccuaaaaauu

SEQ ID NO: 2775980 - RNA, 17 nt, Leptospira interrogans serovar lai str. 56601
aagacgucuacagauaa

SEQ ID NO: 2775981 - RNA, 15 nt, Leptospira interrogans serovar lai str. 56601
aagacuaaaaaguua

SEQ ID NO: 2775982 - RNA, 16 nt, Leptospira interrogans serovar lai str. 56601
aagacuauauucuucg

SEQ ID NO: 2775983 - RNA, 17 nt, Leptospira interrogans serovar lai str. 56601
aagacuuuauagucaaa

SEQ ID NO: 2775984 - RNA, 12 nt, Leptospira interrogans serovar lai str. 56601
aagacuuugaaa

SEQ ID NO: 2775985 - RNA, 14 nt, Leptospira interrogans serovar lai str. 56601
aagagaauuucuau

SEQ ID NO: 2775986 - RNA, 15 nt, Leptospira interrogans serovar lai str. 56601
aagagacauugaaga

SEQ ID NO: 2775987 - RNA, 15 nt, Leptospira interrogans serovar lai str. 56601
aagagagauauacac

SEQ ID NO: 2775988 - RNA, 23 nt, Leptospira interrogans serovar lai str. 56601
aagagagauauacacuauaacaa

SEQ ID NO: 2775989 - RNA, 20 nt, Leptospira interrogans serovar lai str. 56601
aagagagggucuuucgagau

SEQ ID NO: 2775990 - RNA, 19 nt, Leptospira interrogans serovar lai str. 56601
aagagaugugaguuuuaaa

SEQ ID NO: 2775991 - RNA, 21 nt, Leptospira interrogans serovar lai str. 56601
aagagccuaauccaauaaaau

SEQ ID NO: 2775992 - RNA, 23 nt, Leptospira interrogans serovar lai str. 56601
aagagccuaauccaauaaaauuu

SEQ ID NO: 2775993 - RNA, 15 nt, Leptospira interrogans serovar lai str. 56601
aagagcgucuuugaa

SEQ ID NO: 2775994 - RNA, 19 nt, Leptospira interrogans serovar lai str. 56601
aagagcuccuacauuuuau

SEQ ID NO: 2775995 - RNA, 11 nt, Leptospira interrogans serovar lai str. 56601
aagagucaaac

SEQ ID NO: 2775996 - RNA, 18 nt, Leptospira interrogans serovar lai str. 56601
aagagucauuuuuaaaua

SEQ ID NO: 2775997 - RNA, 11 nt, Leptospira interrogans serovar lai str. 56601
aagagucgauu

SEQ ID NO: 2775998 - RNA, 17 nt, Leptospira interrogans serovar lai str. 56601
aagagucuauauguaaa

SEQ ID NO: 2775999 - RNA, 21 nt, Leptospira interrogans serovar lai str. 56601
aagagugcagauuaaaaaaua

SEQ ID NO: 2776000 - RNA, 11 nt, Leptospira interrogans serovar lai str. 56601
aagaguuccua

SEQ ID NO: 2776001 - RNA, 15 nt, Leptospira interrogans serovar lai str. 56601
aagaguuuaaaaaau

SEQ ID NO: 2776002 - RNA, 23 nt, Leptospira interrogans serovar lai str. 56601
aagauaaaacguacuuacugaaa

SEQ ID NO: 2776003 - RNA, 19 nt, Leptospira interrogans serovar lai str. 56601
aagauaaaacucaaaggaa

SEQ ID NO: 2776004 - RNA, 13 nt, Leptospira interrogans serovar lai str. 56601
aagauaaauuuag

SEQ ID NO: 2776005 - RNA, 15 nt, Leptospira interrogans serovar lai str. 56601
aagauaaauuuagua

SEQ ID NO: 2776006 - RNA, 15 nt, Leptospira interrogans serovar lai str. 56601
aagauagauuuauaa

SEQ ID NO: 2776007 - RNA, 15 nt, Leptospira interrogans serovar lai str. 56601
aagauaggucaaaaa

SEQ ID NO: 2776008 - RNA, 19 nt, Leptospira interrogans serovar lai str. 56601
aagauaggucaaaaaauua

SEQ ID NO: 2776009 - RNA, 21 nt, Leptospira interrogans serovar lai str. 56601
aagauaugaauuaauuuguaa

SEQ ID NO: 2776010 - RNA, 13 nt, Leptospira interrogans serovar lai str. 56601
aagauauuaacaa

SEQ ID NO: 2776011 - RNA, 15 nt, Leptospira interrogans serovar lai str. 56601
aagauauuaacaaau

SEQ ID NO: 2776012 - RNA, 20 nt, Leptospira interrogans serovar lai str. 56601
aagauauuaacaaauuuaaa

SEQ ID NO: 2776013 - RNA, 21 nt, Leptospira interrogans serovar lai str. 56601
aagauauuaacaaauuuaaaa

SEQ ID NO: 2776014 - RNA, 14 nt, Leptospira interrogans serovar lai str. 56601
aagauauuuuccuu

SEQ ID NO: 2776015 - RNA, 14 nt, Leptospira interrogans serovar lai str. 56601
aagauccaaauuuu

SEQ ID NO: 2776016 - RNA, 11 nt, Leptospira interrogans serovar lai str. 56601
aagaucuauuc

SEQ ID NO: 2776017 - RNA, 17 nt, Leptospira interrogans serovar lai str. 56601
aagaucuauuccuaaaa

SEQ ID NO: 2776018 - RNA, 22 nt, Leptospira interrogans serovar lai str. 56601
aagaucuuauaauuaacgugaa

SEQ ID NO: 2776019 - RNA, 21 nt, Leptospira interrogans serovar lai str. 56601
aagaugauuuuguuaauuaaa

SEQ ID NO: 2776020 - RNA, 22 nt, Leptospira interrogans serovar lai str. 56601
aagaugauuuuguuaauuaaac

SEQ ID NO: 2776021 - RNA, 20 nt, Leptospira interrogans serovar lai str. 56601
aagaugggcacugaauaaaa

SEQ ID NO: 2776022 - RNA, 22 nt, Leptospira interrogans serovar lai str. 56601
aagaugguggaauaacaacgau

SEQ ID NO: 2776023 - RNA, 14 nt, Leptospira interrogans serovar lai str. 56601
aagauuaaucuggu

SEQ ID NO: 2776024 - RNA, 20 nt, Leptospira interrogans serovar lai str. 56601
aagauuacauuuuucuaaau

SEQ ID NO: 2776025 - RNA, 14 nt, Leptospira interrogans serovar lai str. 56601
aagauuagaaaaac

SEQ ID NO: 2776026 - RNA, 22 nt, Leptospira interrogans serovar lai str. 56601
aagauuauauuauauuucguaa

SEQ ID NO: 2776027 - RNA, 21 nt, Leptospira interrogans serovar lai str. 56601
aagauuaugguaaaauuucau

SEQ ID NO: 2776028 - RNA, 23 nt, Leptospira interrogans serovar lai str. 56601
aagauuaugguaaaauuucauuu

SEQ ID NO: 2776029 - RNA, 17 nt, Leptospira interrogans serovar lai str. 56601
aagauucaaagauaaaa

SEQ ID NO: 2776030 - RNA, 22 nt, Leptospira interrogans serovar lai str. 56601
aagauucauuucguaaaaucca

SEQ ID NO: 2776031 - RNA, 18 nt, Leptospira interrogans serovar lai str. 56601
aagauucuucuccucuuc

SEQ ID NO: 2776032 - RNA, 14 nt, Leptospira interrogans serovar lai str. 56601
aagauugaaugaaa

SEQ ID NO: 2776033 - RNA, 16 nt, Leptospira interrogans serovar lai str. 56601
aagauugaauuuuuau

SEQ ID NO: 2776034 - RNA, 15 nt, Leptospira interrogans serovar lai str. 56601
aagauugauuuuaau

SEQ ID NO: 2776035 - RNA, 21 nt, Leptospira interrogans serovar lai str. 56601
aagauuggacgauguuguuua

SEQ ID NO: 2776036 - RNA, 15 nt, Leptospira interrogans serovar lai str. 56601
aagauugucuuuauu

SEQ ID NO: 2776037 - RNA, 17 nt, Leptospira interrogans serovar lai str. 56601
aagauuuccuaauaacu

SEQ ID NO: 2776038 - RNA, 18 nt, Leptospira interrogans serovar lai str. 56601
aagauuuccuaauaacuu

SEQ ID NO: 2776039 - RNA, 18 nt, Leptospira interrogans serovar lai str. 56601
aagauuucguucggaaaa

SEQ ID NO: 2776040 - RNA, 22 nt, Leptospira interrogans serovar lai str. 56601
aagauuucguucggaaaaagua

SEQ ID NO: 2776041 - RNA, 19 nt, Leptospira interrogans serovar lai str. 56601
aagauuuguugaaaaguga

SEQ ID NO: 2776042 - RNA, 23 nt, Leptospira interrogans serovar lai str. 56601
aagauuuguugaaaagugaguuu

SEQ ID NO: 2776043 - RNA, 14 nt, Leptospira interrogans serovar lai str. 56601
aagauuuguuuuau

SEQ ID NO: 2776044 - RNA, 13 nt, Leptospira interrogans serovar lai str. 56601
aagauuuuaaaaa

SEQ ID NO: 2776045 - RNA, 18 nt, Leptospira interrogans serovar lai str. 56601
aagauuuuaaaaauucaa

SEQ ID NO: 2776046 - RNA, 17 nt, Leptospira interrogans serovar lai str. 56601
aagauuuuacgaacaaa

SEQ ID NO: 2776047 - RNA, 22 nt, Leptospira interrogans serovar lai str. 56601
aagauuuuacgaacaaauucua

SEQ ID NO: 2776048 - RNA, 17 nt, Leptospira interrogans serovar lai str. 56601
aagauuuucuuugauug

SEQ ID NO: 2776049 - RNA, 22 nt, Leptospira interrogans serovar lai str. 56601
aagauuuucuuugauugaauua

SEQ ID NO: 2776050 - RNA, 17 nt, Leptospira interrogans serovar lai str. 56601
aagauuuuuacucacac

SEQ ID NO: 2776051 - RNA, 15 nt, Leptospira interrogans serovar lai str. 56601
aagauuuuucuuuaa

SEQ ID NO: 2776052 - RNA, 16 nt, Leptospira interrogans serovar lai str. 56601
aagauuuuucuuuaaa

SEQ ID NO: 2776053 - RNA, 22 nt, Leptospira interrogans serovar lai str. 56601
aaguaauccauuuuuccguaaa

SEQ ID NO: 2776054 - RNA, 21 nt, Leptospira interrogans serovar lai str. 56601
aaguaaucuuuuuaaaaguuu

SEQ ID NO: 2776055 - RNA, 16 nt, Leptospira interrogans serovar lai str. 56601
aaguaauggauuuuua

SEQ ID NO: 2776056 - RNA, 17 nt, Leptospira interrogans serovar lai str. 56601
aaguaauggauuuuuau

SEQ ID NO: 2776057 - RNA, 16 nt, Leptospira interrogans serovar lai str. 56601
aaguaauuacacccuu

SEQ ID NO: 2776058 - RNA, 17 nt, Leptospira interrogans serovar lai str. 56601
aaguaauuuaaaaaaau

SEQ ID NO: 2776059 - RNA, 20 nt, Leptospira interrogans serovar lai str. 56601
aaguacgaaaccucuauuuu

SEQ ID NO: 2776060 - RNA, 13 nt, Leptospira interrogans serovar lai str. 56601
aaguacgaaauuc

SEQ ID NO: 2776061 - RNA, 14 nt, Leptospira interrogans serovar lai str. 56601
aaguacuaauucaa

SEQ ID NO: 2776062 - RNA, 23 nt, Leptospira interrogans serovar lai str. 56601
aaguacuaauucaauaaguuuac

SEQ ID NO: 2776063 - RNA, 16 nt, Leptospira interrogans serovar lai str. 56601
aaguagaaagauuaaa

SEQ ID NO: 2776064 - RNA, 20 nt, Leptospira interrogans serovar lai str. 56601
aaguagaaagauuaaauucu

SEQ ID NO: 2776065 - RNA, 15 nt, Leptospira interrogans serovar lai str. 56601
aaguagaaauuuaau

SEQ ID NO: 2776066 - RNA, 18 nt, Leptospira interrogans serovar lai str. 56601
aaguagaaccuaaaaaua

SEQ ID NO: 2776067 - RNA, 22 nt, Leptospira interrogans serovar lai str. 56601
aaguagaaucaucucaaaaaua

SEQ ID NO: 2776068 - RNA, 19 nt, Leptospira interrogans serovar lai str. 56601
aaguagagagugaaaaauc

SEQ ID NO: 2776069 - RNA, 15 nt, Leptospira interrogans serovar lai str. 56601
aaguaguaacacuca

SEQ ID NO: 2776070 - RNA, 23 nt, Leptospira interrogans serovar lai str. 56601
aaguaguuucgccaaucuccauu

SEQ ID NO: 2776071 - RNA, 21 nt, Leptospira interrogans serovar lai str. 56601
aaguauaaaagugaauuuuug

SEQ ID NO: 2776072 - RNA, 17 nt, Leptospira interrogans serovar lai str. 56601
aaguauaaguuccuaca

SEQ ID NO: 2776073 - RNA, 15 nt, Leptospira interrogans serovar lai str. 56601
aaguauaauauuuau

SEQ ID NO: 2776074 - RNA, 14 nt, Leptospira interrogans serovar lai str. 56601
aaguauaauuuaaa

SEQ ID NO: 2776075 - RNA, 18 nt, Leptospira interrogans serovar lai str. 56601
aaguauauauuaaaguau

SEQ ID NO: 2776076 - RNA, 22 nt, Leptospira interrogans serovar lai str. 56601
aaguauauauuaaaguauuaau

SEQ ID NO: 2776077 - RNA, 20 nt, Leptospira interrogans serovar lai str. 56601
aaguaucaccguaauucuua

SEQ ID NO: 2776078 - RNA, 22 nt, Leptospira interrogans serovar lai str. 56601
aaguaucagaaucaaaggaaau

SEQ ID NO: 2776079 - RNA, 14 nt, Leptospira interrogans serovar lai str. 56601
aaguaucuaaaagu

SEQ ID NO: 2776080 - RNA, 16 nt, Leptospira interrogans serovar lai str. 56601
aaguaucuaaaaguuu

SEQ ID NO: 2776081 - RNA, 23 nt, Leptospira interrogans serovar lai str. 56601
aaguaugaguuccuacaauuuua

SEQ ID NO: 2776082 - RNA, 16 nt, Leptospira interrogans serovar lai str. 56601
aaguauguuuuucuaa

SEQ ID NO: 2776083 - RNA, 21 nt, Leptospira interrogans serovar lai str. 56601
aaguauguuuuucuaauagag

SEQ ID NO: 2776084 - RNA, 19 nt, Leptospira interrogans serovar lai str. 56601
aaguauuauaaauuuugag

SEQ ID NO: 2776085 - RNA, 20 nt, Leptospira interrogans serovar lai str. 56601
aaguauuauauggaguucua

SEQ ID NO: 2776086 - RNA, 22 nt, Leptospira interrogans serovar lai str. 56601
aaguauuauauggaguucuaaa

SEQ ID NO: 2776087 - RNA, 20 nt, Leptospira interrogans serovar lai str. 56601
aaguauuccauauagagaau

SEQ ID NO: 2776088 - RNA, 14 nt, Leptospira interrogans serovar lai str. 56601
aaguauucuauuua

SEQ ID NO: 2776089 - RNA, 21 nt, Leptospira interrogans serovar lai str. 56601
aaguauucucccccaacugaa

SEQ ID NO: 2776090 - RNA, 13 nt, Leptospira interrogans serovar lai str. 56601
aaguauucuuucc

SEQ ID NO: 2776091 - RNA, 19 nt, Leptospira interrogans serovar lai str. 56601
aaguauuguuaagauaaau

SEQ ID NO: 2776092 - RNA, 20 nt, Leptospira interrogans serovar lai str. 56601
aaguauuguuaagauaaauu

SEQ ID NO: 2776093 - RNA, 21 nt, Leptospira interrogans serovar lai str. 56601
aaguauuguuaagauaaauuu

SEQ ID NO: 2776094 - RNA, 22 nt, Leptospira interrogans serovar lai str. 56601
aaguauuugaucucaauauaaa

SEQ ID NO: 2776095 - RNA, 17 nt, Leptospira interrogans serovar lai str. 56601
aagucaaacuuacaaaa

SEQ ID NO: 2776096 - RNA, 22 nt, Leptospira interrogans serovar lai str. 56601
aagucaacgacucguaauuaaa

SEQ ID NO: 2776097 - RNA, 18 nt, Leptospira interrogans serovar lai str. 56601
aagucagguuuuaucaaa

SEQ ID NO: 2776098 - RNA, 14 nt, Leptospira interrogans serovar lai str. 56601
aaguccaaaacaaa

SEQ ID NO: 2776099 - RNA, 17 nt, Leptospira interrogans serovar lai str. 56601
aaguccaaaacaaagua

SEQ ID NO: 2776100 - RNA, 15 nt, Leptospira interrogans serovar lai str. 56601
aaguccaauuuuaaa

SEQ ID NO: 2776101 - RNA, 18 nt, Leptospira interrogans serovar lai str. 56601
aagucgcccaaaccccag

SEQ ID NO: 2776102 - RNA, 19 nt, Leptospira interrogans serovar lai str. 56601
aagucguuguauuuuaaac

SEQ ID NO: 2776103 - RNA, 20 nt, Leptospira interrogans serovar lai str. 56601
aagucguuguauuuuaaaca

SEQ ID NO: 2776104 - RNA, 19 nt, Leptospira interrogans serovar lai str. 56601
aagucuaacaguaaaacuu

SEQ ID NO: 2776105 - RNA, 15 nt, Leptospira interrogans serovar lai str. 56601
aagucuagaaaugua

SEQ ID NO: 2776106 - RNA, 18 nt, Leptospira interrogans serovar lai str. 56601
aagucuagaaauguagga

SEQ ID NO: 2776107 - RNA, 16 nt, Leptospira interrogans serovar lai str. 56601
aagucuauucgcgauc

SEQ ID NO: 2776108 - RNA, 17 nt, Leptospira interrogans serovar lai str. 56601
aagucuauuucccaaaa

SEQ ID NO: 2776109 - RNA, 22 nt, Leptospira interrogans serovar lai str. 56601
aagucuauuucccaaaauuuca

SEQ ID NO: 2776110 - RNA, 14 nt, Leptospira interrogans serovar lai str. 56601
aagucuauuucuaa

SEQ ID NO: 2776111 - RNA, 18 nt, Leptospira interrogans serovar lai str. 56601
aagucucaaaaccuguaa

SEQ ID NO: 2776112 - RNA, 20 nt, Leptospira interrogans serovar lai str. 56601
aagucuccagcauuuagaaa

SEQ ID NO: 2776113 - RNA, 18 nt, Leptospira interrogans serovar lai str. 56601
aagucugguuuauuuuug

SEQ ID NO: 2776114 - RNA, 14 nt, Leptospira interrogans serovar lai str. 56601
aagucuuuaaaaau

SEQ ID NO: 2776115 - RNA, 16 nt, Leptospira interrogans serovar lai str. 56601
aagucuuucuacacca

SEQ ID NO: 2776116 - RNA, 22 nt, Leptospira interrogans serovar lai str. 56601
aagucuuuuuugacuucggaac

SEQ ID NO: 2776117 - RNA, 15 nt, Leptospira interrogans serovar lai str. 56601
aagugaaaauuacaa

SEQ ID NO: 2776118 - RNA, 22 nt, Leptospira interrogans serovar lai str. 56601
aagugaaccucuguaaauacaa

SEQ ID NO: 2776119 - RNA, 18 nt, Leptospira interrogans serovar lai str. 56601
aagugaauuaaaagaaac

SEQ ID NO: 2776120 - RNA, 17 nt, Leptospira interrogans serovar lai str. 56601
aagugaugaagagaaag

SEQ ID NO: 2776121 - RNA, 21 nt, Leptospira interrogans serovar lai str. 56601
aagugauucauucuaagauuu

SEQ ID NO: 2776122 - RNA, 17 nt, Leptospira interrogans serovar lai str. 56601
aaguguaucccuuuggc

SEQ ID NO: 2776123 - RNA, 22 nt, Leptospira interrogans serovar lai str. 56601
aaguguggucuauuacaaaacu

SEQ ID NO: 2776124 - RNA, 22 nt, Leptospira interrogans serovar lai str. 56601
aaguguuguaucucaagauuaa

SEQ ID NO: 2776125 - RNA, 12 nt, Leptospira interrogans serovar lai str. 56601
aaguguuuuugu

SEQ ID NO: 2776126 - RNA, 14 nt, Leptospira interrogans serovar lai str. 56601
aaguguuuuuguaa

SEQ ID NO: 2776127 - RNA, 13 nt, Leptospira interrogans serovar lai str. 56601
aaguuaaauauaa

SEQ ID NO: 2776128 - RNA, 18 nt, Leptospira interrogans serovar lai str. 56601
aaguuaagaagauaaaua

SEQ ID NO: 2776129 - RNA, 21 nt, Leptospira interrogans serovar lai str. 56601
aaguuaagaguuuguuccaaa

SEQ ID NO: 2776130 - RNA, 13 nt, Leptospira interrogans serovar lai str. 56601
aaguuaagugaaa

SEQ ID NO: 2776131 - RNA, 15 nt, Leptospira interrogans serovar lai str. 56601
aaguuaauaggauuu

SEQ ID NO: 2776132 - RNA, 14 nt, Leptospira interrogans serovar lai str. 56601
aaguuaauucuaaa

SEQ ID NO: 2776133 - RNA, 16 nt, Leptospira interrogans serovar lai str. 56601
aaguuacucauuucca

SEQ ID NO: 2776134 - RNA, 15 nt, Leptospira interrogans serovar lai str. 56601
aaguuacuucccuuc

SEQ ID NO: 2776135 - RNA, 12 nt, Leptospira interrogans serovar lai str. 56601
aauaaagaaaag

SEQ ID NO: 2776136 - RNA, 15 nt, Leptospira interrogans serovar lai str. 56601
aauaaagaaaaggaa

SEQ ID NO: 2776137 - RNA, 15 nt, Leptospira interrogans serovar lai str. 56601
aauaaagaaacuguu

SEQ ID NO: 2776138 - RNA, 16 nt, Leptospira interrogans serovar lai str. 56601
aauaaagaagaguuga

SEQ ID NO: 2776139 - RNA, 19 nt, Leptospira interrogans serovar lai str. 56601
aauaaagaagaguugaaua

SEQ ID NO: 2776140 - RNA, 20 nt, Leptospira interrogans serovar lai str. 56601
aauaaagauucacuuagaaa

SEQ ID NO: 2776141 - RNA, 23 nt, Leptospira interrogans serovar lai str. 56601
aauaaagauucacuuagaaagau

SEQ ID NO: 2776142 - RNA, 16 nt, Leptospira interrogans serovar lai str. 56601
aauaaagguuuuauag

SEQ ID NO: 2776143 - RNA, 14 nt, Leptospira interrogans serovar lai str. 56601
aauaaaguaccuaa

SEQ ID NO: 2776144 - RNA, 22 nt, Leptospira interrogans serovar lai str. 56601
aauaaaucaaaaggaauacaau

SEQ ID NO: 2776145 - RNA, 18 nt, Leptospira interrogans serovar lai str. 56601
aauaaauccggaaguaau

SEQ ID NO: 2776146 - RNA, 17 nt, Leptospira interrogans serovar lai str. 56601
aauaaauuaaaaaaaaa

SEQ ID NO: 2776147 - RNA, 16 nt, Leptospira interrogans serovar lai str. 56601
aauaaauuccccaaaa

SEQ ID NO: 2776148 - RNA, 20 nt, Leptospira interrogans serovar lai str. 56601
aauaaauugaaaguaaagau

SEQ ID NO: 2776149 - RNA, 22 nt, Leptospira interrogans serovar lai str. 56601
aauaaauugaacguaauacaaa

SEQ ID NO: 2776150 - RNA, 17 nt, Leptospira interrogans serovar lai str. 56601
aauaaauugcacaaaag

SEQ ID NO: 2776151 - RNA, 18 nt, Leptospira interrogans serovar lai str. 56601
aauaaauuguauaaaaga

SEQ ID NO: 2776152 - RNA, 23 nt, Leptospira interrogans serovar lai str. 56601
aauaaauuguauaaaagaaacau

SEQ ID NO: 2776153 - RNA, 12 nt, Leptospira interrogans serovar lai str. 56601
aauaaauuuaaa

SEQ ID NO: 2776154 - RNA, 12 nt, Leptospira interrogans serovar lai str. 56601
aauaaauuuuuc

SEQ ID NO: 2776155 - RNA, 22 nt, Leptospira interrogans serovar lai str. 56601
aauaaauuuuucuggaaaaguu

SEQ ID NO: 2776156 - RNA, 12 nt, Leptospira interrogans serovar lai str. 56601
aauaacaaaaaa

SEQ ID NO: 2776157 - RNA, 20 nt, Leptospira interrogans serovar lai str. 56601
aauaacaaaaaaugcucaaa

SEQ ID NO: 2776158 - RNA, 22 nt, Leptospira interrogans serovar lai str. 56601
aauaacaacgauuucuguagaa

SEQ ID NO: 2776159 - RNA, 14 nt, Leptospira interrogans serovar lai str. 56601
aauaacauuuuuuc

SEQ ID NO: 2776160 - RNA, 17 nt, Leptospira interrogans serovar lai str. 56601
aauaaccaauuuuauga

SEQ ID NO: 2776161 - RNA, 20 nt, Leptospira interrogans serovar lai str. 56601
aauaaccuucggguuccgua

SEQ ID NO: 2776162 - RNA, 14 nt, Leptospira interrogans serovar lai str. 56601
aauaacgauacuua

SEQ ID NO: 2776163 - RNA, 20 nt, Leptospira interrogans serovar lai str. 56601
aauaacguaugauguaagga

SEQ ID NO: 2776164 - RNA, 19 nt, Leptospira interrogans serovar lai str. 56601
aauaacuaacgugaguuca

SEQ ID NO: 2776165 - RNA, 23 nt, Leptospira interrogans serovar lai str. 56601
aauaacuaacgugaguucagaca

SEQ ID NO: 2776166 - RNA, 23 nt, Leptospira interrogans serovar lai str. 56601
aauaacucuauuaguuuaauaua

SEQ ID NO: 2776167 - RNA, 19 nt, Leptospira interrogans serovar lai str. 56601
aauaagaaucgaaaaaaua

SEQ ID NO: 2776168 - RNA, 22 nt, Leptospira interrogans serovar lai str. 56601
aauaagaguuacuacaauuuua

SEQ ID NO: 2776169 - RNA, 13 nt, Leptospira interrogans serovar lai str. 56601
aauaagauuuguu

SEQ ID NO: 2776170 - RNA, 14 nt, Leptospira interrogans serovar lai str. 56601
aauaagauuuuaga

SEQ ID NO: 2776171 - RNA, 20 nt, Leptospira interrogans serovar lai str. 56601
aauaaggagcaccuaacccu

SEQ ID NO: 2776172 - RNA, 18 nt, Leptospira interrogans serovar lai str. 56601
aauaaguaaaucuagcaa

SEQ ID NO: 2776173 - RNA, 21 nt, Leptospira interrogans serovar lai str. 56601
aauaaguuagaacuucuuccc

SEQ ID NO: 2776174 - RNA, 15 nt, Leptospira interrogans serovar lai str. 56601
aauaaguuuacauca

SEQ ID NO: 2776175 - RNA, 14 nt, Leptospira interrogans serovar lai str. 56601
aauaaguuuuauau

SEQ ID NO: 2776176 - RNA, 14 nt, Leptospira interrogans serovar lai str. 56601
aauaauaauauuuu

SEQ ID NO: 2776177 - RNA, 15 nt, Leptospira interrogans serovar lai str. 56601
aauaauaaucuuaaa

SEQ ID NO: 2776178 - RNA, 18 nt, Leptospira interrogans serovar lai str. 56601
aauaauacagaauucauu

SEQ ID NO: 2776179 - RNA, 22 nt, Leptospira interrogans serovar lai str. 56601
aauaauacagaauucauuuuac

SEQ ID NO: 2776180 - RNA, 23 nt, Leptospira interrogans serovar lai str. 56601
aauaauaggaaucggcauaagca

SEQ ID NO: 2776181 - RNA, 14 nt, Leptospira interrogans serovar lai str. 56601
aauaauauacuaaa

SEQ ID NO: 2776182 - RNA, 16 nt, Leptospira interrogans serovar lai str. 56601
aauaauauacuaaauu

SEQ ID NO: 2776183 - RNA, 16 nt, Leptospira interrogans serovar lai str. 56601
aauaauauauuuauaa

SEQ ID NO: 2776184 - RNA, 13 nt, Leptospira interrogans serovar lai str. 56601
aauaauaugaauu

SEQ ID NO: 2776185 - RNA, 17 nt, Leptospira interrogans serovar lai str. 56601
aauaauaugaauucauu

SEQ ID NO: 2776186 - RNA, 18 nt, Leptospira interrogans serovar lai str. 56601
aauaauaugauguaaauu

SEQ ID NO: 2776187 - RNA, 19 nt, Leptospira interrogans serovar lai str. 56601
aauaauaugauguaaauuu

SEQ ID NO: 2776188 - RNA, 21 nt, Leptospira interrogans serovar lai str. 56601
aauaauauggguauugguuug

SEQ ID NO: 2776189 - RNA, 13 nt, Leptospira interrogans serovar lai str. 56601
aauaaucggaaau

SEQ ID NO: 2776190 - RNA, 13 nt, Leptospira interrogans serovar lai str. 56601
aauaaucuaagac

SEQ ID NO: 2776191 - RNA, 14 nt, Leptospira interrogans serovar lai str. 56601
aauaaucuuaaaua

SEQ ID NO: 2776192 - RNA, 15 nt, Leptospira interrogans serovar lai str. 56601
aauaaugaaaacuug

SEQ ID NO: 2776193 - RNA, 15 nt, Leptospira interrogans serovar lai str. 56601
aauaauguauugcuu

SEQ ID NO: 2776194 - RNA, 17 nt, Leptospira interrogans serovar lai str. 56601
aauaauguccgaaauuu

SEQ ID NO: 2776195 - RNA, 15 nt, Leptospira interrogans serovar lai str. 56601
aauaauguggaacuc

SEQ ID NO: 2776196 - RNA, 15 nt, Leptospira interrogans serovar lai str. 56601
aauaauuagaaaaau

SEQ ID NO: 2776197 - RNA, 17 nt, Leptospira interrogans serovar lai str. 56601
aauaauuagaaaaauau

SEQ ID NO: 2776198 - RNA, 14 nt, Leptospira interrogans serovar lai str. 56601
aauaauuagcucuu

SEQ ID NO: 2776199 - RNA, 23 nt, Leptospira interrogans serovar lai str. 56601
aauaauuagcucuuguuaaaaua

SEQ ID NO: 2776200 - RNA, 14 nt, Leptospira interrogans serovar lai str. 56601
aauaauucaaaauu

SEQ ID NO: 2776201 - RNA, 17 nt, Leptospira interrogans serovar lai str. 56601
aauaauucaaaauuuga

SEQ ID NO: 2776202 - RNA, 21 nt, Leptospira interrogans serovar lai str. 56601
aauaauucaaaauuugauccu

SEQ ID NO: 2776203 - RNA, 12 nt, Leptospira interrogans serovar lai str. 56601
aauaauuccucc

SEQ ID NO: 2776204 - RNA, 20 nt, Leptospira interrogans serovar lai str. 56601
aauaauucuaucgauuccaa

SEQ ID NO: 2776205 - RNA, 14 nt, Leptospira interrogans serovar lai str. 56601
aauaauugaauaaa

SEQ ID NO: 2776206 - RNA, 23 nt, Leptospira interrogans serovar lai str. 56601
aauaauuggaucucaauauaaau

SEQ ID NO: 2776207 - RNA, 19 nt, Leptospira interrogans serovar lai str. 56601
aauaauuguugaauaucua

SEQ ID NO: 2776208 - RNA, 21 nt, Leptospira interrogans serovar lai str. 56601
aauaauuucccauaaaaagag

SEQ ID NO: 2776209 - RNA, 17 nt, Leptospira interrogans serovar lai str. 56601
aauaauuuuaauauuuc

SEQ ID NO: 2776210 - RNA, 19 nt, Leptospira interrogans serovar lai str. 56601
aauaauuuuaauauuucga

SEQ ID NO: 2776211 - RNA, 12 nt, Leptospira interrogans serovar lai str. 56601
aauaauuuuuac

SEQ ID NO: 2776212 - RNA, 13 nt, Leptospira interrogans serovar lai str. 56601
aauacaaaaaacu

SEQ ID NO: 2776213 - RNA, 15 nt, Leptospira interrogans serovar lai str. 56601
aauacaaaaaauguu

SEQ ID NO: 2776214 - RNA, 17 nt, Leptospira interrogans serovar lai str. 56601
aauacaaaaaauguuua

SEQ ID NO: 2776215 - RNA, 13 nt, Leptospira interrogans serovar lai str. 56601
aauacaaaaagaa

SEQ ID NO: 2776216 - RNA, 14 nt, Leptospira interrogans serovar lai str. 56601
aauacaaaaagaau

SEQ ID NO: 2776217 - RNA, 13 nt, Leptospira interrogans serovar lai str. 56601
aauacaaaacaag

SEQ ID NO: 2776218 - RNA, 17 nt, Leptospira interrogans serovar lai str. 56601
aauagcuuaaaagugau

SEQ ID NO: 2776219 - RNA, 17 nt, Leptospira interrogans serovar lai str. 56601
aauagcuucuuuaaaaa

SEQ ID NO: 2776220 - RNA, 19 nt, Leptospira interrogans serovar lai str. 56601
aauagcuucuuuaaaaacu

SEQ ID NO: 2776221 - RNA, 14 nt, Leptospira interrogans serovar lai str. 56601
aauaggaguuccua

SEQ ID NO: 2776222 - RNA, 21 nt, Leptospira interrogans serovar lai str. 56601
aauaggaguuccuacauuuau

SEQ ID NO: 2776223 - RNA, 15 nt, Leptospira interrogans serovar lai str. 56601
aauaggaucagaauu

SEQ ID NO: 2776224 - RNA, 17 nt, Leptospira interrogans serovar lai str. 56601
aauaggauuuaaauuuu

SEQ ID NO: 2776225 - RNA, 14 nt, Leptospira interrogans serovar lai str. 56601
aauaggauuuuaga

SEQ ID NO: 2776226 - RNA, 20 nt, Leptospira interrogans serovar lai str. 56601
aauaggauuuuagaaugaga

SEQ ID NO: 2776227 - RNA, 16 nt, Leptospira interrogans serovar lai str. 56601
aauagggaaaacucaa

SEQ ID NO: 2776228 - RNA, 20 nt, Leptospira interrogans serovar lai str. 56601
aauagggaaaacucaucaca

SEQ ID NO: 2776229 - RNA, 18 nt, Leptospira interrogans serovar lai str. 56601
aauagggaauauuccauu

SEQ ID NO: 2776230 - RNA, 22 nt, Leptospira interrogans serovar lai str. 56601
aauagggguuuuaccaggauga

SEQ ID NO: 2776231 - RNA, 14 nt, Leptospira interrogans serovar lai str. 56601
aauaguauccaaaa

SEQ ID NO: 2776232 - RNA, 17 nt, Leptospira interrogans serovar lai str. 56601
aauaguauccaaaauua

SEQ ID NO: 2776233 - RNA, 21 nt, Leptospira interrogans serovar lai str. 56601
aauagucaauugaagcaguuu

SEQ ID NO: 2776234 - RNA, 19 nt, Leptospira interrogans serovar lai str. 56601
aauagugauacaauguucc

SEQ ID NO: 2776235 - RNA, 17 nt, Leptospira interrogans serovar lai str. 56601
aauaguucccacaaauu

SEQ ID NO: 2776236 - RNA, 16 nt, Leptospira interrogans serovar lai str. 56601
aauaguugaaauucac

SEQ ID NO: 2776237 - RNA, 19 nt, Leptospira interrogans serovar lai str. 56601
aauaguuucuacauuuuug

SEQ ID NO: 2776238 - RNA, 20 nt, Leptospira interrogans serovar lai str. 56601
aauaguuuguacaucuuaaa

SEQ ID NO: 2776239 - RNA, 14 nt, Leptospira interrogans serovar lai str. 56601
aauauaaaaaauaa

SEQ ID NO: 2776240 - RNA, 16 nt, Leptospira interrogans serovar lai str. 56601
aauauaaaaaauaaua

SEQ ID NO: 2776241 - RNA, 13 nt, Leptospira interrogans serovar lai str. 56601
aauauaaaaacca

SEQ ID NO: 2776242 - RNA, 12 nt, Leptospira interrogans serovar lai str. 56601
aauauaaaagau

SEQ ID NO: 2776243 - RNA, 12 nt, Leptospira interrogans serovar lai str. 56601
aauauaaaaucu

SEQ ID NO: 2776244 - RNA, 13 nt, Leptospira interrogans serovar lai str. 56601
aauauaaaauuuu

SEQ ID NO: 2776245 - RNA, 21 nt, Leptospira interrogans serovar lai str. 56601
aauauaaaucaaucauauuuu

SEQ ID NO: 2776246 - RNA, 18 nt, Leptospira interrogans serovar lai str. 56601
aauauaaaucugucggaa

SEQ ID NO: 2776247 - RNA, 18 nt, Leptospira interrogans serovar lai str. 56601
aauauaaccucaacauaa

SEQ ID NO: 2776248 - RNA, 14 nt, Leptospira interrogans serovar lai str. 56601
aauauaagaaagua

SEQ ID NO: 2776249 - RNA, 10 nt, Leptospira interrogans serovar lai str. 56601
aauauaauaa

SEQ ID NO: 2776250 - RNA, 16 nt, Leptospira interrogans serovar lai str. 56601
aauauaauaaaauuau

SEQ ID NO: 2776251 - RNA, 18 nt, Leptospira interrogans serovar lai str. 56601
aauauaauaauuguugaa

SEQ ID NO: 2776252 - RNA, 19 nt, Leptospira interrogans serovar lai str. 56601
aauauaauucuguaaaaua

SEQ ID NO: 2776253 - RNA, 14 nt, Leptospira interrogans serovar lai str. 56601
aauauacaaaacau

SEQ ID NO: 2776254 - RNA, 21 nt, Leptospira interrogans serovar lai str. 56601
aauauacaacuuuuuuaauuu

SEQ ID NO: 2776255 - RNA, 15 nt, Leptospira interrogans serovar lai str. 56601
aauauacaauaaaua

SEQ ID NO: 2776256 - RNA, 18 nt, Leptospira interrogans serovar lai str. 56601
aauauacuugauauuucu

SEQ ID NO: 2776257 - RNA, 17 nt, Leptospira interrogans serovar lai str. 56601
aauauacuuuucaaacg

SEQ ID NO: 2776258 - RNA, 15 nt, Leptospira interrogans serovar lai str. 56601
aauauagguucuugc

SEQ ID NO: 2776259 - RNA, 17 nt, Leptospira interrogans serovar lai str. 56601
aauauagguucuugcaa

SEQ ID NO: 2776260 - RNA, 22 nt, Leptospira interrogans serovar lai str. 56601
aauauagguucuugcaaaaaua

SEQ ID NO: 2776261 - RNA, 23 nt, Leptospira interrogans serovar lai str. 56601
aauauagguucuugcaaaaauag

SEQ ID NO: 2776262 - RNA, 15 nt, Leptospira interrogans serovar lai str. 56601
aauauaguuccuaca

SEQ ID NO: 2776263 - RNA, 14 nt, Leptospira interrogans serovar lai str. 56601
aauauaucagauug

SEQ ID NO: 2776264 - RNA, 13 nt, Leptospira interrogans serovar lai str. 56601
aauauauuaaaau

SEQ ID NO: 2776265 - RNA, 16 nt, Leptospira interrogans serovar lai str. 56601
aauauauucaaaagau

SEQ ID NO: 2776266 - RNA, 14 nt, Leptospira interrogans serovar lai str. 56601
aauauauucaauuu

SEQ ID NO: 2776267 - RNA, 23 nt, Leptospira interrogans serovar lai str. 56601
aauauauucaauuucuuuaauuu

SEQ ID NO: 2776268 - RNA, 22 nt, Leptospira interrogans serovar lai str. 56601
aauauauucuuuucugaauaaa

SEQ ID NO: 2776269 - RNA, 19 nt, Leptospira interrogans serovar lai str. 56601
aauauauuggcgaaagagg

SEQ ID NO: 2776270 - RNA, 21 nt, Leptospira interrogans serovar lai str. 56601
aauauauuggcgaaagaggga

SEQ ID NO: 2776271 - RNA, 24 nt, Leptospira interrogans serovar lai str. 56601
aauauauugucuugaauuacaauu

SEQ ID NO: 2776272 - RNA, 18 nt, Leptospira interrogans serovar lai str. 56601
aauaucaaaaugaacaau

SEQ ID NO: 2776273 - RNA, 22 nt, Leptospira interrogans serovar lai str. 56601
aauaucaaaugugagaguuccc

SEQ ID NO: 2776274 - RNA, 20 nt, Leptospira interrogans serovar lai str. 56601
aauaucaguuucuccggcga

SEQ ID NO: 2776275 - RNA, 18 nt, Leptospira interrogans serovar lai str. 56601
aauaucauaaauuuuuau

SEQ ID NO: 2776276 - RNA, 20 nt, Leptospira interrogans serovar lai str. 56601
aauaucggaaucgaggaaau

SEQ ID NO: 2776277 - RNA, 14 nt, Leptospira interrogans serovar lai str. 56601
aauaucuaauauuu

SEQ ID NO: 2776278 - RNA, 19 nt, Leptospira interrogans serovar lai str. 56601
aauaucuaaucuuuugaaa

SEQ ID NO: 2776279 - RNA, 14 nt, Leptospira interrogans serovar lai str. 56601
aauaucuccaaaau

SEQ ID NO: 2776280 - RNA, 21 nt, Leptospira interrogans serovar lai str. 56601
aauaucugaauuuuuauaagu

SEQ ID NO: 2776281 - RNA, 15 nt, Leptospira interrogans serovar lai str. 56601
aauaucuuaagaauu

SEQ ID NO: 2776282 - RNA, 20 nt, Leptospira interrogans serovar lai str. 56601
aauaucuuaauauaauaauu

SEQ ID NO: 2776283 - RNA, 15 nt, Leptospira interrogans serovar lai str. 56601
aauaucuuagaauaa

SEQ ID NO: 2776284 - RNA, 21 nt, Leptospira interrogans serovar lai str. 56601
aauaugaaaggaaucgauucu

SEQ ID NO: 2776285 - RNA, 17 nt, Leptospira interrogans serovar lai str. 56601
aauaugaaguaugaagu

SEQ ID NO: 2776286 - RNA, 18 nt, Leptospira interrogans serovar lai str. 56601
aauaugaaguaugaagua

SEQ ID NO: 2776287 - RNA, 18 nt, Leptospira interrogans serovar lai str. 56601
aauaugaauuacuacaaa

SEQ ID NO: 2776288 - RNA, 14 nt, Leptospira interrogans serovar lai str. 56601
aauaugaauuuuua

SEQ ID NO: 2776289 - RNA, 22 nt, Leptospira interrogans serovar lai str. 56601
aauauguuuagaguauuauaaa

SEQ ID NO: 2776290 - RNA, 11 nt, Leptospira interrogans serovar lai str. 56601
aauauuaaaaa

SEQ ID NO: 2776291 - RNA, 14 nt, Leptospira interrogans serovar lai str. 56601
aauauuaaaaaaau

SEQ ID NO: 2776292 - RNA, 14 nt, Leptospira interrogans serovar lai str. 56601
aauauuaaaaacac

SEQ ID NO: 2776293 - RNA, 15 nt, Leptospira interrogans serovar lai str. 56601
aauauuaaaaacaca

SEQ ID NO: 2776294 - RNA, 14 nt, Leptospira interrogans serovar lai str. 56601
aauauuaauuuaaa

SEQ ID NO: 2776295 - RNA, 18 nt, Leptospira interrogans serovar lai str. 56601
aauauuaauuuaaaaaca

SEQ ID NO: 2776296 - RNA, 11 nt, Leptospira interrogans serovar lai str. 56601
aauauuauaaa

SEQ ID NO: 2776297 - RNA, 13 nt, Leptospira interrogans serovar lai str. 56601
aauauuauaaaua

SEQ ID NO: 2776298 - RNA, 22 nt, Leptospira interrogans serovar lai str. 56601
aauauuauaaauuuaaaaaacc

SEQ ID NO: 2776299 - RNA, 15 nt, Leptospira interrogans serovar lai str. 56601
aauauuauauuuuua

SEQ ID NO: 2776300 - RNA, 14 nt, Leptospira interrogans serovar lai str. 56601
aauauuaugaaaua

SEQ ID NO: 2776301 - RNA, 19 nt, Leptospira interrogans serovar lai str. 56601
aaucaguuaauacaaaacu

SEQ ID NO: 2776302 - RNA, 21 nt, Leptospira interrogans serovar lai str. 56601
aaucaguuuuguuaauuuuga

SEQ ID NO: 2776303 - RNA, 22 nt, Leptospira interrogans serovar lai str. 56601
aaucaguuuuguuaauuuugaa

SEQ ID NO: 2776304 - RNA, 15 nt, Leptospira interrogans serovar lai str. 56601
aaucauacaaucaaa

SEQ ID NO: 2776305 - RNA, 16 nt, Leptospira interrogans serovar lai str. 56601
aaucauagauacauaa

SEQ ID NO: 2776306 - RNA, 21 nt, Leptospira interrogans serovar lai str. 56601
aaucauaggauacaaaacuuu

SEQ ID NO: 2776307 - RNA, 14 nt, Leptospira interrogans serovar lai str. 56601
aaucauagguuauu

SEQ ID NO: 2776308 - RNA, 19 nt, Leptospira interrogans serovar lai str. 56601
aaucauauuuucaaaaaau

SEQ ID NO: 2776309 - RNA, 22 nt, Leptospira interrogans serovar lai str. 56601
aaucaucuaucuuuucaaaagu

SEQ ID NO: 2776310 - RNA, 22 nt, Leptospira interrogans serovar lai str. 56601
aaucaucuugcucuaaaugacu

SEQ ID NO: 2776311 - RNA, 13 nt, Leptospira interrogans serovar lai str. 56601
aaucaugaauauu

SEQ ID NO: 2776312 - RNA, 17 nt, Leptospira interrogans serovar lai str. 56601
aaucaugaauauuuucc

SEQ ID NO: 2776313 - RNA, 18 nt, Leptospira interrogans serovar lai str. 56601
aaucaugaauauuuucca

SEQ ID NO: 2776314 - RNA, 17 nt, Leptospira interrogans serovar lai str. 56601
aaucaugucucaguuca

SEQ ID NO: 2776315 - RNA, 19 nt, Leptospira interrogans serovar lai str. 56601
aaucaugucucaguucaaa

SEQ ID NO: 2776316 - RNA, 23 nt, Leptospira interrogans serovar lai str. 56601
aaucaugucucaguucaaaauau

SEQ ID NO: 2776317 - RNA, 23 nt, Leptospira interrogans serovar lai str. 56601
aaucauucuuuagaaauuuuuaa

SEQ ID NO: 2776318 - RNA, 16 nt, Leptospira interrogans serovar lai str. 56601
aaucauucuuuuguga

SEQ ID NO: 2776319 - RNA, 21 nt, Leptospira interrogans serovar lai str. 56601
aaucauuuuuugggcuucuga

SEQ ID NO: 2776320 - RNA, 14 nt, Leptospira interrogans serovar lai str. 56601
aaucauuuuuuguu

SEQ ID NO: 2776321 - RNA, 11 nt, Leptospira interrogans serovar lai str. 56601
aauccaaaauu

SEQ ID NO: 2776322 - RNA, 18 nt, Leptospira interrogans serovar lai str. 56601
aauccaacuuaaaacugu

SEQ ID NO: 2776323 - RNA, 21 nt, Leptospira interrogans serovar lai str. 56601
aauccaaguagagagugaaaa

SEQ ID NO: 2776324 - RNA, 16 nt, Leptospira interrogans serovar lai str. 56601
aauccagcugaaacua

SEQ ID NO: 2776325 - RNA, 22 nt, Leptospira interrogans serovar lai str. 56601
aauccauaucuacaaaagauuu

SEQ ID NO: 2776326 - RNA, 15 nt, Leptospira interrogans serovar lai str. 56601
aauccauaugaguuc

SEQ ID NO: 2776327 - RNA, 19 nt, Leptospira interrogans serovar lai str. 56601
aauccaucugagaauuucu

SEQ ID NO: 2776328 - RNA, 15 nt, Leptospira interrogans serovar lai str. 56601
aauccauucaaaaaa

SEQ ID NO: 2776329 - RNA, 13 nt, Leptospira interrogans serovar lai str. 56601
aauccauuuuucc

SEQ ID NO: 2776330 - RNA, 13 nt, Leptospira interrogans serovar lai str. 56601
aaucccaaaaccg

SEQ ID NO: 2776331 - RNA, 16 nt, Leptospira interrogans serovar lai str. 56601
aaucccaaauucuuuc

SEQ ID NO: 2776332 - RNA, 20 nt, Leptospira interrogans serovar lai str. 56601
aaucccaaauucuuuccuuu

SEQ ID NO: 2776333 - RNA, 16 nt, Leptospira interrogans serovar lai str. 56601
aaucccagaaaggaac

SEQ ID NO: 2776334 - RNA, 18 nt, Leptospira interrogans serovar lai str. 56601
aaucccagaaaggaacua

SEQ ID NO: 2776335 - RNA, 18 nt, Leptospira interrogans serovar lai str. 56601
aaucccggaucguuuuuc

SEQ ID NO: 2776336 - RNA, 15 nt, Leptospira interrogans serovar lai str. 56601
aauccgaaaaaccuu

SEQ ID NO: 2776337 - RNA, 14 nt, Leptospira interrogans serovar lai str. 56601
aauccgaauacaaa

SEQ ID NO: 2776338 - RNA, 18 nt, Leptospira interrogans serovar lai str. 56601
aauccggaaguaauuaca

SEQ ID NO: 2776339 - RNA, 23 nt, Leptospira interrogans serovar lai str. 56601
aauccggauuuguuaauuuuuag

SEQ ID NO: 2776340 - RNA, 15 nt, Leptospira interrogans serovar lai str. 56601
aauccguagccgcuu

SEQ ID NO: 2776341 - RNA, 21 nt, Leptospira interrogans serovar lai str. 56601
aauccguagccgcuucaaagu

SEQ ID NO: 2776342 - RNA, 15 nt, Leptospira interrogans serovar lai str. 56601
aauccuguaaauuca

SEQ ID NO: 2776343 - RNA, 18 nt, Leptospira interrogans serovar lai str. 56601
aauccuuccaaaucugaa

SEQ ID NO: 2776344 - RNA, 18 nt, Leptospira interrogans serovar lai str. 56601
aauccuuccuccaaaaua

SEQ ID NO: 2776345 - RNA, 19 nt, Leptospira interrogans serovar lai str. 56601
aauccuuccuccaaaauau

SEQ ID NO: 2776346 - RNA, 17 nt, Leptospira interrogans serovar lai str. 56601
aaucgaaaaaauacaaa

SEQ ID NO: 2776347 - RNA, 17 nt, Leptospira interrogans serovar lai str. 56601
aaucgaaacuauaacgg

SEQ ID NO: 2776348 - RNA, 21 nt, Leptospira interrogans serovar lai str. 56601
aaucgaagaugguacuuuacg

SEQ ID NO: 2776349 - RNA, 15 nt, Leptospira interrogans serovar lai str. 56601
aaucgaauaaaaaag

SEQ ID NO: 2776350 - RNA, 14 nt, Leptospira interrogans serovar lai str. 56601
aaucgaauccuuuu

SEQ ID NO: 2776351 - RNA, 17 nt, Leptospira interrogans serovar lai str. 56601
aaucgacgauuuuacga

SEQ ID NO: 2776352 - RNA, 21 nt, Leptospira interrogans serovar lai str. 56601
aaucgaugguuucaauuuaaa

SEQ ID NO: 2776353 - RNA, 22 nt, Leptospira interrogans serovar lai str. 56601
aaucgaugguuucaauuuaaaa

SEQ ID NO: 2776354 - RNA, 19 nt, Leptospira interrogans serovar lai str. 56601
aaucgauuacucuuugaga

SEQ ID NO: 2776355 - RNA, 18 nt, Leptospira interrogans serovar lai str. 56601
aaucgauucuaggaaacu

SEQ ID NO: 2776356 - RNA, 23 nt, Leptospira interrogans serovar lai str. 56601
aaucgauuucuaaauugugagaa

SEQ ID NO: 2776357 - RNA, 13 nt, Leptospira interrogans serovar lai str. 56601
aaucgauuugauc

SEQ ID NO: 2776358 - RNA, 20 nt, Leptospira interrogans serovar lai str. 56601
aaucgcagguugcaauccaa

SEQ ID NO: 2776359 - RNA, 22 nt, Leptospira interrogans serovar lai str. 56601
aaucgccgcuauggaauuuuuc

SEQ ID NO: 2776360 - RNA, 17 nt, Leptospira interrogans serovar lai str. 56601
aaucgcucgcaaauuuu

SEQ ID NO: 2776361 - RNA, 19 nt, Leptospira interrogans serovar lai str. 56601
aaucgcucgcgaauuucau

SEQ ID NO: 2776362 - RNA, 21 nt, Leptospira interrogans serovar lai str. 56601
aaucggaaauaccgcuggaaa

SEQ ID NO: 2776363 - RNA, 14 nt, Leptospira interrogans serovar lai str. 56601
aaucggaaauauaa

SEQ ID NO: 2776364 - RNA, 15 nt, Leptospira interrogans serovar lai str. 56601
aaucggagaauuuaa

SEQ ID NO: 2776365 - RNA, 20 nt, Leptospira interrogans serovar lai str. 56601
aaucgguucuauaaaagccg

SEQ ID NO: 2776366 - RNA, 22 nt, Leptospira interrogans serovar lai str. 56601
aaucguaguuuuacagccaucc

SEQ ID NO: 2776367 - RNA, 18 nt, Leptospira interrogans serovar lai str. 56601
aaucguccaaucucuuuc

SEQ ID NO: 2776368 - RNA, 19 nt, Leptospira interrogans serovar lai str. 56601
aaucgucuguaaaagaaaa

SEQ ID NO: 2776369 - RNA, 20 nt, Leptospira interrogans serovar lai str. 56601
aaucgucuguaaaagaaaaa

SEQ ID NO: 2776370 - RNA, 15 nt, Leptospira interrogans serovar lai str. 56601
aaucgugaauuuaca

SEQ ID NO: 2776371 - RNA, 16 nt, Leptospira interrogans serovar lai str. 56601
aaucgugaauuuacca

SEQ ID NO: 2776372 - RNA, 22 nt, Leptospira interrogans serovar lai str. 56601
aaucguguuugagauuaaaaag

SEQ ID NO: 2776373 - RNA, 16 nt, Leptospira interrogans serovar lai str. 56601
aaucguuuguaaaauc

SEQ ID NO: 2776374 - RNA, 15 nt, Leptospira interrogans serovar lai str. 56601
aaucguuuuaaaaac

SEQ ID NO: 2776375 - RNA, 17 nt, Leptospira interrogans serovar lai str. 56601
aaucguuuuaaaaaccu

SEQ ID NO: 2776376 - RNA, 14 nt, Leptospira interrogans serovar lai str. 56601
aaucuaaaaaaaau

SEQ ID NO: 2776377 - RNA, 22 nt, Leptospira interrogans serovar lai str. 56601
aaucuaaaaaaaaucaccgucc

SEQ ID NO: 2776378 - RNA, 16 nt, Leptospira interrogans serovar lai str. 56601
aaucuaaaaagaauca

SEQ ID NO: 2776379 - RNA, 12 nt, Leptospira interrogans serovar lai str. 56601
aaucuaaaaaua

SEQ ID NO: 2776380 - RNA, 14 nt, Leptospira interrogans serovar lai str. 56601
aaucuaaaagaaac

SEQ ID NO: 2776381 - RNA, 14 nt, Leptospira interrogans serovar lai str. 56601
aaucuaaacuugag

SEQ ID NO: 2776382 - RNA, 17 nt, Leptospira interrogans serovar lai str. 56601
aaucuaaauuuguaaua

SEQ ID NO: 2776383 - RNA, 14 nt, Leptospira interrogans serovar lai str. 56601
aaucuaaauuuguu

SEQ ID NO: 2776384 - RNA, 17 nt, Leptospira interrogans serovar lai str. 56601
aaugaacucaacagaac

SEQ ID NO: 2776385 - RNA, 18 nt, Leptospira interrogans serovar lai str. 56601
aaugaagaugagcaaaau

SEQ ID NO: 2776386 - RNA, 20 nt, Leptospira interrogans serovar lai str. 56601
aaugaaguguaaaacccauc

SEQ ID NO: 2776387 - RNA, 21 nt, Leptospira interrogans serovar lai str. 56601
aaugaaguguaaaacccaucg

SEQ ID NO: 2776388 - RNA, 14 nt, Leptospira interrogans serovar lai str. 56601
aaugaaucaugaau

SEQ ID NO: 2776389 - RNA, 19 nt, Leptospira interrogans serovar lai str. 56601
aaugaaucguaaaaaaaua

SEQ ID NO: 2776390 - RNA, 12 nt, Leptospira interrogans serovar lai str. 56601
aaugaauguuua

SEQ ID NO: 2776391 - RNA, 15 nt, Leptospira interrogans serovar lai str. 56601
aaugaauguuuaaaa

SEQ ID NO: 2776392 - RNA, 17 nt, Leptospira interrogans serovar lai str. 56601
aaugaauguuuaaaauu

SEQ ID NO: 2776393 - RNA, 13 nt, Leptospira interrogans serovar lai str. 56601
aaugaauuguaaa

SEQ ID NO: 2776394 - RNA, 14 nt, Leptospira interrogans serovar lai str. 56601
aaugaauuuuaaau

SEQ ID NO: 2776395 - RNA, 13 nt, Leptospira interrogans serovar lai str. 56601
aaugaauuuuuca

SEQ ID NO: 2776396 - RNA, 20 nt, Leptospira interrogans serovar lai str. 56601
aaugaauuuuucauuuuguu

SEQ ID NO: 2776397 - RNA, 20 nt, Leptospira interrogans serovar lai str. 56601
aaugacacuuaucaaauaga

SEQ ID NO: 2776398 - RNA, 15 nt, Leptospira interrogans serovar lai str. 56601
aaugacuugcauuua

SEQ ID NO: 2776399 - RNA, 22 nt, Leptospira interrogans serovar lai str. 56601
aaugagaguucgugaagaaauu

SEQ ID NO: 2776400 - RNA, 22 nt, Leptospira interrogans serovar lai str. 56601
aaugagauaucacaaauuuuaa

SEQ ID NO: 2776401 - RNA, 16 nt, Leptospira interrogans serovar lai str. 56601
aaugagauuaaaacug

SEQ ID NO: 2776402 - RNA, 20 nt, Leptospira interrogans serovar lai str. 56601
aaugagccagguuaauuaaa

SEQ ID NO: 2776403 - RNA, 21 nt, Leptospira interrogans serovar lai str. 56601
aaugagccagguuaauuaaau

SEQ ID NO: 2776404 - RNA, 18 nt, Leptospira interrogans serovar lai str. 56601
aaugagcuagauuuagau

SEQ ID NO: 2776405 - RNA, 16 nt, Leptospira interrogans serovar lai str. 56601
aaugaguaaacuauug

SEQ ID NO: 2776406 - RNA, 13 nt, Leptospira interrogans serovar lai str. 56601
aaugagucuuuuu

SEQ ID NO: 2776407 - RNA, 22 nt, Leptospira interrogans serovar lai str. 56601
aaugaguuauaguaaaagaaaa

SEQ ID NO: 2776408 - RNA, 23 nt, Leptospira interrogans serovar lai str. 56601
aaugaguuauaguaaaagaaaau

SEQ ID NO: 2776409 - RNA, 13 nt, Leptospira interrogans serovar lai str. 56601
aaugaguuuuaga

SEQ ID NO: 2776410 - RNA, 21 nt, Leptospira interrogans serovar lai str. 56601
aaugaguuuuagaauauuaag

SEQ ID NO: 2776411 - RNA, 13 nt, Leptospira interrogans serovar lai str. 56601
aaugauacuauua

SEQ ID NO: 2776412 - RNA, 15 nt, Leptospira interrogans serovar lai str. 56601
aaugauacuuuguaa

SEQ ID NO: 2776413 - RNA, 13 nt, Leptospira interrogans serovar lai str. 56601
aaugauagaaaua

SEQ ID NO: 2776414 - RNA, 19 nt, Leptospira interrogans serovar lai str. 56601
aaugauaggcuaaucaaau

SEQ ID NO: 2776415 - RNA, 22 nt, Leptospira interrogans serovar lai str. 56601
aaugauagugaucuaugauauu

SEQ ID NO: 2776416 - RNA, 15 nt, Leptospira interrogans serovar lai str. 56601
aaugaucaauagaau

SEQ ID NO: 2776417 - RNA, 18 nt, Leptospira interrogans serovar lai str. 56601
aaugauuuuuuaaaauaa

SEQ ID NO: 2776418 - RNA, 19 nt, Leptospira interrogans serovar lai str. 56601
aaugauuuuuuaaaauaac

SEQ ID NO: 2776419 - RNA, 14 nt, Leptospira interrogans serovar lai str. 56601
aaugcaaaaguuuu

SEQ ID NO: 2776420 - RNA, 20 nt, Leptospira interrogans serovar lai str. 56601
aaugcaaccuuacugcauuu

SEQ ID NO: 2776421 - RNA, 13 nt, Leptospira interrogans serovar lai str. 56601
aaugcaauauauu

SEQ ID NO: 2776422 - RNA, 23 nt, Leptospira interrogans serovar lai str. 56601
aaugcagcaaaaccuucgugaaa

SEQ ID NO: 2776423 - RNA, 14 nt, Leptospira interrogans serovar lai str. 56601
aaugcagcuucuuc

SEQ ID NO: 2776424 - RNA, 14 nt, Leptospira interrogans serovar lai str. 56601
aaugcaucucuucu

SEQ ID NO: 2776425 - RNA, 15 nt, Leptospira interrogans serovar lai str. 56601
aaugccgcaccuaau

SEQ ID NO: 2776426 - RNA, 21 nt, Leptospira interrogans serovar lai str. 56601
aaugcgauuguucuuguggga

SEQ ID NO: 2776427 - RNA, 14 nt, Leptospira interrogans serovar lai str. 56601
aaugcggaaacuuu

SEQ ID NO: 2776428 - RNA, 14 nt, Leptospira interrogans serovar lai str. 56601
aaugcucaaaaauu

SEQ ID NO: 2776429 - RNA, 21 nt, Leptospira interrogans serovar lai str. 56601
aaugcucgguacucuauuaua

SEQ ID NO: 2776430 - RNA, 13 nt, Leptospira interrogans serovar lai str. 56601
aaugcugauuuuu

SEQ ID NO: 2776431 - RNA, 18 nt, Leptospira interrogans serovar lai str. 56601
aaugcugauuuuucuuua

SEQ ID NO: 2776432 - RNA, 18 nt, Leptospira interrogans serovar lai str. 56601
aaugcuucauauaauaaa

SEQ ID NO: 2776433 - RNA, 14 nt, Leptospira interrogans serovar lai str. 56601
aauggaaaaaagau

SEQ ID NO: 2776434 - RNA, 13 nt, Leptospira interrogans serovar lai str. 56601
aauggaaaauuga

SEQ ID NO: 2776435 - RNA, 19 nt, Leptospira interrogans serovar lai str. 56601
aauggaauuuauuauaucg

SEQ ID NO: 2776436 - RNA, 13 nt, Leptospira interrogans serovar lai str. 56601
aauggacucauaa

SEQ ID NO: 2776437 - RNA, 16 nt, Leptospira interrogans serovar lai str. 56601
aauggaggauccuuuc

SEQ ID NO: 2776438 - RNA, 17 nt, Leptospira interrogans serovar lai str. 56601
aauggauaaauuuuaga

SEQ ID NO: 2776439 - RNA, 17 nt, Leptospira interrogans serovar lai str. 56601
aauggaucaaaagaguu

SEQ ID NO: 2776440 - RNA, 18 nt, Leptospira interrogans serovar lai str. 56601
aauggauggaaaaugaau

SEQ ID NO: 2776441 - RNA, 20 nt, Leptospira interrogans serovar lai str. 56601
aauggauuuuuauguaauau

SEQ ID NO: 2776442 - RNA, 18 nt, Leptospira interrogans serovar lai str. 56601
aauggccuucuagggcaa

SEQ ID NO: 2776443 - RNA, 21 nt, Leptospira interrogans serovar lai str. 56601
aauggcguauaagaauguuuu

SEQ ID NO: 2776444 - RNA, 21 nt, Leptospira interrogans serovar lai str. 56601
aaugggauuuuguaaugaaau

SEQ ID NO: 2776445 - RNA, 23 nt, Leptospira interrogans serovar lai str. 56601
aaugggauuuuguaaugaaaucu

SEQ ID NO: 2776446 - RNA, 17 nt, Leptospira interrogans serovar lai str. 56601
aauggggcaauugaagc

SEQ ID NO: 2776447 - RNA, 19 nt, Leptospira interrogans serovar lai str. 56601
aauguaaaaaaauauuaaa

SEQ ID NO: 2776448 - RNA, 16 nt, Leptospira interrogans serovar lai str. 56601
aauguaagaguuccua

SEQ ID NO: 2776449 - RNA, 15 nt, Leptospira interrogans serovar lai str. 56601
aauguacaacauccu

SEQ ID NO: 2776450 - RNA, 13 nt, Leptospira interrogans serovar lai str. 56601
aauguauaauccu

SEQ ID NO: 2776451 - RNA, 20 nt, Leptospira interrogans serovar lai str. 56601
aauguauaauccuuucccuu

SEQ ID NO: 2776452 - RNA, 14 nt, Leptospira interrogans serovar lai str. 56601
aauguauaccaaua

SEQ ID NO: 2776453 - RNA, 21 nt, Leptospira interrogans serovar lai str. 56601
aauguauccaauccaaaauug

SEQ ID NO: 2776454 - RNA, 16 nt, Leptospira interrogans serovar lai str. 56601
aauguaucgcuucuau

SEQ ID NO: 2776455 - RNA, 17 nt, Leptospira interrogans serovar lai str. 56601
aauguauucuauaaaau

SEQ ID NO: 2776456 - RNA, 19 nt, Leptospira interrogans serovar lai str. 56601
aauguauucuauaaaauuu

SEQ ID NO: 2776457 - RNA, 13 nt, Leptospira interrogans serovar lai str. 56601
aauguauugcuuu

SEQ ID NO: 2776458 - RNA, 23 nt, Leptospira interrogans serovar lai str. 56601
aaugucaacaggggcuuugauug

SEQ ID NO: 2776459 - RNA, 23 nt, Leptospira interrogans serovar lai str. 56601
aaugucauuugugcuauauucaa

SEQ ID NO: 2776460 - RNA, 17 nt, Leptospira interrogans serovar lai str. 56601
aaugucuaugauuaaag

SEQ ID NO: 2776461 - RNA, 23 nt, Leptospira interrogans serovar lai str. 56601
aaugugacggcaaugugcaaagg

SEQ ID NO: 2776462 - RNA, 11 nt, Leptospira interrogans serovar lai str. 56601
aaugugagagu

SEQ ID NO: 2776463 - RNA, 16 nt, Leptospira interrogans serovar lai str. 56601
aaugugagaguuccca

SEQ ID NO: 2776464 - RNA, 20 nt, Leptospira interrogans serovar lai str. 56601
aaugugaguggauugccauc

SEQ ID NO: 2776465 - RNA, 20 nt, Leptospira interrogans serovar lai str. 56601
aaugugggaacuaccaccaa

SEQ ID NO: 2776466 - RNA, 15 nt, Leptospira interrogans serovar lai str. 56601
aaugugggaacuacu

SEQ ID NO: 2776467 - RNA, 23 nt, Leptospira interrogans serovar lai str. 56601
aauuaugauuucacgaacacaaa

SEQ ID NO: 2776468 - RNA, 22 nt, Leptospira interrogans serovar lai str. 56601
aauuauggcacuuauucuuaua

SEQ ID NO: 2776469 - RNA, 19 nt, Leptospira interrogans serovar lai str. 56601
aauuauguuugccauuuuu

SEQ ID NO: 2776470 - RNA, 14 nt, Leptospira interrogans serovar lai str. 56601
aauuauuauaaacu

SEQ ID NO: 2776471 - RNA, 17 nt, Leptospira interrogans serovar lai str. 56601
aauuauugauaaaaaaa

SEQ ID NO: 2776472 - RNA, 18 nt, Leptospira interrogans serovar lai str. 56601
aauuauugauaaaaaaau

SEQ ID NO: 2776473 - RNA, 19 nt, Leptospira interrogans serovar lai str. 56601
aauuauugauaaaaaaaug

SEQ ID NO: 2776474 - RNA, 21 nt, Leptospira interrogans serovar lai str. 56601
aauuauugauaaaaaaauguu

SEQ ID NO: 2776475 - RNA, 20 nt, Leptospira interrogans serovar lai str. 56601
aauuauuuacuuuuuccaaa

SEQ ID NO: 2776476 - RNA, 21 nt, Leptospira interrogans serovar lai str. 56601
aauuauuuacuuuuuccaaaa

SEQ ID NO: 2776477 - RNA, 22 nt, Leptospira interrogans serovar lai str. 56601
aauuauuuacuuuuuccaaaag

SEQ ID NO: 2776478 - RNA, 21 nt, Leptospira interrogans serovar lai str. 56601
aauuauuuauuucaauacaac

SEQ ID NO: 2776479 - RNA, 19 nt, Leptospira interrogans serovar lai str. 56601
aauuauuuuaggauuuuug

SEQ ID NO: 2776480 - RNA, 13 nt, Leptospira interrogans serovar lai str. 56601
aauucaaaaagaa

SEQ ID NO: 2776481 - RNA, 19 nt, Leptospira interrogans serovar lai str. 56601
aauucaaaauaagaaaaua

SEQ ID NO: 2776482 - RNA, 18 nt, Leptospira interrogans serovar lai str. 56601
aauucaaaggccgcuucu

SEQ ID NO: 2776483 - RNA, 20 nt, Leptospira interrogans serovar lai str. 56601
aauucaaccgcaaauuuuuu

SEQ ID NO: 2776484 - RNA, 16 nt, Leptospira interrogans serovar lai str. 56601
aauucaacuuguaaaa

SEQ ID NO: 2776485 - RNA, 19 nt, Leptospira interrogans serovar lai str. 56601
aauucaacuuguaaaacag

SEQ ID NO: 2776486 - RNA, 20 nt, Leptospira interrogans serovar lai str. 56601
aauucaacuuguaaaacagc

SEQ ID NO: 2776487 - RNA, 14 nt, Leptospira interrogans serovar lai str. 56601
aauucacauaaagu

SEQ ID NO: 2776488 - RNA, 18 nt, Leptospira interrogans serovar lai str. 56601
aauucacauaaaguuaau

SEQ ID NO: 2776489 - RNA, 18 nt, Leptospira interrogans serovar lai str. 56601
aauucacgaccuuaaaua

SEQ ID NO: 2776490 - RNA, 18 nt, Leptospira interrogans serovar lai str. 56601
aauucacguuaaaauaau

SEQ ID NO: 2776491 - RNA, 22 nt, Leptospira interrogans serovar lai str. 56601
aauucacguuaaaauaaugaua

SEQ ID NO: 2776492 - RNA, 22 nt, Leptospira interrogans serovar lai str. 56601
aauucacguuauuuagaucaaa

SEQ ID NO: 2776493 - RNA, 21 nt, Leptospira interrogans serovar lai str. 56601
aauucacguucaacaaacaaa

SEQ ID NO: 2776494 - RNA, 20 nt, Leptospira interrogans serovar lai str. 56601
aauucacucuuaaauacuua

SEQ ID NO: 2776495 - RNA, 14 nt, Leptospira interrogans serovar lai str. 56601
aauucacuguuaaa

SEQ ID NO: 2776496 - RNA, 20 nt, Leptospira interrogans serovar lai str. 56601
aauucacuguuaaaagauuu

SEQ ID NO: 2776497 - RNA, 19 nt, Leptospira interrogans serovar lai str. 56601
aauucagaaaaaaaaagaa

SEQ ID NO: 2776498 - RNA, 20 nt, Leptospira interrogans serovar lai str. 56601
aauucagaaaaaaaaagaau

SEQ ID NO: 2776499 - RNA, 21 nt, Leptospira interrogans serovar lai str. 56601
aauucagaaaaaaaaagaauu

SEQ ID NO: 2776500 - RNA, 22 nt, Leptospira interrogans serovar lai str. 56601
aauucagaaaaaaaaagaauuu

SEQ ID NO: 2776501 - RNA, 13 nt, Leptospira interrogans serovar lai str. 56601
aauucagauuuca

SEQ ID NO: 2776502 - RNA, 23 nt, Leptospira interrogans serovar lai str. 56601
aauucagauuucagcuccaaaaa

SEQ ID NO: 2776503 - RNA, 16 nt, Leptospira interrogans serovar lai str. 56601
aauucagcaucgaaua

SEQ ID NO: 2776504 - RNA, 23 nt, Leptospira interrogans serovar lai str. 56601
aauucagcuuauugaugauugaa

SEQ ID NO: 2776505 - RNA, 16 nt, Leptospira interrogans serovar lai str. 56601
aauucaggauaaacau

SEQ ID NO: 2776506 - RNA, 21 nt, Leptospira interrogans serovar lai str. 56601
aauucaggugggaguuuagaa

SEQ ID NO: 2776507 - RNA, 13 nt, Leptospira interrogans serovar lai str. 56601
aauucaguaaauu

SEQ ID NO: 2776508 - RNA, 13 nt, Leptospira interrogans serovar lai str. 56601
aauucaguuuuuc

SEQ ID NO: 2776509 - RNA, 18 nt, Leptospira interrogans serovar lai str. 56601
aauucaguuuuucggaug

SEQ ID NO: 2776510 - RNA, 13 nt, Leptospira interrogans serovar lai str. 56601
aauucauaauaaa

SEQ ID NO: 2776511 - RNA, 17 nt, Leptospira interrogans serovar lai str. 56601
aauucauaauaaaacua

SEQ ID NO: 2776512 - RNA, 20 nt, Leptospira interrogans serovar lai str. 56601
aauucauacuuuuaaaaagu

SEQ ID NO: 2776513 - RNA, 20 nt, Leptospira interrogans serovar lai str. 56601
aauucauauugagauaaaaa

SEQ ID NO: 2776514 - RNA, 22 nt, Leptospira interrogans serovar lai str. 56601
aauucauauugagauaaaaagu

SEQ ID NO: 2776515 - RNA, 20 nt, Leptospira interrogans serovar lai str. 56601
aauucaucaaauuugcuuca

SEQ ID NO: 2776516 - RNA, 16 nt, Leptospira interrogans serovar lai str. 56601
aauucaucaaugaaua

SEQ ID NO: 2776517 - RNA, 22 nt, Leptospira interrogans serovar lai str. 56601
aauucaucuccuccgauucuga

SEQ ID NO: 2776518 - RNA, 18 nt, Leptospira interrogans serovar lai str. 56601
aauucauuguaagaaaua

SEQ ID NO: 2776519 - RNA, 16 nt, Leptospira interrogans serovar lai str. 56601
aauucauuuuacagaa

SEQ ID NO: 2776520 - RNA, 23 nt, Leptospira interrogans serovar lai str. 56601
aauucauuuuucuacaauuauau

SEQ ID NO: 2776521 - RNA, 18 nt, Leptospira interrogans serovar lai str. 56601
aauucauuuuucugaaaa

SEQ ID NO: 2776522 - RNA, 15 nt, Leptospira interrogans serovar lai str. 56601
aauuccaauuuuucu

SEQ ID NO: 2776523 - RNA, 20 nt, Leptospira interrogans serovar lai str. 56601
aauuccaccuuggaaagaaa

SEQ ID NO: 2776524 - RNA, 17 nt, Leptospira interrogans serovar lai str. 56601
aauuccacuaugaaagu

SEQ ID NO: 2776525 - RNA, 22 nt, Leptospira interrogans serovar lai str. 56601
aauuccacuaugaaaguuuuuc

SEQ ID NO: 2776526 - RNA, 15 nt, Leptospira interrogans serovar lai str. 56601
aauuccacuucucac

SEQ ID NO: 2776527 - RNA, 22 nt, Leptospira interrogans serovar lai str. 56601
aauucccaaugaugaauucugg

SEQ ID NO: 2776528 - RNA, 23 nt, Leptospira interrogans serovar lai str. 56601
aauuccccaaaaugaauuguaaa

SEQ ID NO: 2776529 - RNA, 18 nt, Leptospira interrogans serovar lai str. 56601
aauuccgacccagaaaaa

SEQ ID NO: 2776530 - RNA, 19 nt, Leptospira interrogans serovar lai str. 56601
aauuccgacccagaaaaaa

SEQ ID NO: 2776531 - RNA, 13 nt, Leptospira interrogans serovar lai str. 56601
aauuccuaaaugc

SEQ ID NO: 2776532 - RNA, 23 nt, Leptospira interrogans serovar lai str. 56601
aauuccuaaugcagcuucuucca

SEQ ID NO: 2776533 - RNA, 19 nt, Leptospira interrogans serovar lai str. 56601
aauuccuguaguauuucca

SEQ ID NO: 2776534 - RNA, 16 nt, Leptospira interrogans serovar lai str. 56601
aauuccuuccaaguuu

SEQ ID NO: 2776535 - RNA, 17 nt, Leptospira interrogans serovar lai str. 56601
aauucgaucuaagaaau

SEQ ID NO: 2776536 - RNA, 22 nt, Leptospira interrogans serovar lai str. 56601
aauucgccguaaaaaauccaug

SEQ ID NO: 2776537 - RNA, 23 nt, Leptospira interrogans serovar lai str. 56601
aauucgccguaaaaaauccauga

SEQ ID NO: 2776538 - RNA, 21 nt, Leptospira interrogans serovar lai str. 56601
aauucgucaaaaccaaaacau

SEQ ID NO: 2776539 - RNA, 13 nt, Leptospira interrogans serovar lai str. 56601
aauucguuccaaa

SEQ ID NO: 2776540 - RNA, 15 nt, Leptospira interrogans serovar lai str. 56601
aauucguuccaaaua

SEQ ID NO: 2776541 - RNA, 18 nt, Leptospira interrogans serovar lai str. 56601
aauucguuuuuuaaaaug

SEQ ID NO: 2776542 - RNA, 20 nt, Leptospira interrogans serovar lai str. 56601
aauucguuuuuuaaaaugua

SEQ ID NO: 2776543 - RNA, 24 nt, Leptospira interrogans serovar lai str. 56601
aauucguuuuuuaaaauguaggaa

SEQ ID NO: 2776544 - RNA, 17 nt, Leptospira interrogans serovar lai str. 56601
aauucuaaaaauuuuuu

SEQ ID NO: 2776545 - RNA, 14 nt, Leptospira interrogans serovar lai str. 56601
aauucuaaaauacu

SEQ ID NO: 2776546 - RNA, 14 nt, Leptospira interrogans serovar lai str. 56601
aauucuaaaaucau

SEQ ID NO: 2776547 - RNA, 23 nt, Leptospira interrogans serovar lai str. 56601
aauucuaaaaucauacuuuuaaa

SEQ ID NO: 2776548 - RNA, 15 nt, Leptospira interrogans serovar lai str. 56601
aauucuaaaauugua

SEQ ID NO: 2776549 - RNA, 15 nt, Leptospira interrogans serovar lai str. 56601
aauuguugaagaauu

SEQ ID NO: 2776550 - RNA, 16 nt, Leptospira interrogans serovar lai str. 56601
aauuguugaagaauua

SEQ ID NO: 2776551 - RNA, 21 nt, Leptospira interrogans serovar lai str. 56601
aauuguugaauccuacuaaca

SEQ ID NO: 2776552 - RNA, 17 nt, Leptospira interrogans serovar lai str. 56601
aauuguuguuauggaau

SEQ ID NO: 2776553 - RNA, 22 nt, Leptospira interrogans serovar lai str. 56601
aauuguuguuauggaauuuuuc

SEQ ID NO: 2776554 - RNA, 15 nt, Leptospira interrogans serovar lai str. 56601
aauuguuugaaaguu

SEQ ID NO: 2776555 - RNA, 23 nt, Leptospira interrogans serovar lai str. 56601
aauuguuugaucucgggaaaaaa

SEQ ID NO: 2776556 - RNA, 14 nt, Leptospira interrogans serovar lai str. 56601
aauuuaaaaaaauc

SEQ ID NO: 2776557 - RNA, 17 nt, Leptospira interrogans serovar lai str. 56601
aauuuaaaaaaaucacu

SEQ ID NO: 2776558 - RNA, 21 nt, Leptospira interrogans serovar lai str. 56601
aauuuaaaacuugucccaaaa

SEQ ID NO: 2776559 - RNA, 13 nt, Leptospira interrogans serovar lai str. 56601
aauuuaaaauaua

SEQ ID NO: 2776560 - RNA, 20 nt, Leptospira interrogans serovar lai str. 56601
aauuuaaaaucguaaaaaag

SEQ ID NO: 2776561 - RNA, 16 nt, Leptospira interrogans serovar lai str. 56601
aauuuaaacaacagua

SEQ ID NO: 2776562 - RNA, 12 nt, Leptospira interrogans serovar lai str. 56601
aauuuaaaugua

SEQ ID NO: 2776563 - RNA, 17 nt, Leptospira interrogans serovar lai str. 56601
aauuuaaauguauguuu

SEQ ID NO: 2776564 - RNA, 19 nt, Leptospira interrogans serovar lai str. 56601
aauuuaaauguuuuuguau

SEQ ID NO: 2776565 - RNA, 21 nt, Leptospira interrogans serovar lai str. 56601
aauuuaaauguuuuuguauuu

SEQ ID NO: 2776566 - RNA, 20 nt, Leptospira interrogans serovar lai str. 56601
aauuuaacgacauuagaacu

SEQ ID NO: 2776567 - RNA, 17 nt, Leptospira interrogans serovar lai str. 56601
aauuuaacgauauuaga

SEQ ID NO: 2776568 - RNA, 23 nt, Leptospira interrogans serovar lai str. 56601
aauuuaacuacacgagagcugcu

SEQ ID NO: 2776569 - RNA, 12 nt, Leptospira interrogans serovar lai str. 56601
aauuuaaguauu

SEQ ID NO: 2776570 - RNA, 16 nt, Leptospira interrogans serovar lai str. 56601
aauuuaaguauuauaa

SEQ ID NO: 2776571 - RNA, 16 nt, Leptospira interrogans serovar lai str. 56601
aauuuaauaaaaaaau

SEQ ID NO: 2776572 - RNA, 16 nt, Leptospira interrogans serovar lai str. 56601
aauuuaauacaauauu

SEQ ID NO: 2776573 - RNA, 16 nt, Leptospira interrogans serovar lai str. 56601
aauuuaauauauuaaa

SEQ ID NO: 2776574 - RNA, 22 nt, Leptospira interrogans serovar lai str. 56601
aauuuacaguuaaacuuugaaa

SEQ ID NO: 2776575 - RNA, 18 nt, Leptospira interrogans serovar lai str. 56601
aauuuacaucauguaaua

SEQ ID NO: 2776576 - RNA, 21 nt, Leptospira interrogans serovar lai str. 56601
aauuuacaucauguaauauaa

SEQ ID NO: 2776577 - RNA, 15 nt, Leptospira interrogans serovar lai str. 56601
aauuuaccaguuaaa

SEQ ID NO: 2776578 - RNA, 19 nt, Leptospira interrogans serovar lai str. 56601
aauuuacgaaaauuuuuua

SEQ ID NO: 2776579 - RNA, 16 nt, Leptospira interrogans serovar lai str. 56601
aauuuacgauucuaaa

SEQ ID NO: 2776580 - RNA, 16 nt, Leptospira interrogans serovar lai str. 56601
aauuuacuacaucuaa

SEQ ID NO: 2776581 - RNA, 22 nt, Leptospira interrogans serovar lai str. 56601
aauuuacuacaucuaaugauuu

SEQ ID NO: 2776582 - RNA, 15 nt, Leptospira interrogans serovar lai str. 56601
aauuuacuauuuuga

SEQ ID NO: 2776583 - RNA, 18 nt, Leptospira interrogans serovar lai str. 56601
aauuuacuauuuugauga

SEQ ID NO: 2776584 - RNA, 23 nt, Leptospira interrogans serovar lai str. 56601
aauuuacuauuuugaugaaugaa

SEQ ID NO: 2776585 - RNA, 16 nt, Leptospira interrogans serovar lai str. 56601
aauuuacucuuauaaa

SEQ ID NO: 2776586 - RNA, 19 nt, Leptospira interrogans serovar lai str. 56601
aauuuacucuuauaaaauu

SEQ ID NO: 2776587 - RNA, 23 nt, Leptospira interrogans serovar lai str. 56601
aauuuacucuuauaaaauuuuag

SEQ ID NO: 2776588 - RNA, 14 nt, Leptospira interrogans serovar lai str. 56601
aauuuacuucaauu

SEQ ID NO: 2776589 - RNA, 19 nt, Leptospira interrogans serovar lai str. 56601
aauuuacuucaauuaucua

SEQ ID NO: 2776590 - RNA, 15 nt, Leptospira interrogans serovar lai str. 56601
aauuuacuucauucg

SEQ ID NO: 2776591 - RNA, 15 nt, Leptospira interrogans serovar lai str. 56601
aauuuacuugaucag

SEQ ID NO: 2776592 - RNA, 17 nt, Leptospira interrogans serovar lai str. 56601
aauuuagaaaauuagaa

SEQ ID NO: 2776593 - RNA, 18 nt, Leptospira interrogans serovar lai str. 56601
aauuuagaaauagauaua

SEQ ID NO: 2776594 - RNA, 12 nt, Leptospira interrogans serovar lai str. 56601
aauuuagaaauu

SEQ ID NO: 2776595 - RNA, 16 nt, Leptospira interrogans serovar lai str. 56601
aauuuagaaauuuaua

SEQ ID NO: 2776596 - RNA, 17 nt, Leptospira interrogans serovar lai str. 56601
aauuuagaaauuuauac

SEQ ID NO: 2776597 - RNA, 13 nt, Leptospira interrogans serovar lai str. 56601
aauuuagaauaaa

SEQ ID NO: 2776598 - RNA, 20 nt, Leptospira interrogans serovar lai str. 56601
aauuuagcuaagucuuuaaa

SEQ ID NO: 2776599 - RNA, 12 nt, Leptospira interrogans serovar lai str. 56601
aauuuaggaaau

SEQ ID NO: 2776600 - RNA, 18 nt, Leptospira interrogans serovar lai str. 56601
aauuuaggaagcguuuua

SEQ ID NO: 2776601 - RNA, 20 nt, Leptospira interrogans serovar lai str. 56601
aauuuaguauauuuugaucu

SEQ ID NO: 2776602 - RNA, 19 nt, Leptospira interrogans serovar lai str. 56601
aauuuaguaucauaaguuu

SEQ ID NO: 2776603 - RNA, 14 nt, Leptospira interrogans serovar lai str. 56601
aauuuaguuuuugu

SEQ ID NO: 2776604 - RNA, 20 nt, Leptospira interrogans serovar lai str. 56601
aauuuaguuuuuguaugagu

SEQ ID NO: 2776605 - RNA, 18 nt, Leptospira interrogans serovar lai str. 56601
aauuuauaaauguaggaa

SEQ ID NO: 2776606 - RNA, 21 nt, Leptospira interrogans serovar lai str. 56601
aauuuauaaauguaggaacua

SEQ ID NO: 2776607 - RNA, 14 nt, Leptospira interrogans serovar lai str. 56601
aauuuauagauaua

SEQ ID NO: 2776608 - RNA, 15 nt, Leptospira interrogans serovar lai str. 56601
aauuuauagauauaa

SEQ ID NO: 2776609 - RNA, 24 nt, Leptospira interrogans serovar lai str. 56601
aauuuauaggaucguauuuuagaa

SEQ ID NO: 2776610 - RNA, 13 nt, Leptospira interrogans serovar lai str. 56601
aauuuauaugauu

SEQ ID NO: 2776611 - RNA, 16 nt, Leptospira interrogans serovar lai str. 56601
aauuuaucauuucuuu

SEQ ID NO: 2776612 - RNA, 16 nt, Leptospira interrogans serovar lai str. 56601
aauuuaucgauuuaaa

SEQ ID NO: 2776613 - RNA, 18 nt, Leptospira interrogans serovar lai str. 56601
aauuuaucgauuuaaaaa

SEQ ID NO: 2776614 - RNA, 20 nt, Leptospira interrogans serovar lai str. 56601
aauuuaucgauuuaaaaacu

SEQ ID NO: 2776615 - RNA, 21 nt, Leptospira interrogans serovar lai str. 56601
aauuuaucgauuuaaaaacua

SEQ ID NO: 2776616 - RNA, 13 nt, Leptospira interrogans serovar lai str. 56601
aauuuaucuguaa

SEQ ID NO: 2776617 - RNA, 20 nt, Leptospira interrogans serovar lai str. 56601
aauuuaucuguaauuuuaca

SEQ ID NO: 2776618 - RNA, 16 nt, Leptospira interrogans serovar lai str. 56601
aauuuauguacuuuua

SEQ ID NO: 2776619 - RNA, 22 nt, Leptospira interrogans serovar lai str. 56601
aauuuauguacuuuuaagaauu

SEQ ID NO: 2776620 - RNA, 19 nt, Leptospira interrogans serovar lai str. 56601
aauuuauguuucaguauuc

SEQ ID NO: 2776621 - RNA, 13 nt, Leptospira interrogans serovar lai str. 56601
aauuuauuauaga

SEQ ID NO: 2776622 - RNA, 13 nt, Leptospira interrogans serovar lai str. 56601
aauuuauuauauc

SEQ ID NO: 2776623 - RNA, 15 nt, Leptospira interrogans serovar lai str. 56601
aauuuauucucuauc

SEQ ID NO: 2776624 - RNA, 16 nt, Leptospira interrogans serovar lai str. 56601
aauuuauuuguaaaau

SEQ ID NO: 2776625 - RNA, 13 nt, Leptospira interrogans serovar lai str. 56601
aauuuauuuuaaa

SEQ ID NO: 2776626 - RNA, 17 nt, Leptospira interrogans serovar lai str. 56601
aauuucaauaacuugac

SEQ ID NO: 2776627 - RNA, 19 nt, Leptospira interrogans serovar lai str. 56601
aauuucagauauuuucgcc

SEQ ID NO: 2776628 - RNA, 21 nt, Leptospira interrogans serovar lai str. 56601
aauuucagcgcauuuagaaga

SEQ ID NO: 2776629 - RNA, 21 nt, Leptospira interrogans serovar lai str. 56601
aauuucagucaauaaauugua

SEQ ID NO: 2776630 - RNA, 18 nt, Leptospira interrogans serovar lai str. 56601
aauuucauaaaauucuua

SEQ ID NO: 2776631 - RNA, 22 nt, Leptospira interrogans serovar lai str. 56601
aauuucauagugggauugccaa

SEQ ID NO: 2776632 - RNA, 15 nt, Leptospira interrogans serovar lai str. 56601
aauuuuuaaaaagaa

SEQ ID NO: 2776633 - RNA, 16 nt, Leptospira interrogans serovar lai str. 56601
aauuuuuaaaaagaau

SEQ ID NO: 2776634 - RNA, 13 nt, Leptospira interrogans serovar lai str. 56601
aauuuuuaaaaau

SEQ ID NO: 2776635 - RNA, 21 nt, Leptospira interrogans serovar lai str. 56601
aauuuuuaaaaguagaaucau

SEQ ID NO: 2776636 - RNA, 15 nt, Leptospira interrogans serovar lai str. 56601
aauuuuuaagaauaa

SEQ ID NO: 2776637 - RNA, 16 nt, Leptospira interrogans serovar lai str. 56601
aauuuuuaauaaaaua

SEQ ID NO: 2776638 - RNA, 17 nt, Leptospira interrogans serovar lai str. 56601
aauuuuuaauaaaaugc

SEQ ID NO: 2776639 - RNA, 13 nt, Leptospira interrogans serovar lai str. 56601
aauuuuuaaucaa

SEQ ID NO: 2776640 - RNA, 17 nt, Leptospira interrogans serovar lai str. 56601
aauuuuuacucaaagaa

SEQ ID NO: 2776641 - RNA, 22 nt, Leptospira interrogans serovar lai str. 56601
aauuuuuacucaaagaaucgag

SEQ ID NO: 2776642 - RNA, 23 nt, Leptospira interrogans serovar lai str. 56601
aauuuuuagaagaaggucucaca

SEQ ID NO: 2776643 - RNA, 11 nt, Leptospira interrogans serovar lai str. 56601
aauuuuuagag

SEQ ID NO: 2776644 - RNA, 14 nt, Leptospira interrogans serovar lai str. 56601
aauuuuuagaguuu

SEQ ID NO: 2776645 - RNA, 16 nt, Leptospira interrogans serovar lai str. 56601
aauuuuuauaaaaaua

SEQ ID NO: 2776646 - RNA, 15 nt, Leptospira interrogans serovar lai str. 56601
aauuuuuauaaaaua

SEQ ID NO: 2776647 - RNA, 19 nt, Leptospira interrogans serovar lai str. 56601
aauuuuuauaaaauaccaa

SEQ ID NO: 2776648 - RNA, 18 nt, Leptospira interrogans serovar lai str. 56601
aauuuuuauaaguuuaau

SEQ ID NO: 2776649 - RNA, 11 nt, Leptospira interrogans serovar lai str. 56601
aauuuuuauga

SEQ ID NO: 2776650 - RNA, 17 nt, Leptospira interrogans serovar lai str. 56601
aauuuuuauuggaaaaa

SEQ ID NO: 2776651 - RNA, 16 nt, Leptospira interrogans serovar lai str. 56601
aauuuuucaaaaacuc

SEQ ID NO: 2776652 - RNA, 20 nt, Leptospira interrogans serovar lai str. 56601
aauuuuucaacaacucuaau

SEQ ID NO: 2776653 - RNA, 19 nt, Leptospira interrogans serovar lai str. 56601
aauuuuucauuuuguuucu

SEQ ID NO: 2776654 - RNA, 23 nt, Leptospira interrogans serovar lai str. 56601
aauuuuucgaaacaaaaucaaag

SEQ ID NO: 2776655 - RNA, 13 nt, Leptospira interrogans serovar lai str. 56601
aauuuuucucccu

SEQ ID NO: 2776656 - RNA, 20 nt, Leptospira interrogans serovar lai str. 56601
aauuuuucucuaucagaaaa

SEQ ID NO: 2776657 - RNA, 18 nt, Leptospira interrogans serovar lai str. 56601
aauuuuucugaaaaguuu

SEQ ID NO: 2776658 - RNA, 12 nt, Leptospira interrogans serovar lai str. 56601
aauuuuucuuaa

SEQ ID NO: 2776659 - RNA, 13 nt, Leptospira interrogans serovar lai str. 56601
aauuuuugaauca

SEQ ID NO: 2776660 - RNA, 15 nt, Leptospira interrogans serovar lai str. 56601
aauuuuuguacaaaa

SEQ ID NO: 2776661 - RNA, 17 nt, Leptospira interrogans serovar lai str. 56601
aauuuuuguuuguaaaa

SEQ ID NO: 2776662 - RNA, 16 nt, Leptospira interrogans serovar lai str. 56601
aauuuuuuaaaaauuu

SEQ ID NO: 2776663 - RNA, 20 nt, Leptospira interrogans serovar lai str. 56601
aauuuuuuaacaacucuaau

SEQ ID NO: 2776664 - RNA, 22 nt, Leptospira interrogans serovar lai str. 56601
aauuuuuuagaguuaagagaau

SEQ ID NO: 2776665 - RNA, 21 nt, Leptospira interrogans serovar lai str. 56601
aauuuuuuauuaagaacuuuc

SEQ ID NO: 2776666 - RNA, 15 nt, Leptospira interrogans serovar lai str. 56601
aauuuuuucacaaaa

SEQ ID NO: 2776667 - RNA, 11 nt, Leptospira interrogans serovar lai str. 56601
aauuuuuuccc

SEQ ID NO: 2776668 - RNA, 13 nt, Leptospira interrogans serovar lai str. 56601
aauuuuuuccuuu

SEQ ID NO: 2776669 - RNA, 17 nt, Leptospira interrogans serovar lai str. 56601
aauuuuuucguuccuuu

SEQ ID NO: 2776670 - RNA, 17 nt, Leptospira interrogans serovar lai str. 56601
aauuuuuucuuuuuagg

SEQ ID NO: 2776671 - RNA, 13 nt, Leptospira interrogans serovar lai str. 56601
aauuuuuugaaaa

SEQ ID NO: 2776672 - RNA, 14 nt, Leptospira interrogans serovar lai str. 56601
aauuuuuugaaaaa

SEQ ID NO: 2776673 - RNA, 14 nt, Leptospira interrogans serovar lai str. 56601
aauuuuuuggaaau

SEQ ID NO: 2776674 - RNA, 13 nt, Leptospira interrogans serovar lai str. 56601
aauuuuuuuaaga

SEQ ID NO: 2776675 - RNA, 20 nt, Leptospira interrogans serovar lai str. 56601
aauuuuuuuaagaauuuguu

SEQ ID NO: 2776676 - RNA, 22 nt, Leptospira interrogans serovar lai str. 56601
aauuuuuuuaagagccuacaaa

SEQ ID NO: 2776677 - RNA, 23 nt, Leptospira interrogans serovar lai str. 56601
aauuuuuuuaagagccuacaaau

SEQ ID NO: 2776678 - RNA, 17 nt, Leptospira interrogans serovar lai str. 56601
aauuuuuuucuaaaaua

SEQ ID NO: 2776679 - RNA, 16 nt, Leptospira interrogans serovar lai str. 56601
aauuuuuuugauucaa

SEQ ID NO: 2776680 - RNA, 13 nt, Leptospira interrogans serovar lai str. 56601
aauuuuuuuguau

SEQ ID NO: 2776681 - RNA, 15 nt, Leptospira interrogans serovar lai str. 56601
aauuuuuuuguauau

SEQ ID NO: 2776682 - RNA, 18 nt, Leptospira interrogans serovar lai str. 56601
aauuuuuuuuauuuuuag

SEQ ID NO: 2776683 - RNA, 16 nt, Leptospira interrogans serovar lai str. 56601
acaaaaaauguuuaaa

SEQ ID NO: 2776684 - RNA, 17 nt, Leptospira interrogans serovar lai str. 56601
acaaaaacaaauucacg

SEQ ID NO: 2776685 - RNA, 19 nt, Leptospira interrogans serovar lai str. 56601
acaaaaacaaauucacguu

SEQ ID NO: 2776686 - RNA, 22 nt, Leptospira interrogans serovar lai str. 56601
acaaaaaguguuuauaauuuuu

SEQ ID NO: 2776687 - RNA, 17 nt, Leptospira interrogans serovar lai str. 56601
acaaaaaugaaaaaacu

SEQ ID NO: 2776688 - RNA, 14 nt, Leptospira interrogans serovar lai str. 56601
acaaaaaugagaau

SEQ ID NO: 2776689 - RNA, 18 nt, Leptospira interrogans serovar lai str. 56601
acaaaacacuucuuguaa

SEQ ID NO: 2776690 - RNA, 16 nt, Leptospira interrogans serovar lai str. 56601
acaaaacuacuucaau

SEQ ID NO: 2776691 - RNA, 20 nt, Leptospira interrogans serovar lai str. 56601
acaaaacuacuucaaucgac

SEQ ID NO: 2776692 - RNA, 13 nt, Leptospira interrogans serovar lai str. 56601
acaaaacuuaaau

SEQ ID NO: 2776693 - RNA, 15 nt, Leptospira interrogans serovar lai str. 56601
acaaaacuuaaguuu

SEQ ID NO: 2776694 - RNA, 17 nt, Leptospira interrogans serovar lai str. 56601
acaaaagcguuguauaa

SEQ ID NO: 2776695 - RNA, 11 nt, Leptospira interrogans serovar lai str. 56601
acaaaauuuac

SEQ ID NO: 2776696 - RNA, 19 nt, Leptospira interrogans serovar lai str. 56601
acaaaauuuacgaaaauuu

SEQ ID NO: 2776697 - RNA, 13 nt, Leptospira interrogans serovar lai str. 56601
acaaaauuuagaa

SEQ ID NO: 2776698 - RNA, 23 nt, Leptospira interrogans serovar lai str. 56601
acaaaauuuuuuccuuuaaacuu

SEQ ID NO: 2776699 - RNA, 19 nt, Leptospira interrogans serovar lai str. 56601
acaaacgguuuuaguaaaa

SEQ ID NO: 2776700 - RNA, 14 nt, Leptospira interrogans serovar lai str. 56601
acaaacuaucuuaa

SEQ ID NO: 2776701 - RNA, 13 nt, Leptospira interrogans serovar lai str. 56601
acaaacuauucua

SEQ ID NO: 2776702 - RNA, 14 nt, Leptospira interrogans serovar lai str. 56601
acaaacuauucuau

SEQ ID NO: 2776703 - RNA, 19 nt, Leptospira interrogans serovar lai str. 56601
acaaacucuugaacagaaa

SEQ ID NO: 2776704 - RNA, 14 nt, Leptospira interrogans serovar lai str. 56601
acaaagaauaccaa

SEQ ID NO: 2776705 - RNA, 15 nt, Leptospira interrogans serovar lai str. 56601
acaaagaguuuaaaa

SEQ ID NO: 2776706 - RNA, 9 nt, Leptospira interrogans serovar lai str. 56601
acaaagauu

SEQ ID NO: 2776707 - RNA, 12 nt, Leptospira interrogans serovar lai str. 56601
acaaaguauuuu

SEQ ID NO: 2776708 - RNA, 14 nt, Leptospira interrogans serovar lai str. 56601
acaaauaaaacuuc

SEQ ID NO: 2776709 - RNA, 20 nt, Leptospira interrogans serovar lai str. 56601
acaaauaaaacuucuccuuu

SEQ ID NO: 2776710 - RNA, 14 nt, Leptospira interrogans serovar lai str. 56601
acaaauagaaauaa

SEQ ID NO: 2776711 - RNA, 20 nt, Leptospira interrogans serovar lai str. 56601
acaaauagagugccaaaauu

SEQ ID NO: 2776712 - RNA, 21 nt, Leptospira interrogans serovar lai str. 56601
acaaauagagugccaaaauuu

SEQ ID NO: 2776713 - RNA, 14 nt, Leptospira interrogans serovar lai str. 56601
acaaauaucaugau

SEQ ID NO: 2776714 - RNA, 17 nt, Leptospira interrogans serovar lai str. 56601
acaaaucacaauuuuaa

SEQ ID NO: 2776715 - RNA, 20 nt, Leptospira interrogans serovar lai str. 56601
acaaaucacgauuuuacaaa

SEQ ID NO: 2776716 - RNA, 18 nt, Leptospira interrogans serovar lai str. 56601
acaauugauuuaaaaacc

SEQ ID NO: 2776717 - RNA, 14 nt, Leptospira interrogans serovar lai str. 56601
acaauuuaaaauaa

SEQ ID NO: 2776718 - RNA, 15 nt, Leptospira interrogans serovar lai str. 56601
acaauuuaaaauaau

SEQ ID NO: 2776719 - RNA, 17 nt, Leptospira interrogans serovar lai str. 56601
acaauuuaucuaaaaca

SEQ ID NO: 2776720 - RNA, 10 nt, Leptospira interrogans serovar lai str. 56601
acaauuugcu

SEQ ID NO: 2776721 - RNA, 16 nt, Leptospira interrogans serovar lai str. 56601
acaauuugcuaaaaua

SEQ ID NO: 2776722 - RNA, 19 nt, Leptospira interrogans serovar lai str. 56601
acaauuuuagaauuuauuc

SEQ ID NO: 2776723 - RNA, 22 nt, Leptospira interrogans serovar lai str. 56601
acaauuuuagaauuuauuugua

SEQ ID NO: 2776724 - RNA, 22 nt, Leptospira interrogans serovar lai str. 56601
acaauuuugagaccuuaaguuu

SEQ ID NO: 2776725 - RNA, 18 nt, Leptospira interrogans serovar lai str. 56601
acaauuuugccaauucca

SEQ ID NO: 2776726 - RNA, 15 nt, Leptospira interrogans serovar lai str. 56601
acaauuuuucucuau

SEQ ID NO: 2776727 - RNA, 15 nt, Leptospira interrogans serovar lai str. 56601
acaauuuuuugaaaa

SEQ ID NO: 2776728 - RNA, 16 nt, Leptospira interrogans serovar lai str. 56601
acaauuuuuugaaaaa

SEQ ID NO: 2776729 - RNA, 15 nt, Leptospira interrogans serovar lai str. 56601
acacaacgcucucua

SEQ ID NO: 2776730 - RNA, 15 nt, Leptospira interrogans serovar lai str. 56601
acacaacgcucuuua

SEQ ID NO: 2776731 - RNA, 19 nt, Leptospira interrogans serovar lai str. 56601
acacaacggcucucuccua

SEQ ID NO: 2776732 - RNA, 15 nt, Leptospira interrogans serovar lai str. 56601
acacaaguuuggaaa

SEQ ID NO: 2776733 - RNA, 17 nt, Leptospira interrogans serovar lai str. 56601
acacacucuguuuuuag

SEQ ID NO: 2776734 - RNA, 23 nt, Leptospira interrogans serovar lai str. 56601
acacacuuuauaaaaguauaaua

SEQ ID NO: 2776735 - RNA, 15 nt, Leptospira interrogans serovar lai str. 56601
acacaugagcauucu

SEQ ID NO: 2776736 - RNA, 17 nt, Leptospira interrogans serovar lai str. 56601
acacaugagcauucuug

SEQ ID NO: 2776737 - RNA, 16 nt, Leptospira interrogans serovar lai str. 56601
acacauucuaaaauua

SEQ ID NO: 2776738 - RNA, 21 nt, Leptospira interrogans serovar lai str. 56601
acaccaauucgguugacucca

SEQ ID NO: 2776739 - RNA, 17 nt, Leptospira interrogans serovar lai str. 56601
acacccaaagucgccca

SEQ ID NO: 2776740 - RNA, 22 nt, Leptospira interrogans serovar lai str. 56601
acaccguugcuauaaaaaggau

SEQ ID NO: 2776741 - RNA, 20 nt, Leptospira interrogans serovar lai str. 56601
acaccuucucuuuuaaaaac

SEQ ID NO: 2776742 - RNA, 16 nt, Leptospira interrogans serovar lai str. 56601
acacgaauuccucaau

SEQ ID NO: 2776743 - RNA, 18 nt, Leptospira interrogans serovar lai str. 56601
acacgaauuccucaauua

SEQ ID NO: 2776744 - RNA, 19 nt, Leptospira interrogans serovar lai str. 56601
acacgaauuccucaauuag

SEQ ID NO: 2776745 - RNA, 15 nt, Leptospira interrogans serovar lai str. 56601
acacgauaauuuuua

SEQ ID NO: 2776746 - RNA, 22 nt, Leptospira interrogans serovar lai str. 56601
acacgaucauucuuuagaaauu

SEQ ID NO: 2776747 - RNA, 13 nt, Leptospira interrogans serovar lai str. 56601
acacgucuuaaau

SEQ ID NO: 2776748 - RNA, 16 nt, Leptospira interrogans serovar lai str. 56601
acacguugaauaagau

SEQ ID NO: 2776749 - RNA, 16 nt, Leptospira interrogans serovar lai str. 56601
acacucccccuuccga

SEQ ID NO: 2776750 - RNA, 18 nt, Leptospira interrogans serovar lai str. 56601
acacucuaaaucuuagga

SEQ ID NO: 2776751 - RNA, 23 nt, Leptospira interrogans serovar lai str. 56601
acacucuaaaucuuaggaacuuu

SEQ ID NO: 2776752 - RNA, 16 nt, Leptospira interrogans serovar lai str. 56601
acacugagucaacaaa

SEQ ID NO: 2776753 - RNA, 16 nt, Leptospira interrogans serovar lai str. 56601
acacuguguucuuuuu

SEQ ID NO: 2776754 - RNA, 18 nt, Leptospira interrogans serovar lai str. 56601
acacuguuaguuugcaau

SEQ ID NO: 2776755 - RNA, 19 nt, Leptospira interrogans serovar lai str. 56601
acacuguuaguuugcaauu

SEQ ID NO: 2776756 - RNA, 14 nt, Leptospira interrogans serovar lai str. 56601
acacuuaucaaaua

SEQ ID NO: 2776757 - RNA, 23 nt, Leptospira interrogans serovar lai str. 56601
acacuucuuguaaguuguguuua

SEQ ID NO: 2776758 - RNA, 13 nt, Leptospira interrogans serovar lai str. 56601
acacuugaaaaau

SEQ ID NO: 2776759 - RNA, 21 nt, Leptospira interrogans serovar lai str. 56601
acacuuuucagggcucaaagu

SEQ ID NO: 2776760 - RNA, 20 nt, Leptospira interrogans serovar lai str. 56601
acagaaauauauucuuuucu

SEQ ID NO: 2776761 - RNA, 16 nt, Leptospira interrogans serovar lai str. 56601
acagaacaaaauuuac

SEQ ID NO: 2776762 - RNA, 18 nt, Leptospira interrogans serovar lai str. 56601
acagaagggagaauaucu

SEQ ID NO: 2776763 - RNA, 14 nt, Leptospira interrogans serovar lai str. 56601
acagaauaaauaca

SEQ ID NO: 2776764 - RNA, 23 nt, Leptospira interrogans serovar lai str. 56601
acagaaugucuuagaauuuuguu

SEQ ID NO: 2776765 - RNA, 23 nt, Leptospira interrogans serovar lai str. 56601
acagaauguucuuagacucagua

SEQ ID NO: 2776766 - RNA, 15 nt, Leptospira interrogans serovar lai str. 56601
acagaauuuuuuaac

SEQ ID NO: 2776767 - RNA, 24 nt, Leptospira interrogans serovar lai str. 56601
acagaauuuuuuaacaauucuaau

SEQ ID NO: 2776768 - RNA, 19 nt, Leptospira interrogans serovar lai str. 56601
acagacugauuuuuuaaau

SEQ ID NO: 2776769 - RNA, 20 nt, Leptospira interrogans serovar lai str. 56601
acagagcuuuacaauaaaaa

SEQ ID NO: 2776770 - RNA, 23 nt, Leptospira interrogans serovar lai str. 56601
acagauauaguuuugagauuaca

SEQ ID NO: 2776771 - RNA, 22 nt, Leptospira interrogans serovar lai str. 56601
acagaucguguucuaaauugaa

SEQ ID NO: 2776772 - RNA, 17 nt, Leptospira interrogans serovar lai str. 56601
acagauggaaaguuagu

SEQ ID NO: 2776773 - RNA, 19 nt, Leptospira interrogans serovar lai str. 56601
acagauggaaaguuaguuu

SEQ ID NO: 2776774 - RNA, 17 nt, Leptospira interrogans serovar lai str. 56601
acagauucaauuuuuau

SEQ ID NO: 2776775 - RNA, 15 nt, Leptospira interrogans serovar lai str. 56601
acagcaaaaaauuug

SEQ ID NO: 2776776 - RNA, 18 nt, Leptospira interrogans serovar lai str. 56601
acagcaaggagcaacauu

SEQ ID NO: 2776777 - RNA, 22 nt, Leptospira interrogans serovar lai str. 56601
acagcaucaacaucacgcacau

SEQ ID NO: 2776778 - RNA, 20 nt, Leptospira interrogans serovar lai str. 56601
acagccaccaucaaaauuua

SEQ ID NO: 2776779 - RNA, 21 nt, Leptospira interrogans serovar lai str. 56601
acagccaucccacuuuuauau

SEQ ID NO: 2776780 - RNA, 20 nt, Leptospira interrogans serovar lai str. 56601
acagcgugaguucaauguaa

SEQ ID NO: 2776781 - RNA, 19 nt, Leptospira interrogans serovar lai str. 56601
acagcugaggaguuuuuau

SEQ ID NO: 2776782 - RNA, 22 nt, Leptospira interrogans serovar lai str. 56601
acagcugaggaguuuuuauaaa

SEQ ID NO: 2776783 - RNA, 13 nt, Leptospira interrogans serovar lai str. 56601
acagcuugaagau

SEQ ID NO: 2776784 - RNA, 13 nt, Leptospira interrogans serovar lai str. 56601
acaguacaagaau

SEQ ID NO: 2776785 - RNA, 22 nt, Leptospira interrogans serovar lai str. 56601
acaguacaagaaucaaaacggc

SEQ ID NO: 2776786 - RNA, 18 nt, Leptospira interrogans serovar lai str. 56601
acaguacuauauuuuugu

SEQ ID NO: 2776787 - RNA, 19 nt, Leptospira interrogans serovar lai str. 56601
acaguaucgaaaauuaaca

SEQ ID NO: 2776788 - RNA, 15 nt, Leptospira interrogans serovar lai str. 56601
acaguauuuguaaaa

SEQ ID NO: 2776789 - RNA, 17 nt, Leptospira interrogans serovar lai str. 56601
acaguauuuguaaaaau

SEQ ID NO: 2776790 - RNA, 18 nt, Leptospira interrogans serovar lai str. 56601
acaguauuuguaaaaaug

SEQ ID NO: 2776791 - RNA, 22 nt, Leptospira interrogans serovar lai str. 56601
acaguauuuuccguaccccaaa

SEQ ID NO: 2776792 - RNA, 18 nt, Leptospira interrogans serovar lai str. 56601
acagugucuugaaauucu

SEQ ID NO: 2776793 - RNA, 16 nt, Leptospira interrogans serovar lai str. 56601
acaguuauuauuuaac

SEQ ID NO: 2776794 - RNA, 18 nt, Leptospira interrogans serovar lai str. 56601
acaguuccacuuuaaaaa

SEQ ID NO: 2776795 - RNA, 16 nt, Leptospira interrogans serovar lai str. 56601
acaguucugaguaaga

SEQ ID NO: 2776796 - RNA, 21 nt, Leptospira interrogans serovar lai str. 56601
acaguuugaauuuuacuaaaa

SEQ ID NO: 2776797 - RNA, 15 nt, Leptospira interrogans serovar lai str. 56601
acauaaaaauuuuuu

SEQ ID NO: 2776798 - RNA, 13 nt, Leptospira interrogans serovar lai str. 56601
acauuuugugaaa

SEQ ID NO: 2776799 - RNA, 20 nt, Leptospira interrogans serovar lai str. 56601
acauuuuguuuuuuuggaua

SEQ ID NO: 2776800 - RNA, 15 nt, Leptospira interrogans serovar lai str. 56601
acauuuuuaaaaauu

SEQ ID NO: 2776801 - RNA, 18 nt, Leptospira interrogans serovar lai str. 56601
acauuuuuaaaaguuauu

SEQ ID NO: 2776802 - RNA, 12 nt, Leptospira interrogans serovar lai str. 56601
acauuuuuguga

SEQ ID NO: 2776803 - RNA, 14 nt, Leptospira interrogans serovar lai str. 56601
acauuuuugugaaa

SEQ ID NO: 2776804 - RNA, 20 nt, Leptospira interrogans serovar lai str. 56601
acauuuuugugaaacucaau

SEQ ID NO: 2776805 - RNA, 17 nt, Leptospira interrogans serovar lai str. 56601
acauuuuugugaaacuu

SEQ ID NO: 2776806 - RNA, 20 nt, Leptospira interrogans serovar lai str. 56601
acauuuuuuaucaauuacga

SEQ ID NO: 2776807 - RNA, 19 nt, Leptospira interrogans serovar lai str. 56601
accaaaacggugauuguuu

SEQ ID NO: 2776808 - RNA, 22 nt, Leptospira interrogans serovar lai str. 56601
accaaaucgcauuguuuaaaua

SEQ ID NO: 2776809 - RNA, 17 nt, Leptospira interrogans serovar lai str. 56601
accaaauugcaacuuug

SEQ ID NO: 2776810 - RNA, 12 nt, Leptospira interrogans serovar lai str. 56601
accaacaacacc

SEQ ID NO: 2776811 - RNA, 14 nt, Leptospira interrogans serovar lai str. 56601
accaacaacaccac

SEQ ID NO: 2776812 - RNA, 17 nt, Leptospira interrogans serovar lai str. 56601
accaacagcaucaacau

SEQ ID NO: 2776813 - RNA, 23 nt, Leptospira interrogans serovar lai str. 56601
accaaccucucacuucuugaacu

SEQ ID NO: 2776814 - RNA, 17 nt, Leptospira interrogans serovar lai str. 56601
accaagaauuuccaguc

SEQ ID NO: 2776815 - RNA, 21 nt, Leptospira interrogans serovar lai str. 56601
accaagaguguucaucuucuc

SEQ ID NO: 2776816 - RNA, 14 nt, Leptospira interrogans serovar lai str. 56601
accaauugauaauu

SEQ ID NO: 2776817 - RNA, 17 nt, Leptospira interrogans serovar lai str. 56601
accaauuuuuuuguaaa

SEQ ID NO: 2776818 - RNA, 22 nt, Leptospira interrogans serovar lai str. 56601
accaauuuuuuuguaaaaaaau

SEQ ID NO: 2776819 - RNA, 17 nt, Leptospira interrogans serovar lai str. 56601
accacaauuuacaacca

SEQ ID NO: 2776820 - RNA, 18 nt, Leptospira interrogans serovar lai str. 56601
accacaguuccuaaaauu

SEQ ID NO: 2776821 - RNA, 19 nt, Leptospira interrogans serovar lai str. 56601
accaccaaaguaugauuuu

SEQ ID NO: 2776822 - RNA, 14 nt, Leptospira interrogans serovar lai str. 56601
accaccaacagcau

SEQ ID NO: 2776823 - RNA, 14 nt, Leptospira interrogans serovar lai str. 56601
accacccccaccaa

SEQ ID NO: 2776824 - RNA, 15 nt, Leptospira interrogans serovar lai str. 56601
accacuggaauauaa

SEQ ID NO: 2776825 - RNA, 20 nt, Leptospira interrogans serovar lai str. 56601
accagccugccaaaagaacu

SEQ ID NO: 2776826 - RNA, 14 nt, Leptospira interrogans serovar lai str. 56601
accaggaauacuug

SEQ ID NO: 2776827 - RNA, 20 nt, Leptospira interrogans serovar lai str. 56601
accaguauucaauuccaauu

SEQ ID NO: 2776828 - RNA, 21 nt, Leptospira interrogans serovar lai str. 56601
accagugccauuuuucuucuu

SEQ ID NO: 2776829 - RNA, 17 nt, Leptospira interrogans serovar lai str. 56601
accaguuuguuuuuuau

SEQ ID NO: 2776830 - RNA, 16 nt, Leptospira interrogans serovar lai str. 56601
accauaaaauaaaaaa

SEQ ID NO: 2776831 - RNA, 13 nt, Leptospira interrogans serovar lai str. 56601
accauaaauuuua

SEQ ID NO: 2776832 - RNA, 22 nt, Leptospira interrogans serovar lai str. 56601
accauaaauuuugaaacaaauu

SEQ ID NO: 2776833 - RNA, 14 nt, Leptospira interrogans serovar lai str. 56601
accauaaauuuuua

SEQ ID NO: 2776834 - RNA, 19 nt, Leptospira interrogans serovar lai str. 56601
accauaaauuuuuauuaca

SEQ ID NO: 2776835 - RNA, 21 nt, Leptospira interrogans serovar lai str. 56601
accauaaauuuuuauuacaua

SEQ ID NO: 2776836 - RNA, 15 nt, Leptospira interrogans serovar lai str. 56601
accauaaauuuuuug

SEQ ID NO: 2776837 - RNA, 19 nt, Leptospira interrogans serovar lai str. 56601
accauauugaguuaauuuu

SEQ ID NO: 2776838 - RNA, 12 nt, Leptospira interrogans serovar lai str. 56601
accaucaaaauu

SEQ ID NO: 2776839 - RNA, 22 nt, Leptospira interrogans serovar lai str. 56601
accaucaaaauuuaaaucccau

SEQ ID NO: 2776840 - RNA, 22 nt, Leptospira interrogans serovar lai str. 56601
accaucgauuuacuuuaaaauu

SEQ ID NO: 2776841 - RNA, 16 nt, Leptospira interrogans serovar lai str. 56601
accaucuaaagcggga

SEQ ID NO: 2776842 - RNA, 17 nt, Leptospira interrogans serovar lai str. 56601
accaucuacagaaccca

SEQ ID NO: 2776843 - RNA, 15 nt, Leptospira interrogans serovar lai str. 56601
accaucuuugauauu

SEQ ID NO: 2776844 - RNA, 19 nt, Leptospira interrogans serovar lai str. 56601
accaucuuugauauuugga

SEQ ID NO: 2776845 - RNA, 17 nt, Leptospira interrogans serovar lai str. 56601
accaugaauaaacaaua

SEQ ID NO: 2776846 - RNA, 18 nt, Leptospira interrogans serovar lai str. 56601
accaugauucugaaaaaa

SEQ ID NO: 2776847 - RNA, 14 nt, Leptospira interrogans serovar lai str. 56601
accauuucaaguuu

SEQ ID NO: 2776848 - RNA, 13 nt, Leptospira interrogans serovar lai str. 56601
accauuugaaaaa

SEQ ID NO: 2776849 - RNA, 17 nt, Leptospira interrogans serovar lai str. 56601
accauuuuguugcguuu

SEQ ID NO: 2776850 - RNA, 13 nt, Leptospira interrogans serovar lai str. 56601
acccaaaaauagg

SEQ ID NO: 2776851 - RNA, 15 nt, Leptospira interrogans serovar lai str. 56601
acccaaaaauguagu

SEQ ID NO: 2776852 - RNA, 15 nt, Leptospira interrogans serovar lai str. 56601
acccaauaagaagcc

SEQ ID NO: 2776853 - RNA, 19 nt, Leptospira interrogans serovar lai str. 56601
acccaaucugggugaaucc

SEQ ID NO: 2776854 - RNA, 14 nt, Leptospira interrogans serovar lai str. 56601
acccaaugauucua

SEQ ID NO: 2776855 - RNA, 19 nt, Leptospira interrogans serovar lai str. 56601
acccaauuguauuugcgga

SEQ ID NO: 2776856 - RNA, 20 nt, Leptospira interrogans serovar lai str. 56601
acccauggcuuugaaaaagg

SEQ ID NO: 2776857 - RNA, 14 nt, Leptospira interrogans serovar lai str. 56601
acccauucaacauc

SEQ ID NO: 2776858 - RNA, 17 nt, Leptospira interrogans serovar lai str. 56601
accccacaaguguugua

SEQ ID NO: 2776859 - RNA, 19 nt, Leptospira interrogans serovar lai str. 56601
accccaugagccgcggcca

SEQ ID NO: 2776860 - RNA, 17 nt, Leptospira interrogans serovar lai str. 56601
acccccgucuacuuuua

SEQ ID NO: 2776861 - RNA, 19 nt, Leptospira interrogans serovar lai str. 56601
accccuuuuuuaagaaucu

SEQ ID NO: 2776862 - RNA, 17 nt, Leptospira interrogans serovar lai str. 56601
acccgauauuaaaauga

SEQ ID NO: 2776863 - RNA, 17 nt, Leptospira interrogans serovar lai str. 56601
acccuaaaaaauuuuua

SEQ ID NO: 2776864 - RNA, 18 nt, Leptospira interrogans serovar lai str. 56601
acccuaaaaaauuuuuag

SEQ ID NO: 2776865 - RNA, 23 nt, Leptospira interrogans serovar lai str. 56601
acccuagaagccugaguuugaga

SEQ ID NO: 2776866 - RNA, 15 nt, Leptospira interrogans serovar lai str. 56601
acccucaucagucau

SEQ ID NO: 2776867 - RNA, 22 nt, Leptospira interrogans serovar lai str. 56601
acccugguuucaaaaaaucgac

SEQ ID NO: 2776868 - RNA, 18 nt, Leptospira interrogans serovar lai str. 56601
acccuuaacgguuuugau

SEQ ID NO: 2776869 - RNA, 17 nt, Leptospira interrogans serovar lai str. 56601
accgaaauagaaauaca

SEQ ID NO: 2776870 - RNA, 21 nt, Leptospira interrogans serovar lai str. 56601
accgaacucacguuauuuuaa

SEQ ID NO: 2776871 - RNA, 23 nt, Leptospira interrogans serovar lai str. 56601
accgaagaauccgaaaaaccuug

SEQ ID NO: 2776872 - RNA, 19 nt, Leptospira interrogans serovar lai str. 56601
accgaaucuggaagccaaa

SEQ ID NO: 2776873 - RNA, 19 nt, Leptospira interrogans serovar lai str. 56601
accgaauuuagguuaaguc

SEQ ID NO: 2776874 - RNA, 17 nt, Leptospira interrogans serovar lai str. 56601
accgaucaaacucuuuu

SEQ ID NO: 2776875 - RNA, 15 nt, Leptospira interrogans serovar lai str. 56601
accgaucuuaaaaac

SEQ ID NO: 2776876 - RNA, 15 nt, Leptospira interrogans serovar lai str. 56601
accgauuucuauuuu

SEQ ID NO: 2776877 - RNA, 15 nt, Leptospira interrogans serovar lai str. 56601
accgcaaaucaagau

SEQ ID NO: 2776878 - RNA, 22 nt, Leptospira interrogans serovar lai str. 56601
accgcaaaucacaauuuuacaa

SEQ ID NO: 2776879 - RNA, 21 nt, Leptospira interrogans serovar lai str. 56601
accgcuagaaguuauaaugau

SEQ ID NO: 2776880 - RNA, 23 nt, Leptospira interrogans serovar lai str. 56601
accgcugaagauagguucaaaaa

SEQ ID NO: 2776881 - RNA, 20 nt, Leptospira interrogans serovar lai str. 56601
acgauugaucagacugauau

SEQ ID NO: 2776882 - RNA, 17 nt, Leptospira interrogans serovar lai str. 56601
acgauugauuuuggaaa

SEQ ID NO: 2776883 - RNA, 21 nt, Leptospira interrogans serovar lai str. 56601
acgauugauuuuggaaagaau

SEQ ID NO: 2776884 - RNA, 12 nt, Leptospira interrogans serovar lai str. 56601
acgauuggaagg

SEQ ID NO: 2776885 - RNA, 17 nt, Leptospira interrogans serovar lai str. 56601
acgauuguaaaaaaaca

SEQ ID NO: 2776886 - RNA, 15 nt, Leptospira interrogans serovar lai str. 56601
acgauuucauccaug

SEQ ID NO: 2776887 - RNA, 22 nt, Leptospira interrogans serovar lai str. 56601
acgauuucuccaagaacguuuc

SEQ ID NO: 2776888 - RNA, 22 nt, Leptospira interrogans serovar lai str. 56601
acgauuugcaucgacaaaacuu

SEQ ID NO: 2776889 - RNA, 14 nt, Leptospira interrogans serovar lai str. 56601
acgauuugugggag

SEQ ID NO: 2776890 - RNA, 17 nt, Leptospira interrogans serovar lai str. 56601
acgauuuuacaaacaaa

SEQ ID NO: 2776891 - RNA, 13 nt, Leptospira interrogans serovar lai str. 56601
acgauuuucuccu

SEQ ID NO: 2776892 - RNA, 20 nt, Leptospira interrogans serovar lai str. 56601
acgauuuuuugauucauuca

SEQ ID NO: 2776893 - RNA, 23 nt, Leptospira interrogans serovar lai str. 56601
acgauuuuuugauucauucagga

SEQ ID NO: 2776894 - RNA, 13 nt, Leptospira interrogans serovar lai str. 56601
acgcaaguuccgc

SEQ ID NO: 2776895 - RNA, 19 nt, Leptospira interrogans serovar lai str. 56601
acgcaaguuccgcgauuga

SEQ ID NO: 2776896 - RNA, 19 nt, Leptospira interrogans serovar lai str. 56601
acgcaaucauucuuuagaa

SEQ ID NO: 2776897 - RNA, 22 nt, Leptospira interrogans serovar lai str. 56601
acgcacaucguuaccagcaagc

SEQ ID NO: 2776898 - RNA, 23 nt, Leptospira interrogans serovar lai str. 56601
acgcagauuugauguaaagaaaa

SEQ ID NO: 2776899 - RNA, 13 nt, Leptospira interrogans serovar lai str. 56601
acgcauacuuuuc

SEQ ID NO: 2776900 - RNA, 13 nt, Leptospira interrogans serovar lai str. 56601
acgcaugauaaaa

SEQ ID NO: 2776901 - RNA, 17 nt, Leptospira interrogans serovar lai str. 56601
acgccauguuuuuaaaa

SEQ ID NO: 2776902 - RNA, 19 nt, Leptospira interrogans serovar lai str. 56601
acgccauguuuuuaaaauc

SEQ ID NO: 2776903 - RNA, 19 nt, Leptospira interrogans serovar lai str. 56601
acgcgaauuugacguaaag

SEQ ID NO: 2776904 - RNA, 17 nt, Leptospira interrogans serovar lai str. 56601
acgcgauccguaaaaaa

SEQ ID NO: 2776905 - RNA, 20 nt, Leptospira interrogans serovar lai str. 56601
acgcgauccguagagagcgu

SEQ ID NO: 2776906 - RNA, 20 nt, Leptospira interrogans serovar lai str. 56601
acgcgaucuauagagagcgu

SEQ ID NO: 2776907 - RNA, 20 nt, Leptospira interrogans serovar lai str. 56601
acgcgccuuccuaauuuuag

SEQ ID NO: 2776908 - RNA, 13 nt, Leptospira interrogans serovar lai str. 56601
acgcguugauuuc

SEQ ID NO: 2776909 - RNA, 20 nt, Leptospira interrogans serovar lai str. 56601
acgcuaaaauaaaguaucca

SEQ ID NO: 2776910 - RNA, 15 nt, Leptospira interrogans serovar lai str. 56601
acgcugaguuugaaa

SEQ ID NO: 2776911 - RNA, 21 nt, Leptospira interrogans serovar lai str. 56601
acgcugaguuugaaagauugu

SEQ ID NO: 2776912 - RNA, 15 nt, Leptospira interrogans serovar lai str. 56601
acgcugaguuugaga

SEQ ID NO: 2776913 - RNA, 19 nt, Leptospira interrogans serovar lai str. 56601
acgcugaguuugagagagc

SEQ ID NO: 2776914 - RNA, 22 nt, Leptospira interrogans serovar lai str. 56601
acgcuugcggauuccauucuuc

SEQ ID NO: 2776915 - RNA, 23 nt, Leptospira interrogans serovar lai str. 56601
acgcuugcggauuccauucuuca

SEQ ID NO: 2776916 - RNA, 20 nt, Leptospira interrogans serovar lai str. 56601
acggaaaauaccgcacuuuu

SEQ ID NO: 2776917 - RNA, 12 nt, Leptospira interrogans serovar lai str. 56601
acggaaauguua

SEQ ID NO: 2776918 - RNA, 17 nt, Leptospira interrogans serovar lai str. 56601
acggaacuuaauuuuau

SEQ ID NO: 2776919 - RNA, 16 nt, Leptospira interrogans serovar lai str. 56601
acggaaucggcuugcu

SEQ ID NO: 2776920 - RNA, 13 nt, Leptospira interrogans serovar lai str. 56601
acggauguaacag

SEQ ID NO: 2776921 - RNA, 16 nt, Leptospira interrogans serovar lai str. 56601
acggauugccuaaauu

SEQ ID NO: 2776922 - RNA, 19 nt, Leptospira interrogans serovar lai str. 56601
acggauugccuaaauuccu

SEQ ID NO: 2776923 - RNA, 17 nt, Leptospira interrogans serovar lai str. 56601
acggauuucuauaaaau

SEQ ID NO: 2776924 - RNA, 15 nt, Leptospira interrogans serovar lai str. 56601
acggcaaugugcaaa

SEQ ID NO: 2776925 - RNA, 16 nt, Leptospira interrogans serovar lai str. 56601
acggcacuuugugaua

SEQ ID NO: 2776926 - RNA, 15 nt, Leptospira interrogans serovar lai str. 56601
acggcauuuuuuaaa

SEQ ID NO: 2776927 - RNA, 19 nt, Leptospira interrogans serovar lai str. 56601
acggcuuuaguuugaaaga

SEQ ID NO: 2776928 - RNA, 20 nt, Leptospira interrogans serovar lai str. 56601
acggcuuuaguuugaaagaa

SEQ ID NO: 2776929 - RNA, 17 nt, Leptospira interrogans serovar lai str. 56601
acgggaauaaaaacaaa

SEQ ID NO: 2776930 - RNA, 14 nt, Leptospira interrogans serovar lai str. 56601
acggggccguucga

SEQ ID NO: 2776931 - RNA, 17 nt, Leptospira interrogans serovar lai str. 56601
acgguaaaaggagccaa

SEQ ID NO: 2776932 - RNA, 16 nt, Leptospira interrogans serovar lai str. 56601
acgguaaaaucuuuaa

SEQ ID NO: 2776933 - RNA, 20 nt, Leptospira interrogans serovar lai str. 56601
acgguaaaaucuuuaaguuu

SEQ ID NO: 2776934 - RNA, 21 nt, Leptospira interrogans serovar lai str. 56601
acggucgauugaagcguuuuc

SEQ ID NO: 2776935 - RNA, 17 nt, Leptospira interrogans serovar lai str. 56601
acggugcauuuaaaaaa

SEQ ID NO: 2776936 - RNA, 19 nt, Leptospira interrogans serovar lai str. 56601
acgguuuucuaauuuauga

SEQ ID NO: 2776937 - RNA, 18 nt, Leptospira interrogans serovar lai str. 56601
acguaaagaacuucgauc

SEQ ID NO: 2776938 - RNA, 17 nt, Leptospira interrogans serovar lai str. 56601
acguaaguuaaauauaa

SEQ ID NO: 2776939 - RNA, 18 nt, Leptospira interrogans serovar lai str. 56601
acguaaugugaguucgac

SEQ ID NO: 2776940 - RNA, 19 nt, Leptospira interrogans serovar lai str. 56601
acguagauuacuaugaaaa

SEQ ID NO: 2776941 - RNA, 23 nt, Leptospira interrogans serovar lai str. 56601
acguaggaaaugaaaaagaauuu

SEQ ID NO: 2776942 - RNA, 15 nt, Leptospira interrogans serovar lai str. 56601
acguauaaaaacagc

SEQ ID NO: 2776943 - RNA, 15 nt, Leptospira interrogans serovar lai str. 56601
acguauguguaauga

SEQ ID NO: 2776944 - RNA, 19 nt, Leptospira interrogans serovar lai str. 56601
acguauguguaaugauuuc

SEQ ID NO: 2776945 - RNA, 18 nt, Leptospira interrogans serovar lai str. 56601
acgucauaguucccacaa

SEQ ID NO: 2776946 - RNA, 19 nt, Leptospira interrogans serovar lai str. 56601
acgucccguauaaaagugu

SEQ ID NO: 2776947 - RNA, 19 nt, Leptospira interrogans serovar lai str. 56601
acgucgcuuacaaagugau

SEQ ID NO: 2776948 - RNA, 16 nt, Leptospira interrogans serovar lai str. 56601
acgucuaguccucuuu

SEQ ID NO: 2776949 - RNA, 21 nt, Leptospira interrogans serovar lai str. 56601
acgugacaaacuaaauuuuuc

SEQ ID NO: 2776950 - RNA, 23 nt, Leptospira interrogans serovar lai str. 56601
acgugagcucuauguaagaaaau

SEQ ID NO: 2776951 - RNA, 15 nt, Leptospira interrogans serovar lai str. 56601
acgugaguucagaca

SEQ ID NO: 2776952 - RNA, 21 nt, Leptospira interrogans serovar lai str. 56601
acgugaguucgacguaagaau

SEQ ID NO: 2776953 - RNA, 19 nt, Leptospira interrogans serovar lai str. 56601
acgugauaauucuuuagaa

SEQ ID NO: 2776954 - RNA, 21 nt, Leptospira interrogans serovar lai str. 56601
acgugauucagaguaaggaaa

SEQ ID NO: 2776955 - RNA, 20 nt, Leptospira interrogans serovar lai str. 56601
acgugucauguuuuaaugaa

SEQ ID NO: 2776956 - RNA, 15 nt, Leptospira interrogans serovar lai str. 56601
acguuaaaaguaaua

SEQ ID NO: 2776957 - RNA, 17 nt, Leptospira interrogans serovar lai str. 56601
acguuaauugagauuug

SEQ ID NO: 2776958 - RNA, 18 nt, Leptospira interrogans serovar lai str. 56601
acguuauaaaauuggaaa

SEQ ID NO: 2776959 - RNA, 23 nt, Leptospira interrogans serovar lai str. 56601
acguuaucgaucgagacuucgaa

SEQ ID NO: 2776960 - RNA, 17 nt, Leptospira interrogans serovar lai str. 56601
acguuauuuuaacuuga

SEQ ID NO: 2776961 - RNA, 20 nt, Leptospira interrogans serovar lai str. 56601
acguucaacaaacaaauaga

SEQ ID NO: 2776962 - RNA, 18 nt, Leptospira interrogans serovar lai str. 56601
acguucuuagccuuuaaa

SEQ ID NO: 2776963 - RNA, 16 nt, Leptospira interrogans serovar lai str. 56601
acucacaucucuuuuu

SEQ ID NO: 2776964 - RNA, 17 nt, Leptospira interrogans serovar lai str. 56601
acucacguuauuuuaac

SEQ ID NO: 2776965 - RNA, 14 nt, Leptospira interrogans serovar lai str. 56601
acucagaaaacuca

SEQ ID NO: 2776966 - RNA, 14 nt, Leptospira interrogans serovar lai str. 56601
acucaguaaaacgc

SEQ ID NO: 2776967 - RNA, 19 nt, Leptospira interrogans serovar lai str. 56601
acucauaaaauaacuucca

SEQ ID NO: 2776968 - RNA, 15 nt, Leptospira interrogans serovar lai str. 56601
acucaucuaaucgaa

SEQ ID NO: 2776969 - RNA, 16 nt, Leptospira interrogans serovar lai str. 56601
acuccagaauuagauu

SEQ ID NO: 2776970 - RNA, 13 nt, Leptospira interrogans serovar lai str. 56601
acuccauucuuac

SEQ ID NO: 2776971 - RNA, 18 nt, Leptospira interrogans serovar lai str. 56601
acucccacaauuuugaau

SEQ ID NO: 2776972 - RNA, 20 nt, Leptospira interrogans serovar lai str. 56601
acucccacuuuuaaagaaag

SEQ ID NO: 2776973 - RNA, 13 nt, Leptospira interrogans serovar lai str. 56601
acucccugauaac

SEQ ID NO: 2776974 - RNA, 20 nt, Leptospira interrogans serovar lai str. 56601
acuccggcuaaaaaacugau

SEQ ID NO: 2776975 - RNA, 17 nt, Leptospira interrogans serovar lai str. 56601
acuccuagauguuuugu

SEQ ID NO: 2776976 - RNA, 22 nt, Leptospira interrogans serovar lai str. 56601
acuccuugguucaaaguuuuca

SEQ ID NO: 2776977 - RNA, 21 nt, Leptospira interrogans serovar lai str. 56601
acucgaacuucguuggaaagu

SEQ ID NO: 2776978 - RNA, 14 nt, Leptospira interrogans serovar lai str. 56601
acucgacaaaacac

SEQ ID NO: 2776979 - RNA, 14 nt, Leptospira interrogans serovar lai str. 56601
acucggaaauuuau

SEQ ID NO: 2776980 - RNA, 22 nt, Leptospira interrogans serovar lai str. 56601
acucgguguaaaaaaauuuucu

SEQ ID NO: 2776981 - RNA, 18 nt, Leptospira interrogans serovar lai str. 56601
acucguuagagaaaagca

SEQ ID NO: 2776982 - RNA, 20 nt, Leptospira interrogans serovar lai str. 56601
acucguuagagaaaagcauu

SEQ ID NO: 2776983 - RNA, 23 nt, Leptospira interrogans serovar lai str. 56601
acucuaagcuuuagaaaauaaua

SEQ ID NO: 2776984 - RNA, 17 nt, Leptospira interrogans serovar lai str. 56601
acucuaaguuuuuaaau

SEQ ID NO: 2776985 - RNA, 23 nt, Leptospira interrogans serovar lai str. 56601
acucuaauguacaacauccuuca

SEQ ID NO: 2776986 - RNA, 17 nt, Leptospira interrogans serovar lai str. 56601
acucuaauguaggaacu

SEQ ID NO: 2776987 - RNA, 13 nt, Leptospira interrogans serovar lai str. 56601
acucuaauuuuuu

SEQ ID NO: 2776988 - RNA, 17 nt, Leptospira interrogans serovar lai str. 56601
acucuaguaaagaaacu

SEQ ID NO: 2776989 - RNA, 14 nt, Leptospira interrogans serovar lai str. 56601
acucuauauaaaga

SEQ ID NO: 2776990 - RNA, 19 nt, Leptospira interrogans serovar lai str. 56601
acucuauauaaagaaaaac

SEQ ID NO: 2776991 - RNA, 14 nt, Leptospira interrogans serovar lai str. 56601
acucuauuaaagaa

SEQ ID NO: 2776992 - RNA, 13 nt, Leptospira interrogans serovar lai str. 56601
acucuauuauaua

SEQ ID NO: 2776993 - RNA, 16 nt, Leptospira interrogans serovar lai str. 56601
acucuauuuaaguacu

SEQ ID NO: 2776994 - RNA, 16 nt, Leptospira interrogans serovar lai str. 56601
acucucacaaaucaug

SEQ ID NO: 2776995 - RNA, 18 nt, Leptospira interrogans serovar lai str. 56601
acucugcaaaauuuaaaa

SEQ ID NO: 2776996 - RNA, 20 nt, Leptospira interrogans serovar lai str. 56601
acucugcaaaauuuaaaaag

SEQ ID NO: 2776997 - RNA, 21 nt, Leptospira interrogans serovar lai str. 56601
acucuguaaauucaaagcaag

SEQ ID NO: 2776998 - RNA, 22 nt, Leptospira interrogans serovar lai str. 56601
acucuguucaguguaagauuaa

SEQ ID NO: 2776999 - RNA, 19 nt, Leptospira interrogans serovar lai str. 56601
acucuuaaauuucggacuu

SEQ ID NO: 2777000 - RNA, 21 nt, Leptospira interrogans serovar lai str. 56601
acucuuacgcaugauaaaaau

SEQ ID NO: 2777001 - RNA, 15 nt, Leptospira interrogans serovar lai str. 56601
acucuuacuuugaga

SEQ ID NO: 2777002 - RNA, 17 nt, Leptospira interrogans serovar lai str. 56601
acucuuauuuauauuuc

SEQ ID NO: 2777003 - RNA, 19 nt, Leptospira interrogans serovar lai str. 56601
acucuuauuuauauuucua

SEQ ID NO: 2777004 - RNA, 12 nt, Leptospira interrogans serovar lai str. 56601
acucuucuucua

SEQ ID NO: 2777005 - RNA, 18 nt, Leptospira interrogans serovar lai str. 56601
acucuucuucuagauuuu

SEQ ID NO: 2777006 - RNA, 21 nt, Leptospira interrogans serovar lai str. 56601
acucuucuucuagauuuuaaa

SEQ ID NO: 2777007 - RNA, 14 nt, Leptospira interrogans serovar lai str. 56601
acucuugaacagaa

SEQ ID NO: 2777008 - RNA, 10 nt, Leptospira interrogans serovar lai str. 56601
acucuugaag

SEQ ID NO: 2777009 - RNA, 16 nt, Leptospira interrogans serovar lai str. 56601
acucuuuauuuuuaac

SEQ ID NO: 2777010 - RNA, 15 nt, Leptospira interrogans serovar lai str. 56601
acucuuugagaaacg

SEQ ID NO: 2777011 - RNA, 19 nt, Leptospira interrogans serovar lai str. 56601
acucuuuuaccuuaccacc

SEQ ID NO: 2777012 - RNA, 13 nt, Leptospira interrogans serovar lai str. 56601
acucuuuuucuuc

SEQ ID NO: 2777013 - RNA, 18 nt, Leptospira interrogans serovar lai str. 56601
acucuuuuucuucugcug

SEQ ID NO: 2777014 - RNA, 20 nt, Leptospira interrogans serovar lai str. 56601
acucuuuuucuucugcugca

SEQ ID NO: 2777015 - RNA, 12 nt, Leptospira interrogans serovar lai str. 56601
acugaaaauuua

SEQ ID NO: 2777016 - RNA, 15 nt, Leptospira interrogans serovar lai str. 56601
acugaaaauuuaauu

SEQ ID NO: 2777017 - RNA, 12 nt, Leptospira interrogans serovar lai str. 56601
acugaaaccauc

SEQ ID NO: 2777018 - RNA, 21 nt, Leptospira interrogans serovar lai str. 56601
acugagagaaaguaaagaugg

SEQ ID NO: 2777019 - RNA, 18 nt, Leptospira interrogans serovar lai str. 56601
acugagucaacaaauauu

SEQ ID NO: 2777020 - RNA, 14 nt, Leptospira interrogans serovar lai str. 56601
acugaguuucaaac

SEQ ID NO: 2777021 - RNA, 15 nt, Leptospira interrogans serovar lai str. 56601
acugauucuuuaaau

SEQ ID NO: 2777022 - RNA, 16 nt, Leptospira interrogans serovar lai str. 56601
acugauuuaauuauuu

SEQ ID NO: 2777023 - RNA, 17 nt, Leptospira interrogans serovar lai str. 56601
acugauuucuauaaaau

SEQ ID NO: 2777024 - RNA, 21 nt, Leptospira interrogans serovar lai str. 56601
acugauuuucaugaauuaaag

SEQ ID NO: 2777025 - RNA, 22 nt, Leptospira interrogans serovar lai str. 56601
acugcaagaaaccucuauaaau

SEQ ID NO: 2777026 - RNA, 19 nt, Leptospira interrogans serovar lai str. 56601
acugcccguuucaauuuuu

SEQ ID NO: 2777027 - RNA, 18 nt, Leptospira interrogans serovar lai str. 56601
acugcucgaaaguucaca

SEQ ID NO: 2777028 - RNA, 16 nt, Leptospira interrogans serovar lai str. 56601
acuggaauauucuuuu

SEQ ID NO: 2777029 - RNA, 21 nt, Leptospira interrogans serovar lai str. 56601
acuggauucaaaauuggauga

SEQ ID NO: 2777030 - RNA, 13 nt, Leptospira interrogans serovar lai str. 56601
acuguaaaauuua

SEQ ID NO: 2777031 - RNA, 14 nt, Leptospira interrogans serovar lai str. 56601
acuguaaaauuuaa

SEQ ID NO: 2777032 - RNA, 16 nt, Leptospira interrogans serovar lai str. 56601
acuguaaaauuuaaau

SEQ ID NO: 2777033 - RNA, 18 nt, Leptospira interrogans serovar lai str. 56601
acuguaaacuugauuaaa

SEQ ID NO: 2777034 - RNA, 17 nt, Leptospira interrogans serovar lai str. 56601
acuguaaauuagauuau

SEQ ID NO: 2777035 - RNA, 13 nt, Leptospira interrogans serovar lai str. 56601
acuguaauuaauu

SEQ ID NO: 2777036 - RNA, 20 nt, Leptospira interrogans serovar lai str. 56601
acuguaauuaauucagcauc

SEQ ID NO: 2777037 - RNA, 16 nt, Leptospira interrogans serovar lai str. 56601
acuguguucuuuuuga

SEQ ID NO: 2777038 - RNA, 21 nt, Leptospira interrogans serovar lai str. 56601
acuguguuucuaauuuucuug

SEQ ID NO: 2777039 - RNA, 14 nt, Leptospira interrogans serovar lai str. 56601
acuguugaaaaaau

SEQ ID NO: 2777040 - RNA, 22 nt, Leptospira interrogans serovar lai str. 56601
acuguuucgacguaaaaauauu

SEQ ID NO: 2777041 - RNA, 17 nt, Leptospira interrogans serovar lai str. 56601
acuguuuuugaaacauu

SEQ ID NO: 2777042 - RNA, 13 nt, Leptospira interrogans serovar lai str. 56601
acuuaaaaacccc

SEQ ID NO: 2777043 - RNA, 18 nt, Leptospira interrogans serovar lai str. 56601
acuuaaaagaagauuuuu

SEQ ID NO: 2777044 - RNA, 20 nt, Leptospira interrogans serovar lai str. 56601
acuuaaaagaagauuuuucu

SEQ ID NO: 2777045 - RNA, 12 nt, Leptospira interrogans serovar lai str. 56601
acuuaaaaugag

SEQ ID NO: 2777046 - RNA, 17 nt, Leptospira interrogans serovar lai str. 56601
acuuucagcuacaauca

SEQ ID NO: 2777047 - RNA, 21 nt, Leptospira interrogans serovar lai str. 56601
acuuucccacuuauaauaaaa

SEQ ID NO: 2777048 - RNA, 23 nt, Leptospira interrogans serovar lai str. 56601
acuuuccgaauaggaucagaauu

SEQ ID NO: 2777049 - RNA, 23 nt, Leptospira interrogans serovar lai str. 56601
acuuuccguagaucuuuuauaau

SEQ ID NO: 2777050 - RNA, 16 nt, Leptospira interrogans serovar lai str. 56601
acuuuccgucuuuuag

SEQ ID NO: 2777051 - RNA, 14 nt, Leptospira interrogans serovar lai str. 56601
acuuucgagcaguu

SEQ ID NO: 2777052 - RNA, 19 nt, Leptospira interrogans serovar lai str. 56601
acuuugaaaauugugggaa

SEQ ID NO: 2777053 - RNA, 22 nt, Leptospira interrogans serovar lai str. 56601
acuuugaaaauuuuuuuguaau

SEQ ID NO: 2777054 - RNA, 14 nt, Leptospira interrogans serovar lai str. 56601
acuuugaaugaaaa

SEQ ID NO: 2777055 - RNA, 18 nt, Leptospira interrogans serovar lai str. 56601
acuuugaccauucuuugu

SEQ ID NO: 2777056 - RNA, 22 nt, Leptospira interrogans serovar lai str. 56601
acuuugaccauucuuuguuuug

SEQ ID NO: 2777057 - RNA, 16 nt, Leptospira interrogans serovar lai str. 56601
acuuugagaaaauuuu

SEQ ID NO: 2777058 - RNA, 20 nt, Leptospira interrogans serovar lai str. 56601
acuuugcucucgcaaugaaa

SEQ ID NO: 2777059 - RNA, 18 nt, Leptospira interrogans serovar lai str. 56601
acuuugguugaguuuuuu

SEQ ID NO: 2777060 - RNA, 15 nt, Leptospira interrogans serovar lai str. 56601
acuuugguuuguaau

SEQ ID NO: 2777061 - RNA, 23 nt, Leptospira interrogans serovar lai str. 56601
acuuugguuuguaauaguuccca

SEQ ID NO: 2777062 - RNA, 15 nt, Leptospira interrogans serovar lai str. 56601
acuuuguaaaucuau

SEQ ID NO: 2777063 - RNA, 16 nt, Leptospira interrogans serovar lai str. 56601
acuuuguaaaucuauu

SEQ ID NO: 2777064 - RNA, 17 nt, Leptospira interrogans serovar lai str. 56601
acuuuguaaaucuauuc

SEQ ID NO: 2777065 - RNA, 21 nt, Leptospira interrogans serovar lai str. 56601
acuuuuacuguaaaauuuaaa

SEQ ID NO: 2777066 - RNA, 20 nt, Leptospira interrogans serovar lai str. 56601
acuuuuagaaaaaauuuuuc

SEQ ID NO: 2777067 - RNA, 18 nt, Leptospira interrogans serovar lai str. 56601
acuuuuagaaaauuuuua

SEQ ID NO: 2777068 - RNA, 16 nt, Leptospira interrogans serovar lai str. 56601
acuuuuagaagauuuu

SEQ ID NO: 2777069 - RNA, 18 nt, Leptospira interrogans serovar lai str. 56601
acuuuuagauaauuauuc

SEQ ID NO: 2777070 - RNA, 14 nt, Leptospira interrogans serovar lai str. 56601
acuuuuauaaaauc

SEQ ID NO: 2777071 - RNA, 14 nt, Leptospira interrogans serovar lai str. 56601
acuuuuccuaaaau

SEQ ID NO: 2777072 - RNA, 15 nt, Leptospira interrogans serovar lai str. 56601
acuuuuccuaaaauu

SEQ ID NO: 2777073 - RNA, 14 nt, Leptospira interrogans serovar lai str. 56601
acuuuucuauaaaa

SEQ ID NO: 2777074 - RNA, 15 nt, Leptospira interrogans serovar lai str. 56601
acuuuucuauaaaau

SEQ ID NO: 2777075 - RNA, 17 nt, Leptospira interrogans serovar lai str. 56601
acuuuucugauuuuuau

SEQ ID NO: 2777076 - RNA, 21 nt, Leptospira interrogans serovar lai str. 56601
acuuuugaaaauccauaugag

SEQ ID NO: 2777077 - RNA, 17 nt, Leptospira interrogans serovar lai str. 56601
acuuuuguaauaaaaau

SEQ ID NO: 2777078 - RNA, 20 nt, Leptospira interrogans serovar lai str. 56601
acuuuuguugcggagaaugu

SEQ ID NO: 2777079 - RNA, 15 nt, Leptospira interrogans serovar lai str. 56601
acuuuuuauaaaaag

SEQ ID NO: 2777080 - RNA, 13 nt, Leptospira interrogans serovar lai str. 56601
acuuuuucugguu

SEQ ID NO: 2777081 - RNA, 21 nt, Leptospira interrogans serovar lai str. 56601
acuuuuugcaaguaaaaagac

SEQ ID NO: 2777082 - RNA, 21 nt, Leptospira interrogans serovar lai str. 56601
acuuuuuuaauuuuaauuaag

SEQ ID NO: 2777083 - RNA, 23 nt, Leptospira interrogans serovar lai str. 56601
acuuuuuucggagucauacauuu

SEQ ID NO: 2777084 - RNA, 21 nt, Leptospira interrogans serovar lai str. 56601
acuuuuuuuaaaaaauucauu

SEQ ID NO: 2777085 - RNA, 19 nt, Leptospira interrogans serovar lai str. 56601
acuuuuuuuagaaucauag

SEQ ID NO: 2777086 - RNA, 14 nt, Leptospira interrogans serovar lai str. 56601
agaaaaaaagauuu

SEQ ID NO: 2777087 - RNA, 20 nt, Leptospira interrogans serovar lai str. 56601
agaaaaaacuuucuaaaaau

SEQ ID NO: 2777088 - RNA, 23 nt, Leptospira interrogans serovar lai str. 56601
agaaaaaacuuucuaaaaauaag

SEQ ID NO: 2777089 - RNA, 12 nt, Leptospira interrogans serovar lai str. 56601
agaaaaaagcag

SEQ ID NO: 2777090 - RNA, 21 nt, Leptospira interrogans serovar lai str. 56601
agaaaaaagcagcuaaaaaga

SEQ ID NO: 2777091 - RNA, 14 nt, Leptospira interrogans serovar lai str. 56601
agaaaaaauaacaa

SEQ ID NO: 2777092 - RNA, 13 nt, Leptospira interrogans serovar lai str. 56601
agaaaaaauccau

SEQ ID NO: 2777093 - RNA, 22 nt, Leptospira interrogans serovar lai str. 56601
agaaaaagagaugguuuagaaa

SEQ ID NO: 2777094 - RNA, 11 nt, Leptospira interrogans serovar lai str. 56601
agaaaaagcac

SEQ ID NO: 2777095 - RNA, 16 nt, Leptospira interrogans serovar lai str. 56601
agaaaaagcacaaaac

SEQ ID NO: 2777096 - RNA, 20 nt, Leptospira interrogans serovar lai str. 56601
agaaaaaucagguuuuauaa

SEQ ID NO: 2777097 - RNA, 17 nt, Leptospira interrogans serovar lai str. 56601
agaaaaauuuuccgaac

SEQ ID NO: 2777098 - RNA, 16 nt, Leptospira interrogans serovar lai str. 56601
agaaaaccacccccac

SEQ ID NO: 2777099 - RNA, 19 nt, Leptospira interrogans serovar lai str. 56601
agaaaaccuaaaauagauc

SEQ ID NO: 2777100 - RNA, 17 nt, Leptospira interrogans serovar lai str. 56601
agaaaacgagaaagaau

SEQ ID NO: 2777101 - RNA, 22 nt, Leptospira interrogans serovar lai str. 56601
agaaaacucaaaucuacaaaac

SEQ ID NO: 2777102 - RNA, 15 nt, Leptospira interrogans serovar lai str. 56601
agaaaacuuggguuu

SEQ ID NO: 2777103 - RNA, 22 nt, Leptospira interrogans serovar lai str. 56601
agaaaacuugguuggauuccuu

SEQ ID NO: 2777104 - RNA, 14 nt, Leptospira interrogans serovar lai str. 56601
agaaaaggaaggag

SEQ ID NO: 2777105 - RNA, 20 nt, Leptospira interrogans serovar lai str. 56601
agaaaagguguggauaccuu

SEQ ID NO: 2777106 - RNA, 15 nt, Leptospira interrogans serovar lai str. 56601
agaaaauaaaaaauu

SEQ ID NO: 2777107 - RNA, 11 nt, Leptospira interrogans serovar lai str. 56601
agaaaauaaua

SEQ ID NO: 2777108 - RNA, 16 nt, Leptospira interrogans serovar lai str. 56601
agaaaauaauaauauu

SEQ ID NO: 2777109 - RNA, 22 nt, Leptospira interrogans serovar lai str. 56601
agaaaauccagucaaguaaaga

SEQ ID NO: 2777110 - RNA, 22 nt, Leptospira interrogans serovar lai str. 56601
agaaaaucugggcgaaucgcuc

SEQ ID NO: 2777111 - RNA, 23 nt, Leptospira interrogans serovar lai str. 56601
agaaaauuaauuuuucaacaacu

SEQ ID NO: 2777112 - RNA, 18 nt, Leptospira interrogans serovar lai str. 56601
agaaaauuauaaacaaau

SEQ ID NO: 2777113 - RNA, 10 nt, Leptospira interrogans serovar lai str. 56601
agaaaauucg

SEQ ID NO: 2777114 - RNA, 13 nt, Leptospira interrogans serovar lai str. 56601
agaaaauuuuuac

SEQ ID NO: 2777115 - RNA, 12 nt, Leptospira interrogans serovar lai str. 56601
agaaaauuuuuu

SEQ ID NO: 2777116 - RNA, 22 nt, Leptospira interrogans serovar lai str. 56601
agaaacaaggcuuuguaauaaa

SEQ ID NO: 2777117 - RNA, 22 nt, Leptospira interrogans serovar lai str. 56601
agaaacaauucuuccuuuuuca

SEQ ID NO: 2777118 - RNA, 23 nt, Leptospira interrogans serovar lai str. 56601
agaaacacucccccuuccgauuc

SEQ ID NO: 2777119 - RNA, 18 nt, Leptospira interrogans serovar lai str. 56601
agaaacaguauauuauaa

SEQ ID NO: 2777120 - RNA, 19 nt, Leptospira interrogans serovar lai str. 56601
agaaaccgaucuuaaaaac

SEQ ID NO: 2777121 - RNA, 21 nt, Leptospira interrogans serovar lai str. 56601
agaaaccgaucuuaaaaacuu

SEQ ID NO: 2777122 - RNA, 16 nt, Leptospira interrogans serovar lai str. 56601
agaaaccgauuuuaau

SEQ ID NO: 2777123 - RNA, 16 nt, Leptospira interrogans serovar lai str. 56601
agaaaccucuauaaau

SEQ ID NO: 2777124 - RNA, 16 nt, Leptospira interrogans serovar lai str. 56601
agaaaccuuuauagaa

SEQ ID NO: 2777125 - RNA, 21 nt, Leptospira interrogans serovar lai str. 56601
agaaacggauggagaauuuau

SEQ ID NO: 2777126 - RNA, 20 nt, Leptospira interrogans serovar lai str. 56601
agaaacggugcauuuaaaaa

SEQ ID NO: 2777127 - RNA, 23 nt, Leptospira interrogans serovar lai str. 56601
agaaacggugcauuuaaaaaauu

SEQ ID NO: 2777128 - RNA, 13 nt, Leptospira interrogans serovar lai str. 56601
agaacuuucucga

SEQ ID NO: 2777129 - RNA, 13 nt, Leptospira interrogans serovar lai str. 56601
agaagaaauaagu

SEQ ID NO: 2777130 - RNA, 18 nt, Leptospira interrogans serovar lai str. 56601
agaagagccucaaguaaa

SEQ ID NO: 2777131 - RNA, 22 nt, Leptospira interrogans serovar lai str. 56601
agaagagccucaaguaaaacgu

SEQ ID NO: 2777132 - RNA, 16 nt, Leptospira interrogans serovar lai str. 56601
agaagagucaaacacu

SEQ ID NO: 2777133 - RNA, 11 nt, Leptospira interrogans serovar lai str. 56601
agaagauaaaa

SEQ ID NO: 2777134 - RNA, 14 nt, Leptospira interrogans serovar lai str. 56601
agaagauaaaacuc

SEQ ID NO: 2777135 - RNA, 16 nt, Leptospira interrogans serovar lai str. 56601
agaagauaaauauuuc

SEQ ID NO: 2777136 - RNA, 18 nt, Leptospira interrogans serovar lai str. 56601
agaagaugcuuucucuuu

SEQ ID NO: 2777137 - RNA, 18 nt, Leptospira interrogans serovar lai str. 56601
agaagauuuuaucgaaua

SEQ ID NO: 2777138 - RNA, 19 nt, Leptospira interrogans serovar lai str. 56601
agaagauuuuuacucacac

SEQ ID NO: 2777139 - RNA, 14 nt, Leptospira interrogans serovar lai str. 56601
agaagcuaaaauug

SEQ ID NO: 2777140 - RNA, 19 nt, Leptospira interrogans serovar lai str. 56601
agaagcuuuauuaaauuau

SEQ ID NO: 2777141 - RNA, 20 nt, Leptospira interrogans serovar lai str. 56601
agaagcuuuauuaaauuaua

SEQ ID NO: 2777142 - RNA, 20 nt, Leptospira interrogans serovar lai str. 56601
agaaggcagcuaagaaaaaa

SEQ ID NO: 2777143 - RNA, 22 nt, Leptospira interrogans serovar lai str. 56601
agaaggcagcuaagaaaaaagu

SEQ ID NO: 2777144 - RNA, 15 nt, Leptospira interrogans serovar lai str. 56601
agaagggaugaaauu

SEQ ID NO: 2777145 - RNA, 18 nt, Leptospira interrogans serovar lai str. 56601
agaaguaguaguucccac

SEQ ID NO: 2777146 - RNA, 23 nt, Leptospira interrogans serovar lai str. 56601
agaaguauuuucgcacauucuau

SEQ ID NO: 2777147 - RNA, 21 nt, Leptospira interrogans serovar lai str. 56601
agaagucugguuuauuuuuga

SEQ ID NO: 2777148 - RNA, 18 nt, Leptospira interrogans serovar lai str. 56601
agaagugagacgcuuucg

SEQ ID NO: 2777149 - RNA, 16 nt, Leptospira interrogans serovar lai str. 56601
agaagugggaaggaau

SEQ ID NO: 2777150 - RNA, 14 nt, Leptospira interrogans serovar lai str. 56601
agaaguuaaaaaau

SEQ ID NO: 2777151 - RNA, 15 nt, Leptospira interrogans serovar lai str. 56601
agaaguuaaaaaaug

SEQ ID NO: 2777152 - RNA, 23 nt, Leptospira interrogans serovar lai str. 56601
agaaguugaucuuauacucuuaa

SEQ ID NO: 2777153 - RNA, 12 nt, Leptospira interrogans serovar lai str. 56601
agaauaaaaacu

SEQ ID NO: 2777154 - RNA, 13 nt, Leptospira interrogans serovar lai str. 56601
agaauaaaauuug

SEQ ID NO: 2777155 - RNA, 13 nt, Leptospira interrogans serovar lai str. 56601
agaauaaagagaa

SEQ ID NO: 2777156 - RNA, 13 nt, Leptospira interrogans serovar lai str. 56601
agaauaaaguacc

SEQ ID NO: 2777157 - RNA, 18 nt, Leptospira interrogans serovar lai str. 56601
agaauaaauuauacaauu

SEQ ID NO: 2777158 - RNA, 19 nt, Leptospira interrogans serovar lai str. 56601
agaauaagguuagauuauu

SEQ ID NO: 2777159 - RNA, 17 nt, Leptospira interrogans serovar lai str. 56601
agaauaauauuuuaaug

SEQ ID NO: 2777160 - RNA, 20 nt, Leptospira interrogans serovar lai str. 56601
agaauaaucuccuaccaacu

SEQ ID NO: 2777161 - RNA, 14 nt, Leptospira interrogans serovar lai str. 56601
agaauaauuuaaac

SEQ ID NO: 2777162 - RNA, 15 nt, Leptospira interrogans serovar lai str. 56601
agaauagauucuuaa

SEQ ID NO: 2777163 - RNA, 13 nt, Leptospira interrogans serovar lai str. 56601
agaauauaagaaa

SEQ ID NO: 2777164 - RNA, 16 nt, Leptospira interrogans serovar lai str. 56601
agaauaugucguugua

SEQ ID NO: 2777165 - RNA, 13 nt, Leptospira interrogans serovar lai str. 56601
agaauauuaaauu

SEQ ID NO: 2777166 - RNA, 21 nt, Leptospira interrogans serovar lai str. 56601
agaauauuauaaauauuaauu

SEQ ID NO: 2777167 - RNA, 20 nt, Leptospira interrogans serovar lai str. 56601
agaauauuaugaaauaaaga

SEQ ID NO: 2777168 - RNA, 17 nt, Leptospira interrogans serovar lai str. 56601
agaaucaaaaugaacuc

SEQ ID NO: 2777169 - RNA, 19 nt, Leptospira interrogans serovar lai str. 56601
agaaucaaaggaaauaaaa

SEQ ID NO: 2777170 - RNA, 12 nt, Leptospira interrogans serovar lai str. 56601
agaaucagaaug

SEQ ID NO: 2777171 - RNA, 21 nt, Leptospira interrogans serovar lai str. 56601
agaaucagaaugaacucaaca

SEQ ID NO: 2777172 - RNA, 21 nt, Leptospira interrogans serovar lai str. 56601
agaaucauacaaucaaauuuu

SEQ ID NO: 2777173 - RNA, 13 nt, Leptospira interrogans serovar lai str. 56601
agaaucauagguu

SEQ ID NO: 2777174 - RNA, 21 nt, Leptospira interrogans serovar lai str. 56601
agaaucaugaaccauggauuu

SEQ ID NO: 2777175 - RNA, 19 nt, Leptospira interrogans serovar lai str. 56601
agaauccuguuugaaaaaa

SEQ ID NO: 2777176 - RNA, 20 nt, Leptospira interrogans serovar lai str. 56601
agaauccuguuugaaaaaau

SEQ ID NO: 2777177 - RNA, 23 nt, Leptospira interrogans serovar lai str. 56601
agaauccuguuugaaaaaaugua

SEQ ID NO: 2777178 - RNA, 14 nt, Leptospira interrogans serovar lai str. 56601
agaaucgaaaaaau

SEQ ID NO: 2777179 - RNA, 20 nt, Leptospira interrogans serovar lai str. 56601
agaaucuaucucaaaauacu

SEQ ID NO: 2777180 - RNA, 18 nt, Leptospira interrogans serovar lai str. 56601
agaaucugccccaaaauu

SEQ ID NO: 2777181 - RNA, 20 nt, Leptospira interrogans serovar lai str. 56601
agaaucuguuuuguuuccuu

SEQ ID NO: 2777182 - RNA, 20 nt, Leptospira interrogans serovar lai str. 56601
agaaucuugggguuuuugua

SEQ ID NO: 2777183 - RNA, 15 nt, Leptospira interrogans serovar lai str. 56601
agaaucuuuuuaaaa

SEQ ID NO: 2777184 - RNA, 14 nt, Leptospira interrogans serovar lai str. 56601
agaaugaaaaaacu

SEQ ID NO: 2777185 - RNA, 17 nt, Leptospira interrogans serovar lai str. 56601
agaaugaaaaaacuauu

SEQ ID NO: 2777186 - RNA, 14 nt, Leptospira interrogans serovar lai str. 56601
agaaugaacucaac

SEQ ID NO: 2777187 - RNA, 16 nt, Leptospira interrogans serovar lai str. 56601
agaaugaacucaacag

SEQ ID NO: 2777188 - RNA, 15 nt, Leptospira interrogans serovar lai str. 56601
agaaugagucuuuuu

SEQ ID NO: 2777189 - RNA, 18 nt, Leptospira interrogans serovar lai str. 56601
agaaugagucuuuuuacu

SEQ ID NO: 2777190 - RNA, 22 nt, Leptospira interrogans serovar lai str. 56601
agaaugagucuuuuuacuugca

SEQ ID NO: 2777191 - RNA, 16 nt, Leptospira interrogans serovar lai str. 56601
agaaugauaaaucuug

SEQ ID NO: 2777192 - RNA, 21 nt, Leptospira interrogans serovar lai str. 56601
agaaugauaaaucuuggauca

SEQ ID NO: 2777193 - RNA, 15 nt, Leptospira interrogans serovar lai str. 56601
agaaugaucaauaga

SEQ ID NO: 2777194 - RNA, 22 nt, Leptospira interrogans serovar lai str. 56601
agaaugaucaauagaauuguug

SEQ ID NO: 2777195 - RNA, 23 nt, Leptospira interrogans serovar lai str. 56601
agaaugaucaauagaauuguuga

SEQ ID NO: 2777196 - RNA, 20 nt, Leptospira interrogans serovar lai str. 56601
agaaugaucacguaaaacuu

SEQ ID NO: 2777197 - RNA, 21 nt, Leptospira interrogans serovar lai str. 56601
agaauguaaaagcuuuugcuu

SEQ ID NO: 2777198 - RNA, 22 nt, Leptospira interrogans serovar lai str. 56601
agaauguaaaagcuuuugcuuu

SEQ ID NO: 2777199 - RNA, 21 nt, Leptospira interrogans serovar lai str. 56601
agaauguuugagguuuuaaaa

SEQ ID NO: 2777200 - RNA, 23 nt, Leptospira interrogans serovar lai str. 56601
agaauguuugagguuuuaaaagu

SEQ ID NO: 2777201 - RNA, 15 nt, Leptospira interrogans serovar lai str. 56601
agaauguuuucuaca

SEQ ID NO: 2777202 - RNA, 20 nt, Leptospira interrogans serovar lai str. 56601
agaauguuuucuacaaauaa

SEQ ID NO: 2777203 - RNA, 21 nt, Leptospira interrogans serovar lai str. 56601
agaauuaauuuuuuaaaaauu

SEQ ID NO: 2777204 - RNA, 18 nt, Leptospira interrogans serovar lai str. 56601
agaauuagauuaaauuuu

SEQ ID NO: 2777205 - RNA, 15 nt, Leptospira interrogans serovar lai str. 56601
agaauucauuuuaca

SEQ ID NO: 2777206 - RNA, 15 nt, Leptospira interrogans serovar lai str. 56601
agaauucauuuuucu

SEQ ID NO: 2777207 - RNA, 17 nt, Leptospira interrogans serovar lai str. 56601
agaauucauuuuucuac

SEQ ID NO: 2777208 - RNA, 22 nt, Leptospira interrogans serovar lai str. 56601
agaauuccuacauucauuuuua

SEQ ID NO: 2777209 - RNA, 18 nt, Leptospira interrogans serovar lai str. 56601
agaauucuacauucugaa

SEQ ID NO: 2777210 - RNA, 12 nt, Leptospira interrogans serovar lai str. 56601
agaauucuuuga

SEQ ID NO: 2777211 - RNA, 19 nt, Leptospira interrogans serovar lai str. 56601
agagaauuaauuuuucaac

SEQ ID NO: 2777212 - RNA, 18 nt, Leptospira interrogans serovar lai str. 56601
agagaauuucuauaaaau

SEQ ID NO: 2777213 - RNA, 17 nt, Leptospira interrogans serovar lai str. 56601
agagacauugaagaaaa

SEQ ID NO: 2777214 - RNA, 22 nt, Leptospira interrogans serovar lai str. 56601
agagaccgguagcgguaaaaga

SEQ ID NO: 2777215 - RNA, 15 nt, Leptospira interrogans serovar lai str. 56601
agagagcguucugcu

SEQ ID NO: 2777216 - RNA, 13 nt, Leptospira interrogans serovar lai str. 56601
agagauauagaaa

SEQ ID NO: 2777217 - RNA, 14 nt, Leptospira interrogans serovar lai str. 56601
agagauauagaaau

SEQ ID NO: 2777218 - RNA, 22 nt, Leptospira interrogans serovar lai str. 56601
agagaucauuaaugcgaaaauu

SEQ ID NO: 2777219 - RNA, 21 nt, Leptospira interrogans serovar lai str. 56601
agagaugguuuagaaaacgga

SEQ ID NO: 2777220 - RNA, 18 nt, Leptospira interrogans serovar lai str. 56601
agagauuguccuccagaa

SEQ ID NO: 2777221 - RNA, 18 nt, Leptospira interrogans serovar lai str. 56601
agagcaguucaauuuuug

SEQ ID NO: 2777222 - RNA, 13 nt, Leptospira interrogans serovar lai str. 56601
agagcguucugcu

SEQ ID NO: 2777223 - RNA, 18 nt, Leptospira interrogans serovar lai str. 56601
agagcuccuacauuuuau

SEQ ID NO: 2777224 - RNA, 13 nt, Leptospira interrogans serovar lai str. 56601
agagcugcuugaa

SEQ ID NO: 2777225 - RNA, 19 nt, Leptospira interrogans serovar lai str. 56601
agagcuuuacaauaaaaau

SEQ ID NO: 2777226 - RNA, 23 nt, Leptospira interrogans serovar lai str. 56601
agagcuuuacaauaaaaauuaga

SEQ ID NO: 2777227 - RNA, 18 nt, Leptospira interrogans serovar lai str. 56601
agaggaaacguauuuuua

SEQ ID NO: 2777228 - RNA, 21 nt, Leptospira interrogans serovar lai str. 56601
agaggaguccaugauucugaa

SEQ ID NO: 2777229 - RNA, 17 nt, Leptospira interrogans serovar lai str. 56601
agaggauguaauuccag

SEQ ID NO: 2777230 - RNA, 23 nt, Leptospira interrogans serovar lai str. 56601
agaggucgucucaaaaauauugu

SEQ ID NO: 2777231 - RNA, 14 nt, Leptospira interrogans serovar lai str. 56601
agaggugaaauuuc

SEQ ID NO: 2777232 - RNA, 17 nt, Leptospira interrogans serovar lai str. 56601
agaggugaaauuuccac

SEQ ID NO: 2777233 - RNA, 20 nt, Leptospira interrogans serovar lai str. 56601
agagguucugagucguucga

SEQ ID NO: 2777234 - RNA, 18 nt, Leptospira interrogans serovar lai str. 56601
agaguaagaaacaucaaa

SEQ ID NO: 2777235 - RNA, 17 nt, Leptospira interrogans serovar lai str. 56601
agaguaccauaaauuuu

SEQ ID NO: 2777236 - RNA, 16 nt, Leptospira interrogans serovar lai str. 56601
agagucauuuuuaaau

SEQ ID NO: 2777237 - RNA, 19 nt, Leptospira interrogans serovar lai str. 56601
agagucauuuuuaaauacu

SEQ ID NO: 2777238 - RNA, 21 nt, Leptospira interrogans serovar lai str. 56601
agaguccuccaaacaauuuuu

SEQ ID NO: 2777239 - RNA, 22 nt, Leptospira interrogans serovar lai str. 56601
agagugaccguugugagaaaua

SEQ ID NO: 2777240 - RNA, 18 nt, Leptospira interrogans serovar lai str. 56601
agagugcagauuaaaaaa

SEQ ID NO: 2777241 - RNA, 16 nt, Leptospira interrogans serovar lai str. 56601
agagugccaaaauuuu

SEQ ID NO: 2777242 - RNA, 20 nt, Leptospira interrogans serovar lai str. 56601
agagugccaaaauuuugcuu

SEQ ID NO: 2777243 - RNA, 22 nt, Leptospira interrogans serovar lai str. 56601
agagugguuuucaaauauuuua

SEQ ID NO: 2777244 - RNA, 15 nt, Leptospira interrogans serovar lai str. 56601
agaguguucaucuuc

SEQ ID NO: 2777245 - RNA, 16 nt, Leptospira interrogans serovar lai str. 56601
agaguguugacucuuu

SEQ ID NO: 2777246 - RNA, 17 nt, Leptospira interrogans serovar lai str. 56601
agaguuaagagaauuuc

SEQ ID NO: 2777247 - RNA, 14 nt, Leptospira interrogans serovar lai str. 56601
agaguuacagaaaa

SEQ ID NO: 2777248 - RNA, 16 nt, Leptospira interrogans serovar lai str. 56601
agaguuacagaaaaaa

SEQ ID NO: 2777249 - RNA, 18 nt, Leptospira interrogans serovar lai str. 56601
agaguuacagaaaaaauc

SEQ ID NO: 2777250 - RNA, 19 nt, Leptospira interrogans serovar lai str. 56601
agaguuauugaaaaauuuc

SEQ ID NO: 2777251 - RNA, 23 nt, Leptospira interrogans serovar lai str. 56601
agaguucccacauuuuaaagauu

SEQ ID NO: 2777252 - RNA, 19 nt, Leptospira interrogans serovar lai str. 56601
agaguucccacauuuugaa

SEQ ID NO: 2777253 - RNA, 23 nt, Leptospira interrogans serovar lai str. 56601
agaguucccacguuuuaaagguu

SEQ ID NO: 2777254 - RNA, 16 nt, Leptospira interrogans serovar lai str. 56601
agaguucgugaagaaa

SEQ ID NO: 2777255 - RNA, 18 nt, Leptospira interrogans serovar lai str. 56601
agaguucguuaagaauaa

SEQ ID NO: 2777256 - RNA, 15 nt, Leptospira interrogans serovar lai str. 56601
agaguuguccuaaaa

SEQ ID NO: 2777257 - RNA, 17 nt, Leptospira interrogans serovar lai str. 56601
agaguuguuaaaaaauu

SEQ ID NO: 2777258 - RNA, 19 nt, Leptospira interrogans serovar lai str. 56601
agaguuguugaaaaauucc

SEQ ID NO: 2777259 - RNA, 19 nt, Leptospira interrogans serovar lai str. 56601
agaguuguugaaaaauuuu

SEQ ID NO: 2777260 - RNA, 14 nt, Leptospira interrogans serovar lai str. 56601
agauaaaaaaggau

SEQ ID NO: 2777261 - RNA, 16 nt, Leptospira interrogans serovar lai str. 56601
agauaaaaaaggaucc

SEQ ID NO: 2777262 - RNA, 21 nt, Leptospira interrogans serovar lai str. 56601
agauaaaacucaaaggaaaau

SEQ ID NO: 2777263 - RNA, 16 nt, Leptospira interrogans serovar lai str. 56601
agauaaagguaaaaga

SEQ ID NO: 2777264 - RNA, 21 nt, Leptospira interrogans serovar lai str. 56601
agauaaauauuuccaaauugu

SEQ ID NO: 2777265 - RNA, 23 nt, Leptospira interrogans serovar lai str. 56601
agauaaaucguuugcuuuucuau

SEQ ID NO: 2777266 - RNA, 15 nt, Leptospira interrogans serovar lai str. 56601
agauaacuucauuuc

SEQ ID NO: 2777267 - RNA, 17 nt, Leptospira interrogans serovar lai str. 56601
agauaaugagccagguu

SEQ ID NO: 2777268 - RNA, 21 nt, Leptospira interrogans serovar lai str. 56601
agauaaugagccagguuaauu

SEQ ID NO: 2777269 - RNA, 23 nt, Leptospira interrogans serovar lai str. 56601
agauaauuaaacaaagaauaaau

SEQ ID NO: 2777270 - RNA, 12 nt, Leptospira interrogans serovar lai str. 56601
agauaauuuuua

SEQ ID NO: 2777271 - RNA, 16 nt, Leptospira interrogans serovar lai str. 56601
agauaauuuuuacuca

SEQ ID NO: 2777272 - RNA, 22 nt, Leptospira interrogans serovar lai str. 56601
agauaauuuuuacucaaagaau

SEQ ID NO: 2777273 - RNA, 14 nt, Leptospira interrogans serovar lai str. 56601
agauacaauuaaac

SEQ ID NO: 2777274 - RNA, 20 nt, Leptospira interrogans serovar lai str. 56601
agauacgcccguaaauuucu

SEQ ID NO: 2777275 - RNA, 18 nt, Leptospira interrogans serovar lai str. 56601
agauagaaccuauaucuu

SEQ ID NO: 2777276 - RNA, 19 nt, Leptospira interrogans serovar lai str. 56601
agauagagaauuaauuuuu

SEQ ID NO: 2777277 - RNA, 14 nt, Leptospira interrogans serovar lai str. 56601
agauaggaauguuu

SEQ ID NO: 2777278 - RNA, 14 nt, Leptospira interrogans serovar lai str. 56601
agauauaacuuagu

SEQ ID NO: 2777279 - RNA, 15 nt, Leptospira interrogans serovar lai str. 56601
agauauagaaauuuu

SEQ ID NO: 2777280 - RNA, 20 nt, Leptospira interrogans serovar lai str. 56601
agauauagaaauuuucaaaa

SEQ ID NO: 2777281 - RNA, 18 nt, Leptospira interrogans serovar lai str. 56601
agauauuaacaaauuuaa

SEQ ID NO: 2777282 - RNA, 19 nt, Leptospira interrogans serovar lai str. 56601
agauauugcacaugauaua

SEQ ID NO: 2777283 - RNA, 15 nt, Leptospira interrogans serovar lai str. 56601
agauauuucaagaau

SEQ ID NO: 2777284 - RNA, 13 nt, Leptospira interrogans serovar lai str. 56601
agauauuuuccuu

SEQ ID NO: 2777285 - RNA, 21 nt, Leptospira interrogans serovar lai str. 56601
agaucaaagagaugauuucuu

SEQ ID NO: 2777286 - RNA, 23 nt, Leptospira interrogans serovar lai str. 56601
agaucaacacaaauauuaagaau

SEQ ID NO: 2777287 - RNA, 21 nt, Leptospira interrogans serovar lai str. 56601
agaucaagaauuaauuuuuca

SEQ ID NO: 2777288 - RNA, 14 nt, Leptospira interrogans serovar lai str. 56601
agaucaauucuuaa

SEQ ID NO: 2777289 - RNA, 19 nt, Leptospira interrogans serovar lai str. 56601
agaucaauuuguuccuaaa

SEQ ID NO: 2777290 - RNA, 19 nt, Leptospira interrogans serovar lai str. 56601
agaucauucuauuuggauu

SEQ ID NO: 2777291 - RNA, 19 nt, Leptospira interrogans serovar lai str. 56601
agauccacuacggaaggaa

SEQ ID NO: 2777292 - RNA, 14 nt, Leptospira interrogans serovar lai str. 56601
agauccguaaacca

SEQ ID NO: 2777293 - RNA, 20 nt, Leptospira interrogans serovar lai str. 56601
agauuuuucguucuaagaau

SEQ ID NO: 2777294 - RNA, 23 nt, Leptospira interrogans serovar lai str. 56601
agauuuuucguucuaagaaucuu

SEQ ID NO: 2777295 - RNA, 14 nt, Leptospira interrogans serovar lai str. 56601
agauuuuugcacaa

SEQ ID NO: 2777296 - RNA, 16 nt, Leptospira interrogans serovar lai str. 56601
agauuuuugcacaaaa

SEQ ID NO: 2777297 - RNA, 14 nt, Leptospira interrogans serovar lai str. 56601
agauuuuuguaguu

SEQ ID NO: 2777298 - RNA, 16 nt, Leptospira interrogans serovar lai str. 56601
agcaaaaauuuucuaa

SEQ ID NO: 2777299 - RNA, 17 nt, Leptospira interrogans serovar lai str. 56601
agcaaacuuuuuauaaa

SEQ ID NO: 2777300 - RNA, 19 nt, Leptospira interrogans serovar lai str. 56601
agcaaagaaggcagcuaag

SEQ ID NO: 2777301 - RNA, 21 nt, Leptospira interrogans serovar lai str. 56601
agcaaauaacgauuccauuuu

SEQ ID NO: 2777302 - RNA, 18 nt, Leptospira interrogans serovar lai str. 56601
agcaaaucacgauuuuac

SEQ ID NO: 2777303 - RNA, 15 nt, Leptospira interrogans serovar lai str. 56601
agcaaauuuacuuca

SEQ ID NO: 2777304 - RNA, 18 nt, Leptospira interrogans serovar lai str. 56601
agcaacaauuaacaaaac

SEQ ID NO: 2777305 - RNA, 21 nt, Leptospira interrogans serovar lai str. 56601
agcaacggcugaugcauccaa

SEQ ID NO: 2777306 - RNA, 21 nt, Leptospira interrogans serovar lai str. 56601
agcaacguagucguguuguuu

SEQ ID NO: 2777307 - RNA, 13 nt, Leptospira interrogans serovar lai str. 56601
agcaauaaaauca

SEQ ID NO: 2777308 - RNA, 15 nt, Leptospira interrogans serovar lai str. 56601
agcaauccauucaaa

SEQ ID NO: 2777309 - RNA, 21 nt, Leptospira interrogans serovar lai str. 56601
agcaauccauucaaaaaauca

SEQ ID NO: 2777310 - RNA, 20 nt, Leptospira interrogans serovar lai str. 56601
agcaaucgaucuguaaaauu

SEQ ID NO: 2777311 - RNA, 12 nt, Leptospira interrogans serovar lai str. 56601
agcaaucuuccu

SEQ ID NO: 2777312 - RNA, 23 nt, Leptospira interrogans serovar lai str. 56601
agcaauucuaagaccuaaacccu

SEQ ID NO: 2777313 - RNA, 14 nt, Leptospira interrogans serovar lai str. 56601
agcaauuugugaac

SEQ ID NO: 2777314 - RNA, 13 nt, Leptospira interrogans serovar lai str. 56601
agcacaauauauu

SEQ ID NO: 2777315 - RNA, 15 nt, Leptospira interrogans serovar lai str. 56601
agcacaauauauuca

SEQ ID NO: 2777316 - RNA, 22 nt, Leptospira interrogans serovar lai str. 56601
agcacauccgcauucucacaaa

SEQ ID NO: 2777317 - RNA, 21 nt, Leptospira interrogans serovar lai str. 56601
agcaccuucuaaauuccaaaa

SEQ ID NO: 2777318 - RNA, 14 nt, Leptospira interrogans serovar lai str. 56601
agcaccuuuuuuaa

SEQ ID NO: 2777319 - RNA, 23 nt, Leptospira interrogans serovar lai str. 56601
agcacuuuuuuccucgaauucag

SEQ ID NO: 2777320 - RNA, 13 nt, Leptospira interrogans serovar lai str. 56601
agcagcaaagaag

SEQ ID NO: 2777321 - RNA, 14 nt, Leptospira interrogans serovar lai str. 56601
agcagcaaagaagg

SEQ ID NO: 2777322 - RNA, 14 nt, Leptospira interrogans serovar lai str. 56601
agcagcuaaaaaga

SEQ ID NO: 2777323 - RNA, 16 nt, Leptospira interrogans serovar lai str. 56601
agcagcuaaaaagaaa

SEQ ID NO: 2777324 - RNA, 13 nt, Leptospira interrogans serovar lai str. 56601
agcaguaaaaaag

SEQ ID NO: 2777325 - RNA, 21 nt, Leptospira interrogans serovar lai str. 56601
agcaguaaaaucuuuaaguuu

SEQ ID NO: 2777326 - RNA, 11 nt, Leptospira interrogans serovar lai str. 56601
agcaguucuaa

SEQ ID NO: 2777327 - RNA, 13 nt, Leptospira interrogans serovar lai str. 56601
agcauaaaaaaau

SEQ ID NO: 2777328 - RNA, 14 nt, Leptospira interrogans serovar lai str. 56601
agcaucaacaucac

SEQ ID NO: 2777329 - RNA, 20 nt, Leptospira interrogans serovar lai str. 56601
agcaucaacaucacgcacau

SEQ ID NO: 2777330 - RNA, 16 nt, Leptospira interrogans serovar lai str. 56601
agcaugaaauuuucuu

SEQ ID NO: 2777331 - RNA, 17 nt, Leptospira interrogans serovar lai str. 56601
agcaugaaauuuucuua

SEQ ID NO: 2777332 - RNA, 22 nt, Leptospira interrogans serovar lai str. 56601
agcaugaggcaacggaauuuuu

SEQ ID NO: 2777333 - RNA, 20 nt, Leptospira interrogans serovar lai str. 56601
agcauuacuacagacaaucc

SEQ ID NO: 2777334 - RNA, 18 nt, Leptospira interrogans serovar lai str. 56601
agcauuauaaguuuuuau

SEQ ID NO: 2777335 - RNA, 18 nt, Leptospira interrogans serovar lai str. 56601
agcauuuuuaagauuaca

SEQ ID NO: 2777336 - RNA, 14 nt, Leptospira interrogans serovar lai str. 56601
agcauuuuuuuaau

SEQ ID NO: 2777337 - RNA, 19 nt, Leptospira interrogans serovar lai str. 56601
agcauuuuuuuaauacaaa

SEQ ID NO: 2777338 - RNA, 15 nt, Leptospira interrogans serovar lai str. 56601
agccaaaaauuagaa

SEQ ID NO: 2777339 - RNA, 18 nt, Leptospira interrogans serovar lai str. 56601
agccaaaaccaauuuuuc

SEQ ID NO: 2777340 - RNA, 21 nt, Leptospira interrogans serovar lai str. 56601
agccaaaauucaaauucuuuu

SEQ ID NO: 2777341 - RNA, 18 nt, Leptospira interrogans serovar lai str. 56601
agccaaaucugaaaaaga

SEQ ID NO: 2777342 - RNA, 15 nt, Leptospira interrogans serovar lai str. 56601
agccaacacauucca

SEQ ID NO: 2777343 - RNA, 15 nt, Leptospira interrogans serovar lai str. 56601
agccaauuccaaacg

SEQ ID NO: 2777344 - RNA, 15 nt, Leptospira interrogans serovar lai str. 56601
agccaccaucaaaau

SEQ ID NO: 2777345 - RNA, 23 nt, Leptospira interrogans serovar lai str. 56601
agccaucguucucucaauuaaag

SEQ ID NO: 2777346 - RNA, 14 nt, Leptospira interrogans serovar lai str. 56601
agccaugccaaaca

SEQ ID NO: 2777347 - RNA, 15 nt, Leptospira interrogans serovar lai str. 56601
agccaugccaaacac

SEQ ID NO: 2777348 - RNA, 16 nt, Leptospira interrogans serovar lai str. 56601
agccaugguaagaaga

SEQ ID NO: 2777349 - RNA, 17 nt, Leptospira interrogans serovar lai str. 56601
agccaugguaagaagaa

SEQ ID NO: 2777350 - RNA, 16 nt, Leptospira interrogans serovar lai str. 56601
agccauuuagguugua

SEQ ID NO: 2777351 - RNA, 21 nt, Leptospira interrogans serovar lai str. 56601
agccauuucaaaaauauauua

SEQ ID NO: 2777352 - RNA, 17 nt, Leptospira interrogans serovar lai str. 56601
agccccagucuauaaau

SEQ ID NO: 2777353 - RNA, 22 nt, Leptospira interrogans serovar lai str. 56601
agcccucagcuauaaaauaggu

SEQ ID NO: 2777354 - RNA, 22 nt, Leptospira interrogans serovar lai str. 56601
agcccuugcguaucaaaccuuu

SEQ ID NO: 2777355 - RNA, 16 nt, Leptospira interrogans serovar lai str. 56601
agccgcacaaaccaaa

SEQ ID NO: 2777356 - RNA, 20 nt, Leptospira interrogans serovar lai str. 56601
agccgcgcuuuccuuauuaa

SEQ ID NO: 2777357 - RNA, 16 nt, Leptospira interrogans serovar lai str. 56601
agccgcuucaucaaac

SEQ ID NO: 2777358 - RNA, 13 nt, Leptospira interrogans serovar lai str. 56601
agccguaaauauu

SEQ ID NO: 2777359 - RNA, 16 nt, Leptospira interrogans serovar lai str. 56601
agccuaauccaauaaa

SEQ ID NO: 2777360 - RNA, 23 nt, Leptospira interrogans serovar lai str. 56601
agccuaauccaauaaaauuuuau

SEQ ID NO: 2777361 - RNA, 19 nt, Leptospira interrogans serovar lai str. 56601
agccuaauuacgauuuuuu

SEQ ID NO: 2777362 - RNA, 17 nt, Leptospira interrogans serovar lai str. 56601
agccugaguuugagaga

SEQ ID NO: 2777363 - RNA, 19 nt, Leptospira interrogans serovar lai str. 56601
agccugaguuugagagaga

SEQ ID NO: 2777364 - RNA, 16 nt, Leptospira interrogans serovar lai str. 56601
agccuuaaaucaaucc

SEQ ID NO: 2777365 - RNA, 13 nt, Leptospira interrogans serovar lai str. 56601
agccuucaauuau

SEQ ID NO: 2777366 - RNA, 20 nt, Leptospira interrogans serovar lai str. 56601
agccuuccaucaaauacaaa

SEQ ID NO: 2777367 - RNA, 16 nt, Leptospira interrogans serovar lai str. 56601
agccuuucacaucucc

SEQ ID NO: 2777368 - RNA, 24 nt, Leptospira interrogans serovar lai str. 56601
agcgaaagaauguauaccaauaau

SEQ ID NO: 2777369 - RNA, 22 nt, Leptospira interrogans serovar lai str. 56601
agcgaacggcuuuaguuugaaa

SEQ ID NO: 2777370 - RNA, 13 nt, Leptospira interrogans serovar lai str. 56601
agcgaccauagaa

SEQ ID NO: 2777371 - RNA, 19 nt, Leptospira interrogans serovar lai str. 56601
agcgaccauagaagcgaga

SEQ ID NO: 2777372 - RNA, 19 nt, Leptospira interrogans serovar lai str. 56601
agcgagagacgcugaguua

SEQ ID NO: 2777373 - RNA, 14 nt, Leptospira interrogans serovar lai str. 56601
agcgaugaucgauu

SEQ ID NO: 2777374 - RNA, 12 nt, Leptospira interrogans serovar lai str. 56601
agcgcagacucu

SEQ ID NO: 2777375 - RNA, 14 nt, Leptospira interrogans serovar lai str. 56601
agcgcuugaaaauu

SEQ ID NO: 2777376 - RNA, 13 nt, Leptospira interrogans serovar lai str. 56601
aggauuaauuccc

SEQ ID NO: 2777377 - RNA, 16 nt, Leptospira interrogans serovar lai str. 56601
aggauuccauugauuu

SEQ ID NO: 2777378 - RNA, 22 nt, Leptospira interrogans serovar lai str. 56601
aggauuccauugauuuucauuu

SEQ ID NO: 2777379 - RNA, 16 nt, Leptospira interrogans serovar lai str. 56601
aggauuuuagaaucaa

SEQ ID NO: 2777380 - RNA, 19 nt, Leptospira interrogans serovar lai str. 56601
aggauuuuagaaucaaaau

SEQ ID NO: 2777381 - RNA, 19 nt, Leptospira interrogans serovar lai str. 56601
aggauuuuagaaugagaag

SEQ ID NO: 2777382 - RNA, 12 nt, Leptospira interrogans serovar lai str. 56601
aggauuuuauga

SEQ ID NO: 2777383 - RNA, 13 nt, Leptospira interrogans serovar lai str. 56601
aggcaaaagacuc

SEQ ID NO: 2777384 - RNA, 13 nt, Leptospira interrogans serovar lai str. 56601
aggcaauuuucuc

SEQ ID NO: 2777385 - RNA, 17 nt, Leptospira interrogans serovar lai str. 56601
aggcacauuuuucaagu

SEQ ID NO: 2777386 - RNA, 14 nt, Leptospira interrogans serovar lai str. 56601
aggcaucauucuuu

SEQ ID NO: 2777387 - RNA, 14 nt, Leptospira interrogans serovar lai str. 56601
aggcgcggaaaaau

SEQ ID NO: 2777388 - RNA, 17 nt, Leptospira interrogans serovar lai str. 56601
aggcguugagcacagca

SEQ ID NO: 2777389 - RNA, 13 nt, Leptospira interrogans serovar lai str. 56601
aggcucaauauuu

SEQ ID NO: 2777390 - RNA, 20 nt, Leptospira interrogans serovar lai str. 56601
aggcucaauauuuaaaaauu

SEQ ID NO: 2777391 - RNA, 21 nt, Leptospira interrogans serovar lai str. 56601
aggcucgaauuuuuuucagua

SEQ ID NO: 2777392 - RNA, 23 nt, Leptospira interrogans serovar lai str. 56601
aggcugccgcucuuucuuccgga

SEQ ID NO: 2777393 - RNA, 20 nt, Leptospira interrogans serovar lai str. 56601
aggcuggcaaaauccgaaac

SEQ ID NO: 2777394 - RNA, 19 nt, Leptospira interrogans serovar lai str. 56601
aggcugucuucagcagucu

SEQ ID NO: 2777395 - RNA, 20 nt, Leptospira interrogans serovar lai str. 56601
aggcuuguuugaauuuuucg

SEQ ID NO: 2777396 - RNA, 16 nt, Leptospira interrogans serovar lai str. 56601
aggcuuuacauuuuua

SEQ ID NO: 2777397 - RNA, 21 nt, Leptospira interrogans serovar lai str. 56601
aggcuuuguaauaaaaauuua

SEQ ID NO: 2777398 - RNA, 15 nt, Leptospira interrogans serovar lai str. 56601
agggaaaaaagcaua

SEQ ID NO: 2777399 - RNA, 14 nt, Leptospira interrogans serovar lai str. 56601
agggaaaguuauuu

SEQ ID NO: 2777400 - RNA, 16 nt, Leptospira interrogans serovar lai str. 56601
agggaaaguuauuucu

SEQ ID NO: 2777401 - RNA, 18 nt, Leptospira interrogans serovar lai str. 56601
agggagaauaucuacuuu

SEQ ID NO: 2777402 - RNA, 15 nt, Leptospira interrogans serovar lai str. 56601
agggguuuuuccuuu

SEQ ID NO: 2777403 - RNA, 21 nt, Leptospira interrogans serovar lai str. 56601
agggucuuucgagauuaaaau

SEQ ID NO: 2777404 - RNA, 16 nt, Leptospira interrogans serovar lai str. 56601
aggguuuuuacaauua

SEQ ID NO: 2777405 - RNA, 15 nt, Leptospira interrogans serovar lai str. 56601
agguaauagaaaacu

SEQ ID NO: 2777406 - RNA, 13 nt, Leptospira interrogans serovar lai str. 56601
agguaauuuagga

SEQ ID NO: 2777407 - RNA, 14 nt, Leptospira interrogans serovar lai str. 56601
agguaauuuaggaa

SEQ ID NO: 2777408 - RNA, 15 nt, Leptospira interrogans serovar lai str. 56601
agguacagaaacaaa

SEQ ID NO: 2777409 - RNA, 17 nt, Leptospira interrogans serovar lai str. 56601
agguauaaaauaaaaau

SEQ ID NO: 2777410 - RNA, 14 nt, Leptospira interrogans serovar lai str. 56601
agguauaaccuuug

SEQ ID NO: 2777411 - RNA, 20 nt, Leptospira interrogans serovar lai str. 56601
agguauuuuagagaaacuuu

SEQ ID NO: 2777412 - RNA, 13 nt, Leptospira interrogans serovar lai str. 56601
aggucauuuuuca

SEQ ID NO: 2777413 - RNA, 18 nt, Leptospira interrogans serovar lai str. 56601
aggucuacguccguuccc

SEQ ID NO: 2777414 - RNA, 13 nt, Leptospira interrogans serovar lai str. 56601
aggucucaacaac

SEQ ID NO: 2777415 - RNA, 23 nt, Leptospira interrogans serovar lai str. 56601
aggucugaaggaauauucauuca

SEQ ID NO: 2777416 - RNA, 16 nt, Leptospira interrogans serovar lai str. 56601
aggugaaauuuccacu

SEQ ID NO: 2777417 - RNA, 12 nt, Leptospira interrogans serovar lai str. 56601
aggugauuaaac

SEQ ID NO: 2777418 - RNA, 14 nt, Leptospira interrogans serovar lai str. 56601
aggugcaaauuacg

SEQ ID NO: 2777419 - RNA, 14 nt, Leptospira interrogans serovar lai str. 56601
aggugcuacugcaa

SEQ ID NO: 2777420 - RNA, 16 nt, Leptospira interrogans serovar lai str. 56601
agguuauaauuucuuu

SEQ ID NO: 2777421 - RNA, 19 nt, Leptospira interrogans serovar lai str. 56601
agguucaaaaaaauuaaac

SEQ ID NO: 2777422 - RNA, 21 nt, Leptospira interrogans serovar lai str. 56601
agguucuuaugagauuuuugg

SEQ ID NO: 2777423 - RNA, 23 nt, Leptospira interrogans serovar lai str. 56601
agguucuugcaaaaauagaauuu

SEQ ID NO: 2777424 - RNA, 16 nt, Leptospira interrogans serovar lai str. 56601
agguugagcaguaaaa

SEQ ID NO: 2777425 - RNA, 19 nt, Leptospira interrogans serovar lai str. 56601
agguugagcaguaaaaucu

SEQ ID NO: 2777426 - RNA, 16 nt, Leptospira interrogans serovar lai str. 56601
agguugaguaguaaaa

SEQ ID NO: 2777427 - RNA, 19 nt, Leptospira interrogans serovar lai str. 56601
agguugaguaguaaaaucu

SEQ ID NO: 2777428 - RNA, 16 nt, Leptospira interrogans serovar lai str. 56601
agguugaguucuuuua

SEQ ID NO: 2777429 - RNA, 20 nt, Leptospira interrogans serovar lai str. 56601
agguuguaacucaaaauuuc

SEQ ID NO: 2777430 - RNA, 18 nt, Leptospira interrogans serovar lai str. 56601
aguaaaaauggauacuua

SEQ ID NO: 2777431 - RNA, 18 nt, Leptospira interrogans serovar lai str. 56601
aguaaaacccaauaccaa

SEQ ID NO: 2777432 - RNA, 18 nt, Leptospira interrogans serovar lai str. 56601
aguaaaacgcucucuacc

SEQ ID NO: 2777433 - RNA, 20 nt, Leptospira interrogans serovar lai str. 56601
aguaaaacgcucucuacgga

SEQ ID NO: 2777434 - RNA, 13 nt, Leptospira interrogans serovar lai str. 56601
aguaaaacuguuu

SEQ ID NO: 2777435 - RNA, 14 nt, Leptospira interrogans serovar lai str. 56601
aguaaaacuuuggu

SEQ ID NO: 2777436 - RNA, 19 nt, Leptospira interrogans serovar lai str. 56601
aguaaaacuuugguuugua

SEQ ID NO: 2777437 - RNA, 16 nt, Leptospira interrogans serovar lai str. 56601
aguaaaacuuuuaaag

SEQ ID NO: 2777438 - RNA, 17 nt, Leptospira interrogans serovar lai str. 56601
aguaaaacuuuuaaaga

SEQ ID NO: 2777439 - RNA, 13 nt, Leptospira interrogans serovar lai str. 56601
aguaaaagaaaau

SEQ ID NO: 2777440 - RNA, 14 nt, Leptospira interrogans serovar lai str. 56601
aguaaaagaaaauu

SEQ ID NO: 2777441 - RNA, 14 nt, Leptospira interrogans serovar lai str. 56601
aguaaaauuaaaag

SEQ ID NO: 2777442 - RNA, 18 nt, Leptospira interrogans serovar lai str. 56601
aguaaaauuuaaaauucu

SEQ ID NO: 2777443 - RNA, 15 nt, Leptospira interrogans serovar lai str. 56601
aguaaaauuuaaauu

SEQ ID NO: 2777444 - RNA, 20 nt, Leptospira interrogans serovar lai str. 56601
aguaaacuauugcagauaag

SEQ ID NO: 2777445 - RNA, 13 nt, Leptospira interrogans serovar lai str. 56601
aguaaagaaacuc

SEQ ID NO: 2777446 - RNA, 23 nt, Leptospira interrogans serovar lai str. 56601
aguaaagaacgauuuuuuacaaa

SEQ ID NO: 2777447 - RNA, 22 nt, Leptospira interrogans serovar lai str. 56601
aguaaagguuucacaaauuuua

SEQ ID NO: 2777448 - RNA, 15 nt, Leptospira interrogans serovar lai str. 56601
aguaaauaaaaaacg

SEQ ID NO: 2777449 - RNA, 16 nt, Leptospira interrogans serovar lai str. 56601
aguaaauccacaaguu

SEQ ID NO: 2777450 - RNA, 21 nt, Leptospira interrogans serovar lai str. 56601
aguaaaucgaugguuucaauu

SEQ ID NO: 2777451 - RNA, 17 nt, Leptospira interrogans serovar lai str. 56601
aguaaaucugaggauuu

SEQ ID NO: 2777452 - RNA, 22 nt, Leptospira interrogans serovar lai str. 56601
aguaacagaaaaauguuaaaaa

SEQ ID NO: 2777453 - RNA, 19 nt, Leptospira interrogans serovar lai str. 56601
aguaacgaguagaauucuc

SEQ ID NO: 2777454 - RNA, 16 nt, Leptospira interrogans serovar lai str. 56601
aguaagauauuaacaa

SEQ ID NO: 2777455 - RNA, 19 nt, Leptospira interrogans serovar lai str. 56601
aguaagcccccgaagaauu

SEQ ID NO: 2777456 - RNA, 17 nt, Leptospira interrogans serovar lai str. 56601
aguaaggauucuuuucc

SEQ ID NO: 2777457 - RNA, 14 nt, Leptospira interrogans serovar lai str. 56601
aguaaggcaaacuu

SEQ ID NO: 2777458 - RNA, 23 nt, Leptospira interrogans serovar lai str. 56601
aguaaggcaaacuuuuuuagcaa

SEQ ID NO: 2777459 - RNA, 16 nt, Leptospira interrogans serovar lai str. 56601
aguccuuuuugagaaa

SEQ ID NO: 2777460 - RNA, 13 nt, Leptospira interrogans serovar lai str. 56601
agucgaaagaauu

SEQ ID NO: 2777461 - RNA, 14 nt, Leptospira interrogans serovar lai str. 56601
agucgaaagaauuu

SEQ ID NO: 2777462 - RNA, 12 nt, Leptospira interrogans serovar lai str. 56601
agucgaauuuuu

SEQ ID NO: 2777463 - RNA, 23 nt, Leptospira interrogans serovar lai str. 56601
agucgaucuacuaaaucagaaua

SEQ ID NO: 2777464 - RNA, 17 nt, Leptospira interrogans serovar lai str. 56601
agucgcccaaaccccag

SEQ ID NO: 2777465 - RNA, 23 nt, Leptospira interrogans serovar lai str. 56601
agucuaacaguaaaacuuugguu

SEQ ID NO: 2777466 - RNA, 20 nt, Leptospira interrogans serovar lai str. 56601
agucuagaaauguaggaacu

SEQ ID NO: 2777467 - RNA, 12 nt, Leptospira interrogans serovar lai str. 56601
agucuagaauuc

SEQ ID NO: 2777468 - RNA, 17 nt, Leptospira interrogans serovar lai str. 56601
agucuagaauucuuuga

SEQ ID NO: 2777469 - RNA, 22 nt, Leptospira interrogans serovar lai str. 56601
agucuauaaauugcaucaaaga

SEQ ID NO: 2777470 - RNA, 15 nt, Leptospira interrogans serovar lai str. 56601
agucuauuucccaaa

SEQ ID NO: 2777471 - RNA, 19 nt, Leptospira interrogans serovar lai str. 56601
agucucaaaaccuguaaau

SEQ ID NO: 2777472 - RNA, 14 nt, Leptospira interrogans serovar lai str. 56601
agucugaaauaaau

SEQ ID NO: 2777473 - RNA, 15 nt, Leptospira interrogans serovar lai str. 56601
agucugaaauaaauu

SEQ ID NO: 2777474 - RNA, 21 nt, Leptospira interrogans serovar lai str. 56601
agucugugauugccuucggcu

SEQ ID NO: 2777475 - RNA, 17 nt, Leptospira interrogans serovar lai str. 56601
agucuuacaauuuuaga

SEQ ID NO: 2777476 - RNA, 14 nt, Leptospira interrogans serovar lai str. 56601
agucuucaaaauug

SEQ ID NO: 2777477 - RNA, 18 nt, Leptospira interrogans serovar lai str. 56601
agucuuuuguuuaaaauu

SEQ ID NO: 2777478 - RNA, 18 nt, Leptospira interrogans serovar lai str. 56601
agucuuuuuacuugcaaa

SEQ ID NO: 2777479 - RNA, 20 nt, Leptospira interrogans serovar lai str. 56601
agucuuuuuacuugcaaaaa

SEQ ID NO: 2777480 - RNA, 15 nt, Leptospira interrogans serovar lai str. 56601
agucuuuuuugacuu

SEQ ID NO: 2777481 - RNA, 23 nt, Leptospira interrogans serovar lai str. 56601
agugaaaaaucgauuugaucuac

SEQ ID NO: 2777482 - RNA, 17 nt, Leptospira interrogans serovar lai str. 56601
agugaaaguaaucuuuu

SEQ ID NO: 2777483 - RNA, 20 nt, Leptospira interrogans serovar lai str. 56601
agugaaccucuguaaauaca

SEQ ID NO: 2777484 - RNA, 22 nt, Leptospira interrogans serovar lai str. 56601
agugaaccucuguaaauacaaa

SEQ ID NO: 2777485 - RNA, 24 nt, Leptospira interrogans serovar lai str. 56601
agugaaccucuguaaauacaaaau

SEQ ID NO: 2777486 - RNA, 12 nt, Leptospira interrogans serovar lai str. 56601
agugaacuccau

SEQ ID NO: 2777487 - RNA, 12 nt, Leptospira interrogans serovar lai str. 56601
agugaauaaaau

SEQ ID NO: 2777488 - RNA, 15 nt, Leptospira interrogans serovar lai str. 56601
agugaauuaaaagaa

SEQ ID NO: 2777489 - RNA, 17 nt, Leptospira interrogans serovar lai str. 56601
agugaauuaaaagaaac

SEQ ID NO: 2777490 - RNA, 16 nt, Leptospira interrogans serovar lai str. 56601
agugaauuuguaauuc

SEQ ID NO: 2777491 - RNA, 22 nt, Leptospira interrogans serovar lai str. 56601
agugaauuuguaauucuucaau

SEQ ID NO: 2777492 - RNA, 14 nt, Leptospira interrogans serovar lai str. 56601
agugaguuuucuuc

SEQ ID NO: 2777493 - RNA, 16 nt, Leptospira interrogans serovar lai str. 56601
agugauucgaaauuuu

SEQ ID NO: 2777494 - RNA, 22 nt, Leptospira interrogans serovar lai str. 56601
agugauuucaugcaaaaauuua

SEQ ID NO: 2777495 - RNA, 22 nt, Leptospira interrogans serovar lai str. 56601
agugcaacgcguuuuaguuuua

SEQ ID NO: 2777496 - RNA, 13 nt, Leptospira interrogans serovar lai str. 56601
agugccaaaauuu

SEQ ID NO: 2777497 - RNA, 14 nt, Leptospira interrogans serovar lai str. 56601
agugccauuuuucu

SEQ ID NO: 2777498 - RNA, 15 nt, Leptospira interrogans serovar lai str. 56601
agugccgcaccuuuu

SEQ ID NO: 2777499 - RNA, 18 nt, Leptospira interrogans serovar lai str. 56601
aguggaguggagauuuug

SEQ ID NO: 2777500 - RNA, 22 nt, Leptospira interrogans serovar lai str. 56601
aguggauugccauccacaaagg

SEQ ID NO: 2777501 - RNA, 22 nt, Leptospira interrogans serovar lai str. 56601
agugggaaggaauuuccuaaaa

SEQ ID NO: 2777502 - RNA, 17 nt, Leptospira interrogans serovar lai str. 56601
agugguuuucaaauauu

SEQ ID NO: 2777503 - RNA, 19 nt, Leptospira interrogans serovar lai str. 56601
agugguuuucaaauauuuu

SEQ ID NO: 2777504 - RNA, 20 nt, Leptospira interrogans serovar lai str. 56601
agugguuuucaaauauuuua

SEQ ID NO: 2777505 - RNA, 15 nt, Leptospira interrogans serovar lai str. 56601
aguguaaaauuaaaa

SEQ ID NO: 2777506 - RNA, 14 nt, Leptospira interrogans serovar lai str. 56601
aguguuaguuccca

SEQ ID NO: 2777507 - RNA, 20 nt, Leptospira interrogans serovar lai str. 56601
aguguuguguugaguuucaa

SEQ ID NO: 2777508 - RNA, 13 nt, Leptospira interrogans serovar lai str. 56601
aguguuugcugag

SEQ ID NO: 2777509 - RNA, 18 nt, Leptospira interrogans serovar lai str. 56601
aguguuuugugauaaaau

SEQ ID NO: 2777510 - RNA, 20 nt, Leptospira interrogans serovar lai str. 56601
aguuaaaaaaugaauuuuuc

SEQ ID NO: 2777511 - RNA, 21 nt, Leptospira interrogans serovar lai str. 56601
aguuaaaaaaugaauuuuuca

SEQ ID NO: 2777512 - RNA, 16 nt, Leptospira interrogans serovar lai str. 56601
aguuaaauauaaaaga

SEQ ID NO: 2777513 - RNA, 22 nt, Leptospira interrogans serovar lai str. 56601
aguuaagagaauuucuauaaaa

SEQ ID NO: 2777514 - RNA, 22 nt, Leptospira interrogans serovar lai str. 56601
aguuaagagaugugaguuuuaa

SEQ ID NO: 2777515 - RNA, 23 nt, Leptospira interrogans serovar lai str. 56601
aguuaagcugaaaauuuucccua

SEQ ID NO: 2777516 - RNA, 13 nt, Leptospira interrogans serovar lai str. 56601
aguuaagugaaaa

SEQ ID NO: 2777517 - RNA, 18 nt, Leptospira interrogans serovar lai str. 56601
aguuaauagaguuguuga

SEQ ID NO: 2777518 - RNA, 15 nt, Leptospira interrogans serovar lai str. 56601
aguuaauaggauuuu

SEQ ID NO: 2777519 - RNA, 19 nt, Leptospira interrogans serovar lai str. 56601
aguuaccuagaggagccau

SEQ ID NO: 2777520 - RNA, 15 nt, Leptospira interrogans serovar lai str. 56601
aguuacucauuucca

SEQ ID NO: 2777521 - RNA, 17 nt, Leptospira interrogans serovar lai str. 56601
aguuacucauuuccauc

SEQ ID NO: 2777522 - RNA, 16 nt, Leptospira interrogans serovar lai str. 56601
aguuacuuauuuuuga

SEQ ID NO: 2777523 - RNA, 13 nt, Leptospira interrogans serovar lai str. 56601
aguuagaauauac

SEQ ID NO: 2777524 - RNA, 20 nt, Leptospira interrogans serovar lai str. 56601
aguuaguuuuucaacaacuc

SEQ ID NO: 2777525 - RNA, 14 nt, Leptospira interrogans serovar lai str. 56601
aguuauauaauaaa

SEQ ID NO: 2777526 - RNA, 20 nt, Leptospira interrogans serovar lai str. 56601
aguuaugaauaaaaaauuuc

SEQ ID NO: 2777527 - RNA, 21 nt, Leptospira interrogans serovar lai str. 56601
aguuaugaauaaaaaauuucu

SEQ ID NO: 2777528 - RNA, 22 nt, Leptospira interrogans serovar lai str. 56601
aguuaugaauaaaaaauuucuu

SEQ ID NO: 2777529 - RNA, 19 nt, Leptospira interrogans serovar lai str. 56601
aguuauuaauuauauucuu

SEQ ID NO: 2777530 - RNA, 22 nt, Leptospira interrogans serovar lai str. 56601
aguuauuauuuuuguuaaacaa

SEQ ID NO: 2777531 - RNA, 15 nt, Leptospira interrogans serovar lai str. 56601
aguuauucuaugaaa

SEQ ID NO: 2777532 - RNA, 18 nt, Leptospira interrogans serovar lai str. 56601
aguuauugaauagaauuu

SEQ ID NO: 2777533 - RNA, 20 nt, Leptospira interrogans serovar lai str. 56601
aguuauuucgaagcccauaa

SEQ ID NO: 2777534 - RNA, 16 nt, Leptospira interrogans serovar lai str. 56601
aguuauuucuuucaaa

SEQ ID NO: 2777535 - RNA, 13 nt, Leptospira interrogans serovar lai str. 56601
aguucaaaaaaag

SEQ ID NO: 2777536 - RNA, 15 nt, Leptospira interrogans serovar lai str. 56601
aguucaauguaagaa

SEQ ID NO: 2777537 - RNA, 17 nt, Leptospira interrogans serovar lai str. 56601
aguucaauuaacaaaac

SEQ ID NO: 2777538 - RNA, 13 nt, Leptospira interrogans serovar lai str. 56601
aguucaauuuuug

SEQ ID NO: 2777539 - RNA, 22 nt, Leptospira interrogans serovar lai str. 56601
aguucacaaauugcaaaauacg

SEQ ID NO: 2777540 - RNA, 20 nt, Leptospira interrogans serovar lai str. 56601
aguucacuucuugaaaggug

SEQ ID NO: 2777541 - RNA, 21 nt, Leptospira interrogans serovar lai str. 56601
aguucagacaugauucauuuu

SEQ ID NO: 2777542 - RNA, 13 nt, Leptospira interrogans serovar lai str. 56601
aguuuauuuuucu

SEQ ID NO: 2777543 - RNA, 20 nt, Leptospira interrogans serovar lai str. 56601
aguuuauuuuucuuuuaaaa

SEQ ID NO: 2777544 - RNA, 21 nt, Leptospira interrogans serovar lai str. 56601
aguuucaaacgcgaucuaucg

SEQ ID NO: 2777545 - RNA, 22 nt, Leptospira interrogans serovar lai str. 56601
aguuucaaacgcgaucuaucga

SEQ ID NO: 2777546 - RNA, 15 nt, Leptospira interrogans serovar lai str. 56601
aguuucaaacgcuuu

SEQ ID NO: 2777547 - RNA, 18 nt, Leptospira interrogans serovar lai str. 56601
aguuucaauuuaaaacga

SEQ ID NO: 2777548 - RNA, 12 nt, Leptospira interrogans serovar lai str. 56601
aguuucacaaaa

SEQ ID NO: 2777549 - RNA, 18 nt, Leptospira interrogans serovar lai str. 56601
aguuucacagaaacccuc

SEQ ID NO: 2777550 - RNA, 22 nt, Leptospira interrogans serovar lai str. 56601
aguuuccaaaaaagacuuaaaa

SEQ ID NO: 2777551 - RNA, 14 nt, Leptospira interrogans serovar lai str. 56601
aguuuccacagauu

SEQ ID NO: 2777552 - RNA, 21 nt, Leptospira interrogans serovar lai str. 56601
aguuuccccaagacuuugaaa

SEQ ID NO: 2777553 - RNA, 12 nt, Leptospira interrogans serovar lai str. 56601
aguuucuaaaaa

SEQ ID NO: 2777554 - RNA, 19 nt, Leptospira interrogans serovar lai str. 56601
aguuucuacauuuuuguga

SEQ ID NO: 2777555 - RNA, 21 nt, Leptospira interrogans serovar lai str. 56601
aguuucuacauuuuugugaaa

SEQ ID NO: 2777556 - RNA, 17 nt, Leptospira interrogans serovar lai str. 56601
aguuucuccacuuaaaa

SEQ ID NO: 2777557 - RNA, 22 nt, Leptospira interrogans serovar lai str. 56601
aguuucuccggcgaccuuucua

SEQ ID NO: 2777558 - RNA, 21 nt, Leptospira interrogans serovar lai str. 56601
aguuucuuauauaaaaguaau

SEQ ID NO: 2777559 - RNA, 17 nt, Leptospira interrogans serovar lai str. 56601
aguuucuucuuuuagag

SEQ ID NO: 2777560 - RNA, 17 nt, Leptospira interrogans serovar lai str. 56601
aguuucuugaacucaau

SEQ ID NO: 2777561 - RNA, 19 nt, Leptospira interrogans serovar lai str. 56601
aguuugaaagucuaacagu

SEQ ID NO: 2777562 - RNA, 22 nt, Leptospira interrogans serovar lai str. 56601
aguuugaucuuuuugauaaaau

SEQ ID NO: 2777563 - RNA, 14 nt, Leptospira interrogans serovar lai str. 56601
aguuuguagauaaa

SEQ ID NO: 2777564 - RNA, 15 nt, Leptospira interrogans serovar lai str. 56601
aguuuguagauaaag

SEQ ID NO: 2777565 - RNA, 19 nt, Leptospira interrogans serovar lai str. 56601
aguuugucuguaaaaugau

SEQ ID NO: 2777566 - RNA, 19 nt, Leptospira interrogans serovar lai str. 56601
aguuuguuagagugccgca

SEQ ID NO: 2777567 - RNA, 16 nt, Leptospira interrogans serovar lai str. 56601
aguuuguuccaaaaac

SEQ ID NO: 2777568 - RNA, 22 nt, Leptospira interrogans serovar lai str. 56601
aguuuguuccaaaaccucaaaa

SEQ ID NO: 2777569 - RNA, 15 nt, Leptospira interrogans serovar lai str. 56601
aguuuguucuaaaaa

SEQ ID NO: 2777570 - RNA, 19 nt, Leptospira interrogans serovar lai str. 56601
aguuuguuuguaaagcaac

SEQ ID NO: 2777571 - RNA, 16 nt, Leptospira interrogans serovar lai str. 56601
aguuuguuuuuuauau

SEQ ID NO: 2777572 - RNA, 17 nt, Leptospira interrogans serovar lai str. 56601
aguuuuacaaagaguuu

SEQ ID NO: 2777573 - RNA, 20 nt, Leptospira interrogans serovar lai str. 56601
aguuuuacaaagaguuuaaa

SEQ ID NO: 2777574 - RNA, 16 nt, Leptospira interrogans serovar lai str. 56601
aguuuuacaaauuagu

SEQ ID NO: 2777575 - RNA, 16 nt, Leptospira interrogans serovar lai str. 56601
aguuuuacagaagauu

SEQ ID NO: 2777576 - RNA, 21 nt, Leptospira interrogans serovar lai str. 56601
aguuuuacagaagauuuuguc

SEQ ID NO: 2777577 - RNA, 16 nt, Leptospira interrogans serovar lai str. 56601
aguuuuacuguaaaau

SEQ ID NO: 2777578 - RNA, 18 nt, Leptospira interrogans serovar lai str. 56601
aguuuuacuguaaaauuu

SEQ ID NO: 2777579 - RNA, 21 nt, Leptospira interrogans serovar lai str. 56601
aguuuuauauguauuuauuca

SEQ ID NO: 2777580 - RNA, 14 nt, Leptospira interrogans serovar lai str. 56601
aguuuucaaaaaau

SEQ ID NO: 2777581 - RNA, 15 nt, Leptospira interrogans serovar lai str. 56601
aguuuucaaaaaaug

SEQ ID NO: 2777582 - RNA, 20 nt, Leptospira interrogans serovar lai str. 56601
aguuuucaaucgaagaaaua

SEQ ID NO: 2777583 - RNA, 15 nt, Leptospira interrogans serovar lai str. 56601
aguuuucauuacaaa

SEQ ID NO: 2777584 - RNA, 12 nt, Leptospira interrogans serovar lai str. 56601
aguuuuccauuc

SEQ ID NO: 2777585 - RNA, 23 nt, Leptospira interrogans serovar lai str. 56601
aguuuuccgguucgaaucauuac

SEQ ID NO: 2777586 - RNA, 17 nt, Leptospira interrogans serovar lai str. 56601
aguuuuccuucuagaua

SEQ ID NO: 2777587 - RNA, 21 nt, Leptospira interrogans serovar lai str. 56601
aguuuucguuaucuaggguuu

SEQ ID NO: 2777588 - RNA, 21 nt, Leptospira interrogans serovar lai str. 56601
aguuuucucgaacuacccaaa

SEQ ID NO: 2777589 - RNA, 16 nt, Leptospira interrogans serovar lai str. 56601
aguuuucuuuuuuucu

SEQ ID NO: 2777590 - RNA, 17 nt, Leptospira interrogans serovar lai str. 56601
aguuuugagauuacaaa

SEQ ID NO: 2777591 - RNA, 18 nt, Leptospira interrogans serovar lai str. 56601
aguuuugagcauaaaaaa

SEQ ID NO: 2777592 - RNA, 18 nt, Leptospira interrogans serovar lai str. 56601
aguuuugauguuuuucgu

SEQ ID NO: 2777593 - RNA, 18 nt, Leptospira interrogans serovar lai str. 56601
aguuuugcgggaacuccc

SEQ ID NO: 2777594 - RNA, 22 nt, Leptospira interrogans serovar lai str. 56601
aguuuugcuguaaaauuuagau

SEQ ID NO: 2777595 - RNA, 22 nt, Leptospira interrogans serovar lai str. 56601
aguuuuguaccguaaagaagag

SEQ ID NO: 2777596 - RNA, 14 nt, Leptospira interrogans serovar lai str. 56601
aguuuuuagugauu

SEQ ID NO: 2777597 - RNA, 22 nt, Leptospira interrogans serovar lai str. 56601
aguuuuuauaaaaucuaaaaag

SEQ ID NO: 2777598 - RNA, 18 nt, Leptospira interrogans serovar lai str. 56601
aguuuuuauauucuagaa

SEQ ID NO: 2777599 - RNA, 23 nt, Leptospira interrogans serovar lai str. 56601
aguuuuucgguaaaaucauucuu

SEQ ID NO: 2777600 - RNA, 13 nt, Leptospira interrogans serovar lai str. 56601
aguuuuucuaaau

SEQ ID NO: 2777601 - RNA, 16 nt, Leptospira interrogans serovar lai str. 56601
aguuuuucuuaaaaag

SEQ ID NO: 2777602 - RNA, 16 nt, Leptospira interrogans serovar lai str. 56601
aguuuuucuuuuuaag

SEQ ID NO: 2777603 - RNA, 18 nt, Leptospira interrogans serovar lai str. 56601
aguuuuugaaaaaugaau

SEQ ID NO: 2777604 - RNA, 17 nt, Leptospira interrogans serovar lai str. 56601
aguuuuugugacuuccu

SEQ ID NO: 2777605 - RNA, 14 nt, Leptospira interrogans serovar lai str. 56601
aguuuuuguuugaa

SEQ ID NO: 2777606 - RNA, 12 nt, Leptospira interrogans serovar lai str. 56601
aguuuuuuaaaa

SEQ ID NO: 2777607 - RNA, 17 nt, Leptospira interrogans serovar lai str. 56601
aguuuuuuaaaacgaac

SEQ ID NO: 2777608 - RNA, 13 nt, Leptospira interrogans serovar lai str. 56601
aguuuuuuagcca

SEQ ID NO: 2777609 - RNA, 20 nt, Leptospira interrogans serovar lai str. 56601
aguuuuuucaaaaauuccaa

SEQ ID NO: 2777610 - RNA, 18 nt, Leptospira interrogans serovar lai str. 56601
aguuuuuugagaaacaac

SEQ ID NO: 2777611 - RNA, 14 nt, Leptospira interrogans serovar lai str. 56601
aguuuuuuuauaaa

SEQ ID NO: 2777612 - RNA, 16 nt, Leptospira interrogans serovar lai str. 56601
aguuuuuuuauaaaau

SEQ ID NO: 2777613 - RNA, 20 nt, Leptospira interrogans serovar lai str. 56601
aguuuuuuuauaaaauuaga

SEQ ID NO: 2777614 - RNA, 22 nt, Leptospira interrogans serovar lai str. 56601
auaaaaaaaucaagagccaagu

SEQ ID NO: 2777615 - RNA, 11 nt, Leptospira interrogans serovar lai str. 56601
auaaaaaaauu

SEQ ID NO: 2777616 - RNA, 15 nt, Leptospira interrogans serovar lai str. 56601
auaaaaaaauuaaaa

SEQ ID NO: 2777617 - RNA, 13 nt, Leptospira interrogans serovar lai str. 56601
auaaaaaacucaa

SEQ ID NO: 2777618 - RNA, 14 nt, Leptospira interrogans serovar lai str. 56601
auaaaaaacucaau

SEQ ID NO: 2777619 - RNA, 15 nt, Leptospira interrogans serovar lai str. 56601
auaaaaaagaaagca

SEQ ID NO: 2777620 - RNA, 12 nt, Leptospira interrogans serovar lai str. 56601
auaaaaaaggaa

SEQ ID NO: 2777621 - RNA, 14 nt, Leptospira interrogans serovar lai str. 56601
auaaaaaauguauu

SEQ ID NO: 2777622 - RNA, 12 nt, Leptospira interrogans serovar lai str. 56601
auaaaaaauuuu

SEQ ID NO: 2777623 - RNA, 13 nt, Leptospira interrogans serovar lai str. 56601
auaaaaacaaaau

SEQ ID NO: 2777624 - RNA, 12 nt, Leptospira interrogans serovar lai str. 56601
auaaaaacaucu

SEQ ID NO: 2777625 - RNA, 20 nt, Leptospira interrogans serovar lai str. 56601
auaaacuucucuuaaaauuu

SEQ ID NO: 2777626 - RNA, 18 nt, Leptospira interrogans serovar lai str. 56601
auaaacuuucaaagaaua

SEQ ID NO: 2777627 - RNA, 13 nt, Leptospira interrogans serovar lai str. 56601
auaaagaaaacca

SEQ ID NO: 2777628 - RNA, 14 nt, Leptospira interrogans serovar lai str. 56601
auaaagaaaaccac

SEQ ID NO: 2777629 - RNA, 11 nt, Leptospira interrogans serovar lai str. 56601
auaaagaaaag

SEQ ID NO: 2777630 - RNA, 20 nt, Leptospira interrogans serovar lai str. 56601
auaaagaaacuguuuaauaa

SEQ ID NO: 2777631 - RNA, 15 nt, Leptospira interrogans serovar lai str. 56601
auaaagaauuuuaaa

SEQ ID NO: 2777632 - RNA, 19 nt, Leptospira interrogans serovar lai str. 56601
auaaagauucacuuagaaa

SEQ ID NO: 2777633 - RNA, 21 nt, Leptospira interrogans serovar lai str. 56601
auaaagauuuccuaauaacuu

SEQ ID NO: 2777634 - RNA, 22 nt, Leptospira interrogans serovar lai str. 56601
auaaagguuuuauagucuucaa

SEQ ID NO: 2777635 - RNA, 15 nt, Leptospira interrogans serovar lai str. 56601
auaaaguaaaauuaa

SEQ ID NO: 2777636 - RNA, 15 nt, Leptospira interrogans serovar lai str. 56601
auaaaguaccuauuu

SEQ ID NO: 2777637 - RNA, 18 nt, Leptospira interrogans serovar lai str. 56601
auaaaguacuaauucaau

SEQ ID NO: 2777638 - RNA, 16 nt, Leptospira interrogans serovar lai str. 56601
auaaaguauagaacag

SEQ ID NO: 2777639 - RNA, 19 nt, Leptospira interrogans serovar lai str. 56601
auaaaguauuuuuaagaua

SEQ ID NO: 2777640 - RNA, 16 nt, Leptospira interrogans serovar lai str. 56601
auaaagucguuuuuaa

SEQ ID NO: 2777641 - RNA, 20 nt, Leptospira interrogans serovar lai str. 56601
auaaagucuauuucccaaaa

SEQ ID NO: 2777642 - RNA, 18 nt, Leptospira interrogans serovar lai str. 56601
auaaaguuaauacaaaaa

SEQ ID NO: 2777643 - RNA, 15 nt, Leptospira interrogans serovar lai str. 56601
auaaauaaauuuaaa

SEQ ID NO: 2777644 - RNA, 15 nt, Leptospira interrogans serovar lai str. 56601
auaaauaaugaaaac

SEQ ID NO: 2777645 - RNA, 14 nt, Leptospira interrogans serovar lai str. 56601
auaaauacaaaaau

SEQ ID NO: 2777646 - RNA, 17 nt, Leptospira interrogans serovar lai str. 56601
auaaauacauacaauga

SEQ ID NO: 2777647 - RNA, 19 nt, Leptospira interrogans serovar lai str. 56601
auaaauagggaauauucca

SEQ ID NO: 2777648 - RNA, 22 nt, Leptospira interrogans serovar lai str. 56601
auaaauagggaauauuccauuu

SEQ ID NO: 2777649 - RNA, 22 nt, Leptospira interrogans serovar lai str. 56601
auaaauagggcucgguaaaaag

SEQ ID NO: 2777650 - RNA, 22 nt, Leptospira interrogans serovar lai str. 56601
auaaauaguauauuuucugcuu

SEQ ID NO: 2777651 - RNA, 18 nt, Leptospira interrogans serovar lai str. 56601
auaaauauuaauuuaaaa

SEQ ID NO: 2777652 - RNA, 12 nt, Leptospira interrogans serovar lai str. 56601
auaaauauuucc

SEQ ID NO: 2777653 - RNA, 20 nt, Leptospira interrogans serovar lai str. 56601
auaaauauuuccaaauugua

SEQ ID NO: 2777654 - RNA, 11 nt, Leptospira interrogans serovar lai str. 56601
auaaaucaauc

SEQ ID NO: 2777655 - RNA, 14 nt, Leptospira interrogans serovar lai str. 56601
auaaaucaaucuac

SEQ ID NO: 2777656 - RNA, 20 nt, Leptospira interrogans serovar lai str. 56601
auaaaucaugaucaaauuca

SEQ ID NO: 2777657 - RNA, 17 nt, Leptospira interrogans serovar lai str. 56601
auaaaucgaagagaaga

SEQ ID NO: 2777658 - RNA, 17 nt, Leptospira interrogans serovar lai str. 56601
auaaaucgauuacaauu

SEQ ID NO: 2777659 - RNA, 16 nt, Leptospira interrogans serovar lai str. 56601
auaaaucgcaaauaca

SEQ ID NO: 2777660 - RNA, 20 nt, Leptospira interrogans serovar lai str. 56601
auaaaucuguacuuaaauuu

SEQ ID NO: 2777661 - RNA, 14 nt, Leptospira interrogans serovar lai str. 56601
auaaaugauaauaa

SEQ ID NO: 2777662 - RNA, 17 nt, Leptospira interrogans serovar lai str. 56601
auaaaugauaauaauua

SEQ ID NO: 2777663 - RNA, 19 nt, Leptospira interrogans serovar lai str. 56601
auaaaugauacuuuguaaa

SEQ ID NO: 2777664 - RNA, 20 nt, Leptospira interrogans serovar lai str. 56601
auaaaugauacuuuguaaaa

SEQ ID NO: 2777665 - RNA, 17 nt, Leptospira interrogans serovar lai str. 56601
auaaauguaggaacuac

SEQ ID NO: 2777666 - RNA, 14 nt, Leptospira interrogans serovar lai str. 56601
auaaaugugggaac

SEQ ID NO: 2777667 - RNA, 23 nt, Leptospira interrogans serovar lai str. 56601
auaaauuacugauuucaaaaaua

SEQ ID NO: 2777668 - RNA, 15 nt, Leptospira interrogans serovar lai str. 56601
auaaauuaguaauuu

SEQ ID NO: 2777669 - RNA, 15 nt, Leptospira interrogans serovar lai str. 56601
auaaauuauacaauu

SEQ ID NO: 2777670 - RNA, 18 nt, Leptospira interrogans serovar lai str. 56601
auaaauuauacaauuuaa

SEQ ID NO: 2777671 - RNA, 19 nt, Leptospira interrogans serovar lai str. 56601
auaaauuauacaauuuaau

SEQ ID NO: 2777672 - RNA, 22 nt, Leptospira interrogans serovar lai str. 56601
auaaauuauacaauuuaauagu

SEQ ID NO: 2777673 - RNA, 23 nt, Leptospira interrogans serovar lai str. 56601
auaaauuauaguuuuauuagaac

SEQ ID NO: 2777674 - RNA, 11 nt, Leptospira interrogans serovar lai str. 56601
auaaauuauuu

SEQ ID NO: 2777675 - RNA, 14 nt, Leptospira interrogans serovar lai str. 56601
auaaauuauuuuuu

SEQ ID NO: 2777676 - RNA, 15 nt, Leptospira interrogans serovar lai str. 56601
auaaauuccccaaaa

SEQ ID NO: 2777677 - RNA, 16 nt, Leptospira interrogans serovar lai str. 56601
auaaauuccccaaaau

SEQ ID NO: 2777678 - RNA, 19 nt, Leptospira interrogans serovar lai str. 56601
auaaauucgcaaaaaaaau

SEQ ID NO: 2777679 - RNA, 19 nt, Leptospira interrogans serovar lai str. 56601
auaaauucgccguaaaaaa

SEQ ID NO: 2777680 - RNA, 12 nt, Leptospira interrogans serovar lai str. 56601
auaaauucuaca

SEQ ID NO: 2777681 - RNA, 14 nt, Leptospira interrogans serovar lai str. 56601
auaaauucuuacua

SEQ ID NO: 2777682 - RNA, 15 nt, Leptospira interrogans serovar lai str. 56601
auaaauucuuacuaa

SEQ ID NO: 2777683 - RNA, 22 nt, Leptospira interrogans serovar lai str. 56601
auaaauugugguaguuccuaca

SEQ ID NO: 2777684 - RNA, 22 nt, Leptospira interrogans serovar lai str. 56601
auaaauuguuucauaaaauucu

SEQ ID NO: 2777685 - RNA, 13 nt, Leptospira interrogans serovar lai str. 56601
auaaauuuaaaaa

SEQ ID NO: 2777686 - RNA, 14 nt, Leptospira interrogans serovar lai str. 56601
auaaauuuaaaugu

SEQ ID NO: 2777687 - RNA, 20 nt, Leptospira interrogans serovar lai str. 56601
auaaauuuaguaguaaauaa

SEQ ID NO: 2777688 - RNA, 13 nt, Leptospira interrogans serovar lai str. 56601
auaaauuuauaau

SEQ ID NO: 2777689 - RNA, 20 nt, Leptospira interrogans serovar lai str. 56601
auaaauuucauaucuaaaau

SEQ ID NO: 2777690 - RNA, 23 nt, Leptospira interrogans serovar lai str. 56601
auaaauuuuaaccgcaaaaucau

SEQ ID NO: 2777691 - RNA, 13 nt, Leptospira interrogans serovar lai str. 56601
auaaauuuugaaa

SEQ ID NO: 2777692 - RNA, 16 nt, Leptospira interrogans serovar lai str. 56601
auaaauuuugaaacaa

SEQ ID NO: 2777693 - RNA, 17 nt, Leptospira interrogans serovar lai str. 56601
auaaauuuugaaacaaa

SEQ ID NO: 2777694 - RNA, 14 nt, Leptospira interrogans serovar lai str. 56601
auaaauuuuuauua

SEQ ID NO: 2777695 - RNA, 18 nt, Leptospira interrogans serovar lai str. 56601
auaaauuuuucuggaaaa

SEQ ID NO: 2777696 - RNA, 14 nt, Leptospira interrogans serovar lai str. 56601
auaacaaaaauacu

SEQ ID NO: 2777697 - RNA, 14 nt, Leptospira interrogans serovar lai str. 56601
auaacaaacuuuua

SEQ ID NO: 2777698 - RNA, 23 nt, Leptospira interrogans serovar lai str. 56601
auaacaaauaaaaggaguaauuc

SEQ ID NO: 2777699 - RNA, 20 nt, Leptospira interrogans serovar lai str. 56601
auaacacgauacucaauauu

SEQ ID NO: 2777700 - RNA, 15 nt, Leptospira interrogans serovar lai str. 56601
auaacauuuuuucau

SEQ ID NO: 2777701 - RNA, 18 nt, Leptospira interrogans serovar lai str. 56601
auaaccaaccccacaagu

SEQ ID NO: 2777702 - RNA, 20 nt, Leptospira interrogans serovar lai str. 56601
auaaccaaccccacaaguau

SEQ ID NO: 2777703 - RNA, 23 nt, Leptospira interrogans serovar lai str. 56601
auaaccaaccccacaaguauuug

SEQ ID NO: 2777704 - RNA, 22 nt, Leptospira interrogans serovar lai str. 56601
auaaccccuaagcguucuaagu

SEQ ID NO: 2777705 - RNA, 14 nt, Leptospira interrogans serovar lai str. 56601
auaaccuaaaauuu

SEQ ID NO: 2777706 - RNA, 16 nt, Leptospira interrogans serovar lai str. 56601
auaaccucaacauaaa

SEQ ID NO: 2777707 - RNA, 22 nt, Leptospira interrogans serovar lai str. 56601
auaaccuuacccacaaauaauu

SEQ ID NO: 2777708 - RNA, 22 nt, Leptospira interrogans serovar lai str. 56601
auaauuagcucuuguuaaaaua

SEQ ID NO: 2777709 - RNA, 23 nt, Leptospira interrogans serovar lai str. 56601
auaauucaaagaugguggaauaa

SEQ ID NO: 2777710 - RNA, 18 nt, Leptospira interrogans serovar lai str. 56601
auaauucaagacuuuaua

SEQ ID NO: 2777711 - RNA, 13 nt, Leptospira interrogans serovar lai str. 56601
auaauuccuccau

SEQ ID NO: 2777712 - RNA, 15 nt, Leptospira interrogans serovar lai str. 56601
auaauuccuccauga

SEQ ID NO: 2777713 - RNA, 17 nt, Leptospira interrogans serovar lai str. 56601
auaauucguuuuuuaaa

SEQ ID NO: 2777714 - RNA, 18 nt, Leptospira interrogans serovar lai str. 56601
auaauucguuuuuuaaaa

SEQ ID NO: 2777715 - RNA, 21 nt, Leptospira interrogans serovar lai str. 56601
auaauucguuuuuuaaaaugu

SEQ ID NO: 2777716 - RNA, 16 nt, Leptospira interrogans serovar lai str. 56601
auaauucugaauaauu

SEQ ID NO: 2777717 - RNA, 23 nt, Leptospira interrogans serovar lai str. 56601
auaauucuguaaaaauagaacua

SEQ ID NO: 2777718 - RNA, 19 nt, Leptospira interrogans serovar lai str. 56601
auaauucuguaaaauaaau

SEQ ID NO: 2777719 - RNA, 18 nt, Leptospira interrogans serovar lai str. 56601
auaauucuuuaaaauuuu

SEQ ID NO: 2777720 - RNA, 21 nt, Leptospira interrogans serovar lai str. 56601
auaauucuuuaaaauuuuuaa

SEQ ID NO: 2777721 - RNA, 14 nt, Leptospira interrogans serovar lai str. 56601
auaauucuuuagaa

SEQ ID NO: 2777722 - RNA, 17 nt, Leptospira interrogans serovar lai str. 56601
auaauucuuuagaaauu

SEQ ID NO: 2777723 - RNA, 19 nt, Leptospira interrogans serovar lai str. 56601
auaauucuuuagaaauuuu

SEQ ID NO: 2777724 - RNA, 14 nt, Leptospira interrogans serovar lai str. 56601
auaauugaacauuu

SEQ ID NO: 2777725 - RNA, 16 nt, Leptospira interrogans serovar lai str. 56601
auaauugaacauuuuu

SEQ ID NO: 2777726 - RNA, 18 nt, Leptospira interrogans serovar lai str. 56601
auaauugaacauuuuuaa

SEQ ID NO: 2777727 - RNA, 16 nt, Leptospira interrogans serovar lai str. 56601
auaauuuaaacuuacu

SEQ ID NO: 2777728 - RNA, 21 nt, Leptospira interrogans serovar lai str. 56601
auaauuuagaguuguuaaaaa

SEQ ID NO: 2777729 - RNA, 16 nt, Leptospira interrogans serovar lai str. 56601
auaauuucccauaaaa

SEQ ID NO: 2777730 - RNA, 15 nt, Leptospira interrogans serovar lai str. 56601
auaauuucuuuuuau

SEQ ID NO: 2777731 - RNA, 14 nt, Leptospira interrogans serovar lai str. 56601
auaauuuuaaauaa

SEQ ID NO: 2777732 - RNA, 16 nt, Leptospira interrogans serovar lai str. 56601
auaauuuuaaauaaua

SEQ ID NO: 2777733 - RNA, 18 nt, Leptospira interrogans serovar lai str. 56601
auaauuuuaauauuucga

SEQ ID NO: 2777734 - RNA, 12 nt, Leptospira interrogans serovar lai str. 56601
auaauuuuagaa

SEQ ID NO: 2777735 - RNA, 21 nt, Leptospira interrogans serovar lai str. 56601
auaauuuucuuaauaaacuuu

SEQ ID NO: 2777736 - RNA, 21 nt, Leptospira interrogans serovar lai str. 56601
auaauuuucuuuagaaauuuu

SEQ ID NO: 2777737 - RNA, 22 nt, Leptospira interrogans serovar lai str. 56601
auaauuuuuacucaaagaaucg

SEQ ID NO: 2777738 - RNA, 16 nt, Leptospira interrogans serovar lai str. 56601
auaauuuuuguuugua

SEQ ID NO: 2777739 - RNA, 19 nt, Leptospira interrogans serovar lai str. 56601
auaauuuuuguuuguaaaa

SEQ ID NO: 2777740 - RNA, 18 nt, Leptospira interrogans serovar lai str. 56601
auaauuuuuuaaaaaaau

SEQ ID NO: 2777741 - RNA, 19 nt, Leptospira interrogans serovar lai str. 56601
auaauuuuuuaaaaaaauu

SEQ ID NO: 2777742 - RNA, 22 nt, Leptospira interrogans serovar lai str. 56601
auaauuuuuuaaaaaaauuacu

SEQ ID NO: 2777743 - RNA, 13 nt, Leptospira interrogans serovar lai str. 56601
auacaaaaagaau

SEQ ID NO: 2777744 - RNA, 18 nt, Leptospira interrogans serovar lai str. 56601
auacaaaacucuuuaaaa

SEQ ID NO: 2777745 - RNA, 23 nt, Leptospira interrogans serovar lai str. 56601
auacaaaacuuaaauucggaaau

SEQ ID NO: 2777746 - RNA, 16 nt, Leptospira interrogans serovar lai str. 56601
auacaaaaugaaugau

SEQ ID NO: 2777747 - RNA, 11 nt, Leptospira interrogans serovar lai str. 56601
auacaaaauuu

SEQ ID NO: 2777748 - RNA, 17 nt, Leptospira interrogans serovar lai str. 56601
auacaaaauuuuuuccu

SEQ ID NO: 2777749 - RNA, 19 nt, Leptospira interrogans serovar lai str. 56601
auacaaaguaaguucaaau

SEQ ID NO: 2777750 - RNA, 14 nt, Leptospira interrogans serovar lai str. 56601
auacaaaguuugua

SEQ ID NO: 2777751 - RNA, 20 nt, Leptospira interrogans serovar lai str. 56601
auacaaaguuuguaguaacu

SEQ ID NO: 2777752 - RNA, 21 nt, Leptospira interrogans serovar lai str. 56601
auacaacuuucagauuaaaac

SEQ ID NO: 2777753 - RNA, 15 nt, Leptospira interrogans serovar lai str. 56601
auacaacuuuuuuaa

SEQ ID NO: 2777754 - RNA, 19 nt, Leptospira interrogans serovar lai str. 56601
auacaaucaaauuuuugca

SEQ ID NO: 2777755 - RNA, 19 nt, Leptospira interrogans serovar lai str. 56601
auacaaugaaaaagcauau

SEQ ID NO: 2777756 - RNA, 17 nt, Leptospira interrogans serovar lai str. 56601
auacaauugauuuaaaa

SEQ ID NO: 2777757 - RNA, 14 nt, Leptospira interrogans serovar lai str. 56601
auacaauuugaucu

SEQ ID NO: 2777758 - RNA, 18 nt, Leptospira interrogans serovar lai str. 56601
auacaauuugaucuaugu

SEQ ID NO: 2777759 - RNA, 11 nt, Leptospira interrogans serovar lai str. 56601
auacacucuuu

SEQ ID NO: 2777760 - RNA, 13 nt, Leptospira interrogans serovar lai str. 56601
auacagaauucau

SEQ ID NO: 2777761 - RNA, 19 nt, Leptospira interrogans serovar lai str. 56601
auacaguacuauauuuuug

SEQ ID NO: 2777762 - RNA, 16 nt, Leptospira interrogans serovar lai str. 56601
auacauaaaaaaauaa

SEQ ID NO: 2777763 - RNA, 21 nt, Leptospira interrogans serovar lai str. 56601
auacaucgcuuccugaaugca

SEQ ID NO: 2777764 - RNA, 18 nt, Leptospira interrogans serovar lai str. 56601
auacaucucuuuuuuaaa

SEQ ID NO: 2777765 - RNA, 16 nt, Leptospira interrogans serovar lai str. 56601
auacaugauuacucau

SEQ ID NO: 2777766 - RNA, 15 nt, Leptospira interrogans serovar lai str. 56601
auacauuaagauuau

SEQ ID NO: 2777767 - RNA, 15 nt, Leptospira interrogans serovar lai str. 56601
auacauucuuauaaa

SEQ ID NO: 2777768 - RNA, 18 nt, Leptospira interrogans serovar lai str. 56601
auacauuuaaacuuuuca

SEQ ID NO: 2777769 - RNA, 16 nt, Leptospira interrogans serovar lai str. 56601
auacauuuguaaauaa

SEQ ID NO: 2777770 - RNA, 12 nt, Leptospira interrogans serovar lai str. 56601
auacauuuugua

SEQ ID NO: 2777771 - RNA, 15 nt, Leptospira interrogans serovar lai str. 56601
auaccaaaaaaguac

SEQ ID NO: 2777772 - RNA, 16 nt, Leptospira interrogans serovar lai str. 56601
auaccaaauaaauauu

SEQ ID NO: 2777773 - RNA, 21 nt, Leptospira interrogans serovar lai str. 56601
auaccaaguucgauuaaaaua

SEQ ID NO: 2777774 - RNA, 23 nt, Leptospira interrogans serovar lai str. 56601
auaccaaguucgauuaaaauaaa

SEQ ID NO: 2777775 - RNA, 14 nt, Leptospira interrogans serovar lai str. 56601
auaccaguuaaauu

SEQ ID NO: 2777776 - RNA, 20 nt, Leptospira interrogans serovar lai str. 56601
auacccguuuauaccgaaac

SEQ ID NO: 2777777 - RNA, 14 nt, Leptospira interrogans serovar lai str. 56601
auaccgauuucuau

SEQ ID NO: 2777778 - RNA, 16 nt, Leptospira interrogans serovar lai str. 56601
auaccgauuucuauuu

SEQ ID NO: 2777779 - RNA, 21 nt, Leptospira interrogans serovar lai str. 56601
auaccgauuucuauuuuaaaa

SEQ ID NO: 2777780 - RNA, 16 nt, Leptospira interrogans serovar lai str. 56601
auaccgggccuuuuuu

SEQ ID NO: 2777781 - RNA, 12 nt, Leptospira interrogans serovar lai str. 56601
auaccuaaaaug

SEQ ID NO: 2777782 - RNA, 18 nt, Leptospira interrogans serovar lai str. 56601
auacgaguaaaaauucuu

SEQ ID NO: 2777783 - RNA, 16 nt, Leptospira interrogans serovar lai str. 56601
auacgauagauucaau

SEQ ID NO: 2777784 - RNA, 13 nt, Leptospira interrogans serovar lai str. 56601
auacgauauuuug

SEQ ID NO: 2777785 - RNA, 17 nt, Leptospira interrogans serovar lai str. 56601
auacgauucgaaagauu

SEQ ID NO: 2777786 - RNA, 23 nt, Leptospira interrogans serovar lai str. 56601
auacgcuucucuugcuugaacca

SEQ ID NO: 2777787 - RNA, 15 nt, Leptospira interrogans serovar lai str. 56601
auacggguaaaucgc

SEQ ID NO: 2777788 - RNA, 14 nt, Leptospira interrogans serovar lai str. 56601
auacguaaaaauaa

SEQ ID NO: 2777789 - RNA, 19 nt, Leptospira interrogans serovar lai str. 56601
auacgugucauuuccacau

SEQ ID NO: 2777790 - RNA, 14 nt, Leptospira interrogans serovar lai str. 56601
auacguuauuuccg

SEQ ID NO: 2777791 - RNA, 22 nt, Leptospira interrogans serovar lai str. 56601
auagcagauuuucucaaaaaaa

SEQ ID NO: 2777792 - RNA, 23 nt, Leptospira interrogans serovar lai str. 56601
auagcagauuuucucaaaaaaag

SEQ ID NO: 2777793 - RNA, 15 nt, Leptospira interrogans serovar lai str. 56601
auagccuaauuuacu

SEQ ID NO: 2777794 - RNA, 16 nt, Leptospira interrogans serovar lai str. 56601
auagcuucuuuaaaaa

SEQ ID NO: 2777795 - RNA, 17 nt, Leptospira interrogans serovar lai str. 56601
auagcuucuuuaaaaac

SEQ ID NO: 2777796 - RNA, 21 nt, Leptospira interrogans serovar lai str. 56601
auagcuucuuuaaaaacuuca

SEQ ID NO: 2777797 - RNA, 21 nt, Leptospira interrogans serovar lai str. 56601
auagcuuuugagcaguaaaaa

SEQ ID NO: 2777798 - RNA, 19 nt, Leptospira interrogans serovar lai str. 56601
auaggaaauucuuuuccaa

SEQ ID NO: 2777799 - RNA, 13 nt, Leptospira interrogans serovar lai str. 56601
auaggaguuccua

SEQ ID NO: 2777800 - RNA, 18 nt, Leptospira interrogans serovar lai str. 56601
auaggaucaguaguucuc

SEQ ID NO: 2777801 - RNA, 14 nt, Leptospira interrogans serovar lai str. 56601
auaggauuuaaauu

SEQ ID NO: 2777802 - RNA, 21 nt, Leptospira interrogans serovar lai str. 56601
auaggauuuuagaaucaaaau

SEQ ID NO: 2777803 - RNA, 15 nt, Leptospira interrogans serovar lai str. 56601
auagggaaaacucaa

SEQ ID NO: 2777804 - RNA, 16 nt, Leptospira interrogans serovar lai str. 56601
auagggaaaacucaac

SEQ ID NO: 2777805 - RNA, 13 nt, Leptospira interrogans serovar lai str. 56601
auagguucaaaaa

SEQ ID NO: 2777806 - RNA, 19 nt, Leptospira interrogans serovar lai str. 56601
auagguucuugcaaaaaua

SEQ ID NO: 2777807 - RNA, 17 nt, Leptospira interrogans serovar lai str. 56601
auagguuuuguaagaau

SEQ ID NO: 2777808 - RNA, 19 nt, Leptospira interrogans serovar lai str. 56601
auagguuuuguaagaauuc

SEQ ID NO: 2777809 - RNA, 15 nt, Leptospira interrogans serovar lai str. 56601
auaguaaaagaaaau

SEQ ID NO: 2777810 - RNA, 20 nt, Leptospira interrogans serovar lai str. 56601
auaguaaagauuagaaaaac

SEQ ID NO: 2777811 - RNA, 21 nt, Leptospira interrogans serovar lai str. 56601
auaguaaagauuagaaaaacu

SEQ ID NO: 2777812 - RNA, 22 nt, Leptospira interrogans serovar lai str. 56601
auaguaacagaaaaauguuaaa

SEQ ID NO: 2777813 - RNA, 23 nt, Leptospira interrogans serovar lai str. 56601
auaguaacagaaaaauguuaaaa

SEQ ID NO: 2777814 - RNA, 12 nt, Leptospira interrogans serovar lai str. 56601
auaguaguuccc

SEQ ID NO: 2777815 - RNA, 15 nt, Leptospira interrogans serovar lai str. 56601
auaguaguucccgca

SEQ ID NO: 2777816 - RNA, 21 nt, Leptospira interrogans serovar lai str. 56601
auaguauaauccuuuuacuuc

SEQ ID NO: 2777817 - RNA, 15 nt, Leptospira interrogans serovar lai str. 56601
auaguauauaauggc

SEQ ID NO: 2777818 - RNA, 16 nt, Leptospira interrogans serovar lai str. 56601
auaguauauuuucugc

SEQ ID NO: 2777819 - RNA, 13 nt, Leptospira interrogans serovar lai str. 56601
auaguauuuugug

SEQ ID NO: 2777820 - RNA, 21 nt, Leptospira interrogans serovar lai str. 56601
auagucaaaacucuguguuag

SEQ ID NO: 2777821 - RNA, 19 nt, Leptospira interrogans serovar lai str. 56601
auagucaaugguugcaaaa

SEQ ID NO: 2777822 - RNA, 22 nt, Leptospira interrogans serovar lai str. 56601
auagucaaugguugcaaaaaag

SEQ ID NO: 2777823 - RNA, 15 nt, Leptospira interrogans serovar lai str. 56601
auagucauuuugaua

SEQ ID NO: 2777824 - RNA, 15 nt, Leptospira interrogans serovar lai str. 56601
auagucuucaaaauu

SEQ ID NO: 2777825 - RNA, 18 nt, Leptospira interrogans serovar lai str. 56601
auagucuucaaaauugag

SEQ ID NO: 2777826 - RNA, 14 nt, Leptospira interrogans serovar lai str. 56601
auagugaucgcguu

SEQ ID NO: 2777827 - RNA, 17 nt, Leptospira interrogans serovar lai str. 56601
auaguuacgacauuuua

SEQ ID NO: 2777828 - RNA, 21 nt, Leptospira interrogans serovar lai str. 56601
auaguuacgacauuuuaauaa

SEQ ID NO: 2777829 - RNA, 16 nt, Leptospira interrogans serovar lai str. 56601
auaguuauauaauaaa

SEQ ID NO: 2777830 - RNA, 22 nt, Leptospira interrogans serovar lai str. 56601
auaguuaucaguaguuauauua

SEQ ID NO: 2777831 - RNA, 17 nt, Leptospira interrogans serovar lai str. 56601
auaguucaauuaacaaa

SEQ ID NO: 2777832 - RNA, 13 nt, Leptospira interrogans serovar lai str. 56601
auaguucccacaa

SEQ ID NO: 2777833 - RNA, 19 nt, Leptospira interrogans serovar lai str. 56601
auaguucccacaaauugag

SEQ ID NO: 2777834 - RNA, 14 nt, Leptospira interrogans serovar lai str. 56601
auaguucccacagu

SEQ ID NO: 2777835 - RNA, 22 nt, Leptospira interrogans serovar lai str. 56601
auaguucccacauuugaauacg

SEQ ID NO: 2777836 - RNA, 15 nt, Leptospira interrogans serovar lai str. 56601
auaguuccuacaauu

SEQ ID NO: 2777837 - RNA, 19 nt, Leptospira interrogans serovar lai str. 56601
auaguuccuacaauuuuag

SEQ ID NO: 2777838 - RNA, 21 nt, Leptospira interrogans serovar lai str. 56601
auaguuccuauauuuuaaauu

SEQ ID NO: 2777839 - RNA, 18 nt, Leptospira interrogans serovar lai str. 56601
auaguugaaauucaccuu

SEQ ID NO: 2777840 - RNA, 20 nt, Leptospira interrogans serovar lai str. 56601
auaguuuacauaucaauccu

SEQ ID NO: 2777841 - RNA, 19 nt, Leptospira interrogans serovar lai str. 56601
auaguuucuacauuuuugu

SEQ ID NO: 2777842 - RNA, 18 nt, Leptospira interrogans serovar lai str. 56601
auaguuuguacaucuuaa

SEQ ID NO: 2777843 - RNA, 23 nt, Leptospira interrogans serovar lai str. 56601
auaguuuguuaucaauagaaaua

SEQ ID NO: 2777844 - RNA, 19 nt, Leptospira interrogans serovar lai str. 56601
auaguuuugagauuacaaa

SEQ ID NO: 2777845 - RNA, 21 nt, Leptospira interrogans serovar lai str. 56601
auaguuuugagcauaaaaaaa

SEQ ID NO: 2777846 - RNA, 18 nt, Leptospira interrogans serovar lai str. 56601
auaguuuuuaguauucuc

SEQ ID NO: 2777847 - RNA, 23 nt, Leptospira interrogans serovar lai str. 56601
auaguuuuuguuaggcaauauua

SEQ ID NO: 2777848 - RNA, 11 nt, Leptospira interrogans serovar lai str. 56601
auauaaaaaau

SEQ ID NO: 2777849 - RNA, 14 nt, Leptospira interrogans serovar lai str. 56601
auauaaaagugaac

SEQ ID NO: 2777850 - RNA, 17 nt, Leptospira interrogans serovar lai str. 56601
auauaaaaucuuaaauu

SEQ ID NO: 2777851 - RNA, 12 nt, Leptospira interrogans serovar lai str. 56601
auauaaaauuuu

SEQ ID NO: 2777852 - RNA, 14 nt, Leptospira interrogans serovar lai str. 56601
auauaaaauuuuua

SEQ ID NO: 2777853 - RNA, 18 nt, Leptospira interrogans serovar lai str. 56601
auauaaacugucggaauu

SEQ ID NO: 2777854 - RNA, 14 nt, Leptospira interrogans serovar lai str. 56601
auauaaagaaaaac

SEQ ID NO: 2777855 - RNA, 19 nt, Leptospira interrogans serovar lai str. 56601
auauaaagucguuuuuaag

SEQ ID NO: 2777856 - RNA, 12 nt, Leptospira interrogans serovar lai str. 56601
auauaaaucaau

SEQ ID NO: 2777857 - RNA, 21 nt, Leptospira interrogans serovar lai str. 56601
auauaaauucgccguaaaaaa

SEQ ID NO: 2777858 - RNA, 18 nt, Leptospira interrogans serovar lai str. 56601
auauaaccucaacauaaa

SEQ ID NO: 2777859 - RNA, 18 nt, Leptospira interrogans serovar lai str. 56601
auauaacuuuuucagaau

SEQ ID NO: 2777860 - RNA, 15 nt, Leptospira interrogans serovar lai str. 56601
auauaagaaaguauu

SEQ ID NO: 2777861 - RNA, 15 nt, Leptospira interrogans serovar lai str. 56601
auauaagaucuaucu

SEQ ID NO: 2777862 - RNA, 19 nt, Leptospira interrogans serovar lai str. 56601
auauaagaucuaucucaaa

SEQ ID NO: 2777863 - RNA, 13 nt, Leptospira interrogans serovar lai str. 56601
auauaaguuaaau

SEQ ID NO: 2777864 - RNA, 15 nt, Leptospira interrogans serovar lai str. 56601
auauaauuaaaaaga

SEQ ID NO: 2777865 - RNA, 12 nt, Leptospira interrogans serovar lai str. 56601
auauaauuuuua

SEQ ID NO: 2777866 - RNA, 13 nt, Leptospira interrogans serovar lai str. 56601
auauaauuuuuaa

SEQ ID NO: 2777867 - RNA, 17 nt, Leptospira interrogans serovar lai str. 56601
auauacaaaacauucca

SEQ ID NO: 2777868 - RNA, 19 nt, Leptospira interrogans serovar lai str. 56601
auauacaaaguuuauaaga

SEQ ID NO: 2777869 - RNA, 19 nt, Leptospira interrogans serovar lai str. 56601
auauacaacuuuuuuaauu

SEQ ID NO: 2777870 - RNA, 22 nt, Leptospira interrogans serovar lai str. 56601
auauacaacuuuuuuaauuuua

SEQ ID NO: 2777871 - RNA, 16 nt, Leptospira interrogans serovar lai str. 56601
auauacaauaaauaga

SEQ ID NO: 2777872 - RNA, 22 nt, Leptospira interrogans serovar lai str. 56601
auauaccaguuaaauucaucaa

SEQ ID NO: 2777873 - RNA, 13 nt, Leptospira interrogans serovar lai str. 56601
auauacguaaaaa

SEQ ID NO: 2777874 - RNA, 19 nt, Leptospira interrogans serovar lai str. 56601
auauguauuuauucaaaau

SEQ ID NO: 2777875 - RNA, 17 nt, Leptospira interrogans serovar lai str. 56601
auaugucguuguauaua

SEQ ID NO: 2777876 - RNA, 13 nt, Leptospira interrogans serovar lai str. 56601
auauguuauauaa

SEQ ID NO: 2777877 - RNA, 21 nt, Leptospira interrogans serovar lai str. 56601
auauguuuagaguauuauaaa

SEQ ID NO: 2777878 - RNA, 19 nt, Leptospira interrogans serovar lai str. 56601
auauguuucuuuuguaaaa

SEQ ID NO: 2777879 - RNA, 12 nt, Leptospira interrogans serovar lai str. 56601
auauuaaaaaaa

SEQ ID NO: 2777880 - RNA, 13 nt, Leptospira interrogans serovar lai str. 56601
auauuaaaaaaau

SEQ ID NO: 2777881 - RNA, 14 nt, Leptospira interrogans serovar lai str. 56601
auauuaaaaaaaua

SEQ ID NO: 2777882 - RNA, 16 nt, Leptospira interrogans serovar lai str. 56601
auauuaaaaaaauaau

SEQ ID NO: 2777883 - RNA, 12 nt, Leptospira interrogans serovar lai str. 56601
auauuaaaacac

SEQ ID NO: 2777884 - RNA, 20 nt, Leptospira interrogans serovar lai str. 56601
auauuaaagaauaauauuuu

SEQ ID NO: 2777885 - RNA, 19 nt, Leptospira interrogans serovar lai str. 56601
auauuaaaguauuaauuua

SEQ ID NO: 2777886 - RNA, 12 nt, Leptospira interrogans serovar lai str. 56601
auauuaaauuaa

SEQ ID NO: 2777887 - RNA, 17 nt, Leptospira interrogans serovar lai str. 56601
auauuaagaauucuaaa

SEQ ID NO: 2777888 - RNA, 21 nt, Leptospira interrogans serovar lai str. 56601
auauuaaguuuuuuaaauuua

SEQ ID NO: 2777889 - RNA, 12 nt, Leptospira interrogans serovar lai str. 56601
auauuaauuaua

SEQ ID NO: 2777890 - RNA, 15 nt, Leptospira interrogans serovar lai str. 56601
auauuaauuuaaaaa

SEQ ID NO: 2777891 - RNA, 21 nt, Leptospira interrogans serovar lai str. 56601
auauuagaauuguugaaaaau

SEQ ID NO: 2777892 - RNA, 21 nt, Leptospira interrogans serovar lai str. 56601
auauuagaguuucuaaaaaaa

SEQ ID NO: 2777893 - RNA, 20 nt, Leptospira interrogans serovar lai str. 56601
auauuagaguuuuugaaaaa

SEQ ID NO: 2777894 - RNA, 21 nt, Leptospira interrogans serovar lai str. 56601
auauuagaguuuuugaaaaau

SEQ ID NO: 2777895 - RNA, 12 nt, Leptospira interrogans serovar lai str. 56601
auauuagauuua

SEQ ID NO: 2777896 - RNA, 13 nt, Leptospira interrogans serovar lai str. 56601
auauuauaaaauu

SEQ ID NO: 2777897 - RNA, 14 nt, Leptospira interrogans serovar lai str. 56601
auauuauaaauauu

SEQ ID NO: 2777898 - RNA, 18 nt, Leptospira interrogans serovar lai str. 56601
auauuauaaauuuaaaaa

SEQ ID NO: 2777899 - RNA, 15 nt, Leptospira interrogans serovar lai str. 56601
auauuauaauuuuaa

SEQ ID NO: 2777900 - RNA, 18 nt, Leptospira interrogans serovar lai str. 56601
auauuauaauuuuaaaua

SEQ ID NO: 2777901 - RNA, 12 nt, Leptospira interrogans serovar lai str. 56601
auauuauauuuu

SEQ ID NO: 2777902 - RNA, 14 nt, Leptospira interrogans serovar lai str. 56601
auauuauauuuuua

SEQ ID NO: 2777903 - RNA, 21 nt, Leptospira interrogans serovar lai str. 56601
auauuauauuuuuaaaaagua

SEQ ID NO: 2777904 - RNA, 14 nt, Leptospira interrogans serovar lai str. 56601
auauuaugaaauaa

SEQ ID NO: 2777905 - RNA, 15 nt, Leptospira interrogans serovar lai str. 56601
auauuauuauauuua

SEQ ID NO: 2777906 - RNA, 14 nt, Leptospira interrogans serovar lai str. 56601
auauuauuuuaacu

SEQ ID NO: 2777907 - RNA, 16 nt, Leptospira interrogans serovar lai str. 56601
auauuauuuuaacuug

SEQ ID NO: 2777908 - RNA, 12 nt, Leptospira interrogans serovar lai str. 56601
auauuauuuuca

SEQ ID NO: 2777909 - RNA, 12 nt, Leptospira interrogans serovar lai str. 56601
auauucaaaaga

SEQ ID NO: 2777910 - RNA, 13 nt, Leptospira interrogans serovar lai str. 56601
auauucaaaagau

SEQ ID NO: 2777911 - RNA, 19 nt, Leptospira interrogans serovar lai str. 56601
auauucacaaaaaaauuca

SEQ ID NO: 2777912 - RNA, 22 nt, Leptospira interrogans serovar lai str. 56601
auauucagaaacuggaauauuc

SEQ ID NO: 2777913 - RNA, 17 nt, Leptospira interrogans serovar lai str. 56601
auauuccuugagaaaag

SEQ ID NO: 2777914 - RNA, 20 nt, Leptospira interrogans serovar lai str. 56601
auauucgaucaaguaagaau

SEQ ID NO: 2777915 - RNA, 21 nt, Leptospira interrogans serovar lai str. 56601
auauucgaucaaguaagaauc

SEQ ID NO: 2777916 - RNA, 20 nt, Leptospira interrogans serovar lai str. 56601
auauucgcuccguuuugaau

SEQ ID NO: 2777917 - RNA, 16 nt, Leptospira interrogans serovar lai str. 56601
auauucguaagaaaaa

SEQ ID NO: 2777918 - RNA, 17 nt, Leptospira interrogans serovar lai str. 56601
auauucguaagaaaaaa

SEQ ID NO: 2777919 - RNA, 22 nt, Leptospira interrogans serovar lai str. 56601
auauucguaagaaaaaauuucu

SEQ ID NO: 2777920 - RNA, 19 nt, Leptospira interrogans serovar lai str. 56601
auauucguguucuauuaua

SEQ ID NO: 2777921 - RNA, 20 nt, Leptospira interrogans serovar lai str. 56601
auauucguguucuauuauau

SEQ ID NO: 2777922 - RNA, 18 nt, Leptospira interrogans serovar lai str. 56601
auauucuaauuuuauaaa

SEQ ID NO: 2777923 - RNA, 15 nt, Leptospira interrogans serovar lai str. 56601
auauucuaauuuuua

SEQ ID NO: 2777924 - RNA, 16 nt, Leptospira interrogans serovar lai str. 56601
auauucuaauuuuuau

SEQ ID NO: 2777925 - RNA, 20 nt, Leptospira interrogans serovar lai str. 56601
auauucugaaagugaaagua

SEQ ID NO: 2777926 - RNA, 15 nt, Leptospira interrogans serovar lai str. 56601
auauucuuauauauc

SEQ ID NO: 2777927 - RNA, 22 nt, Leptospira interrogans serovar lai str. 56601
auauucuuauauuauaauucuc

SEQ ID NO: 2777928 - RNA, 18 nt, Leptospira interrogans serovar lai str. 56601
auauucuuuucugaauaa

SEQ ID NO: 2777929 - RNA, 15 nt, Leptospira interrogans serovar lai str. 56601
auauucuuuuuagac

SEQ ID NO: 2777930 - RNA, 13 nt, Leptospira interrogans serovar lai str. 56601
auauugagcaaga

SEQ ID NO: 2777931 - RNA, 20 nt, Leptospira interrogans serovar lai str. 56601
auauugagcuaauucuuaaa

SEQ ID NO: 2777932 - RNA, 21 nt, Leptospira interrogans serovar lai str. 56601
auauugagcuaauucuuaaaa

SEQ ID NO: 2777933 - RNA, 22 nt, Leptospira interrogans serovar lai str. 56601
auauugagcuaauucuuaaaaa

SEQ ID NO: 2777934 - RNA, 20 nt, Leptospira interrogans serovar lai str. 56601
auauugcugucauaaaccga

SEQ ID NO: 2777935 - RNA, 21 nt, Leptospira interrogans serovar lai str. 56601
auauugguuauaccaaauuca

SEQ ID NO: 2777936 - RNA, 13 nt, Leptospira interrogans serovar lai str. 56601
auauuguuuaaua

SEQ ID NO: 2777937 - RNA, 14 nt, Leptospira interrogans serovar lai str. 56601
auauuuaacuguaa

SEQ ID NO: 2777938 - RNA, 16 nt, Leptospira interrogans serovar lai str. 56601
auauuuauaaaacaau

SEQ ID NO: 2777939 - RNA, 19 nt, Leptospira interrogans serovar lai str. 56601
auauuuauaaaacaaucuu

SEQ ID NO: 2777940 - RNA, 15 nt, Leptospira interrogans serovar lai str. 56601
auauuuauaaaacga

SEQ ID NO: 2777941 - RNA, 11 nt, Leptospira interrogans serovar lai str. 56601
auauuuauaau

SEQ ID NO: 2777942 - RNA, 16 nt, Leptospira interrogans serovar lai str. 56601
auauuucaaaaauuuu

SEQ ID NO: 2777943 - RNA, 16 nt, Leptospira interrogans serovar lai str. 56601
auauuucaagaauuuu

SEQ ID NO: 2777944 - RNA, 16 nt, Leptospira interrogans serovar lai str. 56601
auauuucaauauaaaa

SEQ ID NO: 2777945 - RNA, 18 nt, Leptospira interrogans serovar lai str. 56601
auauuucaauauaaaaau

SEQ ID NO: 2777946 - RNA, 16 nt, Leptospira interrogans serovar lai str. 56601
auauuucaauuccugu

SEQ ID NO: 2777947 - RNA, 18 nt, Leptospira interrogans serovar lai str. 56601
auauuuccaaauuguaug

SEQ ID NO: 2777948 - RNA, 15 nt, Leptospira interrogans serovar lai str. 56601
auauuucuaaaagaa

SEQ ID NO: 2777949 - RNA, 18 nt, Leptospira interrogans serovar lai str. 56601
auauuucuaaaagaagau

SEQ ID NO: 2777950 - RNA, 19 nt, Leptospira interrogans serovar lai str. 56601
auauuucucucaaauucuu

SEQ ID NO: 2777951 - RNA, 21 nt, Leptospira interrogans serovar lai str. 56601
auauuucucucaaauucuuca

SEQ ID NO: 2777952 - RNA, 19 nt, Leptospira interrogans serovar lai str. 56601
auauuucuuaaauucuaaa

SEQ ID NO: 2777953 - RNA, 20 nt, Leptospira interrogans serovar lai str. 56601
auauuucuucguuauuuuua

SEQ ID NO: 2777954 - RNA, 20 nt, Leptospira interrogans serovar lai str. 56601
auauuucuuucgauuuuucg

SEQ ID NO: 2777955 - RNA, 15 nt, Leptospira interrogans serovar lai str. 56601
auauuugaauuuuau

SEQ ID NO: 2777956 - RNA, 22 nt, Leptospira interrogans serovar lai str. 56601
auauuugcauaaacuucaucua

SEQ ID NO: 2777957 - RNA, 22 nt, Leptospira interrogans serovar lai str. 56601
aucacaaggguuguuucaguaa

SEQ ID NO: 2777958 - RNA, 20 nt, Leptospira interrogans serovar lai str. 56601
aucacaauuuuuuuagaauc

SEQ ID NO: 2777959 - RNA, 16 nt, Leptospira interrogans serovar lai str. 56601
aucaccguaauucuua

SEQ ID NO: 2777960 - RNA, 18 nt, Leptospira interrogans serovar lai str. 56601
aucaccguaauucuuaau

SEQ ID NO: 2777961 - RNA, 14 nt, Leptospira interrogans serovar lai str. 56601
aucacgaaaaauga

SEQ ID NO: 2777962 - RNA, 15 nt, Leptospira interrogans serovar lai str. 56601
aucacgaaaaaugaa

SEQ ID NO: 2777963 - RNA, 19 nt, Leptospira interrogans serovar lai str. 56601
aucacgauuuuacaaacaa

SEQ ID NO: 2777964 - RNA, 18 nt, Leptospira interrogans serovar lai str. 56601
aucacgccgaaauuacga

SEQ ID NO: 2777965 - RNA, 12 nt, Leptospira interrogans serovar lai str. 56601
aucacguucuua

SEQ ID NO: 2777966 - RNA, 19 nt, Leptospira interrogans serovar lai str. 56601
aucacuuccauuuuuugau

SEQ ID NO: 2777967 - RNA, 17 nt, Leptospira interrogans serovar lai str. 56601
aucacuuuauauugguu

SEQ ID NO: 2777968 - RNA, 13 nt, Leptospira interrogans serovar lai str. 56601
aucagaaaaacaa

SEQ ID NO: 2777969 - RNA, 13 nt, Leptospira interrogans serovar lai str. 56601
aucagaauaaucu

SEQ ID NO: 2777970 - RNA, 15 nt, Leptospira interrogans serovar lai str. 56601
aucagaauaaucucc

SEQ ID NO: 2777971 - RNA, 17 nt, Leptospira interrogans serovar lai str. 56601
aucagaauagauucuua

SEQ ID NO: 2777972 - RNA, 18 nt, Leptospira interrogans serovar lai str. 56601
aucagaaugaacucaaca

SEQ ID NO: 2777973 - RNA, 16 nt, Leptospira interrogans serovar lai str. 56601
aucagaauuaaaaauu

SEQ ID NO: 2777974 - RNA, 21 nt, Leptospira interrogans serovar lai str. 56601
aucagagucuauuuaauuaug

SEQ ID NO: 2777975 - RNA, 12 nt, Leptospira interrogans serovar lai str. 56601
aucagaucuauu

SEQ ID NO: 2777976 - RNA, 18 nt, Leptospira interrogans serovar lai str. 56601
aucagaucuauuucuuaa

SEQ ID NO: 2777977 - RNA, 19 nt, Leptospira interrogans serovar lai str. 56601
aucagauuuugcacaaaac

SEQ ID NO: 2777978 - RNA, 15 nt, Leptospira interrogans serovar lai str. 56601
aucagcauaaguauu

SEQ ID NO: 2777979 - RNA, 15 nt, Leptospira interrogans serovar lai str. 56601
aucagccauuaaauu

SEQ ID NO: 2777980 - RNA, 16 nt, Leptospira interrogans serovar lai str. 56601
aucaggcuuuauaaaa

SEQ ID NO: 2777981 - RNA, 20 nt, Leptospira interrogans serovar lai str. 56601
aucaggcuuuauaaaaugaa

SEQ ID NO: 2777982 - RNA, 17 nt, Leptospira interrogans serovar lai str. 56601
aucagggccggagaaaa

SEQ ID NO: 2777983 - RNA, 19 nt, Leptospira interrogans serovar lai str. 56601
aucagggccggagaaaauu

SEQ ID NO: 2777984 - RNA, 19 nt, Leptospira interrogans serovar lai str. 56601
aucaguaguuauauuaaua

SEQ ID NO: 2777985 - RNA, 21 nt, Leptospira interrogans serovar lai str. 56601
aucaguaguuauauuaauauu

SEQ ID NO: 2777986 - RNA, 14 nt, Leptospira interrogans serovar lai str. 56601
aucaguguuuugug

SEQ ID NO: 2777987 - RNA, 13 nt, Leptospira interrogans serovar lai str. 56601
aucaguuucuccg

SEQ ID NO: 2777988 - RNA, 21 nt, Leptospira interrogans serovar lai str. 56601
aucaguuuuguuaaccaaaaa

SEQ ID NO: 2777989 - RNA, 15 nt, Leptospira interrogans serovar lai str. 56601
aucaguuuuguuaau

SEQ ID NO: 2777990 - RNA, 18 nt, Leptospira interrogans serovar lai str. 56601
aucauaaaaauaaagaaa

SEQ ID NO: 2777991 - RNA, 22 nt, Leptospira interrogans serovar lai str. 56601
aucauaaaggagagguuuuccu

SEQ ID NO: 2777992 - RNA, 22 nt, Leptospira interrogans serovar lai str. 56601
aucauaaaggugcaugaaaaua

SEQ ID NO: 2777993 - RNA, 14 nt, Leptospira interrogans serovar lai str. 56601
aucauaacaaauaa

SEQ ID NO: 2777994 - RNA, 18 nt, Leptospira interrogans serovar lai str. 56601
aucauacaguaaaaccac

SEQ ID NO: 2777995 - RNA, 16 nt, Leptospira interrogans serovar lai str. 56601
aucauacuuuuaaaaa

SEQ ID NO: 2777996 - RNA, 17 nt, Leptospira interrogans serovar lai str. 56601
aucauacuuuuaaaaaa

SEQ ID NO: 2777997 - RNA, 18 nt, Leptospira interrogans serovar lai str. 56601
aucauacuuuuaaaaaau

SEQ ID NO: 2777998 - RNA, 15 nt, Leptospira interrogans serovar lai str. 56601
aucauagauacauaa

SEQ ID NO: 2777999 - RNA, 22 nt, Leptospira interrogans serovar lai str. 56601
aucaucaaaacuuaaaucccau

SEQ ID NO: 2778000 - RNA, 18 nt, Leptospira interrogans serovar lai str. 56601
aucaucccgcccaaagua

SEQ ID NO: 2778001 - RNA, 16 nt, Leptospira interrogans serovar lai str. 56601
aucaucuaucuuuuca

SEQ ID NO: 2778002 - RNA, 15 nt, Leptospira interrogans serovar lai str. 56601
aucaucucaaaaaua

SEQ ID NO: 2778003 - RNA, 21 nt, Leptospira interrogans serovar lai str. 56601
aucaugaaccauggauuuuua

SEQ ID NO: 2778004 - RNA, 14 nt, Leptospira interrogans serovar lai str. 56601
aucaugaucaaauu

SEQ ID NO: 2778005 - RNA, 17 nt, Leptospira interrogans serovar lai str. 56601
aucaugaucaaauucac

SEQ ID NO: 2778006 - RNA, 15 nt, Leptospira interrogans serovar lai str. 56601
aucauggccuucugg

SEQ ID NO: 2778007 - RNA, 14 nt, Leptospira interrogans serovar lai str. 56601
aucauguaauauaa

SEQ ID NO: 2778008 - RNA, 19 nt, Leptospira interrogans serovar lai str. 56601
aucaugucucaguucaaaa

SEQ ID NO: 2778009 - RNA, 22 nt, Leptospira interrogans serovar lai str. 56601
aucauuaaugcgaaaauuuaac

SEQ ID NO: 2778010 - RNA, 16 nt, Leptospira interrogans serovar lai str. 56601
aucauucugaaaaaag

SEQ ID NO: 2778011 - RNA, 19 nt, Leptospira interrogans serovar lai str. 56601
aucauucugaaaaaaguug

SEQ ID NO: 2778012 - RNA, 15 nt, Leptospira interrogans serovar lai str. 56601
aucauucuuuagaaa

SEQ ID NO: 2778013 - RNA, 21 nt, Leptospira interrogans serovar lai str. 56601
aucauucuuuagaaauuuuua

SEQ ID NO: 2778014 - RNA, 23 nt, Leptospira interrogans serovar lai str. 56601
aucauucuuuagaaauuuuuaau

SEQ ID NO: 2778015 - RNA, 15 nt, Leptospira interrogans serovar lai str. 56601
aucauuggaguuuuu

SEQ ID NO: 2778016 - RNA, 19 nt, Leptospira interrogans serovar lai str. 56601
aucauuggaguuuuuuaaa

SEQ ID NO: 2778017 - RNA, 23 nt, Leptospira interrogans serovar lai str. 56601
aucauuugcauaggugauuaaac

SEQ ID NO: 2778018 - RNA, 18 nt, Leptospira interrogans serovar lai str. 56601
aucauuuucaauuuuuau

SEQ ID NO: 2778019 - RNA, 17 nt, Leptospira interrogans serovar lai str. 56601
aucauuuuguaagucca

SEQ ID NO: 2778020 - RNA, 20 nt, Leptospira interrogans serovar lai str. 56601
auccaaagaaagaaaauaca

SEQ ID NO: 2778021 - RNA, 16 nt, Leptospira interrogans serovar lai str. 56601
auccaacuuaaaacug

SEQ ID NO: 2778022 - RNA, 12 nt, Leptospira interrogans serovar lai str. 56601
auccaauacaaa

SEQ ID NO: 2778023 - RNA, 15 nt, Leptospira interrogans serovar lai str. 56601
auccaauauuuaugc

SEQ ID NO: 2778024 - RNA, 12 nt, Leptospira interrogans serovar lai str. 56601
auccaauuauuu

SEQ ID NO: 2778025 - RNA, 16 nt, Leptospira interrogans serovar lai str. 56601
auccaauugaauauaa

SEQ ID NO: 2778026 - RNA, 13 nt, Leptospira interrogans serovar lai str. 56601
auccacuaaaaua

SEQ ID NO: 2778027 - RNA, 14 nt, Leptospira interrogans serovar lai str. 56601
auccagaauaauaa

SEQ ID NO: 2778028 - RNA, 22 nt, Leptospira interrogans serovar lai str. 56601
auccagaauaauaaucuuaaau

SEQ ID NO: 2778029 - RNA, 13 nt, Leptospira interrogans serovar lai str. 56601
auccauaaaucga

SEQ ID NO: 2778030 - RNA, 16 nt, Leptospira interrogans serovar lai str. 56601
auccauaaauucuaca

SEQ ID NO: 2778031 - RNA, 20 nt, Leptospira interrogans serovar lai str. 56601
auccauaaauucuacaaauu

SEQ ID NO: 2778032 - RNA, 13 nt, Leptospira interrogans serovar lai str. 56601
auccauaaguucc

SEQ ID NO: 2778033 - RNA, 22 nt, Leptospira interrogans serovar lai str. 56601
auccauaaguuccuuaaaagua

SEQ ID NO: 2778034 - RNA, 17 nt, Leptospira interrogans serovar lai str. 56601
auccauacaacuuucag

SEQ ID NO: 2778035 - RNA, 22 nt, Leptospira interrogans serovar lai str. 56601
auccaugauucauuuuucuaaa

SEQ ID NO: 2778036 - RNA, 15 nt, Leptospira interrogans serovar lai str. 56601
auccaugauucugaa

SEQ ID NO: 2778037 - RNA, 22 nt, Leptospira interrogans serovar lai str. 56601
auccaugauuuguaauaguucc

SEQ ID NO: 2778038 - RNA, 17 nt, Leptospira interrogans serovar lai str. 56601
auccauucaaaaaauca

SEQ ID NO: 2778039 - RNA, 18 nt, Leptospira interrogans serovar lai str. 56601
auccauuucguuucccuc

SEQ ID NO: 2778040 - RNA, 15 nt, Leptospira interrogans serovar lai str. 56601
aucgguuuaaaacua

SEQ ID NO: 2778041 - RNA, 22 nt, Leptospira interrogans serovar lai str. 56601
aucgguuuucguuguauggaaa

SEQ ID NO: 2778042 - RNA, 23 nt, Leptospira interrogans serovar lai str. 56601
aucguaaaaaaauauuucaaaaa

SEQ ID NO: 2778043 - RNA, 20 nt, Leptospira interrogans serovar lai str. 56601
aucguacgaaucagauccuu

SEQ ID NO: 2778044 - RNA, 18 nt, Leptospira interrogans serovar lai str. 56601
aucguauucggaaauuug

SEQ ID NO: 2778045 - RNA, 12 nt, Leptospira interrogans serovar lai str. 56601
aucgucaaaauu

SEQ ID NO: 2778046 - RNA, 14 nt, Leptospira interrogans serovar lai str. 56601
aucgucaaaauuua

SEQ ID NO: 2778047 - RNA, 19 nt, Leptospira interrogans serovar lai str. 56601
aucgucagggaagcaguuu

SEQ ID NO: 2778048 - RNA, 14 nt, Leptospira interrogans serovar lai str. 56601
aucguccaaucucu

SEQ ID NO: 2778049 - RNA, 20 nt, Leptospira interrogans serovar lai str. 56601
aucgugaauuuacaguuaaa

SEQ ID NO: 2778050 - RNA, 17 nt, Leptospira interrogans serovar lai str. 56601
aucguguaaaauuuuuu

SEQ ID NO: 2778051 - RNA, 23 nt, Leptospira interrogans serovar lai str. 56601
aucguguuugagauuaaaaagaa

SEQ ID NO: 2778052 - RNA, 15 nt, Leptospira interrogans serovar lai str. 56601
aucguuccaaacccu

SEQ ID NO: 2778053 - RNA, 12 nt, Leptospira interrogans serovar lai str. 56601
aucguucuagaa

SEQ ID NO: 2778054 - RNA, 19 nt, Leptospira interrogans serovar lai str. 56601
aucguuuaagaauuuuaaa

SEQ ID NO: 2778055 - RNA, 20 nt, Leptospira interrogans serovar lai str. 56601
aucguuuauaaaucgaaucg

SEQ ID NO: 2778056 - RNA, 15 nt, Leptospira interrogans serovar lai str. 56601
aucguuuauuuuucu

SEQ ID NO: 2778057 - RNA, 22 nt, Leptospira interrogans serovar lai str. 56601
aucguuuauuuuucuaaaaaaa

SEQ ID NO: 2778058 - RNA, 14 nt, Leptospira interrogans serovar lai str. 56601
aucguuuuuauuca

SEQ ID NO: 2778059 - RNA, 15 nt, Leptospira interrogans serovar lai str. 56601
aucguuuuuuuuguu

SEQ ID NO: 2778060 - RNA, 13 nt, Leptospira interrogans serovar lai str. 56601
aucuaaaaaaaau

SEQ ID NO: 2778061 - RNA, 22 nt, Leptospira interrogans serovar lai str. 56601
aucuaaaaaaacaauuaaucaa

SEQ ID NO: 2778062 - RNA, 15 nt, Leptospira interrogans serovar lai str. 56601
aucuaaaaagaauca

SEQ ID NO: 2778063 - RNA, 20 nt, Leptospira interrogans serovar lai str. 56601
aucuaaaacacaucuuaaaa

SEQ ID NO: 2778064 - RNA, 12 nt, Leptospira interrogans serovar lai str. 56601
aucuaaaagaaa

SEQ ID NO: 2778065 - RNA, 17 nt, Leptospira interrogans serovar lai str. 56601
aucuaaaauggacugca

SEQ ID NO: 2778066 - RNA, 17 nt, Leptospira interrogans serovar lai str. 56601
aucuaaacuuugcaaau

SEQ ID NO: 2778067 - RNA, 20 nt, Leptospira interrogans serovar lai str. 56601
aucuaaacuuugcaaaucga

SEQ ID NO: 2778068 - RNA, 17 nt, Leptospira interrogans serovar lai str. 56601
aucuaaagacuaaaaag

SEQ ID NO: 2778069 - RNA, 16 nt, Leptospira interrogans serovar lai str. 56601
aucuaaauauugaucu

SEQ ID NO: 2778070 - RNA, 17 nt, Leptospira interrogans serovar lai str. 56601
aucuaaauauugaucua

SEQ ID NO: 2778071 - RNA, 18 nt, Leptospira interrogans serovar lai str. 56601
aucuaaauauugaucuaa

SEQ ID NO: 2778072 - RNA, 16 nt, Leptospira interrogans serovar lai str. 56601
aucuaaauuuguaaua

SEQ ID NO: 2778073 - RNA, 16 nt, Leptospira interrogans serovar lai str. 56601
aucuaaauuuguugca

SEQ ID NO: 2778074 - RNA, 16 nt, Leptospira interrogans serovar lai str. 56601
aucuaagaaauccguu

SEQ ID NO: 2778075 - RNA, 13 nt, Leptospira interrogans serovar lai str. 56601
aucuaagacgaaa

SEQ ID NO: 2778076 - RNA, 18 nt, Leptospira interrogans serovar lai str. 56601
aucuaagauccaaauuuu

SEQ ID NO: 2778077 - RNA, 21 nt, Leptospira interrogans serovar lai str. 56601
aucuaagauccaaauuuuuua

SEQ ID NO: 2778078 - RNA, 15 nt, Leptospira interrogans serovar lai str. 56601
aucuaauauuuuucc

SEQ ID NO: 2778079 - RNA, 15 nt, Leptospira interrogans serovar lai str. 56601
aucuaaugauuucuu

SEQ ID NO: 2778080 - RNA, 14 nt, Leptospira interrogans serovar lai str. 56601
aucuaauuuauaaa

SEQ ID NO: 2778081 - RNA, 19 nt, Leptospira interrogans serovar lai str. 56601
aucuacaaaagauuuuuau

SEQ ID NO: 2778082 - RNA, 19 nt, Leptospira interrogans serovar lai str. 56601
aucuacagaacccaauaaa

SEQ ID NO: 2778083 - RNA, 21 nt, Leptospira interrogans serovar lai str. 56601
aucuacagaacccaauaaaaa

SEQ ID NO: 2778084 - RNA, 24 nt, Leptospira interrogans serovar lai str. 56601
aucuacagaacccaauaaaaacua

SEQ ID NO: 2778085 - RNA, 18 nt, Leptospira interrogans serovar lai str. 56601
aucuacauaaaaaaggaa

SEQ ID NO: 2778086 - RNA, 14 nt, Leptospira interrogans serovar lai str. 56601
aucuacauuggaag

SEQ ID NO: 2778087 - RNA, 12 nt, Leptospira interrogans serovar lai str. 56601
aucuacuaaauc

SEQ ID NO: 2778088 - RNA, 15 nt, Leptospira interrogans serovar lai str. 56601
aucuacuauuauaau

SEQ ID NO: 2778089 - RNA, 18 nt, Leptospira interrogans serovar lai str. 56601
aucuacuuacauagaacu

SEQ ID NO: 2778090 - RNA, 20 nt, Leptospira interrogans serovar lai str. 56601
aucuacuuacauagaacuca

SEQ ID NO: 2778091 - RNA, 17 nt, Leptospira interrogans serovar lai str. 56601
aucuacuuuauuucgga

SEQ ID NO: 2778092 - RNA, 16 nt, Leptospira interrogans serovar lai str. 56601
aucuaggguauugagg

SEQ ID NO: 2778093 - RNA, 21 nt, Leptospira interrogans serovar lai str. 56601
aucuaguucaacguaagaaaa

SEQ ID NO: 2778094 - RNA, 23 nt, Leptospira interrogans serovar lai str. 56601
aucuauauuuuacaguaaaacuu

SEQ ID NO: 2778095 - RNA, 19 nt, Leptospira interrogans serovar lai str. 56601
aucuaucucaaaaauacuu

SEQ ID NO: 2778096 - RNA, 15 nt, Leptospira interrogans serovar lai str. 56601
aucuaucucaaaaua

SEQ ID NO: 2778097 - RNA, 15 nt, Leptospira interrogans serovar lai str. 56601
aucuaucuuuucaaa

SEQ ID NO: 2778098 - RNA, 17 nt, Leptospira interrogans serovar lai str. 56601
aucuaugauucugaaaa

SEQ ID NO: 2778099 - RNA, 19 nt, Leptospira interrogans serovar lai str. 56601
aucuauguccuuuuuuucu

SEQ ID NO: 2778100 - RNA, 14 nt, Leptospira interrogans serovar lai str. 56601
aucuauugaaacaa

SEQ ID NO: 2778101 - RNA, 21 nt, Leptospira interrogans serovar lai str. 56601
aucuauuuccguuauauuaaa

SEQ ID NO: 2778102 - RNA, 23 nt, Leptospira interrogans serovar lai str. 56601
aucuauuuccguuauauuaaaau

SEQ ID NO: 2778103 - RNA, 12 nt, Leptospira interrogans serovar lai str. 56601
aucuauuuuuga

SEQ ID NO: 2778104 - RNA, 21 nt, Leptospira interrogans serovar lai str. 56601
aucuauuuuugauuuuagaaa

SEQ ID NO: 2778105 - RNA, 22 nt, Leptospira interrogans serovar lai str. 56601
aucucaaaaauacuuugaacuu

SEQ ID NO: 2778106 - RNA, 19 nt, Leptospira interrogans serovar lai str. 56601
aucucaaauucgucaaaac

SEQ ID NO: 2778107 - RNA, 19 nt, Leptospira interrogans serovar lai str. 56601
aucucaaucaaaauuuuuu

SEQ ID NO: 2778108 - RNA, 17 nt, Leptospira interrogans serovar lai str. 56601
aucucagaaaauuuuac

SEQ ID NO: 2778109 - RNA, 18 nt, Leptospira interrogans serovar lai str. 56601
aucucagaaaauuuuaca

SEQ ID NO: 2778110 - RNA, 21 nt, Leptospira interrogans serovar lai str. 56601
aucuccacuauggaauuuuuu

SEQ ID NO: 2778111 - RNA, 18 nt, Leptospira interrogans serovar lai str. 56601
aucuccacuuaauuuuuc

SEQ ID NO: 2778112 - RNA, 12 nt, Leptospira interrogans serovar lai str. 56601
aucuccacuuga

SEQ ID NO: 2778113 - RNA, 17 nt, Leptospira interrogans serovar lai str. 56601
aucucccgaaugaauuu

SEQ ID NO: 2778114 - RNA, 15 nt, Leptospira interrogans serovar lai str. 56601
aucuccgcucuauuu

SEQ ID NO: 2778115 - RNA, 19 nt, Leptospira interrogans serovar lai str. 56601
aucucgauuucuaaaaugu

SEQ ID NO: 2778116 - RNA, 16 nt, Leptospira interrogans serovar lai str. 56601
aucucguuaaauuuuc

SEQ ID NO: 2778117 - RNA, 14 nt, Leptospira interrogans serovar lai str. 56601
aucucuauaaaauc

SEQ ID NO: 2778118 - RNA, 17 nt, Leptospira interrogans serovar lai str. 56601
aucucuauaaaaucaag

SEQ ID NO: 2778119 - RNA, 14 nt, Leptospira interrogans serovar lai str. 56601
aucucuuaaucgaa

SEQ ID NO: 2778120 - RNA, 19 nt, Leptospira interrogans serovar lai str. 56601
aucucuucgucucaccaac

SEQ ID NO: 2778121 - RNA, 23 nt, Leptospira interrogans serovar lai str. 56601
aucucuuuuacgacuuuauucaa

SEQ ID NO: 2778122 - RNA, 14 nt, Leptospira interrogans serovar lai str. 56601
aucugaaucucuuu

SEQ ID NO: 2778123 - RNA, 15 nt, Leptospira interrogans serovar lai str. 56601
aucuuuuaaaaucaa

SEQ ID NO: 2778124 - RNA, 19 nt, Leptospira interrogans serovar lai str. 56601
aucuuuuaaaaucaagagc

SEQ ID NO: 2778125 - RNA, 19 nt, Leptospira interrogans serovar lai str. 56601
aucuuuucaaaaguauuuu

SEQ ID NO: 2778126 - RNA, 13 nt, Leptospira interrogans serovar lai str. 56601
aucuuuuccauug

SEQ ID NO: 2778127 - RNA, 15 nt, Leptospira interrogans serovar lai str. 56601
aucuuuucuuaaaau

SEQ ID NO: 2778128 - RNA, 17 nt, Leptospira interrogans serovar lai str. 56601
aucuuuugaaaguuuuu

SEQ ID NO: 2778129 - RNA, 21 nt, Leptospira interrogans serovar lai str. 56601
aucuuuugaaaguuuuuuuau

SEQ ID NO: 2778130 - RNA, 12 nt, Leptospira interrogans serovar lai str. 56601
aucuuuuuaaaa

SEQ ID NO: 2778131 - RNA, 16 nt, Leptospira interrogans serovar lai str. 56601
aucuuuuuaaaaguau

SEQ ID NO: 2778132 - RNA, 22 nt, Leptospira interrogans serovar lai str. 56601
aucuuuuuaacgcagauuugau

SEQ ID NO: 2778133 - RNA, 18 nt, Leptospira interrogans serovar lai str. 56601
aucuuuuucuaucaagaa

SEQ ID NO: 2778134 - RNA, 18 nt, Leptospira interrogans serovar lai str. 56601
aucuuuuuuaauuauguu

SEQ ID NO: 2778135 - RNA, 22 nt, Leptospira interrogans serovar lai str. 56601
aucuuuuuuucuagauauuuca

SEQ ID NO: 2778136 - RNA, 20 nt, Leptospira interrogans serovar lai str. 56601
aucuuuuuuugccuuucacc

SEQ ID NO: 2778137 - RNA, 19 nt, Leptospira interrogans serovar lai str. 56601
aucuuuuuuuucuaaaaua

SEQ ID NO: 2778138 - RNA, 17 nt, Leptospira interrogans serovar lai str. 56601
augaaaaaaaacaaaga

SEQ ID NO: 2778139 - RNA, 11 nt, Leptospira interrogans serovar lai str. 56601
augaaaaaauu

SEQ ID NO: 2778140 - RNA, 14 nt, Leptospira interrogans serovar lai str. 56601
augaaaaaauucag

SEQ ID NO: 2778141 - RNA, 17 nt, Leptospira interrogans serovar lai str. 56601
augaaaaagaauuuuua

SEQ ID NO: 2778142 - RNA, 20 nt, Leptospira interrogans serovar lai str. 56601
augaaaaagaauuuuuaaaa

SEQ ID NO: 2778143 - RNA, 23 nt, Leptospira interrogans serovar lai str. 56601
augaaaaagaauuuuuaaaaaua

SEQ ID NO: 2778144 - RNA, 18 nt, Leptospira interrogans serovar lai str. 56601
augaaaaauuucuuuguc

SEQ ID NO: 2778145 - RNA, 19 nt, Leptospira interrogans serovar lai str. 56601
augaaaacgaugucuuuug

SEQ ID NO: 2778146 - RNA, 16 nt, Leptospira interrogans serovar lai str. 56601
augaaaauaauaccaa

SEQ ID NO: 2778147 - RNA, 21 nt, Leptospira interrogans serovar lai str. 56601
augaaaauaauaucaaaauga

SEQ ID NO: 2778148 - RNA, 18 nt, Leptospira interrogans serovar lai str. 56601
augaaacuuaguuccuac

SEQ ID NO: 2778149 - RNA, 22 nt, Leptospira interrogans serovar lai str. 56601
augaaagaaacauaaugcaaua

SEQ ID NO: 2778150 - RNA, 11 nt, Leptospira interrogans serovar lai str. 56601
augaaauaaag

SEQ ID NO: 2778151 - RNA, 18 nt, Leptospira interrogans serovar lai str. 56601
augaaaucuacaaaacug

SEQ ID NO: 2778152 - RNA, 19 nt, Leptospira interrogans serovar lai str. 56601
augaaaucuaguucaacgu

SEQ ID NO: 2778153 - RNA, 22 nt, Leptospira interrogans serovar lai str. 56601
augaaaucuaguucaacguaag

SEQ ID NO: 2778154 - RNA, 13 nt, Leptospira interrogans serovar lai str. 56601
augaaauuuuaaa

SEQ ID NO: 2778155 - RNA, 15 nt, Leptospira interrogans serovar lai str. 56601
augaaauuuuaaaac

SEQ ID NO: 2778156 - RNA, 18 nt, Leptospira interrogans serovar lai str. 56601
augaaauuuuaaaacccg

SEQ ID NO: 2778157 - RNA, 13 nt, Leptospira interrogans serovar lai str. 56601
augaaauuuucuu

SEQ ID NO: 2778158 - RNA, 12 nt, Leptospira interrogans serovar lai str. 56601
augaaauuuuug

SEQ ID NO: 2778159 - RNA, 20 nt, Leptospira interrogans serovar lai str. 56601
augaaauuuuuguacaaaac

SEQ ID NO: 2778160 - RNA, 21 nt, Leptospira interrogans serovar lai str. 56601
augaacaaugaauuuuuauaa

SEQ ID NO: 2778161 - RNA, 16 nt, Leptospira interrogans serovar lai str. 56601
augaacgaauuuuuca

SEQ ID NO: 2778162 - RNA, 20 nt, Leptospira interrogans serovar lai str. 56601
augaacgaauuuuucaacaa

SEQ ID NO: 2778163 - RNA, 15 nt, Leptospira interrogans serovar lai str. 56601
augaacucaacagaa

SEQ ID NO: 2778164 - RNA, 20 nt, Leptospira interrogans serovar lai str. 56601
augaagaagcuaaaauugaa

SEQ ID NO: 2778165 - RNA, 16 nt, Leptospira interrogans serovar lai str. 56601
augaagagaaaguaac

SEQ ID NO: 2778166 - RNA, 14 nt, Leptospira interrogans serovar lai str. 56601
augaaguaaguuau

SEQ ID NO: 2778167 - RNA, 22 nt, Leptospira interrogans serovar lai str. 56601
augaaguuuuacuaaaaguaac

SEQ ID NO: 2778168 - RNA, 13 nt, Leptospira interrogans serovar lai str. 56601
augaauaaaaaag

SEQ ID NO: 2778169 - RNA, 23 nt, Leptospira interrogans serovar lai str. 56601
augaauaaacaauaaaauaacua

SEQ ID NO: 2778170 - RNA, 20 nt, Leptospira interrogans serovar lai str. 56601
augaauaacuuuacaaaaau

SEQ ID NO: 2778171 - RNA, 18 nt, Leptospira interrogans serovar lai str. 56601
augaauaggcgauuuuac

SEQ ID NO: 2778172 - RNA, 19 nt, Leptospira interrogans serovar lai str. 56601
augaauaggcgauuuuaca

SEQ ID NO: 2778173 - RNA, 21 nt, Leptospira interrogans serovar lai str. 56601
augaauaggcgauuuuacaaa

SEQ ID NO: 2778174 - RNA, 14 nt, Leptospira interrogans serovar lai str. 56601
augaauauuuucca

SEQ ID NO: 2778175 - RNA, 15 nt, Leptospira interrogans serovar lai str. 56601
augaaucguaaaaaa

SEQ ID NO: 2778176 - RNA, 22 nt, Leptospira interrogans serovar lai str. 56601
augaaucguaaaaaaauauuuc

SEQ ID NO: 2778177 - RNA, 14 nt, Leptospira interrogans serovar lai str. 56601
augaauguuuaaaa

SEQ ID NO: 2778178 - RNA, 14 nt, Leptospira interrogans serovar lai str. 56601
augaauucucuauc

SEQ ID NO: 2778179 - RNA, 16 nt, Leptospira interrogans serovar lai str. 56601
augaauugcuaaaaaa

SEQ ID NO: 2778180 - RNA, 15 nt, Leptospira interrogans serovar lai str. 56601
augaauuguaaaaaa

SEQ ID NO: 2778181 - RNA, 13 nt, Leptospira interrogans serovar lai str. 56601
augaauuuagaaa

SEQ ID NO: 2778182 - RNA, 22 nt, Leptospira interrogans serovar lai str. 56601
augaauuuagaaaauuagaaag

SEQ ID NO: 2778183 - RNA, 13 nt, Leptospira interrogans serovar lai str. 56601
augaauuuuaaau

SEQ ID NO: 2778184 - RNA, 15 nt, Leptospira interrogans serovar lai str. 56601
augaauuuucaaaau

SEQ ID NO: 2778185 - RNA, 20 nt, Leptospira interrogans serovar lai str. 56601
augaauuuucaaaaucggaa

SEQ ID NO: 2778186 - RNA, 14 nt, Leptospira interrogans serovar lai str. 56601
augaauuuuuaaac

SEQ ID NO: 2778187 - RNA, 15 nt, Leptospira interrogans serovar lai str. 56601
augaauuuuuaaaca

SEQ ID NO: 2778188 - RNA, 15 nt, Leptospira interrogans serovar lai str. 56601
augaauuuuuauaaa

SEQ ID NO: 2778189 - RNA, 21 nt, Leptospira interrogans serovar lai str. 56601
augaauuuuuauaaaaauaca

SEQ ID NO: 2778190 - RNA, 11 nt, Leptospira interrogans serovar lai str. 56601
augaauuuuuu

SEQ ID NO: 2778191 - RNA, 20 nt, Leptospira interrogans serovar lai str. 56601
augacuuaaucugugggaac

SEQ ID NO: 2778192 - RNA, 23 nt, Leptospira interrogans serovar lai str. 56601
augacuuaaucugugggaacucu

SEQ ID NO: 2778193 - RNA, 21 nt, Leptospira interrogans serovar lai str. 56601
augacuugcauuuaauauauu

SEQ ID NO: 2778194 - RNA, 14 nt, Leptospira interrogans serovar lai str. 56601
augagaaagaauuu

SEQ ID NO: 2778195 - RNA, 14 nt, Leptospira interrogans serovar lai str. 56601
augagaguucccac

SEQ ID NO: 2778196 - RNA, 19 nt, Leptospira interrogans serovar lai str. 56601
augagauaucacaaauuuu

SEQ ID NO: 2778197 - RNA, 15 nt, Leptospira interrogans serovar lai str. 56601
augagauuaaaacug

SEQ ID NO: 2778198 - RNA, 21 nt, Leptospira interrogans serovar lai str. 56601
augagauuuuuggaaauucca

SEQ ID NO: 2778199 - RNA, 20 nt, Leptospira interrogans serovar lai str. 56601
augagcauucuugagaaagg

SEQ ID NO: 2778200 - RNA, 16 nt, Leptospira interrogans serovar lai str. 56601
augagccaucuuuuuu

SEQ ID NO: 2778201 - RNA, 22 nt, Leptospira interrogans serovar lai str. 56601
augagcgacucagaaaacucag

SEQ ID NO: 2778202 - RNA, 17 nt, Leptospira interrogans serovar lai str. 56601
augagcuuacuuuaauu

SEQ ID NO: 2778203 - RNA, 13 nt, Leptospira interrogans serovar lai str. 56601
augaggagaaaaa

SEQ ID NO: 2778204 - RNA, 16 nt, Leptospira interrogans serovar lai str. 56601
augagggcucccacaa

SEQ ID NO: 2778205 - RNA, 15 nt, Leptospira interrogans serovar lai str. 56601
augaguaaacuauug

SEQ ID NO: 2778206 - RNA, 18 nt, Leptospira interrogans serovar lai str. 56601
auggacugcaaaaucagu

SEQ ID NO: 2778207 - RNA, 14 nt, Leptospira interrogans serovar lai str. 56601
auggagaauuaauu

SEQ ID NO: 2778208 - RNA, 16 nt, Leptospira interrogans serovar lai str. 56601
auggagaauuuauuuu

SEQ ID NO: 2778209 - RNA, 18 nt, Leptospira interrogans serovar lai str. 56601
auggagauuacuuuuucu

SEQ ID NO: 2778210 - RNA, 19 nt, Leptospira interrogans serovar lai str. 56601
auggauuauccaaaacaau

SEQ ID NO: 2778211 - RNA, 18 nt, Leptospira interrogans serovar lai str. 56601
auggauuuacaguuaaac

SEQ ID NO: 2778212 - RNA, 23 nt, Leptospira interrogans serovar lai str. 56601
auggauuugauuuuucgaaaauu

SEQ ID NO: 2778213 - RNA, 14 nt, Leptospira interrogans serovar lai str. 56601
auggauuuuuaugu

SEQ ID NO: 2778214 - RNA, 15 nt, Leptospira interrogans serovar lai str. 56601
auggauuuuuccaac

SEQ ID NO: 2778215 - RNA, 23 nt, Leptospira interrogans serovar lai str. 56601
auggauuuuuugucuuuaaaauu

SEQ ID NO: 2778216 - RNA, 18 nt, Leptospira interrogans serovar lai str. 56601
auggcauccaggauuuuc

SEQ ID NO: 2778217 - RNA, 19 nt, Leptospira interrogans serovar lai str. 56601
auggccuucuggaaaaauu

SEQ ID NO: 2778218 - RNA, 17 nt, Leptospira interrogans serovar lai str. 56601
auggcgccccaaccaga

SEQ ID NO: 2778219 - RNA, 15 nt, Leptospira interrogans serovar lai str. 56601
auggcguauaagaau

SEQ ID NO: 2778220 - RNA, 22 nt, Leptospira interrogans serovar lai str. 56601
auggcucauuuuucuuaaaaaa

SEQ ID NO: 2778221 - RNA, 18 nt, Leptospira interrogans serovar lai str. 56601
auggcucugaguagaaag

SEQ ID NO: 2778222 - RNA, 14 nt, Leptospira interrogans serovar lai str. 56601
auggcuuugaaaaa

SEQ ID NO: 2778223 - RNA, 23 nt, Leptospira interrogans serovar lai str. 56601
augggaauuuuuguaaaauccag

SEQ ID NO: 2778224 - RNA, 13 nt, Leptospira interrogans serovar lai str. 56601
augggaccaagag

SEQ ID NO: 2778225 - RNA, 23 nt, Leptospira interrogans serovar lai str. 56601
augggaguucguaugaguuccca

SEQ ID NO: 2778226 - RNA, 20 nt, Leptospira interrogans serovar lai str. 56601
augggccccaccuaaaauga

SEQ ID NO: 2778227 - RNA, 22 nt, Leptospira interrogans serovar lai str. 56601
augggcucuaggcgauuuuucg

SEQ ID NO: 2778228 - RNA, 17 nt, Leptospira interrogans serovar lai str. 56601
auggguuuucauuuuua

SEQ ID NO: 2778229 - RNA, 20 nt, Leptospira interrogans serovar lai str. 56601
auggguuuucauuuuuacaa

SEQ ID NO: 2778230 - RNA, 13 nt, Leptospira interrogans serovar lai str. 56601
augguaaaaauau

SEQ ID NO: 2778231 - RNA, 14 nt, Leptospira interrogans serovar lai str. 56601
augguaaggaaccc

SEQ ID NO: 2778232 - RNA, 14 nt, Leptospira interrogans serovar lai str. 56601
augguaaggagcuc

SEQ ID NO: 2778233 - RNA, 22 nt, Leptospira interrogans serovar lai str. 56601
augguacuuuacgaaaguugaa

SEQ ID NO: 2778234 - RNA, 22 nt, Leptospira interrogans serovar lai str. 56601
augguaucugcgauuaaagauu

SEQ ID NO: 2778235 - RNA, 19 nt, Leptospira interrogans serovar lai str. 56601
augguccaaucagauuuuu

SEQ ID NO: 2778236 - RNA, 23 nt, Leptospira interrogans serovar lai str. 56601
augguuccgauacgaguaaaaau

SEQ ID NO: 2778237 - RNA, 20 nt, Leptospira interrogans serovar lai str. 56601
auguaaaaacuaccacaaau

SEQ ID NO: 2778238 - RNA, 21 nt, Leptospira interrogans serovar lai str. 56601
auguaaaagcuuauacuuuaa

SEQ ID NO: 2778239 - RNA, 22 nt, Leptospira interrogans serovar lai str. 56601
auguaaaagcuuuugcuuuuaa

SEQ ID NO: 2778240 - RNA, 12 nt, Leptospira interrogans serovar lai str. 56601
auguaaaauuuu

SEQ ID NO: 2778241 - RNA, 13 nt, Leptospira interrogans serovar lai str. 56601
auguaaagaaaac

SEQ ID NO: 2778242 - RNA, 14 nt, Leptospira interrogans serovar lai str. 56601
auguaaagaaaacc

SEQ ID NO: 2778243 - RNA, 15 nt, Leptospira interrogans serovar lai str. 56601
auguaaaguucuuuu

SEQ ID NO: 2778244 - RNA, 17 nt, Leptospira interrogans serovar lai str. 56601
auguaacaguaagaaga

SEQ ID NO: 2778245 - RNA, 15 nt, Leptospira interrogans serovar lai str. 56601
auguaagaaaaacua

SEQ ID NO: 2778246 - RNA, 22 nt, Leptospira interrogans serovar lai str. 56601
auguaagcucucguaauaucua

SEQ ID NO: 2778247 - RNA, 15 nt, Leptospira interrogans serovar lai str. 56601
auguaaucuauaaua

SEQ ID NO: 2778248 - RNA, 21 nt, Leptospira interrogans serovar lai str. 56601
auguaaucuauaauaagauuu

SEQ ID NO: 2778249 - RNA, 23 nt, Leptospira interrogans serovar lai str. 56601
auguaaucucgauuucuaaaaug

SEQ ID NO: 2778250 - RNA, 13 nt, Leptospira interrogans serovar lai str. 56601
auguaauuccaga

SEQ ID NO: 2778251 - RNA, 14 nt, Leptospira interrogans serovar lai str. 56601
auguaauuccagag

SEQ ID NO: 2778252 - RNA, 15 nt, Leptospira interrogans serovar lai str. 56601
auguacaauuaaagu

SEQ ID NO: 2778253 - RNA, 23 nt, Leptospira interrogans serovar lai str. 56601
auguacuaaaauuuuauaaaaau

SEQ ID NO: 2778254 - RNA, 15 nt, Leptospira interrogans serovar lai str. 56601
auguagaguaaauuu

SEQ ID NO: 2778255 - RNA, 20 nt, Leptospira interrogans serovar lai str. 56601
auguagauccuagcuauuuu

SEQ ID NO: 2778256 - RNA, 15 nt, Leptospira interrogans serovar lai str. 56601
auguaguaacuacua

SEQ ID NO: 2778257 - RNA, 16 nt, Leptospira interrogans serovar lai str. 56601
auguauaaaaauaaua

SEQ ID NO: 2778258 - RNA, 15 nt, Leptospira interrogans serovar lai str. 56601
auguauauaaauuua

SEQ ID NO: 2778259 - RNA, 19 nt, Leptospira interrogans serovar lai str. 56601
auguauauucguuguuucu

SEQ ID NO: 2778260 - RNA, 20 nt, Leptospira interrogans serovar lai str. 56601
auguauccaauccaaaauug

SEQ ID NO: 2778261 - RNA, 22 nt, Leptospira interrogans serovar lai str. 56601
auguauuacucagaguuauaua

SEQ ID NO: 2778262 - RNA, 21 nt, Leptospira interrogans serovar lai str. 56601
auguauuccaugguuuuuuca

SEQ ID NO: 2778263 - RNA, 19 nt, Leptospira interrogans serovar lai str. 56601
auguccggguuagaaucaa

SEQ ID NO: 2778264 - RNA, 17 nt, Leptospira interrogans serovar lai str. 56601
auguccuuuuuuucuuu

SEQ ID NO: 2778265 - RNA, 22 nt, Leptospira interrogans serovar lai str. 56601
auguccuuuuuuucuuuuaaaa

SEQ ID NO: 2778266 - RNA, 22 nt, Leptospira interrogans serovar lai str. 56601
augucguacuaaaauuaaaaau

SEQ ID NO: 2778267 - RNA, 22 nt, Leptospira interrogans serovar lai str. 56601
augucuacuugucuuuagaacu

SEQ ID NO: 2778268 - RNA, 13 nt, Leptospira interrogans serovar lai str. 56601
augugaauucaga

SEQ ID NO: 2778269 - RNA, 18 nt, Leptospira interrogans serovar lai str. 56601
augugaauucagaaaaaa

SEQ ID NO: 2778270 - RNA, 21 nt, Leptospira interrogans serovar lai str. 56601
augugacuuaaucugugggaa

SEQ ID NO: 2778271 - RNA, 14 nt, Leptospira interrogans serovar lai str. 56601
augugacuuuaauu

SEQ ID NO: 2778272 - RNA, 22 nt, Leptospira interrogans serovar lai str. 56601
augugacuuuaauuuuaguaaa

SEQ ID NO: 2778273 - RNA, 23 nt, Leptospira interrogans serovar lai str. 56601
augugacuuuaauuuuaguaaaa

SEQ ID NO: 2778274 - RNA, 20 nt, Leptospira interrogans serovar lai str. 56601
augugaguuuuaaaacucac

SEQ ID NO: 2778275 - RNA, 21 nt, Leptospira interrogans serovar lai str. 56601
auguggaugauaaaaaacgaa

SEQ ID NO: 2778276 - RNA, 19 nt, Leptospira interrogans serovar lai str. 56601
augugggaacuaccacaaa

SEQ ID NO: 2778277 - RNA, 15 nt, Leptospira interrogans serovar lai str. 56601
augugggaacuacua

SEQ ID NO: 2778278 - RNA, 21 nt, Leptospira interrogans serovar lai str. 56601
augugggaacuacuacaaaaa

SEQ ID NO: 2778279 - RNA, 22 nt, Leptospira interrogans serovar lai str. 56601
augugggaacuacuacaaauca

SEQ ID NO: 2778280 - RNA, 20 nt, Leptospira interrogans serovar lai str. 56601
augugggaacuacuacaaga

SEQ ID NO: 2778281 - RNA, 18 nt, Leptospira interrogans serovar lai str. 56601
augugggaacucccacaa

SEQ ID NO: 2778282 - RNA, 17 nt, Leptospira interrogans serovar lai str. 56601
augugggaacucucaca

SEQ ID NO: 2778283 - RNA, 13 nt, Leptospira interrogans serovar lai str. 56601
augugguaacuac

SEQ ID NO: 2778284 - RNA, 15 nt, Leptospira interrogans serovar lai str. 56601
augugguaguuccca

SEQ ID NO: 2778285 - RNA, 14 nt, Leptospira interrogans serovar lai str. 56601
augugguuuccuug

SEQ ID NO: 2778286 - RNA, 15 nt, Leptospira interrogans serovar lai str. 56601
auguguugucuacga

SEQ ID NO: 2778287 - RNA, 23 nt, Leptospira interrogans serovar lai str. 56601
auguuaaaaaacuauaaaucauu

SEQ ID NO: 2778288 - RNA, 15 nt, Leptospira interrogans serovar lai str. 56601
auuaauuuuucaaca

SEQ ID NO: 2778289 - RNA, 22 nt, Leptospira interrogans serovar lai str. 56601
auuaauuuuucaacaacucuaa

SEQ ID NO: 2778290 - RNA, 15 nt, Leptospira interrogans serovar lai str. 56601
auuaauuuuucaaua

SEQ ID NO: 2778291 - RNA, 14 nt, Leptospira interrogans serovar lai str. 56601
auuaauuuuuuaaa

SEQ ID NO: 2778292 - RNA, 15 nt, Leptospira interrogans serovar lai str. 56601
auuaauuuuuuaaaa

SEQ ID NO: 2778293 - RNA, 14 nt, Leptospira interrogans serovar lai str. 56601
auuacaaaacuuag

SEQ ID NO: 2778294 - RNA, 15 nt, Leptospira interrogans serovar lai str. 56601
auuacaaaaucugaa

SEQ ID NO: 2778295 - RNA, 13 nt, Leptospira interrogans serovar lai str. 56601
auuacaaagcacu

SEQ ID NO: 2778296 - RNA, 15 nt, Leptospira interrogans serovar lai str. 56601
auuacaaaguaucuu

SEQ ID NO: 2778297 - RNA, 22 nt, Leptospira interrogans serovar lai str. 56601
auuacacuucuuuuaugcaauu

SEQ ID NO: 2778298 - RNA, 22 nt, Leptospira interrogans serovar lai str. 56601
auuacagaagggagaauaucua

SEQ ID NO: 2778299 - RNA, 23 nt, Leptospira interrogans serovar lai str. 56601
auuacauaacuaauaaaaacaau

SEQ ID NO: 2778300 - RNA, 23 nt, Leptospira interrogans serovar lai str. 56601
auuacauaaguucgguguaaaaa

SEQ ID NO: 2778301 - RNA, 20 nt, Leptospira interrogans serovar lai str. 56601
auuacauaauaaaguacuaa

SEQ ID NO: 2778302 - RNA, 22 nt, Leptospira interrogans serovar lai str. 56601
auuacgaaaacuauuuuucuuu

SEQ ID NO: 2778303 - RNA, 15 nt, Leptospira interrogans serovar lai str. 56601
auuacgaauuuuuaa

SEQ ID NO: 2778304 - RNA, 18 nt, Leptospira interrogans serovar lai str. 56601
auuacgaauuuuuaaaua

SEQ ID NO: 2778305 - RNA, 20 nt, Leptospira interrogans serovar lai str. 56601
auuacgauuuuuugauucau

SEQ ID NO: 2778306 - RNA, 19 nt, Leptospira interrogans serovar lai str. 56601
auuacgcugauuagaauuc

SEQ ID NO: 2778307 - RNA, 14 nt, Leptospira interrogans serovar lai str. 56601
auuacggguauuuu

SEQ ID NO: 2778308 - RNA, 19 nt, Leptospira interrogans serovar lai str. 56601
auuacguagcgaagaauau

SEQ ID NO: 2778309 - RNA, 20 nt, Leptospira interrogans serovar lai str. 56601
auuacguagcgaagaauauc

SEQ ID NO: 2778310 - RNA, 14 nt, Leptospira interrogans serovar lai str. 56601
auuacuacagacaa

SEQ ID NO: 2778311 - RNA, 20 nt, Leptospira interrogans serovar lai str. 56601
auuacuauggaauauaaaag

SEQ ID NO: 2778312 - RNA, 22 nt, Leptospira interrogans serovar lai str. 56601
auuacuauggaauauaaaagaa

SEQ ID NO: 2778313 - RNA, 18 nt, Leptospira interrogans serovar lai str. 56601
auuacucggauguauaaa

SEQ ID NO: 2778314 - RNA, 13 nt, Leptospira interrogans serovar lai str. 56601
auuacucuuugag

SEQ ID NO: 2778315 - RNA, 16 nt, Leptospira interrogans serovar lai str. 56601
auuacucuuugagaaa

SEQ ID NO: 2778316 - RNA, 19 nt, Leptospira interrogans serovar lai str. 56601
auuacugauuucaaaaaua

SEQ ID NO: 2778317 - RNA, 17 nt, Leptospira interrogans serovar lai str. 56601
auuacuucaauugucca

SEQ ID NO: 2778318 - RNA, 20 nt, Leptospira interrogans serovar lai str. 56601
auuacuucaauuguccauuu

SEQ ID NO: 2778319 - RNA, 14 nt, Leptospira interrogans serovar lai str. 56601
auuacuuuuuaaac

SEQ ID NO: 2778320 - RNA, 22 nt, Leptospira interrogans serovar lai str. 56601
auuagaaaaaaaguauauauua

SEQ ID NO: 2778321 - RNA, 16 nt, Leptospira interrogans serovar lai str. 56601
auuagaacuacucaca

SEQ ID NO: 2778322 - RNA, 18 nt, Leptospira interrogans serovar lai str. 56601
auuagaacuacucacaaa

SEQ ID NO: 2778323 - RNA, 19 nt, Leptospira interrogans serovar lai str. 56601
auuagaacuguguuucuaa

SEQ ID NO: 2778324 - RNA, 13 nt, Leptospira interrogans serovar lai str. 56601
auuagaagaauug

SEQ ID NO: 2778325 - RNA, 19 nt, Leptospira interrogans serovar lai str. 56601
auuagaauguaaaugaauu

SEQ ID NO: 2778326 - RNA, 14 nt, Leptospira interrogans serovar lai str. 56601
auuagaauuguuga

SEQ ID NO: 2778327 - RNA, 15 nt, Leptospira interrogans serovar lai str. 56601
auuagaauuguugaa

SEQ ID NO: 2778328 - RNA, 18 nt, Leptospira interrogans serovar lai str. 56601
auuagaauuguugaaaaa

SEQ ID NO: 2778329 - RNA, 23 nt, Leptospira interrogans serovar lai str. 56601
auuagaauuguugaaaaacucca

SEQ ID NO: 2778330 - RNA, 22 nt, Leptospira interrogans serovar lai str. 56601
auuagaauuuuaugauuuucuu

SEQ ID NO: 2778331 - RNA, 23 nt, Leptospira interrogans serovar lai str. 56601
auuagaauuuuaugauuuucuuu

SEQ ID NO: 2778332 - RNA, 15 nt, Leptospira interrogans serovar lai str. 56601
auuagaauuuuauug

SEQ ID NO: 2778333 - RNA, 15 nt, Leptospira interrogans serovar lai str. 56601
auuagaguuguugaa

SEQ ID NO: 2778334 - RNA, 16 nt, Leptospira interrogans serovar lai str. 56601
auuagaguuucuaaaa

SEQ ID NO: 2778335 - RNA, 21 nt, Leptospira interrogans serovar lai str. 56601
auuagaguuucuaaaaaaauu

SEQ ID NO: 2778336 - RNA, 20 nt, Leptospira interrogans serovar lai str. 56601
auuagaguuugaguuucuuu

SEQ ID NO: 2778337 - RNA, 22 nt, Leptospira interrogans serovar lai str. 56601
auuagaguuugaguuucuuuuu

SEQ ID NO: 2778338 - RNA, 14 nt, Leptospira interrogans serovar lai str. 56601
auuagcaaauuuac

SEQ ID NO: 2778339 - RNA, 17 nt, Leptospira interrogans serovar lai str. 56601
auuagcaugaaauuuuc

SEQ ID NO: 2778340 - RNA, 19 nt, Leptospira interrogans serovar lai str. 56601
auuagcaugaaauuuucuu

SEQ ID NO: 2778341 - RNA, 21 nt, Leptospira interrogans serovar lai str. 56601
auuagcguguaugguaaaaau

SEQ ID NO: 2778342 - RNA, 22 nt, Leptospira interrogans serovar lai str. 56601
auuagcguguaugguaaaaaua

SEQ ID NO: 2778343 - RNA, 21 nt, Leptospira interrogans serovar lai str. 56601
auuagcucuuguuaaaauaaa

SEQ ID NO: 2778344 - RNA, 22 nt, Leptospira interrogans serovar lai str. 56601
auuagcucuuguuaaaauaaaa

SEQ ID NO: 2778345 - RNA, 23 nt, Leptospira interrogans serovar lai str. 56601
auuagcucuuguuaaaauaaaaa

SEQ ID NO: 2778346 - RNA, 13 nt, Leptospira interrogans serovar lai str. 56601
auuagcuuaacuu

SEQ ID NO: 2778347 - RNA, 18 nt, Leptospira interrogans serovar lai str. 56601
auuagcuuaacuucggua

SEQ ID NO: 2778348 - RNA, 16 nt, Leptospira interrogans serovar lai str. 56601
auuagcuuaagaauuu

SEQ ID NO: 2778349 - RNA, 19 nt, Leptospira interrogans serovar lai str. 56601
auuaguacuuuugaauuua

SEQ ID NO: 2778350 - RNA, 13 nt, Leptospira interrogans serovar lai str. 56601
auuaguuuucuuc

SEQ ID NO: 2778351 - RNA, 22 nt, Leptospira interrogans serovar lai str. 56601
auuaguuuucuucuauuucuua

SEQ ID NO: 2778352 - RNA, 14 nt, Leptospira interrogans serovar lai str. 56601
auuauaaaaacaag

SEQ ID NO: 2778353 - RNA, 16 nt, Leptospira interrogans serovar lai str. 56601
auuauaaaaacaaguu

SEQ ID NO: 2778354 - RNA, 20 nt, Leptospira interrogans serovar lai str. 56601
auuauaaaaacaaguuuaaa

SEQ ID NO: 2778355 - RNA, 15 nt, Leptospira interrogans serovar lai str. 56601
auuauaaaauuuuuc

SEQ ID NO: 2778356 - RNA, 21 nt, Leptospira interrogans serovar lai str. 56601
auuauaaacagucgcuaaacu

SEQ ID NO: 2778357 - RNA, 20 nt, Leptospira interrogans serovar lai str. 56601
auuauaaacuucuauuuuau

SEQ ID NO: 2778358 - RNA, 16 nt, Leptospira interrogans serovar lai str. 56601
auuauaaauacaaaaa

SEQ ID NO: 2778359 - RNA, 12 nt, Leptospira interrogans serovar lai str. 56601
auuauaaauuua

SEQ ID NO: 2778360 - RNA, 17 nt, Leptospira interrogans serovar lai str. 56601
auuauaaauuuaaaaaa

SEQ ID NO: 2778361 - RNA, 21 nt, Leptospira interrogans serovar lai str. 56601
auuauaaauuuaaaaaaccgc

SEQ ID NO: 2778362 - RNA, 24 nt, Leptospira interrogans serovar lai str. 56601
auuauaaauuuauaaauguaggaa

SEQ ID NO: 2778363 - RNA, 17 nt, Leptospira interrogans serovar lai str. 56601
auuauaaauuuugagcc

SEQ ID NO: 2778364 - RNA, 18 nt, Leptospira interrogans serovar lai str. 56601
auuauaaguagaaauuua

SEQ ID NO: 2778365 - RNA, 19 nt, Leptospira interrogans serovar lai str. 56601
auuauaaucuuuguaugag

SEQ ID NO: 2778366 - RNA, 19 nt, Leptospira interrogans serovar lai str. 56601
auuauaauucucuuuuugg

SEQ ID NO: 2778367 - RNA, 17 nt, Leptospira interrogans serovar lai str. 56601
auuauaauugauucgau

SEQ ID NO: 2778368 - RNA, 15 nt, Leptospira interrogans serovar lai str. 56601
auuauaauuuuaaau

SEQ ID NO: 2778369 - RNA, 21 nt, Leptospira interrogans serovar lai str. 56601
auuauacaaaacucuuuaaaa

SEQ ID NO: 2778370 - RNA, 15 nt, Leptospira interrogans serovar lai str. 56601
auucacugaaaauuu

SEQ ID NO: 2778371 - RNA, 16 nt, Leptospira interrogans serovar lai str. 56601
auucacugaaaauuua

SEQ ID NO: 2778372 - RNA, 21 nt, Leptospira interrogans serovar lai str. 56601
auucacuuguuauuaaaaucu

SEQ ID NO: 2778373 - RNA, 19 nt, Leptospira interrogans serovar lai str. 56601
auucacuuuuccaaauaua

SEQ ID NO: 2778374 - RNA, 18 nt, Leptospira interrogans serovar lai str. 56601
auucagaaaaaaaaucug

SEQ ID NO: 2778375 - RNA, 20 nt, Leptospira interrogans serovar lai str. 56601
auucagaaaacagaauguau

SEQ ID NO: 2778376 - RNA, 20 nt, Leptospira interrogans serovar lai str. 56601
auucagacacgguccuacau

SEQ ID NO: 2778377 - RNA, 20 nt, Leptospira interrogans serovar lai str. 56601
auucagagugguuucuuaug

SEQ ID NO: 2778378 - RNA, 21 nt, Leptospira interrogans serovar lai str. 56601
auucaggugggaguuuagaac

SEQ ID NO: 2778379 - RNA, 13 nt, Leptospira interrogans serovar lai str. 56601
auucaguuucaaa

SEQ ID NO: 2778380 - RNA, 15 nt, Leptospira interrogans serovar lai str. 56601
auucaguuuccacuc

SEQ ID NO: 2778381 - RNA, 16 nt, Leptospira interrogans serovar lai str. 56601
auucauaacuauauaa

SEQ ID NO: 2778382 - RNA, 17 nt, Leptospira interrogans serovar lai str. 56601
auucauacuuuuaaaaa

SEQ ID NO: 2778383 - RNA, 18 nt, Leptospira interrogans serovar lai str. 56601
auucauacuuuuaaaaag

SEQ ID NO: 2778384 - RNA, 19 nt, Leptospira interrogans serovar lai str. 56601
auucauacuuuuaaaaagu

SEQ ID NO: 2778385 - RNA, 20 nt, Leptospira interrogans serovar lai str. 56601
auucauauugagauaaaaag

SEQ ID NO: 2778386 - RNA, 23 nt, Leptospira interrogans serovar lai str. 56601
auucaucaauuuuggaaagcccc

SEQ ID NO: 2778387 - RNA, 17 nt, Leptospira interrogans serovar lai str. 56601
auucaucgcuuuuaaau

SEQ ID NO: 2778388 - RNA, 20 nt, Leptospira interrogans serovar lai str. 56601
auucauuccuauaaauaaau

SEQ ID NO: 2778389 - RNA, 12 nt, Leptospira interrogans serovar lai str. 56601
auucauucuaag

SEQ ID NO: 2778390 - RNA, 14 nt, Leptospira interrogans serovar lai str. 56601
auucauuuaaaaau

SEQ ID NO: 2778391 - RNA, 15 nt, Leptospira interrogans serovar lai str. 56601
auucauuuaaaaauu

SEQ ID NO: 2778392 - RNA, 21 nt, Leptospira interrogans serovar lai str. 56601
auucauuuaaaaauugaucuc

SEQ ID NO: 2778393 - RNA, 19 nt, Leptospira interrogans serovar lai str. 56601
auucauuuggaucuguaau

SEQ ID NO: 2778394 - RNA, 13 nt, Leptospira interrogans serovar lai str. 56601
auucauuuucuau

SEQ ID NO: 2778395 - RNA, 17 nt, Leptospira interrogans serovar lai str. 56601
auucauuuuuauuuuua

SEQ ID NO: 2778396 - RNA, 12 nt, Leptospira interrogans serovar lai str. 56601
auucauuuuucu

SEQ ID NO: 2778397 - RNA, 18 nt, Leptospira interrogans serovar lai str. 56601
auucauuuuucuaaaaaa

SEQ ID NO: 2778398 - RNA, 19 nt, Leptospira interrogans serovar lai str. 56601
auucauuuuucuaaaaaaa

SEQ ID NO: 2778399 - RNA, 13 nt, Leptospira interrogans serovar lai str. 56601
auucauuuuucug

SEQ ID NO: 2778400 - RNA, 14 nt, Leptospira interrogans serovar lai str. 56601
auucauuuuucuga

SEQ ID NO: 2778401 - RNA, 18 nt, Leptospira interrogans serovar lai str. 56601
auucauuuuucugaaaaa

SEQ ID NO: 2778402 - RNA, 19 nt, Leptospira interrogans serovar lai str. 56601
auucauuuuucugaaaaaa

SEQ ID NO: 2778403 - RNA, 19 nt, Leptospira interrogans serovar lai str. 56601
auucauuuuucugaaaaag

SEQ ID NO: 2778404 - RNA, 21 nt, Leptospira interrogans serovar lai str. 56601
auucauuuuuucuaaauuaga

SEQ ID NO: 2778405 - RNA, 17 nt, Leptospira interrogans serovar lai str. 56601
auucauuuuuugaaaaa

SEQ ID NO: 2778406 - RNA, 18 nt, Leptospira interrogans serovar lai str. 56601
auuccaaagauaaaaaag

SEQ ID NO: 2778407 - RNA, 23 nt, Leptospira interrogans serovar lai str. 56601
auuccaacuuuuucagaaaaaug

SEQ ID NO: 2778408 - RNA, 16 nt, Leptospira interrogans serovar lai str. 56601
auuccaagauuuuuua

SEQ ID NO: 2778409 - RNA, 18 nt, Leptospira interrogans serovar lai str. 56601
auuccaagcaauucuaag

SEQ ID NO: 2778410 - RNA, 13 nt, Leptospira interrogans serovar lai str. 56601
auuccaauuuuuc

SEQ ID NO: 2778411 - RNA, 14 nt, Leptospira interrogans serovar lai str. 56601
auuccaauuuuucu

SEQ ID NO: 2778412 - RNA, 16 nt, Leptospira interrogans serovar lai str. 56601
auuccaauuuuucuga

SEQ ID NO: 2778413 - RNA, 22 nt, Leptospira interrogans serovar lai str. 56601
auuccacuaugaaaguuuuuca

SEQ ID NO: 2778414 - RNA, 13 nt, Leptospira interrogans serovar lai str. 56601
auuccacuucuca

SEQ ID NO: 2778415 - RNA, 15 nt, Leptospira interrogans serovar lai str. 56601
auuccacuucucaca

SEQ ID NO: 2778416 - RNA, 16 nt, Leptospira interrogans serovar lai str. 56601
auuccagaaguauuuu

SEQ ID NO: 2778417 - RNA, 19 nt, Leptospira interrogans serovar lai str. 56601
auuccagaggcaguacaau

SEQ ID NO: 2778418 - RNA, 18 nt, Leptospira interrogans serovar lai str. 56601
auuccauaaugaagauga

SEQ ID NO: 2778419 - RNA, 21 nt, Leptospira interrogans serovar lai str. 56601
auuccauaggcaauugcguuc

SEQ ID NO: 2778420 - RNA, 18 nt, Leptospira interrogans serovar lai str. 56601
auuccauagugaagauuu

SEQ ID NO: 2778421 - RNA, 20 nt, Leptospira interrogans serovar lai str. 56601
auuccaucguuuauuuuucu

SEQ ID NO: 2778422 - RNA, 17 nt, Leptospira interrogans serovar lai str. 56601
auuccaugguuuuuuca

SEQ ID NO: 2778423 - RNA, 15 nt, Leptospira interrogans serovar lai str. 56601
auuccauucuucaaa

SEQ ID NO: 2778424 - RNA, 15 nt, Leptospira interrogans serovar lai str. 56601
auuccauugauuuuc

SEQ ID NO: 2778425 - RNA, 20 nt, Leptospira interrogans serovar lai str. 56601
auuccauugauuuucauuuu

SEQ ID NO: 2778426 - RNA, 21 nt, Leptospira interrogans serovar lai str. 56601
auuccauuuuuuagaauccca

SEQ ID NO: 2778427 - RNA, 14 nt, Leptospira interrogans serovar lai str. 56601
auucccaguaaauc

SEQ ID NO: 2778428 - RNA, 16 nt, Leptospira interrogans serovar lai str. 56601
auucccaguaaaucca

SEQ ID NO: 2778429 - RNA, 22 nt, Leptospira interrogans serovar lai str. 56601
auucccaguaaauccacaaguu

SEQ ID NO: 2778430 - RNA, 19 nt, Leptospira interrogans serovar lai str. 56601
auucccauccgaaauccca

SEQ ID NO: 2778431 - RNA, 14 nt, Leptospira interrogans serovar lai str. 56601
auuccccaaaauga

SEQ ID NO: 2778432 - RNA, 17 nt, Leptospira interrogans serovar lai str. 56601
auucccccgguucuagg

SEQ ID NO: 2778433 - RNA, 17 nt, Leptospira interrogans serovar lai str. 56601
auucccucaauaaucca

SEQ ID NO: 2778434 - RNA, 15 nt, Leptospira interrogans serovar lai str. 56601
auucccuuaaucauu

SEQ ID NO: 2778435 - RNA, 16 nt, Leptospira interrogans serovar lai str. 56601
auucccuuaaucauuu

SEQ ID NO: 2778436 - RNA, 14 nt, Leptospira interrogans serovar lai str. 56601
auucccuucuccug

SEQ ID NO: 2778437 - RNA, 16 nt, Leptospira interrogans serovar lai str. 56601
auucccuuuugaucuu

SEQ ID NO: 2778438 - RNA, 21 nt, Leptospira interrogans serovar lai str. 56601
auucccuuuugaucuuuaaaa

SEQ ID NO: 2778439 - RNA, 14 nt, Leptospira interrogans serovar lai str. 56601
auuccgaaggaauu

SEQ ID NO: 2778440 - RNA, 16 nt, Leptospira interrogans serovar lai str. 56601
auuccgacccagaaaa

SEQ ID NO: 2778441 - RNA, 15 nt, Leptospira interrogans serovar lai str. 56601
auuccgacgauagau

SEQ ID NO: 2778442 - RNA, 17 nt, Leptospira interrogans serovar lai str. 56601
auuccgcaaaaauuccu

SEQ ID NO: 2778443 - RNA, 16 nt, Leptospira interrogans serovar lai str. 56601
auuccguacuguuuuu

SEQ ID NO: 2778444 - RNA, 18 nt, Leptospira interrogans serovar lai str. 56601
auuccgucauaaguguau

SEQ ID NO: 2778445 - RNA, 21 nt, Leptospira interrogans serovar lai str. 56601
auuccuaaaugccgccccaua

SEQ ID NO: 2778446 - RNA, 22 nt, Leptospira interrogans serovar lai str. 56601
auuccuaaugcagcuucuucca

SEQ ID NO: 2778447 - RNA, 13 nt, Leptospira interrogans serovar lai str. 56601
auuccuacuuauu

SEQ ID NO: 2778448 - RNA, 17 nt, Leptospira interrogans serovar lai str. 56601
auuccuagcaguauuuu

SEQ ID NO: 2778449 - RNA, 19 nt, Leptospira interrogans serovar lai str. 56601
auuccuauaaauaaauuua

SEQ ID NO: 2778450 - RNA, 20 nt, Leptospira interrogans serovar lai str. 56601
auuccuccagugcaauacau

SEQ ID NO: 2778451 - RNA, 20 nt, Leptospira interrogans serovar lai str. 56601
auuccuuacucguuuuuagu

SEQ ID NO: 2778452 - RNA, 17 nt, Leptospira interrogans serovar lai str. 56601
auuccuuccaaguuuuu

SEQ ID NO: 2778453 - RNA, 21 nt, Leptospira interrogans serovar lai str. 56601
auucuccuccugaaaauuuuc

SEQ ID NO: 2778454 - RNA, 22 nt, Leptospira interrogans serovar lai str. 56601
auucuccuccugaaaauuuucc

SEQ ID NO: 2778455 - RNA, 23 nt, Leptospira interrogans serovar lai str. 56601
auucuccuccugaaaauuuuccu

SEQ ID NO: 2778456 - RNA, 15 nt, Leptospira interrogans serovar lai str. 56601
auucuccucuucacc

SEQ ID NO: 2778457 - RNA, 21 nt, Leptospira interrogans serovar lai str. 56601
auucucgcauuuuccuuuuuc

SEQ ID NO: 2778458 - RNA, 20 nt, Leptospira interrogans serovar lai str. 56601
auucucuauggguuuucguu

SEQ ID NO: 2778459 - RNA, 21 nt, Leptospira interrogans serovar lai str. 56601
auucucuauggguuuucguug

SEQ ID NO: 2778460 - RNA, 17 nt, Leptospira interrogans serovar lai str. 56601
auucucuuuugaccaaa

SEQ ID NO: 2778461 - RNA, 17 nt, Leptospira interrogans serovar lai str. 56601
auucugaaaaaaguuag

SEQ ID NO: 2778462 - RNA, 19 nt, Leptospira interrogans serovar lai str. 56601
auucugaaaaaaguuggga

SEQ ID NO: 2778463 - RNA, 15 nt, Leptospira interrogans serovar lai str. 56601
auucugaaaauguaa

SEQ ID NO: 2778464 - RNA, 14 nt, Leptospira interrogans serovar lai str. 56601
auucugaaagaguu

SEQ ID NO: 2778465 - RNA, 13 nt, Leptospira interrogans serovar lai str. 56601
auucugaauaauu

SEQ ID NO: 2778466 - RNA, 16 nt, Leptospira interrogans serovar lai str. 56601
auucugaauauuuuau

SEQ ID NO: 2778467 - RNA, 18 nt, Leptospira interrogans serovar lai str. 56601
auucugauaacuauauaa

SEQ ID NO: 2778468 - RNA, 19 nt, Leptospira interrogans serovar lai str. 56601
auucugcucauuuuuucuu

SEQ ID NO: 2778469 - RNA, 16 nt, Leptospira interrogans serovar lai str. 56601
auucuggauugaucga

SEQ ID NO: 2778470 - RNA, 19 nt, Leptospira interrogans serovar lai str. 56601
auucuguaaaauaaauuua

SEQ ID NO: 2778471 - RNA, 14 nt, Leptospira interrogans serovar lai str. 56601
auucuguuuuacaa

SEQ ID NO: 2778472 - RNA, 14 nt, Leptospira interrogans serovar lai str. 56601
auucuuaaaaauuu

SEQ ID NO: 2778473 - RNA, 20 nt, Leptospira interrogans serovar lai str. 56601
auucuuaaaauguaggaacu

SEQ ID NO: 2778474 - RNA, 15 nt, Leptospira interrogans serovar lai str. 56601
auucuuaauagaauc

SEQ ID NO: 2778475 - RNA, 17 nt, Leptospira interrogans serovar lai str. 56601
auucuuaauagaaucuu

SEQ ID NO: 2778476 - RNA, 17 nt, Leptospira interrogans serovar lai str. 56601
auucuuaauauacuuaa

SEQ ID NO: 2778477 - RNA, 17 nt, Leptospira interrogans serovar lai str. 56601
auucuuaaugucccaga

SEQ ID NO: 2778478 - RNA, 16 nt, Leptospira interrogans serovar lai str. 56601
auucuuaauuuguuug

SEQ ID NO: 2778479 - RNA, 17 nt, Leptospira interrogans serovar lai str. 56601
auucuuagaauuuuccu

SEQ ID NO: 2778480 - RNA, 17 nt, Leptospira interrogans serovar lai str. 56601
auucuuauguuuuuuau

SEQ ID NO: 2778481 - RNA, 19 nt, Leptospira interrogans serovar lai str. 56601
auucuuauguuuuuuaugg

SEQ ID NO: 2778482 - RNA, 17 nt, Leptospira interrogans serovar lai str. 56601
auucuucaaauaacauu

SEQ ID NO: 2778483 - RNA, 23 nt, Leptospira interrogans serovar lai str. 56601
auucuucaaauaacauuuuuuca

SEQ ID NO: 2778484 - RNA, 19 nt, Leptospira interrogans serovar lai str. 56601
auucuuccgggaggaauuu

SEQ ID NO: 2778485 - RNA, 22 nt, Leptospira interrogans serovar lai str. 56601
auucuuccgggaggaauuuuua

SEQ ID NO: 2778486 - RNA, 13 nt, Leptospira interrogans serovar lai str. 56601
auucuuccuucuu

SEQ ID NO: 2778487 - RNA, 15 nt, Leptospira interrogans serovar lai str. 56601
auucuuccuucuuga

SEQ ID NO: 2778488 - RNA, 16 nt, Leptospira interrogans serovar lai str. 56601
auucuuccuuuuucau

SEQ ID NO: 2778489 - RNA, 15 nt, Leptospira interrogans serovar lai str. 56601
auucuucuccucuuc

SEQ ID NO: 2778490 - RNA, 20 nt, Leptospira interrogans serovar lai str. 56601
auucuucuccucuuccggaa

SEQ ID NO: 2778491 - RNA, 18 nt, Leptospira interrogans serovar lai str. 56601
auucuucuuucguuugag

SEQ ID NO: 2778492 - RNA, 17 nt, Leptospira interrogans serovar lai str. 56601
auucuugauugguugug

SEQ ID NO: 2778493 - RNA, 14 nt, Leptospira interrogans serovar lai str. 56601
auucuuuaaaauuu

SEQ ID NO: 2778494 - RNA, 19 nt, Leptospira interrogans serovar lai str. 56601
auucuuuaaaauuuuuaau

SEQ ID NO: 2778495 - RNA, 19 nt, Leptospira interrogans serovar lai str. 56601
auucuuuaaaugugggaac

SEQ ID NO: 2778496 - RNA, 14 nt, Leptospira interrogans serovar lai str. 56601
auucuuuagaaauu

SEQ ID NO: 2778497 - RNA, 16 nt, Leptospira interrogans serovar lai str. 56601
auucuuuagaaauuuu

SEQ ID NO: 2778498 - RNA, 19 nt, Leptospira interrogans serovar lai str. 56601
auucuuuagaaauuuuuaa

SEQ ID NO: 2778499 - RNA, 17 nt, Leptospira interrogans serovar lai str. 56601
auucuuuccaaccauuu

SEQ ID NO: 2778500 - RNA, 16 nt, Leptospira interrogans serovar lai str. 56601
auucuuucuauuuuuu

SEQ ID NO: 2778501 - RNA, 19 nt, Leptospira interrogans serovar lai str. 56601
auucuuucuauuuuuuccg

SEQ ID NO: 2778502 - RNA, 16 nt, Leptospira interrogans serovar lai str. 56601
auucuuugagauuuug

SEQ ID NO: 2778503 - RNA, 18 nt, Leptospira interrogans serovar lai str. 56601
auucuuuggaaauuuuua

SEQ ID NO: 2778504 - RNA, 12 nt, Leptospira interrogans serovar lai str. 56601
auucuuuguuuu

SEQ ID NO: 2778505 - RNA, 21 nt, Leptospira interrogans serovar lai str. 56601
auucuuuucugaauaaaaaua

SEQ ID NO: 2778506 - RNA, 23 nt, Leptospira interrogans serovar lai str. 56601
auucuuuucugaauaaaaauacu

SEQ ID NO: 2778507 - RNA, 16 nt, Leptospira interrogans serovar lai str. 56601
auucuuuuuauuuuua

SEQ ID NO: 2778508 - RNA, 22 nt, Leptospira interrogans serovar lai str. 56601
auugaaaaauagaauuguugaa

SEQ ID NO: 2778509 - RNA, 12 nt, Leptospira interrogans serovar lai str. 56601
auugaaacaaaa

SEQ ID NO: 2778510 - RNA, 22 nt, Leptospira interrogans serovar lai str. 56601
auugaaacguuuucaaaaaauu

SEQ ID NO: 2778511 - RNA, 21 nt, Leptospira interrogans serovar lai str. 56601
auugaaacuauacuuucaaaa

SEQ ID NO: 2778512 - RNA, 21 nt, Leptospira interrogans serovar lai str. 56601
auugaaaguaucagaaucaaa

SEQ ID NO: 2778513 - RNA, 14 nt, Leptospira interrogans serovar lai str. 56601
auugaaauagaauc

SEQ ID NO: 2778514 - RNA, 22 nt, Leptospira interrogans serovar lai str. 56601
auugaaaucugaacuuugcaga

SEQ ID NO: 2778515 - RNA, 17 nt, Leptospira interrogans serovar lai str. 56601
auugaacauuuuuaaaa

SEQ ID NO: 2778516 - RNA, 21 nt, Leptospira interrogans serovar lai str. 56601
auugaacgguaaaaucuuuaa

SEQ ID NO: 2778517 - RNA, 23 nt, Leptospira interrogans serovar lai str. 56601
auugaacgguaaaaucuuuaagu

SEQ ID NO: 2778518 - RNA, 22 nt, Leptospira interrogans serovar lai str. 56601
auugaacguaaguuaaauauaa

SEQ ID NO: 2778519 - RNA, 23 nt, Leptospira interrogans serovar lai str. 56601
auugaacguaaguuaaauauaaa

SEQ ID NO: 2778520 - RNA, 17 nt, Leptospira interrogans serovar lai str. 56601
auugaacguaauacaaa

SEQ ID NO: 2778521 - RNA, 17 nt, Leptospira interrogans serovar lai str. 56601
auugaagaaaaaaagau

SEQ ID NO: 2778522 - RNA, 15 nt, Leptospira interrogans serovar lai str. 56601
auugaagauauuuuc

SEQ ID NO: 2778523 - RNA, 17 nt, Leptospira interrogans serovar lai str. 56601
auugaagauauuuuccu

SEQ ID NO: 2778524 - RNA, 19 nt, Leptospira interrogans serovar lai str. 56601
auugaagcaguuuugcuaa

SEQ ID NO: 2778525 - RNA, 21 nt, Leptospira interrogans serovar lai str. 56601
auugaauaucauaaauuuuua

SEQ ID NO: 2778526 - RNA, 22 nt, Leptospira interrogans serovar lai str. 56601
auugaauccaucugagaauuuc

SEQ ID NO: 2778527 - RNA, 22 nt, Leptospira interrogans serovar lai str. 56601
auugaauccuuccuccaaaaua

SEQ ID NO: 2778528 - RNA, 17 nt, Leptospira interrogans serovar lai str. 56601
auugaauuucuucgauu

SEQ ID NO: 2778529 - RNA, 22 nt, Leptospira interrogans serovar lai str. 56601
auugaauuuuuauggaauuguu

SEQ ID NO: 2778530 - RNA, 16 nt, Leptospira interrogans serovar lai str. 56601
auugaauuuuuuaaau

SEQ ID NO: 2778531 - RNA, 19 nt, Leptospira interrogans serovar lai str. 56601
auugaauuuuuuaaaugca

SEQ ID NO: 2778532 - RNA, 14 nt, Leptospira interrogans serovar lai str. 56601
auugacuuucugua

SEQ ID NO: 2778533 - RNA, 19 nt, Leptospira interrogans serovar lai str. 56601
auugagggaauucccacau

SEQ ID NO: 2778534 - RNA, 19 nt, Leptospira interrogans serovar lai str. 56601
auugagucaagauuauuuu

SEQ ID NO: 2778535 - RNA, 21 nt, Leptospira interrogans serovar lai str. 56601
auuuaaauguuuuuguauuuu

SEQ ID NO: 2778536 - RNA, 15 nt, Leptospira interrogans serovar lai str. 56601
auuuaaauuuauaau

SEQ ID NO: 2778537 - RNA, 23 nt, Leptospira interrogans serovar lai str. 56601
auuuaaauuugugguaguuccua

SEQ ID NO: 2778538 - RNA, 22 nt, Leptospira interrogans serovar lai str. 56601
auuuaacucguuagagaaaagc

SEQ ID NO: 2778539 - RNA, 22 nt, Leptospira interrogans serovar lai str. 56601
auuuaacuguaauuagaggaua

SEQ ID NO: 2778540 - RNA, 21 nt, Leptospira interrogans serovar lai str. 56601
auuuaagaaucaucuugcucu

SEQ ID NO: 2778541 - RNA, 16 nt, Leptospira interrogans serovar lai str. 56601
auuuaagauugauuuu

SEQ ID NO: 2778542 - RNA, 21 nt, Leptospira interrogans serovar lai str. 56601
auuuaaguauuauaaauuuug

SEQ ID NO: 2778543 - RNA, 12 nt, Leptospira interrogans serovar lai str. 56601
auuuaaguuuuu

SEQ ID NO: 2778544 - RNA, 20 nt, Leptospira interrogans serovar lai str. 56601
auuuaaguuuuucuuaaaaa

SEQ ID NO: 2778545 - RNA, 19 nt, Leptospira interrogans serovar lai str. 56601
auuuaauaaaaaaaugaau

SEQ ID NO: 2778546 - RNA, 17 nt, Leptospira interrogans serovar lai str. 56601
auuuaauaaaauuuuua

SEQ ID NO: 2778547 - RNA, 12 nt, Leptospira interrogans serovar lai str. 56601
auuuaauauauu

SEQ ID NO: 2778548 - RNA, 21 nt, Leptospira interrogans serovar lai str. 56601
auuuaaugaccacaaacuauc

SEQ ID NO: 2778549 - RNA, 13 nt, Leptospira interrogans serovar lai str. 56601
auuuaauuuuucu

SEQ ID NO: 2778550 - RNA, 22 nt, Leptospira interrogans serovar lai str. 56601
auuuacaaccacuggaauauaa

SEQ ID NO: 2778551 - RNA, 20 nt, Leptospira interrogans serovar lai str. 56601
auuuacaaucgaacggauuc

SEQ ID NO: 2778552 - RNA, 21 nt, Leptospira interrogans serovar lai str. 56601
auuuacacgauaauuuucuuu

SEQ ID NO: 2778553 - RNA, 19 nt, Leptospira interrogans serovar lai str. 56601
auuuacaguuaaacuuuga

SEQ ID NO: 2778554 - RNA, 12 nt, Leptospira interrogans serovar lai str. 56601
auuuacauauau

SEQ ID NO: 2778555 - RNA, 19 nt, Leptospira interrogans serovar lai str. 56601
auuuacauauauaauuuau

SEQ ID NO: 2778556 - RNA, 14 nt, Leptospira interrogans serovar lai str. 56601
auuuaccuaaaauu

SEQ ID NO: 2778557 - RNA, 17 nt, Leptospira interrogans serovar lai str. 56601
auuuaccuaaaauucag

SEQ ID NO: 2778558 - RNA, 21 nt, Leptospira interrogans serovar lai str. 56601
auuuaccuugaaacuuuuaau

SEQ ID NO: 2778559 - RNA, 23 nt, Leptospira interrogans serovar lai str. 56601
auuuaccuugaaacuuuuaauaa

SEQ ID NO: 2778560 - RNA, 19 nt, Leptospira interrogans serovar lai str. 56601
auuuacgauucuaaauuau

SEQ ID NO: 2778561 - RNA, 16 nt, Leptospira interrogans serovar lai str. 56601
auuuacggaacuuaau

SEQ ID NO: 2778562 - RNA, 17 nt, Leptospira interrogans serovar lai str. 56601
auuuacggaacuuaauu

SEQ ID NO: 2778563 - RNA, 21 nt, Leptospira interrogans serovar lai str. 56601
auuuacguaugaguuucucca

SEQ ID NO: 2778564 - RNA, 21 nt, Leptospira interrogans serovar lai str. 56601
auuuacuauuuugaugaauga

SEQ ID NO: 2778565 - RNA, 17 nt, Leptospira interrogans serovar lai str. 56601
auuuacucaaauuaacu

SEQ ID NO: 2778566 - RNA, 18 nt, Leptospira interrogans serovar lai str. 56601
auuuacucuuauaaaauu

SEQ ID NO: 2778567 - RNA, 16 nt, Leptospira interrogans serovar lai str. 56601
auuuacuuuuuccaaa

SEQ ID NO: 2778568 - RNA, 14 nt, Leptospira interrogans serovar lai str. 56601
auuuagaaaauuag

SEQ ID NO: 2778569 - RNA, 20 nt, Leptospira interrogans serovar lai str. 56601
auuuagaaaauuagaaagaa

SEQ ID NO: 2778570 - RNA, 12 nt, Leptospira interrogans serovar lai str. 56601
auuuagaauaaa

SEQ ID NO: 2778571 - RNA, 21 nt, Leptospira interrogans serovar lai str. 56601
auuuagaauuguuaucuguga

SEQ ID NO: 2778572 - RNA, 19 nt, Leptospira interrogans serovar lai str. 56601
auuuagagccaaauuuuua

SEQ ID NO: 2778573 - RNA, 15 nt, Leptospira interrogans serovar lai str. 56601
auuuagauucuaaaa

SEQ ID NO: 2778574 - RNA, 16 nt, Leptospira interrogans serovar lai str. 56601
auuuagauucuaaaaa

SEQ ID NO: 2778575 - RNA, 17 nt, Leptospira interrogans serovar lai str. 56601
auuuagauucuaaaaaa

SEQ ID NO: 2778576 - RNA, 19 nt, Leptospira interrogans serovar lai str. 56601
auuuagauucuaaaaaaag

SEQ ID NO: 2778577 - RNA, 17 nt, Leptospira interrogans serovar lai str. 56601
auuuagauuuguguuag

SEQ ID NO: 2778578 - RNA, 21 nt, Leptospira interrogans serovar lai str. 56601
auuuagauuuguguuaguucc

SEQ ID NO: 2778579 - RNA, 23 nt, Leptospira interrogans serovar lai str. 56601
auuuagauuuguguuaguuccca

SEQ ID NO: 2778580 - RNA, 15 nt, Leptospira interrogans serovar lai str. 56601
auuuagcaauuugug

SEQ ID NO: 2778581 - RNA, 16 nt, Leptospira interrogans serovar lai str. 56601
auuuagcauuuuuaag

SEQ ID NO: 2778582 - RNA, 17 nt, Leptospira interrogans serovar lai str. 56601
auuuagcauuuuuaaga

SEQ ID NO: 2778583 - RNA, 22 nt, Leptospira interrogans serovar lai str. 56601
auuuagccuaauuacgauuuuu

SEQ ID NO: 2778584 - RNA, 21 nt, Leptospira interrogans serovar lai str. 56601
auuuagcuaagucuuuaaaaa

SEQ ID NO: 2778585 - RNA, 17 nt, Leptospira interrogans serovar lai str. 56601
auuuaggaaauuuucaa

SEQ ID NO: 2778586 - RNA, 13 nt, Leptospira interrogans serovar lai str. 56601
auuuaggaaguaa

SEQ ID NO: 2778587 - RNA, 22 nt, Leptospira interrogans serovar lai str. 56601
auuuagguuugugguaguuccc

SEQ ID NO: 2778588 - RNA, 15 nt, Leptospira interrogans serovar lai str. 56601
auuuaguaguaaaua

SEQ ID NO: 2778589 - RNA, 17 nt, Leptospira interrogans serovar lai str. 56601
auuuaguaguaaauaaa

SEQ ID NO: 2778590 - RNA, 22 nt, Leptospira interrogans serovar lai str. 56601
auuuauaaaacaaucuucaaau

SEQ ID NO: 2778591 - RNA, 13 nt, Leptospira interrogans serovar lai str. 56601
auuuauaaaacga

SEQ ID NO: 2778592 - RNA, 17 nt, Leptospira interrogans serovar lai str. 56601
auuuauaaaauaaaaaa

SEQ ID NO: 2778593 - RNA, 16 nt, Leptospira interrogans serovar lai str. 56601
auuuauaauaaaucaa

SEQ ID NO: 2778594 - RNA, 21 nt, Leptospira interrogans serovar lai str. 56601
auuuauacuauaacuuuaaaa

SEQ ID NO: 2778595 - RNA, 22 nt, Leptospira interrogans serovar lai str. 56601
auuuauacuauaacuuuaaaaa

SEQ ID NO: 2778596 - RNA, 19 nt, Leptospira interrogans serovar lai str. 56601
auuuauaggaucguauuuu

SEQ ID NO: 2778597 - RNA, 13 nt, Leptospira interrogans serovar lai str. 56601
auuuauaguuuuu

SEQ ID NO: 2778598 - RNA, 19 nt, Leptospira interrogans serovar lai str. 56601
auuuauauauauucacaaa

SEQ ID NO: 2778599 - RNA, 16 nt, Leptospira interrogans serovar lai str. 56601
auuuauaugauuuuau

SEQ ID NO: 2778600 - RNA, 23 nt, Leptospira interrogans serovar lai str. 56601
auuuauauucgcuccguuuugaa

SEQ ID NO: 2778601 - RNA, 20 nt, Leptospira interrogans serovar lai str. 56601
auuuauauugagaucaaaua

SEQ ID NO: 2778602 - RNA, 17 nt, Leptospira interrogans serovar lai str. 56601
auuuauauuucuaaaag

SEQ ID NO: 2778603 - RNA, 16 nt, Leptospira interrogans serovar lai str. 56601
auuuauauuuuuugaa

SEQ ID NO: 2778604 - RNA, 15 nt, Leptospira interrogans serovar lai str. 56601
auuuaucauuucuuu

SEQ ID NO: 2778605 - RNA, 16 nt, Leptospira interrogans serovar lai str. 56601
auuuaucgauuuaaaa

SEQ ID NO: 2778606 - RNA, 20 nt, Leptospira interrogans serovar lai str. 56601
auuuaucgauuuaaaaacua

SEQ ID NO: 2778607 - RNA, 18 nt, Leptospira interrogans serovar lai str. 56601
auuuaucuguaaaauuug

SEQ ID NO: 2778608 - RNA, 20 nt, Leptospira interrogans serovar lai str. 56601
auuuaucuguaaaauuugga

SEQ ID NO: 2778609 - RNA, 18 nt, Leptospira interrogans serovar lai str. 56601
auuuauguacuuuuaaga

SEQ ID NO: 2778610 - RNA, 19 nt, Leptospira interrogans serovar lai str. 56601
auuuauguacuuuuaagaa

SEQ ID NO: 2778611 - RNA, 17 nt, Leptospira interrogans serovar lai str. 56601
auuuauguucguuccca

SEQ ID NO: 2778612 - RNA, 13 nt, Leptospira interrogans serovar lai str. 56601
auuuauucaaaau

SEQ ID NO: 2778613 - RNA, 13 nt, Leptospira interrogans serovar lai str. 56601
auuuauucucuau

SEQ ID NO: 2778614 - RNA, 16 nt, Leptospira interrogans serovar lai str. 56601
auuuauugaaaaauag

SEQ ID NO: 2778615 - RNA, 18 nt, Leptospira interrogans serovar lai str. 56601
auuuauuucaaaauuuau

SEQ ID NO: 2778616 - RNA, 16 nt, Leptospira interrogans serovar lai str. 56601
auuuauuuguaaaucc

SEQ ID NO: 2778617 - RNA, 17 nt, Leptospira interrogans serovar lai str. 56601
auuucuauaaaauugag

SEQ ID NO: 2778618 - RNA, 23 nt, Leptospira interrogans serovar lai str. 56601
auuucuauaaaauugaguuucua

SEQ ID NO: 2778619 - RNA, 18 nt, Leptospira interrogans serovar lai str. 56601
auuucuauaaauugagua

SEQ ID NO: 2778620 - RNA, 15 nt, Leptospira interrogans serovar lai str. 56601
auuucuauauucaaa

SEQ ID NO: 2778621 - RNA, 13 nt, Leptospira interrogans serovar lai str. 56601
auuucuauccauu

SEQ ID NO: 2778622 - RNA, 15 nt, Leptospira interrogans serovar lai str. 56601
auuucuauccauucu

SEQ ID NO: 2778623 - RNA, 12 nt, Leptospira interrogans serovar lai str. 56601
auuucuauuuuu

SEQ ID NO: 2778624 - RNA, 22 nt, Leptospira interrogans serovar lai str. 56601
auuucucuaauucuaaaaauuu

SEQ ID NO: 2778625 - RNA, 19 nt, Leptospira interrogans serovar lai str. 56601
auuucugcaaaaaccguuc

SEQ ID NO: 2778626 - RNA, 12 nt, Leptospira interrogans serovar lai str. 56601
auuucugcugcu

SEQ ID NO: 2778627 - RNA, 13 nt, Leptospira interrogans serovar lai str. 56601
auuucugcugcuu

SEQ ID NO: 2778628 - RNA, 19 nt, Leptospira interrogans serovar lai str. 56601
auuucugcuucuaagugga

SEQ ID NO: 2778629 - RNA, 16 nt, Leptospira interrogans serovar lai str. 56601
auuucuggaaauucug

SEQ ID NO: 2778630 - RNA, 14 nt, Leptospira interrogans serovar lai str. 56601
auuucugugggaac

SEQ ID NO: 2778631 - RNA, 11 nt, Leptospira interrogans serovar lai str. 56601
auuucuuaaaa

SEQ ID NO: 2778632 - RNA, 14 nt, Leptospira interrogans serovar lai str. 56601
auuucuuaaaagau

SEQ ID NO: 2778633 - RNA, 20 nt, Leptospira interrogans serovar lai str. 56601
auuucuuaaauucuaaaaaa

SEQ ID NO: 2778634 - RNA, 18 nt, Leptospira interrogans serovar lai str. 56601
auuucuucauaucaaauu

SEQ ID NO: 2778635 - RNA, 22 nt, Leptospira interrogans serovar lai str. 56601
auuucuucauaucaaauucaug

SEQ ID NO: 2778636 - RNA, 19 nt, Leptospira interrogans serovar lai str. 56601
auuucuucguuauuuuuau

SEQ ID NO: 2778637 - RNA, 22 nt, Leptospira interrogans serovar lai str. 56601
auuucuucguuauuuuuauaaa

SEQ ID NO: 2778638 - RNA, 21 nt, Leptospira interrogans serovar lai str. 56601
auuucuugagggguuuuuccu

SEQ ID NO: 2778639 - RNA, 15 nt, Leptospira interrogans serovar lai str. 56601
auuucuuuaauuuca

SEQ ID NO: 2778640 - RNA, 17 nt, Leptospira interrogans serovar lai str. 56601
auuucuuucaaaaauuu

SEQ ID NO: 2778641 - RNA, 19 nt, Leptospira interrogans serovar lai str. 56601
auuucuuucucucgaaaua

SEQ ID NO: 2778642 - RNA, 18 nt, Leptospira interrogans serovar lai str. 56601
auuucuuuucagguugaa

SEQ ID NO: 2778643 - RNA, 20 nt, Leptospira interrogans serovar lai str. 56601
auuucuuuucagguugaauu

SEQ ID NO: 2778644 - RNA, 14 nt, Leptospira interrogans serovar lai str. 56601
auuucuuuugauac

SEQ ID NO: 2778645 - RNA, 22 nt, Leptospira interrogans serovar lai str. 56601
auuucuuuugauacaauucagc

SEQ ID NO: 2778646 - RNA, 21 nt, Leptospira interrogans serovar lai str. 56601
auuucuuuuuuguuuuguguc

SEQ ID NO: 2778647 - RNA, 21 nt, Leptospira interrogans serovar lai str. 56601
auuugaaaaaccgcugaagau

SEQ ID NO: 2778648 - RNA, 20 nt, Leptospira interrogans serovar lai str. 56601
auuugaaaaagggauucuau

SEQ ID NO: 2778649 - RNA, 21 nt, Leptospira interrogans serovar lai str. 56601
auuugaaaaagggauucuauu

SEQ ID NO: 2778650 - RNA, 22 nt, Leptospira interrogans serovar lai str. 56601
auuugaaaaagggauucuauuc

SEQ ID NO: 2778651 - RNA, 19 nt, Leptospira interrogans serovar lai str. 56601
auuugaaaagaaaccaauc

SEQ ID NO: 2778652 - RNA, 21 nt, Leptospira interrogans serovar lai str. 56601
auuugaaaauugaauuuaaaa

SEQ ID NO: 2778653 - RNA, 13 nt, Leptospira interrogans serovar lai str. 56601
auuugaaaguaaa

SEQ ID NO: 2778654 - RNA, 15 nt, Leptospira interrogans serovar lai str. 56601
auuugaaaguaaaaa

SEQ ID NO: 2778655 - RNA, 19 nt, Leptospira interrogans serovar lai str. 56601
auuugaaaguaaaaaagag

SEQ ID NO: 2778656 - RNA, 15 nt, Leptospira interrogans serovar lai str. 56601
auuugaaguauuuua

SEQ ID NO: 2778657 - RNA, 15 nt, Leptospira interrogans serovar lai str. 56601
auuugaauacgacag

SEQ ID NO: 2778658 - RNA, 14 nt, Leptospira interrogans serovar lai str. 56601
auuugaauuuaaaa

SEQ ID NO: 2778659 - RNA, 21 nt, Leptospira interrogans serovar lai str. 56601
auuugaauuuaagaucuuuau

SEQ ID NO: 2778660 - RNA, 18 nt, Leptospira interrogans serovar lai str. 56601
auuugaauuuauagauau

SEQ ID NO: 2778661 - RNA, 16 nt, Leptospira interrogans serovar lai str. 56601
auuugacaauuuguga

SEQ ID NO: 2778662 - RNA, 17 nt, Leptospira interrogans serovar lai str. 56601
auuugacaauuugugaa

SEQ ID NO: 2778663 - RNA, 18 nt, Leptospira interrogans serovar lai str. 56601
auuugacaauuugugaac

SEQ ID NO: 2778664 - RNA, 17 nt, Leptospira interrogans serovar lai str. 56601
auuugacguaaaggaau

SEQ ID NO: 2778665 - RNA, 15 nt, Leptospira interrogans serovar lai str. 56601
auuugauaugaauca

SEQ ID NO: 2778666 - RNA, 16 nt, Leptospira interrogans serovar lai str. 56601
auuugauuaaaaauuu

SEQ ID NO: 2778667 - RNA, 14 nt, Leptospira interrogans serovar lai str. 56601
auuugauuagaaaa

SEQ ID NO: 2778668 - RNA, 20 nt, Leptospira interrogans serovar lai str. 56601
auuugauuccaagauuuuuu

SEQ ID NO: 2778669 - RNA, 18 nt, Leptospira interrogans serovar lai str. 56601
auuugcggggaguuccca

SEQ ID NO: 2778670 - RNA, 23 nt, Leptospira interrogans serovar lai str. 56601
auuugcucuuaauggaucaaaag

SEQ ID NO: 2778671 - RNA, 18 nt, Leptospira interrogans serovar lai str. 56601
auuugcuuaaagcauuaa

SEQ ID NO: 2778672 - RNA, 17 nt, Leptospira interrogans serovar lai str. 56601
auuugcuuccauugucu

SEQ ID NO: 2778673 - RNA, 22 nt, Leptospira interrogans serovar lai str. 56601
auuuggaucgggacaaaucaua

SEQ ID NO: 2778674 - RNA, 16 nt, Leptospira interrogans serovar lai str. 56601
auuuggauuuauguuc

SEQ ID NO: 2778675 - RNA, 17 nt, Leptospira interrogans serovar lai str. 56601
auuugguaauuugugaa

SEQ ID NO: 2778676 - RNA, 18 nt, Leptospira interrogans serovar lai str. 56601
auuugguuuucauuuuag

SEQ ID NO: 2778677 - RNA, 14 nt, Leptospira interrogans serovar lai str. 56601
auuuguaaaauuca

SEQ ID NO: 2778678 - RNA, 15 nt, Leptospira interrogans serovar lai str. 56601
auuuguaaaauucag

SEQ ID NO: 2778679 - RNA, 17 nt, Leptospira interrogans serovar lai str. 56601
auuuguaaauucuccgu

SEQ ID NO: 2778680 - RNA, 23 nt, Leptospira interrogans serovar lai str. 56601
auuuguaagaacacugcauuuua

SEQ ID NO: 2778681 - RNA, 17 nt, Leptospira interrogans serovar lai str. 56601
auuuguaaucaguuaaa

SEQ ID NO: 2778682 - RNA, 22 nt, Leptospira interrogans serovar lai str. 56601
auuuguaauucugucuuuugaa

SEQ ID NO: 2778683 - RNA, 15 nt, Leptospira interrogans serovar lai str. 56601
auuuguaauucuuca

SEQ ID NO: 2778684 - RNA, 21 nt, Leptospira interrogans serovar lai str. 56601
auuuguagagauugauauuca

SEQ ID NO: 2778685 - RNA, 20 nt, Leptospira interrogans serovar lai str. 56601
auuugucucaaaauuuaaga

SEQ ID NO: 2778686 - RNA, 17 nt, Leptospira interrogans serovar lai str. 56601
auuugugcaaaaauuuu

SEQ ID NO: 2778687 - RNA, 17 nt, Leptospira interrogans serovar lai str. 56601
auuugugguaguuccua

SEQ ID NO: 2778688 - RNA, 15 nt, Leptospira interrogans serovar lai str. 56601
auuuguuaauuuuua

SEQ ID NO: 2778689 - RNA, 19 nt, Leptospira interrogans serovar lai str. 56601
auuuguucgugaaauugug

SEQ ID NO: 2778690 - RNA, 15 nt, Leptospira interrogans serovar lai str. 56601
auuuguucuuaaaau

SEQ ID NO: 2778691 - RNA, 19 nt, Leptospira interrogans serovar lai str. 56601
auuuguucuuaaaauugug

SEQ ID NO: 2778692 - RNA, 17 nt, Leptospira interrogans serovar lai str. 56601
auuuguugaaaagugag

SEQ ID NO: 2778693 - RNA, 16 nt, Leptospira interrogans serovar lai str. 56601
auuuguugauuuuuga

SEQ ID NO: 2778694 - RNA, 23 nt, Leptospira interrogans serovar lai str. 56601
auuuguugcaauacauucuuaua

SEQ ID NO: 2778695 - RNA, 20 nt, Leptospira interrogans serovar lai str. 56601
auuuguuguaucgaacucac

SEQ ID NO: 2778696 - RNA, 17 nt, Leptospira interrogans serovar lai str. 56601
auuuguuuaggaauuuu

SEQ ID NO: 2778697 - RNA, 22 nt, Leptospira interrogans serovar lai str. 56601
auuuguuuaggaauuuuuuaaa

SEQ ID NO: 2778698 - RNA, 19 nt, Leptospira interrogans serovar lai str. 56601
auuuguuucuauuuuaugg

SEQ ID NO: 2778699 - RNA, 14 nt, Leptospira interrogans serovar lai str. 56601
auuuguuuguaaaa

SEQ ID NO: 2778700 - RNA, 13 nt, Leptospira interrogans serovar lai str. 56601
auuuucaaguaaa

SEQ ID NO: 2778701 - RNA, 17 nt, Leptospira interrogans serovar lai str. 56601
auuuucaaguaaaucug

SEQ ID NO: 2778702 - RNA, 23 nt, Leptospira interrogans serovar lai str. 56601
auuuucagugaauaaaauaaaaa

SEQ ID NO: 2778703 - RNA, 21 nt, Leptospira interrogans serovar lai str. 56601
auuuucauaauaaauuuuucu

SEQ ID NO: 2778704 - RNA, 20 nt, Leptospira interrogans serovar lai str. 56601
auuuucauaggaaauucuuu

SEQ ID NO: 2778705 - RNA, 20 nt, Leptospira interrogans serovar lai str. 56601
auuuucaugaauuaaagaag

SEQ ID NO: 2778706 - RNA, 14 nt, Leptospira interrogans serovar lai str. 56601
auuuucauucuaaa

SEQ ID NO: 2778707 - RNA, 18 nt, Leptospira interrogans serovar lai str. 56601
auuuucauucuaaagaag

SEQ ID NO: 2778708 - RNA, 13 nt, Leptospira interrogans serovar lai str. 56601
auuuucauuuuau

SEQ ID NO: 2778709 - RNA, 16 nt, Leptospira interrogans serovar lai str. 56601
auuuuccaaaaauuua

SEQ ID NO: 2778710 - RNA, 20 nt, Leptospira interrogans serovar lai str. 56601
auuuuccgaaccuuaccacc

SEQ ID NO: 2778711 - RNA, 20 nt, Leptospira interrogans serovar lai str. 56601
auuuuccggacuuuccagaa

SEQ ID NO: 2778712 - RNA, 17 nt, Leptospira interrogans serovar lai str. 56601
auuuuccguaccccaaa

SEQ ID NO: 2778713 - RNA, 22 nt, Leptospira interrogans serovar lai str. 56601
auuuuccguaccccaaagauuu

SEQ ID NO: 2778714 - RNA, 19 nt, Leptospira interrogans serovar lai str. 56601
auuuuccuauuuucgaaaa

SEQ ID NO: 2778715 - RNA, 11 nt, Leptospira interrogans serovar lai str. 56601
auuuuccuucg

SEQ ID NO: 2778716 - RNA, 14 nt, Leptospira interrogans serovar lai str. 56601
auuuuccuuuaaau

SEQ ID NO: 2778717 - RNA, 15 nt, Leptospira interrogans serovar lai str. 56601
auuuuccuuuuuccg

SEQ ID NO: 2778718 - RNA, 16 nt, Leptospira interrogans serovar lai str. 56601
auuuucgauugcucuc

SEQ ID NO: 2778719 - RNA, 14 nt, Leptospira interrogans serovar lai str. 56601
auuuucgauuuaau

SEQ ID NO: 2778720 - RNA, 22 nt, Leptospira interrogans serovar lai str. 56601
auuuucgauuuaauauauuuuc

SEQ ID NO: 2778721 - RNA, 15 nt, Leptospira interrogans serovar lai str. 56601
auuuucgcacauucu

SEQ ID NO: 2778722 - RNA, 16 nt, Leptospira interrogans serovar lai str. 56601
auuuucgcacauucua

SEQ ID NO: 2778723 - RNA, 16 nt, Leptospira interrogans serovar lai str. 56601
auuuucggcauuuuau

SEQ ID NO: 2778724 - RNA, 12 nt, Leptospira interrogans serovar lai str. 56601
auuuucuaaaag

SEQ ID NO: 2778725 - RNA, 14 nt, Leptospira interrogans serovar lai str. 56601
auuuucuaaaagua

SEQ ID NO: 2778726 - RNA, 16 nt, Leptospira interrogans serovar lai str. 56601
auuuucuaaaaguaaa

SEQ ID NO: 2778727 - RNA, 15 nt, Leptospira interrogans serovar lai str. 56601
auuuucuaaagauuc

SEQ ID NO: 2778728 - RNA, 15 nt, Leptospira interrogans serovar lai str. 56601
auuuucuaagaaucu

SEQ ID NO: 2778729 - RNA, 20 nt, Leptospira interrogans serovar lai str. 56601
auuuucuaauauaacucacu

SEQ ID NO: 2778730 - RNA, 12 nt, Leptospira interrogans serovar lai str. 56601
auuuucuagaua

SEQ ID NO: 2778731 - RNA, 15 nt, Leptospira interrogans serovar lai str. 56601
auuuucuauuuuaau

SEQ ID NO: 2778732 - RNA, 16 nt, Leptospira interrogans serovar lai str. 56601
auuuucuauuuuaaua

SEQ ID NO: 2778733 - RNA, 18 nt, Leptospira interrogans serovar lai str. 56601
auuuucuauuuuaauaua

SEQ ID NO: 2778734 - RNA, 16 nt, Leptospira interrogans serovar lai str. 56601
auuuucucaaaaaaag

SEQ ID NO: 2778735 - RNA, 13 nt, Leptospira interrogans serovar lai str. 56601
auuuucucaguaa

SEQ ID NO: 2778736 - RNA, 15 nt, Leptospira interrogans serovar lai str. 56601
auuuucucauucuac

SEQ ID NO: 2778737 - RNA, 13 nt, Leptospira interrogans serovar lai str. 56601
auuuucuguuuau

SEQ ID NO: 2778738 - RNA, 19 nt, Leptospira interrogans serovar lai str. 56601
auuuucuuaauaaacuuuc

SEQ ID NO: 2778739 - RNA, 20 nt, Leptospira interrogans serovar lai str. 56601
auuuucuuaauaaacuuuca

SEQ ID NO: 2778740 - RNA, 19 nt, Leptospira interrogans serovar lai str. 56601
auuuucuuauugaacguaa

SEQ ID NO: 2778741 - RNA, 21 nt, Leptospira interrogans serovar lai str. 56601
auuuucuuuagaaauuuuuaa

SEQ ID NO: 2778742 - RNA, 17 nt, Leptospira interrogans serovar lai str. 56601
auuuucuuucuaaauga

SEQ ID NO: 2778743 - RNA, 15 nt, Leptospira interrogans serovar lai str. 56601
auuuugaaaauacgc

SEQ ID NO: 2778744 - RNA, 20 nt, Leptospira interrogans serovar lai str. 56601
auuuugaacaaguucuaaau

SEQ ID NO: 2778745 - RNA, 18 nt, Leptospira interrogans serovar lai str. 56601
auuuugaagacuauaaaa

SEQ ID NO: 2778746 - RNA, 15 nt, Leptospira interrogans serovar lai str. 56601
auuuugaagguugag

SEQ ID NO: 2778747 - RNA, 16 nt, Leptospira interrogans serovar lai str. 56601
auuuugaagguugagc

SEQ ID NO: 2778748 - RNA, 20 nt, Leptospira interrogans serovar lai str. 56601
auuuugagcagauucuaaaa

SEQ ID NO: 2778749 - RNA, 22 nt, Leptospira interrogans serovar lai str. 56601
auuuugagcagauucuaaaaau

SEQ ID NO: 2778750 - RNA, 23 nt, Leptospira interrogans serovar lai str. 56601
auuuugaguagccaauugaauau

SEQ ID NO: 2778751 - RNA, 15 nt, Leptospira interrogans serovar lai str. 56601
auuuugauaauuuca

SEQ ID NO: 2778752 - RNA, 16 nt, Leptospira interrogans serovar lai str. 56601
auuuugaucuaauaau

SEQ ID NO: 2778753 - RNA, 18 nt, Leptospira interrogans serovar lai str. 56601
auuuugaucuuuuuuucu

SEQ ID NO: 2778754 - RNA, 17 nt, Leptospira interrogans serovar lai str. 56601
auuuugauuacaaagca

SEQ ID NO: 2778755 - RNA, 10 nt, Leptospira interrogans serovar lai str. 56601
auuuugauuc

SEQ ID NO: 2778756 - RNA, 22 nt, Leptospira interrogans serovar lai str. 56601
auuuugauuccaaagauaaaaa

SEQ ID NO: 2778757 - RNA, 12 nt, Leptospira interrogans serovar lai str. 56601
auuuugauugug

SEQ ID NO: 2778758 - RNA, 16 nt, Leptospira interrogans serovar lai str. 56601
auuuugcacguaaaca

SEQ ID NO: 2778759 - RNA, 18 nt, Leptospira interrogans serovar lai str. 56601
auuuugcacguaaacauu

SEQ ID NO: 2778760 - RNA, 17 nt, Leptospira interrogans serovar lai str. 56601
auuuugcacugaaauag

SEQ ID NO: 2778761 - RNA, 18 nt, Leptospira interrogans serovar lai str. 56601
auuuugcacugaaauaga

SEQ ID NO: 2778762 - RNA, 22 nt, Leptospira interrogans serovar lai str. 56601
auuuugcacugaaauagaauuu

SEQ ID NO: 2778763 - RNA, 11 nt, Leptospira interrogans serovar lai str. 56601
auuuugccaau

SEQ ID NO: 2778764 - RNA, 22 nt, Leptospira interrogans serovar lai str. 56601
auuuugcuucuaaaaaggauac

SEQ ID NO: 2778765 - RNA, 21 nt, Leptospira interrogans serovar lai str. 56601
auuuuggcccuccucuaaaau

SEQ ID NO: 2778766 - RNA, 22 nt, Leptospira interrogans serovar lai str. 56601
auuuugggacaagcuuuaaauu

SEQ ID NO: 2778767 - RNA, 14 nt, Leptospira interrogans serovar lai str. 56601
auuuugggauuuua

SEQ ID NO: 2778768 - RNA, 15 nt, Leptospira interrogans serovar lai str. 56601
auuuugggauuuuau

SEQ ID NO: 2778769 - RNA, 22 nt, Leptospira interrogans serovar lai str. 56601
auuuugggauuuuauugaagau

SEQ ID NO: 2778770 - RNA, 15 nt, Leptospira interrogans serovar lai str. 56601
auuuuguaaugaaau

SEQ ID NO: 2778771 - RNA, 17 nt, Leptospira interrogans serovar lai str. 56601
auuuuguauugaaauag

SEQ ID NO: 2778772 - RNA, 22 nt, Leptospira interrogans serovar lai str. 56601
auuuugugaaacuuaaaucuca

SEQ ID NO: 2778773 - RNA, 23 nt, Leptospira interrogans serovar lai str. 56601
auuuugugaaacuuaaaucucac

SEQ ID NO: 2778774 - RNA, 15 nt, Leptospira interrogans serovar lai str. 56601
auuuuguuucuaaaa

SEQ ID NO: 2778775 - RNA, 17 nt, Leptospira interrogans serovar lai str. 56601
auuuuguuuuauagaaa

SEQ ID NO: 2778776 - RNA, 17 nt, Leptospira interrogans serovar lai str. 56601
auuuuuaaaaagaauug

SEQ ID NO: 2778777 - RNA, 13 nt, Leptospira interrogans serovar lai str. 56601
auuuuuaaaaagu

SEQ ID NO: 2778778 - RNA, 17 nt, Leptospira interrogans serovar lai str. 56601
auuuuuaaaaguagaau

SEQ ID NO: 2778779 - RNA, 19 nt, Leptospira interrogans serovar lai str. 56601
auuuuuaaaaguagaauca

SEQ ID NO: 2778780 - RNA, 17 nt, Leptospira interrogans serovar lai str. 56601
auuuuuaagaauaauuu

SEQ ID NO: 2778781 - RNA, 15 nt, Leptospira interrogans serovar lai str. 56601
auuuuuaagauaaau

SEQ ID NO: 2778782 - RNA, 15 nt, Leptospira interrogans serovar lai str. 56601
auuuuuaagauuaca

SEQ ID NO: 2778783 - RNA, 22 nt, Leptospira interrogans serovar lai str. 56601
auuuuuuguaugaguuccuaca

SEQ ID NO: 2778784 - RNA, 18 nt, Leptospira interrogans serovar lai str. 56601
auuuuuugucuuuaaaau

SEQ ID NO: 2778785 - RNA, 13 nt, Leptospira interrogans serovar lai str. 56601
auuuuuuuaaaaa

SEQ ID NO: 2778786 - RNA, 12 nt, Leptospira interrogans serovar lai str. 56601
auuuuuuuaaac

SEQ ID NO: 2778787 - RNA, 16 nt, Leptospira interrogans serovar lai str. 56601
auuuuuuuaagaauuu

SEQ ID NO: 2778788 - RNA, 15 nt, Leptospira interrogans serovar lai str. 56601
auuuuuuuaucuauu

SEQ ID NO: 2778789 - RNA, 24 nt, Leptospira interrogans serovar lai str. 56601
auuuuuuucgcaaauucuacuauu

SEQ ID NO: 2778790 - RNA, 16 nt, Leptospira interrogans serovar lai str. 56601
auuuuuuucuaaaaua

SEQ ID NO: 2778791 - RNA, 15 nt, Leptospira interrogans serovar lai str. 56601
auuuuuuucuccuuu

SEQ ID NO: 2778792 - RNA, 14 nt, Leptospira interrogans serovar lai str. 56601
auuuuuuuguaaaa

SEQ ID NO: 2778793 - RNA, 15 nt, Leptospira interrogans serovar lai str. 56601
auuuuuuuuacauaa

SEQ ID NO: 2778794 - RNA, 23 nt, Leptospira interrogans serovar lai str. 56601
auuuuuuuugagaaaagagauuu

SEQ ID NO: 2778795 - RNA, 11 nt, Leptospira interrogans serovar lai str. 56601
caaaaaaaaua

SEQ ID NO: 2778796 - RNA, 11 nt, Leptospira interrogans serovar lai str. 56601
caaaaaaaauu

SEQ ID NO: 2778797 - RNA, 10 nt, Leptospira interrogans serovar lai str. 56601
caaaaaaaua

SEQ ID NO: 2778798 - RNA, 12 nt, Leptospira interrogans serovar lai str. 56601
caaaaaaauaaa

SEQ ID NO: 2778799 - RNA, 20 nt, Leptospira interrogans serovar lai str. 56601
caaaaaaaucaggcuuuaua

SEQ ID NO: 2778800 - RNA, 18 nt, Leptospira interrogans serovar lai str. 56601
caaaaaaauucuccucuu

SEQ ID NO: 2778801 - RNA, 14 nt, Leptospira interrogans serovar lai str. 56601
caaaaaagaaagca

SEQ ID NO: 2778802 - RNA, 15 nt, Leptospira interrogans serovar lai str. 56601
caaaaaagaaagcag

SEQ ID NO: 2778803 - RNA, 17 nt, Leptospira interrogans serovar lai str. 56601
caaaaaagaaagcagca

SEQ ID NO: 2778804 - RNA, 22 nt, Leptospira interrogans serovar lai str. 56601
caaaaaagaaagcagcaaagaa

SEQ ID NO: 2778805 - RNA, 17 nt, Leptospira interrogans serovar lai str. 56601
caaaaaagauaaaaaga

SEQ ID NO: 2778806 - RNA, 19 nt, Leptospira interrogans serovar lai str. 56601
caaaaaaguccaaaacaaa

SEQ ID NO: 2778807 - RNA, 14 nt, Leptospira interrogans serovar lai str. 56601
caaaaaauaaaauu

SEQ ID NO: 2778808 - RNA, 16 nt, Leptospira interrogans serovar lai str. 56601
caaaaaauauacuuuu

SEQ ID NO: 2778809 - RNA, 20 nt, Leptospira interrogans serovar lai str. 56601
caaaaaaugcucaaaaauua

SEQ ID NO: 2778810 - RNA, 13 nt, Leptospira interrogans serovar lai str. 56601
caaaaaauggaac

SEQ ID NO: 2778811 - RNA, 11 nt, Leptospira interrogans serovar lai str. 56601
caaaaaauggu

SEQ ID NO: 2778812 - RNA, 17 nt, Leptospira interrogans serovar lai str. 56601
caaaaaaugguuuuuua

SEQ ID NO: 2778813 - RNA, 23 nt, Leptospira interrogans serovar lai str. 56601
caaaaaauucuuuuuauuuuuac

SEQ ID NO: 2778814 - RNA, 18 nt, Leptospira interrogans serovar lai str. 56601
caaaaaauugcauauucc

SEQ ID NO: 2778815 - RNA, 20 nt, Leptospira interrogans serovar lai str. 56601
caaaaaauuucuaugaaaau

SEQ ID NO: 2778816 - RNA, 14 nt, Leptospira interrogans serovar lai str. 56601
caaaaaauuuuuac

SEQ ID NO: 2778817 - RNA, 14 nt, Leptospira interrogans serovar lai str. 56601
caaaaacacuuuau

SEQ ID NO: 2778818 - RNA, 15 nt, Leptospira interrogans serovar lai str. 56601
caaaaacuaaaauac

SEQ ID NO: 2778819 - RNA, 15 nt, Leptospira interrogans serovar lai str. 56601
caaaaacucaaagaa

SEQ ID NO: 2778820 - RNA, 12 nt, Leptospira interrogans serovar lai str. 56601
caaaaagaaaaa

SEQ ID NO: 2778821 - RNA, 17 nt, Leptospira interrogans serovar lai str. 56601
caaaaagacuauauucu

SEQ ID NO: 2778822 - RNA, 11 nt, Leptospira interrogans serovar lai str. 56601
caaaaaguaug

SEQ ID NO: 2778823 - RNA, 12 nt, Leptospira interrogans serovar lai str. 56601
caaaaaguaugu

SEQ ID NO: 2778824 - RNA, 21 nt, Leptospira interrogans serovar lai str. 56601
caaaaaguuuuauaaacgauu

SEQ ID NO: 2778825 - RNA, 19 nt, Leptospira interrogans serovar lai str. 56601
caaaaauaaaguauuuuua

SEQ ID NO: 2778826 - RNA, 14 nt, Leptospira interrogans serovar lai str. 56601
caaaaauacuaaau

SEQ ID NO: 2778827 - RNA, 18 nt, Leptospira interrogans serovar lai str. 56601
caaaaauagaauuuuugu

SEQ ID NO: 2778828 - RNA, 21 nt, Leptospira interrogans serovar lai str. 56601
caaaaauagggaaaacucaac

SEQ ID NO: 2778829 - RNA, 17 nt, Leptospira interrogans serovar lai str. 56601
caaaaauaucuuagaau

SEQ ID NO: 2778830 - RNA, 13 nt, Leptospira interrogans serovar lai str. 56601
caaaaaugagaau

SEQ ID NO: 2778831 - RNA, 15 nt, Leptospira interrogans serovar lai str. 56601
caaaaauuauaaauc

SEQ ID NO: 2778832 - RNA, 12 nt, Leptospira interrogans serovar lai str. 56601
caaaaauuccaa

SEQ ID NO: 2778833 - RNA, 13 nt, Leptospira interrogans serovar lai str. 56601
caaaaauuguaaa

SEQ ID NO: 2778834 - RNA, 15 nt, Leptospira interrogans serovar lai str. 56601
caaaaauuuaaaaau

SEQ ID NO: 2778835 - RNA, 16 nt, Leptospira interrogans serovar lai str. 56601
caaaaauuuaauaaca

SEQ ID NO: 2778836 - RNA, 22 nt, Leptospira interrogans serovar lai str. 56601
caaaacaaaguauaacccaaaa

SEQ ID NO: 2778837 - RNA, 19 nt, Leptospira interrogans serovar lai str. 56601
caaaacaaucuuagaaugu

SEQ ID NO: 2778838 - RNA, 14 nt, Leptospira interrogans serovar lai str. 56601
caaaaccaaaacau

SEQ ID NO: 2778839 - RNA, 15 nt, Leptospira interrogans serovar lai str. 56601
caaaaccauuuuugc

SEQ ID NO: 2778840 - RNA, 13 nt, Leptospira interrogans serovar lai str. 56601
caaaaccucaaaa

SEQ ID NO: 2778841 - RNA, 15 nt, Leptospira interrogans serovar lai str. 56601
caaaaccucaaaaaa

SEQ ID NO: 2778842 - RNA, 16 nt, Leptospira interrogans serovar lai str. 56601
caaaaccucaaaaaau

SEQ ID NO: 2778843 - RNA, 19 nt, Leptospira interrogans serovar lai str. 56601
caaaaccucaaaaaauuua

SEQ ID NO: 2778844 - RNA, 14 nt, Leptospira interrogans serovar lai str. 56601
caaaaccuucguga

SEQ ID NO: 2778845 - RNA, 21 nt, Leptospira interrogans serovar lai str. 56601
caaaacgcgauccguaaaaaa

SEQ ID NO: 2778846 - RNA, 22 nt, Leptospira interrogans serovar lai str. 56601
caaaacgguaauuucauaaaau

SEQ ID NO: 2778847 - RNA, 18 nt, Leptospira interrogans serovar lai str. 56601
caaaacgguaauuuuaug

SEQ ID NO: 2778848 - RNA, 22 nt, Leptospira interrogans serovar lai str. 56601
caaaacgguuuucuaauuuaug

SEQ ID NO: 2778849 - RNA, 20 nt, Leptospira interrogans serovar lai str. 56601
caaaacuaccucaauuuucc

SEQ ID NO: 2778850 - RNA, 16 nt, Leptospira interrogans serovar lai str. 56601
caaaacuuaaguuugu

SEQ ID NO: 2778851 - RNA, 12 nt, Leptospira interrogans serovar lai str. 56601
caaaacuuuacg

SEQ ID NO: 2778852 - RNA, 12 nt, Leptospira interrogans serovar lai str. 56601
caaaagaacuuu

SEQ ID NO: 2778853 - RNA, 12 nt, Leptospira interrogans serovar lai str. 56601
caaaagcaaaau

SEQ ID NO: 2778854 - RNA, 16 nt, Leptospira interrogans serovar lai str. 56601
caaaagcguuguauaa

SEQ ID NO: 2778855 - RNA, 11 nt, Leptospira interrogans serovar lai str. 56601
caaaaggauuc

SEQ ID NO: 2778856 - RNA, 21 nt, Leptospira interrogans serovar lai str. 56601
caaaaggauuccauuucauug

SEQ ID NO: 2778857 - RNA, 15 nt, Leptospira interrogans serovar lai str. 56601
caaaauaagaaaaua

SEQ ID NO: 2778858 - RNA, 16 nt, Leptospira interrogans serovar lai str. 56601
caaaauaagaauuuuc

SEQ ID NO: 2778859 - RNA, 20 nt, Leptospira interrogans serovar lai str. 56601
caaaauacgaucuaauuugu

SEQ ID NO: 2778860 - RNA, 13 nt, Leptospira interrogans serovar lai str. 56601
caaaauacuuuau

SEQ ID NO: 2778861 - RNA, 20 nt, Leptospira interrogans serovar lai str. 56601
caaaauacuuuaucuuuacu

SEQ ID NO: 2778862 - RNA, 23 nt, Leptospira interrogans serovar lai str. 56601
caaaauagauggagaauuaauuu

SEQ ID NO: 2778863 - RNA, 16 nt, Leptospira interrogans serovar lai str. 56601
caaaauaggaaccauc

SEQ ID NO: 2778864 - RNA, 13 nt, Leptospira interrogans serovar lai str. 56601
caaaaucaaagag

SEQ ID NO: 2778865 - RNA, 20 nt, Leptospira interrogans serovar lai str. 56601
caaaaucaaagagcaacucu

SEQ ID NO: 2778866 - RNA, 19 nt, Leptospira interrogans serovar lai str. 56601
caaaaucccagaaaggaac

SEQ ID NO: 2778867 - RNA, 19 nt, Leptospira interrogans serovar lai str. 56601
caaaguuauugaauagaau

SEQ ID NO: 2778868 - RNA, 16 nt, Leptospira interrogans serovar lai str. 56601
caaaguuuauaagaga

SEQ ID NO: 2778869 - RNA, 11 nt, Leptospira interrogans serovar lai str. 56601
caaauaaaaac

SEQ ID NO: 2778870 - RNA, 13 nt, Leptospira interrogans serovar lai str. 56601
caaauaaaaacac

SEQ ID NO: 2778871 - RNA, 14 nt, Leptospira interrogans serovar lai str. 56601
caaauaaaacuucu

SEQ ID NO: 2778872 - RNA, 16 nt, Leptospira interrogans serovar lai str. 56601
caaauaaaacuucucc

SEQ ID NO: 2778873 - RNA, 23 nt, Leptospira interrogans serovar lai str. 56601
caaauaaaaggcugcuuuuuuga

SEQ ID NO: 2778874 - RNA, 22 nt, Leptospira interrogans serovar lai str. 56601
caaauaaagaaaaggaaggagu

SEQ ID NO: 2778875 - RNA, 10 nt, Leptospira interrogans serovar lai str. 56601
caaauaacau

SEQ ID NO: 2778876 - RNA, 21 nt, Leptospira interrogans serovar lai str. 56601
caaauaacgauuccauuuuuu

SEQ ID NO: 2778877 - RNA, 22 nt, Leptospira interrogans serovar lai str. 56601
caaauaacgauuccauuuuuua

SEQ ID NO: 2778878 - RNA, 17 nt, Leptospira interrogans serovar lai str. 56601
caaauaauaaaacuuuu

SEQ ID NO: 2778879 - RNA, 15 nt, Leptospira interrogans serovar lai str. 56601
caaauacagugucuu

SEQ ID NO: 2778880 - RNA, 20 nt, Leptospira interrogans serovar lai str. 56601
caaauacagugucuugaaau

SEQ ID NO: 2778881 - RNA, 22 nt, Leptospira interrogans serovar lai str. 56601
caaauacagugucuugaaauuc

SEQ ID NO: 2778882 - RNA, 16 nt, Leptospira interrogans serovar lai str. 56601
caaauacuuagaauuu

SEQ ID NO: 2778883 - RNA, 14 nt, Leptospira interrogans serovar lai str. 56601
caaauagaaauaac

SEQ ID NO: 2778884 - RNA, 17 nt, Leptospira interrogans serovar lai str. 56601
caaauagaaauaacuua

SEQ ID NO: 2778885 - RNA, 19 nt, Leptospira interrogans serovar lai str. 56601
caaauagaguaccauaaau

SEQ ID NO: 2778886 - RNA, 13 nt, Leptospira interrogans serovar lai str. 56601
caaauaucaugau

SEQ ID NO: 2778887 - RNA, 20 nt, Leptospira interrogans serovar lai str. 56601
caaauauuaagaauucuaaa

SEQ ID NO: 2778888 - RNA, 14 nt, Leptospira interrogans serovar lai str. 56601
caaauauuucgaca

SEQ ID NO: 2778889 - RNA, 14 nt, Leptospira interrogans serovar lai str. 56601
caaaucaauuuuaa

SEQ ID NO: 2778890 - RNA, 16 nt, Leptospira interrogans serovar lai str. 56601
caaaucacaauuuuaa

SEQ ID NO: 2778891 - RNA, 17 nt, Leptospira interrogans serovar lai str. 56601
caaaucacaauuuuaag

SEQ ID NO: 2778892 - RNA, 16 nt, Leptospira interrogans serovar lai str. 56601
caaaucacaauuuuac

SEQ ID NO: 2778893 - RNA, 21 nt, Leptospira interrogans serovar lai str. 56601
caaaucacaauuuuacaaaca

SEQ ID NO: 2778894 - RNA, 15 nt, Leptospira interrogans serovar lai str. 56601
caaaucacgauuuua

SEQ ID NO: 2778895 - RNA, 19 nt, Leptospira interrogans serovar lai str. 56601
caaaucauaggauacaaaa

SEQ ID NO: 2778896 - RNA, 22 nt, Leptospira interrogans serovar lai str. 56601
caaaucauaggauacaaaacuu

SEQ ID NO: 2778897 - RNA, 16 nt, Leptospira interrogans serovar lai str. 56601
caaaucaucuaucuuu

SEQ ID NO: 2778898 - RNA, 19 nt, Leptospira interrogans serovar lai str. 56601
caaaucaucuaucuuuuca

SEQ ID NO: 2778899 - RNA, 22 nt, Leptospira interrogans serovar lai str. 56601
caaaucaucuaucuuuucaaaa

SEQ ID NO: 2778900 - RNA, 13 nt, Leptospira interrogans serovar lai str. 56601
caaaucgauuucu

SEQ ID NO: 2778901 - RNA, 16 nt, Leptospira interrogans serovar lai str. 56601
caaaucgcauuguuua

SEQ ID NO: 2778902 - RNA, 19 nt, Leptospira interrogans serovar lai str. 56601
caaaucgcauuguuuaaau

SEQ ID NO: 2778903 - RNA, 17 nt, Leptospira interrogans serovar lai str. 56601
caaaucgugaauuuaca

SEQ ID NO: 2778904 - RNA, 15 nt, Leptospira interrogans serovar lai str. 56601
caaaucuaaauuuua

SEQ ID NO: 2778905 - RNA, 22 nt, Leptospira interrogans serovar lai str. 56601
caaaucugaaauucaucaaauu

SEQ ID NO: 2778906 - RNA, 15 nt, Leptospira interrogans serovar lai str. 56601
caaaucuucgguuua

SEQ ID NO: 2778907 - RNA, 19 nt, Leptospira interrogans serovar lai str. 56601
caaaucuuucacuuuaaaa

SEQ ID NO: 2778908 - RNA, 15 nt, Leptospira interrogans serovar lai str. 56601
caaaugauagaaacu

SEQ ID NO: 2778909 - RNA, 13 nt, Leptospira interrogans serovar lai str. 56601
caaaugugagagu

SEQ ID NO: 2778910 - RNA, 16 nt, Leptospira interrogans serovar lai str. 56601
caaauguuauuuuugc

SEQ ID NO: 2778911 - RNA, 17 nt, Leptospira interrogans serovar lai str. 56601
caaauuaaguuuaaaaa

SEQ ID NO: 2778912 - RNA, 18 nt, Leptospira interrogans serovar lai str. 56601
caaauuaauuacuuagau

SEQ ID NO: 2778913 - RNA, 20 nt, Leptospira interrogans serovar lai str. 56601
caaauuaggucacauuugau

SEQ ID NO: 2778914 - RNA, 20 nt, Leptospira interrogans serovar lai str. 56601
caaauuagguuguguuugau

SEQ ID NO: 2778915 - RNA, 20 nt, Leptospira interrogans serovar lai str. 56601
caaauucacgaccuuaaaua

SEQ ID NO: 2778916 - RNA, 13 nt, Leptospira interrogans serovar lai str. 56601
caaauucaugaua

SEQ ID NO: 2778917 - RNA, 18 nt, Leptospira interrogans serovar lai str. 56601
caaauucgucaaaaccaa

SEQ ID NO: 2778918 - RNA, 20 nt, Leptospira interrogans serovar lai str. 56601
caaauucgucaaaaccaaaa

SEQ ID NO: 2778919 - RNA, 20 nt, Leptospira interrogans serovar lai str. 56601
caaauucuaaaauuguagaa

SEQ ID NO: 2778920 - RNA, 20 nt, Leptospira interrogans serovar lai str. 56601
caaauucuaaacuuguaaga

SEQ ID NO: 2778921 - RNA, 15 nt, Leptospira interrogans serovar lai str. 56601
caaauucuucuuccu

SEQ ID NO: 2778922 - RNA, 18 nt, Leptospira interrogans serovar lai str. 56601
caaauuggguauaagaag

SEQ ID NO: 2778923 - RNA, 18 nt, Leptospira interrogans serovar lai str. 56601
caaauuguaggaguucau

SEQ ID NO: 2778924 - RNA, 14 nt, Leptospira interrogans serovar lai str. 56601
caaauuguuuucua

SEQ ID NO: 2778925 - RNA, 19 nt, Leptospira interrogans serovar lai str. 56601
caaauuguuuucuaaagga

SEQ ID NO: 2778926 - RNA, 21 nt, Leptospira interrogans serovar lai str. 56601
caaauuuacucuuauaaaauu

SEQ ID NO: 2778927 - RNA, 14 nt, Leptospira interrogans serovar lai str. 56601
caaauuuauaugau

SEQ ID NO: 2778928 - RNA, 15 nt, Leptospira interrogans serovar lai str. 56601
caaauuucugcauca

SEQ ID NO: 2778929 - RNA, 18 nt, Leptospira interrogans serovar lai str. 56601
caaauuucugcaugaaau

SEQ ID NO: 2778930 - RNA, 18 nt, Leptospira interrogans serovar lai str. 56601
caaauuugcgaaaaaaau

SEQ ID NO: 2778931 - RNA, 22 nt, Leptospira interrogans serovar lai str. 56601
caaauuuuacauuguuuuucga

SEQ ID NO: 2778932 - RNA, 18 nt, Leptospira interrogans serovar lai str. 56601
caaauuuuugcauaaaau

SEQ ID NO: 2778933 - RNA, 19 nt, Leptospira interrogans serovar lai str. 56601
caaauuuuugcauaaaauc

SEQ ID NO: 2778934 - RNA, 20 nt, Leptospira interrogans serovar lai str. 56601
caaauuuuugcauaaaaucg

SEQ ID NO: 2778935 - RNA, 20 nt, Leptospira interrogans serovar lai str. 56601
caaauuuuuucguuucugag

SEQ ID NO: 2778936 - RNA, 20 nt, Leptospira interrogans serovar lai str. 56601
caaauuuuuuucuaaaauau

SEQ ID NO: 2778937 - RNA, 13 nt, Leptospira interrogans serovar lai str. 56601
caacaaaaaauau

SEQ ID NO: 2778938 - RNA, 19 nt, Leptospira interrogans serovar lai str. 56601
caacaaaaaauauacuuuu

SEQ ID NO: 2778939 - RNA, 21 nt, Leptospira interrogans serovar lai str. 56601
caacaacucuaauacaaaaaa

SEQ ID NO: 2778940 - RNA, 21 nt, Leptospira interrogans serovar lai str. 56601
caacaacucuaauauaaaaac

SEQ ID NO: 2778941 - RNA, 17 nt, Leptospira interrogans serovar lai str. 56601
caacaacucuauuuuau

SEQ ID NO: 2778942 - RNA, 20 nt, Leptospira interrogans serovar lai str. 56601
caacaaguuuacacauuuau

SEQ ID NO: 2778943 - RNA, 23 nt, Leptospira interrogans serovar lai str. 56601
caacacacacuuuauaaaaguau

SEQ ID NO: 2778944 - RNA, 20 nt, Leptospira interrogans serovar lai str. 56601
caacaccaauucgguugacu

SEQ ID NO: 2778945 - RNA, 19 nt, Leptospira interrogans serovar lai str. 56601
caacacugagucaacaaau

SEQ ID NO: 2778946 - RNA, 20 nt, Leptospira interrogans serovar lai str. 56601
caacagaaacggauggagaa

SEQ ID NO: 2778947 - RNA, 20 nt, Leptospira interrogans serovar lai str. 56601
caacagaucgcguuuuauaa

SEQ ID NO: 2778948 - RNA, 19 nt, Leptospira interrogans serovar lai str. 56601
caacaguacaagaaucaaa

SEQ ID NO: 2778949 - RNA, 17 nt, Leptospira interrogans serovar lai str. 56601
caacauaaugcugcaau

SEQ ID NO: 2778950 - RNA, 17 nt, Leptospira interrogans serovar lai str. 56601
caaguuauuaacggcca

SEQ ID NO: 2778951 - RNA, 12 nt, Leptospira interrogans serovar lai str. 56601
caaguuccaaau

SEQ ID NO: 2778952 - RNA, 18 nt, Leptospira interrogans serovar lai str. 56601
caaguucgauuaaaauaa

SEQ ID NO: 2778953 - RNA, 22 nt, Leptospira interrogans serovar lai str. 56601
caaguucgccuacacuguguuc

SEQ ID NO: 2778954 - RNA, 23 nt, Leptospira interrogans serovar lai str. 56601
caaguucgguagaaagaauuuuc

SEQ ID NO: 2778955 - RNA, 19 nt, Leptospira interrogans serovar lai str. 56601
caaguucuggguaaaaaaa

SEQ ID NO: 2778956 - RNA, 15 nt, Leptospira interrogans serovar lai str. 56601
caaguugaaagggga

SEQ ID NO: 2778957 - RNA, 16 nt, Leptospira interrogans serovar lai str. 56601
caaguugaauaggauu

SEQ ID NO: 2778958 - RNA, 18 nt, Leptospira interrogans serovar lai str. 56601
caaguugaauaggauuuu

SEQ ID NO: 2778959 - RNA, 15 nt, Leptospira interrogans serovar lai str. 56601
caaguugauuaugau

SEQ ID NO: 2778960 - RNA, 15 nt, Leptospira interrogans serovar lai str. 56601
caaguuuucuuuuuu

SEQ ID NO: 2778961 - RNA, 19 nt, Leptospira interrogans serovar lai str. 56601
caaguuuucuuuuuuucuc

SEQ ID NO: 2778962 - RNA, 19 nt, Leptospira interrogans serovar lai str. 56601
caaguuuuugugacuuccu

SEQ ID NO: 2778963 - RNA, 16 nt, Leptospira interrogans serovar lai str. 56601
caauaaaaacagaugg

SEQ ID NO: 2778964 - RNA, 13 nt, Leptospira interrogans serovar lai str. 56601
caauaaaaacuaa

SEQ ID NO: 2778965 - RNA, 15 nt, Leptospira interrogans serovar lai str. 56601
caauaaaaacuaaua

SEQ ID NO: 2778966 - RNA, 13 nt, Leptospira interrogans serovar lai str. 56601
caauaaaaauuag

SEQ ID NO: 2778967 - RNA, 14 nt, Leptospira interrogans serovar lai str. 56601
caauaaaauaccau

SEQ ID NO: 2778968 - RNA, 17 nt, Leptospira interrogans serovar lai str. 56601
caauaaaauaccauaaa

SEQ ID NO: 2778969 - RNA, 23 nt, Leptospira interrogans serovar lai str. 56601
caauaacaaccaccuuuacauaa

SEQ ID NO: 2778970 - RNA, 15 nt, Leptospira interrogans serovar lai str. 56601
caauaaggagcaccu

SEQ ID NO: 2778971 - RNA, 17 nt, Leptospira interrogans serovar lai str. 56601
caauaaguuagaacuuc

SEQ ID NO: 2778972 - RNA, 22 nt, Leptospira interrogans serovar lai str. 56601
caauaaguuuacaucaacucug

SEQ ID NO: 2778973 - RNA, 20 nt, Leptospira interrogans serovar lai str. 56601
caauaauccagcugaaacua

SEQ ID NO: 2778974 - RNA, 12 nt, Leptospira interrogans serovar lai str. 56601
caauaauuuaac

SEQ ID NO: 2778975 - RNA, 21 nt, Leptospira interrogans serovar lai str. 56601
caauaauuucccauaaaaaga

SEQ ID NO: 2778976 - RNA, 13 nt, Leptospira interrogans serovar lai str. 56601
caauacaaaacaa

SEQ ID NO: 2778977 - RNA, 15 nt, Leptospira interrogans serovar lai str. 56601
caauacaacgaaaau

SEQ ID NO: 2778978 - RNA, 22 nt, Leptospira interrogans serovar lai str. 56601
caauacuuuauagguucuggau

SEQ ID NO: 2778979 - RNA, 13 nt, Leptospira interrogans serovar lai str. 56601
caauagaaauacu

SEQ ID NO: 2778980 - RNA, 24 nt, Leptospira interrogans serovar lai str. 56601
caauagaaauacuucuccacgauu

SEQ ID NO: 2778981 - RNA, 22 nt, Leptospira interrogans serovar lai str. 56601
caauagaauuguguuaguuccc

SEQ ID NO: 2778982 - RNA, 22 nt, Leptospira interrogans serovar lai str. 56601
caauagagucguugaaaaauua

SEQ ID NO: 2778983 - RNA, 18 nt, Leptospira interrogans serovar lai str. 56601
caauagcuucuuuaaaaa

SEQ ID NO: 2778984 - RNA, 17 nt, Leptospira interrogans serovar lai str. 56601
caauaguucuauuuuau

SEQ ID NO: 2778985 - RNA, 19 nt, Leptospira interrogans serovar lai str. 56601
caauauuauuuuaacuuga

SEQ ID NO: 2778986 - RNA, 14 nt, Leptospira interrogans serovar lai str. 56601
caauauucuaauuu

SEQ ID NO: 2778987 - RNA, 14 nt, Leptospira interrogans serovar lai str. 56601
caauauucuugauu

SEQ ID NO: 2778988 - RNA, 13 nt, Leptospira interrogans serovar lai str. 56601
caaucaaauuuuu

SEQ ID NO: 2778989 - RNA, 15 nt, Leptospira interrogans serovar lai str. 56601
caaucaaauuuuuga

SEQ ID NO: 2778990 - RNA, 15 nt, Leptospira interrogans serovar lai str. 56601
caaucaaauuuuugc

SEQ ID NO: 2778991 - RNA, 21 nt, Leptospira interrogans serovar lai str. 56601
caaucaaauuuuugcauaaaa

SEQ ID NO: 2778992 - RNA, 15 nt, Leptospira interrogans serovar lai str. 56601
caaucaauugaaagu

SEQ ID NO: 2778993 - RNA, 23 nt, Leptospira interrogans serovar lai str. 56601
caaucacguucaacguucaaaca

SEQ ID NO: 2778994 - RNA, 18 nt, Leptospira interrogans serovar lai str. 56601
caaucagauuuuuguagu

SEQ ID NO: 2778995 - RNA, 15 nt, Leptospira interrogans serovar lai str. 56601
caaucaguaaaaugu

SEQ ID NO: 2778996 - RNA, 20 nt, Leptospira interrogans serovar lai str. 56601
caaucauagauacauaaacu

SEQ ID NO: 2778997 - RNA, 14 nt, Leptospira interrogans serovar lai str. 56601
caaucaugaauauu

SEQ ID NO: 2778998 - RNA, 21 nt, Leptospira interrogans serovar lai str. 56601
caaucccggcggaaaauccua

SEQ ID NO: 2778999 - RNA, 20 nt, Leptospira interrogans serovar lai str. 56601
caaucgauaacuugauuuua

SEQ ID NO: 2779000 - RNA, 16 nt, Leptospira interrogans serovar lai str. 56601
caaucggguaaaaaau

SEQ ID NO: 2779001 - RNA, 14 nt, Leptospira interrogans serovar lai str. 56601
caaucgucuguaaa

SEQ ID NO: 2779002 - RNA, 15 nt, Leptospira interrogans serovar lai str. 56601
caaucuccauuauag

SEQ ID NO: 2779003 - RNA, 18 nt, Leptospira interrogans serovar lai str. 56601
caaucuccauuauaguuu

SEQ ID NO: 2779004 - RNA, 22 nt, Leptospira interrogans serovar lai str. 56601
caaucuuagaaugugggaacua

SEQ ID NO: 2779005 - RNA, 13 nt, Leptospira interrogans serovar lai str. 56601
caaucuucaaauu

SEQ ID NO: 2779006 - RNA, 20 nt, Leptospira interrogans serovar lai str. 56601
caaucuuccugggaaguugu

SEQ ID NO: 2779007 - RNA, 15 nt, Leptospira interrogans serovar lai str. 56601
caaugaaaaagcaua

SEQ ID NO: 2779008 - RNA, 12 nt, Leptospira interrogans serovar lai str. 56601
caaugaaaauuc

SEQ ID NO: 2779009 - RNA, 18 nt, Leptospira interrogans serovar lai str. 56601
caaugaauuuuuauaaaa

SEQ ID NO: 2779010 - RNA, 20 nt, Leptospira interrogans serovar lai str. 56601
caaugaauuuuuauaaaaau

SEQ ID NO: 2779011 - RNA, 22 nt, Leptospira interrogans serovar lai str. 56601
caaugaucauauccgaaagaua

SEQ ID NO: 2779012 - RNA, 13 nt, Leptospira interrogans serovar lai str. 56601
caaugauucuaac

SEQ ID NO: 2779013 - RNA, 23 nt, Leptospira interrogans serovar lai str. 56601
caaugauucuaacuuuugcaauc

SEQ ID NO: 2779014 - RNA, 14 nt, Leptospira interrogans serovar lai str. 56601
caaugcaaaaaauu

SEQ ID NO: 2779015 - RNA, 15 nt, Leptospira interrogans serovar lai str. 56601
caaugcaacagaaac

SEQ ID NO: 2779016 - RNA, 14 nt, Leptospira interrogans serovar lai str. 56601
caaugguugcaaaa

SEQ ID NO: 2779017 - RNA, 17 nt, Leptospira interrogans serovar lai str. 56601
caaugugggaacuacua

SEQ ID NO: 2779018 - RNA, 14 nt, Leptospira interrogans serovar lai str. 56601
caauguuauaaaau

SEQ ID NO: 2779019 - RNA, 19 nt, Leptospira interrogans serovar lai str. 56601
caauguuccuguggaaacg

SEQ ID NO: 2779020 - RNA, 14 nt, Leptospira interrogans serovar lai str. 56601
caauguugcuccuu

SEQ ID NO: 2779021 - RNA, 20 nt, Leptospira interrogans serovar lai str. 56601
caauguuuuucgcuuaucaa

SEQ ID NO: 2779022 - RNA, 12 nt, Leptospira interrogans serovar lai str. 56601
caauuaaaaaga

SEQ ID NO: 2779023 - RNA, 14 nt, Leptospira interrogans serovar lai str. 56601
caauuaaaaagaua

SEQ ID NO: 2779024 - RNA, 16 nt, Leptospira interrogans serovar lai str. 56601
caauuaaacuucaaaa

SEQ ID NO: 2779025 - RNA, 19 nt, Leptospira interrogans serovar lai str. 56601
caauuaaacuucaaaaaau

SEQ ID NO: 2779026 - RNA, 20 nt, Leptospira interrogans serovar lai str. 56601
caauuaaacuucaaaaaaua

SEQ ID NO: 2779027 - RNA, 21 nt, Leptospira interrogans serovar lai str. 56601
caauuaaagcgucucauuucu

SEQ ID NO: 2779028 - RNA, 11 nt, Leptospira interrogans serovar lai str. 56601
caauuaacaaa

SEQ ID NO: 2779029 - RNA, 17 nt, Leptospira interrogans serovar lai str. 56601
caauuaacaaaacuacu

SEQ ID NO: 2779030 - RNA, 18 nt, Leptospira interrogans serovar lai str. 56601
caauuaacaaaacuacuu

SEQ ID NO: 2779031 - RNA, 18 nt, Leptospira interrogans serovar lai str. 56601
caauuaacaaaacugcuu

SEQ ID NO: 2779032 - RNA, 20 nt, Leptospira interrogans serovar lai str. 56601
caauuagcguguaugguaaa

SEQ ID NO: 2779033 - RNA, 19 nt, Leptospira interrogans serovar lai str. 56601
cacaucguuaccagcaagc

SEQ ID NO: 2779034 - RNA, 17 nt, Leptospira interrogans serovar lai str. 56601
cacaucuuauuuuuaca

SEQ ID NO: 2779035 - RNA, 18 nt, Leptospira interrogans serovar lai str. 56601
cacauuaaaauaggauuu

SEQ ID NO: 2779036 - RNA, 21 nt, Leptospira interrogans serovar lai str. 56601
cacauuaaaauaggauuuaaa

SEQ ID NO: 2779037 - RNA, 21 nt, Leptospira interrogans serovar lai str. 56601
cacauuauuuaaugaauccua

SEQ ID NO: 2779038 - RNA, 17 nt, Leptospira interrogans serovar lai str. 56601
cacauucauuuuuucua

SEQ ID NO: 2779039 - RNA, 20 nt, Leptospira interrogans serovar lai str. 56601
cacauucauuuuuucuaaau

SEQ ID NO: 2779040 - RNA, 19 nt, Leptospira interrogans serovar lai str. 56601
cacauuguguuuuuuaaca

SEQ ID NO: 2779041 - RNA, 13 nt, Leptospira interrogans serovar lai str. 56601
cacauuuuaaaga

SEQ ID NO: 2779042 - RNA, 13 nt, Leptospira interrogans serovar lai str. 56601
cacauuuuaggaa

SEQ ID NO: 2779043 - RNA, 14 nt, Leptospira interrogans serovar lai str. 56601
cacauuuuucaaau

SEQ ID NO: 2779044 - RNA, 14 nt, Leptospira interrogans serovar lai str. 56601
cacauuuuucaagu

SEQ ID NO: 2779045 - RNA, 21 nt, Leptospira interrogans serovar lai str. 56601
cacauuuuugugaaacuuaau

SEQ ID NO: 2779046 - RNA, 19 nt, Leptospira interrogans serovar lai str. 56601
caccaaccgaaacuuucaa

SEQ ID NO: 2779047 - RNA, 21 nt, Leptospira interrogans serovar lai str. 56601
cacccaaaaauagggaaaacu

SEQ ID NO: 2779048 - RNA, 24 nt, Leptospira interrogans serovar lai str. 56601
caccgcaagaaccguaacugacau

SEQ ID NO: 2779049 - RNA, 17 nt, Leptospira interrogans serovar lai str. 56601
caccggcuacaggugga

SEQ ID NO: 2779050 - RNA, 23 nt, Leptospira interrogans serovar lai str. 56601
caccguugcuauaaaaaggaucu

SEQ ID NO: 2779051 - RNA, 16 nt, Leptospira interrogans serovar lai str. 56601
caccuaaaaugaaaaa

SEQ ID NO: 2779052 - RNA, 15 nt, Leptospira interrogans serovar lai str. 56601
caccugguuuuuugu

SEQ ID NO: 2779053 - RNA, 16 nt, Leptospira interrogans serovar lai str. 56601
caccuucaugagaaac

SEQ ID NO: 2779054 - RNA, 18 nt, Leptospira interrogans serovar lai str. 56601
caccuucaugagaaacaa

SEQ ID NO: 2779055 - RNA, 16 nt, Leptospira interrogans serovar lai str. 56601
caccuuccaaagauuu

SEQ ID NO: 2779056 - RNA, 16 nt, Leptospira interrogans serovar lai str. 56601
caccuucucuuuuaaa

SEQ ID NO: 2779057 - RNA, 13 nt, Leptospira interrogans serovar lai str. 56601
caccuucuuuuuu

SEQ ID NO: 2779058 - RNA, 16 nt, Leptospira interrogans serovar lai str. 56601
caccuuuacauaauaa

SEQ ID NO: 2779059 - RNA, 19 nt, Leptospira interrogans serovar lai str. 56601
caccuuuuuuuaugaaaaa

SEQ ID NO: 2779060 - RNA, 14 nt, Leptospira interrogans serovar lai str. 56601
cacgaaaaaugaau

SEQ ID NO: 2779061 - RNA, 18 nt, Leptospira interrogans serovar lai str. 56601
cacgaaaauuaaaaaauc

SEQ ID NO: 2779062 - RNA, 14 nt, Leptospira interrogans serovar lai str. 56601
cacgaauuccucaa

SEQ ID NO: 2779063 - RNA, 14 nt, Leptospira interrogans serovar lai str. 56601
cacgacgucuauga

SEQ ID NO: 2779064 - RNA, 23 nt, Leptospira interrogans serovar lai str. 56601
cacgauaauuuuuagaaauuuuu

SEQ ID NO: 2779065 - RNA, 20 nt, Leptospira interrogans serovar lai str. 56601
cacgauuuuacgaacaaauu

SEQ ID NO: 2779066 - RNA, 22 nt, Leptospira interrogans serovar lai str. 56601
cacgauuuuacgaacacauucu

SEQ ID NO: 2779067 - RNA, 13 nt, Leptospira interrogans serovar lai str. 56601
cacgcuaaaauaa

SEQ ID NO: 2779068 - RNA, 22 nt, Leptospira interrogans serovar lai str. 56601
cacguaauucuuuggaaauuuu

SEQ ID NO: 2779069 - RNA, 13 nt, Leptospira interrogans serovar lai str. 56601
cacgucccacaaa

SEQ ID NO: 2779070 - RNA, 15 nt, Leptospira interrogans serovar lai str. 56601
cacguuaaaaguaau

SEQ ID NO: 2779071 - RNA, 13 nt, Leptospira interrogans serovar lai str. 56601
cacguuaaaauaa

SEQ ID NO: 2779072 - RNA, 14 nt, Leptospira interrogans serovar lai str. 56601
cacguuaaaauaau

SEQ ID NO: 2779073 - RNA, 18 nt, Leptospira interrogans serovar lai str. 56601
cacguuaaguaggaacua

SEQ ID NO: 2779074 - RNA, 15 nt, Leptospira interrogans serovar lai str. 56601
cacguuaaguuauau

SEQ ID NO: 2779075 - RNA, 14 nt, Leptospira interrogans serovar lai str. 56601
cacguugaauaaga

SEQ ID NO: 2779076 - RNA, 17 nt, Leptospira interrogans serovar lai str. 56601
cacguugaauaagauuu

SEQ ID NO: 2779077 - RNA, 19 nt, Leptospira interrogans serovar lai str. 56601
cacuaaaauacuuuuagaa

SEQ ID NO: 2779078 - RNA, 18 nt, Leptospira interrogans serovar lai str. 56601
cacuacaaucacuuuaua

SEQ ID NO: 2779079 - RNA, 18 nt, Leptospira interrogans serovar lai str. 56601
cacuacggaaggaaaaaa

SEQ ID NO: 2779080 - RNA, 17 nt, Leptospira interrogans serovar lai str. 56601
cacuaugaaaguuuuuc

SEQ ID NO: 2779081 - RNA, 15 nt, Leptospira interrogans serovar lai str. 56601
cacucaauuuuauau

SEQ ID NO: 2779082 - RNA, 13 nt, Leptospira interrogans serovar lai str. 56601
cacucauuuuuag

SEQ ID NO: 2779083 - RNA, 16 nt, Leptospira interrogans serovar lai str. 56601
cacucccccuuccgau

SEQ ID NO: 2779084 - RNA, 17 nt, Leptospira interrogans serovar lai str. 56601
cacucccccuuccgauu

SEQ ID NO: 2779085 - RNA, 15 nt, Leptospira interrogans serovar lai str. 56601
cacuccgauacauuu

SEQ ID NO: 2779086 - RNA, 20 nt, Leptospira interrogans serovar lai str. 56601
cacucuuucaauguuuuucg

SEQ ID NO: 2779087 - RNA, 16 nt, Leptospira interrogans serovar lai str. 56601
cacugaaaauuuaauu

SEQ ID NO: 2779088 - RNA, 15 nt, Leptospira interrogans serovar lai str. 56601
cacugagucaacaaa

SEQ ID NO: 2779089 - RNA, 18 nt, Leptospira interrogans serovar lai str. 56601
cacugcauuuuauuaaaa

SEQ ID NO: 2779090 - RNA, 18 nt, Leptospira interrogans serovar lai str. 56601
cacuuaaaaaguuuuucu

SEQ ID NO: 2779091 - RNA, 19 nt, Leptospira interrogans serovar lai str. 56601
cacuuaugauuuaguaaaa

SEQ ID NO: 2779092 - RNA, 22 nt, Leptospira interrogans serovar lai str. 56601
cacuuauucuuauaagaaucga

SEQ ID NO: 2779093 - RNA, 16 nt, Leptospira interrogans serovar lai str. 56601
cacuuccauuggauuc

SEQ ID NO: 2779094 - RNA, 14 nt, Leptospira interrogans serovar lai str. 56601
cacuuccauuuuuu

SEQ ID NO: 2779095 - RNA, 16 nt, Leptospira interrogans serovar lai str. 56601
cacuucugguuuuuua

SEQ ID NO: 2779096 - RNA, 12 nt, Leptospira interrogans serovar lai str. 56601
cacuugaaaaau

SEQ ID NO: 2779097 - RNA, 13 nt, Leptospira interrogans serovar lai str. 56601
cacuuuauaaaag

SEQ ID NO: 2779098 - RNA, 20 nt, Leptospira interrogans serovar lai str. 56601
cacuuuauaaaaguauaaua

SEQ ID NO: 2779099 - RNA, 13 nt, Leptospira interrogans serovar lai str. 56601
cacuuuuccaaau

SEQ ID NO: 2779100 - RNA, 22 nt, Leptospira interrogans serovar lai str. 56601
cacuuuuguugcggagaauguu

SEQ ID NO: 2779101 - RNA, 13 nt, Leptospira interrogans serovar lai str. 56601
cacuuuuuuaaag

SEQ ID NO: 2779102 - RNA, 14 nt, Leptospira interrogans serovar lai str. 56601
cacuuuuuuaaagu

SEQ ID NO: 2779103 - RNA, 15 nt, Leptospira interrogans serovar lai str. 56601
cacuuuuuuaaagug

SEQ ID NO: 2779104 - RNA, 14 nt, Leptospira interrogans serovar lai str. 56601
cagaaaaaaaaaga

SEQ ID NO: 2779105 - RNA, 23 nt, Leptospira interrogans serovar lai str. 56601
cagaaaaaaaaagaauuucuaaa

SEQ ID NO: 2779106 - RNA, 14 nt, Leptospira interrogans serovar lai str. 56601
cagaaaaaaccucc

SEQ ID NO: 2779107 - RNA, 16 nt, Leptospira interrogans serovar lai str. 56601
cagaaaaaauccauau

SEQ ID NO: 2779108 - RNA, 15 nt, Leptospira interrogans serovar lai str. 56601
cagaaaaacaaaaaa

SEQ ID NO: 2779109 - RNA, 11 nt, Leptospira interrogans serovar lai str. 56601
cagaaaaagug

SEQ ID NO: 2779110 - RNA, 13 nt, Leptospira interrogans serovar lai str. 56601
cagaaaaaugaau

SEQ ID NO: 2779111 - RNA, 16 nt, Leptospira interrogans serovar lai str. 56601
cagaaaccauaaaaua

SEQ ID NO: 2779112 - RNA, 17 nt, Leptospira interrogans serovar lai str. 56601
cagaaaccauaaaauaa

SEQ ID NO: 2779113 - RNA, 22 nt, Leptospira interrogans serovar lai str. 56601
cagaaaccauaaaauaaaaaac

SEQ ID NO: 2779114 - RNA, 20 nt, Leptospira interrogans serovar lai str. 56601
cagaaacggauggagaauuu

SEQ ID NO: 2779115 - RNA, 12 nt, Leptospira interrogans serovar lai str. 56601
cagaaagaaguu

SEQ ID NO: 2779116 - RNA, 14 nt, Leptospira interrogans serovar lai str. 56601
caguaaaaaagcga

SEQ ID NO: 2779117 - RNA, 23 nt, Leptospira interrogans serovar lai str. 56601
caguaaaaaagcgaaagaaugua

SEQ ID NO: 2779118 - RNA, 17 nt, Leptospira interrogans serovar lai str. 56601
caguaaaacgcucucua

SEQ ID NO: 2779119 - RNA, 19 nt, Leptospira interrogans serovar lai str. 56601
caguaaaacuuugagaugu

SEQ ID NO: 2779120 - RNA, 19 nt, Leptospira interrogans serovar lai str. 56601
caguaaaaucuaaauuugu

SEQ ID NO: 2779121 - RNA, 13 nt, Leptospira interrogans serovar lai str. 56601
caguaaaaucuuu

SEQ ID NO: 2779122 - RNA, 14 nt, Leptospira interrogans serovar lai str. 56601
caguaagaagaaaa

SEQ ID NO: 2779123 - RNA, 16 nt, Leptospira interrogans serovar lai str. 56601
caguaaggauucuuuu

SEQ ID NO: 2779124 - RNA, 19 nt, Leptospira interrogans serovar lai str. 56601
caguaauaaucuaaacuug

SEQ ID NO: 2779125 - RNA, 15 nt, Leptospira interrogans serovar lai str. 56601
caguacaagaaucaa

SEQ ID NO: 2779126 - RNA, 15 nt, Leptospira interrogans serovar lai str. 56601
caguacaauucaaaa

SEQ ID NO: 2779127 - RNA, 17 nt, Leptospira interrogans serovar lai str. 56601
caguacuauauuuuugu

SEQ ID NO: 2779128 - RNA, 20 nt, Leptospira interrogans serovar lai str. 56601
caguacuauauuuuugugaa

SEQ ID NO: 2779129 - RNA, 14 nt, Leptospira interrogans serovar lai str. 56601
caguaggcuauuuu

SEQ ID NO: 2779130 - RNA, 16 nt, Leptospira interrogans serovar lai str. 56601
caguauguuuuuuuga

SEQ ID NO: 2779131 - RNA, 16 nt, Leptospira interrogans serovar lai str. 56601
caguauucaauuuuua

SEQ ID NO: 2779132 - RNA, 19 nt, Leptospira interrogans serovar lai str. 56601
caguauucaauuuuuauag

SEQ ID NO: 2779133 - RNA, 19 nt, Leptospira interrogans serovar lai str. 56601
caguauuuguaaaaaugag

SEQ ID NO: 2779134 - RNA, 17 nt, Leptospira interrogans serovar lai str. 56601
cagucaccucuauaaaa

SEQ ID NO: 2779135 - RNA, 14 nt, Leptospira interrogans serovar lai str. 56601
cagucauaaaaaac

SEQ ID NO: 2779136 - RNA, 22 nt, Leptospira interrogans serovar lai str. 56601
cagucgcacccccgucuacuuu

SEQ ID NO: 2779137 - RNA, 20 nt, Leptospira interrogans serovar lai str. 56601
cagugaauaaaauaaaaaaa

SEQ ID NO: 2779138 - RNA, 22 nt, Leptospira interrogans serovar lai str. 56601
cagugaauaaaauaaaaaaaua

SEQ ID NO: 2779139 - RNA, 14 nt, Leptospira interrogans serovar lai str. 56601
cagugccauuuuuc

SEQ ID NO: 2779140 - RNA, 16 nt, Leptospira interrogans serovar lai str. 56601
cagugccauuuuucuu

SEQ ID NO: 2779141 - RNA, 20 nt, Leptospira interrogans serovar lai str. 56601
caguguuuugugauaaaauu

SEQ ID NO: 2779142 - RNA, 22 nt, Leptospira interrogans serovar lai str. 56601
caguuaaacuuugaaaauugug

SEQ ID NO: 2779143 - RNA, 17 nt, Leptospira interrogans serovar lai str. 56601
caguuaaacuuuguaaa

SEQ ID NO: 2779144 - RNA, 12 nt, Leptospira interrogans serovar lai str. 56601
caguuaaaucac

SEQ ID NO: 2779145 - RNA, 16 nt, Leptospira interrogans serovar lai str. 56601
caguuaaauucaucaa

SEQ ID NO: 2779146 - RNA, 23 nt, Leptospira interrogans serovar lai str. 56601
caguuaaauucaucaaugaauau

SEQ ID NO: 2779147 - RNA, 14 nt, Leptospira interrogans serovar lai str. 56601
caguuaauaaauug

SEQ ID NO: 2779148 - RNA, 15 nt, Leptospira interrogans serovar lai str. 56601
caguuaauacaaaac

SEQ ID NO: 2779149 - RNA, 19 nt, Leptospira interrogans serovar lai str. 56601
caguuauuauuuaacauga

SEQ ID NO: 2779150 - RNA, 15 nt, Leptospira interrogans serovar lai str. 56601
caguucaaaauauuu

SEQ ID NO: 2779151 - RNA, 15 nt, Leptospira interrogans serovar lai str. 56601
caguuccacuuuaaa

SEQ ID NO: 2779152 - RNA, 17 nt, Leptospira interrogans serovar lai str. 56601
caguucuaaugucguua

SEQ ID NO: 2779153 - RNA, 12 nt, Leptospira interrogans serovar lai str. 56601
caguucuacuuu

SEQ ID NO: 2779154 - RNA, 14 nt, Leptospira interrogans serovar lai str. 56601
caguucuacuuuau

SEQ ID NO: 2779155 - RNA, 11 nt, Leptospira interrogans serovar lai str. 56601
caguucugaga

SEQ ID NO: 2779156 - RNA, 11 nt, Leptospira interrogans serovar lai str. 56601
caguuucuccg

SEQ ID NO: 2779157 - RNA, 19 nt, Leptospira interrogans serovar lai str. 56601
caguuuggcauuuauauuc

SEQ ID NO: 2779158 - RNA, 20 nt, Leptospira interrogans serovar lai str. 56601
caguuuuacuguaaaauuua

SEQ ID NO: 2779159 - RNA, 19 nt, Leptospira interrogans serovar lai str. 56601
caguuuuguuaaccaaaaa

SEQ ID NO: 2779160 - RNA, 15 nt, Leptospira interrogans serovar lai str. 56601
caguuuuuucguaaa

SEQ ID NO: 2779161 - RNA, 18 nt, Leptospira interrogans serovar lai str. 56601
caguuuuuucguaaaaaa

SEQ ID NO: 2779162 - RNA, 11 nt, Leptospira interrogans serovar lai str. 56601
cauaaaaaaau

SEQ ID NO: 2779163 - RNA, 12 nt, Leptospira interrogans serovar lai str. 56601
cauaaaaaaaua

SEQ ID NO: 2779164 - RNA, 17 nt, Leptospira interrogans serovar lai str. 56601
cauaaaaaaauuaaaaa

SEQ ID NO: 2779165 - RNA, 13 nt, Leptospira interrogans serovar lai str. 56601
cauaaaaaacaua

SEQ ID NO: 2779166 - RNA, 12 nt, Leptospira interrogans serovar lai str. 56601
cauaaaaauaaa

SEQ ID NO: 2779167 - RNA, 16 nt, Leptospira interrogans serovar lai str. 56601
cauaaaaauacuuuau

SEQ ID NO: 2779168 - RNA, 17 nt, Leptospira interrogans serovar lai str. 56601
cauaaaacucuaaauuc

SEQ ID NO: 2779169 - RNA, 13 nt, Leptospira interrogans serovar lai str. 56601
cauaaaagaaaca

SEQ ID NO: 2779170 - RNA, 15 nt, Leptospira interrogans serovar lai str. 56601
cauaaaauaaaaaac

SEQ ID NO: 2779171 - RNA, 17 nt, Leptospira interrogans serovar lai str. 56601
cauaaaauaaaaaacaa

SEQ ID NO: 2779172 - RNA, 17 nt, Leptospira interrogans serovar lai str. 56601
cauaaaauaacuuccau

SEQ ID NO: 2779173 - RNA, 20 nt, Leptospira interrogans serovar lai str. 56601
cauaaaauagaaacaaaugg

SEQ ID NO: 2779174 - RNA, 20 nt, Leptospira interrogans serovar lai str. 56601
cauaaacgauuauuuuuuaa

SEQ ID NO: 2779175 - RNA, 18 nt, Leptospira interrogans serovar lai str. 56601
cauaaacuucaucuauuc

SEQ ID NO: 2779176 - RNA, 21 nt, Leptospira interrogans serovar lai str. 56601
cauaaagagcguuguguugag

SEQ ID NO: 2779177 - RNA, 19 nt, Leptospira interrogans serovar lai str. 56601
cauaaaggugcaugaaaau

SEQ ID NO: 2779178 - RNA, 22 nt, Leptospira interrogans serovar lai str. 56601
cauaaaggugcaugaaaauaau

SEQ ID NO: 2779179 - RNA, 22 nt, Leptospira interrogans serovar lai str. 56601
cauaaaguuaauacaaaaaacu

SEQ ID NO: 2779180 - RNA, 13 nt, Leptospira interrogans serovar lai str. 56601
cauaaaugauaau

SEQ ID NO: 2779181 - RNA, 16 nt, Leptospira interrogans serovar lai str. 56601
cauaaaugauacuuug

SEQ ID NO: 2779182 - RNA, 20 nt, Leptospira interrogans serovar lai str. 56601
cauaaaugauacuuuguaaa

SEQ ID NO: 2779183 - RNA, 22 nt, Leptospira interrogans serovar lai str. 56601
cauaaauggcguauaagaaugu

SEQ ID NO: 2779184 - RNA, 23 nt, Leptospira interrogans serovar lai str. 56601
cauaaauucuacaaauucuucuu

SEQ ID NO: 2779185 - RNA, 11 nt, Leptospira interrogans serovar lai str. 56601
cauaaauuuug

SEQ ID NO: 2779186 - RNA, 13 nt, Leptospira interrogans serovar lai str. 56601
cauaaauuuugug

SEQ ID NO: 2779187 - RNA, 15 nt, Leptospira interrogans serovar lai str. 56601
cauaaauuuuuugga

SEQ ID NO: 2779188 - RNA, 22 nt, Leptospira interrogans serovar lai str. 56601
cauaaauuuuuuggaaaucgaa

SEQ ID NO: 2779189 - RNA, 14 nt, Leptospira interrogans serovar lai str. 56601
cauaaccuuaccca

SEQ ID NO: 2779190 - RNA, 21 nt, Leptospira interrogans serovar lai str. 56601
cauaaccuuacccacaaauaa

SEQ ID NO: 2779191 - RNA, 23 nt, Leptospira interrogans serovar lai str. 56601
cauaaccuuacccacaaauaauu

SEQ ID NO: 2779192 - RNA, 14 nt, Leptospira interrogans serovar lai str. 56601
cauaacuaauaaaa

SEQ ID NO: 2779193 - RNA, 16 nt, Leptospira interrogans serovar lai str. 56601
cauaacuaauaaaaac

SEQ ID NO: 2779194 - RNA, 17 nt, Leptospira interrogans serovar lai str. 56601
cauaacuaauaaaaaca

SEQ ID NO: 2779195 - RNA, 19 nt, Leptospira interrogans serovar lai str. 56601
cauaacuaauaaaaacaau

SEQ ID NO: 2779196 - RNA, 16 nt, Leptospira interrogans serovar lai str. 56601
cauaagaccauauuga

SEQ ID NO: 2779197 - RNA, 14 nt, Leptospira interrogans serovar lai str. 56601
cauaagcaaaaaua

SEQ ID NO: 2779198 - RNA, 16 nt, Leptospira interrogans serovar lai str. 56601
cauaagcaaaaauaaa

SEQ ID NO: 2779199 - RNA, 19 nt, Leptospira interrogans serovar lai str. 56601
caugaaaauaauacuacca

SEQ ID NO: 2779200 - RNA, 21 nt, Leptospira interrogans serovar lai str. 56601
caugaaaucaguguuuuguga

SEQ ID NO: 2779201 - RNA, 18 nt, Leptospira interrogans serovar lai str. 56601
caugaaauuuucuuagaa

SEQ ID NO: 2779202 - RNA, 21 nt, Leptospira interrogans serovar lai str. 56601
caugaauaaacaauaaaauaa

SEQ ID NO: 2779203 - RNA, 22 nt, Leptospira interrogans serovar lai str. 56601
caugaauaaacaauaaaauaac

SEQ ID NO: 2779204 - RNA, 17 nt, Leptospira interrogans serovar lai str. 56601
caugacuacagaauaaa

SEQ ID NO: 2779205 - RNA, 13 nt, Leptospira interrogans serovar lai str. 56601
caugagaaacaaa

SEQ ID NO: 2779206 - RNA, 14 nt, Leptospira interrogans serovar lai str. 56601
caugagacuauaaa

SEQ ID NO: 2779207 - RNA, 15 nt, Leptospira interrogans serovar lai str. 56601
caugagacuauaaag

SEQ ID NO: 2779208 - RNA, 17 nt, Leptospira interrogans serovar lai str. 56601
caugagcauucuugaga

SEQ ID NO: 2779209 - RNA, 21 nt, Leptospira interrogans serovar lai str. 56601
caugaguucggcguaagaaaa

SEQ ID NO: 2779210 - RNA, 13 nt, Leptospira interrogans serovar lai str. 56601
caugauaaaaauu

SEQ ID NO: 2779211 - RNA, 22 nt, Leptospira interrogans serovar lai str. 56601
caugauccauuuuucugaaaaa

SEQ ID NO: 2779212 - RNA, 22 nt, Leptospira interrogans serovar lai str. 56601
caugaugauuggacuaaaccac

SEQ ID NO: 2779213 - RNA, 13 nt, Leptospira interrogans serovar lai str. 56601
caugauucauuuu

SEQ ID NO: 2779214 - RNA, 13 nt, Leptospira interrogans serovar lai str. 56601
caugauucugaaa

SEQ ID NO: 2779215 - RNA, 16 nt, Leptospira interrogans serovar lai str. 56601
caugauucugaaaaaa

SEQ ID NO: 2779216 - RNA, 18 nt, Leptospira interrogans serovar lai str. 56601
caugauucugaaaagaau

SEQ ID NO: 2779217 - RNA, 14 nt, Leptospira interrogans serovar lai str. 56601
caugauuuguaaua

SEQ ID NO: 2779218 - RNA, 17 nt, Leptospira interrogans serovar lai str. 56601
caugauuuuuuaaucug

SEQ ID NO: 2779219 - RNA, 23 nt, Leptospira interrogans serovar lai str. 56601
caugauuuuuuaaucuggaaacg

SEQ ID NO: 2779220 - RNA, 18 nt, Leptospira interrogans serovar lai str. 56601
caugccaaacacgaauuc

SEQ ID NO: 2779221 - RNA, 21 nt, Leptospira interrogans serovar lai str. 56601
caugcuguaguuuauuuuucu

SEQ ID NO: 2779222 - RNA, 16 nt, Leptospira interrogans serovar lai str. 56601
cauggaggcugccgcu

SEQ ID NO: 2779223 - RNA, 23 nt, Leptospira interrogans serovar lai str. 56601
cauggaggcugccgcucuuucuu

SEQ ID NO: 2779224 - RNA, 18 nt, Leptospira interrogans serovar lai str. 56601
cauggaugaauugauuuu

SEQ ID NO: 2779225 - RNA, 16 nt, Leptospira interrogans serovar lai str. 56601
cauggcuuugaaaaag

SEQ ID NO: 2779226 - RNA, 17 nt, Leptospira interrogans serovar lai str. 56601
cauggcuuugaaaaagg

SEQ ID NO: 2779227 - RNA, 22 nt, Leptospira interrogans serovar lai str. 56601
cauguauauaaauuuauauuuu

SEQ ID NO: 2779228 - RNA, 15 nt, Leptospira interrogans serovar lai str. 56601
cauguauuacucaga

SEQ ID NO: 2779229 - RNA, 17 nt, Leptospira interrogans serovar lai str. 56601
cauguuuuaaugaaaaa

SEQ ID NO: 2779230 - RNA, 23 nt, Leptospira interrogans serovar lai str. 56601
cauguuuuaaugaaaaauuucuu

SEQ ID NO: 2779231 - RNA, 16 nt, Leptospira interrogans serovar lai str. 56601
cauguuuuauauaaag

SEQ ID NO: 2779232 - RNA, 13 nt, Leptospira interrogans serovar lai str. 56601
cauguuuuuaaaa

SEQ ID NO: 2779233 - RNA, 15 nt, Leptospira interrogans serovar lai str. 56601
cauuaaaaaagauaa

SEQ ID NO: 2779234 - RNA, 11 nt, Leptospira interrogans serovar lai str. 56601
cauuaaaaagc

SEQ ID NO: 2779235 - RNA, 15 nt, Leptospira interrogans serovar lai str. 56601
cauuaaaauaggauu

SEQ ID NO: 2779236 - RNA, 20 nt, Leptospira interrogans serovar lai str. 56601
cauuaaaauaggauuuaaau

SEQ ID NO: 2779237 - RNA, 17 nt, Leptospira interrogans serovar lai str. 56601
cauuaaacaauuuuuca

SEQ ID NO: 2779238 - RNA, 18 nt, Leptospira interrogans serovar lai str. 56601
cauuaaaguccaaaucaa

SEQ ID NO: 2779239 - RNA, 14 nt, Leptospira interrogans serovar lai str. 56601
cauuaaauucuagc

SEQ ID NO: 2779240 - RNA, 17 nt, Leptospira interrogans serovar lai str. 56601
cauuaacuauauaauaa

SEQ ID NO: 2779241 - RNA, 20 nt, Leptospira interrogans serovar lai str. 56601
cauuaagggaguuuguaaag

SEQ ID NO: 2779242 - RNA, 14 nt, Leptospira interrogans serovar lai str. 56601
cauuacaaaacacu

SEQ ID NO: 2779243 - RNA, 23 nt, Leptospira interrogans serovar lai str. 56601
cauuagaguuguugaacauucca

SEQ ID NO: 2779244 - RNA, 16 nt, Leptospira interrogans serovar lai str. 56601
cauuauaaguuuuuau

SEQ ID NO: 2779245 - RNA, 23 nt, Leptospira interrogans serovar lai str. 56601
cauuauaaguuuuuauuauaaaa

SEQ ID NO: 2779246 - RNA, 22 nt, Leptospira interrogans serovar lai str. 56601
cauuauacaucauauuauuugu

SEQ ID NO: 2779247 - RNA, 18 nt, Leptospira interrogans serovar lai str. 56601
cauuauaguuuuuucaaa

SEQ ID NO: 2779248 - RNA, 17 nt, Leptospira interrogans serovar lai str. 56601
cauuaugaauuuuuaaa

SEQ ID NO: 2779249 - RNA, 18 nt, Leptospira interrogans serovar lai str. 56601
cauuaugcgcaaucucaa

SEQ ID NO: 2779250 - RNA, 19 nt, Leptospira interrogans serovar lai str. 56601
cauuauuuauaauuuuaua

SEQ ID NO: 2779251 - RNA, 21 nt, Leptospira interrogans serovar lai str. 56601
cauuauuucaaugcaaaaaau

SEQ ID NO: 2779252 - RNA, 16 nt, Leptospira interrogans serovar lai str. 56601
cauuauuuuauggaca

SEQ ID NO: 2779253 - RNA, 16 nt, Leptospira interrogans serovar lai str. 56601
cauucaaaaaaucaaa

SEQ ID NO: 2779254 - RNA, 18 nt, Leptospira interrogans serovar lai str. 56601
cauucaaaaaguuuuaua

SEQ ID NO: 2779255 - RNA, 20 nt, Leptospira interrogans serovar lai str. 56601
cauucaaauuucugaaacaa

SEQ ID NO: 2779256 - RNA, 13 nt, Leptospira interrogans serovar lai str. 56601
cauucaagguaau

SEQ ID NO: 2779257 - RNA, 14 nt, Leptospira interrogans serovar lai str. 56601
cauucaggauuacu

SEQ ID NO: 2779258 - RNA, 23 nt, Leptospira interrogans serovar lai str. 56601
cauucaucaaaguuauuucgauu

SEQ ID NO: 2779259 - RNA, 22 nt, Leptospira interrogans serovar lai str. 56601
cauucauccuaagaaucaaauc

SEQ ID NO: 2779260 - RNA, 13 nt, Leptospira interrogans serovar lai str. 56601
cauucauuuuuau

SEQ ID NO: 2779261 - RNA, 13 nt, Leptospira interrogans serovar lai str. 56601
cauuccaauuucc

SEQ ID NO: 2779262 - RNA, 20 nt, Leptospira interrogans serovar lai str. 56601
cauuccaauuuccuaaaauu

SEQ ID NO: 2779263 - RNA, 16 nt, Leptospira interrogans serovar lai str. 56601
cauuccauaaugaaga

SEQ ID NO: 2779264 - RNA, 19 nt, Leptospira interrogans serovar lai str. 56601
cauucccauccgaaauccc

SEQ ID NO: 2779265 - RNA, 18 nt, Leptospira interrogans serovar lai str. 56601
cauuccgcaaaaauuccu

SEQ ID NO: 2779266 - RNA, 21 nt, Leptospira interrogans serovar lai str. 56601
cauuccgcaaaaauuccuuuu

SEQ ID NO: 2779267 - RNA, 18 nt, Leptospira interrogans serovar lai str. 56601
cauucgcgacgauugauc

SEQ ID NO: 2779268 - RNA, 12 nt, Leptospira interrogans serovar lai str. 56601
cauucuaaaauu

SEQ ID NO: 2779269 - RNA, 16 nt, Leptospira interrogans serovar lai str. 56601
cauucuaagaucugau

SEQ ID NO: 2779270 - RNA, 20 nt, Leptospira interrogans serovar lai str. 56601
cauucuacuuugaaugaaaa

SEQ ID NO: 2779271 - RNA, 23 nt, Leptospira interrogans serovar lai str. 56601
cauucuagaaccuggaaaagaau

SEQ ID NO: 2779272 - RNA, 15 nt, Leptospira interrogans serovar lai str. 56601
cauucuaguuuguuu

SEQ ID NO: 2779273 - RNA, 21 nt, Leptospira interrogans serovar lai str. 56601
cauucuauuuggauuuuauaa

SEQ ID NO: 2779274 - RNA, 16 nt, Leptospira interrogans serovar lai str. 56601
cauucugaaaaaaguu

SEQ ID NO: 2779275 - RNA, 15 nt, Leptospira interrogans serovar lai str. 56601
cauucugaaacuuuu

SEQ ID NO: 2779276 - RNA, 19 nt, Leptospira interrogans serovar lai str. 56601
cauucugaaacuuuucaaa

SEQ ID NO: 2779277 - RNA, 16 nt, Leptospira interrogans serovar lai str. 56601
cauucuucaaauaaca

SEQ ID NO: 2779278 - RNA, 19 nt, Leptospira interrogans serovar lai str. 56601
cauucuugucggaacacuu

SEQ ID NO: 2779279 - RNA, 17 nt, Leptospira interrogans serovar lai str. 56601
cauucuuuagaaauuuu

SEQ ID NO: 2779280 - RNA, 18 nt, Leptospira interrogans serovar lai str. 56601
cauucuuuagaaauuuuu

SEQ ID NO: 2779281 - RNA, 18 nt, Leptospira interrogans serovar lai str. 56601
cauucuuuccuauaaaag

SEQ ID NO: 2779282 - RNA, 21 nt, Leptospira interrogans serovar lai str. 56601
ccaaaaccucaaaaaauuuua

SEQ ID NO: 2779283 - RNA, 21 nt, Leptospira interrogans serovar lai str. 56601
ccaaaacgcgauccguaaaaa

SEQ ID NO: 2779284 - RNA, 20 nt, Leptospira interrogans serovar lai str. 56601
ccaaaacuucaaagaaucuu

SEQ ID NO: 2779285 - RNA, 15 nt, Leptospira interrogans serovar lai str. 56601
ccaaaagaacuuuga

SEQ ID NO: 2779286 - RNA, 19 nt, Leptospira interrogans serovar lai str. 56601
ccaaaaggcacauuuuuca

SEQ ID NO: 2779287 - RNA, 23 nt, Leptospira interrogans serovar lai str. 56601
ccaaaaguccaauuuuaaaacca

SEQ ID NO: 2779288 - RNA, 13 nt, Leptospira interrogans serovar lai str. 56601
ccaaaaucccaga

SEQ ID NO: 2779289 - RNA, 14 nt, Leptospira interrogans serovar lai str. 56601
ccaaaaucguccaa

SEQ ID NO: 2779290 - RNA, 16 nt, Leptospira interrogans serovar lai str. 56601
ccaaaaugaauuguaa

SEQ ID NO: 2779291 - RNA, 23 nt, Leptospira interrogans serovar lai str. 56601
ccaaaauuguuggccuuuuugaa

SEQ ID NO: 2779292 - RNA, 13 nt, Leptospira interrogans serovar lai str. 56601
ccaaaauuuagaa

SEQ ID NO: 2779293 - RNA, 20 nt, Leptospira interrogans serovar lai str. 56601
ccaaaauuuagaauuguuau

SEQ ID NO: 2779294 - RNA, 19 nt, Leptospira interrogans serovar lai str. 56601
ccaaacagccaaagaaaua

SEQ ID NO: 2779295 - RNA, 17 nt, Leptospira interrogans serovar lai str. 56601
ccaaacucaaugcugcu

SEQ ID NO: 2779296 - RNA, 18 nt, Leptospira interrogans serovar lai str. 56601
ccaaacucaaugcugcuc

SEQ ID NO: 2779297 - RNA, 21 nt, Leptospira interrogans serovar lai str. 56601
ccaaacucuuaaucugcugaa

SEQ ID NO: 2779298 - RNA, 22 nt, Leptospira interrogans serovar lai str. 56601
ccaaaggauaaucuaccccauc

SEQ ID NO: 2779299 - RNA, 22 nt, Leptospira interrogans serovar lai str. 56601
ccaaagucgcccaaaccccagu

SEQ ID NO: 2779300 - RNA, 13 nt, Leptospira interrogans serovar lai str. 56601
ccaaauaaaaaca

SEQ ID NO: 2779301 - RNA, 15 nt, Leptospira interrogans serovar lai str. 56601
ccaaauaauaaaacu

SEQ ID NO: 2779302 - RNA, 23 nt, Leptospira interrogans serovar lai str. 56601
ccaaauacuuagaauuuuuucgu

SEQ ID NO: 2779303 - RNA, 22 nt, Leptospira interrogans serovar lai str. 56601
ccaaaucgcugguuuuauuucu

SEQ ID NO: 2779304 - RNA, 23 nt, Leptospira interrogans serovar lai str. 56601
ccaaaucgcugguuuuauuucug

SEQ ID NO: 2779305 - RNA, 15 nt, Leptospira interrogans serovar lai str. 56601
ccaaaugcgaccuaa

SEQ ID NO: 2779306 - RNA, 14 nt, Leptospira interrogans serovar lai str. 56601
ccaaauucuuuccu

SEQ ID NO: 2779307 - RNA, 21 nt, Leptospira interrogans serovar lai str. 56601
ccaaauuugcgaaaaaaauaa

SEQ ID NO: 2779308 - RNA, 13 nt, Leptospira interrogans serovar lai str. 56601
ccaaauuuuuaga

SEQ ID NO: 2779309 - RNA, 14 nt, Leptospira interrogans serovar lai str. 56601
ccaaauuuuuuaca

SEQ ID NO: 2779310 - RNA, 15 nt, Leptospira interrogans serovar lai str. 56601
ccaaauuuuuuacaa

SEQ ID NO: 2779311 - RNA, 19 nt, Leptospira interrogans serovar lai str. 56601
ccaaccagagccguaaaua

SEQ ID NO: 2779312 - RNA, 22 nt, Leptospira interrogans serovar lai str. 56601
ccaaccgaaacuuucaaaauag

SEQ ID NO: 2779313 - RNA, 13 nt, Leptospira interrogans serovar lai str. 56601
ccaacguaccaaa

SEQ ID NO: 2779314 - RNA, 21 nt, Leptospira interrogans serovar lai str. 56601
ccaacugaaaaugaccaaaau

SEQ ID NO: 2779315 - RNA, 12 nt, Leptospira interrogans serovar lai str. 56601
ccaagacgucua

SEQ ID NO: 2779316 - RNA, 22 nt, Leptospira interrogans serovar lai str. 56601
ccaagauucaaagauaaaauau

SEQ ID NO: 2779317 - RNA, 14 nt, Leptospira interrogans serovar lai str. 56601
ccaagcaauucuaa

SEQ ID NO: 2779318 - RNA, 15 nt, Leptospira interrogans serovar lai str. 56601
ccaaggauaacccuc

SEQ ID NO: 2779319 - RNA, 18 nt, Leptospira interrogans serovar lai str. 56601
ccaaguauaaaagugaau

SEQ ID NO: 2779320 - RNA, 15 nt, Leptospira interrogans serovar lai str. 56601
ccaaguauucuauuu

SEQ ID NO: 2779321 - RNA, 23 nt, Leptospira interrogans serovar lai str. 56601
ccaaguguggucuauuacaaaac

SEQ ID NO: 2779322 - RNA, 20 nt, Leptospira interrogans serovar lai str. 56601
ccaaguucgauuaaaauaaa

SEQ ID NO: 2779323 - RNA, 15 nt, Leptospira interrogans serovar lai str. 56601
ccaauaaaaacuaau

SEQ ID NO: 2779324 - RNA, 21 nt, Leptospira interrogans serovar lai str. 56601
ccaaucaaauuuuugcauaaa

SEQ ID NO: 2779325 - RNA, 11 nt, Leptospira interrogans serovar lai str. 56601
ccaauccaaaa

SEQ ID NO: 2779326 - RNA, 13 nt, Leptospira interrogans serovar lai str. 56601
ccaaugcgaaaua

SEQ ID NO: 2779327 - RNA, 14 nt, Leptospira interrogans serovar lai str. 56601
ccaauuaacaaaac

SEQ ID NO: 2779328 - RNA, 16 nt, Leptospira interrogans serovar lai str. 56601
ccaauuaacaaaacug

SEQ ID NO: 2779329 - RNA, 19 nt, Leptospira interrogans serovar lai str. 56601
ccaauuaacaaaacugcuu

SEQ ID NO: 2779330 - RNA, 20 nt, Leptospira interrogans serovar lai str. 56601
ccaauuauaaaauuuuucuc

SEQ ID NO: 2779331 - RNA, 12 nt, Leptospira interrogans serovar lai str. 56601
ccaauuccaaac

SEQ ID NO: 2779332 - RNA, 18 nt, Leptospira interrogans serovar lai str. 56601
ccaauuccaccuuggaaa

SEQ ID NO: 2779333 - RNA, 22 nt, Leptospira interrogans serovar lai str. 56601
ccaauucgguugacuccaaaaa

SEQ ID NO: 2779334 - RNA, 12 nt, Leptospira interrogans serovar lai str. 56601
ccaauucuaaaa

SEQ ID NO: 2779335 - RNA, 18 nt, Leptospira interrogans serovar lai str. 56601
ccaauugaauauaaaauu

SEQ ID NO: 2779336 - RNA, 15 nt, Leptospira interrogans serovar lai str. 56601
ccaauuucaauuucu

SEQ ID NO: 2779337 - RNA, 22 nt, Leptospira interrogans serovar lai str. 56601
ccaauuuugcuucuaaaaagga

SEQ ID NO: 2779338 - RNA, 21 nt, Leptospira interrogans serovar lai str. 56601
ccaauuuuuuuguaaaaaaau

SEQ ID NO: 2779339 - RNA, 15 nt, Leptospira interrogans serovar lai str. 56601
ccacaaaaacaaauu

SEQ ID NO: 2779340 - RNA, 18 nt, Leptospira interrogans serovar lai str. 56601
ccacaaaucuaaauuuua

SEQ ID NO: 2779341 - RNA, 16 nt, Leptospira interrogans serovar lai str. 56601
ccacaaauuccugccu

SEQ ID NO: 2779342 - RNA, 13 nt, Leptospira interrogans serovar lai str. 56601
ccacaaguugaau

SEQ ID NO: 2779343 - RNA, 16 nt, Leptospira interrogans serovar lai str. 56601
ccacaaucaagauggg

SEQ ID NO: 2779344 - RNA, 20 nt, Leptospira interrogans serovar lai str. 56601
ccacagguuuuaaacuauag

SEQ ID NO: 2779345 - RNA, 21 nt, Leptospira interrogans serovar lai str. 56601
ccacaguaggcuauuuuacug

SEQ ID NO: 2779346 - RNA, 20 nt, Leptospira interrogans serovar lai str. 56601
ccacagugaaagauuaaaga

SEQ ID NO: 2779347 - RNA, 18 nt, Leptospira interrogans serovar lai str. 56601
ccacaucgaaaaaacaaa

SEQ ID NO: 2779348 - RNA, 16 nt, Leptospira interrogans serovar lai str. 56601
ccacaucuuauuuuua

SEQ ID NO: 2779349 - RNA, 22 nt, Leptospira interrogans serovar lai str. 56601
ccacaucuuauuuuuacagaaa

SEQ ID NO: 2779350 - RNA, 21 nt, Leptospira interrogans serovar lai str. 56601
ccacauuggacgauuuugaga

SEQ ID NO: 2779351 - RNA, 16 nt, Leptospira interrogans serovar lai str. 56601
ccacauuuauuuuuac

SEQ ID NO: 2779352 - RNA, 16 nt, Leptospira interrogans serovar lai str. 56601
ccacauuuauuuuuua

SEQ ID NO: 2779353 - RNA, 15 nt, Leptospira interrogans serovar lai str. 56601
ccacauuuuagaaau

SEQ ID NO: 2779354 - RNA, 17 nt, Leptospira interrogans serovar lai str. 56601
ccacauuuucaaaaucu

SEQ ID NO: 2779355 - RNA, 12 nt, Leptospira interrogans serovar lai str. 56601
ccacccaaaccg

SEQ ID NO: 2779356 - RNA, 16 nt, Leptospira interrogans serovar lai str. 56601
ccacccaaaccggaga

SEQ ID NO: 2779357 - RNA, 13 nt, Leptospira interrogans serovar lai str. 56601
ccaccuaaaauga

SEQ ID NO: 2779358 - RNA, 16 nt, Leptospira interrogans serovar lai str. 56601
ccaccuuggaaagaaa

SEQ ID NO: 2779359 - RNA, 14 nt, Leptospira interrogans serovar lai str. 56601
ccaccuuuacauaa

SEQ ID NO: 2779360 - RNA, 23 nt, Leptospira interrogans serovar lai str. 56601
ccaccuuuacauaauaauacaga

SEQ ID NO: 2779361 - RNA, 23 nt, Leptospira interrogans serovar lai str. 56601
ccaccuuuuuuuaugaaaaaauu

SEQ ID NO: 2779362 - RNA, 18 nt, Leptospira interrogans serovar lai str. 56601
ccacuacggaaggaaaaa

SEQ ID NO: 2779363 - RNA, 18 nt, Leptospira interrogans serovar lai str. 56601
ccacuuaaaaaguuuuuc

SEQ ID NO: 2779364 - RNA, 14 nt, Leptospira interrogans serovar lai str. 56601
ccacuucucacaaa

SEQ ID NO: 2779365 - RNA, 17 nt, Leptospira interrogans serovar lai str. 56601
cccauccgaaaucccaa

SEQ ID NO: 2779366 - RNA, 18 nt, Leptospira interrogans serovar lai str. 56601
cccaucgcacgucccaca

SEQ ID NO: 2779367 - RNA, 21 nt, Leptospira interrogans serovar lai str. 56601
cccaucgcacgucccacaaau

SEQ ID NO: 2779368 - RNA, 20 nt, Leptospira interrogans serovar lai str. 56601
cccaugauagaguucugaaa

SEQ ID NO: 2779369 - RNA, 20 nt, Leptospira interrogans serovar lai str. 56601
ccccaagacgucuacagaua

SEQ ID NO: 2779370 - RNA, 16 nt, Leptospira interrogans serovar lai str. 56601
ccccaccuaaaaugaa

SEQ ID NO: 2779371 - RNA, 20 nt, Leptospira interrogans serovar lai str. 56601
ccccaccuaaaaugaaaaaa

SEQ ID NO: 2779372 - RNA, 16 nt, Leptospira interrogans serovar lai str. 56601
ccccaucucuucgucu

SEQ ID NO: 2779373 - RNA, 23 nt, Leptospira interrogans serovar lai str. 56601
ccccaucucuucgucucaccaac

SEQ ID NO: 2779374 - RNA, 15 nt, Leptospira interrogans serovar lai str. 56601
ccccauuaaaaagcu

SEQ ID NO: 2779375 - RNA, 12 nt, Leptospira interrogans serovar lai str. 56601
ccccauucuuuu

SEQ ID NO: 2779376 - RNA, 13 nt, Leptospira interrogans serovar lai str. 56601
cccccaccaaaaa

SEQ ID NO: 2779377 - RNA, 17 nt, Leptospira interrogans serovar lai str. 56601
ccccgaaauacauaaac

SEQ ID NO: 2779378 - RNA, 12 nt, Leptospira interrogans serovar lai str. 56601
cccgaagaauua

SEQ ID NO: 2779379 - RNA, 19 nt, Leptospira interrogans serovar lai str. 56601
cccgaagauucuauuaaga

SEQ ID NO: 2779380 - RNA, 20 nt, Leptospira interrogans serovar lai str. 56601
cccgaauuuuaaauauuaau

SEQ ID NO: 2779381 - RNA, 17 nt, Leptospira interrogans serovar lai str. 56601
cccgauauuaaaaugag

SEQ ID NO: 2779382 - RNA, 20 nt, Leptospira interrogans serovar lai str. 56601
cccggaucggcuuuuccauc

SEQ ID NO: 2779383 - RNA, 14 nt, Leptospira interrogans serovar lai str. 56601
cccgucauuuacuc

SEQ ID NO: 2779384 - RNA, 15 nt, Leptospira interrogans serovar lai str. 56601
cccuaguuuauguga

SEQ ID NO: 2779385 - RNA, 17 nt, Leptospira interrogans serovar lai str. 56601
cccuauuguauuugauu

SEQ ID NO: 2779386 - RNA, 23 nt, Leptospira interrogans serovar lai str. 56601
cccucccguuauuuuuuuuacau

SEQ ID NO: 2779387 - RNA, 21 nt, Leptospira interrogans serovar lai str. 56601
cccuccguuuacaaaaugauu

SEQ ID NO: 2779388 - RNA, 21 nt, Leptospira interrogans serovar lai str. 56601
cccucugggaucggaaccaaa

SEQ ID NO: 2779389 - RNA, 15 nt, Leptospira interrogans serovar lai str. 56601
cccuuaaucauuuuu

SEQ ID NO: 2779390 - RNA, 18 nt, Leptospira interrogans serovar lai str. 56601
cccuuccgauucacuucc

SEQ ID NO: 2779391 - RNA, 17 nt, Leptospira interrogans serovar lai str. 56601
ccgaaaagguuaaaaau

SEQ ID NO: 2779392 - RNA, 22 nt, Leptospira interrogans serovar lai str. 56601
ccgaaacguuuugcguuuuuaa

SEQ ID NO: 2779393 - RNA, 12 nt, Leptospira interrogans serovar lai str. 56601
ccgaaagaacuc

SEQ ID NO: 2779394 - RNA, 13 nt, Leptospira interrogans serovar lai str. 56601
ccgaaauagaaau

SEQ ID NO: 2779395 - RNA, 12 nt, Leptospira interrogans serovar lai str. 56601
ccgaaccuuacc

SEQ ID NO: 2779396 - RNA, 20 nt, Leptospira interrogans serovar lai str. 56601
ccgaacucacaaguugaaug

SEQ ID NO: 2779397 - RNA, 14 nt, Leptospira interrogans serovar lai str. 56601
ccgaagaauuauuu

SEQ ID NO: 2779398 - RNA, 11 nt, Leptospira interrogans serovar lai str. 56601
ccgaaggaauu

SEQ ID NO: 2779399 - RNA, 17 nt, Leptospira interrogans serovar lai str. 56601
ccgaauaggaucagaau

SEQ ID NO: 2779400 - RNA, 22 nt, Leptospira interrogans serovar lai str. 56601
ccgaauucuaaaauacuuuuga

SEQ ID NO: 2779401 - RNA, 19 nt, Leptospira interrogans serovar lai str. 56601
ccgacauaugcugccuaug

SEQ ID NO: 2779402 - RNA, 14 nt, Leptospira interrogans serovar lai str. 56601
ccgacggcuucaau

SEQ ID NO: 2779403 - RNA, 23 nt, Leptospira interrogans serovar lai str. 56601
ccgacuugagauuccuuuuaaga

SEQ ID NO: 2779404 - RNA, 22 nt, Leptospira interrogans serovar lai str. 56601
ccgauaaagaaaguaauuuuga

SEQ ID NO: 2779405 - RNA, 16 nt, Leptospira interrogans serovar lai str. 56601
ccgaucugugauugaa

SEQ ID NO: 2779406 - RNA, 19 nt, Leptospira interrogans serovar lai str. 56601
ccgauuccagcacugaucg

SEQ ID NO: 2779407 - RNA, 11 nt, Leptospira interrogans serovar lai str. 56601
ccgauugaagc

SEQ ID NO: 2779408 - RNA, 18 nt, Leptospira interrogans serovar lai str. 56601
ccgauuucuauuuuaaaa

SEQ ID NO: 2779409 - RNA, 22 nt, Leptospira interrogans serovar lai str. 56601
ccgauuugguuuucauucaaaa

SEQ ID NO: 2779410 - RNA, 20 nt, Leptospira interrogans serovar lai str. 56601
ccgauuuuaaucuccgcucu

SEQ ID NO: 2779411 - RNA, 12 nt, Leptospira interrogans serovar lai str. 56601
ccgcacuuuuuu

SEQ ID NO: 2779412 - RNA, 12 nt, Leptospira interrogans serovar lai str. 56601
ccgcauuuuuau

SEQ ID NO: 2779413 - RNA, 12 nt, Leptospira interrogans serovar lai str. 56601
ccgccuuuccaa

SEQ ID NO: 2779414 - RNA, 14 nt, Leptospira interrogans serovar lai str. 56601
ccgcuguaugaaaa

SEQ ID NO: 2779415 - RNA, 16 nt, Leptospira interrogans serovar lai str. 56601
ccgcuuuuaguuuuuc

SEQ ID NO: 2779416 - RNA, 18 nt, Leptospira interrogans serovar lai str. 56601
ccgcuuuuaguuuuuccu

SEQ ID NO: 2779417 - RNA, 21 nt, Leptospira interrogans serovar lai str. 56601
ccggaauacuuuucuucccag

SEQ ID NO: 2779418 - RNA, 15 nt, Leptospira interrogans serovar lai str. 56601
ccggaauuuccaaac

SEQ ID NO: 2779419 - RNA, 20 nt, Leptospira interrogans serovar lai str. 56601
ccggagaaagcgcagacucu

SEQ ID NO: 2779420 - RNA, 18 nt, Leptospira interrogans serovar lai str. 56601
ccggauucgcucaaauuu

SEQ ID NO: 2779421 - RNA, 20 nt, Leptospira interrogans serovar lai str. 56601
ccggauuuguugauuuuuga

SEQ ID NO: 2779422 - RNA, 15 nt, Leptospira interrogans serovar lai str. 56601
ccggcgcuguaauga

SEQ ID NO: 2779423 - RNA, 21 nt, Leptospira interrogans serovar lai str. 56601
ccggcuaaaaaacugauuaaa

SEQ ID NO: 2779424 - RNA, 14 nt, Leptospira interrogans serovar lai str. 56601
ccgggauuuuaaaa

SEQ ID NO: 2779425 - RNA, 18 nt, Leptospira interrogans serovar lai str. 56601
ccggucucgaauuguuuu

SEQ ID NO: 2779426 - RNA, 15 nt, Leptospira interrogans serovar lai str. 56601
ccguaaagaagaggu

SEQ ID NO: 2779427 - RNA, 20 nt, Leptospira interrogans serovar lai str. 56601
ccguaaauauuuuuuuuaau

SEQ ID NO: 2779428 - RNA, 13 nt, Leptospira interrogans serovar lai str. 56601
ccguaauaaauuc

SEQ ID NO: 2779429 - RNA, 17 nt, Leptospira interrogans serovar lai str. 56601
ccguaauaucuccaaaa

SEQ ID NO: 2779430 - RNA, 14 nt, Leptospira interrogans serovar lai str. 56601
ccguagccgcuuca

SEQ ID NO: 2779431 - RNA, 21 nt, Leptospira interrogans serovar lai str. 56601
ccguccaaugugggaacuacu

SEQ ID NO: 2779432 - RNA, 20 nt, Leptospira interrogans serovar lai str. 56601
ccgucggaagccauaaucaa

SEQ ID NO: 2779433 - RNA, 19 nt, Leptospira interrogans serovar lai str. 56601
ccgucucagcaagucuauu

SEQ ID NO: 2779434 - RNA, 23 nt, Leptospira interrogans serovar lai str. 56601
ccguuacauaaguuguuauaaac

SEQ ID NO: 2779435 - RNA, 12 nt, Leptospira interrogans serovar lai str. 56601
ccguuauuaaaa

SEQ ID NO: 2779436 - RNA, 17 nt, Leptospira interrogans serovar lai str. 56601
ccuaaaaauuguugaag

SEQ ID NO: 2779437 - RNA, 19 nt, Leptospira interrogans serovar lai str. 56601
ccuaaaauggauuuauaau

SEQ ID NO: 2779438 - RNA, 18 nt, Leptospira interrogans serovar lai str. 56601
ccuaaaaugugggaacuc

SEQ ID NO: 2779439 - RNA, 18 nt, Leptospira interrogans serovar lai str. 56601
ccuaaaauuuuaaaaaau

SEQ ID NO: 2779440 - RNA, 14 nt, Leptospira interrogans serovar lai str. 56601
ccuaaauauuuauu

SEQ ID NO: 2779441 - RNA, 18 nt, Leptospira interrogans serovar lai str. 56601
ccuaaauuccuuccaagu

SEQ ID NO: 2779442 - RNA, 16 nt, Leptospira interrogans serovar lai str. 56601
ccuaagcguucuaagu

SEQ ID NO: 2779443 - RNA, 19 nt, Leptospira interrogans serovar lai str. 56601
ccuaaggauccaauacaaa

SEQ ID NO: 2779444 - RNA, 15 nt, Leptospira interrogans serovar lai str. 56601
ccuaauaacuuguuc

SEQ ID NO: 2779445 - RNA, 22 nt, Leptospira interrogans serovar lai str. 56601
ccuaauaccgugguaucuacau

SEQ ID NO: 2779446 - RNA, 17 nt, Leptospira interrogans serovar lai str. 56601
ccuaauccaauaaaauu

SEQ ID NO: 2779447 - RNA, 20 nt, Leptospira interrogans serovar lai str. 56601
ccuaaucuuauucaauaaaa

SEQ ID NO: 2779448 - RNA, 16 nt, Leptospira interrogans serovar lai str. 56601
ccuuugaauaaaaccg

SEQ ID NO: 2779449 - RNA, 17 nt, Leptospira interrogans serovar lai str. 56601
ccuuuggacgaaucgaa

SEQ ID NO: 2779450 - RNA, 15 nt, Leptospira interrogans serovar lai str. 56601
ccuuuguauuaauuu

SEQ ID NO: 2779451 - RNA, 22 nt, Leptospira interrogans serovar lai str. 56601
ccuuugugacacugaaaacauu

SEQ ID NO: 2779452 - RNA, 19 nt, Leptospira interrogans serovar lai str. 56601
ccuuuuagauaaauacauc

SEQ ID NO: 2779453 - RNA, 17 nt, Leptospira interrogans serovar lai str. 56601
ccuuuucuagacuuucu

SEQ ID NO: 2779454 - RNA, 22 nt, Leptospira interrogans serovar lai str. 56601
ccuuuugaaguaguaacacuca

SEQ ID NO: 2779455 - RNA, 13 nt, Leptospira interrogans serovar lai str. 56601
ccuuuugaaucua

SEQ ID NO: 2779456 - RNA, 18 nt, Leptospira interrogans serovar lai str. 56601
ccuuuuuaacucccugau

SEQ ID NO: 2779457 - RNA, 14 nt, Leptospira interrogans serovar lai str. 56601
ccuuuuuauuucua

SEQ ID NO: 2779458 - RNA, 20 nt, Leptospira interrogans serovar lai str. 56601
ccuuuuuauuucuaaguccu

SEQ ID NO: 2779459 - RNA, 21 nt, Leptospira interrogans serovar lai str. 56601
ccuuuuuccggaauacuuuuc

SEQ ID NO: 2779460 - RNA, 10 nt, Leptospira interrogans serovar lai str. 56601
ccuuuuucua

SEQ ID NO: 2779461 - RNA, 19 nt, Leptospira interrogans serovar lai str. 56601
ccuuuuuguaaggauuccu

SEQ ID NO: 2779462 - RNA, 23 nt, Leptospira interrogans serovar lai str. 56601
ccuuuuuuguaaaggaagauaaa

SEQ ID NO: 2779463 - RNA, 18 nt, Leptospira interrogans serovar lai str. 56601
ccuuuuuuucuuuuaaaa

SEQ ID NO: 2779464 - RNA, 13 nt, Leptospira interrogans serovar lai str. 56601
cgaaaaaaauaac

SEQ ID NO: 2779465 - RNA, 14 nt, Leptospira interrogans serovar lai str. 56601
cgaaaaaacaaaua

SEQ ID NO: 2779466 - RNA, 16 nt, Leptospira interrogans serovar lai str. 56601
cgaaaaaauacaaaca

SEQ ID NO: 2779467 - RNA, 12 nt, Leptospira interrogans serovar lai str. 56601
cgaaaaauucca

SEQ ID NO: 2779468 - RNA, 15 nt, Leptospira interrogans serovar lai str. 56601
cgaaaaauuccacuu

SEQ ID NO: 2779469 - RNA, 23 nt, Leptospira interrogans serovar lai str. 56601
cgaaaacagaucaagaauuaauu

SEQ ID NO: 2779470 - RNA, 19 nt, Leptospira interrogans serovar lai str. 56601
cgaaaaccaaccucucacu

SEQ ID NO: 2779471 - RNA, 23 nt, Leptospira interrogans serovar lai str. 56601
cgaaaaccaaccucucacuucuu

SEQ ID NO: 2779472 - RNA, 17 nt, Leptospira interrogans serovar lai str. 56601
cgaaaacgauuuuucaa

SEQ ID NO: 2779473 - RNA, 20 nt, Leptospira interrogans serovar lai str. 56601
cgaaaagaccauuuuccuuc

SEQ ID NO: 2779474 - RNA, 19 nt, Leptospira interrogans serovar lai str. 56601
cgaaaagguuaaaaauuua

SEQ ID NO: 2779475 - RNA, 18 nt, Leptospira interrogans serovar lai str. 56601
cgaaaaguuuuccgguuc

SEQ ID NO: 2779476 - RNA, 20 nt, Leptospira interrogans serovar lai str. 56601
cgaaaaucucagaaaauuuu

SEQ ID NO: 2779477 - RNA, 16 nt, Leptospira interrogans serovar lai str. 56601
cgaaaauuaaaaaauc

SEQ ID NO: 2779478 - RNA, 19 nt, Leptospira interrogans serovar lai str. 56601
cgaaaauuaacuuugauag

SEQ ID NO: 2779479 - RNA, 13 nt, Leptospira interrogans serovar lai str. 56601
cgaaaauuccgaa

SEQ ID NO: 2779480 - RNA, 13 nt, Leptospira interrogans serovar lai str. 56601
cgaaaauucugaa

SEQ ID NO: 2779481 - RNA, 17 nt, Leptospira interrogans serovar lai str. 56601
cgaaaauucugaaagag

SEQ ID NO: 2779482 - RNA, 14 nt, Leptospira interrogans serovar lai str. 56601
cgaaacaaaaucaa

SEQ ID NO: 2779483 - RNA, 17 nt, Leptospira interrogans serovar lai str. 56601
cgaaaccucaaaaaauu

SEQ ID NO: 2779484 - RNA, 14 nt, Leptospira interrogans serovar lai str. 56601
cgaaacuuuaauuu

SEQ ID NO: 2779485 - RNA, 19 nt, Leptospira interrogans serovar lai str. 56601
cgaaacuuuuagaauucuc

SEQ ID NO: 2779486 - RNA, 16 nt, Leptospira interrogans serovar lai str. 56601
cgaaagagggaaugua

SEQ ID NO: 2779487 - RNA, 19 nt, Leptospira interrogans serovar lai str. 56601
cgaaagcgauuguaacgaa

SEQ ID NO: 2779488 - RNA, 22 nt, Leptospira interrogans serovar lai str. 56601
cgaaagcguuucguucuuuuuu

SEQ ID NO: 2779489 - RNA, 14 nt, Leptospira interrogans serovar lai str. 56601
cgaaaggaaaagaa

SEQ ID NO: 2779490 - RNA, 20 nt, Leptospira interrogans serovar lai str. 56601
cgaaaguaaauggauaaauu

SEQ ID NO: 2779491 - RNA, 12 nt, Leptospira interrogans serovar lai str. 56601
cgaaauauauua

SEQ ID NO: 2779492 - RNA, 15 nt, Leptospira interrogans serovar lai str. 56601
cgaaaugguuccgau

SEQ ID NO: 2779493 - RNA, 15 nt, Leptospira interrogans serovar lai str. 56601
cgaaauuauacaaaa

SEQ ID NO: 2779494 - RNA, 19 nt, Leptospira interrogans serovar lai str. 56601
cgaaauuauacaaaacucu

SEQ ID NO: 2779495 - RNA, 16 nt, Leptospira interrogans serovar lai str. 56601
cgaaauuuuacaguaa

SEQ ID NO: 2779496 - RNA, 21 nt, Leptospira interrogans serovar lai str. 56601
cgaaauuuuuuuaaaaauguc

SEQ ID NO: 2779497 - RNA, 20 nt, Leptospira interrogans serovar lai str. 56601
cgaacaaauucuaaaauugu

SEQ ID NO: 2779498 - RNA, 16 nt, Leptospira interrogans serovar lai str. 56601
cgaacacauucuaaaa

SEQ ID NO: 2779499 - RNA, 19 nt, Leptospira interrogans serovar lai str. 56601
cgaacacauucuaaaauua

SEQ ID NO: 2779500 - RNA, 16 nt, Leptospira interrogans serovar lai str. 56601
cgaacgaauucuaaaa

SEQ ID NO: 2779501 - RNA, 20 nt, Leptospira interrogans serovar lai str. 56601
cgaacgaauucuaaaauuug

SEQ ID NO: 2779502 - RNA, 20 nt, Leptospira interrogans serovar lai str. 56601
cgaacggauucuaauuuuau

SEQ ID NO: 2779503 - RNA, 22 nt, Leptospira interrogans serovar lai str. 56601
cgaacuaaugaaggaauuggaa

SEQ ID NO: 2779504 - RNA, 19 nt, Leptospira interrogans serovar lai str. 56601
cgaacucacaaguugaaug

SEQ ID NO: 2779505 - RNA, 18 nt, Leptospira interrogans serovar lai str. 56601
cgaacuuuucuauaaaau

SEQ ID NO: 2779506 - RNA, 12 nt, Leptospira interrogans serovar lai str. 56601
cgaagaauccga

SEQ ID NO: 2779507 - RNA, 14 nt, Leptospira interrogans serovar lai str. 56601
cgaagaauuauuua

SEQ ID NO: 2779508 - RNA, 17 nt, Leptospira interrogans serovar lai str. 56601
cgaagauaccaaauaaa

SEQ ID NO: 2779509 - RNA, 12 nt, Leptospira interrogans serovar lai str. 56601
cgaauaaaaaac

SEQ ID NO: 2779510 - RNA, 14 nt, Leptospira interrogans serovar lai str. 56601
cgaauaaaaaacuc

SEQ ID NO: 2779511 - RNA, 15 nt, Leptospira interrogans serovar lai str. 56601
cgaauaaaaaacuca

SEQ ID NO: 2779512 - RNA, 14 nt, Leptospira interrogans serovar lai str. 56601
cgaauacaaagaac

SEQ ID NO: 2779513 - RNA, 19 nt, Leptospira interrogans serovar lai str. 56601
cgaauaggaucagaauuuc

SEQ ID NO: 2779514 - RNA, 21 nt, Leptospira interrogans serovar lai str. 56601
cgaauaguaccgucacaaacu

SEQ ID NO: 2779515 - RNA, 21 nt, Leptospira interrogans serovar lai str. 56601
cgaaucuggaagccaaaacca

SEQ ID NO: 2779516 - RNA, 16 nt, Leptospira interrogans serovar lai str. 56601
cgaaugcacuguagag

SEQ ID NO: 2779517 - RNA, 19 nt, Leptospira interrogans serovar lai str. 56601
cgaaugguacgaccaaaac

SEQ ID NO: 2779518 - RNA, 20 nt, Leptospira interrogans serovar lai str. 56601
cgaauucacguuaaaauaau

SEQ ID NO: 2779519 - RNA, 21 nt, Leptospira interrogans serovar lai str. 56601
cgaauugaguuuuuguuugaa

SEQ ID NO: 2779520 - RNA, 17 nt, Leptospira interrogans serovar lai str. 56601
cgaauuuccauuucuga

SEQ ID NO: 2779521 - RNA, 20 nt, Leptospira interrogans serovar lai str. 56601
cgaauuugacguaaaggaau

SEQ ID NO: 2779522 - RNA, 12 nt, Leptospira interrogans serovar lai str. 56601
cgaauuuuaaau

SEQ ID NO: 2779523 - RNA, 20 nt, Leptospira interrogans serovar lai str. 56601
cgacaaaacuuccauuuuuu

SEQ ID NO: 2779524 - RNA, 19 nt, Leptospira interrogans serovar lai str. 56601
cgacaaaaggauuccauuu

SEQ ID NO: 2779525 - RNA, 14 nt, Leptospira interrogans serovar lai str. 56601
cgacaaguccucua

SEQ ID NO: 2779526 - RNA, 22 nt, Leptospira interrogans serovar lai str. 56601
cgacagauuuauauugagauca

SEQ ID NO: 2779527 - RNA, 19 nt, Leptospira interrogans serovar lai str. 56601
cgacauuuuagagcagaac

SEQ ID NO: 2779528 - RNA, 18 nt, Leptospira interrogans serovar lai str. 56601
cgacccagaaaaaaccuc

SEQ ID NO: 2779529 - RNA, 16 nt, Leptospira interrogans serovar lai str. 56601
cgaccccgucauuuac

SEQ ID NO: 2779530 - RNA, 15 nt, Leptospira interrogans serovar lai str. 56601
cgacccuagaagccu

SEQ ID NO: 2779531 - RNA, 15 nt, Leptospira interrogans serovar lai str. 56601
cguguuugagauuaa

SEQ ID NO: 2779532 - RNA, 14 nt, Leptospira interrogans serovar lai str. 56601
cguuaaauagaaac

SEQ ID NO: 2779533 - RNA, 23 nt, Leptospira interrogans serovar lai str. 56601
cguuaaauuuucguaauaguucc

SEQ ID NO: 2779534 - RNA, 22 nt, Leptospira interrogans serovar lai str. 56601
cguuauaaacaauaugaaagga

SEQ ID NO: 2779535 - RNA, 21 nt, Leptospira interrogans serovar lai str. 56601
cguuauaauucuuuaaaauuu

SEQ ID NO: 2779536 - RNA, 22 nt, Leptospira interrogans serovar lai str. 56601
cguuaucgaucgagacuucgaa

SEQ ID NO: 2779537 - RNA, 15 nt, Leptospira interrogans serovar lai str. 56601
cguuauuuagaucaa

SEQ ID NO: 2779538 - RNA, 19 nt, Leptospira interrogans serovar lai str. 56601
cguuauuuuaacuugaguu

SEQ ID NO: 2779539 - RNA, 22 nt, Leptospira interrogans serovar lai str. 56601
cguuauuuuuauaaagauaaau

SEQ ID NO: 2779540 - RNA, 16 nt, Leptospira interrogans serovar lai str. 56601
cguuauuuuuuuuaca

SEQ ID NO: 2779541 - RNA, 13 nt, Leptospira interrogans serovar lai str. 56601
cguuccaaacccu

SEQ ID NO: 2779542 - RNA, 16 nt, Leptospira interrogans serovar lai str. 56601
cguuccaaacccugcc

SEQ ID NO: 2779543 - RNA, 22 nt, Leptospira interrogans serovar lai str. 56601
cguucggaaaaaguauaauuua

SEQ ID NO: 2779544 - RNA, 19 nt, Leptospira interrogans serovar lai str. 56601
cguucuaaguccacccaaa

SEQ ID NO: 2779545 - RNA, 12 nt, Leptospira interrogans serovar lai str. 56601
cguucuacaaaa

SEQ ID NO: 2779546 - RNA, 17 nt, Leptospira interrogans serovar lai str. 56601
cguucugcuaaguuccc

SEQ ID NO: 2779547 - RNA, 14 nt, Leptospira interrogans serovar lai str. 56601
cguucugcugaguu

SEQ ID NO: 2779548 - RNA, 23 nt, Leptospira interrogans serovar lai str. 56601
cguucuguugaguucauucugau

SEQ ID NO: 2779549 - RNA, 16 nt, Leptospira interrogans serovar lai str. 56601
cguucuuacauugagu

SEQ ID NO: 2779550 - RNA, 19 nt, Leptospira interrogans serovar lai str. 56601
cguugaagcggaguuccua

SEQ ID NO: 2779551 - RNA, 22 nt, Leptospira interrogans serovar lai str. 56601
cguugaaguagucauauaaaag

SEQ ID NO: 2779552 - RNA, 12 nt, Leptospira interrogans serovar lai str. 56601
cguugaauaaga

SEQ ID NO: 2779553 - RNA, 13 nt, Leptospira interrogans serovar lai str. 56601
cguuuaaaaacag

SEQ ID NO: 2779554 - RNA, 14 nt, Leptospira interrogans serovar lai str. 56601
cguuuaaauacauu

SEQ ID NO: 2779555 - RNA, 19 nt, Leptospira interrogans serovar lai str. 56601
cguuuaaauacauuaagau

SEQ ID NO: 2779556 - RNA, 14 nt, Leptospira interrogans serovar lai str. 56601
cguuuaacaaaaau

SEQ ID NO: 2779557 - RNA, 22 nt, Leptospira interrogans serovar lai str. 56601
cguuuaagaauuuuaaaaaaug

SEQ ID NO: 2779558 - RNA, 17 nt, Leptospira interrogans serovar lai str. 56601
cguuuagguaaagauuu

SEQ ID NO: 2779559 - RNA, 14 nt, Leptospira interrogans serovar lai str. 56601
cguuucguucuuuu

SEQ ID NO: 2779560 - RNA, 20 nt, Leptospira interrogans serovar lai str. 56601
cguuucuugucucuacucuu

SEQ ID NO: 2779561 - RNA, 14 nt, Leptospira interrogans serovar lai str. 56601
cguuucuuuuucua

SEQ ID NO: 2779562 - RNA, 23 nt, Leptospira interrogans serovar lai str. 56601
cguuugaacucggcucauaaaaa

SEQ ID NO: 2779563 - RNA, 13 nt, Leptospira interrogans serovar lai str. 56601
cguuugcauccca

SEQ ID NO: 2779564 - RNA, 12 nt, Leptospira interrogans serovar lai str. 56601
cguuuuaaaauu

SEQ ID NO: 2779565 - RNA, 15 nt, Leptospira interrogans serovar lai str. 56601
cguuuuacugaguuu

SEQ ID NO: 2779566 - RNA, 16 nt, Leptospira interrogans serovar lai str. 56601
cguuuuauaaaaacuu

SEQ ID NO: 2779567 - RNA, 16 nt, Leptospira interrogans serovar lai str. 56601
cguuuuaucuuagagu

SEQ ID NO: 2779568 - RNA, 17 nt, Leptospira interrogans serovar lai str. 56601
cguuuuaucuuagaguu

SEQ ID NO: 2779569 - RNA, 17 nt, Leptospira interrogans serovar lai str. 56601
cguuuuauuauauaauu

SEQ ID NO: 2779570 - RNA, 15 nt, Leptospira interrogans serovar lai str. 56601
cguuuugacacucua

SEQ ID NO: 2779571 - RNA, 15 nt, Leptospira interrogans serovar lai str. 56601
cguuuugcugaguuu

SEQ ID NO: 2779572 - RNA, 15 nt, Leptospira interrogans serovar lai str. 56601
cguuuuguugaguuu

SEQ ID NO: 2779573 - RNA, 18 nt, Leptospira interrogans serovar lai str. 56601
cguuuuguugaguuugaa

SEQ ID NO: 2779574 - RNA, 12 nt, Leptospira interrogans serovar lai str. 56601
cguuuuuaaaca

SEQ ID NO: 2779575 - RNA, 14 nt, Leptospira interrogans serovar lai str. 56601
cguuuuuaaaugug

SEQ ID NO: 2779576 - RNA, 15 nt, Leptospira interrogans serovar lai str. 56601
cguuuuuaguuucaa

SEQ ID NO: 2779577 - RNA, 12 nt, Leptospira interrogans serovar lai str. 56601
cguuuuuuaaaa

SEQ ID NO: 2779578 - RNA, 12 nt, Leptospira interrogans serovar lai str. 56601
cguuuuuuucau

SEQ ID NO: 2779579 - RNA, 11 nt, Leptospira interrogans serovar lai str. 56601
cuaaaaaaaau

SEQ ID NO: 2779580 - RNA, 12 nt, Leptospira interrogans serovar lai str. 56601
cuaaaaaaaaua

SEQ ID NO: 2779581 - RNA, 12 nt, Leptospira interrogans serovar lai str. 56601
cuaaaaaaaauc

SEQ ID NO: 2779582 - RNA, 13 nt, Leptospira interrogans serovar lai str. 56601
cuaaaaaaaaugg

SEQ ID NO: 2779583 - RNA, 15 nt, Leptospira interrogans serovar lai str. 56601
cuaaaaaaaauguaa

SEQ ID NO: 2779584 - RNA, 11 nt, Leptospira interrogans serovar lai str. 56601
cuaaaaaaaua

SEQ ID NO: 2779585 - RNA, 14 nt, Leptospira interrogans serovar lai str. 56601
cuaaaaaaauuaau

SEQ ID NO: 2779586 - RNA, 19 nt, Leptospira interrogans serovar lai str. 56601
cuaaaaaaauuaauucucc

SEQ ID NO: 2779587 - RNA, 12 nt, Leptospira interrogans serovar lai str. 56601
cuaaaaaacaua

SEQ ID NO: 2779588 - RNA, 18 nt, Leptospira interrogans serovar lai str. 56601
cuaaaaaacugauuaaaa

SEQ ID NO: 2779589 - RNA, 12 nt, Leptospira interrogans serovar lai str. 56601
cuaaaaaauaaa

SEQ ID NO: 2779590 - RNA, 23 nt, Leptospira interrogans serovar lai str. 56601
cuaaaaaauuaccgaguuuauca

SEQ ID NO: 2779591 - RNA, 12 nt, Leptospira interrogans serovar lai str. 56601
cuaaaaacucaa

SEQ ID NO: 2779592 - RNA, 10 nt, Leptospira interrogans serovar lai str. 56601
cuaaaaagaa

SEQ ID NO: 2779593 - RNA, 14 nt, Leptospira interrogans serovar lai str. 56601
cuaaaaagaaaguu

SEQ ID NO: 2779594 - RNA, 15 nt, Leptospira interrogans serovar lai str. 56601
cuaaaaagaaaguug

SEQ ID NO: 2779595 - RNA, 16 nt, Leptospira interrogans serovar lai str. 56601
cuaaaaagaaaguugc

SEQ ID NO: 2779596 - RNA, 20 nt, Leptospira interrogans serovar lai str. 56601
cuaaaaagaaaguugcaaag

SEQ ID NO: 2779597 - RNA, 23 nt, Leptospira interrogans serovar lai str. 56601
cuaaaaagaaaguugcaaagaag

SEQ ID NO: 2779598 - RNA, 12 nt, Leptospira interrogans serovar lai str. 56601
cuaaaaaugaaa

SEQ ID NO: 2779599 - RNA, 20 nt, Leptospira interrogans serovar lai str. 56601
cuaaaacacaucuuaaaaac

SEQ ID NO: 2779600 - RNA, 23 nt, Leptospira interrogans serovar lai str. 56601
cuaaaacacaucuuaaaaacucu

SEQ ID NO: 2779601 - RNA, 22 nt, Leptospira interrogans serovar lai str. 56601
cuaaaagaagaugcuuucucuu

SEQ ID NO: 2779602 - RNA, 16 nt, Leptospira interrogans serovar lai str. 56601
cuaaaagcuaauaauc

SEQ ID NO: 2779603 - RNA, 21 nt, Leptospira interrogans serovar lai str. 56601
cuaaaagcuaauaaucgauuu

SEQ ID NO: 2779604 - RNA, 20 nt, Leptospira interrogans serovar lai str. 56601
cuaaaaguaacaguuccuaa

SEQ ID NO: 2779605 - RNA, 15 nt, Leptospira interrogans serovar lai str. 56601
cuaaaauaaaauucc

SEQ ID NO: 2779606 - RNA, 16 nt, Leptospira interrogans serovar lai str. 56601
cuaaaauaauuuuuac

SEQ ID NO: 2779607 - RNA, 22 nt, Leptospira interrogans serovar lai str. 56601
cuaaaauacuuuuagaaaauua

SEQ ID NO: 2779608 - RNA, 23 nt, Leptospira interrogans serovar lai str. 56601
cuaaaauacuuuuagaaaauuag

SEQ ID NO: 2779609 - RNA, 21 nt, Leptospira interrogans serovar lai str. 56601
cuaaaauauuugcauaaacuu

SEQ ID NO: 2779610 - RNA, 22 nt, Leptospira interrogans serovar lai str. 56601
cuaaaaucauacuuuuaaaaaa

SEQ ID NO: 2779611 - RNA, 16 nt, Leptospira interrogans serovar lai str. 56601
cuaaaaucuggauuuu

SEQ ID NO: 2779612 - RNA, 18 nt, Leptospira interrogans serovar lai str. 56601
cuaaaaucuggauuuuga

SEQ ID NO: 2779613 - RNA, 19 nt, Leptospira interrogans serovar lai str. 56601
cuaaaaucuggauuuugau

SEQ ID NO: 2779614 - RNA, 22 nt, Leptospira interrogans serovar lai str. 56601
cuaauuuaucgauuuaaaaacu

SEQ ID NO: 2779615 - RNA, 23 nt, Leptospira interrogans serovar lai str. 56601
cuaauuucauugaguuuuuuagu

SEQ ID NO: 2779616 - RNA, 13 nt, Leptospira interrogans serovar lai str. 56601
cuaauuugcgauu

SEQ ID NO: 2779617 - RNA, 15 nt, Leptospira interrogans serovar lai str. 56601
cuaauuuuagagaau

SEQ ID NO: 2779618 - RNA, 21 nt, Leptospira interrogans serovar lai str. 56601
cuaauuuugugaaucaaaagg

SEQ ID NO: 2779619 - RNA, 19 nt, Leptospira interrogans serovar lai str. 56601
cuaauuuuucaaaaacucu

SEQ ID NO: 2779620 - RNA, 21 nt, Leptospira interrogans serovar lai str. 56601
cuacaaaaauuuaauaacauu

SEQ ID NO: 2779621 - RNA, 16 nt, Leptospira interrogans serovar lai str. 56601
cuacaaaauuuagaac

SEQ ID NO: 2779622 - RNA, 14 nt, Leptospira interrogans serovar lai str. 56601
cuacaaauucauca

SEQ ID NO: 2779623 - RNA, 17 nt, Leptospira interrogans serovar lai str. 56601
cuacaaauucuucuucc

SEQ ID NO: 2779624 - RNA, 20 nt, Leptospira interrogans serovar lai str. 56601
cuacaaauucuucuuccuuu

SEQ ID NO: 2779625 - RNA, 21 nt, Leptospira interrogans serovar lai str. 56601
cuacaaguucauaagauugga

SEQ ID NO: 2779626 - RNA, 15 nt, Leptospira interrogans serovar lai str. 56601
cuacaauucaucacc

SEQ ID NO: 2779627 - RNA, 15 nt, Leptospira interrogans serovar lai str. 56601
cuacaauuuuagaau

SEQ ID NO: 2779628 - RNA, 19 nt, Leptospira interrogans serovar lai str. 56601
cuacaauuuuagaauuugu

SEQ ID NO: 2779629 - RNA, 22 nt, Leptospira interrogans serovar lai str. 56601
cuacaccaguauucaauuccaa

SEQ ID NO: 2779630 - RNA, 18 nt, Leptospira interrogans serovar lai str. 56601
cuacaccuucuaaaucau

SEQ ID NO: 2779631 - RNA, 14 nt, Leptospira interrogans serovar lai str. 56601
cuacacguuuuccu

SEQ ID NO: 2779632 - RNA, 14 nt, Leptospira interrogans serovar lai str. 56601
cuacagcaaaucac

SEQ ID NO: 2779633 - RNA, 15 nt, Leptospira interrogans serovar lai str. 56601
cuacaguuuuagaau

SEQ ID NO: 2779634 - RNA, 21 nt, Leptospira interrogans serovar lai str. 56601
cuacauaaaaaaggaagcaca

SEQ ID NO: 2779635 - RNA, 17 nt, Leptospira interrogans serovar lai str. 56601
cuacaucaguauuuuuu

SEQ ID NO: 2779636 - RNA, 13 nt, Leptospira interrogans serovar lai str. 56601
cuacaucuaauga

SEQ ID NO: 2779637 - RNA, 16 nt, Leptospira interrogans serovar lai str. 56601
cuacaugauucauuua

SEQ ID NO: 2779638 - RNA, 22 nt, Leptospira interrogans serovar lai str. 56601
cuacaugauucauuuaaaaauu

SEQ ID NO: 2779639 - RNA, 15 nt, Leptospira interrogans serovar lai str. 56601
cuacauguaaaacuu

SEQ ID NO: 2779640 - RNA, 15 nt, Leptospira interrogans serovar lai str. 56601
cuacauuauuuuaug

SEQ ID NO: 2779641 - RNA, 20 nt, Leptospira interrogans serovar lai str. 56601
cuacauuugauuaaaaauuu

SEQ ID NO: 2779642 - RNA, 20 nt, Leptospira interrogans serovar lai str. 56601
cuacauuuuuuaaauuuauc

SEQ ID NO: 2779643 - RNA, 16 nt, Leptospira interrogans serovar lai str. 56601
cuaccacagaaagcuu

SEQ ID NO: 2779644 - RNA, 18 nt, Leptospira interrogans serovar lai str. 56601
cuaccaucaccaacccca

SEQ ID NO: 2779645 - RNA, 12 nt, Leptospira interrogans serovar lai str. 56601
cuacggaaggaa

SEQ ID NO: 2779646 - RNA, 20 nt, Leptospira interrogans serovar lai str. 56601
cuacgucuucuaaauuugua

SEQ ID NO: 2779647 - RNA, 14 nt, Leptospira interrogans serovar lai str. 56601
cuacguuucaauua

SEQ ID NO: 2779648 - RNA, 20 nt, Leptospira interrogans serovar lai str. 56601
cuacguuucaauuacuuucg

SEQ ID NO: 2779649 - RNA, 21 nt, Leptospira interrogans serovar lai str. 56601
cuacuaaaucucaauucagua

SEQ ID NO: 2779650 - RNA, 19 nt, Leptospira interrogans serovar lai str. 56601
cuacuaaucucuauaaaag

SEQ ID NO: 2779651 - RNA, 21 nt, Leptospira interrogans serovar lai str. 56601
cuacuaauuuaucgauuuaaa

SEQ ID NO: 2779652 - RNA, 15 nt, Leptospira interrogans serovar lai str. 56601
cuacuacgaaaacuu

SEQ ID NO: 2779653 - RNA, 12 nt, Leptospira interrogans serovar lai str. 56601
cuacuacuuuaa

SEQ ID NO: 2779654 - RNA, 15 nt, Leptospira interrogans serovar lai str. 56601
cuacuaggaaaauuu

SEQ ID NO: 2779655 - RNA, 15 nt, Leptospira interrogans serovar lai str. 56601
cuacuauaaauuacu

SEQ ID NO: 2779656 - RNA, 16 nt, Leptospira interrogans serovar lai str. 56601
cuacucacaaauuguc

SEQ ID NO: 2779657 - RNA, 23 nt, Leptospira interrogans serovar lai str. 56601
cuacuccagauuuaauuuuucug

SEQ ID NO: 2779658 - RNA, 15 nt, Leptospira interrogans serovar lai str. 56601
cuacucgaauuuaua

SEQ ID NO: 2779659 - RNA, 20 nt, Leptospira interrogans serovar lai str. 56601
cuacucggaaauuuauuuua

SEQ ID NO: 2779660 - RNA, 19 nt, Leptospira interrogans serovar lai str. 56601
cuacuuaaacguauaaaaa

SEQ ID NO: 2779661 - RNA, 20 nt, Leptospira interrogans serovar lai str. 56601
cuacuugugagugaacucca

SEQ ID NO: 2779662 - RNA, 15 nt, Leptospira interrogans serovar lai str. 56601
cuacuuuuagaaaau

SEQ ID NO: 2779663 - RNA, 22 nt, Leptospira interrogans serovar lai str. 56601
cuagaaagaauuuaauaaaaaa

SEQ ID NO: 2779664 - RNA, 20 nt, Leptospira interrogans serovar lai str. 56601
cuagauagguucuuagaacu

SEQ ID NO: 2779665 - RNA, 20 nt, Leptospira interrogans serovar lai str. 56601
cuagauauuucaagaauuuu

SEQ ID NO: 2779666 - RNA, 23 nt, Leptospira interrogans serovar lai str. 56601
cuagauauuucaagaauuuuaga

SEQ ID NO: 2779667 - RNA, 19 nt, Leptospira interrogans serovar lai str. 56601
cuagauuuagauucuaaaa

SEQ ID NO: 2779668 - RNA, 23 nt, Leptospira interrogans serovar lai str. 56601
cuagauuuuacgauuaaauuuug

SEQ ID NO: 2779669 - RNA, 16 nt, Leptospira interrogans serovar lai str. 56601
cuagcaacacauuuuc

SEQ ID NO: 2779670 - RNA, 23 nt, Leptospira interrogans serovar lai str. 56601
cuagcuauuuucagaaaaaugaa

SEQ ID NO: 2779671 - RNA, 23 nt, Leptospira interrogans serovar lai str. 56601
cuaggaaaauuuaacaacauuag

SEQ ID NO: 2779672 - RNA, 13 nt, Leptospira interrogans serovar lai str. 56601
cuaggaacuccuu

SEQ ID NO: 2779673 - RNA, 19 nt, Leptospira interrogans serovar lai str. 56601
cuaggaacugcuuccaaaa

SEQ ID NO: 2779674 - RNA, 19 nt, Leptospira interrogans serovar lai str. 56601
cuaggauauuugauauaau

SEQ ID NO: 2779675 - RNA, 18 nt, Leptospira interrogans serovar lai str. 56601
cuaggcauaugaaaauaa

SEQ ID NO: 2779676 - RNA, 24 nt, Leptospira interrogans serovar lai str. 56601
cuagggaauuuuucaacaacucua

SEQ ID NO: 2779677 - RNA, 13 nt, Leptospira interrogans serovar lai str. 56601
cuagguuuaaacu

SEQ ID NO: 2779678 - RNA, 13 nt, Leptospira interrogans serovar lai str. 56601
cuagguuuccuuc

SEQ ID NO: 2779679 - RNA, 20 nt, Leptospira interrogans serovar lai str. 56601
cuaguaguucccacauuuug

SEQ ID NO: 2779680 - RNA, 18 nt, Leptospira interrogans serovar lai str. 56601
cuaguuuauaugaguucc

SEQ ID NO: 2779681 - RNA, 10 nt, Leptospira interrogans serovar lai str. 56601
cuauaaaauc

SEQ ID NO: 2779682 - RNA, 13 nt, Leptospira interrogans serovar lai str. 56601
cuauaaaaucaag

SEQ ID NO: 2779683 - RNA, 18 nt, Leptospira interrogans serovar lai str. 56601
cuauaaaaucuaaaaaaa

SEQ ID NO: 2779684 - RNA, 18 nt, Leptospira interrogans serovar lai str. 56601
cuauaaaaucuaaaaaga

SEQ ID NO: 2779685 - RNA, 19 nt, Leptospira interrogans serovar lai str. 56601
cuauaaaaucuaaaaauaa

SEQ ID NO: 2779686 - RNA, 14 nt, Leptospira interrogans serovar lai str. 56601
cuauaaaauucaaa

SEQ ID NO: 2779687 - RNA, 23 nt, Leptospira interrogans serovar lai str. 56601
cuauaaaauucaaaaagaaucgu

SEQ ID NO: 2779688 - RNA, 12 nt, Leptospira interrogans serovar lai str. 56601
cuauaaaauuga

SEQ ID NO: 2779689 - RNA, 15 nt, Leptospira interrogans serovar lai str. 56601
cuauaaaauuugaaa

SEQ ID NO: 2779690 - RNA, 18 nt, Leptospira interrogans serovar lai str. 56601
cuauaaacuucucuuaaa

SEQ ID NO: 2779691 - RNA, 12 nt, Leptospira interrogans serovar lai str. 56601
cuauaaaguuuu

SEQ ID NO: 2779692 - RNA, 18 nt, Leptospira interrogans serovar lai str. 56601
cuauaaaugaauuuuaaa

SEQ ID NO: 2779693 - RNA, 20 nt, Leptospira interrogans serovar lai str. 56601
cuauaaauuacugauuucaa

SEQ ID NO: 2779694 - RNA, 21 nt, Leptospira interrogans serovar lai str. 56601
cuauaaauucaucuaaaaaaa

SEQ ID NO: 2779695 - RNA, 20 nt, Leptospira interrogans serovar lai str. 56601
cuauaaauugcaucaaagaa

SEQ ID NO: 2779696 - RNA, 17 nt, Leptospira interrogans serovar lai str. 56601
cuauaacacgauacuca

SEQ ID NO: 2779697 - RNA, 19 nt, Leptospira interrogans serovar lai str. 56601
cucaaaauuaagaaucaau

SEQ ID NO: 2779698 - RNA, 19 nt, Leptospira interrogans serovar lai str. 56601
cucaaaauucuuaaaaaau

SEQ ID NO: 2779699 - RNA, 20 nt, Leptospira interrogans serovar lai str. 56601
cucaaaauucuuaaaaaaua

SEQ ID NO: 2779700 - RNA, 20 nt, Leptospira interrogans serovar lai str. 56601
cucaaaauuucggaaccggc

SEQ ID NO: 2779701 - RNA, 17 nt, Leptospira interrogans serovar lai str. 56601
cucaaagauuacauaau

SEQ ID NO: 2779702 - RNA, 12 nt, Leptospira interrogans serovar lai str. 56601
cucaaaggaaaa

SEQ ID NO: 2779703 - RNA, 20 nt, Leptospira interrogans serovar lai str. 56601
cucaaaggaaaaugaagaaa

SEQ ID NO: 2779704 - RNA, 20 nt, Leptospira interrogans serovar lai str. 56601
cucaaauucgucaaaaccaa

SEQ ID NO: 2779705 - RNA, 14 nt, Leptospira interrogans serovar lai str. 56601
cucaacaacucuaa

SEQ ID NO: 2779706 - RNA, 14 nt, Leptospira interrogans serovar lai str. 56601
cucaacucugguua

SEQ ID NO: 2779707 - RNA, 18 nt, Leptospira interrogans serovar lai str. 56601
cucaagauuaaucugguc

SEQ ID NO: 2779708 - RNA, 19 nt, Leptospira interrogans serovar lai str. 56601
cucaagauuuaauuuagaa

SEQ ID NO: 2779709 - RNA, 18 nt, Leptospira interrogans serovar lai str. 56601
cucaauccaauauuuaug

SEQ ID NO: 2779710 - RNA, 17 nt, Leptospira interrogans serovar lai str. 56601
cucaauuuuacagagau

SEQ ID NO: 2779711 - RNA, 15 nt, Leptospira interrogans serovar lai str. 56601
cucaauuuuccauuu

SEQ ID NO: 2779712 - RNA, 21 nt, Leptospira interrogans serovar lai str. 56601
cucaauuuugaagacuauaaa

SEQ ID NO: 2779713 - RNA, 18 nt, Leptospira interrogans serovar lai str. 56601
cucacaaaucgugaauuu

SEQ ID NO: 2779714 - RNA, 15 nt, Leptospira interrogans serovar lai str. 56601
cucacaccuucuuuu

SEQ ID NO: 2779715 - RNA, 23 nt, Leptospira interrogans serovar lai str. 56601
cucacagauucagucucauuuca

SEQ ID NO: 2779716 - RNA, 15 nt, Leptospira interrogans serovar lai str. 56601
cucacauuauuuaau

SEQ ID NO: 2779717 - RNA, 15 nt, Leptospira interrogans serovar lai str. 56601
cucacguuauccuua

SEQ ID NO: 2779718 - RNA, 11 nt, Leptospira interrogans serovar lai str. 56601
cucacuaccuu

SEQ ID NO: 2779719 - RNA, 16 nt, Leptospira interrogans serovar lai str. 56601
cucacucauuuuuaga

SEQ ID NO: 2779720 - RNA, 22 nt, Leptospira interrogans serovar lai str. 56601
cucacuuaugauuuaguaaaau

SEQ ID NO: 2779721 - RNA, 20 nt, Leptospira interrogans serovar lai str. 56601
cucacuucgacaacuuuguc

SEQ ID NO: 2779722 - RNA, 22 nt, Leptospira interrogans serovar lai str. 56601
cucacuucuugaacucaaugca

SEQ ID NO: 2779723 - RNA, 14 nt, Leptospira interrogans serovar lai str. 56601
cucagaaaacucag

SEQ ID NO: 2779724 - RNA, 22 nt, Leptospira interrogans serovar lai str. 56601
cucagagaauaucugaauuuuu

SEQ ID NO: 2779725 - RNA, 21 nt, Leptospira interrogans serovar lai str. 56601
cucagagcgauauaauaaaau

SEQ ID NO: 2779726 - RNA, 21 nt, Leptospira interrogans serovar lai str. 56601
cucagauuuccuuucucugaa

SEQ ID NO: 2779727 - RNA, 20 nt, Leptospira interrogans serovar lai str. 56601
cucagcacaacgcugcuuuc

SEQ ID NO: 2779728 - RNA, 22 nt, Leptospira interrogans serovar lai str. 56601
cucagcgaaaauacuucucuaa

SEQ ID NO: 2779729 - RNA, 14 nt, Leptospira interrogans serovar lai str. 56601
cucagcuauaaaau

SEQ ID NO: 2779730 - RNA, 14 nt, Leptospira interrogans serovar lai str. 56601
cucagcucugguua

SEQ ID NO: 2779731 - RNA, 21 nt, Leptospira interrogans serovar lai str. 56601
cucaguaaaacgcucucuacc

SEQ ID NO: 2779732 - RNA, 15 nt, Leptospira interrogans serovar lai str. 56601
cucaguaaaauggga

SEQ ID NO: 2779733 - RNA, 15 nt, Leptospira interrogans serovar lai str. 56601
cucaguaaacucaau

SEQ ID NO: 2779734 - RNA, 14 nt, Leptospira interrogans serovar lai str. 56601
cucagucaccucua

SEQ ID NO: 2779735 - RNA, 19 nt, Leptospira interrogans serovar lai str. 56601
cucagucaccucuauaaaa

SEQ ID NO: 2779736 - RNA, 18 nt, Leptospira interrogans serovar lai str. 56601
cucaguucaaaauauuua

SEQ ID NO: 2779737 - RNA, 14 nt, Leptospira interrogans serovar lai str. 56601
cucauaaaauaacu

SEQ ID NO: 2779738 - RNA, 13 nt, Leptospira interrogans serovar lai str. 56601
cucauacauuuuu

SEQ ID NO: 2779739 - RNA, 14 nt, Leptospira interrogans serovar lai str. 56601
cucauacuucuaaa

SEQ ID NO: 2779740 - RNA, 11 nt, Leptospira interrogans serovar lai str. 56601
cucauacuuuu

SEQ ID NO: 2779741 - RNA, 16 nt, Leptospira interrogans serovar lai str. 56601
cucauaguuauauaau

SEQ ID NO: 2779742 - RNA, 19 nt, Leptospira interrogans serovar lai str. 56601
cucauaguuauauaauaaa

SEQ ID NO: 2779743 - RNA, 18 nt, Leptospira interrogans serovar lai str. 56601
cucauauuuuuagaaaau

SEQ ID NO: 2779744 - RNA, 13 nt, Leptospira interrogans serovar lai str. 56601
cucaucauucuga

SEQ ID NO: 2779745 - RNA, 21 nt, Leptospira interrogans serovar lai str. 56601
cucaucauucugaaaaaaguu

SEQ ID NO: 2779746 - RNA, 19 nt, Leptospira interrogans serovar lai str. 56601
cucauuaacucaucuaauc

SEQ ID NO: 2779747 - RNA, 15 nt, Leptospira interrogans serovar lai str. 56601
cucauuaccaauuga

SEQ ID NO: 2779748 - RNA, 22 nt, Leptospira interrogans serovar lai str. 56601
cucauuagaauuguugaaaaau

SEQ ID NO: 2779749 - RNA, 22 nt, Leptospira interrogans serovar lai str. 56601
cucauuauuuauaauuuuauaa

SEQ ID NO: 2779750 - RNA, 23 nt, Leptospira interrogans serovar lai str. 56601
cucauuauuuauaauuuuauaau

SEQ ID NO: 2779751 - RNA, 22 nt, Leptospira interrogans serovar lai str. 56601
cucauugugaauguauauuuuu

SEQ ID NO: 2779752 - RNA, 11 nt, Leptospira interrogans serovar lai str. 56601
cucauuuccau

SEQ ID NO: 2779753 - RNA, 13 nt, Leptospira interrogans serovar lai str. 56601
cucauuuuaaacg

SEQ ID NO: 2779754 - RNA, 14 nt, Leptospira interrogans serovar lai str. 56601
cucauuuuucuaaa

SEQ ID NO: 2779755 - RNA, 16 nt, Leptospira interrogans serovar lai str. 56601
cucauuuuucuuaaaa

SEQ ID NO: 2779756 - RNA, 15 nt, Leptospira interrogans serovar lai str. 56601
cuccaaaaaaauaaa

SEQ ID NO: 2779757 - RNA, 15 nt, Leptospira interrogans serovar lai str. 56601
cuccaaaauaugaag

SEQ ID NO: 2779758 - RNA, 21 nt, Leptospira interrogans serovar lai str. 56601
cuccaaaauuuuuguguaaaa

SEQ ID NO: 2779759 - RNA, 22 nt, Leptospira interrogans serovar lai str. 56601
cuccaaacaauuuuuugaaaaa

SEQ ID NO: 2779760 - RNA, 14 nt, Leptospira interrogans serovar lai str. 56601
cuccacgauugauu

SEQ ID NO: 2779761 - RNA, 23 nt, Leptospira interrogans serovar lai str. 56601
cuccacgauugauuuuggaaaga

SEQ ID NO: 2779762 - RNA, 16 nt, Leptospira interrogans serovar lai str. 56601
cuccacuauggaauuu

SEQ ID NO: 2779763 - RNA, 18 nt, Leptospira interrogans serovar lai str. 56601
cuccacuauggaauuuuu

SEQ ID NO: 2779764 - RNA, 12 nt, Leptospira interrogans serovar lai str. 56601
cuccagaauuag

SEQ ID NO: 2779765 - RNA, 18 nt, Leptospira interrogans serovar lai str. 56601
cuccagauuuaauuuuuc

SEQ ID NO: 2779766 - RNA, 23 nt, Leptospira interrogans serovar lai str. 56601
cuccaucuauuuuguuuuauaga

SEQ ID NO: 2779767 - RNA, 12 nt, Leptospira interrogans serovar lai str. 56601
cuccaucuguuu

SEQ ID NO: 2779768 - RNA, 16 nt, Leptospira interrogans serovar lai str. 56601
cuccaucuguuuucuu

SEQ ID NO: 2779769 - RNA, 23 nt, Leptospira interrogans serovar lai str. 56601
cuccaucuuuuuuuucuaaaaua

SEQ ID NO: 2779770 - RNA, 13 nt, Leptospira interrogans serovar lai str. 56601
cuccauucuuacu

SEQ ID NO: 2779771 - RNA, 15 nt, Leptospira interrogans serovar lai str. 56601
cuccauucuuacucc

SEQ ID NO: 2779772 - RNA, 16 nt, Leptospira interrogans serovar lai str. 56601
cuccccaaaaucuuua

SEQ ID NO: 2779773 - RNA, 17 nt, Leptospira interrogans serovar lai str. 56601
cucccuuaccuccuuuu

SEQ ID NO: 2779774 - RNA, 15 nt, Leptospira interrogans serovar lai str. 56601
cuccgauaauuguag

SEQ ID NO: 2779775 - RNA, 15 nt, Leptospira interrogans serovar lai str. 56601
cuccggaaaaaacug

SEQ ID NO: 2779776 - RNA, 17 nt, Leptospira interrogans serovar lai str. 56601
cuccgugaacuucuuuc

SEQ ID NO: 2779777 - RNA, 14 nt, Leptospira interrogans serovar lai str. 56601
cuccuaaaauaaaa

SEQ ID NO: 2779778 - RNA, 13 nt, Leptospira interrogans serovar lai str. 56601
cuccucuucacca

SEQ ID NO: 2779779 - RNA, 16 nt, Leptospira interrogans serovar lai str. 56601
cuccugcauccacaaa

SEQ ID NO: 2779780 - RNA, 21 nt, Leptospira interrogans serovar lai str. 56601
cucuuuugagagccuuuuuau

SEQ ID NO: 2779781 - RNA, 22 nt, Leptospira interrogans serovar lai str. 56601
cucuuuuuagacaaaaauacua

SEQ ID NO: 2779782 - RNA, 16 nt, Leptospira interrogans serovar lai str. 56601
cucuuuuuauuuuuug

SEQ ID NO: 2779783 - RNA, 15 nt, Leptospira interrogans serovar lai str. 56601
cucuuuuucucuuug

SEQ ID NO: 2779784 - RNA, 19 nt, Leptospira interrogans serovar lai str. 56601
cucuuuuucuucugcugca

SEQ ID NO: 2779785 - RNA, 19 nt, Leptospira interrogans serovar lai str. 56601
cucuuuuugggaauuuuuu

SEQ ID NO: 2779786 - RNA, 12 nt, Leptospira interrogans serovar lai str. 56601
cucuuuuuuaaa

SEQ ID NO: 2779787 - RNA, 13 nt, Leptospira interrogans serovar lai str. 56601
cucuuuuuuaaag

SEQ ID NO: 2779788 - RNA, 18 nt, Leptospira interrogans serovar lai str. 56601
cugaaaaaaacgucuuua

SEQ ID NO: 2779789 - RNA, 13 nt, Leptospira interrogans serovar lai str. 56601
cugaaaaaaauua

SEQ ID NO: 2779790 - RNA, 16 nt, Leptospira interrogans serovar lai str. 56601
cugaaaaaaguugaaa

SEQ ID NO: 2779791 - RNA, 14 nt, Leptospira interrogans serovar lai str. 56601
cugaaaaaaguugg

SEQ ID NO: 2779792 - RNA, 24 nt, Leptospira interrogans serovar lai str. 56601
cugaaaaaaguuggaauuugaauu

SEQ ID NO: 2779793 - RNA, 18 nt, Leptospira interrogans serovar lai str. 56601
cugaaaagaauugaaauc

SEQ ID NO: 2779794 - RNA, 16 nt, Leptospira interrogans serovar lai str. 56601
cugaaaaguuuaugaa

SEQ ID NO: 2779795 - RNA, 16 nt, Leptospira interrogans serovar lai str. 56601
cugaaaaugaccaaaa

SEQ ID NO: 2779796 - RNA, 23 nt, Leptospira interrogans serovar lai str. 56601
cugaaaaugaccaaaauuuccaa

SEQ ID NO: 2779797 - RNA, 18 nt, Leptospira interrogans serovar lai str. 56601
cugaaacuugaacuguuu

SEQ ID NO: 2779798 - RNA, 19 nt, Leptospira interrogans serovar lai str. 56601
cugaaacuuuucaaaaucu

SEQ ID NO: 2779799 - RNA, 11 nt, Leptospira interrogans serovar lai str. 56601
cugaaauaaau

SEQ ID NO: 2779800 - RNA, 20 nt, Leptospira interrogans serovar lai str. 56601
cugaaauaaauuuaaauguu

SEQ ID NO: 2779801 - RNA, 21 nt, Leptospira interrogans serovar lai str. 56601
cugaaaucuuaggacggauuu

SEQ ID NO: 2779802 - RNA, 20 nt, Leptospira interrogans serovar lai str. 56601
cugaaauucaucaaauuugc

SEQ ID NO: 2779803 - RNA, 20 nt, Leptospira interrogans serovar lai str. 56601
cugaaauuguuuuaaaacuu

SEQ ID NO: 2779804 - RNA, 19 nt, Leptospira interrogans serovar lai str. 56601
cugaaccugcaaauuuuuu

SEQ ID NO: 2779805 - RNA, 14 nt, Leptospira interrogans serovar lai str. 56601
cugaacuuaaaauc

SEQ ID NO: 2779806 - RNA, 16 nt, Leptospira interrogans serovar lai str. 56601
cugaacuuaaaaucua

SEQ ID NO: 2779807 - RNA, 14 nt, Leptospira interrogans serovar lai str. 56601
cugaacuuuauaga

SEQ ID NO: 2779808 - RNA, 14 nt, Leptospira interrogans serovar lai str. 56601
cugaauaaaaauac

SEQ ID NO: 2779809 - RNA, 17 nt, Leptospira interrogans serovar lai str. 56601
cugaauaauugaauaaa

SEQ ID NO: 2779810 - RNA, 15 nt, Leptospira interrogans serovar lai str. 56601
cugaaucucuuuuuc

SEQ ID NO: 2779811 - RNA, 16 nt, Leptospira interrogans serovar lai str. 56601
cugaaucucuuuuucu

SEQ ID NO: 2779812 - RNA, 13 nt, Leptospira interrogans serovar lai str. 56601
cugaauuuuauag

SEQ ID NO: 2779813 - RNA, 14 nt, Leptospira interrogans serovar lai str. 56601
cugacauuccagcu

SEQ ID NO: 2779814 - RNA, 16 nt, Leptospira interrogans serovar lai str. 56601
cugacauucuaaacau

SEQ ID NO: 2779815 - RNA, 19 nt, Leptospira interrogans serovar lai str. 56601
cugagaaccauuucaaguu

SEQ ID NO: 2779816 - RNA, 22 nt, Leptospira interrogans serovar lai str. 56601
cugagauuugucucaaaauuua

SEQ ID NO: 2779817 - RNA, 18 nt, Leptospira interrogans serovar lai str. 56601
cugaggaggauuagaaga

SEQ ID NO: 2779818 - RNA, 21 nt, Leptospira interrogans serovar lai str. 56601
cugaggaguuuuuauaaaauc

SEQ ID NO: 2779819 - RNA, 14 nt, Leptospira interrogans serovar lai str. 56601
cugaguaguaaguu

SEQ ID NO: 2779820 - RNA, 15 nt, Leptospira interrogans serovar lai str. 56601
cugagucuagaauuc

SEQ ID NO: 2779821 - RNA, 15 nt, Leptospira interrogans serovar lai str. 56601
cugaguuugagagag

SEQ ID NO: 2779822 - RNA, 16 nt, Leptospira interrogans serovar lai str. 56601
cugaguuugagagaga

SEQ ID NO: 2779823 - RNA, 16 nt, Leptospira interrogans serovar lai str. 56601
cugaguuugagagagc

SEQ ID NO: 2779824 - RNA, 17 nt, Leptospira interrogans serovar lai str. 56601
cugauaaagaaaaccuu

SEQ ID NO: 2779825 - RNA, 22 nt, Leptospira interrogans serovar lai str. 56601
cugauaaauuccguaaaauuca

SEQ ID NO: 2779826 - RNA, 20 nt, Leptospira interrogans serovar lai str. 56601
cugauaaauuucauaucuaa

SEQ ID NO: 2779827 - RNA, 15 nt, Leptospira interrogans serovar lai str. 56601
cugauaauuuuuuaa

SEQ ID NO: 2779828 - RNA, 22 nt, Leptospira interrogans serovar lai str. 56601
cugauauaauucguuugaacuc

SEQ ID NO: 2779829 - RNA, 14 nt, Leptospira interrogans serovar lai str. 56601
cugauauuuuaaau

SEQ ID NO: 2779830 - RNA, 18 nt, Leptospira interrogans serovar lai str. 56601
cugaucgaauaccguucu

SEQ ID NO: 2779831 - RNA, 24 nt, Leptospira interrogans serovar lai str. 56601
cugaucuuauggacucuauuauga

SEQ ID NO: 2779832 - RNA, 17 nt, Leptospira interrogans serovar lai str. 56601
cugauucuaaaauccua

SEQ ID NO: 2779833 - RNA, 21 nt, Leptospira interrogans serovar lai str. 56601
cugauugagaaaauaaaaaau

SEQ ID NO: 2779834 - RNA, 15 nt, Leptospira interrogans serovar lai str. 56601
cugauuuaauuauuu

SEQ ID NO: 2779835 - RNA, 16 nt, Leptospira interrogans serovar lai str. 56601
cugauuuaauuauuua

SEQ ID NO: 2779836 - RNA, 14 nt, Leptospira interrogans serovar lai str. 56601
cugauuucaaaaau

SEQ ID NO: 2779837 - RNA, 17 nt, Leptospira interrogans serovar lai str. 56601
cugauuucaaaaauaaa

SEQ ID NO: 2779838 - RNA, 15 nt, Leptospira interrogans serovar lai str. 56601
cugauuucuauaaaa

SEQ ID NO: 2779839 - RNA, 18 nt, Leptospira interrogans serovar lai str. 56601
cugauuuuuauaauuuag

SEQ ID NO: 2779840 - RNA, 12 nt, Leptospira interrogans serovar lai str. 56601
cugauuuuucug

SEQ ID NO: 2779841 - RNA, 18 nt, Leptospira interrogans serovar lai str. 56601
cugauuuuucuuuagaca

SEQ ID NO: 2779842 - RNA, 20 nt, Leptospira interrogans serovar lai str. 56601
cugcaaaaucaguuaauaca

SEQ ID NO: 2779843 - RNA, 16 nt, Leptospira interrogans serovar lai str. 56601
cugcaaauuuuuuucu

SEQ ID NO: 2779844 - RNA, 21 nt, Leptospira interrogans serovar lai str. 56601
cugcaauaguuucuacauuuu

SEQ ID NO: 2779845 - RNA, 20 nt, Leptospira interrogans serovar lai str. 56601
cugcaauucgcauuaaaauu

SEQ ID NO: 2779846 - RNA, 17 nt, Leptospira interrogans serovar lai str. 56601
cugcaucaaccaagaau

SEQ ID NO: 2779847 - RNA, 14 nt, Leptospira interrogans serovar lai str. 56601
cugcaucuuuucua

SEQ ID NO: 2779848 - RNA, 21 nt, Leptospira interrogans serovar lai str. 56601
cugcauucuuagaauuuuccu

SEQ ID NO: 2779849 - RNA, 14 nt, Leptospira interrogans serovar lai str. 56601
cugcauuuuauuaa

SEQ ID NO: 2779850 - RNA, 18 nt, Leptospira interrogans serovar lai str. 56601
cugcauuuuauuaaagaa

SEQ ID NO: 2779851 - RNA, 14 nt, Leptospira interrogans serovar lai str. 56601
cugccaaaagaacu

SEQ ID NO: 2779852 - RNA, 22 nt, Leptospira interrogans serovar lai str. 56601
cugccaaaaucccagaaaggaa

SEQ ID NO: 2779853 - RNA, 15 nt, Leptospira interrogans serovar lai str. 56601
cugccgcucuuucuu

SEQ ID NO: 2779854 - RNA, 23 nt, Leptospira interrogans serovar lai str. 56601
cugccuaugccccauucuuuuug

SEQ ID NO: 2779855 - RNA, 14 nt, Leptospira interrogans serovar lai str. 56601
cugcuaaguucauc

SEQ ID NO: 2779856 - RNA, 12 nt, Leptospira interrogans serovar lai str. 56601
cugcucaauaaa

SEQ ID NO: 2779857 - RNA, 16 nt, Leptospira interrogans serovar lai str. 56601
cugcucauuuuuucuu

SEQ ID NO: 2779858 - RNA, 15 nt, Leptospira interrogans serovar lai str. 56601
cugcucgaaaguuua

SEQ ID NO: 2779859 - RNA, 16 nt, Leptospira interrogans serovar lai str. 56601
cugcucgaauuuuuuu

SEQ ID NO: 2779860 - RNA, 13 nt, Leptospira interrogans serovar lai str. 56601
cugcucuucuaau

SEQ ID NO: 2779861 - RNA, 23 nt, Leptospira interrogans serovar lai str. 56601
cugcuucaauuguccauuuccau

SEQ ID NO: 2779862 - RNA, 19 nt, Leptospira interrogans serovar lai str. 56601
cugcuuccaaaaaaagucu

SEQ ID NO: 2779863 - RNA, 22 nt, Leptospira interrogans serovar lai str. 56601
cuuaauguaaaguucuuuucuu

SEQ ID NO: 2779864 - RNA, 23 nt, Leptospira interrogans serovar lai str. 56601
cuuaauguaaaguucuuuucuua

SEQ ID NO: 2779865 - RNA, 14 nt, Leptospira interrogans serovar lai str. 56601
cuuaauuaaaaaau

SEQ ID NO: 2779866 - RNA, 16 nt, Leptospira interrogans serovar lai str. 56601
cuuacaaacuccguga

SEQ ID NO: 2779867 - RNA, 19 nt, Leptospira interrogans serovar lai str. 56601
cuuacaaacuccgugaacu

SEQ ID NO: 2779868 - RNA, 19 nt, Leptospira interrogans serovar lai str. 56601
cuuacaaagcacuuuuuuc

SEQ ID NO: 2779869 - RNA, 21 nt, Leptospira interrogans serovar lai str. 56601
cuuacaaagcacuuuuuuccu

SEQ ID NO: 2779870 - RNA, 22 nt, Leptospira interrogans serovar lai str. 56601
cuuacaaagcacuuuuuuccuc

SEQ ID NO: 2779871 - RNA, 16 nt, Leptospira interrogans serovar lai str. 56601
cuuacaauaaaaacuu

SEQ ID NO: 2779872 - RNA, 19 nt, Leptospira interrogans serovar lai str. 56601
cuuacaauaaaaacuuaug

SEQ ID NO: 2779873 - RNA, 12 nt, Leptospira interrogans serovar lai str. 56601
cuuacaauuuca

SEQ ID NO: 2779874 - RNA, 20 nt, Leptospira interrogans serovar lai str. 56601
cuuacaccgaauucaaguua

SEQ ID NO: 2779875 - RNA, 21 nt, Leptospira interrogans serovar lai str. 56601
cuuacacuccucaaagauuac

SEQ ID NO: 2779876 - RNA, 20 nt, Leptospira interrogans serovar lai str. 56601
cuuacaucccaaaccucuuu

SEQ ID NO: 2779877 - RNA, 19 nt, Leptospira interrogans serovar lai str. 56601
cuuaccaccguguugacaa

SEQ ID NO: 2779878 - RNA, 17 nt, Leptospira interrogans serovar lai str. 56601
cuuacccacaaauaauu

SEQ ID NO: 2779879 - RNA, 16 nt, Leptospira interrogans serovar lai str. 56601
cuuaccucuauaaaau

SEQ ID NO: 2779880 - RNA, 14 nt, Leptospira interrogans serovar lai str. 56601
cuuacggggaauuu

SEQ ID NO: 2779881 - RNA, 15 nt, Leptospira interrogans serovar lai str. 56601
cuuacgucgaacuca

SEQ ID NO: 2779882 - RNA, 14 nt, Leptospira interrogans serovar lai str. 56601
cuuacuaugaaguc

SEQ ID NO: 2779883 - RNA, 20 nt, Leptospira interrogans serovar lai str. 56601
cuuacugcauuuuauuaaag

SEQ ID NO: 2779884 - RNA, 20 nt, Leptospira interrogans serovar lai str. 56601
cuuacuuaccucuauaaaau

SEQ ID NO: 2779885 - RNA, 18 nt, Leptospira interrogans serovar lai str. 56601
cuuacuuugagaaaauuu

SEQ ID NO: 2779886 - RNA, 20 nt, Leptospira interrogans serovar lai str. 56601
cuuagaaagcauggucuguc

SEQ ID NO: 2779887 - RNA, 21 nt, Leptospira interrogans serovar lai str. 56601
cuuagaaagcgugacuaaaau

SEQ ID NO: 2779888 - RNA, 14 nt, Leptospira interrogans serovar lai str. 56601
cuuagaauaauagg

SEQ ID NO: 2779889 - RNA, 17 nt, Leptospira interrogans serovar lai str. 56601
cuuagaauuuuuucguu

SEQ ID NO: 2779890 - RNA, 23 nt, Leptospira interrogans serovar lai str. 56601
cuuagacucaguauguuguucuc

SEQ ID NO: 2779891 - RNA, 15 nt, Leptospira interrogans serovar lai str. 56601
cuuagaguaaaacuu

SEQ ID NO: 2779892 - RNA, 21 nt, Leptospira interrogans serovar lai str. 56601
cuuagaguaaaacuuuuaaag

SEQ ID NO: 2779893 - RNA, 22 nt, Leptospira interrogans serovar lai str. 56601
cuuagaguaaaacuuuuaaaga

SEQ ID NO: 2779894 - RNA, 19 nt, Leptospira interrogans serovar lai str. 56601
cuuagaguuguccuaaaac

SEQ ID NO: 2779895 - RNA, 22 nt, Leptospira interrogans serovar lai str. 56601
cuuagaguuguccuaaaaccuc

SEQ ID NO: 2779896 - RNA, 13 nt, Leptospira interrogans serovar lai str. 56601
cuuaggaacuuuu

SEQ ID NO: 2779897 - RNA, 20 nt, Leptospira interrogans serovar lai str. 56601
cuuaggcccgaauuuuaaau

SEQ ID NO: 2779898 - RNA, 21 nt, Leptospira interrogans serovar lai str. 56601
cuuaggcccgaauuuuaaaua

SEQ ID NO: 2779899 - RNA, 22 nt, Leptospira interrogans serovar lai str. 56601
cuuagguucgaacguauaaaaa

SEQ ID NO: 2779900 - RNA, 16 nt, Leptospira interrogans serovar lai str. 56601
cuuagguuuaucugua

SEQ ID NO: 2779901 - RNA, 22 nt, Leptospira interrogans serovar lai str. 56601
cuuagguuuuguaauaguuccc

SEQ ID NO: 2779902 - RNA, 23 nt, Leptospira interrogans serovar lai str. 56601
cuuagguuuuguaauaguuccca

SEQ ID NO: 2779903 - RNA, 15 nt, Leptospira interrogans serovar lai str. 56601
cuuagucuaaaaaca

SEQ ID NO: 2779904 - RNA, 17 nt, Leptospira interrogans serovar lai str. 56601
cuuagucuaaaaacaac

SEQ ID NO: 2779905 - RNA, 11 nt, Leptospira interrogans serovar lai str. 56601
cuuauaaaauu

SEQ ID NO: 2779906 - RNA, 22 nt, Leptospira interrogans serovar lai str. 56601
cuuauaagaaucgauucagagu

SEQ ID NO: 2779907 - RNA, 14 nt, Leptospira interrogans serovar lai str. 56601
cuuauaaugaagac

SEQ ID NO: 2779908 - RNA, 23 nt, Leptospira interrogans serovar lai str. 56601
cuuauaaugaagacgcuucaucg

SEQ ID NO: 2779909 - RNA, 14 nt, Leptospira interrogans serovar lai str. 56601
cuuauacucuuaaa

SEQ ID NO: 2779910 - RNA, 12 nt, Leptospira interrogans serovar lai str. 56601
cuuaucaaauag

SEQ ID NO: 2779911 - RNA, 17 nt, Leptospira interrogans serovar lai str. 56601
cuuaucacgaaaauuaa

SEQ ID NO: 2779912 - RNA, 21 nt, Leptospira interrogans serovar lai str. 56601
cuuaucacgaaaauuaaaaaa

SEQ ID NO: 2779913 - RNA, 12 nt, Leptospira interrogans serovar lai str. 56601
cuuaucuaauuu

SEQ ID NO: 2779914 - RNA, 16 nt, Leptospira interrogans serovar lai str. 56601
cuuaucuaauuuuuug

SEQ ID NO: 2779915 - RNA, 23 nt, Leptospira interrogans serovar lai str. 56601
cuuaugguuuuuuaauauuagaa

SEQ ID NO: 2779916 - RNA, 22 nt, Leptospira interrogans serovar lai str. 56601
cuuauugaacguaaguuaaaua

SEQ ID NO: 2779917 - RNA, 22 nt, Leptospira interrogans serovar lai str. 56601
cuuauugaugauugaaacguuu

SEQ ID NO: 2779918 - RNA, 12 nt, Leptospira interrogans serovar lai str. 56601
cuuauuugcaau

SEQ ID NO: 2779919 - RNA, 17 nt, Leptospira interrogans serovar lai str. 56601
cuuauuuuugaaaagau

SEQ ID NO: 2779920 - RNA, 17 nt, Leptospira interrogans serovar lai str. 56601
cuuauuuuuuuauuuua

SEQ ID NO: 2779921 - RNA, 18 nt, Leptospira interrogans serovar lai str. 56601
cuuauuuuuuuauuuuau

SEQ ID NO: 2779922 - RNA, 13 nt, Leptospira interrogans serovar lai str. 56601
cuucaaaaaauau

SEQ ID NO: 2779923 - RNA, 15 nt, Leptospira interrogans serovar lai str. 56601
cuucaaaacuaggau

SEQ ID NO: 2779924 - RNA, 14 nt, Leptospira interrogans serovar lai str. 56601
cuucaaaguugauu

SEQ ID NO: 2779925 - RNA, 12 nt, Leptospira interrogans serovar lai str. 56601
cuucaaauucua

SEQ ID NO: 2779926 - RNA, 18 nt, Leptospira interrogans serovar lai str. 56601
cuucaauuguccauuuca

SEQ ID NO: 2779927 - RNA, 15 nt, Leptospira interrogans serovar lai str. 56601
cuucauauaauaaaa

SEQ ID NO: 2779928 - RNA, 21 nt, Leptospira interrogans serovar lai str. 56601
cuucaucaaugguuuuucuuc

SEQ ID NO: 2779929 - RNA, 19 nt, Leptospira interrogans serovar lai str. 56601
cuucauccgggcuuuucuu

SEQ ID NO: 2779930 - RNA, 18 nt, Leptospira interrogans serovar lai str. 56601
cuucauucggcuuuaagu

SEQ ID NO: 2779931 - RNA, 12 nt, Leptospira interrogans serovar lai str. 56601
cuucauuuccaa

SEQ ID NO: 2779932 - RNA, 20 nt, Leptospira interrogans serovar lai str. 56601
cuuccaaaucugaaucucuu

SEQ ID NO: 2779933 - RNA, 16 nt, Leptospira interrogans serovar lai str. 56601
cuuccaucaaauacaa

SEQ ID NO: 2779934 - RNA, 19 nt, Leptospira interrogans serovar lai str. 56601
cuuccauucaacuuagaac

SEQ ID NO: 2779935 - RNA, 19 nt, Leptospira interrogans serovar lai str. 56601
cuuccgauucacuuccauu

SEQ ID NO: 2779936 - RNA, 14 nt, Leptospira interrogans serovar lai str. 56601
cuuccgcauuuuua

SEQ ID NO: 2779937 - RNA, 15 nt, Leptospira interrogans serovar lai str. 56601
cuuccggaagaacaa

SEQ ID NO: 2779938 - RNA, 22 nt, Leptospira interrogans serovar lai str. 56601
cuuccgggaggaauuuuuaaaa

SEQ ID NO: 2779939 - RNA, 13 nt, Leptospira interrogans serovar lai str. 56601
cuuccuuuuucau

SEQ ID NO: 2779940 - RNA, 17 nt, Leptospira interrogans serovar lai str. 56601
cuucgcauaacaaaaau

SEQ ID NO: 2779941 - RNA, 22 nt, Leptospira interrogans serovar lai str. 56601
cuucgguuuaauauacuaaaau

SEQ ID NO: 2779942 - RNA, 16 nt, Leptospira interrogans serovar lai str. 56601
cuucguuagaagacaa

SEQ ID NO: 2779943 - RNA, 22 nt, Leptospira interrogans serovar lai str. 56601
cuucuaaaucuaauucuucuaa

SEQ ID NO: 2779944 - RNA, 12 nt, Leptospira interrogans serovar lai str. 56601
cuucuaauuaaa

SEQ ID NO: 2779945 - RNA, 17 nt, Leptospira interrogans serovar lai str. 56601
cuucuagcaaucuuccu

SEQ ID NO: 2779946 - RNA, 22 nt, Leptospira interrogans serovar lai str. 56601
cuucuauuucuuauuuauuaaa

SEQ ID NO: 2779947 - RNA, 20 nt, Leptospira interrogans serovar lai str. 56601
cuucuauuuuauaaauugug

SEQ ID NO: 2779948 - RNA, 20 nt, Leptospira interrogans serovar lai str. 56601
cuucuccucuuccggaagaa

SEQ ID NO: 2779949 - RNA, 23 nt, Leptospira interrogans serovar lai str. 56601
cuucucgcaacggauuccuccag

SEQ ID NO: 2779950 - RNA, 14 nt, Leptospira interrogans serovar lai str. 56601
cuucucuuaaaauu

SEQ ID NO: 2779951 - RNA, 14 nt, Leptospira interrogans serovar lai str. 56601
cuucucuuuuaaaa

SEQ ID NO: 2779952 - RNA, 21 nt, Leptospira interrogans serovar lai str. 56601
cuucucuuuuaaaaacuuguu

SEQ ID NO: 2779953 - RNA, 21 nt, Leptospira interrogans serovar lai str. 56601
cuucugaacguaguaguuccu

SEQ ID NO: 2779954 - RNA, 21 nt, Leptospira interrogans serovar lai str. 56601
cuucugauuguaacauuauag

SEQ ID NO: 2779955 - RNA, 18 nt, Leptospira interrogans serovar lai str. 56601
cuucuggaaaaauuccua

SEQ ID NO: 2779956 - RNA, 16 nt, Leptospira interrogans serovar lai str. 56601
cuucuggaaugacuga

SEQ ID NO: 2779957 - RNA, 15 nt, Leptospira interrogans serovar lai str. 56601
cuucuguaaaacuua

SEQ ID NO: 2779958 - RNA, 23 nt, Leptospira interrogans serovar lai str. 56601
cuucuuaaguagauaaauucuua

SEQ ID NO: 2779959 - RNA, 17 nt, Leptospira interrogans serovar lai str. 56601
cuucuucaugauuuuuu

SEQ ID NO: 2779960 - RNA, 19 nt, Leptospira interrogans serovar lai str. 56601
cuucuuccauucuaaaauc

SEQ ID NO: 2779961 - RNA, 21 nt, Leptospira interrogans serovar lai str. 56601
cuucuucgguaauuguagauu

SEQ ID NO: 2779962 - RNA, 17 nt, Leptospira interrogans serovar lai str. 56601
cuucuugaaaggugauu

SEQ ID NO: 2779963 - RNA, 18 nt, Leptospira interrogans serovar lai str. 56601
cuucuugaaauaaucgaa

SEQ ID NO: 2779964 - RNA, 15 nt, Leptospira interrogans serovar lai str. 56601
cuucuugcgcuaucu

SEQ ID NO: 2779965 - RNA, 17 nt, Leptospira interrogans serovar lai str. 56601
cuucuugcgcuaucuuc

SEQ ID NO: 2779966 - RNA, 19 nt, Leptospira interrogans serovar lai str. 56601
cuucuuuuguuuuuauaaa

SEQ ID NO: 2779967 - RNA, 13 nt, Leptospira interrogans serovar lai str. 56601
cuucuuuuuucua

SEQ ID NO: 2779968 - RNA, 13 nt, Leptospira interrogans serovar lai str. 56601
cuucuuuuuugca

SEQ ID NO: 2779969 - RNA, 19 nt, Leptospira interrogans serovar lai str. 56601
cuugaaaaaugugccuuuu

SEQ ID NO: 2779970 - RNA, 13 nt, Leptospira interrogans serovar lai str. 56601
cuugaaaauaaaa

SEQ ID NO: 2779971 - RNA, 18 nt, Leptospira interrogans serovar lai str. 56601
cuugaaacuuuuaauaaa

SEQ ID NO: 2779972 - RNA, 16 nt, Leptospira interrogans serovar lai str. 56601
cuugaaauucucuuuu

SEQ ID NO: 2779973 - RNA, 12 nt, Leptospira interrogans serovar lai str. 56601
cuugaacucaau

SEQ ID NO: 2779974 - RNA, 11 nt, Leptospira interrogans serovar lai str. 56601
cuugaagauuu

SEQ ID NO: 2779975 - RNA, 22 nt, Leptospira interrogans serovar lai str. 56601
cuugaauaaagagaaaacaauu

SEQ ID NO: 2779976 - RNA, 13 nt, Leptospira interrogans serovar lai str. 56601
cuugacucugcau

SEQ ID NO: 2779977 - RNA, 20 nt, Leptospira interrogans serovar lai str. 56601
cuugacuuugguugaguuuu

SEQ ID NO: 2779978 - RNA, 17 nt, Leptospira interrogans serovar lai str. 56601
cuugagaaaggagaacu

SEQ ID NO: 2779979 - RNA, 22 nt, Leptospira interrogans serovar lai str. 56601
cuugagaagggugaauuuuuuc

SEQ ID NO: 2779980 - RNA, 17 nt, Leptospira interrogans serovar lai str. 56601
cuugagggguuuuuccu

SEQ ID NO: 2779981 - RNA, 21 nt, Leptospira interrogans serovar lai str. 56601
cuugagggguuuuuccuuuua

SEQ ID NO: 2779982 - RNA, 20 nt, Leptospira interrogans serovar lai str. 56601
cuugauauuucuguaaaaaa

SEQ ID NO: 2779983 - RNA, 23 nt, Leptospira interrogans serovar lai str. 56601
cuugauauuucuguaaaaaauaa

SEQ ID NO: 2779984 - RNA, 15 nt, Leptospira interrogans serovar lai str. 56601
cuugauuauuauuuu

SEQ ID NO: 2779985 - RNA, 14 nt, Leptospira interrogans serovar lai str. 56601
cuugauuauuuucu

SEQ ID NO: 2779986 - RNA, 13 nt, Leptospira interrogans serovar lai str. 56601
cuugauugguugu

SEQ ID NO: 2779987 - RNA, 13 nt, Leptospira interrogans serovar lai str. 56601
cuugcaaaaauag

SEQ ID NO: 2779988 - RNA, 21 nt, Leptospira interrogans serovar lai str. 56601
cuugcaaaaauagaauuuuug

SEQ ID NO: 2779989 - RNA, 18 nt, Leptospira interrogans serovar lai str. 56601
cuugccauggaaauuuuu

SEQ ID NO: 2779990 - RNA, 23 nt, Leptospira interrogans serovar lai str. 56601
cuugccauggaaauuuuuccguc

SEQ ID NO: 2779991 - RNA, 18 nt, Leptospira interrogans serovar lai str. 56601
cuuggaguucuuacuuuu

SEQ ID NO: 2779992 - RNA, 13 nt, Leptospira interrogans serovar lai str. 56601
cuugggauaaaua

SEQ ID NO: 2779993 - RNA, 21 nt, Leptospira interrogans serovar lai str. 56601
cuuguaaguuguguuuauuca

SEQ ID NO: 2779994 - RNA, 23 nt, Leptospira interrogans serovar lai str. 56601
cuuguagaaacuauuauacuuua

SEQ ID NO: 2779995 - RNA, 18 nt, Leptospira interrogans serovar lai str. 56601
cuugucacuauuuuuaug

SEQ ID NO: 2779996 - RNA, 11 nt, Leptospira interrogans serovar lai str. 56601
cuugucccaaa

SEQ ID NO: 2779997 - RNA, 14 nt, Leptospira interrogans serovar lai str. 56601
cuugucccaaaauu

SEQ ID NO: 2779998 - RNA, 20 nt, Leptospira interrogans serovar lai str. 56601
cuugucggaacacuugaaaa

SEQ ID NO: 2779999 - RNA, 15 nt, Leptospira interrogans serovar lai str. 56601
cuugucguaaaaaaa

SEQ ID NO: 2780000 - RNA, 20 nt, Leptospira interrogans serovar lai str. 56601
cuugucguaaaaaaauaaga

SEQ ID NO: 2780001 - RNA, 14 nt, Leptospira interrogans serovar lai str. 56601
cuugugagugaacu

SEQ ID NO: 2780002 - RNA, 19 nt, Leptospira interrogans serovar lai str. 56601
cuugugagugaacuccauu

SEQ ID NO: 2780003 - RNA, 14 nt, Leptospira interrogans serovar lai str. 56601
cuugugggaacuac

SEQ ID NO: 2780004 - RNA, 15 nt, Leptospira interrogans serovar lai str. 56601
cuugugucaagcccu

SEQ ID NO: 2780005 - RNA, 15 nt, Leptospira interrogans serovar lai str. 56601
cuuguguuucagacu

SEQ ID NO: 2780006 - RNA, 22 nt, Leptospira interrogans serovar lai str. 56601
cuuguuaaaauaaaaaaauuga

SEQ ID NO: 2780007 - RNA, 16 nt, Leptospira interrogans serovar lai str. 56601
cuuguuauuaaaaucu

SEQ ID NO: 2780008 - RNA, 17 nt, Leptospira interrogans serovar lai str. 56601
cuuguuauuaaaaucua

SEQ ID NO: 2780009 - RNA, 14 nt, Leptospira interrogans serovar lai str. 56601
cuuguuguaccauu

SEQ ID NO: 2780010 - RNA, 21 nt, Leptospira interrogans serovar lai str. 56601
cuuguuucuguuugaugaaau

SEQ ID NO: 2780011 - RNA, 16 nt, Leptospira interrogans serovar lai str. 56601
cuuguuuuuaaauuaa

SEQ ID NO: 2780012 - RNA, 15 nt, Leptospira interrogans serovar lai str. 56601
cuuuaaaaaauaaga

SEQ ID NO: 2780013 - RNA, 16 nt, Leptospira interrogans serovar lai str. 56601
cuuuaaaaaauaucuu

SEQ ID NO: 2780014 - RNA, 21 nt, Leptospira interrogans serovar lai str. 56601
cuuuaaaaaauuaguuuucuu

SEQ ID NO: 2780015 - RNA, 13 nt, Leptospira interrogans serovar lai str. 56601
cuuuaaaagagcg

SEQ ID NO: 2780016 - RNA, 16 nt, Leptospira interrogans serovar lai str. 56601
cuuuaaaauacuuuac

SEQ ID NO: 2780017 - RNA, 12 nt, Leptospira interrogans serovar lai str. 56601
cuuuaaaauugu

SEQ ID NO: 2780018 - RNA, 24 nt, Leptospira interrogans serovar lai str. 56601
cuuuaaaauuugugauaucucauu

SEQ ID NO: 2780019 - RNA, 19 nt, Leptospira interrogans serovar lai str. 56601
cuuuaaaauuuuuaauaaa

SEQ ID NO: 2780020 - RNA, 16 nt, Leptospira interrogans serovar lai str. 56601
cuuuaaacuuucuucc

SEQ ID NO: 2780021 - RNA, 19 nt, Leptospira interrogans serovar lai str. 56601
cuuuaaaguugguuuuguu

SEQ ID NO: 2780022 - RNA, 15 nt, Leptospira interrogans serovar lai str. 56601
cuuuaaauacuuuau

SEQ ID NO: 2780023 - RNA, 19 nt, Leptospira interrogans serovar lai str. 56601
cuuuaaauguagaaacuac

SEQ ID NO: 2780024 - RNA, 15 nt, Leptospira interrogans serovar lai str. 56601
cuuuaaaugugggaa

SEQ ID NO: 2780025 - RNA, 21 nt, Leptospira interrogans serovar lai str. 56601
cuuuaaaugugggaacuccca

SEQ ID NO: 2780026 - RNA, 23 nt, Leptospira interrogans serovar lai str. 56601
cuuuaagaaaauuuaaaauauaa

SEQ ID NO: 2780027 - RNA, 21 nt, Leptospira interrogans serovar lai str. 56601
cuuuaagagccuuucacaucu

SEQ ID NO: 2780028 - RNA, 21 nt, Leptospira interrogans serovar lai str. 56601
cuuuaagagucauuuuuaaau

SEQ ID NO: 2780029 - RNA, 14 nt, Leptospira interrogans serovar lai str. 56601
cuuugacuacuucc

SEQ ID NO: 2780030 - RNA, 15 nt, Leptospira interrogans serovar lai str. 56601
cuuugagaaaauuuu

SEQ ID NO: 2780031 - RNA, 16 nt, Leptospira interrogans serovar lai str. 56601
cuuugagaaaauuuuu

SEQ ID NO: 2780032 - RNA, 19 nt, Leptospira interrogans serovar lai str. 56601
cuuugauugaauuaaaaaa

SEQ ID NO: 2780033 - RNA, 17 nt, Leptospira interrogans serovar lai str. 56601
cuuugcgauugagaauu

SEQ ID NO: 2780034 - RNA, 18 nt, Leptospira interrogans serovar lai str. 56601
cuuugcgauugagaauuc

SEQ ID NO: 2780035 - RNA, 16 nt, Leptospira interrogans serovar lai str. 56601
cuuugcucucgcaaug

SEQ ID NO: 2780036 - RNA, 22 nt, Leptospira interrogans serovar lai str. 56601
cuuugcucucgcaaugaaaauu

SEQ ID NO: 2780037 - RNA, 20 nt, Leptospira interrogans serovar lai str. 56601
cuuuggaauuggcuucuuau

SEQ ID NO: 2780038 - RNA, 20 nt, Leptospira interrogans serovar lai str. 56601
cuuuggaugcauacauagau

SEQ ID NO: 2780039 - RNA, 14 nt, Leptospira interrogans serovar lai str. 56601
cuuuggauuuugau

SEQ ID NO: 2780040 - RNA, 22 nt, Leptospira interrogans serovar lai str. 56601
cuuugguuaucauaaaaauaaa

SEQ ID NO: 2780041 - RNA, 22 nt, Leptospira interrogans serovar lai str. 56601
cuuuguaaaucuauucuuaaaa

SEQ ID NO: 2780042 - RNA, 23 nt, Leptospira interrogans serovar lai str. 56601
cuuuguaaccuuuguuuccucuu

SEQ ID NO: 2780043 - RNA, 14 nt, Leptospira interrogans serovar lai str. 56601
cuuugucuuuaugc

SEQ ID NO: 2780044 - RNA, 22 nt, Leptospira interrogans serovar lai str. 56601
cuuuguucaaagaaauguggga

SEQ ID NO: 2780045 - RNA, 21 nt, Leptospira interrogans serovar lai str. 56601
cuuuguuuauuguuuauaaaa

SEQ ID NO: 2780046 - RNA, 12 nt, Leptospira interrogans serovar lai str. 56601
cuuuuaaaaaag

SEQ ID NO: 2780047 - RNA, 16 nt, Leptospira interrogans serovar lai str. 56601
cuuuuaaaaucaagag

SEQ ID NO: 2780048 - RNA, 23 nt, Leptospira interrogans serovar lai str. 56601
cuuuuaaacaauugauugcuuuu

SEQ ID NO: 2780049 - RNA, 18 nt, Leptospira interrogans serovar lai str. 56601
cuuuuaaagaagauaaaa

SEQ ID NO: 2780050 - RNA, 14 nt, Leptospira interrogans serovar lai str. 56601
cuuuuaccuuacca

SEQ ID NO: 2780051 - RNA, 15 nt, Leptospira interrogans serovar lai str. 56601
cuuuuaccuuaccac

SEQ ID NO: 2780052 - RNA, 18 nt, Leptospira interrogans serovar lai str. 56601
cuuuuacgacuuuauuca

SEQ ID NO: 2780053 - RNA, 21 nt, Leptospira interrogans serovar lai str. 56601
cuuuuacggauucucgcauuu

SEQ ID NO: 2780054 - RNA, 18 nt, Leptospira interrogans serovar lai str. 56601
cuuuuagaaaaaauuuuu

SEQ ID NO: 2780055 - RNA, 21 nt, Leptospira interrogans serovar lai str. 56601
cuuuuagaaaaaauuuuucuu

SEQ ID NO: 2780056 - RNA, 16 nt, Leptospira interrogans serovar lai str. 56601
cuuuuagaaaauuuuu

SEQ ID NO: 2780057 - RNA, 15 nt, Leptospira interrogans serovar lai str. 56601
cuuuuagaauucucc

SEQ ID NO: 2780058 - RNA, 16 nt, Leptospira interrogans serovar lai str. 56601
cuuuuaggauuuuaug

SEQ ID NO: 2780059 - RNA, 18 nt, Leptospira interrogans serovar lai str. 56601
cuuuuaguuguacaaaaa

SEQ ID NO: 2780060 - RNA, 19 nt, Leptospira interrogans serovar lai str. 56601
cuuuuaguuguacaaaaau

SEQ ID NO: 2780061 - RNA, 21 nt, Leptospira interrogans serovar lai str. 56601
cuuuuaguuguacaaaaaugu

SEQ ID NO: 2780062 - RNA, 13 nt, Leptospira interrogans serovar lai str. 56601
cuuuuauaaaauc

SEQ ID NO: 2780063 - RNA, 14 nt, Leptospira interrogans serovar lai str. 56601
cuuuuauaaaaucu

SEQ ID NO: 2780064 - RNA, 21 nt, Leptospira interrogans serovar lai str. 56601
cuuuuauaaaaucuaaaagaa

SEQ ID NO: 2780065 - RNA, 22 nt, Leptospira interrogans serovar lai str. 56601
cuuuuauauaauuuacuucauu

SEQ ID NO: 2780066 - RNA, 18 nt, Leptospira interrogans serovar lai str. 56601
cuuuuauggucaucucua

SEQ ID NO: 2780067 - RNA, 12 nt, Leptospira interrogans serovar lai str. 56601
cuuuucaaaagu

SEQ ID NO: 2780068 - RNA, 15 nt, Leptospira interrogans serovar lai str. 56601
cuuuucaaaaguauu

SEQ ID NO: 2780069 - RNA, 18 nt, Leptospira interrogans serovar lai str. 56601
cuuuuccccuuuuuuaau

SEQ ID NO: 2780070 - RNA, 19 nt, Leptospira interrogans serovar lai str. 56601
cuuuucgaaaauucugcuc

SEQ ID NO: 2780071 - RNA, 20 nt, Leptospira interrogans serovar lai str. 56601
cuuuucgacuauuucuucca

SEQ ID NO: 2780072 - RNA, 18 nt, Leptospira interrogans serovar lai str. 56601
cuuuucuaaauugagaau

SEQ ID NO: 2780073 - RNA, 14 nt, Leptospira interrogans serovar lai str. 56601
cuuuucuagacuuu

SEQ ID NO: 2780074 - RNA, 19 nt, Leptospira interrogans serovar lai str. 56601
cuuuucuagacuuucuuug

SEQ ID NO: 2780075 - RNA, 14 nt, Leptospira interrogans serovar lai str. 56601
cuuuucuauaaucu

SEQ ID NO: 2780076 - RNA, 14 nt, Leptospira interrogans serovar lai str. 56601
cuuuucuaucaaaa

SEQ ID NO: 2780077 - RNA, 18 nt, Leptospira interrogans serovar lai str. 56601
cuuuucuaucaaaaaauu

SEQ ID NO: 2780078 - RNA, 16 nt, Leptospira interrogans serovar lai str. 56601
cuuuucugaauaaaaa

SEQ ID NO: 2780079 - RNA, 22 nt, Leptospira interrogans serovar lai str. 56601
cuuuucuguucauucuuuaaaa

SEQ ID NO: 2780080 - RNA, 21 nt, Leptospira interrogans serovar lai str. 56601
cuuuucuucccagauucccuu

SEQ ID NO: 2780081 - RNA, 15 nt, Leptospira interrogans serovar lai str. 56601
cuuuucuuuuuuaaa

SEQ ID NO: 2780082 - RNA, 19 nt, Leptospira interrogans serovar lai str. 56601
cuuuugaaacuauccaaaa

SEQ ID NO: 2780083 - RNA, 23 nt, Leptospira interrogans serovar lai str. 56601
cuuuugaaucuaggauauuugau

SEQ ID NO: 2780084 - RNA, 19 nt, Leptospira interrogans serovar lai str. 56601
cuuuugaccaaaagagguc

SEQ ID NO: 2780085 - RNA, 18 nt, Leptospira interrogans serovar lai str. 56601
cuuuugagcaguaaaaaa

SEQ ID NO: 2780086 - RNA, 16 nt, Leptospira interrogans serovar lai str. 56601
cuuuugaucuuuaaaa

SEQ ID NO: 2780087 - RNA, 14 nt, Leptospira interrogans serovar lai str. 56601
cuuuugcauaguuu

SEQ ID NO: 2780088 - RNA, 19 nt, Leptospira interrogans serovar lai str. 56601
cuuuugcauugaaaucaga

SEQ ID NO: 2780089 - RNA, 17 nt, Leptospira interrogans serovar lai str. 56601
cuuuugcuuuuaaaggu

SEQ ID NO: 2780090 - RNA, 15 nt, Leptospira interrogans serovar lai str. 56601
cuuuuguaauaaaaa

SEQ ID NO: 2780091 - RNA, 18 nt, Leptospira interrogans serovar lai str. 56601
cuuuuguuuuuauaaaua

SEQ ID NO: 2780092 - RNA, 19 nt, Leptospira interrogans serovar lai str. 56601
cuuuuuaaaaccaaaaugc

SEQ ID NO: 2780093 - RNA, 12 nt, Leptospira interrogans serovar lai str. 56601
cuuuuuaaaaga

SEQ ID NO: 2780094 - RNA, 12 nt, Leptospira interrogans serovar lai str. 56601
cuuuuuaaauac

SEQ ID NO: 2780095 - RNA, 20 nt, Leptospira interrogans serovar lai str. 56601
cuuuuuaaguaauauuucuc

SEQ ID NO: 2780096 - RNA, 21 nt, Leptospira interrogans serovar lai str. 56601
cuuuuuagacuggcuucgagu

SEQ ID NO: 2780097 - RNA, 12 nt, Leptospira interrogans serovar lai str. 56601
cuuuuuauaaaa

SEQ ID NO: 2780098 - RNA, 13 nt, Leptospira interrogans serovar lai str. 56601
cuuuuuauaaaaa

SEQ ID NO: 2780099 - RNA, 14 nt, Leptospira interrogans serovar lai str. 56601
cuuuuucaaguguu

SEQ ID NO: 2780100 - RNA, 13 nt, Leptospira interrogans serovar lai str. 56601
cuuuuuccaaaag

SEQ ID NO: 2780101 - RNA, 20 nt, Leptospira interrogans serovar lai str. 56601
cuuuuucgaacuauuuuuug

SEQ ID NO: 2780102 - RNA, 18 nt, Leptospira interrogans serovar lai str. 56601
cuuuuucguuuuuuagaa

SEQ ID NO: 2780103 - RNA, 17 nt, Leptospira interrogans serovar lai str. 56601
cuuuuucuagguuuaaa

SEQ ID NO: 2780104 - RNA, 15 nt, Leptospira interrogans serovar lai str. 56601
cuuuuucuucugcug

SEQ ID NO: 2780105 - RNA, 18 nt, Leptospira interrogans serovar lai str. 56601
cuuuuucuuuuuuuaaac

SEQ ID NO: 2780106 - RNA, 18 nt, Leptospira interrogans serovar lai str. 56601
cuuuuugaagaaacaauu

SEQ ID NO: 2780107 - RNA, 21 nt, Leptospira interrogans serovar lai str. 56601
cuuuuugaguaauuccacuca

SEQ ID NO: 2780108 - RNA, 15 nt, Leptospira interrogans serovar lai str. 56601
cuuuuuuaaaacauc

SEQ ID NO: 2780109 - RNA, 11 nt, Leptospira interrogans serovar lai str. 56601
cuuuuuuaaag

SEQ ID NO: 2780110 - RNA, 23 nt, Leptospira interrogans serovar lai str. 56601
cuuuuuuaaagccucaugaaaau

SEQ ID NO: 2780111 - RNA, 17 nt, Leptospira interrogans serovar lai str. 56601
cuuuuuuaaguucuuua

SEQ ID NO: 2780112 - RNA, 19 nt, Leptospira interrogans serovar lai str. 56601
gaaaguuuacaaauuggca

SEQ ID NO: 2780113 - RNA, 22 nt, Leptospira interrogans serovar lai str. 56601
gaaaguuuacacaacauuauga

SEQ ID NO: 2780114 - RNA, 19 nt, Leptospira interrogans serovar lai str. 56601
gaaaguuuauaaagcaaaa

SEQ ID NO: 2780115 - RNA, 18 nt, Leptospira interrogans serovar lai str. 56601
gaaaguuuuuuuauaaaa

SEQ ID NO: 2780116 - RNA, 23 nt, Leptospira interrogans serovar lai str. 56601
gaaauaaaaaagcaccuucuaaa

SEQ ID NO: 2780117 - RNA, 16 nt, Leptospira interrogans serovar lai str. 56601
gaaauaaaaauauaca

SEQ ID NO: 2780118 - RNA, 15 nt, Leptospira interrogans serovar lai str. 56601
gaaauaaagaagagu

SEQ ID NO: 2780119 - RNA, 17 nt, Leptospira interrogans serovar lai str. 56601
gaaauaaagaagaguug

SEQ ID NO: 2780120 - RNA, 18 nt, Leptospira interrogans serovar lai str. 56601
gaaauaacuuagaaucua

SEQ ID NO: 2780121 - RNA, 16 nt, Leptospira interrogans serovar lai str. 56601
gaaauaauuccuccau

SEQ ID NO: 2780122 - RNA, 13 nt, Leptospira interrogans serovar lai str. 56601
gaaauacaaaaag

SEQ ID NO: 2780123 - RNA, 15 nt, Leptospira interrogans serovar lai str. 56601
gaaauacuuaaaaug

SEQ ID NO: 2780124 - RNA, 16 nt, Leptospira interrogans serovar lai str. 56601
gaaauacuuaaaauga

SEQ ID NO: 2780125 - RNA, 15 nt, Leptospira interrogans serovar lai str. 56601
gaaauagaaagacuu

SEQ ID NO: 2780126 - RNA, 14 nt, Leptospira interrogans serovar lai str. 56601
gaaauagaaauaca

SEQ ID NO: 2780127 - RNA, 17 nt, Leptospira interrogans serovar lai str. 56601
gaaauagaauuuugcaa

SEQ ID NO: 2780128 - RNA, 12 nt, Leptospira interrogans serovar lai str. 56601
gaaauauauucu

SEQ ID NO: 2780129 - RNA, 16 nt, Leptospira interrogans serovar lai str. 56601
gaaauauuaaaaaaau

SEQ ID NO: 2780130 - RNA, 21 nt, Leptospira interrogans serovar lai str. 56601
gaaauauuauaaauuuaaaaa

SEQ ID NO: 2780131 - RNA, 17 nt, Leptospira interrogans serovar lai str. 56601
gaaaucgauuuguaaaa

SEQ ID NO: 2780132 - RNA, 20 nt, Leptospira interrogans serovar lai str. 56601
gaaaucgauuuguaaaauuc

SEQ ID NO: 2780133 - RNA, 21 nt, Leptospira interrogans serovar lai str. 56601
gaaaucgauuuguaaaauuca

SEQ ID NO: 2780134 - RNA, 15 nt, Leptospira interrogans serovar lai str. 56601
gaaaucucuaacaaa

SEQ ID NO: 2780135 - RNA, 22 nt, Leptospira interrogans serovar lai str. 56601
gaaaucugaacauaaaaucgau

SEQ ID NO: 2780136 - RNA, 13 nt, Leptospira interrogans serovar lai str. 56601
gaaaucugaccuc

SEQ ID NO: 2780137 - RNA, 18 nt, Leptospira interrogans serovar lai str. 56601
gaaaucuguuuuaucuua

SEQ ID NO: 2780138 - RNA, 23 nt, Leptospira interrogans serovar lai str. 56601
gaaaucuguuuuaucuuagauca

SEQ ID NO: 2780139 - RNA, 19 nt, Leptospira interrogans serovar lai str. 56601
gaaaucuuuuaaaaaaggu

SEQ ID NO: 2780140 - RNA, 19 nt, Leptospira interrogans serovar lai str. 56601
gaaaugauuuuuuaaaaua

SEQ ID NO: 2780141 - RNA, 21 nt, Leptospira interrogans serovar lai str. 56601
gaaauggauggaaaaugaauu

SEQ ID NO: 2780142 - RNA, 19 nt, Leptospira interrogans serovar lai str. 56601
gaaauggggcaauugaagc

SEQ ID NO: 2780143 - RNA, 16 nt, Leptospira interrogans serovar lai str. 56601
gaaauuaaaauaaagg

SEQ ID NO: 2780144 - RNA, 17 nt, Leptospira interrogans serovar lai str. 56601
gaaauuaacucuuugga

SEQ ID NO: 2780145 - RNA, 17 nt, Leptospira interrogans serovar lai str. 56601
gaaauucagaucucacu

SEQ ID NO: 2780146 - RNA, 14 nt, Leptospira interrogans serovar lai str. 56601
gaaauucaucaaau

SEQ ID NO: 2780147 - RNA, 16 nt, Leptospira interrogans serovar lai str. 56601
gaaauucauuuuucug

SEQ ID NO: 2780148 - RNA, 20 nt, Leptospira interrogans serovar lai str. 56601
gaaauucguuuuaucuuaga

SEQ ID NO: 2780149 - RNA, 19 nt, Leptospira interrogans serovar lai str. 56601
gaaauucucaaaaaauuau

SEQ ID NO: 2780150 - RNA, 23 nt, Leptospira interrogans serovar lai str. 56601
gaaauucucuuuugaccaaaaga

SEQ ID NO: 2780151 - RNA, 23 nt, Leptospira interrogans serovar lai str. 56601
gaaauugaguuucacaaaaauau

SEQ ID NO: 2780152 - RNA, 20 nt, Leptospira interrogans serovar lai str. 56601
gaaauuggcgcguaagacca

SEQ ID NO: 2780153 - RNA, 16 nt, Leptospira interrogans serovar lai str. 56601
gaaauuguaggaacuc

SEQ ID NO: 2780154 - RNA, 20 nt, Leptospira interrogans serovar lai str. 56601
gaaauugugagaacuacuuu

SEQ ID NO: 2780155 - RNA, 23 nt, Leptospira interrogans serovar lai str. 56601
gaaauugugggaacuauuacaaa

SEQ ID NO: 2780156 - RNA, 16 nt, Leptospira interrogans serovar lai str. 56601
gaaauuuaaguuuuuc

SEQ ID NO: 2780157 - RNA, 16 nt, Leptospira interrogans serovar lai str. 56601
gaaauuugagaccucu

SEQ ID NO: 2780158 - RNA, 20 nt, Leptospira interrogans serovar lai str. 56601
gaaauuuuacacguaauucu

SEQ ID NO: 2780159 - RNA, 18 nt, Leptospira interrogans serovar lai str. 56601
gaaauuuuuaauaaaaug

SEQ ID NO: 2780160 - RNA, 19 nt, Leptospira interrogans serovar lai str. 56601
gaaauuuuuaauaaaaugc

SEQ ID NO: 2780161 - RNA, 17 nt, Leptospira interrogans serovar lai str. 56601
gaaauuuuuaauauacu

SEQ ID NO: 2780162 - RNA, 16 nt, Leptospira interrogans serovar lai str. 56601
gaaauuuuuaaucaaa

SEQ ID NO: 2780163 - RNA, 20 nt, Leptospira interrogans serovar lai str. 56601
gaaauuuuuaaucaaaugca

SEQ ID NO: 2780164 - RNA, 12 nt, Leptospira interrogans serovar lai str. 56601
gaacaaaauuua

SEQ ID NO: 2780165 - RNA, 18 nt, Leptospira interrogans serovar lai str. 56601
gaacaaauccuggacuga

SEQ ID NO: 2780166 - RNA, 21 nt, Leptospira interrogans serovar lai str. 56601
gaacaaguugaaaggggauua

SEQ ID NO: 2780167 - RNA, 15 nt, Leptospira interrogans serovar lai str. 56601
gaacaauuuaaaaua

SEQ ID NO: 2780168 - RNA, 24 nt, Leptospira interrogans serovar lai str. 56601
gaacaauuuguaauguauaauccu

SEQ ID NO: 2780169 - RNA, 13 nt, Leptospira interrogans serovar lai str. 56601
gaacacaaauucu

SEQ ID NO: 2780170 - RNA, 17 nt, Leptospira interrogans serovar lai str. 56601
gaacacaugauucugaa

SEQ ID NO: 2780171 - RNA, 19 nt, Leptospira interrogans serovar lai str. 56601
gaacaucaauuuuauuucu

SEQ ID NO: 2780172 - RNA, 17 nt, Leptospira interrogans serovar lai str. 56601
gaacauuuuuaaaaauu

SEQ ID NO: 2780173 - RNA, 20 nt, Leptospira interrogans serovar lai str. 56601
gaaccaauucuaaaaucaua

SEQ ID NO: 2780174 - RNA, 18 nt, Leptospira interrogans serovar lai str. 56601
gaaccagagauuccgauu

SEQ ID NO: 2780175 - RNA, 18 nt, Leptospira interrogans serovar lai str. 56601
gaaccaguaucguuuucc

SEQ ID NO: 2780176 - RNA, 14 nt, Leptospira interrogans serovar lai str. 56601
gaaccaucaccaac

SEQ ID NO: 2780177 - RNA, 16 nt, Leptospira interrogans serovar lai str. 56601
gaaccauuucaaguuu

SEQ ID NO: 2780178 - RNA, 19 nt, Leptospira interrogans serovar lai str. 56601
gaacccaauaaaaacuaau

SEQ ID NO: 2780179 - RNA, 16 nt, Leptospira interrogans serovar lai str. 56601
gaaccguaacugacau

SEQ ID NO: 2780180 - RNA, 14 nt, Leptospira interrogans serovar lai str. 56601
gaaccuauaucuua

SEQ ID NO: 2780181 - RNA, 16 nt, Leptospira interrogans serovar lai str. 56601
gaaccucaaagaaauu

SEQ ID NO: 2780182 - RNA, 14 nt, Leptospira interrogans serovar lai str. 56601
gaaccuuaccaccc

SEQ ID NO: 2780183 - RNA, 16 nt, Leptospira interrogans serovar lai str. 56601
gaaccuuuaguuucca

SEQ ID NO: 2780184 - RNA, 19 nt, Leptospira interrogans serovar lai str. 56601
gaaccuuuaguuuccaaaa

SEQ ID NO: 2780185 - RNA, 14 nt, Leptospira interrogans serovar lai str. 56601
gaacggaaauguua

SEQ ID NO: 2780186 - RNA, 17 nt, Leptospira interrogans serovar lai str. 56601
gaacggacuguuuuaau

SEQ ID NO: 2780187 - RNA, 22 nt, Leptospira interrogans serovar lai str. 56601
gaacggcuuuaguuugaaagaa

SEQ ID NO: 2780188 - RNA, 16 nt, Leptospira interrogans serovar lai str. 56601
gaacgggcuuucuaug

SEQ ID NO: 2780189 - RNA, 22 nt, Leptospira interrogans serovar lai str. 56601
gaacggguucuuacaauaaaaa

SEQ ID NO: 2780190 - RNA, 23 nt, Leptospira interrogans serovar lai str. 56601
gaacuaaugaaggaauuggaaua

SEQ ID NO: 2780191 - RNA, 16 nt, Leptospira interrogans serovar lai str. 56601
gaacuacacguuuucc

SEQ ID NO: 2780192 - RNA, 15 nt, Leptospira interrogans serovar lai str. 56601
gaacuaccacagaaa

SEQ ID NO: 2780193 - RNA, 22 nt, Leptospira interrogans serovar lai str. 56601
gaacuacuacuuuuagaaaaaa

SEQ ID NO: 2780194 - RNA, 23 nt, Leptospira interrogans serovar lai str. 56601
gaacuauaauaacaaaaaaugcu

SEQ ID NO: 2780195 - RNA, 19 nt, Leptospira interrogans serovar lai str. 56601
gaauauagcacaaaugaca

SEQ ID NO: 2780196 - RNA, 18 nt, Leptospira interrogans serovar lai str. 56601
gaauaucaggauaaccua

SEQ ID NO: 2780197 - RNA, 22 nt, Leptospira interrogans serovar lai str. 56601
gaauaucauaacaaauaaaagg

SEQ ID NO: 2780198 - RNA, 19 nt, Leptospira interrogans serovar lai str. 56601
gaauaucggaauaacuuuc

SEQ ID NO: 2780199 - RNA, 22 nt, Leptospira interrogans serovar lai str. 56601
gaauauuaaauuuuauuuauau

SEQ ID NO: 2780200 - RNA, 23 nt, Leptospira interrogans serovar lai str. 56601
gaauauuaaguuuuuuaaauuua

SEQ ID NO: 2780201 - RNA, 23 nt, Leptospira interrogans serovar lai str. 56601
gaauauuauuauauuuaaauguu

SEQ ID NO: 2780202 - RNA, 18 nt, Leptospira interrogans serovar lai str. 56601
gaauauucacuuuuccaa

SEQ ID NO: 2780203 - RNA, 23 nt, Leptospira interrogans serovar lai str. 56601
gaauauucguaagaaaaaauuuc

SEQ ID NO: 2780204 - RNA, 18 nt, Leptospira interrogans serovar lai str. 56601
gaauauuucuaaaauuga

SEQ ID NO: 2780205 - RNA, 20 nt, Leptospira interrogans serovar lai str. 56601
gaauauuugggcgaaucgcu

SEQ ID NO: 2780206 - RNA, 14 nt, Leptospira interrogans serovar lai str. 56601
gaauauuuuauccg

SEQ ID NO: 2780207 - RNA, 19 nt, Leptospira interrogans serovar lai str. 56601
gaaucaaaaugaacucaac

SEQ ID NO: 2780208 - RNA, 22 nt, Leptospira interrogans serovar lai str. 56601
gaaucaaaaugaacucaacaga

SEQ ID NO: 2780209 - RNA, 13 nt, Leptospira interrogans serovar lai str. 56601
gaaucaaaggaaa

SEQ ID NO: 2780210 - RNA, 14 nt, Leptospira interrogans serovar lai str. 56601
gaaucaaaggaaau

SEQ ID NO: 2780211 - RNA, 16 nt, Leptospira interrogans serovar lai str. 56601
gaaucaacuuuuccag

SEQ ID NO: 2780212 - RNA, 16 nt, Leptospira interrogans serovar lai str. 56601
gaaucaagagaacuca

SEQ ID NO: 2780213 - RNA, 17 nt, Leptospira interrogans serovar lai str. 56601
gaaucaauuuuagaaua

SEQ ID NO: 2780214 - RNA, 19 nt, Leptospira interrogans serovar lai str. 56601
gaaucacccaaucuuacaa

SEQ ID NO: 2780215 - RNA, 16 nt, Leptospira interrogans serovar lai str. 56601
gaaucauacaaucaaa

SEQ ID NO: 2780216 - RNA, 19 nt, Leptospira interrogans serovar lai str. 56601
gaaucauacaaucaaauuu

SEQ ID NO: 2780217 - RNA, 12 nt, Leptospira interrogans serovar lai str. 56601
gaaucauauuua

SEQ ID NO: 2780218 - RNA, 19 nt, Leptospira interrogans serovar lai str. 56601
gaaucaucauccaaugaaa

SEQ ID NO: 2780219 - RNA, 21 nt, Leptospira interrogans serovar lai str. 56601
gaaucaucauccaaugaaauu

SEQ ID NO: 2780220 - RNA, 18 nt, Leptospira interrogans serovar lai str. 56601
gaaucaucucaaaaauag

SEQ ID NO: 2780221 - RNA, 22 nt, Leptospira interrogans serovar lai str. 56601
gaaucauuacguaaagaacuuc

SEQ ID NO: 2780222 - RNA, 15 nt, Leptospira interrogans serovar lai str. 56601
gaauccgaaaaaccu

SEQ ID NO: 2780223 - RNA, 23 nt, Leptospira interrogans serovar lai str. 56601
gaauccgcuuuggaauuggcuuc

SEQ ID NO: 2780224 - RNA, 21 nt, Leptospira interrogans serovar lai str. 56601
gaauccuauaauaaaauuaac

SEQ ID NO: 2780225 - RNA, 20 nt, Leptospira interrogans serovar lai str. 56601
gaauccuuccuccaaaauau

SEQ ID NO: 2780226 - RNA, 13 nt, Leptospira interrogans serovar lai str. 56601
gaaucgaaucuuu

SEQ ID NO: 2780227 - RNA, 17 nt, Leptospira interrogans serovar lai str. 56601
gaaucguaaaaaaauau

SEQ ID NO: 2780228 - RNA, 15 nt, Leptospira interrogans serovar lai str. 56601
gaaucguuuguaaaa

SEQ ID NO: 2780229 - RNA, 20 nt, Leptospira interrogans serovar lai str. 56601
gaaucuaaacucuauagauu

SEQ ID NO: 2780230 - RNA, 18 nt, Leptospira interrogans serovar lai str. 56601
gaaucuaauuuauaaacu

SEQ ID NO: 2780231 - RNA, 14 nt, Leptospira interrogans serovar lai str. 56601
gaaucuaauuucag

SEQ ID NO: 2780232 - RNA, 14 nt, Leptospira interrogans serovar lai str. 56601
gaaucugaaccugc

SEQ ID NO: 2780233 - RNA, 14 nt, Leptospira interrogans serovar lai str. 56601
gaaucugaauuuua

SEQ ID NO: 2780234 - RNA, 21 nt, Leptospira interrogans serovar lai str. 56601
gaaucuuaaaucuuuaaaaua

SEQ ID NO: 2780235 - RNA, 21 nt, Leptospira interrogans serovar lai str. 56601
gaaucuuucauguauuacuca

SEQ ID NO: 2780236 - RNA, 13 nt, Leptospira interrogans serovar lai str. 56601
gaaucuuuugccc

SEQ ID NO: 2780237 - RNA, 13 nt, Leptospira interrogans serovar lai str. 56601
gaaugaacucaac

SEQ ID NO: 2780238 - RNA, 15 nt, Leptospira interrogans serovar lai str. 56601
gaaugagcuagauuu

SEQ ID NO: 2780239 - RNA, 18 nt, Leptospira interrogans serovar lai str. 56601
gaaugccucucuaaggau

SEQ ID NO: 2780240 - RNA, 16 nt, Leptospira interrogans serovar lai str. 56601
gaaugcgacguaauuu

SEQ ID NO: 2780241 - RNA, 20 nt, Leptospira interrogans serovar lai str. 56601
gaauggaaaucuuuuaaaaa

SEQ ID NO: 2780242 - RNA, 21 nt, Leptospira interrogans serovar lai str. 56601
gaauguaaaugaauuggaaag

SEQ ID NO: 2780243 - RNA, 23 nt, Leptospira interrogans serovar lai str. 56601
gaaugucaacaggggcuuugauu

SEQ ID NO: 2780244 - RNA, 23 nt, Leptospira interrogans serovar lai str. 56601
gaaugucuuagaauuuuguuucu

SEQ ID NO: 2780245 - RNA, 15 nt, Leptospira interrogans serovar lai str. 56601
gaaugugggaacuac

SEQ ID NO: 2780246 - RNA, 19 nt, Leptospira interrogans serovar lai str. 56601
gaauuaagcagaagcuuua

SEQ ID NO: 2780247 - RNA, 15 nt, Leptospira interrogans serovar lai str. 56601
gaauuaauuuuucaa

SEQ ID NO: 2780248 - RNA, 16 nt, Leptospira interrogans serovar lai str. 56601
gaauuacgacaaaucu

SEQ ID NO: 2780249 - RNA, 18 nt, Leptospira interrogans serovar lai str. 56601
gaauuacgacaaaucuuc

SEQ ID NO: 2780250 - RNA, 23 nt, Leptospira interrogans serovar lai str. 56601
gaauuacuacaaaagcguuguau

SEQ ID NO: 2780251 - RNA, 20 nt, Leptospira interrogans serovar lai str. 56601
gaauuaucauguaaaauuuu

SEQ ID NO: 2780252 - RNA, 20 nt, Leptospira interrogans serovar lai str. 56601
gaauuaucguguaaaauuuu

SEQ ID NO: 2780253 - RNA, 22 nt, Leptospira interrogans serovar lai str. 56601
gaauuauuuacuuuuuccaaaa

SEQ ID NO: 2780254 - RNA, 16 nt, Leptospira interrogans serovar lai str. 56601
gaauucaauuuauaaa

SEQ ID NO: 2780255 - RNA, 17 nt, Leptospira interrogans serovar lai str. 56601
gaauucacguuaaaaua

SEQ ID NO: 2780256 - RNA, 19 nt, Leptospira interrogans serovar lai str. 56601
gaauucauacuuuuaaaaa

SEQ ID NO: 2780257 - RNA, 22 nt, Leptospira interrogans serovar lai str. 56601
gaauucauacuuuuaaaaaguu

SEQ ID NO: 2780258 - RNA, 21 nt, Leptospira interrogans serovar lai str. 56601
gaauucauuuaccuaaaauuc

SEQ ID NO: 2780259 - RNA, 21 nt, Leptospira interrogans serovar lai str. 56601
gaauucccacauuuucaaaau

SEQ ID NO: 2780260 - RNA, 19 nt, Leptospira interrogans serovar lai str. 56601
gaauuccgacccagaaaaa

SEQ ID NO: 2780261 - RNA, 20 nt, Leptospira interrogans serovar lai str. 56601
gaauuccuauucaguuucca

SEQ ID NO: 2780262 - RNA, 21 nt, Leptospira interrogans serovar lai str. 56601
gaauucgacguaaggaacuca

SEQ ID NO: 2780263 - RNA, 13 nt, Leptospira interrogans serovar lai str. 56601
gaauucuaaaaua

SEQ ID NO: 2780264 - RNA, 15 nt, Leptospira interrogans serovar lai str. 56601
gaauucuaauuugcg

SEQ ID NO: 2780265 - RNA, 19 nt, Leptospira interrogans serovar lai str. 56601
gaauucucuagaaauuuau

SEQ ID NO: 2780266 - RNA, 14 nt, Leptospira interrogans serovar lai str. 56601
gaauucucuaucuu

SEQ ID NO: 2780267 - RNA, 15 nt, Leptospira interrogans serovar lai str. 56601
gaauugaaaucugaa

SEQ ID NO: 2780268 - RNA, 13 nt, Leptospira interrogans serovar lai str. 56601
gaauugaucuaaa

SEQ ID NO: 2780269 - RNA, 20 nt, Leptospira interrogans serovar lai str. 56601
gaauugaucucauaaagaca

SEQ ID NO: 2780270 - RNA, 17 nt, Leptospira interrogans serovar lai str. 56601
gaauugcacauaaaaga

SEQ ID NO: 2780271 - RNA, 19 nt, Leptospira interrogans serovar lai str. 56601
gaauugcaccaguuaaauc

SEQ ID NO: 2780272 - RNA, 20 nt, Leptospira interrogans serovar lai str. 56601
gaauugcaccaguuaaauca

SEQ ID NO: 2780273 - RNA, 23 nt, Leptospira interrogans serovar lai str. 56601
gaauuguagaauuuauuuucaua

SEQ ID NO: 2780274 - RNA, 19 nt, Leptospira interrogans serovar lai str. 56601
gaauuguugaaaaauuaau

SEQ ID NO: 2780275 - RNA, 18 nt, Leptospira interrogans serovar lai str. 56601
gaauuguuugaaaguucc

SEQ ID NO: 2780276 - RNA, 16 nt, Leptospira interrogans serovar lai str. 56601
gaauuguuugaucucg

SEQ ID NO: 2780277 - RNA, 22 nt, Leptospira interrogans serovar lai str. 56601
gacuaacgauuguaaaaaaaca

SEQ ID NO: 2780278 - RNA, 20 nt, Leptospira interrogans serovar lai str. 56601
gacuaauuuugugaaucaaa

SEQ ID NO: 2780279 - RNA, 23 nt, Leptospira interrogans serovar lai str. 56601
gacuaauuuugugaaucaaaagg

SEQ ID NO: 2780280 - RNA, 16 nt, Leptospira interrogans serovar lai str. 56601
gacuaucaacaagaau

SEQ ID NO: 2780281 - RNA, 19 nt, Leptospira interrogans serovar lai str. 56601
gacuaucacaaaaaugaaa

SEQ ID NO: 2780282 - RNA, 14 nt, Leptospira interrogans serovar lai str. 56601
gacuauuucuucca

SEQ ID NO: 2780283 - RNA, 15 nt, Leptospira interrogans serovar lai str. 56601
gacuauuucuuccag

SEQ ID NO: 2780284 - RNA, 17 nt, Leptospira interrogans serovar lai str. 56601
gacuauuuuauuacaau

SEQ ID NO: 2780285 - RNA, 18 nt, Leptospira interrogans serovar lai str. 56601
gacucaguauguuguucu

SEQ ID NO: 2780286 - RNA, 16 nt, Leptospira interrogans serovar lai str. 56601
gacucauaacgugaca

SEQ ID NO: 2780287 - RNA, 22 nt, Leptospira interrogans serovar lai str. 56601
gacucauauuuuuagaaaauuu

SEQ ID NO: 2780288 - RNA, 19 nt, Leptospira interrogans serovar lai str. 56601
gacugacugaaaaaaacgu

SEQ ID NO: 2780289 - RNA, 16 nt, Leptospira interrogans serovar lai str. 56601
gacugauucuuuaaau

SEQ ID NO: 2780290 - RNA, 17 nt, Leptospira interrogans serovar lai str. 56601
gacugcccguuucaauu

SEQ ID NO: 2780291 - RNA, 13 nt, Leptospira interrogans serovar lai str. 56601
gacuguuuuaauu

SEQ ID NO: 2780292 - RNA, 15 nt, Leptospira interrogans serovar lai str. 56601
gacuucuuuuuugua

SEQ ID NO: 2780293 - RNA, 19 nt, Leptospira interrogans serovar lai str. 56601
gacuugaaaaagcggucuu

SEQ ID NO: 2780294 - RNA, 12 nt, Leptospira interrogans serovar lai str. 56601
gacuuuaaauga

SEQ ID NO: 2780295 - RNA, 23 nt, Leptospira interrogans serovar lai str. 56601
gacuuuaauuuuaguaaaaauca

SEQ ID NO: 2780296 - RNA, 16 nt, Leptospira interrogans serovar lai str. 56601
gacuuuauucaaaaua

SEQ ID NO: 2780297 - RNA, 19 nt, Leptospira interrogans serovar lai str. 56601
gacuuuauucaaaauagaa

SEQ ID NO: 2780298 - RNA, 16 nt, Leptospira interrogans serovar lai str. 56601
gacuuucuguauuuuu

SEQ ID NO: 2780299 - RNA, 20 nt, Leptospira interrogans serovar lai str. 56601
gacuuugaaacaucacuucc

SEQ ID NO: 2780300 - RNA, 11 nt, Leptospira interrogans serovar lai str. 56601
gacuuuuccua

SEQ ID NO: 2780301 - RNA, 12 nt, Leptospira interrogans serovar lai str. 56601
gacuuuuccuaa

SEQ ID NO: 2780302 - RNA, 12 nt, Leptospira interrogans serovar lai str. 56601
gagaaaaguguu

SEQ ID NO: 2780303 - RNA, 12 nt, Leptospira interrogans serovar lai str. 56601
gagaaaauccag

SEQ ID NO: 2780304 - RNA, 11 nt, Leptospira interrogans serovar lai str. 56601
gagaaaauucg

SEQ ID NO: 2780305 - RNA, 16 nt, Leptospira interrogans serovar lai str. 56601
gagaaacaaaguagag

SEQ ID NO: 2780306 - RNA, 15 nt, Leptospira interrogans serovar lai str. 56601
gagaaacgauacaaa

SEQ ID NO: 2780307 - RNA, 15 nt, Leptospira interrogans serovar lai str. 56601
gagaaagaaaaagag

SEQ ID NO: 2780308 - RNA, 19 nt, Leptospira interrogans serovar lai str. 56601
gagaaagcgcagacucuuc

SEQ ID NO: 2780309 - RNA, 11 nt, Leptospira interrogans serovar lai str. 56601
gagaaauccaa

SEQ ID NO: 2780310 - RNA, 19 nt, Leptospira interrogans serovar lai str. 56601
gagaaaucuguuuuaucuu

SEQ ID NO: 2780311 - RNA, 18 nt, Leptospira interrogans serovar lai str. 56601
gagaacgaugcuugagcu

SEQ ID NO: 2780312 - RNA, 19 nt, Leptospira interrogans serovar lai str. 56601
gagaacgaugcuugagcuc

SEQ ID NO: 2780313 - RNA, 18 nt, Leptospira interrogans serovar lai str. 56601
gagaacuacagcaaauca

SEQ ID NO: 2780314 - RNA, 20 nt, Leptospira interrogans serovar lai str. 56601
gagaacucucucaaagcaag

SEQ ID NO: 2780315 - RNA, 18 nt, Leptospira interrogans serovar lai str. 56601
gagaagcggguuuuucuu

SEQ ID NO: 2780316 - RNA, 21 nt, Leptospira interrogans serovar lai str. 56601
gagaagggugaauuuuuuccc

SEQ ID NO: 2780317 - RNA, 21 nt, Leptospira interrogans serovar lai str. 56601
gagaaguuaaaaaaugaauuu

SEQ ID NO: 2780318 - RNA, 21 nt, Leptospira interrogans serovar lai str. 56601
gagaauaucugaauuuuuaua

SEQ ID NO: 2780319 - RNA, 23 nt, Leptospira interrogans serovar lai str. 56601
gagaaugaucaauagaauuguug

SEQ ID NO: 2780320 - RNA, 16 nt, Leptospira interrogans serovar lai str. 56601
gagaauuaauuuuuua

SEQ ID NO: 2780321 - RNA, 13 nt, Leptospira interrogans serovar lai str. 56601
gagaauucaauuu

SEQ ID NO: 2780322 - RNA, 17 nt, Leptospira interrogans serovar lai str. 56601
gagaauucauuuuucua

SEQ ID NO: 2780323 - RNA, 15 nt, Leptospira interrogans serovar lai str. 56601
gagacaguauuuucc

SEQ ID NO: 2780324 - RNA, 13 nt, Leptospira interrogans serovar lai str. 56601
gagacauaaaaaa

SEQ ID NO: 2780325 - RNA, 17 nt, Leptospira interrogans serovar lai str. 56601
gagacucuaguaaagaa

SEQ ID NO: 2780326 - RNA, 19 nt, Leptospira interrogans serovar lai str. 56601
gagacucuaguaaagaaac

SEQ ID NO: 2780327 - RNA, 16 nt, Leptospira interrogans serovar lai str. 56601
gagagcgggguuugua

SEQ ID NO: 2780328 - RNA, 20 nt, Leptospira interrogans serovar lai str. 56601
gagagcguucugcugaguuc

SEQ ID NO: 2780329 - RNA, 12 nt, Leptospira interrogans serovar lai str. 56601
gagagugaaaaa

SEQ ID NO: 2780330 - RNA, 12 nt, Leptospira interrogans serovar lai str. 56601
gagaguucccac

SEQ ID NO: 2780331 - RNA, 17 nt, Leptospira interrogans serovar lai str. 56601
gagaguucuacugaguu

SEQ ID NO: 2780332 - RNA, 21 nt, Leptospira interrogans serovar lai str. 56601
gagauagguuuuguaagaauu

SEQ ID NO: 2780333 - RNA, 18 nt, Leptospira interrogans serovar lai str. 56601
gagauaucacaaauuuua

SEQ ID NO: 2780334 - RNA, 16 nt, Leptospira interrogans serovar lai str. 56601
gagaugugggaacuac

SEQ ID NO: 2780335 - RNA, 16 nt, Leptospira interrogans serovar lai str. 56601
gagauuacuuuuucug

SEQ ID NO: 2780336 - RNA, 23 nt, Leptospira interrogans serovar lai str. 56601
gagauuccuuuuaagaauacugg

SEQ ID NO: 2780337 - RNA, 22 nt, Leptospira interrogans serovar lai str. 56601
gagauugauauuucuuaaauuc

SEQ ID NO: 2780338 - RNA, 23 nt, Leptospira interrogans serovar lai str. 56601
gagauuuggugauuuaaaaauag

SEQ ID NO: 2780339 - RNA, 17 nt, Leptospira interrogans serovar lai str. 56601
gagauuuugucuccugu

SEQ ID NO: 2780340 - RNA, 16 nt, Leptospira interrogans serovar lai str. 56601
gagcaacauugaguuc

SEQ ID NO: 2780341 - RNA, 15 nt, Leptospira interrogans serovar lai str. 56601
gagcacagcaaaaaa

SEQ ID NO: 2780342 - RNA, 12 nt, Leptospira interrogans serovar lai str. 56601
gagcauaaaaaa

SEQ ID NO: 2780343 - RNA, 18 nt, Leptospira interrogans serovar lai str. 56601
gagcauacccguuuauac

SEQ ID NO: 2780344 - RNA, 18 nt, Leptospira interrogans serovar lai str. 56601
gagccuuucacaucucca

SEQ ID NO: 2780345 - RNA, 18 nt, Leptospira interrogans serovar lai str. 56601
gagcgauauaauaaaauc

SEQ ID NO: 2780346 - RNA, 20 nt, Leptospira interrogans serovar lai str. 56601
gagcguccauagaagugaag

SEQ ID NO: 2780347 - RNA, 20 nt, Leptospira interrogans serovar lai str. 56601
gagcgucuuugaauucgcuu

SEQ ID NO: 2780348 - RNA, 16 nt, Leptospira interrogans serovar lai str. 56601
gagcguugaauguuua

SEQ ID NO: 2780349 - RNA, 18 nt, Leptospira interrogans serovar lai str. 56601
gagcuguucuuagucuaa

SEQ ID NO: 2780350 - RNA, 22 nt, Leptospira interrogans serovar lai str. 56601
gagcuuuacaauaaaaauuaga

SEQ ID NO: 2780351 - RNA, 17 nt, Leptospira interrogans serovar lai str. 56601
gaggaguccaugauucu

SEQ ID NO: 2780352 - RNA, 17 nt, Leptospira interrogans serovar lai str. 56601
gaggcaacggaauuuuu

SEQ ID NO: 2780353 - RNA, 16 nt, Leptospira interrogans serovar lai str. 56601
gaggcugccgcucuuu

SEQ ID NO: 2780354 - RNA, 19 nt, Leptospira interrogans serovar lai str. 56601
gaggucgucucaaaaauau

SEQ ID NO: 2780355 - RNA, 15 nt, Leptospira interrogans serovar lai str. 56601
gaggugaaauuucca

SEQ ID NO: 2780356 - RNA, 19 nt, Leptospira interrogans serovar lai str. 56601
gaggugaaauuuccacuuc

SEQ ID NO: 2780357 - RNA, 15 nt, Leptospira interrogans serovar lai str. 56601
gaguaccauaaauuu

SEQ ID NO: 2780358 - RNA, 15 nt, Leptospira interrogans serovar lai str. 56601
gaguaucaauagaaa

SEQ ID NO: 2780359 - RNA, 17 nt, Leptospira interrogans serovar lai str. 56601
gaguaucaauagaaaua

SEQ ID NO: 2780360 - RNA, 16 nt, Leptospira interrogans serovar lai str. 56601
gaguauuauaaacagu

SEQ ID NO: 2780361 - RNA, 19 nt, Leptospira interrogans serovar lai str. 56601
gaguauuuuuuccugauuu

SEQ ID NO: 2780362 - RNA, 21 nt, Leptospira interrogans serovar lai str. 56601
gagucauuuuuaaauacuuuu

SEQ ID NO: 2780363 - RNA, 19 nt, Leptospira interrogans serovar lai str. 56601
gagucguugaaaaauuaau

SEQ ID NO: 2780364 - RNA, 14 nt, Leptospira interrogans serovar lai str. 56601
gagucguugaaaau

SEQ ID NO: 2780365 - RNA, 13 nt, Leptospira interrogans serovar lai str. 56601
gagucuagaauuc

SEQ ID NO: 2780366 - RNA, 14 nt, Leptospira interrogans serovar lai str. 56601
gagucuauaaaaua

SEQ ID NO: 2780367 - RNA, 17 nt, Leptospira interrogans serovar lai str. 56601
gagucugucccaaaauc

SEQ ID NO: 2780368 - RNA, 21 nt, Leptospira interrogans serovar lai str. 56601
gagugaccguugugagaaaua

SEQ ID NO: 2780369 - RNA, 21 nt, Leptospira interrogans serovar lai str. 56601
gagugagguuuuggaaagguc

SEQ ID NO: 2780370 - RNA, 16 nt, Leptospira interrogans serovar lai str. 56601
gagugccaaaauuuug

SEQ ID NO: 2780371 - RNA, 21 nt, Leptospira interrogans serovar lai str. 56601
gaguggauugccauccacaaa

SEQ ID NO: 2780372 - RNA, 23 nt, Leptospira interrogans serovar lai str. 56601
gaguuacuacaauuuuagaauuu

SEQ ID NO: 2780373 - RNA, 12 nt, Leptospira interrogans serovar lai str. 56601
gaguuagacguu

SEQ ID NO: 2780374 - RNA, 19 nt, Leptospira interrogans serovar lai str. 56601
gaguuauaguaaaagaaaa

SEQ ID NO: 2780375 - RNA, 22 nt, Leptospira interrogans serovar lai str. 56601
gaguuauaguaaaagaaaauua

SEQ ID NO: 2780376 - RNA, 16 nt, Leptospira interrogans serovar lai str. 56601
gaguuauugaaaaauu

SEQ ID NO: 2780377 - RNA, 17 nt, Leptospira interrogans serovar lai str. 56601
gaguucauucugauucu

SEQ ID NO: 2780378 - RNA, 12 nt, Leptospira interrogans serovar lai str. 56601
gaguuccaaaac

SEQ ID NO: 2780379 - RNA, 20 nt, Leptospira interrogans serovar lai str. 56601
gaguuccacauuuuaaaggu

SEQ ID NO: 2780380 - RNA, 13 nt, Leptospira interrogans serovar lai str. 56601
gaguucccacaaa

SEQ ID NO: 2780381 - RNA, 15 nt, Leptospira interrogans serovar lai str. 56601
gaguucccacauuua

SEQ ID NO: 2780382 - RNA, 20 nt, Leptospira interrogans serovar lai str. 56601
gaguucgacguaaagaauuc

SEQ ID NO: 2780383 - RNA, 23 nt, Leptospira interrogans serovar lai str. 56601
gaguucggcguaagaaaaccaug

SEQ ID NO: 2780384 - RNA, 14 nt, Leptospira interrogans serovar lai str. 56601
gaguucguaugagu

SEQ ID NO: 2780385 - RNA, 22 nt, Leptospira interrogans serovar lai str. 56601
gaguucuaaauuaugauaguca

SEQ ID NO: 2780386 - RNA, 16 nt, Leptospira interrogans serovar lai str. 56601
gaguugcuuugaauga

SEQ ID NO: 2780387 - RNA, 15 nt, Leptospira interrogans serovar lai str. 56601
gaguuguauaacaga

SEQ ID NO: 2780388 - RNA, 18 nt, Leptospira interrogans serovar lai str. 56601
gaguuguccuaaaaccuc

SEQ ID NO: 2780389 - RNA, 14 nt, Leptospira interrogans serovar lai str. 56601
gaguuguugaaaaa

SEQ ID NO: 2780390 - RNA, 16 nt, Leptospira interrogans serovar lai str. 56601
gaguuguugaaagggg

SEQ ID NO: 2780391 - RNA, 22 nt, Leptospira interrogans serovar lai str. 56601
gaguuuaaagacgauugauucu

SEQ ID NO: 2780392 - RNA, 16 nt, Leptospira interrogans serovar lai str. 56601
gaguuuaagaaacuca

SEQ ID NO: 2780393 - RNA, 23 nt, Leptospira interrogans serovar lai str. 56601
gaguuuacgugaguucgguguaa

SEQ ID NO: 2780394 - RNA, 18 nt, Leptospira interrogans serovar lai str. 56601
gaguuucuugaacucaau

SEQ ID NO: 2780395 - RNA, 22 nt, Leptospira interrogans serovar lai str. 56601
gaguuucuugaacucaauguug

SEQ ID NO: 2780396 - RNA, 17 nt, Leptospira interrogans serovar lai str. 56601
gaguuugaaagauuguu

SEQ ID NO: 2780397 - RNA, 17 nt, Leptospira interrogans serovar lai str. 56601
gaguuuggucaugagau

SEQ ID NO: 2780398 - RNA, 22 nt, Leptospira interrogans serovar lai str. 56601
gaguuuguuccaaaaacucaaa

SEQ ID NO: 2780399 - RNA, 13 nt, Leptospira interrogans serovar lai str. 56601
gaguuuuagaaua

SEQ ID NO: 2780400 - RNA, 12 nt, Leptospira interrogans serovar lai str. 56601
gaguuuuuccua

SEQ ID NO: 2780401 - RNA, 13 nt, Leptospira interrogans serovar lai str. 56601
gaguuuuuccuau

SEQ ID NO: 2780402 - RNA, 14 nt, Leptospira interrogans serovar lai str. 56601
gaguuuuugaaaaa

SEQ ID NO: 2780403 - RNA, 17 nt, Leptospira interrogans serovar lai str. 56601
gauaaaaaacgaaucau

SEQ ID NO: 2780404 - RNA, 14 nt, Leptospira interrogans serovar lai str. 56601
gauaaaaauaguau

SEQ ID NO: 2780405 - RNA, 21 nt, Leptospira interrogans serovar lai str. 56601
gauaaaaccguuuuauaaaua

SEQ ID NO: 2780406 - RNA, 22 nt, Leptospira interrogans serovar lai str. 56601
gauaaaaccguuuuauaaauau

SEQ ID NO: 2780407 - RNA, 19 nt, Leptospira interrogans serovar lai str. 56601
gauaaaacucaaaggaaaa

SEQ ID NO: 2780408 - RNA, 12 nt, Leptospira interrogans serovar lai str. 56601
gauaaaauauag

SEQ ID NO: 2780409 - RNA, 19 nt, Leptospira interrogans serovar lai str. 56601
gauaaaauauaguuaaauu

SEQ ID NO: 2780410 - RNA, 14 nt, Leptospira interrogans serovar lai str. 56601
gauaaaaucacguu

SEQ ID NO: 2780411 - RNA, 19 nt, Leptospira interrogans serovar lai str. 56601
gauaaacauuagaguuguu

SEQ ID NO: 2780412 - RNA, 13 nt, Leptospira interrogans serovar lai str. 56601
gauaaagaaaacc

SEQ ID NO: 2780413 - RNA, 15 nt, Leptospira interrogans serovar lai str. 56601
gauaaagaaaaccac

SEQ ID NO: 2780414 - RNA, 20 nt, Leptospira interrogans serovar lai str. 56601
gauaaagaaaaccuuucccc

SEQ ID NO: 2780415 - RNA, 15 nt, Leptospira interrogans serovar lai str. 56601
gauaaagucuauuuc

SEQ ID NO: 2780416 - RNA, 13 nt, Leptospira interrogans serovar lai str. 56601
gauaaauuuagua

SEQ ID NO: 2780417 - RNA, 14 nt, Leptospira interrogans serovar lai str. 56601
gauaaccuaaaauu

SEQ ID NO: 2780418 - RNA, 17 nt, Leptospira interrogans serovar lai str. 56601
gauaacgcguccucaaa

SEQ ID NO: 2780419 - RNA, 13 nt, Leptospira interrogans serovar lai str. 56601
gauaacggcuaaa

SEQ ID NO: 2780420 - RNA, 16 nt, Leptospira interrogans serovar lai str. 56601
gauaacggcuaaaucu

SEQ ID NO: 2780421 - RNA, 23 nt, Leptospira interrogans serovar lai str. 56601
gauaacggucuccuuagaaagcg

SEQ ID NO: 2780422 - RNA, 13 nt, Leptospira interrogans serovar lai str. 56601
gauaaguuuucua

SEQ ID NO: 2780423 - RNA, 19 nt, Leptospira interrogans serovar lai str. 56601
gauaaguuuucuaguaaaa

SEQ ID NO: 2780424 - RNA, 22 nt, Leptospira interrogans serovar lai str. 56601
gauaauuauccuuaaaaugaaa

SEQ ID NO: 2780425 - RNA, 23 nt, Leptospira interrogans serovar lai str. 56601
gauaauuauccuuaaaaugaaaa

SEQ ID NO: 2780426 - RNA, 15 nt, Leptospira interrogans serovar lai str. 56601
gauaauucgugaacu

SEQ ID NO: 2780427 - RNA, 15 nt, Leptospira interrogans serovar lai str. 56601
gauaauucuuuagaa

SEQ ID NO: 2780428 - RNA, 13 nt, Leptospira interrogans serovar lai str. 56601
gauaauuucuagu

SEQ ID NO: 2780429 - RNA, 21 nt, Leptospira interrogans serovar lai str. 56601
gauaauuuuuacucaaagaau

SEQ ID NO: 2780430 - RNA, 19 nt, Leptospira interrogans serovar lai str. 56601
gauaauuuuuguuuguaaa

SEQ ID NO: 2780431 - RNA, 20 nt, Leptospira interrogans serovar lai str. 56601
gauaauuuuuguuuguaaaa

SEQ ID NO: 2780432 - RNA, 23 nt, Leptospira interrogans serovar lai str. 56601
gauaauuuuuguuuguaaaauuu

SEQ ID NO: 2780433 - RNA, 13 nt, Leptospira interrogans serovar lai str. 56601
gauaauuuuuuaa

SEQ ID NO: 2780434 - RNA, 22 nt, Leptospira interrogans serovar lai str. 56601
gauaauuuuuuaaaaaaauuac

SEQ ID NO: 2780435 - RNA, 22 nt, Leptospira interrogans serovar lai str. 56601
gauacauuaugcgcaaucucaa

SEQ ID NO: 2780436 - RNA, 15 nt, Leptospira interrogans serovar lai str. 56601
gauaccgaaaaagcg

SEQ ID NO: 2780437 - RNA, 16 nt, Leptospira interrogans serovar lai str. 56601
gauaccgaaaaagcgu

SEQ ID NO: 2780438 - RNA, 20 nt, Leptospira interrogans serovar lai str. 56601
gauaccgggauuuuaaaaau

SEQ ID NO: 2780439 - RNA, 17 nt, Leptospira interrogans serovar lai str. 56601
gauacucauaaaauuug

SEQ ID NO: 2780440 - RNA, 16 nt, Leptospira interrogans serovar lai str. 56601
gauacugucaccguuu

SEQ ID NO: 2780441 - RNA, 13 nt, Leptospira interrogans serovar lai str. 56601
gauagaaagguau

SEQ ID NO: 2780442 - RNA, 18 nt, Leptospira interrogans serovar lai str. 56601
gauagaaauauuuagaau

SEQ ID NO: 2780443 - RNA, 14 nt, Leptospira interrogans serovar lai str. 56601
gaugauugauuguu

SEQ ID NO: 2780444 - RNA, 13 nt, Leptospira interrogans serovar lai str. 56601
gaugauuuuucua

SEQ ID NO: 2780445 - RNA, 18 nt, Leptospira interrogans serovar lai str. 56601
gaugcucggcuucuucaa

SEQ ID NO: 2780446 - RNA, 15 nt, Leptospira interrogans serovar lai str. 56601
gauguaaggagccau

SEQ ID NO: 2780447 - RNA, 14 nt, Leptospira interrogans serovar lai str. 56601
gauguaggaacuac

SEQ ID NO: 2780448 - RNA, 22 nt, Leptospira interrogans serovar lai str. 56601
gaugugaguuuuaaaacucaca

SEQ ID NO: 2780449 - RNA, 17 nt, Leptospira interrogans serovar lai str. 56601
gaugugauagaaaggua

SEQ ID NO: 2780450 - RNA, 23 nt, Leptospira interrogans serovar lai str. 56601
gauguggaaguuuucaaaaaaug

SEQ ID NO: 2780451 - RNA, 14 nt, Leptospira interrogans serovar lai str. 56601
gaugugggaacucu

SEQ ID NO: 2780452 - RNA, 20 nt, Leptospira interrogans serovar lai str. 56601
gauguguuaugaguucauuc

SEQ ID NO: 2780453 - RNA, 15 nt, Leptospira interrogans serovar lai str. 56601
gauguugaguuucuu

SEQ ID NO: 2780454 - RNA, 13 nt, Leptospira interrogans serovar lai str. 56601
gauuaaaauaaac

SEQ ID NO: 2780455 - RNA, 23 nt, Leptospira interrogans serovar lai str. 56601
gauuaaaaucagggccggagaaa

SEQ ID NO: 2780456 - RNA, 21 nt, Leptospira interrogans serovar lai str. 56601
gauuaaaaucggaaaauugaa

SEQ ID NO: 2780457 - RNA, 15 nt, Leptospira interrogans serovar lai str. 56601
gauuaaacaggacaa

SEQ ID NO: 2780458 - RNA, 17 nt, Leptospira interrogans serovar lai str. 56601
gauuaaaccgguaaaaa

SEQ ID NO: 2780459 - RNA, 16 nt, Leptospira interrogans serovar lai str. 56601
gauuaaauuuugaaaa

SEQ ID NO: 2780460 - RNA, 19 nt, Leptospira interrogans serovar lai str. 56601
gauuaaauuuugaaaaauu

SEQ ID NO: 2780461 - RNA, 23 nt, Leptospira interrogans serovar lai str. 56601
gauuaaccguagauuuuaacaau

SEQ ID NO: 2780462 - RNA, 23 nt, Leptospira interrogans serovar lai str. 56601
gauuaagaaagacuuuuccuaaa

SEQ ID NO: 2780463 - RNA, 20 nt, Leptospira interrogans serovar lai str. 56601
gauuaaguauuguuaagaua

SEQ ID NO: 2780464 - RNA, 21 nt, Leptospira interrogans serovar lai str. 56601
gauuaauucccaaugaugaau

SEQ ID NO: 2780465 - RNA, 19 nt, Leptospira interrogans serovar lai str. 56601
gauuacuaaugcaauccuc

SEQ ID NO: 2780466 - RNA, 15 nt, Leptospira interrogans serovar lai str. 56601
gauuacuaugaaaau

SEQ ID NO: 2780467 - RNA, 12 nt, Leptospira interrogans serovar lai str. 56601
gauuagaguuaa

SEQ ID NO: 2780468 - RNA, 14 nt, Leptospira interrogans serovar lai str. 56601
gauuagcaugaaau

SEQ ID NO: 2780469 - RNA, 13 nt, Leptospira interrogans serovar lai str. 56601
gauuagcuuaacu

SEQ ID NO: 2780470 - RNA, 14 nt, Leptospira interrogans serovar lai str. 56601
gauuaucuucuaau

SEQ ID NO: 2780471 - RNA, 23 nt, Leptospira interrogans serovar lai str. 56601
gauuaugaagaaugauaaaucuu

SEQ ID NO: 2780472 - RNA, 15 nt, Leptospira interrogans serovar lai str. 56601
gauuauguaauauac

SEQ ID NO: 2780473 - RNA, 23 nt, Leptospira interrogans serovar lai str. 56601
gauuauuauuuugauuuguuucu

SEQ ID NO: 2780474 - RNA, 16 nt, Leptospira interrogans serovar lai str. 56601
gauuauucauaacuau

SEQ ID NO: 2780475 - RNA, 16 nt, Leptospira interrogans serovar lai str. 56601
gauuauugaucucuau

SEQ ID NO: 2780476 - RNA, 12 nt, Leptospira interrogans serovar lai str. 56601
gauuauuuacau

SEQ ID NO: 2780477 - RNA, 15 nt, Leptospira interrogans serovar lai str. 56601
gauuauuuacauaua

SEQ ID NO: 2780478 - RNA, 21 nt, Leptospira interrogans serovar lai str. 56601
gauuauuucaaaaauuuaaau

SEQ ID NO: 2780479 - RNA, 16 nt, Leptospira interrogans serovar lai str. 56601
gauuauuuuuuaaaaa

SEQ ID NO: 2780480 - RNA, 18 nt, Leptospira interrogans serovar lai str. 56601
gauucaaaaacuaaaaua

SEQ ID NO: 2780481 - RNA, 19 nt, Leptospira interrogans serovar lai str. 56601
gauucaaaaacuaaaauac

SEQ ID NO: 2780482 - RNA, 12 nt, Leptospira interrogans serovar lai str. 56601
gauucaaaauug

SEQ ID NO: 2780483 - RNA, 17 nt, Leptospira interrogans serovar lai str. 56601
gauucaauucuacgaau

SEQ ID NO: 2780484 - RNA, 14 nt, Leptospira interrogans serovar lai str. 56601
gauucacuuagaaa

SEQ ID NO: 2780485 - RNA, 22 nt, Leptospira interrogans serovar lai str. 56601
gauucaguuuuacuguaaaauu

SEQ ID NO: 2780486 - RNA, 21 nt, Leptospira interrogans serovar lai str. 56601
gauucauucaggauuacuaau

SEQ ID NO: 2780487 - RNA, 20 nt, Leptospira interrogans serovar lai str. 56601
gauucauuucgaaaacgauu

SEQ ID NO: 2780488 - RNA, 22 nt, Leptospira interrogans serovar lai str. 56601
gauucauuuuucugaaaaaguu

SEQ ID NO: 2780489 - RNA, 18 nt, Leptospira interrogans serovar lai str. 56601
gauucauuuuuugaaaaa

SEQ ID NO: 2780490 - RNA, 16 nt, Leptospira interrogans serovar lai str. 56601
gauuccaaagauaaaa

SEQ ID NO: 2780491 - RNA, 21 nt, Leptospira interrogans serovar lai str. 56601
gauuccaaagauaaaaaagaa

SEQ ID NO: 2780492 - RNA, 17 nt, Leptospira interrogans serovar lai str. 56601
gauuccacgaauugccg

SEQ ID NO: 2780493 - RNA, 14 nt, Leptospira interrogans serovar lai str. 56601
gauuccauugauuu

SEQ ID NO: 2780494 - RNA, 18 nt, Leptospira interrogans serovar lai str. 56601
gauuccauugauuuucau

SEQ ID NO: 2780495 - RNA, 17 nt, Leptospira interrogans serovar lai str. 56601
gauuccauuuuuuagaa

SEQ ID NO: 2780496 - RNA, 18 nt, Leptospira interrogans serovar lai str. 56601
gauuccauuuuuuagaau

SEQ ID NO: 2780497 - RNA, 19 nt, Leptospira interrogans serovar lai str. 56601
gauuccauuuuuuagaauc

SEQ ID NO: 2780498 - RNA, 17 nt, Leptospira interrogans serovar lai str. 56601
gauucccaguaaaucca

SEQ ID NO: 2780499 - RNA, 16 nt, Leptospira interrogans serovar lai str. 56601
gauuccgguaaauuuu

SEQ ID NO: 2780500 - RNA, 14 nt, Leptospira interrogans serovar lai str. 56601
gauuccuaaaaauu

SEQ ID NO: 2780501 - RNA, 15 nt, Leptospira interrogans serovar lai str. 56601
gauuccuaaaaauug

SEQ ID NO: 2780502 - RNA, 17 nt, Leptospira interrogans serovar lai str. 56601
gauuccuaaaaauuguu

SEQ ID NO: 2780503 - RNA, 13 nt, Leptospira interrogans serovar lai str. 56601
gauuccuacuuau

SEQ ID NO: 2780504 - RNA, 15 nt, Leptospira interrogans serovar lai str. 56601
gauuccuuuccgauu

SEQ ID NO: 2780505 - RNA, 21 nt, Leptospira interrogans serovar lai str. 56601
gauucgaacuuuuuuuagaau

SEQ ID NO: 2780506 - RNA, 22 nt, Leptospira interrogans serovar lai str. 56601
gauucgaacuuuuuuuagaauc

SEQ ID NO: 2780507 - RNA, 14 nt, Leptospira interrogans serovar lai str. 56601
gauucuaaaaaaag

SEQ ID NO: 2780508 - RNA, 16 nt, Leptospira interrogans serovar lai str. 56601
gauucuaaaaaaaguu

SEQ ID NO: 2780509 - RNA, 18 nt, Leptospira interrogans serovar lai str. 56601
gauucuaacugguuuuuc

SEQ ID NO: 2780510 - RNA, 20 nt, Leptospira interrogans serovar lai str. 56601
gauucuaacugguuuuucuu

SEQ ID NO: 2780511 - RNA, 18 nt, Leptospira interrogans serovar lai str. 56601
gauucuaggaaacucaag

SEQ ID NO: 2780512 - RNA, 19 nt, Leptospira interrogans serovar lai str. 56601
gauucuauauauugaaaua

SEQ ID NO: 2780513 - RNA, 23 nt, Leptospira interrogans serovar lai str. 56601
gauucuauauauugaaauauuau

SEQ ID NO: 2780514 - RNA, 21 nt, Leptospira interrogans serovar lai str. 56601
gauucucaaaauggccuucua

SEQ ID NO: 2780515 - RNA, 19 nt, Leptospira interrogans serovar lai str. 56601
gauucucgcauuuuccuuu

SEQ ID NO: 2780516 - RNA, 19 nt, Leptospira interrogans serovar lai str. 56601
gauucugaaaaaaauuaga

SEQ ID NO: 2780517 - RNA, 21 nt, Leptospira interrogans serovar lai str. 56601
gauucugaaaaaaguuagaau

SEQ ID NO: 2780518 - RNA, 13 nt, Leptospira interrogans serovar lai str. 56601
gauucugaaaaga

SEQ ID NO: 2780519 - RNA, 18 nt, Leptospira interrogans serovar lai str. 56601
gauucuuucgacuucuuu

SEQ ID NO: 2780520 - RNA, 20 nt, Leptospira interrogans serovar lai str. 56601
gauucuuuucccgcuaaaag

SEQ ID NO: 2780521 - RNA, 23 nt, Leptospira interrogans serovar lai str. 56601
gauucuuuucccgcuaaaaguac

SEQ ID NO: 2780522 - RNA, 22 nt, Leptospira interrogans serovar lai str. 56601
gauugaaacguuuucaaaaaau

SEQ ID NO: 2780523 - RNA, 19 nt, Leptospira interrogans serovar lai str. 56601
gauugaagcaguuuuguua

SEQ ID NO: 2780524 - RNA, 13 nt, Leptospira interrogans serovar lai str. 56601
gauugaauuaaaa

SEQ ID NO: 2780525 - RNA, 15 nt, Leptospira interrogans serovar lai str. 56601
gauugaguuucacaa

SEQ ID NO: 2780526 - RNA, 22 nt, Leptospira interrogans serovar lai str. 56601
gcaaaaguuuucaaaaauguau

SEQ ID NO: 2780527 - RNA, 15 nt, Leptospira interrogans serovar lai str. 56601
gcaaaauaucuggaa

SEQ ID NO: 2780528 - RNA, 13 nt, Leptospira interrogans serovar lai str. 56601
gcaaaauuuaaaa

SEQ ID NO: 2780529 - RNA, 18 nt, Leptospira interrogans serovar lai str. 56601
gcaaacaucuagauuuua

SEQ ID NO: 2780530 - RNA, 16 nt, Leptospira interrogans serovar lai str. 56601
gcaaacuuuuuauaaa

SEQ ID NO: 2780531 - RNA, 17 nt, Leptospira interrogans serovar lai str. 56601
gcaaacuuuuuauaaaa

SEQ ID NO: 2780532 - RNA, 19 nt, Leptospira interrogans serovar lai str. 56601
gcaaacuuuuuauaaaaag

SEQ ID NO: 2780533 - RNA, 20 nt, Leptospira interrogans serovar lai str. 56601
gcaaacuuuuuauaaaaagc

SEQ ID NO: 2780534 - RNA, 23 nt, Leptospira interrogans serovar lai str. 56601
gcaaacuuuuuauaaaaagcugu

SEQ ID NO: 2780535 - RNA, 14 nt, Leptospira interrogans serovar lai str. 56601
gcaaagaagaaaua

SEQ ID NO: 2780536 - RNA, 17 nt, Leptospira interrogans serovar lai str. 56601
gcaaagauuaaguauug

SEQ ID NO: 2780537 - RNA, 16 nt, Leptospira interrogans serovar lai str. 56601
gcaaaggaucaaaucg

SEQ ID NO: 2780538 - RNA, 15 nt, Leptospira interrogans serovar lai str. 56601
gcaaaguuucuuaua

SEQ ID NO: 2780539 - RNA, 13 nt, Leptospira interrogans serovar lai str. 56601
gcaaauaauaaaa

SEQ ID NO: 2780540 - RNA, 20 nt, Leptospira interrogans serovar lai str. 56601
gcaaauguuauuuuugcaca

SEQ ID NO: 2780541 - RNA, 12 nt, Leptospira interrogans serovar lai str. 56601
gcaaauucuacu

SEQ ID NO: 2780542 - RNA, 15 nt, Leptospira interrogans serovar lai str. 56601
gcaaauuuuacauug

SEQ ID NO: 2780543 - RNA, 15 nt, Leptospira interrogans serovar lai str. 56601
gcaaauuuuauagua

SEQ ID NO: 2780544 - RNA, 12 nt, Leptospira interrogans serovar lai str. 56601
gcaaauuuuuuc

SEQ ID NO: 2780545 - RNA, 13 nt, Leptospira interrogans serovar lai str. 56601
gcaacacacacuu

SEQ ID NO: 2780546 - RNA, 20 nt, Leptospira interrogans serovar lai str. 56601
gcaacacacacuuuauaaaa

SEQ ID NO: 2780547 - RNA, 17 nt, Leptospira interrogans serovar lai str. 56601
gcaacacauuuucauuc

SEQ ID NO: 2780548 - RNA, 17 nt, Leptospira interrogans serovar lai str. 56601
gcaacggauuccuccag

SEQ ID NO: 2780549 - RNA, 14 nt, Leptospira interrogans serovar lai str. 56601
gcaagaaaaucugg

SEQ ID NO: 2780550 - RNA, 21 nt, Leptospira interrogans serovar lai str. 56601
gcaagaaccguaacugacauu

SEQ ID NO: 2780551 - RNA, 17 nt, Leptospira interrogans serovar lai str. 56601
gcaagcacauccgcauu

SEQ ID NO: 2780552 - RNA, 22 nt, Leptospira interrogans serovar lai str. 56601
gcaaguaaaaagacucauucuu

SEQ ID NO: 2780553 - RNA, 13 nt, Leptospira interrogans serovar lai str. 56601
gcaaguaauacuu

SEQ ID NO: 2780554 - RNA, 14 nt, Leptospira interrogans serovar lai str. 56601
gcaauacauuagaa

SEQ ID NO: 2780555 - RNA, 18 nt, Leptospira interrogans serovar lai str. 56601
gcaauacauucuuauaaa

SEQ ID NO: 2780556 - RNA, 13 nt, Leptospira interrogans serovar lai str. 56601
gcaauaguuccug

SEQ ID NO: 2780557 - RNA, 21 nt, Leptospira interrogans serovar lai str. 56601
gcaauauuauuuuaacuugag

SEQ ID NO: 2780558 - RNA, 11 nt, Leptospira interrogans serovar lai str. 56601
gcaaucuguug

SEQ ID NO: 2780559 - RNA, 16 nt, Leptospira interrogans serovar lai str. 56601
gcaaugucuccaaagu

SEQ ID NO: 2780560 - RNA, 17 nt, Leptospira interrogans serovar lai str. 56601
gcaaugugcaaaggagu

SEQ ID NO: 2780561 - RNA, 23 nt, Leptospira interrogans serovar lai str. 56601
gcaaugugcaaaggaguauuuuu

SEQ ID NO: 2780562 - RNA, 22 nt, Leptospira interrogans serovar lai str. 56601
gcaauucuaagaccuaaacccu

SEQ ID NO: 2780563 - RNA, 21 nt, Leptospira interrogans serovar lai str. 56601
gcacaaaacgaucauuugcau

SEQ ID NO: 2780564 - RNA, 21 nt, Leptospira interrogans serovar lai str. 56601
gcacaaaauauucguguucua

SEQ ID NO: 2780565 - RNA, 20 nt, Leptospira interrogans serovar lai str. 56601
gcacauaaaagaccuucgga

SEQ ID NO: 2780566 - RNA, 17 nt, Leptospira interrogans serovar lai str. 56601
gcacauccgcauucuca

SEQ ID NO: 2780567 - RNA, 11 nt, Leptospira interrogans serovar lai str. 56601
gcaccaaauug

SEQ ID NO: 2780568 - RNA, 13 nt, Leptospira interrogans serovar lai str. 56601
gcacucaauuuua

SEQ ID NO: 2780569 - RNA, 17 nt, Leptospira interrogans serovar lai str. 56601
gcagaagcuuuauuaaa

SEQ ID NO: 2780570 - RNA, 22 nt, Leptospira interrogans serovar lai str. 56601
gcagaauguuuucuacaaauaa

SEQ ID NO: 2780571 - RNA, 15 nt, Leptospira interrogans serovar lai str. 56601
gcagauucagucuca

SEQ ID NO: 2780572 - RNA, 20 nt, Leptospira interrogans serovar lai str. 56601
gcagauuuucucaaaaaaag

SEQ ID NO: 2780573 - RNA, 22 nt, Leptospira interrogans serovar lai str. 56601
gcagauuuucucaaaaaaagua

SEQ ID NO: 2780574 - RNA, 12 nt, Leptospira interrogans serovar lai str. 56601
gcagcaaagaag

SEQ ID NO: 2780575 - RNA, 19 nt, Leptospira interrogans serovar lai str. 56601
gcagcuaaaaagaaaguug

SEQ ID NO: 2780576 - RNA, 19 nt, Leptospira interrogans serovar lai str. 56601
gcagcuaagaaaaaaguug

SEQ ID NO: 2780577 - RNA, 15 nt, Leptospira interrogans serovar lai str. 56601
gcagcuauuuuuuuc

SEQ ID NO: 2780578 - RNA, 18 nt, Leptospira interrogans serovar lai str. 56601
gcaggcuuguuugaauuu

SEQ ID NO: 2780579 - RNA, 14 nt, Leptospira interrogans serovar lai str. 56601
gcaguacaauucaa

SEQ ID NO: 2780580 - RNA, 15 nt, Leptospira interrogans serovar lai str. 56601
gcaguaguucccaca

SEQ ID NO: 2780581 - RNA, 11 nt, Leptospira interrogans serovar lai str. 56601
gcaguauuuua

SEQ ID NO: 2780582 - RNA, 23 nt, Leptospira interrogans serovar lai str. 56601
gcaguucuacuuuauuaaaaagu

SEQ ID NO: 2780583 - RNA, 22 nt, Leptospira interrogans serovar lai str. 56601
gcaguugugaucagugauucga

SEQ ID NO: 2780584 - RNA, 12 nt, Leptospira interrogans serovar lai str. 56601
gcauaaaaaaau

SEQ ID NO: 2780585 - RNA, 14 nt, Leptospira interrogans serovar lai str. 56601
gcauaaaaaaauau

SEQ ID NO: 2780586 - RNA, 11 nt, Leptospira interrogans serovar lai str. 56601
gcauaaaacuc

SEQ ID NO: 2780587 - RNA, 11 nt, Leptospira interrogans serovar lai str. 56601
gcauacuuuuc

SEQ ID NO: 2780588 - RNA, 16 nt, Leptospira interrogans serovar lai str. 56601
gcauccaaucaugaau

SEQ ID NO: 2780589 - RNA, 17 nt, Leptospira interrogans serovar lai str. 56601
gcaugaaaauaauacua

SEQ ID NO: 2780590 - RNA, 22 nt, Leptospira interrogans serovar lai str. 56601
gcaugaauggauuuuuugucuu

SEQ ID NO: 2780591 - RNA, 15 nt, Leptospira interrogans serovar lai str. 56601
gcauuauaaguuuuu

SEQ ID NO: 2780592 - RNA, 16 nt, Leptospira interrogans serovar lai str. 56601
gcauucaaaaaguuuu

SEQ ID NO: 2780593 - RNA, 22 nt, Leptospira interrogans serovar lai str. 56601
gcauugaaaucagagucuauuu

SEQ ID NO: 2780594 - RNA, 20 nt, Leptospira interrogans serovar lai str. 56601
gcauugaguuacgcugaguu

SEQ ID NO: 2780595 - RNA, 16 nt, Leptospira interrogans serovar lai str. 56601
gcauuuaauauauuca

SEQ ID NO: 2780596 - RNA, 17 nt, Leptospira interrogans serovar lai str. 56601
gcauuuauauucgcucc

SEQ ID NO: 2780597 - RNA, 11 nt, Leptospira interrogans serovar lai str. 56601
gcauuucauuu

SEQ ID NO: 2780598 - RNA, 21 nt, Leptospira interrogans serovar lai str. 56601
gcauuuguuguaucgaacuca

SEQ ID NO: 2780599 - RNA, 18 nt, Leptospira interrogans serovar lai str. 56601
gcauuuuauuaaaaauau

SEQ ID NO: 2780600 - RNA, 20 nt, Leptospira interrogans serovar lai str. 56601
gcauuuuauuaaaaauuuuu

SEQ ID NO: 2780601 - RNA, 17 nt, Leptospira interrogans serovar lai str. 56601
gcauuuuauuaaagaau

SEQ ID NO: 2780602 - RNA, 19 nt, Leptospira interrogans serovar lai str. 56601
gccaaaaucccagaaagga

SEQ ID NO: 2780603 - RNA, 14 nt, Leptospira interrogans serovar lai str. 56601
gccaaagaaauaga

SEQ ID NO: 2780604 - RNA, 18 nt, Leptospira interrogans serovar lai str. 56601
gccaaaucugaaaaagag

SEQ ID NO: 2780605 - RNA, 13 nt, Leptospira interrogans serovar lai str. 56601
gccaauuccaaac

SEQ ID NO: 2780606 - RNA, 19 nt, Leptospira interrogans serovar lai str. 56601
gccaguuuuuugagaaaca

SEQ ID NO: 2780607 - RNA, 21 nt, Leptospira interrogans serovar lai str. 56601
gccaguuuuuugagaaacaac

SEQ ID NO: 2780608 - RNA, 11 nt, Leptospira interrogans serovar lai str. 56601
gccaucuuuuu

SEQ ID NO: 2780609 - RNA, 19 nt, Leptospira interrogans serovar lai str. 56601
gcucauacauuuuuagaau

SEQ ID NO: 2780610 - RNA, 18 nt, Leptospira interrogans serovar lai str. 56601
gcucaucauucugaaaaa

SEQ ID NO: 2780611 - RNA, 13 nt, Leptospira interrogans serovar lai str. 56601
gcuccaaaaaaau

SEQ ID NO: 2780612 - RNA, 15 nt, Leptospira interrogans serovar lai str. 56601
gcuccaaaaaaauaa

SEQ ID NO: 2780613 - RNA, 15 nt, Leptospira interrogans serovar lai str. 56601
gcuccagucaaguua

SEQ ID NO: 2780614 - RNA, 22 nt, Leptospira interrogans serovar lai str. 56601
gcuccgauaauuguagaagcaa

SEQ ID NO: 2780615 - RNA, 21 nt, Leptospira interrogans serovar lai str. 56601
gcuccuugcugucgcaacaua

SEQ ID NO: 2780616 - RNA, 23 nt, Leptospira interrogans serovar lai str. 56601
gcuccuugcugucgcaacauaau

SEQ ID NO: 2780617 - RNA, 20 nt, Leptospira interrogans serovar lai str. 56601
gcuccuuucaucucuauaaa

SEQ ID NO: 2780618 - RNA, 13 nt, Leptospira interrogans serovar lai str. 56601
gcucgaauuuuuu

SEQ ID NO: 2780619 - RNA, 15 nt, Leptospira interrogans serovar lai str. 56601
gcucgauuuuauaga

SEQ ID NO: 2780620 - RNA, 21 nt, Leptospira interrogans serovar lai str. 56601
gcucuaauauuuuaaagaaac

SEQ ID NO: 2780621 - RNA, 13 nt, Leptospira interrogans serovar lai str. 56601
gcucuauuuccac

SEQ ID NO: 2780622 - RNA, 17 nt, Leptospira interrogans serovar lai str. 56601
gcucucagcucugguua

SEQ ID NO: 2780623 - RNA, 22 nt, Leptospira interrogans serovar lai str. 56601
gcucucguaauaucuaaaaccu

SEQ ID NO: 2780624 - RNA, 21 nt, Leptospira interrogans serovar lai str. 56601
gcucucguuuuuaggauuaau

SEQ ID NO: 2780625 - RNA, 15 nt, Leptospira interrogans serovar lai str. 56601
gcucugguuaauaaa

SEQ ID NO: 2780626 - RNA, 14 nt, Leptospira interrogans serovar lai str. 56601
gcucugugaaacuc

SEQ ID NO: 2780627 - RNA, 15 nt, Leptospira interrogans serovar lai str. 56601
gcucuugcuaaaauu

SEQ ID NO: 2780628 - RNA, 18 nt, Leptospira interrogans serovar lai str. 56601
gcucuuuugcuucuuuua

SEQ ID NO: 2780629 - RNA, 12 nt, Leptospira interrogans serovar lai str. 56601
gcugaaaaaaaa

SEQ ID NO: 2780630 - RNA, 20 nt, Leptospira interrogans serovar lai str. 56601
gcugaaaaugguuuucuauu

SEQ ID NO: 2780631 - RNA, 15 nt, Leptospira interrogans serovar lai str. 56601
gcugaaaauuuuccc

SEQ ID NO: 2780632 - RNA, 13 nt, Leptospira interrogans serovar lai str. 56601
gcugaguuugaaa

SEQ ID NO: 2780633 - RNA, 20 nt, Leptospira interrogans serovar lai str. 56601
gcugaguuugaaagagcguu

SEQ ID NO: 2780634 - RNA, 22 nt, Leptospira interrogans serovar lai str. 56601
gcugaugcauccaaucaugaau

SEQ ID NO: 2780635 - RNA, 13 nt, Leptospira interrogans serovar lai str. 56601
gcugauuuuucuu

SEQ ID NO: 2780636 - RNA, 19 nt, Leptospira interrogans serovar lai str. 56601
gcugauuuuucuuuagaca

SEQ ID NO: 2780637 - RNA, 16 nt, Leptospira interrogans serovar lai str. 56601
gcugccgcucuuucuu

SEQ ID NO: 2780638 - RNA, 19 nt, Leptospira interrogans serovar lai str. 56601
gcugccgcucuuucuuccg

SEQ ID NO: 2780639 - RNA, 22 nt, Leptospira interrogans serovar lai str. 56601
gcuggaaauaucaaugaucaua

SEQ ID NO: 2780640 - RNA, 15 nt, Leptospira interrogans serovar lai str. 56601
gcuggauaggauucc

SEQ ID NO: 2780641 - RNA, 22 nt, Leptospira interrogans serovar lai str. 56601
gcuguucuuagucuaaaaacaa

SEQ ID NO: 2780642 - RNA, 18 nt, Leptospira interrogans serovar lai str. 56601
gcuuaaagcauuaaaaaa

SEQ ID NO: 2780643 - RNA, 23 nt, Leptospira interrogans serovar lai str. 56601
gcuuaaagcauuaaaaaagauaa

SEQ ID NO: 2780644 - RNA, 12 nt, Leptospira interrogans serovar lai str. 56601
gcuuacaaagug

SEQ ID NO: 2780645 - RNA, 17 nt, Leptospira interrogans serovar lai str. 56601
gcuucagucaaguuauu

SEQ ID NO: 2780646 - RNA, 14 nt, Leptospira interrogans serovar lai str. 56601
gcuucauauaauaa

SEQ ID NO: 2780647 - RNA, 22 nt, Leptospira interrogans serovar lai str. 56601
gcuucaucaaacggucuuucuu

SEQ ID NO: 2780648 - RNA, 20 nt, Leptospira interrogans serovar lai str. 56601
gcuucaucgaagcaaucugu

SEQ ID NO: 2780649 - RNA, 13 nt, Leptospira interrogans serovar lai str. 56601
gcuuccaauccuu

SEQ ID NO: 2780650 - RNA, 13 nt, Leptospira interrogans serovar lai str. 56601
gcuucucuugcuu

SEQ ID NO: 2780651 - RNA, 21 nt, Leptospira interrogans serovar lai str. 56601
gcuucugaacaagaauuuauu

SEQ ID NO: 2780652 - RNA, 18 nt, Leptospira interrogans serovar lai str. 56601
gcuugaguugcuuugaau

SEQ ID NO: 2780653 - RNA, 13 nt, Leptospira interrogans serovar lai str. 56601
gcuuggaaauauc

SEQ ID NO: 2780654 - RNA, 18 nt, Leptospira interrogans serovar lai str. 56601
gcuugucccaaaaacuca

SEQ ID NO: 2780655 - RNA, 17 nt, Leptospira interrogans serovar lai str. 56601
gcuuguuugaauuuuuc

SEQ ID NO: 2780656 - RNA, 12 nt, Leptospira interrogans serovar lai str. 56601
gcuuuagaaaau

SEQ ID NO: 2780657 - RNA, 14 nt, Leptospira interrogans serovar lai str. 56601
gcuuuagaaaauaa

SEQ ID NO: 2780658 - RNA, 14 nt, Leptospira interrogans serovar lai str. 56601
gcuuuauaaaauga

SEQ ID NO: 2780659 - RNA, 22 nt, Leptospira interrogans serovar lai str. 56601
gcuuuauaaaaugaaucucuua

SEQ ID NO: 2780660 - RNA, 21 nt, Leptospira interrogans serovar lai str. 56601
gcuuuaucuuuauaaaaauga

SEQ ID NO: 2780661 - RNA, 12 nt, Leptospira interrogans serovar lai str. 56601
gcuuuauuaaau

SEQ ID NO: 2780662 - RNA, 18 nt, Leptospira interrogans serovar lai str. 56601
gcuuucguaaaaagcguu

SEQ ID NO: 2780663 - RNA, 15 nt, Leptospira interrogans serovar lai str. 56601
gcuuucucuuuuuag

SEQ ID NO: 2780664 - RNA, 19 nt, Leptospira interrogans serovar lai str. 56601
gcuuugauuggauucuuuc

SEQ ID NO: 2780665 - RNA, 12 nt, Leptospira interrogans serovar lai str. 56601
gcuuuuaaauug

SEQ ID NO: 2780666 - RNA, 18 nt, Leptospira interrogans serovar lai str. 56601
gcuuuuagcucuagucaa

SEQ ID NO: 2780667 - RNA, 12 nt, Leptospira interrogans serovar lai str. 56601
gcuuuuguaaau

SEQ ID NO: 2780668 - RNA, 15 nt, Leptospira interrogans serovar lai str. 56601
gcuuuuuuaaauuuu

SEQ ID NO: 2780669 - RNA, 15 nt, Leptospira interrogans serovar lai str. 56601
ggaaaaaauccccuu

SEQ ID NO: 2780670 - RNA, 20 nt, Leptospira interrogans serovar lai str. 56601
ggaaaaaauccccuuucuaa

SEQ ID NO: 2780671 - RNA, 23 nt, Leptospira interrogans serovar lai str. 56601
ggaaaaauaagguuuuauaaaau

SEQ ID NO: 2780672 - RNA, 23 nt, Leptospira interrogans serovar lai str. 56601
ggaaaagucagguuuuaucaaau

SEQ ID NO: 2780673 - RNA, 24 nt, Leptospira interrogans serovar lai str. 56601
ggaaaagucagguuuuaucaaaua

SEQ ID NO: 2780674 - RNA, 13 nt, Leptospira interrogans serovar lai str. 56601
ggaaaaugaaaac

SEQ ID NO: 2780675 - RNA, 12 nt, Leptospira interrogans serovar lai str. 56601
ggaaaauuuaaa

SEQ ID NO: 2780676 - RNA, 19 nt, Leptospira interrogans serovar lai str. 56601
ggaaacgcaaugucuccaa

SEQ ID NO: 2780677 - RNA, 14 nt, Leptospira interrogans serovar lai str. 56601
ggaaagaaaaggug

SEQ ID NO: 2780678 - RNA, 18 nt, Leptospira interrogans serovar lai str. 56601
ggaaagaauacgauuuaa

SEQ ID NO: 2780679 - RNA, 21 nt, Leptospira interrogans serovar lai str. 56601
ggaaaguuuuuuaaaaaauag

SEQ ID NO: 2780680 - RNA, 13 nt, Leptospira interrogans serovar lai str. 56601
ggaaauagaaaga

SEQ ID NO: 2780681 - RNA, 22 nt, Leptospira interrogans serovar lai str. 56601
ggaaauucuuuuccaaaaacuu

SEQ ID NO: 2780682 - RNA, 20 nt, Leptospira interrogans serovar lai str. 56601
ggaaauugugagaacuacuu

SEQ ID NO: 2780683 - RNA, 17 nt, Leptospira interrogans serovar lai str. 56601
ggaaauuuuuaauaaaa

SEQ ID NO: 2780684 - RNA, 19 nt, Leptospira interrogans serovar lai str. 56601
ggaacaaguugaaagggga

SEQ ID NO: 2780685 - RNA, 15 nt, Leptospira interrogans serovar lai str. 56601
ggaaccaucaccaac

SEQ ID NO: 2780686 - RNA, 21 nt, Leptospira interrogans serovar lai str. 56601
ggaaccaucaccaaccccaca

SEQ ID NO: 2780687 - RNA, 21 nt, Leptospira interrogans serovar lai str. 56601
ggaacccauacaaaauuuaaa

SEQ ID NO: 2780688 - RNA, 13 nt, Leptospira interrogans serovar lai str. 56601
ggaacuauuauaa

SEQ ID NO: 2780689 - RNA, 22 nt, Leptospira interrogans serovar lai str. 56601
ggaacucuauauaaagaaaaac

SEQ ID NO: 2780690 - RNA, 23 nt, Leptospira interrogans serovar lai str. 56601
ggaacucuuacuuugagaaaauu

SEQ ID NO: 2780691 - RNA, 22 nt, Leptospira interrogans serovar lai str. 56601
ggaacugcuuccaaaaaaaguc

SEQ ID NO: 2780692 - RNA, 16 nt, Leptospira interrogans serovar lai str. 56601
gggaauauuccauuuu

SEQ ID NO: 2780693 - RNA, 21 nt, Leptospira interrogans serovar lai str. 56601
gggaauauucguaagaaaaaa

SEQ ID NO: 2780694 - RNA, 14 nt, Leptospira interrogans serovar lai str. 56601
gggagaaacacucc

SEQ ID NO: 2780695 - RNA, 16 nt, Leptospira interrogans serovar lai str. 56601
gggagacucuaguaaa

SEQ ID NO: 2780696 - RNA, 21 nt, Leptospira interrogans serovar lai str. 56601
gggagacucuaguaaagaaac

SEQ ID NO: 2780697 - RNA, 23 nt, Leptospira interrogans serovar lai str. 56601
gggagacucuaguaaagaaacuc

SEQ ID NO: 2780698 - RNA, 13 nt, Leptospira interrogans serovar lai str. 56601
gggaguuccuaca

SEQ ID NO: 2780699 - RNA, 16 nt, Leptospira interrogans serovar lai str. 56601
gggauacucauaaaau

SEQ ID NO: 2780700 - RNA, 17 nt, Leptospira interrogans serovar lai str. 56601
gggauacucauaaaauu

SEQ ID NO: 2780701 - RNA, 15 nt, Leptospira interrogans serovar lai str. 56601
gggauuuuaaaaauu

SEQ ID NO: 2780702 - RNA, 16 nt, Leptospira interrogans serovar lai str. 56601
gggcccaaauaaaaac

SEQ ID NO: 2780703 - RNA, 14 nt, Leptospira interrogans serovar lai str. 56601
gggcucaaaaaggc

SEQ ID NO: 2780704 - RNA, 15 nt, Leptospira interrogans serovar lai str. 56601
ggguauauuggcuuu

SEQ ID NO: 2780705 - RNA, 20 nt, Leptospira interrogans serovar lai str. 56601
ggguuuguaacuccuagaug

SEQ ID NO: 2780706 - RNA, 19 nt, Leptospira interrogans serovar lai str. 56601
ggguuuuaccaggaugaau

SEQ ID NO: 2780707 - RNA, 19 nt, Leptospira interrogans serovar lai str. 56601
ggguuuuaucuaaaauuuc

SEQ ID NO: 2780708 - RNA, 13 nt, Leptospira interrogans serovar lai str. 56601
gguaaaaaaaaau

SEQ ID NO: 2780709 - RNA, 22 nt, Leptospira interrogans serovar lai str. 56601
gguaaaaucauucuuuugugac

SEQ ID NO: 2780710 - RNA, 20 nt, Leptospira interrogans serovar lai str. 56601
gguaacgagcaucuuuagaa

SEQ ID NO: 2780711 - RNA, 11 nt, Leptospira interrogans serovar lai str. 56601
gguaacucagc

SEQ ID NO: 2780712 - RNA, 22 nt, Leptospira interrogans serovar lai str. 56601
gguaaggagcucaucauucuga

SEQ ID NO: 2780713 - RNA, 17 nt, Leptospira interrogans serovar lai str. 56601
gguaauuguagauucuu

SEQ ID NO: 2780714 - RNA, 18 nt, Leptospira interrogans serovar lai str. 56601
gguaauuguagauucuuu

SEQ ID NO: 2780715 - RNA, 21 nt, Leptospira interrogans serovar lai str. 56601
gguacaaucggguaaaaaaua

SEQ ID NO: 2780716 - RNA, 13 nt, Leptospira interrogans serovar lai str. 56601
gguacagaaacaa

SEQ ID NO: 2780717 - RNA, 13 nt, Leptospira interrogans serovar lai str. 56601
gguauaaaauaaa

SEQ ID NO: 2780718 - RNA, 16 nt, Leptospira interrogans serovar lai str. 56601
gguauagaaguucgga

SEQ ID NO: 2780719 - RNA, 20 nt, Leptospira interrogans serovar lai str. 56601
gguaucuacauuggaaggac

SEQ ID NO: 2780720 - RNA, 17 nt, Leptospira interrogans serovar lai str. 56601
gguauuaucuaaagcuu

SEQ ID NO: 2780721 - RNA, 19 nt, Leptospira interrogans serovar lai str. 56601
gguauuuuagguauuucua

SEQ ID NO: 2780722 - RNA, 22 nt, Leptospira interrogans serovar lai str. 56601
ggucauuuuucaaauaaagaaa

SEQ ID NO: 2780723 - RNA, 23 nt, Leptospira interrogans serovar lai str. 56601
ggucauuuuucaaauaaagaaaa

SEQ ID NO: 2780724 - RNA, 13 nt, Leptospira interrogans serovar lai str. 56601
ggucgauugaagc

SEQ ID NO: 2780725 - RNA, 13 nt, Leptospira interrogans serovar lai str. 56601
ggugcaaauuacg

SEQ ID NO: 2780726 - RNA, 20 nt, Leptospira interrogans serovar lai str. 56601
ggugcuuuguucaaagaaau

SEQ ID NO: 2780727 - RNA, 13 nt, Leptospira interrogans serovar lai str. 56601
gguuaaaaauuua

SEQ ID NO: 2780728 - RNA, 20 nt, Leptospira interrogans serovar lai str. 56601
gguuaucauaaaaauaaaga

SEQ ID NO: 2780729 - RNA, 17 nt, Leptospira interrogans serovar lai str. 56601
gguucaaaaaaauuaaa

SEQ ID NO: 2780730 - RNA, 16 nt, Leptospira interrogans serovar lai str. 56601
gguuccauaaagacca

SEQ ID NO: 2780731 - RNA, 14 nt, Leptospira interrogans serovar lai str. 56601
gguugagcaaaaau

SEQ ID NO: 2780732 - RNA, 13 nt, Leptospira interrogans serovar lai str. 56601
gguugaguucuuu

SEQ ID NO: 2780733 - RNA, 14 nt, Leptospira interrogans serovar lai str. 56601
gguuguuaugcaaa

SEQ ID NO: 2780734 - RNA, 12 nt, Leptospira interrogans serovar lai str. 56601
gguuuaaaacua

SEQ ID NO: 2780735 - RNA, 22 nt, Leptospira interrogans serovar lai str. 56601
gguuuagacguaggaaaugaaa

SEQ ID NO: 2780736 - RNA, 14 nt, Leptospira interrogans serovar lai str. 56601
gguuucaauuuaaa

SEQ ID NO: 2780737 - RNA, 14 nt, Leptospira interrogans serovar lai str. 56601
gguuucauagaagg

SEQ ID NO: 2780738 - RNA, 19 nt, Leptospira interrogans serovar lai str. 56601
gguuuggaguagauuccua

SEQ ID NO: 2780739 - RNA, 15 nt, Leptospira interrogans serovar lai str. 56601
gguuuguacguaaaa

SEQ ID NO: 2780740 - RNA, 11 nt, Leptospira interrogans serovar lai str. 56601
gguuuuaaaac

SEQ ID NO: 2780741 - RNA, 20 nt, Leptospira interrogans serovar lai str. 56601
gguuuuacuaaaaaacauaa

SEQ ID NO: 2780742 - RNA, 21 nt, Leptospira interrogans serovar lai str. 56601
gguuuuacuaaaaaacauaaa

SEQ ID NO: 2780743 - RNA, 12 nt, Leptospira interrogans serovar lai str. 56601
gguuuuauaaag

SEQ ID NO: 2780744 - RNA, 16 nt, Leptospira interrogans serovar lai str. 56601
gguuuuauuucugcug

SEQ ID NO: 2780745 - RNA, 16 nt, Leptospira interrogans serovar lai str. 56601
gguuuucuaauuuaug

SEQ ID NO: 2780746 - RNA, 13 nt, Leptospira interrogans serovar lai str. 56601
guaaaaaaauaga

SEQ ID NO: 2780747 - RNA, 12 nt, Leptospira interrogans serovar lai str. 56601
guaaaaaaauau

SEQ ID NO: 2780748 - RNA, 21 nt, Leptospira interrogans serovar lai str. 56601
guaaaaaaauauuaaaacacu

SEQ ID NO: 2780749 - RNA, 12 nt, Leptospira interrogans serovar lai str. 56601
guaaaaaagaua

SEQ ID NO: 2780750 - RNA, 15 nt, Leptospira interrogans serovar lai str. 56601
guaaaaaauccauga

SEQ ID NO: 2780751 - RNA, 17 nt, Leptospira interrogans serovar lai str. 56601
guaaaaaauccaugauu

SEQ ID NO: 2780752 - RNA, 12 nt, Leptospira interrogans serovar lai str. 56601
guaaaaauaaua

SEQ ID NO: 2780753 - RNA, 14 nt, Leptospira interrogans serovar lai str. 56601
guaaaaauucuccu

SEQ ID NO: 2780754 - RNA, 17 nt, Leptospira interrogans serovar lai str. 56601
guaaaacccaauaccaa

SEQ ID NO: 2780755 - RNA, 18 nt, Leptospira interrogans serovar lai str. 56601
guaaaacccaauaccaaa

SEQ ID NO: 2780756 - RNA, 19 nt, Leptospira interrogans serovar lai str. 56601
guaaaacccaucguaaaca

SEQ ID NO: 2780757 - RNA, 13 nt, Leptospira interrogans serovar lai str. 56601
guaaaacgcucuc

SEQ ID NO: 2780758 - RNA, 17 nt, Leptospira interrogans serovar lai str. 56601
guaaaacuuuuaaagaa

SEQ ID NO: 2780759 - RNA, 12 nt, Leptospira interrogans serovar lai str. 56601
guaaaagaaaaa

SEQ ID NO: 2780760 - RNA, 19 nt, Leptospira interrogans serovar lai str. 56601
guaaaagagacauugaaga

SEQ ID NO: 2780761 - RNA, 12 nt, Leptospira interrogans serovar lai str. 56601
guaaaauccaga

SEQ ID NO: 2780762 - RNA, 17 nt, Leptospira interrogans serovar lai str. 56601
guaaaauccagaauaau

SEQ ID NO: 2780763 - RNA, 16 nt, Leptospira interrogans serovar lai str. 56601
guaaaaucgaguuuca

SEQ ID NO: 2780764 - RNA, 13 nt, Leptospira interrogans serovar lai str. 56601
guaaaaucuuaau

SEQ ID NO: 2780765 - RNA, 17 nt, Leptospira interrogans serovar lai str. 56601
guaaaauggaaaaaaga

SEQ ID NO: 2780766 - RNA, 18 nt, Leptospira interrogans serovar lai str. 56601
guaaaauggaaaaaagau

SEQ ID NO: 2780767 - RNA, 20 nt, Leptospira interrogans serovar lai str. 56601
guaaaauguggaaacuauca

SEQ ID NO: 2780768 - RNA, 13 nt, Leptospira interrogans serovar lai str. 56601
guaaaauuaaaau

SEQ ID NO: 2780769 - RNA, 14 nt, Leptospira interrogans serovar lai str. 56601
guaaaauuaaaucu

SEQ ID NO: 2780770 - RNA, 13 nt, Leptospira interrogans serovar lai str. 56601
guaaaauuuagau

SEQ ID NO: 2780771 - RNA, 14 nt, Leptospira interrogans serovar lai str. 56601
guaaaauuuagauu

SEQ ID NO: 2780772 - RNA, 21 nt, Leptospira interrogans serovar lai str. 56601
guaaaauuuagauuuguguua

SEQ ID NO: 2780773 - RNA, 16 nt, Leptospira interrogans serovar lai str. 56601
guaaacgguaaaagga

SEQ ID NO: 2780774 - RNA, 16 nt, Leptospira interrogans serovar lai str. 56601
guaaacuacuaaaucu

SEQ ID NO: 2780775 - RNA, 22 nt, Leptospira interrogans serovar lai str. 56601
guaaagacgauccuuuuuugua

SEQ ID NO: 2780776 - RNA, 20 nt, Leptospira interrogans serovar lai str. 56601
guaguuccuacaaauuaaau

SEQ ID NO: 2780777 - RNA, 17 nt, Leptospira interrogans serovar lai str. 56601
guaguuccuacauuuuu

SEQ ID NO: 2780778 - RNA, 21 nt, Leptospira interrogans serovar lai str. 56601
guaguucucacagaaauauau

SEQ ID NO: 2780779 - RNA, 14 nt, Leptospira interrogans serovar lai str. 56601
guaguuuauuuuuc

SEQ ID NO: 2780780 - RNA, 19 nt, Leptospira interrogans serovar lai str. 56601
guaguuuauuuuucuuuua

SEQ ID NO: 2780781 - RNA, 20 nt, Leptospira interrogans serovar lai str. 56601
guaguuucgccaaucuccau

SEQ ID NO: 2780782 - RNA, 23 nt, Leptospira interrogans serovar lai str. 56601
guaguuuucacuaauugugucgu

SEQ ID NO: 2780783 - RNA, 13 nt, Leptospira interrogans serovar lai str. 56601
guauaaaaacggu

SEQ ID NO: 2780784 - RNA, 18 nt, Leptospira interrogans serovar lai str. 56601
guauaaaagaaacauaau

SEQ ID NO: 2780785 - RNA, 13 nt, Leptospira interrogans serovar lai str. 56601
guauacuuuaaaa

SEQ ID NO: 2780786 - RNA, 15 nt, Leptospira interrogans serovar lai str. 56601
guauagaaaccgauu

SEQ ID NO: 2780787 - RNA, 18 nt, Leptospira interrogans serovar lai str. 56601
guauauauuaaaguauua

SEQ ID NO: 2780788 - RNA, 13 nt, Leptospira interrogans serovar lai str. 56601
guaucaaaccuuu

SEQ ID NO: 2780789 - RNA, 16 nt, Leptospira interrogans serovar lai str. 56601
guaucaauagaaauac

SEQ ID NO: 2780790 - RNA, 13 nt, Leptospira interrogans serovar lai str. 56601
guaucagaaucaa

SEQ ID NO: 2780791 - RNA, 20 nt, Leptospira interrogans serovar lai str. 56601
guaucagaaucaaaggaaau

SEQ ID NO: 2780792 - RNA, 21 nt, Leptospira interrogans serovar lai str. 56601
guaucauaaguuuugauagaa

SEQ ID NO: 2780793 - RNA, 20 nt, Leptospira interrogans serovar lai str. 56601
guauccaucguaucuuucaa

SEQ ID NO: 2780794 - RNA, 14 nt, Leptospira interrogans serovar lai str. 56601
guauccuuaaaaug

SEQ ID NO: 2780795 - RNA, 11 nt, Leptospira interrogans serovar lai str. 56601
guaugaaaacg

SEQ ID NO: 2780796 - RNA, 15 nt, Leptospira interrogans serovar lai str. 56601
guaugaguuccuaca

SEQ ID NO: 2780797 - RNA, 17 nt, Leptospira interrogans serovar lai str. 56601
guaugcaggaaacauac

SEQ ID NO: 2780798 - RNA, 18 nt, Leptospira interrogans serovar lai str. 56601
guaugugguaguucccac

SEQ ID NO: 2780799 - RNA, 22 nt, Leptospira interrogans serovar lai str. 56601
guauguuuacuugaaaauaaaa

SEQ ID NO: 2780800 - RNA, 23 nt, Leptospira interrogans serovar lai str. 56601
guauguuuuucugauagagaaaa

SEQ ID NO: 2780801 - RNA, 11 nt, Leptospira interrogans serovar lai str. 56601
guauuauaaac

SEQ ID NO: 2780802 - RNA, 16 nt, Leptospira interrogans serovar lai str. 56601
guauuauuuuccuuua

SEQ ID NO: 2780803 - RNA, 20 nt, Leptospira interrogans serovar lai str. 56601
guauuccaugguuuuuucaa

SEQ ID NO: 2780804 - RNA, 15 nt, Leptospira interrogans serovar lai str. 56601
guauucuagaauaua

SEQ ID NO: 2780805 - RNA, 16 nt, Leptospira interrogans serovar lai str. 56601
guauucuagaauauaa

SEQ ID NO: 2780806 - RNA, 19 nt, Leptospira interrogans serovar lai str. 56601
guauucucccccaacugaa

SEQ ID NO: 2780807 - RNA, 15 nt, Leptospira interrogans serovar lai str. 56601
guauucuuaauagaa

SEQ ID NO: 2780808 - RNA, 15 nt, Leptospira interrogans serovar lai str. 56601
guauugaaauagaau

SEQ ID NO: 2780809 - RNA, 15 nt, Leptospira interrogans serovar lai str. 56601
guauuguuaagauaa

SEQ ID NO: 2780810 - RNA, 21 nt, Leptospira interrogans serovar lai str. 56601
guauuuagcgcuuauugcaaa

SEQ ID NO: 2780811 - RNA, 14 nt, Leptospira interrogans serovar lai str. 56601
guauuuauuauaua

SEQ ID NO: 2780812 - RNA, 15 nt, Leptospira interrogans serovar lai str. 56601
guauuuauuauauaa

SEQ ID NO: 2780813 - RNA, 20 nt, Leptospira interrogans serovar lai str. 56601
guauuuccacuacaaucacu

SEQ ID NO: 2780814 - RNA, 14 nt, Leptospira interrogans serovar lai str. 56601
guauuuuaaacaaa

SEQ ID NO: 2780815 - RNA, 16 nt, Leptospira interrogans serovar lai str. 56601
guauuuuacgauucaa

SEQ ID NO: 2780816 - RNA, 14 nt, Leptospira interrogans serovar lai str. 56601
guauuuuagaaaua

SEQ ID NO: 2780817 - RNA, 13 nt, Leptospira interrogans serovar lai str. 56601
guauuuuagagaa

SEQ ID NO: 2780818 - RNA, 19 nt, Leptospira interrogans serovar lai str. 56601
guauuuuagagaaacuuua

SEQ ID NO: 2780819 - RNA, 15 nt, Leptospira interrogans serovar lai str. 56601
guauuuugcacugaa

SEQ ID NO: 2780820 - RNA, 17 nt, Leptospira interrogans serovar lai str. 56601
guauuuuuaagauaaau

SEQ ID NO: 2780821 - RNA, 12 nt, Leptospira interrogans serovar lai str. 56601
gucaaaauuuug

SEQ ID NO: 2780822 - RNA, 19 nt, Leptospira interrogans serovar lai str. 56601
gucaaacacucuaaaucuu

SEQ ID NO: 2780823 - RNA, 20 nt, Leptospira interrogans serovar lai str. 56601
gucaaaggagaaggauaaag

SEQ ID NO: 2780824 - RNA, 20 nt, Leptospira interrogans serovar lai str. 56601
gucaaaucaucuaucuuuuc

SEQ ID NO: 2780825 - RNA, 16 nt, Leptospira interrogans serovar lai str. 56601
gucaagauuauuuuug

SEQ ID NO: 2780826 - RNA, 15 nt, Leptospira interrogans serovar lai str. 56601
gucaagcagauuugu

SEQ ID NO: 2780827 - RNA, 13 nt, Leptospira interrogans serovar lai str. 56601
gucaagcccuccc

SEQ ID NO: 2780828 - RNA, 23 nt, Leptospira interrogans serovar lai str. 56601
gucaagcccucccguuauuuuuu

SEQ ID NO: 2780829 - RNA, 13 nt, Leptospira interrogans serovar lai str. 56601
gucaagcccuccu

SEQ ID NO: 2780830 - RNA, 21 nt, Leptospira interrogans serovar lai str. 56601
gucaagcgacgauagaagcga

SEQ ID NO: 2780831 - RNA, 16 nt, Leptospira interrogans serovar lai str. 56601
gucaaugguugcaaaa

SEQ ID NO: 2780832 - RNA, 18 nt, Leptospira interrogans serovar lai str. 56601
gucaaugguugcaaaaaa

SEQ ID NO: 2780833 - RNA, 23 nt, Leptospira interrogans serovar lai str. 56601
gucaauuaaauuguaugaaagaa

SEQ ID NO: 2780834 - RNA, 18 nt, Leptospira interrogans serovar lai str. 56601
gucacauuugauaauucg

SEQ ID NO: 2780835 - RNA, 19 nt, Leptospira interrogans serovar lai str. 56601
gucauuucaguucugagac

SEQ ID NO: 2780836 - RNA, 18 nt, Leptospira interrogans serovar lai str. 56601
gucauuuugauaauuuca

SEQ ID NO: 2780837 - RNA, 18 nt, Leptospira interrogans serovar lai str. 56601
guccaaaucaaaaaaguc

SEQ ID NO: 2780838 - RNA, 14 nt, Leptospira interrogans serovar lai str. 56601
guccaauuuuaaaa

SEQ ID NO: 2780839 - RNA, 14 nt, Leptospira interrogans serovar lai str. 56601
guccacccaaaccg

SEQ ID NO: 2780840 - RNA, 15 nt, Leptospira interrogans serovar lai str. 56601
guccacccaaaccgg

SEQ ID NO: 2780841 - RNA, 14 nt, Leptospira interrogans serovar lai str. 56601
gucccaaaauuucu

SEQ ID NO: 2780842 - RNA, 15 nt, Leptospira interrogans serovar lai str. 56601
gucccacauuuuugu

SEQ ID NO: 2780843 - RNA, 15 nt, Leptospira interrogans serovar lai str. 56601
gucccguauaaaagu

SEQ ID NO: 2780844 - RNA, 17 nt, Leptospira interrogans serovar lai str. 56601
guccggguuagaaucaa

SEQ ID NO: 2780845 - RNA, 14 nt, Leptospira interrogans serovar lai str. 56601
guccuuuuuuucuu

SEQ ID NO: 2780846 - RNA, 18 nt, Leptospira interrogans serovar lai str. 56601
gucgaucuacuaaaucag

SEQ ID NO: 2780847 - RNA, 22 nt, Leptospira interrogans serovar lai str. 56601
gucgcaacacacacuuuauaaa

SEQ ID NO: 2780848 - RNA, 20 nt, Leptospira interrogans serovar lai str. 56601
gucgcaacauaauguuucaa

SEQ ID NO: 2780849 - RNA, 22 nt, Leptospira interrogans serovar lai str. 56601
gucgcacccccgucuacuuuua

SEQ ID NO: 2780850 - RNA, 21 nt, Leptospira interrogans serovar lai str. 56601
gucgcuaaacucauuuuaaac

SEQ ID NO: 2780851 - RNA, 13 nt, Leptospira interrogans serovar lai str. 56601
gucgcucugugaa

SEQ ID NO: 2780852 - RNA, 19 nt, Leptospira interrogans serovar lai str. 56601
gucgcucugugaaacucag

SEQ ID NO: 2780853 - RNA, 23 nt, Leptospira interrogans serovar lai str. 56601
gucggaucauaauccuaugaaaa

SEQ ID NO: 2780854 - RNA, 18 nt, Leptospira interrogans serovar lai str. 56601
gucuaagggaauuugaau

SEQ ID NO: 2780855 - RNA, 12 nt, Leptospira interrogans serovar lai str. 56601
gucuacagauaa

SEQ ID NO: 2780856 - RNA, 14 nt, Leptospira interrogans serovar lai str. 56601
gucuacuuuuaaaa

SEQ ID NO: 2780857 - RNA, 17 nt, Leptospira interrogans serovar lai str. 56601
gucuauaaaauucaaaa

SEQ ID NO: 2780858 - RNA, 22 nt, Leptospira interrogans serovar lai str. 56601
gucuauaaaauucaaaaagaau

SEQ ID NO: 2780859 - RNA, 23 nt, Leptospira interrogans serovar lai str. 56601
guuaauuuuuauuggaaaaaguc

SEQ ID NO: 2780860 - RNA, 16 nt, Leptospira interrogans serovar lai str. 56601
guuacauaaguuguua

SEQ ID NO: 2780861 - RNA, 21 nt, Leptospira interrogans serovar lai str. 56601
guuacauaaguuguuauaaac

SEQ ID NO: 2780862 - RNA, 17 nt, Leptospira interrogans serovar lai str. 56601
guuaccuagaggagcca

SEQ ID NO: 2780863 - RNA, 16 nt, Leptospira interrogans serovar lai str. 56601
guuacgcugaguuuga

SEQ ID NO: 2780864 - RNA, 15 nt, Leptospira interrogans serovar lai str. 56601
guuacucauuuccau

SEQ ID NO: 2780865 - RNA, 19 nt, Leptospira interrogans serovar lai str. 56601
guuacucgucuuuauaaag

SEQ ID NO: 2780866 - RNA, 18 nt, Leptospira interrogans serovar lai str. 56601
guuaguucccacaaauua

SEQ ID NO: 2780867 - RNA, 23 nt, Leptospira interrogans serovar lai str. 56601
guuaguucccacauuuuugugaa

SEQ ID NO: 2780868 - RNA, 12 nt, Leptospira interrogans serovar lai str. 56601
guuauaaaccaa

SEQ ID NO: 2780869 - RNA, 17 nt, Leptospira interrogans serovar lai str. 56601
guuauaacguagauuac

SEQ ID NO: 2780870 - RNA, 17 nt, Leptospira interrogans serovar lai str. 56601
guuauaauucuuuaaaa

SEQ ID NO: 2780871 - RNA, 13 nt, Leptospira interrogans serovar lai str. 56601
guuauaauuucuu

SEQ ID NO: 2780872 - RNA, 17 nt, Leptospira interrogans serovar lai str. 56601
guuauacaauauuucgu

SEQ ID NO: 2780873 - RNA, 15 nt, Leptospira interrogans serovar lai str. 56601
guuauaguaaaagaa

SEQ ID NO: 2780874 - RNA, 17 nt, Leptospira interrogans serovar lai str. 56601
guuauaguaguucccac

SEQ ID NO: 2780875 - RNA, 14 nt, Leptospira interrogans serovar lai str. 56601
guuauauauuuuua

SEQ ID NO: 2780876 - RNA, 12 nt, Leptospira interrogans serovar lai str. 56601
guuauauuaaaa

SEQ ID NO: 2780877 - RNA, 14 nt, Leptospira interrogans serovar lai str. 56601
guuaucaguaguua

SEQ ID NO: 2780878 - RNA, 14 nt, Leptospira interrogans serovar lai str. 56601
guuaucauaaaaau

SEQ ID NO: 2780879 - RNA, 15 nt, Leptospira interrogans serovar lai str. 56601
guuaucgcuaauaca

SEQ ID NO: 2780880 - RNA, 18 nt, Leptospira interrogans serovar lai str. 56601
guuaucggcacuuuuguu

SEQ ID NO: 2780881 - RNA, 14 nt, Leptospira interrogans serovar lai str. 56601
guuaucuucgaaau

SEQ ID NO: 2780882 - RNA, 19 nt, Leptospira interrogans serovar lai str. 56601
guuaugaauaaaaaauuuc

SEQ ID NO: 2780883 - RNA, 17 nt, Leptospira interrogans serovar lai str. 56601
guuaugauauaauauac

SEQ ID NO: 2780884 - RNA, 15 nt, Leptospira interrogans serovar lai str. 56601
guuauggaauuuuuc

SEQ ID NO: 2780885 - RNA, 17 nt, Leptospira interrogans serovar lai str. 56601
guuauguuuuaaaacac

SEQ ID NO: 2780886 - RNA, 22 nt, Leptospira interrogans serovar lai str. 56601
guuauuaaaaucuaucucaaaa

SEQ ID NO: 2780887 - RNA, 14 nt, Leptospira interrogans serovar lai str. 56601
guuauuaaaauuuc

SEQ ID NO: 2780888 - RNA, 17 nt, Leptospira interrogans serovar lai str. 56601
guuauuaauuauauucu

SEQ ID NO: 2780889 - RNA, 20 nt, Leptospira interrogans serovar lai str. 56601
guuauuauuuaacaugaguu

SEQ ID NO: 2780890 - RNA, 21 nt, Leptospira interrogans serovar lai str. 56601
guuauuauuuuuguuaaacaa

SEQ ID NO: 2780891 - RNA, 22 nt, Leptospira interrogans serovar lai str. 56601
guuauuauuuuuguuaaacaac

SEQ ID NO: 2780892 - RNA, 13 nt, Leptospira interrogans serovar lai str. 56601
guuauuucuuuca

SEQ ID NO: 2780893 - RNA, 21 nt, Leptospira interrogans serovar lai str. 56601
guuauuucuuucaaaaauuua

SEQ ID NO: 2780894 - RNA, 14 nt, Leptospira interrogans serovar lai str. 56601
guucaaaaaaagga

SEQ ID NO: 2780895 - RNA, 13 nt, Leptospira interrogans serovar lai str. 56601
guucaaacaacaa

SEQ ID NO: 2780896 - RNA, 22 nt, Leptospira interrogans serovar lai str. 56601
guucaaauggccucuugcuaau

SEQ ID NO: 2780897 - RNA, 24 nt, Leptospira interrogans serovar lai str. 56601
guucaacaaacaaauagaaauaac

SEQ ID NO: 2780898 - RNA, 15 nt, Leptospira interrogans serovar lai str. 56601
guucaacuuuccuuu

SEQ ID NO: 2780899 - RNA, 15 nt, Leptospira interrogans serovar lai str. 56601
guucagcuagaaaag

SEQ ID NO: 2780900 - RNA, 16 nt, Leptospira interrogans serovar lai str. 56601
guucagguaguaguug

SEQ ID NO: 2780901 - RNA, 19 nt, Leptospira interrogans serovar lai str. 56601
guucaucguuccaaacccu

SEQ ID NO: 2780902 - RNA, 12 nt, Leptospira interrogans serovar lai str. 56601
guucaucuucuc

SEQ ID NO: 2780903 - RNA, 20 nt, Leptospira interrogans serovar lai str. 56601
guucaucuucucguucggaa

SEQ ID NO: 2780904 - RNA, 18 nt, Leptospira interrogans serovar lai str. 56601
guucauucauccuaagaa

SEQ ID NO: 2780905 - RNA, 13 nt, Leptospira interrogans serovar lai str. 56601
guuccaaaacuaa

SEQ ID NO: 2780906 - RNA, 13 nt, Leptospira interrogans serovar lai str. 56601
guuccaaacccug

SEQ ID NO: 2780907 - RNA, 13 nt, Leptospira interrogans serovar lai str. 56601
guuccaaagccaa

SEQ ID NO: 2780908 - RNA, 21 nt, Leptospira interrogans serovar lai str. 56601
guuccaaaguuauugaauaga

SEQ ID NO: 2780909 - RNA, 17 nt, Leptospira interrogans serovar lai str. 56601
guuccaacguaccaaaa

SEQ ID NO: 2780910 - RNA, 16 nt, Leptospira interrogans serovar lai str. 56601
guuccaauuaacaaaa

SEQ ID NO: 2780911 - RNA, 18 nt, Leptospira interrogans serovar lai str. 56601
guuccaauuaacaaaacu

SEQ ID NO: 2780912 - RNA, 18 nt, Leptospira interrogans serovar lai str. 56601
guuccacauuuauuuuua

SEQ ID NO: 2780913 - RNA, 23 nt, Leptospira interrogans serovar lai str. 56601
guuccacauuuuaaagguugagc

SEQ ID NO: 2780914 - RNA, 19 nt, Leptospira interrogans serovar lai str. 56601
guucccacaaauuccaauu

SEQ ID NO: 2780915 - RNA, 23 nt, Leptospira interrogans serovar lai str. 56601
guucccacauuuuaagaaucgau

SEQ ID NO: 2780916 - RNA, 15 nt, Leptospira interrogans serovar lai str. 56601
guucccauuggacgg

SEQ ID NO: 2780917 - RNA, 15 nt, Leptospira interrogans serovar lai str. 56601
guucccguuuagaaa

SEQ ID NO: 2780918 - RNA, 19 nt, Leptospira interrogans serovar lai str. 56601
guuccgaaaggaaaagaaa

SEQ ID NO: 2780919 - RNA, 22 nt, Leptospira interrogans serovar lai str. 56601
guuccgacaagaaugagucuuu

SEQ ID NO: 2780920 - RNA, 18 nt, Leptospira interrogans serovar lai str. 56601
guuccgauacgaguaaaa

SEQ ID NO: 2780921 - RNA, 16 nt, Leptospira interrogans serovar lai str. 56601
guuccuaaaaaauaaa

SEQ ID NO: 2780922 - RNA, 21 nt, Leptospira interrogans serovar lai str. 56601
guuccuauaaauucauaaccu

SEQ ID NO: 2780923 - RNA, 16 nt, Leptospira interrogans serovar lai str. 56601
guuccuguggaaacgu

SEQ ID NO: 2780924 - RNA, 21 nt, Leptospira interrogans serovar lai str. 56601
guuccuguggaaacguccaac

SEQ ID NO: 2780925 - RNA, 21 nt, Leptospira interrogans serovar lai str. 56601
guuccuuaaauauaucuucuu

SEQ ID NO: 2780926 - RNA, 15 nt, Leptospira interrogans serovar lai str. 56601
guuccuuugaauaaa

SEQ ID NO: 2780927 - RNA, 19 nt, Leptospira interrogans serovar lai str. 56601
guucgacauaagaaagaau

SEQ ID NO: 2780928 - RNA, 14 nt, Leptospira interrogans serovar lai str. 56601
guucgauuaaaaua

SEQ ID NO: 2780929 - RNA, 15 nt, Leptospira interrogans serovar lai str. 56601
guucgauuaaaauaa

SEQ ID NO: 2780930 - RNA, 22 nt, Leptospira interrogans serovar lai str. 56601
guucgccuacacuguguucuuu

SEQ ID NO: 2780931 - RNA, 16 nt, Leptospira interrogans serovar lai str. 56601
guucgcguuaauauaa

SEQ ID NO: 2780932 - RNA, 20 nt, Leptospira interrogans serovar lai str. 56601
guucggaagauuuuucaauc

SEQ ID NO: 2780933 - RNA, 12 nt, Leptospira interrogans serovar lai str. 56601
guucguaugagu

SEQ ID NO: 2780934 - RNA, 14 nt, Leptospira interrogans serovar lai str. 56601
guucguaugaguuc

SEQ ID NO: 2780935 - RNA, 16 nt, Leptospira interrogans serovar lai str. 56601
guucguggagaaaacg

SEQ ID NO: 2780936 - RNA, 14 nt, Leptospira interrogans serovar lai str. 56601
guucuaaaaacuca

SEQ ID NO: 2780937 - RNA, 19 nt, Leptospira interrogans serovar lai str. 56601
guucuaaccggaauuucca

SEQ ID NO: 2780938 - RNA, 15 nt, Leptospira interrogans serovar lai str. 56601
guucuaagaaucuug

SEQ ID NO: 2780939 - RNA, 18 nt, Leptospira interrogans serovar lai str. 56601
guucuaauguuguuaaau

SEQ ID NO: 2780940 - RNA, 22 nt, Leptospira interrogans serovar lai str. 56601
guucuaauguuguuaaauuuuu

SEQ ID NO: 2780941 - RNA, 17 nt, Leptospira interrogans serovar lai str. 56601
guucuacugaguuucaa

SEQ ID NO: 2780942 - RNA, 21 nt, Leptospira interrogans serovar lai str. 56601
guuucguucuuuuuuccuucu

SEQ ID NO: 2780943 - RNA, 16 nt, Leptospira interrogans serovar lai str. 56601
guuucuaaaaaaauua

SEQ ID NO: 2780944 - RNA, 22 nt, Leptospira interrogans serovar lai str. 56601
guuucuaaguguaaaauuaaaa

SEQ ID NO: 2780945 - RNA, 23 nt, Leptospira interrogans serovar lai str. 56601
guuucuaauuuucuuguuuaaau

SEQ ID NO: 2780946 - RNA, 19 nt, Leptospira interrogans serovar lai str. 56601
guuucuacucggaaauuua

SEQ ID NO: 2780947 - RNA, 15 nt, Leptospira interrogans serovar lai str. 56601
guuucuauaaaacaa

SEQ ID NO: 2780948 - RNA, 18 nt, Leptospira interrogans serovar lai str. 56601
guuucucauuuuauuuuu

SEQ ID NO: 2780949 - RNA, 19 nt, Leptospira interrogans serovar lai str. 56601
guuucucauuuuauuuuua

SEQ ID NO: 2780950 - RNA, 22 nt, Leptospira interrogans serovar lai str. 56601
guuucuccacuuaaaaaguuuu

SEQ ID NO: 2780951 - RNA, 21 nt, Leptospira interrogans serovar lai str. 56601
guuucuccggcgaccuuucua

SEQ ID NO: 2780952 - RNA, 15 nt, Leptospira interrogans serovar lai str. 56601
guuucugaggaauua

SEQ ID NO: 2780953 - RNA, 19 nt, Leptospira interrogans serovar lai str. 56601
guuucuguuugaugaaaua

SEQ ID NO: 2780954 - RNA, 20 nt, Leptospira interrogans serovar lai str. 56601
guuucuuauaucaaacuuau

SEQ ID NO: 2780955 - RNA, 18 nt, Leptospira interrogans serovar lai str. 56601
guuucuucggauucacaa

SEQ ID NO: 2780956 - RNA, 18 nt, Leptospira interrogans serovar lai str. 56601
guuucuugugucaagccc

SEQ ID NO: 2780957 - RNA, 21 nt, Leptospira interrogans serovar lai str. 56601
guuucuugugucaagcccucc

SEQ ID NO: 2780958 - RNA, 14 nt, Leptospira interrogans serovar lai str. 56601
guuucuuuuguaaa

SEQ ID NO: 2780959 - RNA, 20 nt, Leptospira interrogans serovar lai str. 56601
guuugaaaaaauguaacuaa

SEQ ID NO: 2780960 - RNA, 18 nt, Leptospira interrogans serovar lai str. 56601
guuugaaacucaguaaaa

SEQ ID NO: 2780961 - RNA, 19 nt, Leptospira interrogans serovar lai str. 56601
guuugaaacucaguaaaac

SEQ ID NO: 2780962 - RNA, 18 nt, Leptospira interrogans serovar lai str. 56601
guuugaauuuuacuaaaa

SEQ ID NO: 2780963 - RNA, 17 nt, Leptospira interrogans serovar lai str. 56601
guuugaggucccacaau

SEQ ID NO: 2780964 - RNA, 13 nt, Leptospira interrogans serovar lai str. 56601
guuugaguuucuu

SEQ ID NO: 2780965 - RNA, 12 nt, Leptospira interrogans serovar lai str. 56601
guuugauacuuu

SEQ ID NO: 2780966 - RNA, 13 nt, Leptospira interrogans serovar lai str. 56601
guuugaucuuuuu

SEQ ID NO: 2780967 - RNA, 17 nt, Leptospira interrogans serovar lai str. 56601
guuugcaaguagaaguc

SEQ ID NO: 2780968 - RNA, 17 nt, Leptospira interrogans serovar lai str. 56601
guuugcaucccagaaca

SEQ ID NO: 2780969 - RNA, 19 nt, Leptospira interrogans serovar lai str. 56601
guuugcaucccagaacaaa

SEQ ID NO: 2780970 - RNA, 16 nt, Leptospira interrogans serovar lai str. 56601
guuugccauuuuuuuc

SEQ ID NO: 2780971 - RNA, 15 nt, Leptospira interrogans serovar lai str. 56601
guuugcuuuucuauc

SEQ ID NO: 2780972 - RNA, 22 nt, Leptospira interrogans serovar lai str. 56601
guuugcuuuucuaucaaaaaau

SEQ ID NO: 2780973 - RNA, 17 nt, Leptospira interrogans serovar lai str. 56601
guuugucccaaaaccuc

SEQ ID NO: 2780974 - RNA, 20 nt, Leptospira interrogans serovar lai str. 56601
guuugucuuuuucuacaagu

SEQ ID NO: 2780975 - RNA, 13 nt, Leptospira interrogans serovar lai str. 56601
guuugugagaguu

SEQ ID NO: 2780976 - RNA, 18 nt, Leptospira interrogans serovar lai str. 56601
guuugugagaguucccac

SEQ ID NO: 2780977 - RNA, 17 nt, Leptospira interrogans serovar lai str. 56601
guuuguuccaaaaccuc

SEQ ID NO: 2780978 - RNA, 20 nt, Leptospira interrogans serovar lai str. 56601
guuuuaaacgauuuaaaaga

SEQ ID NO: 2780979 - RNA, 18 nt, Leptospira interrogans serovar lai str. 56601
guuuuaaucaugugaauu

SEQ ID NO: 2780980 - RNA, 18 nt, Leptospira interrogans serovar lai str. 56601
guuuuacagccaucccac

SEQ ID NO: 2780981 - RNA, 18 nt, Leptospira interrogans serovar lai str. 56601
guuuuacuguaaaauuua

SEQ ID NO: 2780982 - RNA, 22 nt, Leptospira interrogans serovar lai str. 56601
guuuuacuguuguuaaauuuuu

SEQ ID NO: 2780983 - RNA, 16 nt, Leptospira interrogans serovar lai str. 56601
guuuuaguaaaauuua

SEQ ID NO: 2780984 - RNA, 19 nt, Leptospira interrogans serovar lai str. 56601
guuuuaguuuacaaauuga

SEQ ID NO: 2780985 - RNA, 10 nt, Leptospira interrogans serovar lai str. 56601
guuuuauaaa

SEQ ID NO: 2780986 - RNA, 21 nt, Leptospira interrogans serovar lai str. 56601
guuuuauaaaaugaaaaauua

SEQ ID NO: 2780987 - RNA, 22 nt, Leptospira interrogans serovar lai str. 56601
guuuuauagucuucaaaauuga

SEQ ID NO: 2780988 - RNA, 18 nt, Leptospira interrogans serovar lai str. 56601
guuuuauauguauuuauu

SEQ ID NO: 2780989 - RNA, 14 nt, Leptospira interrogans serovar lai str. 56601
guuuuaucaaauaa

SEQ ID NO: 2780990 - RNA, 10 nt, Leptospira interrogans serovar lai str. 56601
guuuuauucu

SEQ ID NO: 2780991 - RNA, 19 nt, Leptospira interrogans serovar lai str. 56601
guuuucauaaauacaaagu

SEQ ID NO: 2780992 - RNA, 14 nt, Leptospira interrogans serovar lai str. 56601
guuuuccauucuca

SEQ ID NO: 2780993 - RNA, 16 nt, Leptospira interrogans serovar lai str. 56601
guuuucgauuccgauc

SEQ ID NO: 2780994 - RNA, 15 nt, Leptospira interrogans serovar lai str. 56601
guuuucuacaaauaa

SEQ ID NO: 2780995 - RNA, 17 nt, Leptospira interrogans serovar lai str. 56601
guuuucuacaaauaaaa

SEQ ID NO: 2780996 - RNA, 23 nt, Leptospira interrogans serovar lai str. 56601
guuuugaagguugagcaguaaaa

SEQ ID NO: 2780997 - RNA, 19 nt, Leptospira interrogans serovar lai str. 56601
guuuugaccugccuuucuu

SEQ ID NO: 2780998 - RNA, 20 nt, Leptospira interrogans serovar lai str. 56601
guuuugagauuacaaaaaau

SEQ ID NO: 2780999 - RNA, 16 nt, Leptospira interrogans serovar lai str. 56601
guuuugagcauaaaaa

SEQ ID NO: 2781000 - RNA, 22 nt, Leptospira interrogans serovar lai str. 56601
guuuugagcauaaaaaaauauu

SEQ ID NO: 2781001 - RNA, 22 nt, Leptospira interrogans serovar lai str. 56601
guuuugcgggaacucccacaau

SEQ ID NO: 2781002 - RNA, 18 nt, Leptospira interrogans serovar lai str. 56601
guuuugcucuaaaauaau

SEQ ID NO: 2781003 - RNA, 19 nt, Leptospira interrogans serovar lai str. 56601
guuuugcucuaaaauaauu

SEQ ID NO: 2781004 - RNA, 18 nt, Leptospira interrogans serovar lai str. 56601
guuuugcuguaaaauuua

SEQ ID NO: 2781005 - RNA, 13 nt, Leptospira interrogans serovar lai str. 56601
guuuuggaaaggu

SEQ ID NO: 2781006 - RNA, 17 nt, Leptospira interrogans serovar lai str. 56601
guuuuggcucuugcuaa

SEQ ID NO: 2781007 - RNA, 23 nt, Leptospira interrogans serovar lai str. 56601
guuuuggcucuugcuaaaauuuu

SEQ ID NO: 2781008 - RNA, 18 nt, Leptospira interrogans serovar lai str. 56601
guuuugggacaaacuuua

SEQ ID NO: 2781009 - RNA, 19 nt, Leptospira interrogans serovar lai str. 56601
guuuugggacaaacuuuaa

SEQ ID NO: 2781010 - RNA, 19 nt, Leptospira interrogans serovar lai str. 56601
guuuuguuaaccaccucua

SEQ ID NO: 2781011 - RNA, 14 nt, Leptospira interrogans serovar lai str. 56601
guuuuguuuccuuc

SEQ ID NO: 2781012 - RNA, 15 nt, Leptospira interrogans serovar lai str. 56601
guuuuguuuccuucu

SEQ ID NO: 2781013 - RNA, 16 nt, Leptospira interrogans serovar lai str. 56601
guuuuguuuccuucuu

SEQ ID NO: 2781014 - RNA, 15 nt, Leptospira interrogans serovar lai str. 56601
guuuuuaaaauugug

SEQ ID NO: 2781015 - RNA, 15 nt, Leptospira interrogans serovar lai str. 56601
guuuuuaaauacucu

SEQ ID NO: 2781016 - RNA, 13 nt, Leptospira interrogans serovar lai str. 56601
guuuuuaaauuaa

SEQ ID NO: 2781017 - RNA, 17 nt, Leptospira interrogans serovar lai str. 56601
guuuuuacuaugaagac

SEQ ID NO: 2781018 - RNA, 15 nt, Leptospira interrogans serovar lai str. 56601
guuuuuagcguaaau

SEQ ID NO: 2781019 - RNA, 18 nt, Leptospira interrogans serovar lai str. 56601
guuuuuaguuacaauuua

SEQ ID NO: 2781020 - RNA, 17 nt, Leptospira interrogans serovar lai str. 56601
guuuuucaacaacucua

SEQ ID NO: 2781021 - RNA, 19 nt, Leptospira interrogans serovar lai str. 56601
guuuuucuauaaccacaag

SEQ ID NO: 2781022 - RNA, 23 nt, Leptospira interrogans serovar lai str. 56601
guuuuucugauaaagaaaaccuu

SEQ ID NO: 2781023 - RNA, 14 nt, Leptospira interrogans serovar lai str. 56601
guuuuucuugcuaa

SEQ ID NO: 2781024 - RNA, 21 nt, Leptospira interrogans serovar lai str. 56601
guuuuugaaaugcaguuucuu

SEQ ID NO: 2781025 - RNA, 16 nt, Leptospira interrogans serovar lai str. 56601
uaaaacaaaaaaacaa

SEQ ID NO: 2781026 - RNA, 13 nt, Leptospira interrogans serovar lai str. 56601
uaaaacaaaauag

SEQ ID NO: 2781027 - RNA, 15 nt, Leptospira interrogans serovar lai str. 56601
uaaaacaaaauagau

SEQ ID NO: 2781028 - RNA, 22 nt, Leptospira interrogans serovar lai str. 56601
uaaaacacaucuuaaaaacucu

SEQ ID NO: 2781029 - RNA, 23 nt, Leptospira interrogans serovar lai str. 56601
uaaaacacaucuuaaaaacucua

SEQ ID NO: 2781030 - RNA, 21 nt, Leptospira interrogans serovar lai str. 56601
uaaaacacuuuacauuuuuau

SEQ ID NO: 2781031 - RNA, 12 nt, Leptospira interrogans serovar lai str. 56601
uaaaaccaaaau

SEQ ID NO: 2781032 - RNA, 15 nt, Leptospira interrogans serovar lai str. 56601
uaaaaccaaaaugcu

SEQ ID NO: 2781033 - RNA, 20 nt, Leptospira interrogans serovar lai str. 56601
uaaaacccaucguaaacaaa

SEQ ID NO: 2781034 - RNA, 22 nt, Leptospira interrogans serovar lai str. 56601
uaaaaccgaccugcagagcgac

SEQ ID NO: 2781035 - RNA, 17 nt, Leptospira interrogans serovar lai str. 56601
uaaaaccgcugaaaaaa

SEQ ID NO: 2781036 - RNA, 21 nt, Leptospira interrogans serovar lai str. 56601
uaaaaccgcugaaaaaaaaau

SEQ ID NO: 2781037 - RNA, 20 nt, Leptospira interrogans serovar lai str. 56601
uaaaaccguuuuauaaauau

SEQ ID NO: 2781038 - RNA, 12 nt, Leptospira interrogans serovar lai str. 56601
uaaaaccucaaa

SEQ ID NO: 2781039 - RNA, 23 nt, Leptospira interrogans serovar lai str. 56601
uaaaaccugauuuuucuguaaaa

SEQ ID NO: 2781040 - RNA, 24 nt, Leptospira interrogans serovar lai str. 56601
uaaaaccugauuuuucuguaaaaa

SEQ ID NO: 2781041 - RNA, 21 nt, Leptospira interrogans serovar lai str. 56601
uaaaaccuuuauuuaauaaaa

SEQ ID NO: 2781042 - RNA, 22 nt, Leptospira interrogans serovar lai str. 56601
uaaaaccuuuauuuaauaaaau

SEQ ID NO: 2781043 - RNA, 16 nt, Leptospira interrogans serovar lai str. 56601
uaaaacgaauugauaa

SEQ ID NO: 2781044 - RNA, 21 nt, Leptospira interrogans serovar lai str. 56601
uaaaacgaauugauaaaaccg

SEQ ID NO: 2781045 - RNA, 15 nt, Leptospira interrogans serovar lai str. 56601
uaaaacgcucucuac

SEQ ID NO: 2781046 - RNA, 16 nt, Leptospira interrogans serovar lai str. 56601
uaaaacggaauuuugu

SEQ ID NO: 2781047 - RNA, 20 nt, Leptospira interrogans serovar lai str. 56601
uaaaacuacccagucuccau

SEQ ID NO: 2781048 - RNA, 14 nt, Leptospira interrogans serovar lai str. 56601
uaaaacucaaagga

SEQ ID NO: 2781049 - RNA, 16 nt, Leptospira interrogans serovar lai str. 56601
uaaaacucuaaauuca

SEQ ID NO: 2781050 - RNA, 22 nt, Leptospira interrogans serovar lai str. 56601
uaaaacugaguaccguuuauuu

SEQ ID NO: 2781051 - RNA, 19 nt, Leptospira interrogans serovar lai str. 56601
uaaaacugcgguaauaccu

SEQ ID NO: 2781052 - RNA, 19 nt, Leptospira interrogans serovar lai str. 56601
uaaaacuguaaauuagauu

SEQ ID NO: 2781053 - RNA, 17 nt, Leptospira interrogans serovar lai str. 56601
uaaaacuguacaauaga

SEQ ID NO: 2781054 - RNA, 15 nt, Leptospira interrogans serovar lai str. 56601
uaaaacuguuuccag

SEQ ID NO: 2781055 - RNA, 17 nt, Leptospira interrogans serovar lai str. 56601
uaaaacuucagccgcuu

SEQ ID NO: 2781056 - RNA, 21 nt, Leptospira interrogans serovar lai str. 56601
uaaaacuucagccgcuucauc

SEQ ID NO: 2781057 - RNA, 22 nt, Leptospira interrogans serovar lai str. 56601
uaaaacuuuucuaaauugagaa

SEQ ID NO: 2781058 - RNA, 11 nt, Leptospira interrogans serovar lai str. 56601
uaaaagaaaaa

SEQ ID NO: 2781059 - RNA, 14 nt, Leptospira interrogans serovar lai str. 56601
uaaaagaaaauuau

SEQ ID NO: 2781060 - RNA, 13 nt, Leptospira interrogans serovar lai str. 56601
uaaaagaaacauu

SEQ ID NO: 2781061 - RNA, 14 nt, Leptospira interrogans serovar lai str. 56601
uaaaagaaauuuaa

SEQ ID NO: 2781062 - RNA, 15 nt, Leptospira interrogans serovar lai str. 56601
uaaaagaaauuuaau

SEQ ID NO: 2781063 - RNA, 18 nt, Leptospira interrogans serovar lai str. 56601
uaaaagaagauuuuucuu

SEQ ID NO: 2781064 - RNA, 19 nt, Leptospira interrogans serovar lai str. 56601
uaaaagaagauuuuucuuu

SEQ ID NO: 2781065 - RNA, 14 nt, Leptospira interrogans serovar lai str. 56601
uaaaagaauauuau

SEQ ID NO: 2781066 - RNA, 22 nt, Leptospira interrogans serovar lai str. 56601
uaaaagaauauuucuaaaauug

SEQ ID NO: 2781067 - RNA, 15 nt, Leptospira interrogans serovar lai str. 56601
uaaaagaccuucgga

SEQ ID NO: 2781068 - RNA, 22 nt, Leptospira interrogans serovar lai str. 56601
uaaaagagacauugaagaaaaa

SEQ ID NO: 2781069 - RNA, 23 nt, Leptospira interrogans serovar lai str. 56601
uaaaagagacauugaagaaaaaa

SEQ ID NO: 2781070 - RNA, 20 nt, Leptospira interrogans serovar lai str. 56601
uaaaagagagggucuuucga

SEQ ID NO: 2781071 - RNA, 22 nt, Leptospira interrogans serovar lai str. 56601
uaaaagauccgcuacaaauuca

SEQ ID NO: 2781072 - RNA, 12 nt, Leptospira interrogans serovar lai str. 56601
uaaaagaucuga

SEQ ID NO: 2781073 - RNA, 22 nt, Leptospira interrogans serovar lai str. 56601
uaaaagauucguuuuauaaaaa

SEQ ID NO: 2781074 - RNA, 19 nt, Leptospira interrogans serovar lai str. 56601
uaaaagccagaauuuugaa

SEQ ID NO: 2781075 - RNA, 20 nt, Leptospira interrogans serovar lai str. 56601
uaaaagccauuucaaaaaua

SEQ ID NO: 2781076 - RNA, 20 nt, Leptospira interrogans serovar lai str. 56601
uaaaagccgcgaucuaaccg

SEQ ID NO: 2781077 - RNA, 22 nt, Leptospira interrogans serovar lai str. 56601
uaaaagcuuauacuuuaagaaa

SEQ ID NO: 2781078 - RNA, 17 nt, Leptospira interrogans serovar lai str. 56601
uaaaaggacgggaaaau

SEQ ID NO: 2781079 - RNA, 19 nt, Leptospira interrogans serovar lai str. 56601
uaaaaggagaauucaauuu

SEQ ID NO: 2781080 - RNA, 20 nt, Leptospira interrogans serovar lai str. 56601
uaaaaggagaauucaauuua

SEQ ID NO: 2781081 - RNA, 22 nt, Leptospira interrogans serovar lai str. 56601
uaaaaggaggaucguucuccuu

SEQ ID NO: 2781082 - RNA, 19 nt, Leptospira interrogans serovar lai str. 56601
uaaaagggacguaguucuu

SEQ ID NO: 2781083 - RNA, 16 nt, Leptospira interrogans serovar lai str. 56601
uaaaaguacgaaauuc

SEQ ID NO: 2781084 - RNA, 21 nt, Leptospira interrogans serovar lai str. 56601
uaaaaguacgggcucauacau

SEQ ID NO: 2781085 - RNA, 22 nt, Leptospira interrogans serovar lai str. 56601
uaaaaguacgggcucauacauu

SEQ ID NO: 2781086 - RNA, 23 nt, Leptospira interrogans serovar lai str. 56601
uaaaaguagaaucaucucaaaaa

SEQ ID NO: 2781087 - RNA, 13 nt, Leptospira interrogans serovar lai str. 56601
uaaaaguaguagu

SEQ ID NO: 2781088 - RNA, 22 nt, Leptospira interrogans serovar lai str. 56601
uaaaaguaguagucuuacaauu

SEQ ID NO: 2781089 - RNA, 23 nt, Leptospira interrogans serovar lai str. 56601
uaaaaguguaucccuuuggcaua

SEQ ID NO: 2781090 - RNA, 15 nt, Leptospira interrogans serovar lai str. 56601
uaaaaguuugauuuc

SEQ ID NO: 2781091 - RNA, 12 nt, Leptospira interrogans serovar lai str. 56601
uaaaauaaaaaa

SEQ ID NO: 2781092 - RNA, 13 nt, Leptospira interrogans serovar lai str. 56601
uaaaauaaaauuc

SEQ ID NO: 2781093 - RNA, 13 nt, Leptospira interrogans serovar lai str. 56601
uaaaauaaacuau

SEQ ID NO: 2781094 - RNA, 14 nt, Leptospira interrogans serovar lai str. 56601
uaaaauaaacuauc

SEQ ID NO: 2781095 - RNA, 15 nt, Leptospira interrogans serovar lai str. 56601
uaaaauaaaguaucc

SEQ ID NO: 2781096 - RNA, 12 nt, Leptospira interrogans serovar lai str. 56601
uaaaauaaauuu

SEQ ID NO: 2781097 - RNA, 14 nt, Leptospira interrogans serovar lai str. 56601
uaaaauaaauuuau

SEQ ID NO: 2781098 - RNA, 21 nt, Leptospira interrogans serovar lai str. 56601
uaaaauaaauuuauaauucaa

SEQ ID NO: 2781099 - RNA, 12 nt, Leptospira interrogans serovar lai str. 56601
uaaaauaagaau

SEQ ID NO: 2781100 - RNA, 19 nt, Leptospira interrogans serovar lai str. 56601
uaaaauaaugauagaaaua

SEQ ID NO: 2781101 - RNA, 18 nt, Leptospira interrogans serovar lai str. 56601
uaaaauacaguacuauau

SEQ ID NO: 2781102 - RNA, 20 nt, Leptospira interrogans serovar lai str. 56601
uaaaauacaguacuauauuu

SEQ ID NO: 2781103 - RNA, 20 nt, Leptospira interrogans serovar lai str. 56601
uaaaauaccaauaacuuaac

SEQ ID NO: 2781104 - RNA, 15 nt, Leptospira interrogans serovar lai str. 56601
uaaaauaccauaaau

SEQ ID NO: 2781105 - RNA, 17 nt, Leptospira interrogans serovar lai str. 56601
uaaaauaccauaaauuu

SEQ ID NO: 2781106 - RNA, 16 nt, Leptospira interrogans serovar lai str. 56601
uaaaauacuuuuagaa

SEQ ID NO: 2781107 - RNA, 15 nt, Leptospira interrogans serovar lai str. 56601
uaaacaaagacaaag

SEQ ID NO: 2781108 - RNA, 13 nt, Leptospira interrogans serovar lai str. 56601
uaaacaauaaaau

SEQ ID NO: 2781109 - RNA, 17 nt, Leptospira interrogans serovar lai str. 56601
uaaacaauaugaaagga

SEQ ID NO: 2781110 - RNA, 19 nt, Leptospira interrogans serovar lai str. 56601
uaaacagucgcuaaacuca

SEQ ID NO: 2781111 - RNA, 20 nt, Leptospira interrogans serovar lai str. 56601
uaaacauccaauuauaaaau

SEQ ID NO: 2781112 - RNA, 22 nt, Leptospira interrogans serovar lai str. 56601
uaaacauucaagguaauuuaua

SEQ ID NO: 2781113 - RNA, 16 nt, Leptospira interrogans serovar lai str. 56601
uaaaccaucucaaaaa

SEQ ID NO: 2781114 - RNA, 16 nt, Leptospira interrogans serovar lai str. 56601
uaaacccauuuuagaa

SEQ ID NO: 2781115 - RNA, 21 nt, Leptospira interrogans serovar lai str. 56601
uaaacccgccuuguguucauc

SEQ ID NO: 2781116 - RNA, 16 nt, Leptospira interrogans serovar lai str. 56601
uaaacccugagaauau

SEQ ID NO: 2781117 - RNA, 14 nt, Leptospira interrogans serovar lai str. 56601
uaaaccgauuuucc

SEQ ID NO: 2781118 - RNA, 20 nt, Leptospira interrogans serovar lai str. 56601
uaaaccgauuuucccaaaca

SEQ ID NO: 2781119 - RNA, 16 nt, Leptospira interrogans serovar lai str. 56601
uaaaccgcauaaaaga

SEQ ID NO: 2781120 - RNA, 20 nt, Leptospira interrogans serovar lai str. 56601
uaaaccgguaaaaaguaaaa

SEQ ID NO: 2781121 - RNA, 16 nt, Leptospira interrogans serovar lai str. 56601
uaaacgaguaguucuu

SEQ ID NO: 2781122 - RNA, 17 nt, Leptospira interrogans serovar lai str. 56601
uaaacgaucagaaaaac

SEQ ID NO: 2781123 - RNA, 18 nt, Leptospira interrogans serovar lai str. 56601
uaaacgaucagaaaaaca

SEQ ID NO: 2781124 - RNA, 23 nt, Leptospira interrogans serovar lai str. 56601
uaaacgauuauuuuuuaaaaauc

SEQ ID NO: 2781125 - RNA, 14 nt, Leptospira interrogans serovar lai str. 56601
uaaacgauuuaaaa

SEQ ID NO: 2781126 - RNA, 13 nt, Leptospira interrogans serovar lai str. 56601
uaaacguauaaaa

SEQ ID NO: 2781127 - RNA, 16 nt, Leptospira interrogans serovar lai str. 56601
uaaacguauaaaaaca

SEQ ID NO: 2781128 - RNA, 12 nt, Leptospira interrogans serovar lai str. 56601
uaaacuaaaaaa

SEQ ID NO: 2781129 - RNA, 15 nt, Leptospira interrogans serovar lai str. 56601
uaaacuaaaaaaaau

SEQ ID NO: 2781130 - RNA, 18 nt, Leptospira interrogans serovar lai str. 56601
uaaacuaaaaaaaauagg

SEQ ID NO: 2781131 - RNA, 13 nt, Leptospira interrogans serovar lai str. 56601
uaaacuacuaaau

SEQ ID NO: 2781132 - RNA, 17 nt, Leptospira interrogans serovar lai str. 56601
uaaacuagauuauugau

SEQ ID NO: 2781133 - RNA, 15 nt, Leptospira interrogans serovar lai str. 56601
uaaacuaucuauuag

SEQ ID NO: 2781134 - RNA, 16 nt, Leptospira interrogans serovar lai str. 56601
uaaacuaucuauuaga

SEQ ID NO: 2781135 - RNA, 15 nt, Leptospira interrogans serovar lai str. 56601
uaaacuauuacguaa

SEQ ID NO: 2781136 - RNA, 21 nt, Leptospira interrogans serovar lai str. 56601
uaaacuccuaggcaaauccuu

SEQ ID NO: 2781137 - RNA, 17 nt, Leptospira interrogans serovar lai str. 56601
uaaacuguaaacuugau

SEQ ID NO: 2781138 - RNA, 16 nt, Leptospira interrogans serovar lai str. 56601
uaaacugucggaauua

SEQ ID NO: 2781139 - RNA, 21 nt, Leptospira interrogans serovar lai str. 56601
uaaacuuacuaugaagucuua

SEQ ID NO: 2781140 - RNA, 14 nt, Leptospira interrogans serovar lai str. 56601
uaaacuucaaaaaa

SEQ ID NO: 2781141 - RNA, 15 nt, Leptospira interrogans serovar lai str. 56601
uaaacuucaaaaaau

SEQ ID NO: 2781142 - RNA, 21 nt, Leptospira interrogans serovar lai str. 56601
uaaacuucucuuaaaauuuag

SEQ ID NO: 2781143 - RNA, 15 nt, Leptospira interrogans serovar lai str. 56601
uaaacuugauuaaac

SEQ ID NO: 2781144 - RNA, 16 nt, Leptospira interrogans serovar lai str. 56601
uaaacuuuaaucauuu

SEQ ID NO: 2781145 - RNA, 18 nt, Leptospira interrogans serovar lai str. 56601
uaaacuuuaaucauuuuc

SEQ ID NO: 2781146 - RNA, 17 nt, Leptospira interrogans serovar lai str. 56601
uaaacuuucaaagaaua

SEQ ID NO: 2781147 - RNA, 22 nt, Leptospira interrogans serovar lai str. 56601
uaaacuuucaaagaauauaaaa

SEQ ID NO: 2781148 - RNA, 18 nt, Leptospira interrogans serovar lai str. 56601
uaaacuuuguaaaucuau

SEQ ID NO: 2781149 - RNA, 17 nt, Leptospira interrogans serovar lai str. 56601
uaaacuuuguaaauugu

SEQ ID NO: 2781150 - RNA, 14 nt, Leptospira interrogans serovar lai str. 56601
uaaacuuuuauaaa

SEQ ID NO: 2781151 - RNA, 20 nt, Leptospira interrogans serovar lai str. 56601
uaaacuuuuauaaaaucuaa

SEQ ID NO: 2781152 - RNA, 22 nt, Leptospira interrogans serovar lai str. 56601
uaaacuuuuauaaaaucuaaaa

SEQ ID NO: 2781153 - RNA, 19 nt, Leptospira interrogans serovar lai str. 56601
uaaacuuuuuugaauauag

SEQ ID NO: 2781154 - RNA, 14 nt, Leptospira interrogans serovar lai str. 56601
uaaagaaaaccaga

SEQ ID NO: 2781155 - RNA, 13 nt, Leptospira interrogans serovar lai str. 56601
uaaagaaaaggaa

SEQ ID NO: 2781156 - RNA, 14 nt, Leptospira interrogans serovar lai str. 56601
uaaagaagagccuc

SEQ ID NO: 2781157 - RNA, 16 nt, Leptospira interrogans serovar lai str. 56601
uaaagaagaguugaau

SEQ ID NO: 2781158 - RNA, 18 nt, Leptospira interrogans serovar lai str. 56601
uaaagaagaguugaauau

SEQ ID NO: 2781159 - RNA, 15 nt, Leptospira interrogans serovar lai str. 56601
uaaagaagauaaaac

SEQ ID NO: 2781160 - RNA, 16 nt, Leptospira interrogans serovar lai str. 56601
uaaagaagggaugaaa

SEQ ID NO: 2781161 - RNA, 18 nt, Leptospira interrogans serovar lai str. 56601
uaaagaagggaugaaauu

SEQ ID NO: 2781162 - RNA, 22 nt, Leptospira interrogans serovar lai str. 56601
uaaagaagggaugaaauuuuaa

SEQ ID NO: 2781163 - RNA, 22 nt, Leptospira interrogans serovar lai str. 56601
uaaagaaugaucgcauaaaauu

SEQ ID NO: 2781164 - RNA, 18 nt, Leptospira interrogans serovar lai str. 56601
uaaagaauuaucauguaa

SEQ ID NO: 2781165 - RNA, 20 nt, Leptospira interrogans serovar lai str. 56601
uaaagaauuaucauguaaaa

SEQ ID NO: 2781166 - RNA, 20 nt, Leptospira interrogans serovar lai str. 56601
uaaagaauuaucguguaaaa

SEQ ID NO: 2781167 - RNA, 18 nt, Leptospira interrogans serovar lai str. 56601
uaaagaauucauuuuucu

SEQ ID NO: 2781168 - RNA, 18 nt, Leptospira interrogans serovar lai str. 56601
uaaagaauuuuaaaucga

SEQ ID NO: 2781169 - RNA, 19 nt, Leptospira interrogans serovar lai str. 56601
uaaagaauuuuuacagaaa

SEQ ID NO: 2781170 - RNA, 16 nt, Leptospira interrogans serovar lai str. 56601
uaaagaccacaguagg

SEQ ID NO: 2781171 - RNA, 15 nt, Leptospira interrogans serovar lai str. 56601
uaaagacgauugauu

SEQ ID NO: 2781172 - RNA, 16 nt, Leptospira interrogans serovar lai str. 56601
uaaagacuuuaaauga

SEQ ID NO: 2781173 - RNA, 18 nt, Leptospira interrogans serovar lai str. 56601
uaaagagaaaacaauuca

SEQ ID NO: 2781174 - RNA, 15 nt, Leptospira interrogans serovar lai str. 56601
uaaagauuagaaaaa

SEQ ID NO: 2781175 - RNA, 14 nt, Leptospira interrogans serovar lai str. 56601
uaaagauuuccuaa

SEQ ID NO: 2781176 - RNA, 14 nt, Leptospira interrogans serovar lai str. 56601
uaaagcaaaaccua

SEQ ID NO: 2781177 - RNA, 17 nt, Leptospira interrogans serovar lai str. 56601
uaaagcaaauaccaaac

SEQ ID NO: 2781178 - RNA, 20 nt, Leptospira interrogans serovar lai str. 56601
uaaagcaaauaccaaaccuc

SEQ ID NO: 2781179 - RNA, 21 nt, Leptospira interrogans serovar lai str. 56601
uaaagcaaauaccaaaccucu

SEQ ID NO: 2781180 - RNA, 23 nt, Leptospira interrogans serovar lai str. 56601
uaaagccgaucugugauugaaca

SEQ ID NO: 2781181 - RNA, 19 nt, Leptospira interrogans serovar lai str. 56601
uaaaggaauccaugauucu

SEQ ID NO: 2781182 - RNA, 14 nt, Leptospira interrogans serovar lai str. 56601
uaaagguaaaagag

SEQ ID NO: 2781183 - RNA, 22 nt, Leptospira interrogans serovar lai str. 56601
uaaaggugcaugaaaauaauau

SEQ ID NO: 2781184 - RNA, 11 nt, Leptospira interrogans serovar lai str. 56601
uaaagguugag

SEQ ID NO: 2781185 - RNA, 22 nt, Leptospira interrogans serovar lai str. 56601
uaaagguugagcaguaaaaucu

SEQ ID NO: 2781186 - RNA, 22 nt, Leptospira interrogans serovar lai str. 56601
uaaagguugaguaguaaaaucu

SEQ ID NO: 2781187 - RNA, 15 nt, Leptospira interrogans serovar lai str. 56601
uaaagugaaucucuu

SEQ ID NO: 2781188 - RNA, 16 nt, Leptospira interrogans serovar lai str. 56601
uaaaguuaauacaaaa

SEQ ID NO: 2781189 - RNA, 19 nt, Leptospira interrogans serovar lai str. 56601
uaaaguucuuuucuuaaaa

SEQ ID NO: 2781190 - RNA, 17 nt, Leptospira interrogans serovar lai str. 56601
uaaauugcaucaaagaa

SEQ ID NO: 2781191 - RNA, 20 nt, Leptospira interrogans serovar lai str. 56601
uaaauuggguaucuaaauau

SEQ ID NO: 2781192 - RNA, 23 nt, Leptospira interrogans serovar lai str. 56601
uaaauuguauaaaagaaacauaa

SEQ ID NO: 2781193 - RNA, 23 nt, Leptospira interrogans serovar lai str. 56601
uaaauuguaugcaggaaacauaa

SEQ ID NO: 2781194 - RNA, 20 nt, Leptospira interrogans serovar lai str. 56601
uaaauuguaugcaguuguga

SEQ ID NO: 2781195 - RNA, 20 nt, Leptospira interrogans serovar lai str. 56601
uaaauuguucguuucuuaau

SEQ ID NO: 2781196 - RNA, 19 nt, Leptospira interrogans serovar lai str. 56601
uaaauuguuucauaaaauu

SEQ ID NO: 2781197 - RNA, 13 nt, Leptospira interrogans serovar lai str. 56601
uaaauuuaaaaaa

SEQ ID NO: 2781198 - RNA, 14 nt, Leptospira interrogans serovar lai str. 56601
uaaauuuaaaugua

SEQ ID NO: 2781199 - RNA, 15 nt, Leptospira interrogans serovar lai str. 56601
uaaauuuaaauguau

SEQ ID NO: 2781200 - RNA, 21 nt, Leptospira interrogans serovar lai str. 56601
uaaauuuaaauguucaaauuc

SEQ ID NO: 2781201 - RNA, 18 nt, Leptospira interrogans serovar lai str. 56601
uaaauuuacuauuuugau

SEQ ID NO: 2781202 - RNA, 17 nt, Leptospira interrogans serovar lai str. 56601
uaaauuuauaaauguag

SEQ ID NO: 2781203 - RNA, 16 nt, Leptospira interrogans serovar lai str. 56601
uaaauuuauaauucaa

SEQ ID NO: 2781204 - RNA, 18 nt, Leptospira interrogans serovar lai str. 56601
uaaauuuaucuauaaaau

SEQ ID NO: 2781205 - RNA, 14 nt, Leptospira interrogans serovar lai str. 56601
uaaauuugcuuuaa

SEQ ID NO: 2781206 - RNA, 19 nt, Leptospira interrogans serovar lai str. 56601
uaaauuugcuuuaagugaa

SEQ ID NO: 2781207 - RNA, 20 nt, Leptospira interrogans serovar lai str. 56601
uaaauuugugguaguuccua

SEQ ID NO: 2781208 - RNA, 23 nt, Leptospira interrogans serovar lai str. 56601
uaaauuuuaauauuauuaaauuu

SEQ ID NO: 2781209 - RNA, 20 nt, Leptospira interrogans serovar lai str. 56601
uaaauuuuacaauuaaacuu

SEQ ID NO: 2781210 - RNA, 13 nt, Leptospira interrogans serovar lai str. 56601
uaaauuuuauaaa

SEQ ID NO: 2781211 - RNA, 14 nt, Leptospira interrogans serovar lai str. 56601
uaaauuuuauaaaa

SEQ ID NO: 2781212 - RNA, 23 nt, Leptospira interrogans serovar lai str. 56601
uaaauuuucagugaauaaaauaa

SEQ ID NO: 2781213 - RNA, 20 nt, Leptospira interrogans serovar lai str. 56601
uaaauuuuuaaaaguagaau

SEQ ID NO: 2781214 - RNA, 15 nt, Leptospira interrogans serovar lai str. 56601
uaaauuuuuauaaaa

SEQ ID NO: 2781215 - RNA, 14 nt, Leptospira interrogans serovar lai str. 56601
uaaauuuuuauacu

SEQ ID NO: 2781216 - RNA, 13 nt, Leptospira interrogans serovar lai str. 56601
uaaauuuuuauua

SEQ ID NO: 2781217 - RNA, 22 nt, Leptospira interrogans serovar lai str. 56601
uaaauuuuuauugcaaauccua

SEQ ID NO: 2781218 - RNA, 13 nt, Leptospira interrogans serovar lai str. 56601
uaaauuuuuuaga

SEQ ID NO: 2781219 - RNA, 20 nt, Leptospira interrogans serovar lai str. 56601
uaaauuuuuuagaaaucaau

SEQ ID NO: 2781220 - RNA, 17 nt, Leptospira interrogans serovar lai str. 56601
uaaauuuuuugcaaaaa

SEQ ID NO: 2781221 - RNA, 20 nt, Leptospira interrogans serovar lai str. 56601
uaaauuuuuugcaaaaaaau

SEQ ID NO: 2781222 - RNA, 16 nt, Leptospira interrogans serovar lai str. 56601
uaaauuuuuuggaaau

SEQ ID NO: 2781223 - RNA, 22 nt, Leptospira interrogans serovar lai str. 56601
uaaauuuuuuggaaaucgaaaa

SEQ ID NO: 2781224 - RNA, 19 nt, Leptospira interrogans serovar lai str. 56601
uaacaaaaaaugcucaaaa

SEQ ID NO: 2781225 - RNA, 13 nt, Leptospira interrogans serovar lai str. 56601
uaacaaaaauacu

SEQ ID NO: 2781226 - RNA, 18 nt, Leptospira interrogans serovar lai str. 56601
uaacaaaacugcuucaau

SEQ ID NO: 2781227 - RNA, 23 nt, Leptospira interrogans serovar lai str. 56601
uaacaaaacugcuucaauugucc

SEQ ID NO: 2781228 - RNA, 13 nt, Leptospira interrogans serovar lai str. 56601
uaacaaaaugauu

SEQ ID NO: 2781229 - RNA, 18 nt, Leptospira interrogans serovar lai str. 56601
uaacaaaguauuuaauuu

SEQ ID NO: 2781230 - RNA, 15 nt, Leptospira interrogans serovar lai str. 56601
uaacaacauuagaau

SEQ ID NO: 2781231 - RNA, 21 nt, Leptospira interrogans serovar lai str. 56601
uaacaaccaccuuuacauaau

SEQ ID NO: 2781232 - RNA, 11 nt, Leptospira interrogans serovar lai str. 56601
uaacaacucua

SEQ ID NO: 2781233 - RNA, 21 nt, Leptospira interrogans serovar lai str. 56601
uaacaauagcuuaaaagugau

SEQ ID NO: 2781234 - RNA, 17 nt, Leptospira interrogans serovar lai str. 56601
uaacaaucaauugaaag

SEQ ID NO: 2781235 - RNA, 17 nt, Leptospira interrogans serovar lai str. 56601
uaacagauuaaauguau

SEQ ID NO: 2781236 - RNA, 16 nt, Leptospira interrogans serovar lai str. 56601
uaacaguaagaagaaa

SEQ ID NO: 2781237 - RNA, 17 nt, Leptospira interrogans serovar lai str. 56601
uaacaguucucacagau

SEQ ID NO: 2781238 - RNA, 15 nt, Leptospira interrogans serovar lai str. 56601
uaacaucaaagaauc

SEQ ID NO: 2781239 - RNA, 23 nt, Leptospira interrogans serovar lai str. 56601
uaacaucggaaacgcaaugucuc

SEQ ID NO: 2781240 - RNA, 17 nt, Leptospira interrogans serovar lai str. 56601
uaacaucuugaaacccc

SEQ ID NO: 2781241 - RNA, 18 nt, Leptospira interrogans serovar lai str. 56601
uaacaucuugaaacccca

SEQ ID NO: 2781242 - RNA, 15 nt, Leptospira interrogans serovar lai str. 56601
uaacaugcaguaguu

SEQ ID NO: 2781243 - RNA, 19 nt, Leptospira interrogans serovar lai str. 56601
uaacauuuguuuuuuauaa

SEQ ID NO: 2781244 - RNA, 18 nt, Leptospira interrogans serovar lai str. 56601
uaacauuuuauuauaaau

SEQ ID NO: 2781245 - RNA, 22 nt, Leptospira interrogans serovar lai str. 56601
uaacauuuuauuauaaauuuau

SEQ ID NO: 2781246 - RNA, 23 nt, Leptospira interrogans serovar lai str. 56601
uaacauuuuauuauaaauuuaua

SEQ ID NO: 2781247 - RNA, 16 nt, Leptospira interrogans serovar lai str. 56601
uaaccaaccccacaag

SEQ ID NO: 2781248 - RNA, 17 nt, Leptospira interrogans serovar lai str. 56601
uaacccauucaacauca

SEQ ID NO: 2781249 - RNA, 21 nt, Leptospira interrogans serovar lai str. 56601
uaaccccuaagcguucuaagu

SEQ ID NO: 2781250 - RNA, 18 nt, Leptospira interrogans serovar lai str. 56601
uaacccggauuuguugau

SEQ ID NO: 2781251 - RNA, 17 nt, Leptospira interrogans serovar lai str. 56601
uaacccucaucagucau

SEQ ID NO: 2781252 - RNA, 16 nt, Leptospira interrogans serovar lai str. 56601
uaaccggaauuuccaa

SEQ ID NO: 2781253 - RNA, 23 nt, Leptospira interrogans serovar lai str. 56601
uaaccggaauuuccaaacucaau

SEQ ID NO: 2781254 - RNA, 16 nt, Leptospira interrogans serovar lai str. 56601
uaaccguagauuuuaa

SEQ ID NO: 2781255 - RNA, 17 nt, Leptospira interrogans serovar lai str. 56601
uaaccuaaaauuuccau

SEQ ID NO: 2781256 - RNA, 13 nt, Leptospira interrogans serovar lai str. 56601
uaaccucaacaua

SEQ ID NO: 2781257 - RNA, 23 nt, Leptospira interrogans serovar lai str. 56601
uaaccugcaacaccaauucgguu

SEQ ID NO: 2781258 - RNA, 21 nt, Leptospira interrogans serovar lai str. 56601
uaacgaguagaauucucagga

SEQ ID NO: 2781259 - RNA, 17 nt, Leptospira interrogans serovar lai str. 56601
uaacgauacuuaaaaau

SEQ ID NO: 2781260 - RNA, 14 nt, Leptospira interrogans serovar lai str. 56601
uaacgauuguaaaa

SEQ ID NO: 2781261 - RNA, 19 nt, Leptospira interrogans serovar lai str. 56601
uaacgauuguaaaaaaaca

SEQ ID NO: 2781262 - RNA, 17 nt, Leptospira interrogans serovar lai str. 56601
uaacgggaauuauaaau

SEQ ID NO: 2781263 - RNA, 21 nt, Leptospira interrogans serovar lai str. 56601
uaacgguacucaauuuuacag

SEQ ID NO: 2781264 - RNA, 13 nt, Leptospira interrogans serovar lai str. 56601
uaacgucuugauu

SEQ ID NO: 2781265 - RNA, 21 nt, Leptospira interrogans serovar lai str. 56601
uaacgugaguucguggagaaa

SEQ ID NO: 2781266 - RNA, 13 nt, Leptospira interrogans serovar lai str. 56601
uaacuaacuauga

SEQ ID NO: 2781267 - RNA, 16 nt, Leptospira interrogans serovar lai str. 56601
uaacuaugucuaucag

SEQ ID NO: 2781268 - RNA, 22 nt, Leptospira interrogans serovar lai str. 56601
uaacucauauagaaauuauagu

SEQ ID NO: 2781269 - RNA, 16 nt, Leptospira interrogans serovar lai str. 56601
uaacuccuacauuaga

SEQ ID NO: 2781270 - RNA, 12 nt, Leptospira interrogans serovar lai str. 56601
uaacugguuuuu

SEQ ID NO: 2781271 - RNA, 16 nt, Leptospira interrogans serovar lai str. 56601
uaacuuagucuuuguu

SEQ ID NO: 2781272 - RNA, 21 nt, Leptospira interrogans serovar lai str. 56601
uaacuuagucuuuguuuauug

SEQ ID NO: 2781273 - RNA, 20 nt, Leptospira interrogans serovar lai str. 56601
uaaguuugucuguaaaauga

SEQ ID NO: 2781274 - RNA, 16 nt, Leptospira interrogans serovar lai str. 56601
uaaguuugugagaguu

SEQ ID NO: 2781275 - RNA, 20 nt, Leptospira interrogans serovar lai str. 56601
uaaguuugugagaguuccca

SEQ ID NO: 2781276 - RNA, 21 nt, Leptospira interrogans serovar lai str. 56601
uaaguuugugagaguucccac

SEQ ID NO: 2781277 - RNA, 22 nt, Leptospira interrogans serovar lai str. 56601
uaaguuugugagaguucccaca

SEQ ID NO: 2781278 - RNA, 17 nt, Leptospira interrogans serovar lai str. 56601
uaaguuuuacagaagau

SEQ ID NO: 2781279 - RNA, 11 nt, Leptospira interrogans serovar lai str. 56601
uaaguuuucca

SEQ ID NO: 2781280 - RNA, 13 nt, Leptospira interrogans serovar lai str. 56601
uaaguuuuuaaau

SEQ ID NO: 2781281 - RNA, 14 nt, Leptospira interrogans serovar lai str. 56601
uaaguuuuuaaaua

SEQ ID NO: 2781282 - RNA, 15 nt, Leptospira interrogans serovar lai str. 56601
uaaguuuuuaaauaa

SEQ ID NO: 2781283 - RNA, 19 nt, Leptospira interrogans serovar lai str. 56601
uaaguuuuuaaauaagcua

SEQ ID NO: 2781284 - RNA, 16 nt, Leptospira interrogans serovar lai str. 56601
uaaguuuuuaaaucca

SEQ ID NO: 2781285 - RNA, 18 nt, Leptospira interrogans serovar lai str. 56601
uaaguuuuuauuauaaaa

SEQ ID NO: 2781286 - RNA, 12 nt, Leptospira interrogans serovar lai str. 56601
uaaguuuuucga

SEQ ID NO: 2781287 - RNA, 22 nt, Leptospira interrogans serovar lai str. 56601
uaauaaaaaaaugaauuuuuua

SEQ ID NO: 2781288 - RNA, 14 nt, Leptospira interrogans serovar lai str. 56601
uaauaaaaacaaua

SEQ ID NO: 2781289 - RNA, 22 nt, Leptospira interrogans serovar lai str. 56601
uaauaaaaacaauauucuaauu

SEQ ID NO: 2781290 - RNA, 13 nt, Leptospira interrogans serovar lai str. 56601
uaauaaaaauagc

SEQ ID NO: 2781291 - RNA, 14 nt, Leptospira interrogans serovar lai str. 56601
uaauaaaaauuuaa

SEQ ID NO: 2781292 - RNA, 22 nt, Leptospira interrogans serovar lai str. 56601
uaauaaaaauuuaaaauacuca

SEQ ID NO: 2781293 - RNA, 21 nt, Leptospira interrogans serovar lai str. 56601
uaauaaaaauuuacagauacu

SEQ ID NO: 2781294 - RNA, 13 nt, Leptospira interrogans serovar lai str. 56601
uaauaaaaauuug

SEQ ID NO: 2781295 - RNA, 17 nt, Leptospira interrogans serovar lai str. 56601
uaauaaaacguggauuu

SEQ ID NO: 2781296 - RNA, 19 nt, Leptospira interrogans serovar lai str. 56601
uaauaaaacuuuucuaaau

SEQ ID NO: 2781297 - RNA, 10 nt, Leptospira interrogans serovar lai str. 56601
uaauaaaaug

SEQ ID NO: 2781298 - RNA, 11 nt, Leptospira interrogans serovar lai str. 56601
uaauaaaaugc

SEQ ID NO: 2781299 - RNA, 11 nt, Leptospira interrogans serovar lai str. 56601
uaauaaaaugu

SEQ ID NO: 2781300 - RNA, 12 nt, Leptospira interrogans serovar lai str. 56601
uaauaaaauuaa

SEQ ID NO: 2781301 - RNA, 12 nt, Leptospira interrogans serovar lai str. 56601
uaauaaaauuuu

SEQ ID NO: 2781302 - RNA, 19 nt, Leptospira interrogans serovar lai str. 56601
uaauaaaauuuuuaaaaaa

SEQ ID NO: 2781303 - RNA, 18 nt, Leptospira interrogans serovar lai str. 56601
uaauaaaguacuaauuca

SEQ ID NO: 2781304 - RNA, 22 nt, Leptospira interrogans serovar lai str. 56601
uaauaaaucaaucuacuugaau

SEQ ID NO: 2781305 - RNA, 19 nt, Leptospira interrogans serovar lai str. 56601
uaauaaaucaauuuucuuu

SEQ ID NO: 2781306 - RNA, 21 nt, Leptospira interrogans serovar lai str. 56601
uaauaaauuuuugacuaccuu

SEQ ID NO: 2781307 - RNA, 16 nt, Leptospira interrogans serovar lai str. 56601
uaauaagaauacguga

SEQ ID NO: 2781308 - RNA, 22 nt, Leptospira interrogans serovar lai str. 56601
uaauaagagugcagauuaaaaa

SEQ ID NO: 2781309 - RNA, 19 nt, Leptospira interrogans serovar lai str. 56601
uaauaagauuuguugaaaa

SEQ ID NO: 2781310 - RNA, 12 nt, Leptospira interrogans serovar lai str. 56601
uaauaauaugaa

SEQ ID NO: 2781311 - RNA, 16 nt, Leptospira interrogans serovar lai str. 56601
uaauaaucuuaaauau

SEQ ID NO: 2781312 - RNA, 15 nt, Leptospira interrogans serovar lai str. 56601
uaauaauuagaaaaa

SEQ ID NO: 2781313 - RNA, 17 nt, Leptospira interrogans serovar lai str. 56601
uaauaauuagaaaaaua

SEQ ID NO: 2781314 - RNA, 13 nt, Leptospira interrogans serovar lai str. 56601
uaauaauucaaaa

SEQ ID NO: 2781315 - RNA, 17 nt, Leptospira interrogans serovar lai str. 56601
uaauaauuguugaauau

SEQ ID NO: 2781316 - RNA, 17 nt, Leptospira interrogans serovar lai str. 56601
uaauaauuuuagaauau

SEQ ID NO: 2781317 - RNA, 12 nt, Leptospira interrogans serovar lai str. 56601
uaauacaaaaaa

SEQ ID NO: 2781318 - RNA, 14 nt, Leptospira interrogans serovar lai str. 56601
uaauacaaaaaacu

SEQ ID NO: 2781319 - RNA, 12 nt, Leptospira interrogans serovar lai str. 56601
uaauacaaaacu

SEQ ID NO: 2781320 - RNA, 13 nt, Leptospira interrogans serovar lai str. 56601
uaauacaaaucuu

SEQ ID NO: 2781321 - RNA, 15 nt, Leptospira interrogans serovar lai str. 56601
uaauacaauucugaa

SEQ ID NO: 2781322 - RNA, 15 nt, Leptospira interrogans serovar lai str. 56601
uaauaccuaauucuc

SEQ ID NO: 2781323 - RNA, 14 nt, Leptospira interrogans serovar lai str. 56601
uaauacgauauuuu

SEQ ID NO: 2781324 - RNA, 16 nt, Leptospira interrogans serovar lai str. 56601
uaauacgauauuuugu

SEQ ID NO: 2781325 - RNA, 17 nt, Leptospira interrogans serovar lai str. 56601
uaauacgaugauaaauu

SEQ ID NO: 2781326 - RNA, 17 nt, Leptospira interrogans serovar lai str. 56601
uaauacucgaaaccaua

SEQ ID NO: 2781327 - RNA, 13 nt, Leptospira interrogans serovar lai str. 56601
uaauagaaaacuu

SEQ ID NO: 2781328 - RNA, 17 nt, Leptospira interrogans serovar lai str. 56601
uaauagagaaaaauuuu

SEQ ID NO: 2781329 - RNA, 20 nt, Leptospira interrogans serovar lai str. 56601
uaauagaguuacagaaaaaa

SEQ ID NO: 2781330 - RNA, 21 nt, Leptospira interrogans serovar lai str. 56601
uaauagaguuacagaaaaaau

SEQ ID NO: 2781331 - RNA, 23 nt, Leptospira interrogans serovar lai str. 56601
uaauagcuugucacuauuuuuau

SEQ ID NO: 2781332 - RNA, 19 nt, Leptospira interrogans serovar lai str. 56601
uaauaguucccacauuuuu

SEQ ID NO: 2781333 - RNA, 23 nt, Leptospira interrogans serovar lai str. 56601
uaauaguucccacauuuuucaaa

SEQ ID NO: 2781334 - RNA, 21 nt, Leptospira interrogans serovar lai str. 56601
uaauaguuccuauauuuuaaa

SEQ ID NO: 2781335 - RNA, 13 nt, Leptospira interrogans serovar lai str. 56601
uaauaguuuauac

SEQ ID NO: 2781336 - RNA, 16 nt, Leptospira interrogans serovar lai str. 56601
uaauauaaaaaauaau

SEQ ID NO: 2781337 - RNA, 22 nt, Leptospira interrogans serovar lai str. 56601
uaauauaaaaaauaauauuaua

SEQ ID NO: 2781338 - RNA, 12 nt, Leptospira interrogans serovar lai str. 56601
uaauauaaaaac

SEQ ID NO: 2781339 - RNA, 12 nt, Leptospira interrogans serovar lai str. 56601
uaauauaaaauc

SEQ ID NO: 2781340 - RNA, 17 nt, Leptospira interrogans serovar lai str. 56601
uaauauaacauuuccaa

SEQ ID NO: 2781341 - RNA, 21 nt, Leptospira interrogans serovar lai str. 56601
uaauauaacauuuccaacugu

SEQ ID NO: 2781342 - RNA, 13 nt, Leptospira interrogans serovar lai str. 56601
uaauauacaaaac

SEQ ID NO: 2781343 - RNA, 15 nt, Leptospira interrogans serovar lai str. 56601
uaauauacaaaacau

SEQ ID NO: 2781344 - RNA, 17 nt, Leptospira interrogans serovar lai str. 56601
uaauauacuaaaauuau

SEQ ID NO: 2781345 - RNA, 19 nt, Leptospira interrogans serovar lai str. 56601
uaauauacuagggaaagau

SEQ ID NO: 2781346 - RNA, 21 nt, Leptospira interrogans serovar lai str. 56601
uaauauacugcaauaguuucu

SEQ ID NO: 2781347 - RNA, 16 nt, Leptospira interrogans serovar lai str. 56601
uaauauacuuauaaag

SEQ ID NO: 2781348 - RNA, 21 nt, Leptospira interrogans serovar lai str. 56601
uaauauagguucuugcaaaaa

SEQ ID NO: 2781349 - RNA, 23 nt, Leptospira interrogans serovar lai str. 56601
uaauauagguucuugcaaaaaua

SEQ ID NO: 2781350 - RNA, 20 nt, Leptospira interrogans serovar lai str. 56601
uaauauaguauaaauucgca

SEQ ID NO: 2781351 - RNA, 14 nt, Leptospira interrogans serovar lai str. 56601
uaauauauucaaaa

SEQ ID NO: 2781352 - RNA, 15 nt, Leptospira interrogans serovar lai str. 56601
uaauauauucaauuu

SEQ ID NO: 2781353 - RNA, 17 nt, Leptospira interrogans serovar lai str. 56601
uaauauauucaauuucu

SEQ ID NO: 2781354 - RNA, 17 nt, Leptospira interrogans serovar lai str. 56601
uaauaugaauucauugu

SEQ ID NO: 2781355 - RNA, 15 nt, Leptospira interrogans serovar lai str. 56601
uaauaugauguaaau

SEQ ID NO: 2781356 - RNA, 18 nt, Leptospira interrogans serovar lai str. 56601
uaauucuucaauaucuuu

SEQ ID NO: 2781357 - RNA, 16 nt, Leptospira interrogans serovar lai str. 56601
uaauucuucuaaugaa

SEQ ID NO: 2781358 - RNA, 12 nt, Leptospira interrogans serovar lai str. 56601
uaauucuuuaga

SEQ ID NO: 2781359 - RNA, 15 nt, Leptospira interrogans serovar lai str. 56601
uaauucuuuagaaau

SEQ ID NO: 2781360 - RNA, 14 nt, Leptospira interrogans serovar lai str. 56601
uaauugaaacgaau

SEQ ID NO: 2781361 - RNA, 20 nt, Leptospira interrogans serovar lai str. 56601
uaauugaacauuuuuaaaaa

SEQ ID NO: 2781362 - RNA, 13 nt, Leptospira interrogans serovar lai str. 56601
uaauugagauuug

SEQ ID NO: 2781363 - RNA, 22 nt, Leptospira interrogans serovar lai str. 56601
uaauuggccguaauaucuccaa

SEQ ID NO: 2781364 - RNA, 18 nt, Leptospira interrogans serovar lai str. 56601
uaauuguaaaaggagaau

SEQ ID NO: 2781365 - RNA, 14 nt, Leptospira interrogans serovar lai str. 56601
uaauuguagauucu

SEQ ID NO: 2781366 - RNA, 16 nt, Leptospira interrogans serovar lai str. 56601
uaauuguugaauaucu

SEQ ID NO: 2781367 - RNA, 12 nt, Leptospira interrogans serovar lai str. 56601
uaauuuaaaaaa

SEQ ID NO: 2781368 - RNA, 19 nt, Leptospira interrogans serovar lai str. 56601
uaauuuaaaaaagaagaau

SEQ ID NO: 2781369 - RNA, 14 nt, Leptospira interrogans serovar lai str. 56601
uaauuuagaauaaa

SEQ ID NO: 2781370 - RNA, 14 nt, Leptospira interrogans serovar lai str. 56601
uaauuuagcuaagu

SEQ ID NO: 2781371 - RNA, 23 nt, Leptospira interrogans serovar lai str. 56601
uaauuuaguuauaacguuauaaa

SEQ ID NO: 2781372 - RNA, 16 nt, Leptospira interrogans serovar lai str. 56601
uaauuuauauuacaua

SEQ ID NO: 2781373 - RNA, 21 nt, Leptospira interrogans serovar lai str. 56601
uaauuucaauaacuugacucc

SEQ ID NO: 2781374 - RNA, 12 nt, Leptospira interrogans serovar lai str. 56601
uaauuucaauuu

SEQ ID NO: 2781375 - RNA, 21 nt, Leptospira interrogans serovar lai str. 56601
uaauuucauaaaauucuuaga

SEQ ID NO: 2781376 - RNA, 22 nt, Leptospira interrogans serovar lai str. 56601
uaauuucauugaguuuuuuagu

SEQ ID NO: 2781377 - RNA, 16 nt, Leptospira interrogans serovar lai str. 56601
uaauuucccauaaaaa

SEQ ID NO: 2781378 - RNA, 18 nt, Leptospira interrogans serovar lai str. 56601
uaauuucccauaaaaaga

SEQ ID NO: 2781379 - RNA, 17 nt, Leptospira interrogans serovar lai str. 56601
uaauuucgggauauucu

SEQ ID NO: 2781380 - RNA, 21 nt, Leptospira interrogans serovar lai str. 56601
uaauuucguuuuuuuaauauu

SEQ ID NO: 2781381 - RNA, 22 nt, Leptospira interrogans serovar lai str. 56601
uaauuucguuuuuuuaauauua

SEQ ID NO: 2781382 - RNA, 20 nt, Leptospira interrogans serovar lai str. 56601
uaauuucuaaacaauuuuau

SEQ ID NO: 2781383 - RNA, 17 nt, Leptospira interrogans serovar lai str. 56601
uaauuucucuuauuaga

SEQ ID NO: 2781384 - RNA, 21 nt, Leptospira interrogans serovar lai str. 56601
uaauuucucuuauuagaacuc

SEQ ID NO: 2781385 - RNA, 22 nt, Leptospira interrogans serovar lai str. 56601
uaauuucucuuauuagaacuca

SEQ ID NO: 2781386 - RNA, 17 nt, Leptospira interrogans serovar lai str. 56601
uaauuucuuuuuauacu

SEQ ID NO: 2781387 - RNA, 20 nt, Leptospira interrogans serovar lai str. 56601
uaauuuguaagaacacugca

SEQ ID NO: 2781388 - RNA, 15 nt, Leptospira interrogans serovar lai str. 56601
uaauuuguaagaguu

SEQ ID NO: 2781389 - RNA, 22 nt, Leptospira interrogans serovar lai str. 56601
uaauuuguaagaguuccacauu

SEQ ID NO: 2781390 - RNA, 15 nt, Leptospira interrogans serovar lai str. 56601
uaauuuguaauucug

SEQ ID NO: 2781391 - RNA, 14 nt, Leptospira interrogans serovar lai str. 56601
uaauuuguaggaau

SEQ ID NO: 2781392 - RNA, 12 nt, Leptospira interrogans serovar lai str. 56601
uaauuugugaac

SEQ ID NO: 2781393 - RNA, 15 nt, Leptospira interrogans serovar lai str. 56601
uaauuuguuuuugga

SEQ ID NO: 2781394 - RNA, 18 nt, Leptospira interrogans serovar lai str. 56601
uaauuuguuuuuggaaau

SEQ ID NO: 2781395 - RNA, 14 nt, Leptospira interrogans serovar lai str. 56601
uaauuuuaaauaau

SEQ ID NO: 2781396 - RNA, 13 nt, Leptospira interrogans serovar lai str. 56601
uaauuuuaauauu

SEQ ID NO: 2781397 - RNA, 13 nt, Leptospira interrogans serovar lai str. 56601
uaauuuuaauuaa

SEQ ID NO: 2781398 - RNA, 15 nt, Leptospira interrogans serovar lai str. 56601
uaauuuuacuauaaa

SEQ ID NO: 2781399 - RNA, 15 nt, Leptospira interrogans serovar lai str. 56601
uaauuuuagaauauu

SEQ ID NO: 2781400 - RNA, 16 nt, Leptospira interrogans serovar lai str. 56601
uaauuuuaguaaaaau

SEQ ID NO: 2781401 - RNA, 17 nt, Leptospira interrogans serovar lai str. 56601
uaauuuuaguaaaaauc

SEQ ID NO: 2781402 - RNA, 14 nt, Leptospira interrogans serovar lai str. 56601
uaauuuuauuucuu

SEQ ID NO: 2781403 - RNA, 21 nt, Leptospira interrogans serovar lai str. 56601
uaauuuucuagugucuaaacu

SEQ ID NO: 2781404 - RNA, 14 nt, Leptospira interrogans serovar lai str. 56601
uaauuuucuuuaga

SEQ ID NO: 2781405 - RNA, 16 nt, Leptospira interrogans serovar lai str. 56601
uaauuuugaaguauaa

SEQ ID NO: 2781406 - RNA, 20 nt, Leptospira interrogans serovar lai str. 56601
uaauuuugaaguauaaacuu

SEQ ID NO: 2781407 - RNA, 22 nt, Leptospira interrogans serovar lai str. 56601
uaauuuugugaaucaaaaggua

SEQ ID NO: 2781408 - RNA, 12 nt, Leptospira interrogans serovar lai str. 56601
uaauuuuuacuc

SEQ ID NO: 2781409 - RNA, 14 nt, Leptospira interrogans serovar lai str. 56601
uaauuuuuacucaa

SEQ ID NO: 2781410 - RNA, 12 nt, Leptospira interrogans serovar lai str. 56601
uaauuuuuagaa

SEQ ID NO: 2781411 - RNA, 15 nt, Leptospira interrogans serovar lai str. 56601
uaauuuuuauagaau

SEQ ID NO: 2781412 - RNA, 18 nt, Leptospira interrogans serovar lai str. 56601
uaauuuuucaaaaacucu

SEQ ID NO: 2781413 - RNA, 21 nt, Leptospira interrogans serovar lai str. 56601
uaauuuuucuuugaaggaucu

SEQ ID NO: 2781414 - RNA, 23 nt, Leptospira interrogans serovar lai str. 56601
uaauuuuucuuugaaggaucuua

SEQ ID NO: 2781415 - RNA, 12 nt, Leptospira interrogans serovar lai str. 56601
uaauuuuuuagc

SEQ ID NO: 2781416 - RNA, 22 nt, Leptospira interrogans serovar lai str. 56601
uaauuuuuuauuuuugucuacg

SEQ ID NO: 2781417 - RNA, 20 nt, Leptospira interrogans serovar lai str. 56601
uacaaaaaacugaaacuuga

SEQ ID NO: 2781418 - RNA, 22 nt, Leptospira interrogans serovar lai str. 56601
uacaaaaaauguuuaaagaauu

SEQ ID NO: 2781419 - RNA, 14 nt, Leptospira interrogans serovar lai str. 56601
uacaaaaauucuaa

SEQ ID NO: 2781420 - RNA, 15 nt, Leptospira interrogans serovar lai str. 56601
uacaaaaauuuaaua

SEQ ID NO: 2781421 - RNA, 15 nt, Leptospira interrogans serovar lai str. 56601
uacaaaacuguuuuu

SEQ ID NO: 2781422 - RNA, 14 nt, Leptospira interrogans serovar lai str. 56601
uacaaaauuuaaaa

SEQ ID NO: 2781423 - RNA, 16 nt, Leptospira interrogans serovar lai str. 56601
uacaaaauuuaaaaau

SEQ ID NO: 2781424 - RNA, 17 nt, Leptospira interrogans serovar lai str. 56601
uacaaaauuuuuuccuu

SEQ ID NO: 2781425 - RNA, 18 nt, Leptospira interrogans serovar lai str. 56601
uacaaaauuuuuuccuuu

SEQ ID NO: 2781426 - RNA, 14 nt, Leptospira interrogans serovar lai str. 56601
uacaaacuuacauu

SEQ ID NO: 2781427 - RNA, 17 nt, Leptospira interrogans serovar lai str. 56601
uacaaagaguuuaaaaa

SEQ ID NO: 2781428 - RNA, 16 nt, Leptospira interrogans serovar lai str. 56601
uacaaagauuggacga

SEQ ID NO: 2781429 - RNA, 24 nt, Leptospira interrogans serovar lai str. 56601
uacaaagcacuuuuuuccucgaau

SEQ ID NO: 2781430 - RNA, 20 nt, Leptospira interrogans serovar lai str. 56601
uacaaaguaaguucaaauuu

SEQ ID NO: 2781431 - RNA, 14 nt, Leptospira interrogans serovar lai str. 56601
uacaaaguauucuu

SEQ ID NO: 2781432 - RNA, 15 nt, Leptospira interrogans serovar lai str. 56601
uacaaaguauucuuu

SEQ ID NO: 2781433 - RNA, 21 nt, Leptospira interrogans serovar lai str. 56601
uacaaagugaugaagagaaag

SEQ ID NO: 2781434 - RNA, 18 nt, Leptospira interrogans serovar lai str. 56601
uacaaaucacgauuuuac

SEQ ID NO: 2781435 - RNA, 23 nt, Leptospira interrogans serovar lai str. 56601
uacaaaucacgauuuuacaaaca

SEQ ID NO: 2781436 - RNA, 22 nt, Leptospira interrogans serovar lai str. 56601
uacaaaugggaugauagauuaa

SEQ ID NO: 2781437 - RNA, 17 nt, Leptospira interrogans serovar lai str. 56601
uacaaauucuucuuccu

SEQ ID NO: 2781438 - RNA, 14 nt, Leptospira interrogans serovar lai str. 56601
uacaaauugauaau

SEQ ID NO: 2781439 - RNA, 17 nt, Leptospira interrogans serovar lai str. 56601
uacauauauaauuuauu

SEQ ID NO: 2781440 - RNA, 14 nt, Leptospira interrogans serovar lai str. 56601
uacaucaaaaacaa

SEQ ID NO: 2781441 - RNA, 17 nt, Leptospira interrogans serovar lai str. 56601
uacaucaaaaacaaauu

SEQ ID NO: 2781442 - RNA, 23 nt, Leptospira interrogans serovar lai str. 56601
uacaucccaaaccucuuuauacg

SEQ ID NO: 2781443 - RNA, 14 nt, Leptospira interrogans serovar lai str. 56601
uacaucgaauucau

SEQ ID NO: 2781444 - RNA, 14 nt, Leptospira interrogans serovar lai str. 56601
uacaucgucuucuu

SEQ ID NO: 2781445 - RNA, 15 nt, Leptospira interrogans serovar lai str. 56601
uacaucguuugucgc

SEQ ID NO: 2781446 - RNA, 14 nt, Leptospira interrogans serovar lai str. 56601
uacaucuuaaaaaa

SEQ ID NO: 2781447 - RNA, 15 nt, Leptospira interrogans serovar lai str. 56601
uacaucuuaaaaaau

SEQ ID NO: 2781448 - RNA, 16 nt, Leptospira interrogans serovar lai str. 56601
uacaucuuaaaaaaua

SEQ ID NO: 2781449 - RNA, 16 nt, Leptospira interrogans serovar lai str. 56601
uacaugaauucuaauu

SEQ ID NO: 2781450 - RNA, 14 nt, Leptospira interrogans serovar lai str. 56601
uacaugagacuaua

SEQ ID NO: 2781451 - RNA, 13 nt, Leptospira interrogans serovar lai str. 56601
uacauguaaaacu

SEQ ID NO: 2781452 - RNA, 21 nt, Leptospira interrogans serovar lai str. 56601
uacauuagagucguugaaaau

SEQ ID NO: 2781453 - RNA, 15 nt, Leptospira interrogans serovar lai str. 56601
uacauuagaguuguu

SEQ ID NO: 2781454 - RNA, 21 nt, Leptospira interrogans serovar lai str. 56601
uacauuagaguuguugaaaaa

SEQ ID NO: 2781455 - RNA, 22 nt, Leptospira interrogans serovar lai str. 56601
uacauuagaguuguugaaaaau

SEQ ID NO: 2781456 - RNA, 16 nt, Leptospira interrogans serovar lai str. 56601
uacauuaguuaacgug

SEQ ID NO: 2781457 - RNA, 22 nt, Leptospira interrogans serovar lai str. 56601
uacauuaugaauuuuuaaacau

SEQ ID NO: 2781458 - RNA, 16 nt, Leptospira interrogans serovar lai str. 56601
uacauucaauaauuuu

SEQ ID NO: 2781459 - RNA, 20 nt, Leptospira interrogans serovar lai str. 56601
uacauucaauuucuuuaauu

SEQ ID NO: 2781460 - RNA, 15 nt, Leptospira interrogans serovar lai str. 56601
uacauucguuuuaau

SEQ ID NO: 2781461 - RNA, 20 nt, Leptospira interrogans serovar lai str. 56601
uacauucugaaacuuuucaa

SEQ ID NO: 2781462 - RNA, 21 nt, Leptospira interrogans serovar lai str. 56601
uacauugaguccuuucgacuu

SEQ ID NO: 2781463 - RNA, 18 nt, Leptospira interrogans serovar lai str. 56601
uacauuggggaaguaauu

SEQ ID NO: 2781464 - RNA, 20 nt, Leptospira interrogans serovar lai str. 56601
uacauuggggaaguaauuuu

SEQ ID NO: 2781465 - RNA, 21 nt, Leptospira interrogans serovar lai str. 56601
uacauuggggaaguaauuuuc

SEQ ID NO: 2781466 - RNA, 16 nt, Leptospira interrogans serovar lai str. 56601
uacauuuaaacuuuuc

SEQ ID NO: 2781467 - RNA, 14 nt, Leptospira interrogans serovar lai str. 56601
uacauuuuaggaau

SEQ ID NO: 2781468 - RNA, 20 nt, Leptospira interrogans serovar lai str. 56601
uacauuuugaguagccaauu

SEQ ID NO: 2781469 - RNA, 23 nt, Leptospira interrogans serovar lai str. 56601
uacauuuugaguagccaauugaa

SEQ ID NO: 2781470 - RNA, 11 nt, Leptospira interrogans serovar lai str. 56601
uacauuuuuaa

SEQ ID NO: 2781471 - RNA, 14 nt, Leptospira interrogans serovar lai str. 56601
uacauuuuucuaaa

SEQ ID NO: 2781472 - RNA, 15 nt, Leptospira interrogans serovar lai str. 56601
uacauuuuucuaaau

SEQ ID NO: 2781473 - RNA, 19 nt, Leptospira interrogans serovar lai str. 56601
uacauuuuucuaaauuaau

SEQ ID NO: 2781474 - RNA, 14 nt, Leptospira interrogans serovar lai str. 56601
uacauuuuuuaaau

SEQ ID NO: 2781475 - RNA, 18 nt, Leptospira interrogans serovar lai str. 56601
uacauuuuuuaaauuuau

SEQ ID NO: 2781476 - RNA, 12 nt, Leptospira interrogans serovar lai str. 56601
uaccaaaaaagu

SEQ ID NO: 2781477 - RNA, 13 nt, Leptospira interrogans serovar lai str. 56601
uaccaaauucacg

SEQ ID NO: 2781478 - RNA, 16 nt, Leptospira interrogans serovar lai str. 56601
uaccaaauuguuuucu

SEQ ID NO: 2781479 - RNA, 19 nt, Leptospira interrogans serovar lai str. 56601
uaccaaauuguuuucuaaa

SEQ ID NO: 2781480 - RNA, 21 nt, Leptospira interrogans serovar lai str. 56601
uaccaacgucccuauuguauu

SEQ ID NO: 2781481 - RNA, 13 nt, Leptospira interrogans serovar lai str. 56601
uaccaaguuauua

SEQ ID NO: 2781482 - RNA, 14 nt, Leptospira interrogans serovar lai str. 56601
uaccaaguuauuaa

SEQ ID NO: 2781483 - RNA, 20 nt, Leptospira interrogans serovar lai str. 56601
uaccaauaauuucccauaaa

SEQ ID NO: 2781484 - RNA, 18 nt, Leptospira interrogans serovar lai str. 56601
uaccacaaaucuaaauuu

SEQ ID NO: 2781485 - RNA, 21 nt, Leptospira interrogans serovar lai str. 56601
uaccacagugaaagauuaaag

SEQ ID NO: 2781486 - RNA, 15 nt, Leptospira interrogans serovar lai str. 56601
uaccacuuauuucua

SEQ ID NO: 2781487 - RNA, 16 nt, Leptospira interrogans serovar lai str. 56601
uaccacuuauuucuau

SEQ ID NO: 2781488 - RNA, 15 nt, Leptospira interrogans serovar lai str. 56601
uaccagcaagcacau

SEQ ID NO: 2781489 - RNA, 20 nt, Leptospira interrogans serovar lai str. 56601
uaccaguuaaacuuugaaaa

SEQ ID NO: 2781490 - RNA, 16 nt, Leptospira interrogans serovar lai str. 56601
uaccauaaauuuugau

SEQ ID NO: 2781491 - RNA, 19 nt, Leptospira interrogans serovar lai str. 56601
uaccauaggcgcggaaaaa

SEQ ID NO: 2781492 - RNA, 23 nt, Leptospira interrogans serovar lai str. 56601
uacccacucuuugacuacuuccg

SEQ ID NO: 2781493 - RNA, 18 nt, Leptospira interrogans serovar lai str. 56601
uacccuuaagauagccua

SEQ ID NO: 2781494 - RNA, 21 nt, Leptospira interrogans serovar lai str. 56601
uaccgauuucuauuuuaaaag

SEQ ID NO: 2781495 - RNA, 16 nt, Leptospira interrogans serovar lai str. 56601
uaccgcuagaaguuau

SEQ ID NO: 2781496 - RNA, 14 nt, Leptospira interrogans serovar lai str. 56601
uaccguuuuuaaau

SEQ ID NO: 2781497 - RNA, 21 nt, Leptospira interrogans serovar lai str. 56601
uaccuaaaauggauuuauaau

SEQ ID NO: 2781498 - RNA, 20 nt, Leptospira interrogans serovar lai str. 56601
uaccuauacaauucuuucuu

SEQ ID NO: 2781499 - RNA, 22 nt, Leptospira interrogans serovar lai str. 56601
uaccuguuuuaguucaaaaaca

SEQ ID NO: 2781500 - RNA, 14 nt, Leptospira interrogans serovar lai str. 56601
uaccuuauaaaaau

SEQ ID NO: 2781501 - RNA, 19 nt, Leptospira interrogans serovar lai str. 56601
uaccuugaaacuuuuaaua

SEQ ID NO: 2781502 - RNA, 18 nt, Leptospira interrogans serovar lai str. 56601
uacgaaaacuuaaugaga

SEQ ID NO: 2781503 - RNA, 20 nt, Leptospira interrogans serovar lai str. 56601
uacgaacaaauucuaaaauu

SEQ ID NO: 2781504 - RNA, 16 nt, Leptospira interrogans serovar lai str. 56601
uacgaacacauucuaa

SEQ ID NO: 2781505 - RNA, 19 nt, Leptospira interrogans serovar lai str. 56601
uacgaaccaauucuaaaau

SEQ ID NO: 2781506 - RNA, 22 nt, Leptospira interrogans serovar lai str. 56601
uacgaaccaauucuaaaaucau

SEQ ID NO: 2781507 - RNA, 21 nt, Leptospira interrogans serovar lai str. 56601
uacgaaucuguucgucguuua

SEQ ID NO: 2781508 - RNA, 13 nt, Leptospira interrogans serovar lai str. 56601
uacgaauuucaga

SEQ ID NO: 2781509 - RNA, 15 nt, Leptospira interrogans serovar lai str. 56601
uacgaauuuuuaaau

SEQ ID NO: 2781510 - RNA, 21 nt, Leptospira interrogans serovar lai str. 56601
uacgacaaaucuucuguaaaa

SEQ ID NO: 2781511 - RNA, 20 nt, Leptospira interrogans serovar lai str. 56601
uacgacaaguccucuaugaa

SEQ ID NO: 2781512 - RNA, 14 nt, Leptospira interrogans serovar lai str. 56601
uacgacauuuuaau

SEQ ID NO: 2781513 - RNA, 14 nt, Leptospira interrogans serovar lai str. 56601
uacgacuuuauuca

SEQ ID NO: 2781514 - RNA, 18 nt, Leptospira interrogans serovar lai str. 56601
uacgaguaaaaauucuuc

SEQ ID NO: 2781515 - RNA, 13 nt, Leptospira interrogans serovar lai str. 56601
uacgaucaaaucc

SEQ ID NO: 2781516 - RNA, 19 nt, Leptospira interrogans serovar lai str. 56601
uacgauccucuucuuuguc

SEQ ID NO: 2781517 - RNA, 16 nt, Leptospira interrogans serovar lai str. 56601
uacgaugucuuuucaa

SEQ ID NO: 2781518 - RNA, 17 nt, Leptospira interrogans serovar lai str. 56601
uacgauucaauucggaa

SEQ ID NO: 2781519 - RNA, 22 nt, Leptospira interrogans serovar lai str. 56601
uacgauucgaaagauuuuucau

SEQ ID NO: 2781520 - RNA, 17 nt, Leptospira interrogans serovar lai str. 56601
uacgauucuaaauuauu

SEQ ID NO: 2781521 - RNA, 16 nt, Leptospira interrogans serovar lai str. 56601
uacgcaugauaaaaau

SEQ ID NO: 2781522 - RNA, 19 nt, Leptospira interrogans serovar lai str. 56601
uacuuaaacguauaaaaac

SEQ ID NO: 2781523 - RNA, 17 nt, Leptospira interrogans serovar lai str. 56601
uacuuaagcucuaauau

SEQ ID NO: 2781524 - RNA, 18 nt, Leptospira interrogans serovar lai str. 56601
uacuuaccucuauaaaau

SEQ ID NO: 2781525 - RNA, 19 nt, Leptospira interrogans serovar lai str. 56601
uacuuacuaaacgauuuua

SEQ ID NO: 2781526 - RNA, 18 nt, Leptospira interrogans serovar lai str. 56601
uacuuauuucuauaaaau

SEQ ID NO: 2781527 - RNA, 21 nt, Leptospira interrogans serovar lai str. 56601
uacuucauccgggcuuuucuu

SEQ ID NO: 2781528 - RNA, 22 nt, Leptospira interrogans serovar lai str. 56601
uacuucccagacguaucaaaau

SEQ ID NO: 2781529 - RNA, 12 nt, Leptospira interrogans serovar lai str. 56601
uacuucuaaaaa

SEQ ID NO: 2781530 - RNA, 11 nt, Leptospira interrogans serovar lai str. 56601
uacuugcaaaa

SEQ ID NO: 2781531 - RNA, 16 nt, Leptospira interrogans serovar lai str. 56601
uacuugcaaaaaguau

SEQ ID NO: 2781532 - RNA, 14 nt, Leptospira interrogans serovar lai str. 56601
uacuugucuuuaga

SEQ ID NO: 2781533 - RNA, 19 nt, Leptospira interrogans serovar lai str. 56601
uacuuuaaaaaauaucuua

SEQ ID NO: 2781534 - RNA, 16 nt, Leptospira interrogans serovar lai str. 56601
uacuuuaagaaaauuu

SEQ ID NO: 2781535 - RNA, 20 nt, Leptospira interrogans serovar lai str. 56601
uacuuuaagaaaauuuaaaa

SEQ ID NO: 2781536 - RNA, 21 nt, Leptospira interrogans serovar lai str. 56601
uacuuuaagaaaauuuaaaau

SEQ ID NO: 2781537 - RNA, 14 nt, Leptospira interrogans serovar lai str. 56601
uacuuuaauaauau

SEQ ID NO: 2781538 - RNA, 15 nt, Leptospira interrogans serovar lai str. 56601
uacuuuauuaaaaag

SEQ ID NO: 2781539 - RNA, 17 nt, Leptospira interrogans serovar lai str. 56601
uacuuucaaaaaauaua

SEQ ID NO: 2781540 - RNA, 18 nt, Leptospira interrogans serovar lai str. 56601
uacuuucggacuuuccga

SEQ ID NO: 2781541 - RNA, 15 nt, Leptospira interrogans serovar lai str. 56601
uacuuugaacuuguc

SEQ ID NO: 2781542 - RNA, 13 nt, Leptospira interrogans serovar lai str. 56601
uacuuugaaugaa

SEQ ID NO: 2781543 - RNA, 15 nt, Leptospira interrogans serovar lai str. 56601
uacuuugauuauaac

SEQ ID NO: 2781544 - RNA, 16 nt, Leptospira interrogans serovar lai str. 56601
uacuuuguaauuaaaa

SEQ ID NO: 2781545 - RNA, 17 nt, Leptospira interrogans serovar lai str. 56601
uacuuuguaauuaaaau

SEQ ID NO: 2781546 - RNA, 16 nt, Leptospira interrogans serovar lai str. 56601
uacuuuuagaaaaaau

SEQ ID NO: 2781547 - RNA, 16 nt, Leptospira interrogans serovar lai str. 56601
uacuuuuagaaaauuu

SEQ ID NO: 2781548 - RNA, 22 nt, Leptospira interrogans serovar lai str. 56601
uacuuuuagaagauuuuuacuc

SEQ ID NO: 2781549 - RNA, 22 nt, Leptospira interrogans serovar lai str. 56601
uacuuuuagauaauuauucuca

SEQ ID NO: 2781550 - RNA, 13 nt, Leptospira interrogans serovar lai str. 56601
uacuuuucuuccc

SEQ ID NO: 2781551 - RNA, 22 nt, Leptospira interrogans serovar lai str. 56601
uacuuuugaaauagauucuaau

SEQ ID NO: 2781552 - RNA, 18 nt, Leptospira interrogans serovar lai str. 56601
uagaaaaacugauuuaau

SEQ ID NO: 2781553 - RNA, 14 nt, Leptospira interrogans serovar lai str. 56601
uagaaaaauauuau

SEQ ID NO: 2781554 - RNA, 16 nt, Leptospira interrogans serovar lai str. 56601
uagaaaaccauuuugu

SEQ ID NO: 2781555 - RNA, 22 nt, Leptospira interrogans serovar lai str. 56601
uagaaaagacuuuuuauggauu

SEQ ID NO: 2781556 - RNA, 15 nt, Leptospira interrogans serovar lai str. 56601
uagaaaauaauaaua

SEQ ID NO: 2781557 - RNA, 21 nt, Leptospira interrogans serovar lai str. 56601
uagaaaauuagaaagaaucuu

SEQ ID NO: 2781558 - RNA, 14 nt, Leptospira interrogans serovar lai str. 56601
uagaaaauucaaaa

SEQ ID NO: 2781559 - RNA, 15 nt, Leptospira interrogans serovar lai str. 56601
uagaaacaaggcuuu

SEQ ID NO: 2781560 - RNA, 22 nt, Leptospira interrogans serovar lai str. 56601
uagaaaccaguaauaguuugua

SEQ ID NO: 2781561 - RNA, 19 nt, Leptospira interrogans serovar lai str. 56601
uagaaacgauguauugagu

SEQ ID NO: 2781562 - RNA, 17 nt, Leptospira interrogans serovar lai str. 56601
uagaaacuauucuauag

SEQ ID NO: 2781563 - RNA, 23 nt, Leptospira interrogans serovar lai str. 56601
uagaaacuuauacuuuauagaaa

SEQ ID NO: 2781564 - RNA, 17 nt, Leptospira interrogans serovar lai str. 56601
uagaaagaaucuuuuua

SEQ ID NO: 2781565 - RNA, 20 nt, Leptospira interrogans serovar lai str. 56601
uagaaagaaucuuuuuaaaa

SEQ ID NO: 2781566 - RNA, 23 nt, Leptospira interrogans serovar lai str. 56601
uagaaagaaucuuuuuaaaagua

SEQ ID NO: 2781567 - RNA, 11 nt, Leptospira interrogans serovar lai str. 56601
uagaaagaauu

SEQ ID NO: 2781568 - RNA, 20 nt, Leptospira interrogans serovar lai str. 56601
uagaaagacuuuucaucauu

SEQ ID NO: 2781569 - RNA, 19 nt, Leptospira interrogans serovar lai str. 56601
uagaaagaggccuuuauuu

SEQ ID NO: 2781570 - RNA, 18 nt, Leptospira interrogans serovar lai str. 56601
uagaaagauuaaauucua

SEQ ID NO: 2781571 - RNA, 21 nt, Leptospira interrogans serovar lai str. 56601
uagaaagcgaugcauugaguu

SEQ ID NO: 2781572 - RNA, 15 nt, Leptospira interrogans serovar lai str. 56601
uagaaaguuauuuua

SEQ ID NO: 2781573 - RNA, 16 nt, Leptospira interrogans serovar lai str. 56601
uagaaauacuucucca

SEQ ID NO: 2781574 - RNA, 18 nt, Leptospira interrogans serovar lai str. 56601
uagaaauagaaaccuuuc

SEQ ID NO: 2781575 - RNA, 17 nt, Leptospira interrogans serovar lai str. 56601
uagaaauaugaauuacu

SEQ ID NO: 2781576 - RNA, 19 nt, Leptospira interrogans serovar lai str. 56601
uagaaauauuuagaauaaa

SEQ ID NO: 2781577 - RNA, 20 nt, Leptospira interrogans serovar lai str. 56601
uagaaauauuuagaauaaaa

SEQ ID NO: 2781578 - RNA, 17 nt, Leptospira interrogans serovar lai str. 56601
uagaaauguaggaacuc

SEQ ID NO: 2781579 - RNA, 18 nt, Leptospira interrogans serovar lai str. 56601
uagaaauguaggaacuca

SEQ ID NO: 2781580 - RNA, 16 nt, Leptospira interrogans serovar lai str. 56601
uagaaauuuaauuuga

SEQ ID NO: 2781581 - RNA, 20 nt, Leptospira interrogans serovar lai str. 56601
uagaaauuuauaauauucuu

SEQ ID NO: 2781582 - RNA, 21 nt, Leptospira interrogans serovar lai str. 56601
uagaaauuuauaauauucuuu

SEQ ID NO: 2781583 - RNA, 16 nt, Leptospira interrogans serovar lai str. 56601
uagaaauuuucaaaaa

SEQ ID NO: 2781584 - RNA, 14 nt, Leptospira interrogans serovar lai str. 56601
uagaaauuuuuaau

SEQ ID NO: 2781585 - RNA, 19 nt, Leptospira interrogans serovar lai str. 56601
uagaaauuuuuaauaaaau

SEQ ID NO: 2781586 - RNA, 21 nt, Leptospira interrogans serovar lai str. 56601
uagaaauuuuuaaucaaaugc

SEQ ID NO: 2781587 - RNA, 15 nt, Leptospira interrogans serovar lai str. 56601
uagaacagaaugucu

SEQ ID NO: 2781588 - RNA, 13 nt, Leptospira interrogans serovar lai str. 56601
uagaacaucaauu

SEQ ID NO: 2781589 - RNA, 19 nt, Leptospira interrogans serovar lai str. 56601
uagaacaucaauuuuauuu

SEQ ID NO: 2781590 - RNA, 15 nt, Leptospira interrogans serovar lai str. 56601
uagaaccaucucaaa

SEQ ID NO: 2781591 - RNA, 14 nt, Leptospira interrogans serovar lai str. 56601
uagaaccuggauuu

SEQ ID NO: 2781592 - RNA, 14 nt, Leptospira interrogans serovar lai str. 56601
uagaacuacucaca

SEQ ID NO: 2781593 - RNA, 22 nt, Leptospira interrogans serovar lai str. 56601
uagaacuacucacaaauuguca

SEQ ID NO: 2781594 - RNA, 22 nt, Leptospira interrogans serovar lai str. 56601
uagaacucacguuaaauagaaa

SEQ ID NO: 2781595 - RNA, 13 nt, Leptospira interrogans serovar lai str. 56601
uagaacucuuuua

SEQ ID NO: 2781596 - RNA, 17 nt, Leptospira interrogans serovar lai str. 56601
uagaacuguugaaaaaa

SEQ ID NO: 2781597 - RNA, 22 nt, Leptospira interrogans serovar lai str. 56601
uagaacuguugaaaaaauccau

SEQ ID NO: 2781598 - RNA, 16 nt, Leptospira interrogans serovar lai str. 56601
uagaacuugucucaga

SEQ ID NO: 2781599 - RNA, 19 nt, Leptospira interrogans serovar lai str. 56601
uagaagcaauaaaaucaau

SEQ ID NO: 2781600 - RNA, 15 nt, Leptospira interrogans serovar lai str. 56601
uagaagccaaugugc

SEQ ID NO: 2781601 - RNA, 17 nt, Leptospira interrogans serovar lai str. 56601
uagaagccugaguuuga

SEQ ID NO: 2781602 - RNA, 18 nt, Leptospira interrogans serovar lai str. 56601
uagaagccugaguuugag

SEQ ID NO: 2781603 - RNA, 20 nt, Leptospira interrogans serovar lai str. 56601
uagaagcgagacgaaaaacu

SEQ ID NO: 2781604 - RNA, 14 nt, Leptospira interrogans serovar lai str. 56601
uagaauaaagagaa

SEQ ID NO: 2781605 - RNA, 19 nt, Leptospira interrogans serovar lai str. 56601
uagaugaacuuuuuuauau

SEQ ID NO: 2781606 - RNA, 20 nt, Leptospira interrogans serovar lai str. 56601
uagauggagaauucauuuuu

SEQ ID NO: 2781607 - RNA, 23 nt, Leptospira interrogans serovar lai str. 56601
uagauggagaauucauuuuucua

SEQ ID NO: 2781608 - RNA, 19 nt, Leptospira interrogans serovar lai str. 56601
uagauuaauuuuuauagaa

SEQ ID NO: 2781609 - RNA, 16 nt, Leptospira interrogans serovar lai str. 56601
uagauuacuaugaaaa

SEQ ID NO: 2781610 - RNA, 14 nt, Leptospira interrogans serovar lai str. 56601
uagauucaauuauu

SEQ ID NO: 2781611 - RNA, 18 nt, Leptospira interrogans serovar lai str. 56601
uagauucaauuauuauaa

SEQ ID NO: 2781612 - RNA, 15 nt, Leptospira interrogans serovar lai str. 56601
uagauugauuuaaau

SEQ ID NO: 2781613 - RNA, 20 nt, Leptospira interrogans serovar lai str. 56601
uagauugcuuuuuaaaagau

SEQ ID NO: 2781614 - RNA, 17 nt, Leptospira interrogans serovar lai str. 56601
uagauuuagauucuaaa

SEQ ID NO: 2781615 - RNA, 23 nt, Leptospira interrogans serovar lai str. 56601
uagauuuauauguuucuuuugua

SEQ ID NO: 2781616 - RNA, 18 nt, Leptospira interrogans serovar lai str. 56601
uagauuuguguuaguucc

SEQ ID NO: 2781617 - RNA, 20 nt, Leptospira interrogans serovar lai str. 56601
uagauuuguguuaguuccca

SEQ ID NO: 2781618 - RNA, 20 nt, Leptospira interrogans serovar lai str. 56601
uagcaaauuuacuucaauua

SEQ ID NO: 2781619 - RNA, 15 nt, Leptospira interrogans serovar lai str. 56601
uagcaauuugugaac

SEQ ID NO: 2781620 - RNA, 19 nt, Leptospira interrogans serovar lai str. 56601
uagcagaacgcucucucaa

SEQ ID NO: 2781621 - RNA, 23 nt, Leptospira interrogans serovar lai str. 56601
uagcagaugagcauuuuuuuaau

SEQ ID NO: 2781622 - RNA, 22 nt, Leptospira interrogans serovar lai str. 56601
uagcaguucuacuuuauuaaaa

SEQ ID NO: 2781623 - RNA, 23 nt, Leptospira interrogans serovar lai str. 56601
uagcaugaaauuuucuuagaaaa

SEQ ID NO: 2781624 - RNA, 18 nt, Leptospira interrogans serovar lai str. 56601
uagcauuuuuaagauuac

SEQ ID NO: 2781625 - RNA, 17 nt, Leptospira interrogans serovar lai str. 56601
uagccaaaaauuagaau

SEQ ID NO: 2781626 - RNA, 17 nt, Leptospira interrogans serovar lai str. 56601
uagccaguguaaacggu

SEQ ID NO: 2781627 - RNA, 17 nt, Leptospira interrogans serovar lai str. 56601
uagccguagggaugaac

SEQ ID NO: 2781628 - RNA, 16 nt, Leptospira interrogans serovar lai str. 56601
uagcgucuaaaaaauu

SEQ ID NO: 2781629 - RNA, 16 nt, Leptospira interrogans serovar lai str. 56601
uagcuucuuuaaaaac

SEQ ID NO: 2781630 - RNA, 11 nt, Leptospira interrogans serovar lai str. 56601
uaggaaaggga

SEQ ID NO: 2781631 - RNA, 15 nt, Leptospira interrogans serovar lai str. 56601
uaggaaaugaaaaag

SEQ ID NO: 2781632 - RNA, 18 nt, Leptospira interrogans serovar lai str. 56601
uaggaaaugaaaaagaau

SEQ ID NO: 2781633 - RNA, 18 nt, Leptospira interrogans serovar lai str. 56601
uaggaacccauacaaaau

SEQ ID NO: 2781634 - RNA, 22 nt, Leptospira interrogans serovar lai str. 56601
uaggaacccauacaaaauuuaa

SEQ ID NO: 2781635 - RNA, 21 nt, Leptospira interrogans serovar lai str. 56601
uaggaacuacuacuuuuagaa

SEQ ID NO: 2781636 - RNA, 23 nt, Leptospira interrogans serovar lai str. 56601
uaggaacuacuacuuuuagaaaa

SEQ ID NO: 2781637 - RNA, 15 nt, Leptospira interrogans serovar lai str. 56601
uaggaacucauacuu

SEQ ID NO: 2781638 - RNA, 23 nt, Leptospira interrogans serovar lai str. 56601
uaggaacucuuacuuugagaaaa

SEQ ID NO: 2781639 - RNA, 22 nt, Leptospira interrogans serovar lai str. 56601
uaggaacugcuuccaaaaaaag

SEQ ID NO: 2781640 - RNA, 13 nt, Leptospira interrogans serovar lai str. 56601
uaggaacuuuuau

SEQ ID NO: 2781641 - RNA, 14 nt, Leptospira interrogans serovar lai str. 56601
uaggaacuuuuaua

SEQ ID NO: 2781642 - RNA, 16 nt, Leptospira interrogans serovar lai str. 56601
uaggaauuggaggaaa

SEQ ID NO: 2781643 - RNA, 12 nt, Leptospira interrogans serovar lai str. 56601
uaggaauuuuuu

SEQ ID NO: 2781644 - RNA, 19 nt, Leptospira interrogans serovar lai str. 56601
uaggaguuccuacauuuau

SEQ ID NO: 2781645 - RNA, 14 nt, Leptospira interrogans serovar lai str. 56601
uaggaucuaugucc

SEQ ID NO: 2781646 - RNA, 12 nt, Leptospira interrogans serovar lai str. 56601
uaggauuuaaau

SEQ ID NO: 2781647 - RNA, 13 nt, Leptospira interrogans serovar lai str. 56601
uaggauuuuagaa

SEQ ID NO: 2781648 - RNA, 14 nt, Leptospira interrogans serovar lai str. 56601
uaggauuuuagaau

SEQ ID NO: 2781649 - RNA, 21 nt, Leptospira interrogans serovar lai str. 56601
uaggauuuuuggaauaaaauc

SEQ ID NO: 2781650 - RNA, 15 nt, Leptospira interrogans serovar lai str. 56601
uaggcaucauucuuu

SEQ ID NO: 2781651 - RNA, 17 nt, Leptospira interrogans serovar lai str. 56601
uaggcccgaauuuuaaa

SEQ ID NO: 2781652 - RNA, 15 nt, Leptospira interrogans serovar lai str. 56601
uaggcgcggaaaaau

SEQ ID NO: 2781653 - RNA, 15 nt, Leptospira interrogans serovar lai str. 56601
uaggcuaaucaaauu

SEQ ID NO: 2781654 - RNA, 11 nt, Leptospira interrogans serovar lai str. 56601
uagggaaaacu

SEQ ID NO: 2781655 - RNA, 14 nt, Leptospira interrogans serovar lai str. 56601
uagggaaaacucaa

SEQ ID NO: 2781656 - RNA, 16 nt, Leptospira interrogans serovar lai str. 56601
uagggaaaacucaaca

SEQ ID NO: 2781657 - RNA, 17 nt, Leptospira interrogans serovar lai str. 56601
uagggaaaacucaacac

SEQ ID NO: 2781658 - RNA, 18 nt, Leptospira interrogans serovar lai str. 56601
uagggaaaacucaucaca

SEQ ID NO: 2781659 - RNA, 21 nt, Leptospira interrogans serovar lai str. 56601
uagggaaaguuuuuuaaaaaa

SEQ ID NO: 2781660 - RNA, 17 nt, Leptospira interrogans serovar lai str. 56601
uagggaguuccuacacu

SEQ ID NO: 2781661 - RNA, 18 nt, Leptospira interrogans serovar lai str. 56601
uagggaucgaucuguaaa

SEQ ID NO: 2781662 - RNA, 23 nt, Leptospira interrogans serovar lai str. 56601
uagggccgucuauaaaauucaaa

SEQ ID NO: 2781663 - RNA, 18 nt, Leptospira interrogans serovar lai str. 56601
uagguaaagauuuucuaa

SEQ ID NO: 2781664 - RNA, 13 nt, Leptospira interrogans serovar lai str. 56601
uagguaauagaaa

SEQ ID NO: 2781665 - RNA, 15 nt, Leptospira interrogans serovar lai str. 56601
uagguagauguaaua

SEQ ID NO: 2781666 - RNA, 15 nt, Leptospira interrogans serovar lai str. 56601
uagguuccaauucca

SEQ ID NO: 2781667 - RNA, 19 nt, Leptospira interrogans serovar lai str. 56601
uagguucgaacguauaaaa

SEQ ID NO: 2781668 - RNA, 18 nt, Leptospira interrogans serovar lai str. 56601
uagguuguaacucaaaau

SEQ ID NO: 2781669 - RNA, 15 nt, Leptospira interrogans serovar lai str. 56601
uagguuguguuugau

SEQ ID NO: 2781670 - RNA, 20 nt, Leptospira interrogans serovar lai str. 56601
uagguuuaucuguaaaauga

SEQ ID NO: 2781671 - RNA, 19 nt, Leptospira interrogans serovar lai str. 56601
uagguuuguacguaaaaau

SEQ ID NO: 2781672 - RNA, 21 nt, Leptospira interrogans serovar lai str. 56601
uagguuuguacguaaaaauga

SEQ ID NO: 2781673 - RNA, 19 nt, Leptospira interrogans serovar lai str. 56601
uaguaaaacuguuuccagu

SEQ ID NO: 2781674 - RNA, 14 nt, Leptospira interrogans serovar lai str. 56601
uaguaaaagaaaau

SEQ ID NO: 2781675 - RNA, 15 nt, Leptospira interrogans serovar lai str. 56601
uaguaaaauuuaaau

SEQ ID NO: 2781676 - RNA, 14 nt, Leptospira interrogans serovar lai str. 56601
uaguaacuuucagc

SEQ ID NO: 2781677 - RNA, 16 nt, Leptospira interrogans serovar lai str. 56601
uaguaaguuuuucgau

SEQ ID NO: 2781678 - RNA, 19 nt, Leptospira interrogans serovar lai str. 56601
uaguagguccuacauguaa

SEQ ID NO: 2781679 - RNA, 12 nt, Leptospira interrogans serovar lai str. 56601
uaguaguuccca

SEQ ID NO: 2781680 - RNA, 18 nt, Leptospira interrogans serovar lai str. 56601
uaguaguucucacauuua

SEQ ID NO: 2781681 - RNA, 16 nt, Leptospira interrogans serovar lai str. 56601
uaguauauaauggcuc

SEQ ID NO: 2781682 - RNA, 12 nt, Leptospira interrogans serovar lai str. 56601
uaguauccaaaa

SEQ ID NO: 2781683 - RNA, 12 nt, Leptospira interrogans serovar lai str. 56601
uaguauguuuuu

SEQ ID NO: 2781684 - RNA, 22 nt, Leptospira interrogans serovar lai str. 56601
uagucaaauuuggaaauuguga

SEQ ID NO: 2781685 - RNA, 17 nt, Leptospira interrogans serovar lai str. 56601
uagucaaguuaauagag

SEQ ID NO: 2781686 - RNA, 22 nt, Leptospira interrogans serovar lai str. 56601
uagucaguuuuuucguaaaaaa

SEQ ID NO: 2781687 - RNA, 13 nt, Leptospira interrogans serovar lai str. 56601
uagucauauaaaa

SEQ ID NO: 2781688 - RNA, 20 nt, Leptospira interrogans serovar lai str. 56601
uauaaauauuaauuuaaaaa

SEQ ID NO: 2781689 - RNA, 22 nt, Leptospira interrogans serovar lai str. 56601
uauaaauauuaauuuaaaaaca

SEQ ID NO: 2781690 - RNA, 11 nt, Leptospira interrogans serovar lai str. 56601
uauaaaucauu

SEQ ID NO: 2781691 - RNA, 21 nt, Leptospira interrogans serovar lai str. 56601
uauaaaucuguacuuaaauuu

SEQ ID NO: 2781692 - RNA, 18 nt, Leptospira interrogans serovar lai str. 56601
uauaaaugaauuuuaaau

SEQ ID NO: 2781693 - RNA, 12 nt, Leptospira interrogans serovar lai str. 56601
uauaaauuauuu

SEQ ID NO: 2781694 - RNA, 19 nt, Leptospira interrogans serovar lai str. 56601
uauaaauucaucuaaaaaa

SEQ ID NO: 2781695 - RNA, 11 nt, Leptospira interrogans serovar lai str. 56601
uauaaauucgc

SEQ ID NO: 2781696 - RNA, 17 nt, Leptospira interrogans serovar lai str. 56601
uauaaauucgcaaaaaa

SEQ ID NO: 2781697 - RNA, 21 nt, Leptospira interrogans serovar lai str. 56601
uauaaauugaguaccuaucaa

SEQ ID NO: 2781698 - RNA, 14 nt, Leptospira interrogans serovar lai str. 56601
uauaaauuuaaaaa

SEQ ID NO: 2781699 - RNA, 15 nt, Leptospira interrogans serovar lai str. 56601
uauaaauuuaaaaaa

SEQ ID NO: 2781700 - RNA, 15 nt, Leptospira interrogans serovar lai str. 56601
uauaaauuuauauuu

SEQ ID NO: 2781701 - RNA, 20 nt, Leptospira interrogans serovar lai str. 56601
uauaacaaaguauuuaauuu

SEQ ID NO: 2781702 - RNA, 23 nt, Leptospira interrogans serovar lai str. 56601
uauaaccucaacauaaaaacauc

SEQ ID NO: 2781703 - RNA, 20 nt, Leptospira interrogans serovar lai str. 56601
uauaaccuuugauagaacuc

SEQ ID NO: 2781704 - RNA, 17 nt, Leptospira interrogans serovar lai str. 56601
uauaacgaaacuuuaau

SEQ ID NO: 2781705 - RNA, 13 nt, Leptospira interrogans serovar lai str. 56601
uauaacuuuaaaa

SEQ ID NO: 2781706 - RNA, 15 nt, Leptospira interrogans serovar lai str. 56601
uauaacuuuaaaaaa

SEQ ID NO: 2781707 - RNA, 17 nt, Leptospira interrogans serovar lai str. 56601
uauaacuuuaaaaaaua

SEQ ID NO: 2781708 - RNA, 17 nt, Leptospira interrogans serovar lai str. 56601
uauaagaaaguauuaau

SEQ ID NO: 2781709 - RNA, 21 nt, Leptospira interrogans serovar lai str. 56601
uauaagaaucgauucagagug

SEQ ID NO: 2781710 - RNA, 23 nt, Leptospira interrogans serovar lai str. 56601
uauaagccaaaccaaauagaaau

SEQ ID NO: 2781711 - RNA, 19 nt, Leptospira interrogans serovar lai str. 56601
uauaaggcgguaaaacaaa

SEQ ID NO: 2781712 - RNA, 17 nt, Leptospira interrogans serovar lai str. 56601
uauaaguuaagugaaaa

SEQ ID NO: 2781713 - RNA, 19 nt, Leptospira interrogans serovar lai str. 56601
uauaaguuuuuauuauaaa

SEQ ID NO: 2781714 - RNA, 20 nt, Leptospira interrogans serovar lai str. 56601
uauaaguuuuuauuauaaaa

SEQ ID NO: 2781715 - RNA, 13 nt, Leptospira interrogans serovar lai str. 56601
uauaauaaaaucc

SEQ ID NO: 2781716 - RNA, 16 nt, Leptospira interrogans serovar lai str. 56601
uauaauaaaauuaaca

SEQ ID NO: 2781717 - RNA, 16 nt, Leptospira interrogans serovar lai str. 56601
uauaauaaaauuauua

SEQ ID NO: 2781718 - RNA, 13 nt, Leptospira interrogans serovar lai str. 56601
uauaauaacaaaa

SEQ ID NO: 2781719 - RNA, 14 nt, Leptospira interrogans serovar lai str. 56601
uauaauaacaaaaa

SEQ ID NO: 2781720 - RNA, 12 nt, Leptospira interrogans serovar lai str. 56601
uauaauaaucuu

SEQ ID NO: 2781721 - RNA, 21 nt, Leptospira interrogans serovar lai str. 56601
uauaauacaugaauucuaauu

SEQ ID NO: 2781722 - RNA, 22 nt, Leptospira interrogans serovar lai str. 56601
uauaauacaugaauucuaauuu

SEQ ID NO: 2781723 - RNA, 20 nt, Leptospira interrogans serovar lai str. 56601
uauaauauacuuauaaagaa

SEQ ID NO: 2781724 - RNA, 16 nt, Leptospira interrogans serovar lai str. 56601
uauaauauauauaaau

SEQ ID NO: 2781725 - RNA, 15 nt, Leptospira interrogans serovar lai str. 56601
uauaauauucuuaug

SEQ ID NO: 2781726 - RNA, 15 nt, Leptospira interrogans serovar lai str. 56601
uauaauauucuuuua

SEQ ID NO: 2781727 - RNA, 17 nt, Leptospira interrogans serovar lai str. 56601
uauaauauucuuuuaua

SEQ ID NO: 2781728 - RNA, 21 nt, Leptospira interrogans serovar lai str. 56601
uauaauauucuuuuauauaau

SEQ ID NO: 2781729 - RNA, 14 nt, Leptospira interrogans serovar lai str. 56601
uauaauauuuauuu

SEQ ID NO: 2781730 - RNA, 15 nt, Leptospira interrogans serovar lai str. 56601
uauaaucaaauacaa

SEQ ID NO: 2781731 - RNA, 16 nt, Leptospira interrogans serovar lai str. 56601
uauaauccuuuuacuu

SEQ ID NO: 2781732 - RNA, 17 nt, Leptospira interrogans serovar lai str. 56601
uauaaucugaaauagaa

SEQ ID NO: 2781733 - RNA, 14 nt, Leptospira interrogans serovar lai str. 56601
uauaauguuaauuu

SEQ ID NO: 2781734 - RNA, 23 nt, Leptospira interrogans serovar lai str. 56601
uauaauguuaauuuagaauaaaa

SEQ ID NO: 2781735 - RNA, 21 nt, Leptospira interrogans serovar lai str. 56601
uauaauguuugaauuuuuaag

SEQ ID NO: 2781736 - RNA, 12 nt, Leptospira interrogans serovar lai str. 56601
uauaauuaaaaa

SEQ ID NO: 2781737 - RNA, 15 nt, Leptospira interrogans serovar lai str. 56601
uauaauuaauaaaac

SEQ ID NO: 2781738 - RNA, 16 nt, Leptospira interrogans serovar lai str. 56601
uauaauuaauaaaacu

SEQ ID NO: 2781739 - RNA, 18 nt, Leptospira interrogans serovar lai str. 56601
uauaauuaauaaaacuga

SEQ ID NO: 2781740 - RNA, 16 nt, Leptospira interrogans serovar lai str. 56601
uauaauuaaucauguu

SEQ ID NO: 2781741 - RNA, 18 nt, Leptospira interrogans serovar lai str. 56601
uauaauucguuugaacuc

SEQ ID NO: 2781742 - RNA, 16 nt, Leptospira interrogans serovar lai str. 56601
uauaauucguuuuuua

SEQ ID NO: 2781743 - RNA, 17 nt, Leptospira interrogans serovar lai str. 56601
uauaauucuguaaaaua

SEQ ID NO: 2781744 - RNA, 18 nt, Leptospira interrogans serovar lai str. 56601
uauaauucuguaaaauaa

SEQ ID NO: 2781745 - RNA, 12 nt, Leptospira interrogans serovar lai str. 56601
uauaauucuuua

SEQ ID NO: 2781746 - RNA, 15 nt, Leptospira interrogans serovar lai str. 56601
uauaauucuuuaaaa

SEQ ID NO: 2781747 - RNA, 17 nt, Leptospira interrogans serovar lai str. 56601
uauaauucuuuaaaauu

SEQ ID NO: 2781748 - RNA, 22 nt, Leptospira interrogans serovar lai str. 56601
uauaauucuuuaaaauuuuuaa

SEQ ID NO: 2781749 - RNA, 13 nt, Leptospira interrogans serovar lai str. 56601
uauaauugaacau

SEQ ID NO: 2781750 - RNA, 19 nt, Leptospira interrogans serovar lai str. 56601
uauaauugaacauuuuuaa

SEQ ID NO: 2781751 - RNA, 23 nt, Leptospira interrogans serovar lai str. 56601
uauaauugaacauuuuuaaaaau

SEQ ID NO: 2781752 - RNA, 22 nt, Leptospira interrogans serovar lai str. 56601
uauaauuuaaaaucguaaaaaa

SEQ ID NO: 2781753 - RNA, 18 nt, Leptospira interrogans serovar lai str. 56601
uauaauuuaguuuuugua

SEQ ID NO: 2781754 - RNA, 12 nt, Leptospira interrogans serovar lai str. 56601
uauaauuucuuu

SEQ ID NO: 2781755 - RNA, 17 nt, Leptospira interrogans serovar lai str. 56601
uauaauuucuuuuuaua

SEQ ID NO: 2781756 - RNA, 16 nt, Leptospira interrogans serovar lai str. 56601
uauaauuuuaaauaau

SEQ ID NO: 2781757 - RNA, 18 nt, Leptospira interrogans serovar lai str. 56601
uauaauuuuaaauaauaa

SEQ ID NO: 2781758 - RNA, 13 nt, Leptospira interrogans serovar lai str. 56601
uauaauuuuuaac

SEQ ID NO: 2781759 - RNA, 15 nt, Leptospira interrogans serovar lai str. 56601
uauaauuuuuacuuu

SEQ ID NO: 2781760 - RNA, 20 nt, Leptospira interrogans serovar lai str. 56601
uauacaaaacucuuuaaaaa

SEQ ID NO: 2781761 - RNA, 22 nt, Leptospira interrogans serovar lai str. 56601
uauacaacuuuuuuaauuuuaa

SEQ ID NO: 2781762 - RNA, 19 nt, Leptospira interrogans serovar lai str. 56601
uauacaagacuucuauacu

SEQ ID NO: 2781763 - RNA, 20 nt, Leptospira interrogans serovar lai str. 56601
uauacaagacuucuauacuc

SEQ ID NO: 2781764 - RNA, 16 nt, Leptospira interrogans serovar lai str. 56601
uauacaggaaacauua

SEQ ID NO: 2781765 - RNA, 20 nt, Leptospira interrogans serovar lai str. 56601
uauaccaaguucgauuaaaa

SEQ ID NO: 2781766 - RNA, 16 nt, Leptospira interrogans serovar lai str. 56601
uauaccaguuaaauuc

SEQ ID NO: 2781767 - RNA, 16 nt, Leptospira interrogans serovar lai str. 56601
uauacuaaaauuauuc

SEQ ID NO: 2781768 - RNA, 23 nt, Leptospira interrogans serovar lai str. 56601
uauacuagaacaauaaccuucgg

SEQ ID NO: 2781769 - RNA, 14 nt, Leptospira interrogans serovar lai str. 56601
uauacucuuaaaau

SEQ ID NO: 2781770 - RNA, 16 nt, Leptospira interrogans serovar lai str. 56601
uauacuuuaaaaaaua

SEQ ID NO: 2781771 - RNA, 13 nt, Leptospira interrogans serovar lai str. 56601
uaucaauagaaau

SEQ ID NO: 2781772 - RNA, 14 nt, Leptospira interrogans serovar lai str. 56601
uaucaauagaaaua

SEQ ID NO: 2781773 - RNA, 17 nt, Leptospira interrogans serovar lai str. 56601
uaucaauagaaauacca

SEQ ID NO: 2781774 - RNA, 20 nt, Leptospira interrogans serovar lai str. 56601
uaucaaugaucauauccgaa

SEQ ID NO: 2781775 - RNA, 21 nt, Leptospira interrogans serovar lai str. 56601
uaucaaugaucauauccgaaa

SEQ ID NO: 2781776 - RNA, 14 nt, Leptospira interrogans serovar lai str. 56601
uaucacaaacuauu

SEQ ID NO: 2781777 - RNA, 18 nt, Leptospira interrogans serovar lai str. 56601
uaucacaaacuauucuau

SEQ ID NO: 2781778 - RNA, 21 nt, Leptospira interrogans serovar lai str. 56601
uaucacaaaucacaauuuuaa

SEQ ID NO: 2781779 - RNA, 14 nt, Leptospira interrogans serovar lai str. 56601
uaucacaaaucuau

SEQ ID NO: 2781780 - RNA, 18 nt, Leptospira interrogans serovar lai str. 56601
uaucacgaaaauuaaaaa

SEQ ID NO: 2781781 - RNA, 19 nt, Leptospira interrogans serovar lai str. 56601
uaucacgaaaauuaaaaaa

SEQ ID NO: 2781782 - RNA, 12 nt, Leptospira interrogans serovar lai str. 56601
uaucagaaaaac

SEQ ID NO: 2781783 - RNA, 13 nt, Leptospira interrogans serovar lai str. 56601
uaucagaaaaaca

SEQ ID NO: 2781784 - RNA, 18 nt, Leptospira interrogans serovar lai str. 56601
uaucagaaaaacauacuu

SEQ ID NO: 2781785 - RNA, 19 nt, Leptospira interrogans serovar lai str. 56601
uaucagaaaaacauacuuu

SEQ ID NO: 2781786 - RNA, 18 nt, Leptospira interrogans serovar lai str. 56601
uaucagaucuauuucuua

SEQ ID NO: 2781787 - RNA, 12 nt, Leptospira interrogans serovar lai str. 56601
uaucauaaaaau

SEQ ID NO: 2781788 - RNA, 13 nt, Leptospira interrogans serovar lai str. 56601
uaucauaaaaaua

SEQ ID NO: 2781789 - RNA, 14 nt, Leptospira interrogans serovar lai str. 56601
uaucauaaaaauaa

SEQ ID NO: 2781790 - RNA, 20 nt, Leptospira interrogans serovar lai str. 56601
uaucauaaauuuuuauugca

SEQ ID NO: 2781791 - RNA, 16 nt, Leptospira interrogans serovar lai str. 56601
uaucauaaguuuugau

SEQ ID NO: 2781792 - RNA, 17 nt, Leptospira interrogans serovar lai str. 56601
uaucauguuuuauauaa

SEQ ID NO: 2781793 - RNA, 20 nt, Leptospira interrogans serovar lai str. 56601
uaucauucuuuccuauaaaa

SEQ ID NO: 2781794 - RNA, 21 nt, Leptospira interrogans serovar lai str. 56601
uaucauucuuuccuauaaaag

SEQ ID NO: 2781795 - RNA, 14 nt, Leptospira interrogans serovar lai str. 56601
uauccaaaacaauc

SEQ ID NO: 2781796 - RNA, 18 nt, Leptospira interrogans serovar lai str. 56601
uauccaaaaguuuauaaa

SEQ ID NO: 2781797 - RNA, 10 nt, Leptospira interrogans serovar lai str. 56601
uauccaaaau

SEQ ID NO: 2781798 - RNA, 20 nt, Leptospira interrogans serovar lai str. 56601
uauccaauuucaauuucuuc

SEQ ID NO: 2781799 - RNA, 16 nt, Leptospira interrogans serovar lai str. 56601
uauccacuaaaauacu

SEQ ID NO: 2781800 - RNA, 12 nt, Leptospira interrogans serovar lai str. 56601
uauccauaaauu

SEQ ID NO: 2781801 - RNA, 19 nt, Leptospira interrogans serovar lai str. 56601
uauccauauacguaaaaau

SEQ ID NO: 2781802 - RNA, 22 nt, Leptospira interrogans serovar lai str. 56601
uauccauucggacgauuucuau

SEQ ID NO: 2781803 - RNA, 23 nt, Leptospira interrogans serovar lai str. 56601
uauccauucuagaaccuggaaaa

SEQ ID NO: 2781804 - RNA, 13 nt, Leptospira interrogans serovar lai str. 56601
uaucccaauaagg

SEQ ID NO: 2781805 - RNA, 15 nt, Leptospira interrogans serovar lai str. 56601
uauccgauuuuuguu

SEQ ID NO: 2781806 - RNA, 19 nt, Leptospira interrogans serovar lai str. 56601
uauccuaaugaaaaagaaa

SEQ ID NO: 2781807 - RNA, 17 nt, Leptospira interrogans serovar lai str. 56601
uaucgaacgaccugcag

SEQ ID NO: 2781808 - RNA, 18 nt, Leptospira interrogans serovar lai str. 56601
uaucgaauggaauuuauu

SEQ ID NO: 2781809 - RNA, 20 nt, Leptospira interrogans serovar lai str. 56601
uaucgaauuucuucauaaaa

SEQ ID NO: 2781810 - RNA, 21 nt, Leptospira interrogans serovar lai str. 56601
uaucgaauuucuucauaaaau

SEQ ID NO: 2781811 - RNA, 22 nt, Leptospira interrogans serovar lai str. 56601
uaucgaauuucuucauaaaauc

SEQ ID NO: 2781812 - RNA, 19 nt, Leptospira interrogans serovar lai str. 56601
uaucgugaaacuuuccacu

SEQ ID NO: 2781813 - RNA, 12 nt, Leptospira interrogans serovar lai str. 56601
uaucuaaaacac

SEQ ID NO: 2781814 - RNA, 22 nt, Leptospira interrogans serovar lai str. 56601
uaucuaaaacacaucuuaaaaa

SEQ ID NO: 2781815 - RNA, 12 nt, Leptospira interrogans serovar lai str. 56601
uaucuaaaaguu

SEQ ID NO: 2781816 - RNA, 13 nt, Leptospira interrogans serovar lai str. 56601
uaucuaaaaguuu

SEQ ID NO: 2781817 - RNA, 17 nt, Leptospira interrogans serovar lai str. 56601
uaucuaaagacuaaaaa

SEQ ID NO: 2781818 - RNA, 15 nt, Leptospira interrogans serovar lai str. 56601
uaucuaaauauugau

SEQ ID NO: 2781819 - RNA, 12 nt, Leptospira interrogans serovar lai str. 56601
uaucuauaaaau

SEQ ID NO: 2781820 - RNA, 13 nt, Leptospira interrogans serovar lai str. 56601
uaucuauaaaauc

SEQ ID NO: 2781821 - RNA, 21 nt, Leptospira interrogans serovar lai str. 56601
uaucuauugaguuauaaacau

SEQ ID NO: 2781822 - RNA, 22 nt, Leptospira interrogans serovar lai str. 56601
uaucuauugaguuauaaacauu

SEQ ID NO: 2781823 - RNA, 13 nt, Leptospira interrogans serovar lai str. 56601
uaucucaaaaaua

SEQ ID NO: 2781824 - RNA, 15 nt, Leptospira interrogans serovar lai str. 56601
uaucucaaaaauacu

SEQ ID NO: 2781825 - RNA, 20 nt, Leptospira interrogans serovar lai str. 56601
uaucucaaagccuuaaauca

SEQ ID NO: 2781826 - RNA, 18 nt, Leptospira interrogans serovar lai str. 56601
uaucucaagauuaaucug

SEQ ID NO: 2781827 - RNA, 23 nt, Leptospira interrogans serovar lai str. 56601
uaucucuugucagaccuaaaauu

SEQ ID NO: 2781828 - RNA, 13 nt, Leptospira interrogans serovar lai str. 56601
uaucugcaaaaua

SEQ ID NO: 2781829 - RNA, 14 nt, Leptospira interrogans serovar lai str. 56601
uaucugccuucuuu

SEQ ID NO: 2781830 - RNA, 15 nt, Leptospira interrogans serovar lai str. 56601
uaucuguaaaauuug

SEQ ID NO: 2781831 - RNA, 23 nt, Leptospira interrogans serovar lai str. 56601
uaucuuaauauaauaauuccguu

SEQ ID NO: 2781832 - RNA, 12 nt, Leptospira interrogans serovar lai str. 56601
uaucuuaaugua

SEQ ID NO: 2781833 - RNA, 15 nt, Leptospira interrogans serovar lai str. 56601
uaucuuaauuaaaaa

SEQ ID NO: 2781834 - RNA, 21 nt, Leptospira interrogans serovar lai str. 56601
uaucuuagaauuguugaaaaa

SEQ ID NO: 2781835 - RNA, 19 nt, Leptospira interrogans serovar lai str. 56601
uaucuuagaucaauuuguu

SEQ ID NO: 2781836 - RNA, 14 nt, Leptospira interrogans serovar lai str. 56601
uaucuucuaauuaa

SEQ ID NO: 2781837 - RNA, 12 nt, Leptospira interrogans serovar lai str. 56601
uaucuuuaauug

SEQ ID NO: 2781838 - RNA, 13 nt, Leptospira interrogans serovar lai str. 56601
uaucuuuauaaaa

SEQ ID NO: 2781839 - RNA, 17 nt, Leptospira interrogans serovar lai str. 56601
uaucuuuucuuaaaauu

SEQ ID NO: 2781840 - RNA, 11 nt, Leptospira interrogans serovar lai str. 56601
uaugaaaaaau

SEQ ID NO: 2781841 - RNA, 17 nt, Leptospira interrogans serovar lai str. 56601
uaugaaaauucuuucca

SEQ ID NO: 2781842 - RNA, 16 nt, Leptospira interrogans serovar lai str. 56601
uaugaaaauucuuucu

SEQ ID NO: 2781843 - RNA, 14 nt, Leptospira interrogans serovar lai str. 56601
uaugaaaauuuaau

SEQ ID NO: 2781844 - RNA, 16 nt, Leptospira interrogans serovar lai str. 56601
uaugaaacgaaauaua

SEQ ID NO: 2781845 - RNA, 15 nt, Leptospira interrogans serovar lai str. 56601
uaugaaaguuuuuca

SEQ ID NO: 2781846 - RNA, 16 nt, Leptospira interrogans serovar lai str. 56601
uaugaaaguuuuucaa

SEQ ID NO: 2781847 - RNA, 12 nt, Leptospira interrogans serovar lai str. 56601
uaugaaauaaag

SEQ ID NO: 2781848 - RNA, 16 nt, Leptospira interrogans serovar lai str. 56601
uaugaaauacaaaaag

SEQ ID NO: 2781849 - RNA, 19 nt, Leptospira interrogans serovar lai str. 56601
uaugaaauacaaaaagaau

SEQ ID NO: 2781850 - RNA, 12 nt, Leptospira interrogans serovar lai str. 56601
uaugaacccgaa

SEQ ID NO: 2781851 - RNA, 20 nt, Leptospira interrogans serovar lai str. 56601
uaugaacucuuacaauuuca

SEQ ID NO: 2781852 - RNA, 17 nt, Leptospira interrogans serovar lai str. 56601
uaugaagaaaaccuaaa

SEQ ID NO: 2781853 - RNA, 17 nt, Leptospira interrogans serovar lai str. 56601
uaugaagacgcuuaaaa

SEQ ID NO: 2781854 - RNA, 19 nt, Leptospira interrogans serovar lai str. 56601
uaugaagacgcuuaaaaau

SEQ ID NO: 2781855 - RNA, 19 nt, Leptospira interrogans serovar lai str. 56601
uauuauuuuuguuaaacaa

SEQ ID NO: 2781856 - RNA, 22 nt, Leptospira interrogans serovar lai str. 56601
uauucaaaaaagaaaaaucuuc

SEQ ID NO: 2781857 - RNA, 15 nt, Leptospira interrogans serovar lai str. 56601
uauucaaaaaaugga

SEQ ID NO: 2781858 - RNA, 15 nt, Leptospira interrogans serovar lai str. 56601
uauucaaaagauuga

SEQ ID NO: 2781859 - RNA, 23 nt, Leptospira interrogans serovar lai str. 56601
uauucaaaagauugaauuuuuau

SEQ ID NO: 2781860 - RNA, 23 nt, Leptospira interrogans serovar lai str. 56601
uauucaaauuuacucuuauaaaa

SEQ ID NO: 2781861 - RNA, 22 nt, Leptospira interrogans serovar lai str. 56601
uauucaacuuuuugaagaaaca

SEQ ID NO: 2781862 - RNA, 16 nt, Leptospira interrogans serovar lai str. 56601
uauucaauaaaauacc

SEQ ID NO: 2781863 - RNA, 14 nt, Leptospira interrogans serovar lai str. 56601
uauucaauuucuuu

SEQ ID NO: 2781864 - RNA, 18 nt, Leptospira interrogans serovar lai str. 56601
uauucacaaaaaaauuca

SEQ ID NO: 2781865 - RNA, 18 nt, Leptospira interrogans serovar lai str. 56601
uauucacugaaaauuuaa

SEQ ID NO: 2781866 - RNA, 13 nt, Leptospira interrogans serovar lai str. 56601
uauucacuuuucc

SEQ ID NO: 2781867 - RNA, 16 nt, Leptospira interrogans serovar lai str. 56601
uauucagaaaacagaa

SEQ ID NO: 2781868 - RNA, 14 nt, Leptospira interrogans serovar lai str. 56601
uauucauaaaugau

SEQ ID NO: 2781869 - RNA, 21 nt, Leptospira interrogans serovar lai str. 56601
uauucauaaaugauaauaauu

SEQ ID NO: 2781870 - RNA, 16 nt, Leptospira interrogans serovar lai str. 56601
uauuccaugguuuuuu

SEQ ID NO: 2781871 - RNA, 18 nt, Leptospira interrogans serovar lai str. 56601
uauuccaugguuuuuuca

SEQ ID NO: 2781872 - RNA, 12 nt, Leptospira interrogans serovar lai str. 56601
uauucccaaaaa

SEQ ID NO: 2781873 - RNA, 15 nt, Leptospira interrogans serovar lai str. 56601
uauuccuaaaaugug

SEQ ID NO: 2781874 - RNA, 13 nt, Leptospira interrogans serovar lai str. 56601
uauuccuccuuua

SEQ ID NO: 2781875 - RNA, 15 nt, Leptospira interrogans serovar lai str. 56601
uauuccuccuuuauc

SEQ ID NO: 2781876 - RNA, 19 nt, Leptospira interrogans serovar lai str. 56601
uauucguaagaaaaaauuu

SEQ ID NO: 2781877 - RNA, 22 nt, Leptospira interrogans serovar lai str. 56601
uauucguaagaaaaaauuucuc

SEQ ID NO: 2781878 - RNA, 19 nt, Leptospira interrogans serovar lai str. 56601
uauucuaaacaaaauguca

SEQ ID NO: 2781879 - RNA, 15 nt, Leptospira interrogans serovar lai str. 56601
uauucucguuucuaa

SEQ ID NO: 2781880 - RNA, 17 nt, Leptospira interrogans serovar lai str. 56601
uauucucguuucuaaug

SEQ ID NO: 2781881 - RNA, 21 nt, Leptospira interrogans serovar lai str. 56601
uauucucuaucgguuuucguu

SEQ ID NO: 2781882 - RNA, 17 nt, Leptospira interrogans serovar lai str. 56601
uauucuuaaaauguagg

SEQ ID NO: 2781883 - RNA, 16 nt, Leptospira interrogans serovar lai str. 56601
uauucuuauauaucuu

SEQ ID NO: 2781884 - RNA, 23 nt, Leptospira interrogans serovar lai str. 56601
uauucuuauauuauaauucucuu

SEQ ID NO: 2781885 - RNA, 21 nt, Leptospira interrogans serovar lai str. 56601
uauucuucaucauuauuugaa

SEQ ID NO: 2781886 - RNA, 14 nt, Leptospira interrogans serovar lai str. 56601
uauucuucgcuuaa

SEQ ID NO: 2781887 - RNA, 13 nt, Leptospira interrogans serovar lai str. 56601
uauucuuuaaugg

SEQ ID NO: 2781888 - RNA, 16 nt, Leptospira interrogans serovar lai str. 56601
uauugaaaaauuucau

SEQ ID NO: 2781889 - RNA, 18 nt, Leptospira interrogans serovar lai str. 56601
uauugaaauauuauaaau

SEQ ID NO: 2781890 - RNA, 23 nt, Leptospira interrogans serovar lai str. 56601
uauugaauccaucugagaauuuc

SEQ ID NO: 2781891 - RNA, 15 nt, Leptospira interrogans serovar lai str. 56601
uauugaauccuuccu

SEQ ID NO: 2781892 - RNA, 15 nt, Leptospira interrogans serovar lai str. 56601
uauugauaaaaaaau

SEQ ID NO: 2781893 - RNA, 14 nt, Leptospira interrogans serovar lai str. 56601
uauugauccaauug

SEQ ID NO: 2781894 - RNA, 16 nt, Leptospira interrogans serovar lai str. 56601
uauugaugauugaaac

SEQ ID NO: 2781895 - RNA, 13 nt, Leptospira interrogans serovar lai str. 56601
uauugcaaaaccg

SEQ ID NO: 2781896 - RNA, 22 nt, Leptospira interrogans serovar lai str. 56601
uauugcuuuaguaguauuuaag

SEQ ID NO: 2781897 - RNA, 14 nt, Leptospira interrogans serovar lai str. 56601
uauuggguuugauu

SEQ ID NO: 2781898 - RNA, 13 nt, Leptospira interrogans serovar lai str. 56601
uauuguaauaaau

SEQ ID NO: 2781899 - RNA, 16 nt, Leptospira interrogans serovar lai str. 56601
uauuguaauaaaucga

SEQ ID NO: 2781900 - RNA, 20 nt, Leptospira interrogans serovar lai str. 56601
uauuguuaagauaaauuuag

SEQ ID NO: 2781901 - RNA, 15 nt, Leptospira interrogans serovar lai str. 56601
uauuguuuauaaaac

SEQ ID NO: 2781902 - RNA, 24 nt, Leptospira interrogans serovar lai str. 56601
uauuguuuauaaaacuguaaauua

SEQ ID NO: 2781903 - RNA, 14 nt, Leptospira interrogans serovar lai str. 56601
uauuuaaaaauucu

SEQ ID NO: 2781904 - RNA, 13 nt, Leptospira interrogans serovar lai str. 56601
uauuuaaaauuug

SEQ ID NO: 2781905 - RNA, 19 nt, Leptospira interrogans serovar lai str. 56601
uauuuaaacaaacuauacu

SEQ ID NO: 2781906 - RNA, 13 nt, Leptospira interrogans serovar lai str. 56601
uauuuaacaugag

SEQ ID NO: 2781907 - RNA, 18 nt, Leptospira interrogans serovar lai str. 56601
uauuuaacuucguugaaa

SEQ ID NO: 2781908 - RNA, 16 nt, Leptospira interrogans serovar lai str. 56601
uauuuaauaaaauuuu

SEQ ID NO: 2781909 - RNA, 23 nt, Leptospira interrogans serovar lai str. 56601
uauuuaaugaccacaaacuaucu

SEQ ID NO: 2781910 - RNA, 16 nt, Leptospira interrogans serovar lai str. 56601
uauuuacauauauaau

SEQ ID NO: 2781911 - RNA, 18 nt, Leptospira interrogans serovar lai str. 56601
uauuuacauauauaauuu

SEQ ID NO: 2781912 - RNA, 15 nt, Leptospira interrogans serovar lai str. 56601
uauuuacuuuuucca

SEQ ID NO: 2781913 - RNA, 16 nt, Leptospira interrogans serovar lai str. 56601
uauuuacuuuuuccaa

SEQ ID NO: 2781914 - RNA, 18 nt, Leptospira interrogans serovar lai str. 56601
uauuuagaauaaaauuug

SEQ ID NO: 2781915 - RNA, 18 nt, Leptospira interrogans serovar lai str. 56601
uauuuagaucaaauaagc

SEQ ID NO: 2781916 - RNA, 12 nt, Leptospira interrogans serovar lai str. 56601
uauuuaggauuu

SEQ ID NO: 2781917 - RNA, 22 nt, Leptospira interrogans serovar lai str. 56601
uauuuaguccguccacaaauug

SEQ ID NO: 2781918 - RNA, 19 nt, Leptospira interrogans serovar lai str. 56601
uauuuaguuucaauuuaaa

SEQ ID NO: 2781919 - RNA, 14 nt, Leptospira interrogans serovar lai str. 56601
uauuuauaaaacga

SEQ ID NO: 2781920 - RNA, 14 nt, Leptospira interrogans serovar lai str. 56601
uauuuauaaaauaa

SEQ ID NO: 2781921 - RNA, 13 nt, Leptospira interrogans serovar lai str. 56601
uauuuauauuucu

SEQ ID NO: 2781922 - RNA, 13 nt, Leptospira interrogans serovar lai str. 56601
uauuuauuauaua

SEQ ID NO: 2781923 - RNA, 14 nt, Leptospira interrogans serovar lai str. 56601
uauuuauuauauaa

SEQ ID NO: 2781924 - RNA, 19 nt, Leptospira interrogans serovar lai str. 56601
uauuuauucaaaauaucuu

SEQ ID NO: 2781925 - RNA, 14 nt, Leptospira interrogans serovar lai str. 56601
uauuucaaaaauuu

SEQ ID NO: 2781926 - RNA, 16 nt, Leptospira interrogans serovar lai str. 56601
uauuucaaaaauuuaa

SEQ ID NO: 2781927 - RNA, 15 nt, Leptospira interrogans serovar lai str. 56601
uauuucaaaaauuuu

SEQ ID NO: 2781928 - RNA, 12 nt, Leptospira interrogans serovar lai str. 56601
uauuucaaaauu

SEQ ID NO: 2781929 - RNA, 15 nt, Leptospira interrogans serovar lai str. 56601
uauuucaaaauuuau

SEQ ID NO: 2781930 - RNA, 15 nt, Leptospira interrogans serovar lai str. 56601
uauuucccaaaauuu

SEQ ID NO: 2781931 - RNA, 19 nt, Leptospira interrogans serovar lai str. 56601
uauuucccaaaauuucaga

SEQ ID NO: 2781932 - RNA, 18 nt, Leptospira interrogans serovar lai str. 56601
uauuuccguuauauuaaa

SEQ ID NO: 2781933 - RNA, 19 nt, Leptospira interrogans serovar lai str. 56601
uauuuccguuauauuaaaa

SEQ ID NO: 2781934 - RNA, 20 nt, Leptospira interrogans serovar lai str. 56601
uauuucgauguaauuccaga

SEQ ID NO: 2781935 - RNA, 13 nt, Leptospira interrogans serovar lai str. 56601
uauuucuaaaaga

SEQ ID NO: 2781936 - RNA, 15 nt, Leptospira interrogans serovar lai str. 56601
uauuucuaaaagaag

SEQ ID NO: 2781937 - RNA, 12 nt, Leptospira interrogans serovar lai str. 56601
uauuucuaaaau

SEQ ID NO: 2781938 - RNA, 15 nt, Leptospira interrogans serovar lai str. 56601
ucaaaaccauuuuug

SEQ ID NO: 2781939 - RNA, 20 nt, Leptospira interrogans serovar lai str. 56601
ucaaaaccuaauaaacaaaa

SEQ ID NO: 2781940 - RNA, 21 nt, Leptospira interrogans serovar lai str. 56601
ucaaaaccuguaaaugaauuu

SEQ ID NO: 2781941 - RNA, 18 nt, Leptospira interrogans serovar lai str. 56601
ucaaaacgguuuucuaau

SEQ ID NO: 2781942 - RNA, 15 nt, Leptospira interrogans serovar lai str. 56601
ucaaaacuauuaaau

SEQ ID NO: 2781943 - RNA, 18 nt, Leptospira interrogans serovar lai str. 56601
ucaaaacuauuaaauuga

SEQ ID NO: 2781944 - RNA, 15 nt, Leptospira interrogans serovar lai str. 56601
ucaaaacuuaaaucc

SEQ ID NO: 2781945 - RNA, 18 nt, Leptospira interrogans serovar lai str. 56601
ucaaaacuuuuucgaacu

SEQ ID NO: 2781946 - RNA, 16 nt, Leptospira interrogans serovar lai str. 56601
ucaaaagauugaauuu

SEQ ID NO: 2781947 - RNA, 11 nt, Leptospira interrogans serovar lai str. 56601
ucaaaaggaau

SEQ ID NO: 2781948 - RNA, 12 nt, Leptospira interrogans serovar lai str. 56601
ucaaaaggaaua

SEQ ID NO: 2781949 - RNA, 14 nt, Leptospira interrogans serovar lai str. 56601
ucaaaaggaauaca

SEQ ID NO: 2781950 - RNA, 15 nt, Leptospira interrogans serovar lai str. 56601
ucaaaaggaauacaa

SEQ ID NO: 2781951 - RNA, 14 nt, Leptospira interrogans serovar lai str. 56601
ucaaaaguuagaau

SEQ ID NO: 2781952 - RNA, 21 nt, Leptospira interrogans serovar lai str. 56601
ucaaaauaagaaaauaaaggc

SEQ ID NO: 2781953 - RNA, 18 nt, Leptospira interrogans serovar lai str. 56601
ucaaaauagaauaaauua

SEQ ID NO: 2781954 - RNA, 21 nt, Leptospira interrogans serovar lai str. 56601
ucaaaauagaauaaauuauac

SEQ ID NO: 2781955 - RNA, 18 nt, Leptospira interrogans serovar lai str. 56601
ucaaaauaguaccagaau

SEQ ID NO: 2781956 - RNA, 17 nt, Leptospira interrogans serovar lai str. 56601
ucaaaauauuuaguauu

SEQ ID NO: 2781957 - RNA, 22 nt, Leptospira interrogans serovar lai str. 56601
ucaaaauauuuaguauuuuauu

SEQ ID NO: 2781958 - RNA, 17 nt, Leptospira interrogans serovar lai str. 56601
ucaaaaucguuuuaaaa

SEQ ID NO: 2781959 - RNA, 15 nt, Leptospira interrogans serovar lai str. 56601
ucaaaaucuuaauaa

SEQ ID NO: 2781960 - RNA, 17 nt, Leptospira interrogans serovar lai str. 56601
ucaaaaucuuaauaaaa

SEQ ID NO: 2781961 - RNA, 15 nt, Leptospira interrogans serovar lai str. 56601
ucaaaaugaacucaa

SEQ ID NO: 2781962 - RNA, 14 nt, Leptospira interrogans serovar lai str. 56601
ucaaaauuaagaau

SEQ ID NO: 2781963 - RNA, 17 nt, Leptospira interrogans serovar lai str. 56601
ucaaaauuaagaaucaa

SEQ ID NO: 2781964 - RNA, 19 nt, Leptospira interrogans serovar lai str. 56601
ucaaaauuaccuuucauuu

SEQ ID NO: 2781965 - RNA, 23 nt, Leptospira interrogans serovar lai str. 56601
ucaaaauucuuaaaaaauauuuu

SEQ ID NO: 2781966 - RNA, 16 nt, Leptospira interrogans serovar lai str. 56601
ucaaaauugagaauag

SEQ ID NO: 2781967 - RNA, 12 nt, Leptospira interrogans serovar lai str. 56601
ucaaaauuuaaa

SEQ ID NO: 2781968 - RNA, 21 nt, Leptospira interrogans serovar lai str. 56601
ucaaaauuuaaauccuauuuu

SEQ ID NO: 2781969 - RNA, 21 nt, Leptospira interrogans serovar lai str. 56601
ucaaaauuuaucuguaaaauu

SEQ ID NO: 2781970 - RNA, 17 nt, Leptospira interrogans serovar lai str. 56601
ucaaaauuuuuuuaaga

SEQ ID NO: 2781971 - RNA, 16 nt, Leptospira interrogans serovar lai str. 56601
ucaaacaacaaaaaau

SEQ ID NO: 2781972 - RNA, 17 nt, Leptospira interrogans serovar lai str. 56601
ucaaacacucuaaaucu

SEQ ID NO: 2781973 - RNA, 18 nt, Leptospira interrogans serovar lai str. 56601
ucaaacacucuaaaucuu

SEQ ID NO: 2781974 - RNA, 15 nt, Leptospira interrogans serovar lai str. 56601
ucaaacggucuuucu

SEQ ID NO: 2781975 - RNA, 20 nt, Leptospira interrogans serovar lai str. 56601
ucaaacggucuuucuucugu

SEQ ID NO: 2781976 - RNA, 20 nt, Leptospira interrogans serovar lai str. 56601
ucaaacuaaauuaguucuuc

SEQ ID NO: 2781977 - RNA, 14 nt, Leptospira interrogans serovar lai str. 56601
ucaaacucuuuuuc

SEQ ID NO: 2781978 - RNA, 16 nt, Leptospira interrogans serovar lai str. 56601
ucaaacucuuuuucuu

SEQ ID NO: 2781979 - RNA, 18 nt, Leptospira interrogans serovar lai str. 56601
ucaaacugagauuugucu

SEQ ID NO: 2781980 - RNA, 15 nt, Leptospira interrogans serovar lai str. 56601
ucaaacuuacaaaaa

SEQ ID NO: 2781981 - RNA, 20 nt, Leptospira interrogans serovar lai str. 56601
ucaaacuugcaauuuuacuu

SEQ ID NO: 2781982 - RNA, 21 nt, Leptospira interrogans serovar lai str. 56601
ucaaacuuuucggaacaagau

SEQ ID NO: 2781983 - RNA, 20 nt, Leptospira interrogans serovar lai str. 56601
ucaaagaaaugugggaacuc

SEQ ID NO: 2781984 - RNA, 13 nt, Leptospira interrogans serovar lai str. 56601
ucaaagaaauuuu

SEQ ID NO: 2781985 - RNA, 22 nt, Leptospira interrogans serovar lai str. 56601
ucaaagaauuucggcuugauac

SEQ ID NO: 2781986 - RNA, 15 nt, Leptospira interrogans serovar lai str. 56601
ucaaagauaaaauau

SEQ ID NO: 2781987 - RNA, 11 nt, Leptospira interrogans serovar lai str. 56601
ucaaaggaaaa

SEQ ID NO: 2781988 - RNA, 15 nt, Leptospira interrogans serovar lai str. 56601
ucaaaggaaaaugaa

SEQ ID NO: 2781989 - RNA, 17 nt, Leptospira interrogans serovar lai str. 56601
ucaaaggaaaaugaaga

SEQ ID NO: 2781990 - RNA, 18 nt, Leptospira interrogans serovar lai str. 56601
ucaaaggaaauaaaaaua

SEQ ID NO: 2781991 - RNA, 15 nt, Leptospira interrogans serovar lai str. 56601
ucaaaggccgcuucu

SEQ ID NO: 2781992 - RNA, 22 nt, Leptospira interrogans serovar lai str. 56601
ucaaaggccgcuucuuuauuuu

SEQ ID NO: 2781993 - RNA, 18 nt, Leptospira interrogans serovar lai str. 56601
ucaaaguugauucuuccu

SEQ ID NO: 2781994 - RNA, 20 nt, Leptospira interrogans serovar lai str. 56601
ucaaaguuuugcuguaaaau

SEQ ID NO: 2781995 - RNA, 15 nt, Leptospira interrogans serovar lai str. 56601
ucaaauaaagaaaag

SEQ ID NO: 2781996 - RNA, 13 nt, Leptospira interrogans serovar lai str. 56601
ucaaauacaaaaa

SEQ ID NO: 2781997 - RNA, 22 nt, Leptospira interrogans serovar lai str. 56601
ucaaauagaguaccauaaauuu

SEQ ID NO: 2781998 - RNA, 13 nt, Leptospira interrogans serovar lai str. 56601
ucaaaucaauuuu

SEQ ID NO: 2781999 - RNA, 23 nt, Leptospira interrogans serovar lai str. 56601
ucaaaucaucuaucuuuucaaaa

SEQ ID NO: 2782000 - RNA, 15 nt, Leptospira interrogans serovar lai str. 56601
ucaaaucugaaauuc

SEQ ID NO: 2782001 - RNA, 16 nt, Leptospira interrogans serovar lai str. 56601
ucaaauucaucaauuu

SEQ ID NO: 2782002 - RNA, 21 nt, Leptospira interrogans serovar lai str. 56601
ucaaauucaugauaguuaauu

SEQ ID NO: 2782003 - RNA, 22 nt, Leptospira interrogans serovar lai str. 56601
ucaaauucaugauaguuaauuu

SEQ ID NO: 2782004 - RNA, 15 nt, Leptospira interrogans serovar lai str. 56601
ucaaauucuuuuugg

SEQ ID NO: 2782005 - RNA, 20 nt, Leptospira interrogans serovar lai str. 56601
ucaaauuguaggaguucaua

SEQ ID NO: 2782006 - RNA, 17 nt, Leptospira interrogans serovar lai str. 56601
ucaaauuuacucuuaua

SEQ ID NO: 2782007 - RNA, 16 nt, Leptospira interrogans serovar lai str. 56601
ucaaauuuauaugauu

SEQ ID NO: 2782008 - RNA, 14 nt, Leptospira interrogans serovar lai str. 56601
ucaaauuucugaaa

SEQ ID NO: 2782009 - RNA, 18 nt, Leptospira interrogans serovar lai str. 56601
ucaaauuucugaaacaau

SEQ ID NO: 2782010 - RNA, 19 nt, Leptospira interrogans serovar lai str. 56601
ucaaauuucugaaacaauc

SEQ ID NO: 2782011 - RNA, 17 nt, Leptospira interrogans serovar lai str. 56601
ucaaauuucugcaucaa

SEQ ID NO: 2782012 - RNA, 20 nt, Leptospira interrogans serovar lai str. 56601
ucaaauuucugcaucaaauc

SEQ ID NO: 2782013 - RNA, 21 nt, Leptospira interrogans serovar lai str. 56601
ucaaauuugcuucaacacuga

SEQ ID NO: 2782014 - RNA, 18 nt, Leptospira interrogans serovar lai str. 56601
ucaaauuuggaaauugug

SEQ ID NO: 2782015 - RNA, 18 nt, Leptospira interrogans serovar lai str. 56601
ucaaauuuuugaaucagu

SEQ ID NO: 2782016 - RNA, 19 nt, Leptospira interrogans serovar lai str. 56601
ucaaauuuuugcauaaaau

SEQ ID NO: 2782017 - RNA, 13 nt, Leptospira interrogans serovar lai str. 56601
ucaacaaacaaau

SEQ ID NO: 2782018 - RNA, 23 nt, Leptospira interrogans serovar lai str. 56601
ucaacaacucuaauacaaaaaau

SEQ ID NO: 2782019 - RNA, 13 nt, Leptospira interrogans serovar lai str. 56601
ucaacaacucuau

SEQ ID NO: 2782020 - RNA, 17 nt, Leptospira interrogans serovar lai str. 56601
ucaacaagaaugaaaaa

SEQ ID NO: 2782021 - RNA, 15 nt, Leptospira interrogans serovar lai str. 56601
ucaauuacuuucgua

SEQ ID NO: 2782022 - RNA, 14 nt, Leptospira interrogans serovar lai str. 56601
ucaauucaguaaau

SEQ ID NO: 2782023 - RNA, 15 nt, Leptospira interrogans serovar lai str. 56601
ucaauucaguaaauu

SEQ ID NO: 2782024 - RNA, 13 nt, Leptospira interrogans serovar lai str. 56601
ucaauugaaagua

SEQ ID NO: 2782025 - RNA, 10 nt, Leptospira interrogans serovar lai str. 56601
ucaauugauu

SEQ ID NO: 2782026 - RNA, 14 nt, Leptospira interrogans serovar lai str. 56601
ucaauuguccauuu

SEQ ID NO: 2782027 - RNA, 17 nt, Leptospira interrogans serovar lai str. 56601
ucaauuuaaaacgagau

SEQ ID NO: 2782028 - RNA, 12 nt, Leptospira interrogans serovar lai str. 56601
ucaauuuagaac

SEQ ID NO: 2782029 - RNA, 15 nt, Leptospira interrogans serovar lai str. 56601
ucaauuuagaacgca

SEQ ID NO: 2782030 - RNA, 13 nt, Leptospira interrogans serovar lai str. 56601
ucaauuuauaaac

SEQ ID NO: 2782031 - RNA, 14 nt, Leptospira interrogans serovar lai str. 56601
ucaauuucuuuaau

SEQ ID NO: 2782032 - RNA, 15 nt, Leptospira interrogans serovar lai str. 56601
ucaauuuuaccaaaa

SEQ ID NO: 2782033 - RNA, 20 nt, Leptospira interrogans serovar lai str. 56601
ucaauuuuagaauaaaucuu

SEQ ID NO: 2782034 - RNA, 17 nt, Leptospira interrogans serovar lai str. 56601
ucaauuuuaguaaacua

SEQ ID NO: 2782035 - RNA, 17 nt, Leptospira interrogans serovar lai str. 56601
ucaauuuuauuucuaag

SEQ ID NO: 2782036 - RNA, 14 nt, Leptospira interrogans serovar lai str. 56601
ucaauuuuccauuu

SEQ ID NO: 2782037 - RNA, 17 nt, Leptospira interrogans serovar lai str. 56601
ucaauuuuccauuucaa

SEQ ID NO: 2782038 - RNA, 19 nt, Leptospira interrogans serovar lai str. 56601
ucaauuuuccauuucaaua

SEQ ID NO: 2782039 - RNA, 15 nt, Leptospira interrogans serovar lai str. 56601
ucaauuuuuauaaac

SEQ ID NO: 2782040 - RNA, 17 nt, Leptospira interrogans serovar lai str. 56601
ucaauuuuuauaaacuu

SEQ ID NO: 2782041 - RNA, 15 nt, Leptospira interrogans serovar lai str. 56601
ucacaaaaaaauuca

SEQ ID NO: 2782042 - RNA, 15 nt, Leptospira interrogans serovar lai str. 56601
ucacaaaaaagauaa

SEQ ID NO: 2782043 - RNA, 20 nt, Leptospira interrogans serovar lai str. 56601
ucacaaaaaagauaaaaaga

SEQ ID NO: 2782044 - RNA, 17 nt, Leptospira interrogans serovar lai str. 56601
ucacaaaaaugaaaaaa

SEQ ID NO: 2782045 - RNA, 16 nt, Leptospira interrogans serovar lai str. 56601
ucacaaacuauucuau

SEQ ID NO: 2782046 - RNA, 13 nt, Leptospira interrogans serovar lai str. 56601
ucacaaaucacau

SEQ ID NO: 2782047 - RNA, 14 nt, Leptospira interrogans serovar lai str. 56601
ucacaaguuaaauu

SEQ ID NO: 2782048 - RNA, 18 nt, Leptospira interrogans serovar lai str. 56601
ucacaaguuaaauuggua

SEQ ID NO: 2782049 - RNA, 21 nt, Leptospira interrogans serovar lai str. 56601
ucacaauuuuuuuagaaucau

SEQ ID NO: 2782050 - RNA, 23 nt, Leptospira interrogans serovar lai str. 56601
ucacagauucagucucauuucaa

SEQ ID NO: 2782051 - RNA, 20 nt, Leptospira interrogans serovar lai str. 56601
ucacaucucuuuuuuauaau

SEQ ID NO: 2782052 - RNA, 22 nt, Leptospira interrogans serovar lai str. 56601
ucacauuaaaauaggauuuaaa

SEQ ID NO: 2782053 - RNA, 15 nt, Leptospira interrogans serovar lai str. 56601
ucacauuuaaggaau

SEQ ID NO: 2782054 - RNA, 22 nt, Leptospira interrogans serovar lai str. 56601
ucaccaacaacaccaccaacag

SEQ ID NO: 2782055 - RNA, 16 nt, Leptospira interrogans serovar lai str. 56601
ucaccaaccccacaag

SEQ ID NO: 2782056 - RNA, 20 nt, Leptospira interrogans serovar lai str. 56601
ucaccagaauuuagauaacg

SEQ ID NO: 2782057 - RNA, 20 nt, Leptospira interrogans serovar lai str. 56601
ucacgauuuuacaaacaaau

SEQ ID NO: 2782058 - RNA, 20 nt, Leptospira interrogans serovar lai str. 56601
ucacgguucgguggaaacuc

SEQ ID NO: 2782059 - RNA, 16 nt, Leptospira interrogans serovar lai str. 56601
ucacguaaaacuucuu

SEQ ID NO: 2782060 - RNA, 15 nt, Leptospira interrogans serovar lai str. 56601
ucacguuaaaaguaa

SEQ ID NO: 2782061 - RNA, 18 nt, Leptospira interrogans serovar lai str. 56601
ucacguuauauuaaucuu

SEQ ID NO: 2782062 - RNA, 13 nt, Leptospira interrogans serovar lai str. 56601
ucacguuauccuu

SEQ ID NO: 2782063 - RNA, 21 nt, Leptospira interrogans serovar lai str. 56601
ucacguuauuuuaacuugagu

SEQ ID NO: 2782064 - RNA, 24 nt, Leptospira interrogans serovar lai str. 56601
ucacguuggauuaugcaguauuuu

SEQ ID NO: 2782065 - RNA, 16 nt, Leptospira interrogans serovar lai str. 56601
ucacuaccuuauaaaa

SEQ ID NO: 2782066 - RNA, 16 nt, Leptospira interrogans serovar lai str. 56601
ucacuccgauacauuu

SEQ ID NO: 2782067 - RNA, 16 nt, Leptospira interrogans serovar lai str. 56601
ucacugaaaauuuaau

SEQ ID NO: 2782068 - RNA, 21 nt, Leptospira interrogans serovar lai str. 56601
ucacugaaaauuuaauuacga

SEQ ID NO: 2782069 - RNA, 20 nt, Leptospira interrogans serovar lai str. 56601
ucacuuuuccaaauauacga

SEQ ID NO: 2782070 - RNA, 16 nt, Leptospira interrogans serovar lai str. 56601
ucacuuuuuuaaagug

SEQ ID NO: 2782071 - RNA, 16 nt, Leptospira interrogans serovar lai str. 56601
ucagaaaaaaaaagaa

SEQ ID NO: 2782072 - RNA, 18 nt, Leptospira interrogans serovar lai str. 56601
ucagaaaaaaaaagaauu

SEQ ID NO: 2782073 - RNA, 23 nt, Leptospira interrogans serovar lai str. 56601
ucagaaaaaaaaagaauuucuaa

SEQ ID NO: 2782074 - RNA, 13 nt, Leptospira interrogans serovar lai str. 56601
ucagaaaaacaua

SEQ ID NO: 2782075 - RNA, 16 nt, Leptospira interrogans serovar lai str. 56601
ucagaaaaagugaauu

SEQ ID NO: 2782076 - RNA, 23 nt, Leptospira interrogans serovar lai str. 56601
ucagaaacauuggaacuuuuuau

SEQ ID NO: 2782077 - RNA, 15 nt, Leptospira interrogans serovar lai str. 56601
ucagaagucuuucua

SEQ ID NO: 2782078 - RNA, 23 nt, Leptospira interrogans serovar lai str. 56601
ucagaagucuuucuacaccagua

SEQ ID NO: 2782079 - RNA, 18 nt, Leptospira interrogans serovar lai str. 56601
ucagaauagauucuuaau

SEQ ID NO: 2782080 - RNA, 19 nt, Leptospira interrogans serovar lai str. 56601
ucagaauagauucuuaaug

SEQ ID NO: 2782081 - RNA, 18 nt, Leptospira interrogans serovar lai str. 56601
ucagaaucauuggaguuu

SEQ ID NO: 2782082 - RNA, 23 nt, Leptospira interrogans serovar lai str. 56601
ucagaauggcaaaacgauauuuu

SEQ ID NO: 2782083 - RNA, 16 nt, Leptospira interrogans serovar lai str. 56601
ucagaauuucuuucuc

SEQ ID NO: 2782084 - RNA, 21 nt, Leptospira interrogans serovar lai str. 56601
ucagacaugauucauuuuucu

SEQ ID NO: 2782085 - RNA, 21 nt, Leptospira interrogans serovar lai str. 56601
ucagaccaguaguauguuuuu

SEQ ID NO: 2782086 - RNA, 16 nt, Leptospira interrogans serovar lai str. 56601
ucagacuuugaaugca

SEQ ID NO: 2782087 - RNA, 22 nt, Leptospira interrogans serovar lai str. 56601
ucagagcgauauaauaaaaucc

SEQ ID NO: 2782088 - RNA, 15 nt, Leptospira interrogans serovar lai str. 56601
ucagaugaaaguuug

SEQ ID NO: 2782089 - RNA, 14 nt, Leptospira interrogans serovar lai str. 56601
ucagauucaauucu

SEQ ID NO: 2782090 - RNA, 20 nt, Leptospira interrogans serovar lai str. 56601
ucagauuuuugcacaaaauc

SEQ ID NO: 2782091 - RNA, 15 nt, Leptospira interrogans serovar lai str. 56601
ucagauuuuuguagu

SEQ ID NO: 2782092 - RNA, 16 nt, Leptospira interrogans serovar lai str. 56601
ucagcagucugugauu

SEQ ID NO: 2782093 - RNA, 23 nt, Leptospira interrogans serovar lai str. 56601
ucagccgcgcuuuccuuauuaaa

SEQ ID NO: 2782094 - RNA, 15 nt, Leptospira interrogans serovar lai str. 56601
ucagcgcauuuagaa

SEQ ID NO: 2782095 - RNA, 13 nt, Leptospira interrogans serovar lai str. 56601
ucagcuacaauca

SEQ ID NO: 2782096 - RNA, 14 nt, Leptospira interrogans serovar lai str. 56601
ucagcuacaaucaa

SEQ ID NO: 2782097 - RNA, 15 nt, Leptospira interrogans serovar lai str. 56601
ucagcuagaaaagga

SEQ ID NO: 2782098 - RNA, 16 nt, Leptospira interrogans serovar lai str. 56601
ucagcuauaaaauagg

SEQ ID NO: 2782099 - RNA, 18 nt, Leptospira interrogans serovar lai str. 56601
ucagcuccaaaaaaauaa

SEQ ID NO: 2782100 - RNA, 15 nt, Leptospira interrogans serovar lai str. 56601
ucagcucuggucaau

SEQ ID NO: 2782101 - RNA, 22 nt, Leptospira interrogans serovar lai str. 56601
ucagcucugguuaauaaauugc

SEQ ID NO: 2782102 - RNA, 19 nt, Leptospira interrogans serovar lai str. 56601
ucaggaccaaaucuuucac

SEQ ID NO: 2782103 - RNA, 18 nt, Leptospira interrogans serovar lai str. 56601
ucaggauaaccuaaaauu

SEQ ID NO: 2782104 - RNA, 16 nt, Leptospira interrogans serovar lai str. 56601
ucauuaaucagauuuu

SEQ ID NO: 2782105 - RNA, 18 nt, Leptospira interrogans serovar lai str. 56601
ucauuaaugcgaaaauuu

SEQ ID NO: 2782106 - RNA, 14 nt, Leptospira interrogans serovar lai str. 56601
ucauuaauuuuuga

SEQ ID NO: 2782107 - RNA, 20 nt, Leptospira interrogans serovar lai str. 56601
ucauuaccaauugauaauuu

SEQ ID NO: 2782108 - RNA, 13 nt, Leptospira interrogans serovar lai str. 56601
ucauuauuugaaa

SEQ ID NO: 2782109 - RNA, 14 nt, Leptospira interrogans serovar lai str. 56601
ucauuauuugaaaa

SEQ ID NO: 2782110 - RNA, 16 nt, Leptospira interrogans serovar lai str. 56601
ucauuccuauaaauaa

SEQ ID NO: 2782111 - RNA, 24 nt, Leptospira interrogans serovar lai str. 56601
ucauucuacuuugaaugaaaagau

SEQ ID NO: 2782112 - RNA, 14 nt, Leptospira interrogans serovar lai str. 56601
ucauucugauucua

SEQ ID NO: 2782113 - RNA, 17 nt, Leptospira interrogans serovar lai str. 56601
ucauucugauucuaaaa

SEQ ID NO: 2782114 - RNA, 17 nt, Leptospira interrogans serovar lai str. 56601
ucauucuugucggaaca

SEQ ID NO: 2782115 - RNA, 14 nt, Leptospira interrogans serovar lai str. 56601
ucauucuuuaaaau

SEQ ID NO: 2782116 - RNA, 23 nt, Leptospira interrogans serovar lai str. 56601
ucauugaguuucuugaacucaau

SEQ ID NO: 2782117 - RNA, 22 nt, Leptospira interrogans serovar lai str. 56601
ucauuggaguuuuuuaaaauua

SEQ ID NO: 2782118 - RNA, 15 nt, Leptospira interrogans serovar lai str. 56601
ucauuguaagaaaua

SEQ ID NO: 2782119 - RNA, 20 nt, Leptospira interrogans serovar lai str. 56601
ucauugugaauguauauuuu

SEQ ID NO: 2782120 - RNA, 15 nt, Leptospira interrogans serovar lai str. 56601
ucauuguuugaaaua

SEQ ID NO: 2782121 - RNA, 15 nt, Leptospira interrogans serovar lai str. 56601
ucauuuaccuaaaau

SEQ ID NO: 2782122 - RNA, 14 nt, Leptospira interrogans serovar lai str. 56601
ucauuuacucaaau

SEQ ID NO: 2782123 - RNA, 22 nt, Leptospira interrogans serovar lai str. 56601
ucauuucgaaaacgauuuuuca

SEQ ID NO: 2782124 - RNA, 23 nt, Leptospira interrogans serovar lai str. 56601
ucauuucgaaaacgauuuuucaa

SEQ ID NO: 2782125 - RNA, 17 nt, Leptospira interrogans serovar lai str. 56601
ucauuucguuucccaua

SEQ ID NO: 2782126 - RNA, 16 nt, Leptospira interrogans serovar lai str. 56601
ucauuugaaguauuuu

SEQ ID NO: 2782127 - RNA, 22 nt, Leptospira interrogans serovar lai str. 56601
ucauuuguagagaugauugauu

SEQ ID NO: 2782128 - RNA, 14 nt, Leptospira interrogans serovar lai str. 56601
ucauuuuacagaau

SEQ ID NO: 2782129 - RNA, 19 nt, Leptospira interrogans serovar lai str. 56601
ucauuuuagucaucauaaa

SEQ ID NO: 2782130 - RNA, 13 nt, Leptospira interrogans serovar lai str. 56601
ucauuuuucaaau

SEQ ID NO: 2782131 - RNA, 19 nt, Leptospira interrogans serovar lai str. 56601
ucauuuuuccauaaaaaac

SEQ ID NO: 2782132 - RNA, 16 nt, Leptospira interrogans serovar lai str. 56601
ucauuuuucuaaaaaa

SEQ ID NO: 2782133 - RNA, 15 nt, Leptospira interrogans serovar lai str. 56601
ucauuuuucuacaau

SEQ ID NO: 2782134 - RNA, 17 nt, Leptospira interrogans serovar lai str. 56601
ucauuuuucugaaaaaa

SEQ ID NO: 2782135 - RNA, 17 nt, Leptospira interrogans serovar lai str. 56601
ucauuuuucugaaaaag

SEQ ID NO: 2782136 - RNA, 17 nt, Leptospira interrogans serovar lai str. 56601
ucauuuuucuuaaaaaa

SEQ ID NO: 2782137 - RNA, 18 nt, Leptospira interrogans serovar lai str. 56601
ucauuuuucuuaaaaaaa

SEQ ID NO: 2782138 - RNA, 17 nt, Leptospira interrogans serovar lai str. 56601
ucauuuuuucuaaauua

SEQ ID NO: 2782139 - RNA, 16 nt, Leptospira interrogans serovar lai str. 56601
ucauuuuuugaaaaag

SEQ ID NO: 2782140 - RNA, 18 nt, Leptospira interrogans serovar lai str. 56601
uccaaaaaaauaaaucau

SEQ ID NO: 2782141 - RNA, 15 nt, Leptospira interrogans serovar lai str. 56601
uccaaaaagaaaaac

SEQ ID NO: 2782142 - RNA, 18 nt, Leptospira interrogans serovar lai str. 56601
uccaaaaauuuaaaaauu

SEQ ID NO: 2782143 - RNA, 18 nt, Leptospira interrogans serovar lai str. 56601
uccaaaaccucaaaaaau

SEQ ID NO: 2782144 - RNA, 21 nt, Leptospira interrogans serovar lai str. 56601
uccaaaaggcacauuuuucaa

SEQ ID NO: 2782145 - RNA, 16 nt, Leptospira interrogans serovar lai str. 56601
uccaaaaguuuugcgg

SEQ ID NO: 2782146 - RNA, 22 nt, Leptospira interrogans serovar lai str. 56601
uccaaaaucauuuaaagcaaau

SEQ ID NO: 2782147 - RNA, 20 nt, Leptospira interrogans serovar lai str. 56601
uccaaacacuaauaaaaaug

SEQ ID NO: 2782148 - RNA, 20 nt, Leptospira interrogans serovar lai str. 56601
uccaaacccaaugauucuaa

SEQ ID NO: 2782149 - RNA, 16 nt, Leptospira interrogans serovar lai str. 56601
uccaaacucaaugcug

SEQ ID NO: 2782150 - RNA, 15 nt, Leptospira interrogans serovar lai str. 56601
uccaaagauaaaaaa

SEQ ID NO: 2782151 - RNA, 17 nt, Leptospira interrogans serovar lai str. 56601
uccaaagauaaaaaaga

SEQ ID NO: 2782152 - RNA, 18 nt, Leptospira interrogans serovar lai str. 56601
uccaaagauaaaaaagaa

SEQ ID NO: 2782153 - RNA, 16 nt, Leptospira interrogans serovar lai str. 56601
uccaaagauuuuaaaa

SEQ ID NO: 2782154 - RNA, 24 nt, Leptospira interrogans serovar lai str. 56601
uccaaagauuuuaaaaauucaacu

SEQ ID NO: 2782155 - RNA, 15 nt, Leptospira interrogans serovar lai str. 56601
uccaaaucaaaaaag

SEQ ID NO: 2782156 - RNA, 16 nt, Leptospira interrogans serovar lai str. 56601
uccaaaucaaaaaagu

SEQ ID NO: 2782157 - RNA, 17 nt, Leptospira interrogans serovar lai str. 56601
uccaaaucaaaaaaguc

SEQ ID NO: 2782158 - RNA, 16 nt, Leptospira interrogans serovar lai str. 56601
uccaaauccccaaaag

SEQ ID NO: 2782159 - RNA, 17 nt, Leptospira interrogans serovar lai str. 56601
uccaaauuguaugaaga

SEQ ID NO: 2782160 - RNA, 16 nt, Leptospira interrogans serovar lai str. 56601
uccaacccaaacacau

SEQ ID NO: 2782161 - RNA, 18 nt, Leptospira interrogans serovar lai str. 56601
uccaacguaccaaaaccc

SEQ ID NO: 2782162 - RNA, 20 nt, Leptospira interrogans serovar lai str. 56601
uccaagaacguuuccagaaa

SEQ ID NO: 2782163 - RNA, 17 nt, Leptospira interrogans serovar lai str. 56601
uccaagcaauucuaaga

SEQ ID NO: 2782164 - RNA, 19 nt, Leptospira interrogans serovar lai str. 56601
uccaaguagagagugaaaa

SEQ ID NO: 2782165 - RNA, 14 nt, Leptospira interrogans serovar lai str. 56601
uccaauaauuuaac

SEQ ID NO: 2782166 - RNA, 15 nt, Leptospira interrogans serovar lai str. 56601
uccaauacaaaacaa

SEQ ID NO: 2782167 - RNA, 21 nt, Leptospira interrogans serovar lai str. 56601
uccaauacuuacacuccucaa

SEQ ID NO: 2782168 - RNA, 13 nt, Leptospira interrogans serovar lai str. 56601
uccaauauuuaug

SEQ ID NO: 2782169 - RNA, 13 nt, Leptospira interrogans serovar lai str. 56601
uccaaucaugaau

SEQ ID NO: 2782170 - RNA, 14 nt, Leptospira interrogans serovar lai str. 56601
uccaauccaaaauu

SEQ ID NO: 2782171 - RNA, 14 nt, Leptospira interrogans serovar lai str. 56601
uccaaugaaaacua

SEQ ID NO: 2782172 - RNA, 17 nt, Leptospira interrogans serovar lai str. 56601
uccaauguggcagcuac

SEQ ID NO: 2782173 - RNA, 18 nt, Leptospira interrogans serovar lai str. 56601
uccaauuaacaaaacugc

SEQ ID NO: 2782174 - RNA, 12 nt, Leptospira interrogans serovar lai str. 56601
uccaauuauaaa

SEQ ID NO: 2782175 - RNA, 21 nt, Leptospira interrogans serovar lai str. 56601
uccaauuauaaaauuuuucuc

SEQ ID NO: 2782176 - RNA, 17 nt, Leptospira interrogans serovar lai str. 56601
uccaauuccuucggaau

SEQ ID NO: 2782177 - RNA, 15 nt, Leptospira interrogans serovar lai str. 56601
uccaauugaauauaa

SEQ ID NO: 2782178 - RNA, 22 nt, Leptospira interrogans serovar lai str. 56601
uccaauuguuccgaauuaaaaa

SEQ ID NO: 2782179 - RNA, 23 nt, Leptospira interrogans serovar lai str. 56601
uccaauuguuccgaauuaaaaau

SEQ ID NO: 2782180 - RNA, 15 nt, Leptospira interrogans serovar lai str. 56601
uccaauuuccuggau

SEQ ID NO: 2782181 - RNA, 16 nt, Leptospira interrogans serovar lai str. 56601
uccaauuuuaaaacca

SEQ ID NO: 2782182 - RNA, 13 nt, Leptospira interrogans serovar lai str. 56601
uccaauuuugcuu

SEQ ID NO: 2782183 - RNA, 18 nt, Leptospira interrogans serovar lai str. 56601
uccaauuuugcuucuaaa

SEQ ID NO: 2782184 - RNA, 18 nt, Leptospira interrogans serovar lai str. 56601
uccacauuccgucaaauc

SEQ ID NO: 2782185 - RNA, 11 nt, Leptospira interrogans serovar lai str. 56601
uccacauuuua

SEQ ID NO: 2782186 - RNA, 15 nt, Leptospira interrogans serovar lai str. 56601
uccacauuuuaaagg

SEQ ID NO: 2782187 - RNA, 21 nt, Leptospira interrogans serovar lai str. 56601
uccccaaaaugaauuguaaaa

SEQ ID NO: 2782188 - RNA, 23 nt, Leptospira interrogans serovar lai str. 56601
ucccccuuccgauucacuuccau

SEQ ID NO: 2782189 - RNA, 13 nt, Leptospira interrogans serovar lai str. 56601
uccccuuucuaau

SEQ ID NO: 2782190 - RNA, 14 nt, Leptospira interrogans serovar lai str. 56601
uccccuuuuuuaau

SEQ ID NO: 2782191 - RNA, 14 nt, Leptospira interrogans serovar lai str. 56601
ucccgaaugaauuu

SEQ ID NO: 2782192 - RNA, 18 nt, Leptospira interrogans serovar lai str. 56601
ucccgaaugaauuuucaa

SEQ ID NO: 2782193 - RNA, 13 nt, Leptospira interrogans serovar lai str. 56601
ucccgccaaaaau

SEQ ID NO: 2782194 - RNA, 12 nt, Leptospira interrogans serovar lai str. 56601
ucccgcuaaaag

SEQ ID NO: 2782195 - RNA, 22 nt, Leptospira interrogans serovar lai str. 56601
ucccgcuggaaaaugaaaacga

SEQ ID NO: 2782196 - RNA, 23 nt, Leptospira interrogans serovar lai str. 56601
ucccguauaaaaguguaucccuu

SEQ ID NO: 2782197 - RNA, 13 nt, Leptospira interrogans serovar lai str. 56601
ucccguuuagaaa

SEQ ID NO: 2782198 - RNA, 17 nt, Leptospira interrogans serovar lai str. 56601
ucccuauuuuugggugg

SEQ ID NO: 2782199 - RNA, 23 nt, Leptospira interrogans serovar lai str. 56601
ucccucuucuagcaaucuuccug

SEQ ID NO: 2782200 - RNA, 17 nt, Leptospira interrogans serovar lai str. 56601
ucccugauaacucaguu

SEQ ID NO: 2782201 - RNA, 17 nt, Leptospira interrogans serovar lai str. 56601
ucccuuaccuccuuuuu

SEQ ID NO: 2782202 - RNA, 15 nt, Leptospira interrogans serovar lai str. 56601
ucccuugagaaauca

SEQ ID NO: 2782203 - RNA, 13 nt, Leptospira interrogans serovar lai str. 56601
uccgaaaaaccuu

SEQ ID NO: 2782204 - RNA, 21 nt, Leptospira interrogans serovar lai str. 56601
uccgaaaaauuccacuucuca

SEQ ID NO: 2782205 - RNA, 16 nt, Leptospira interrogans serovar lai str. 56601
uccgaaaggaaaagaa

SEQ ID NO: 2782206 - RNA, 14 nt, Leptospira interrogans serovar lai str. 56601
uccgaaaucccaaa

SEQ ID NO: 2782207 - RNA, 16 nt, Leptospira interrogans serovar lai str. 56601
uccgaaaucccaaaac

SEQ ID NO: 2782208 - RNA, 21 nt, Leptospira interrogans serovar lai str. 56601
uccgaaaucccaaaaccgaau

SEQ ID NO: 2782209 - RNA, 13 nt, Leptospira interrogans serovar lai str. 56601
uccgaauacaaag

SEQ ID NO: 2782210 - RNA, 15 nt, Leptospira interrogans serovar lai str. 56601
uccgaauaggaucag

SEQ ID NO: 2782211 - RNA, 15 nt, Leptospira interrogans serovar lai str. 56601
uccgaauuaaaaauu

SEQ ID NO: 2782212 - RNA, 15 nt, Leptospira interrogans serovar lai str. 56601
uccgaauucuaaaau

SEQ ID NO: 2782213 - RNA, 16 nt, Leptospira interrogans serovar lai str. 56601
uccgaauugaucucau

SEQ ID NO: 2782214 - RNA, 17 nt, Leptospira interrogans serovar lai str. 56601
uccgaauugaucucaua

SEQ ID NO: 2782215 - RNA, 17 nt, Leptospira interrogans serovar lai str. 56601
uccgauacgaguaaaaa

SEQ ID NO: 2782216 - RNA, 14 nt, Leptospira interrogans serovar lai str. 56601
uccgaucauuugaa

SEQ ID NO: 2782217 - RNA, 19 nt, Leptospira interrogans serovar lai str. 56601
uccgaugcauugaguucag

SEQ ID NO: 2782218 - RNA, 19 nt, Leptospira interrogans serovar lai str. 56601
uccgcaaaaauuccuuuuu

SEQ ID NO: 2782219 - RNA, 17 nt, Leptospira interrogans serovar lai str. 56601
uccggacuuuccagaaa

SEQ ID NO: 2782220 - RNA, 12 nt, Leptospira interrogans serovar lai str. 56601
uccggcuaaaaa

SEQ ID NO: 2782221 - RNA, 22 nt, Leptospira interrogans serovar lai str. 56601
uccggcuaaaaaacugauuaaa

SEQ ID NO: 2782222 - RNA, 22 nt, Leptospira interrogans serovar lai str. 56601
uccgggaauauucguaagaaaa

SEQ ID NO: 2782223 - RNA, 20 nt, Leptospira interrogans serovar lai str. 56601
uccgguaaauuuuuuagaaa

SEQ ID NO: 2782224 - RNA, 16 nt, Leptospira interrogans serovar lai str. 56601
uccgguucgaaucauu

SEQ ID NO: 2782225 - RNA, 22 nt, Leptospira interrogans serovar lai str. 56601
uccguaaaaaguuaauucuaaa

SEQ ID NO: 2782226 - RNA, 14 nt, Leptospira interrogans serovar lai str. 56601
uccguaaaauucaa

SEQ ID NO: 2782227 - RNA, 13 nt, Leptospira interrogans serovar lai str. 56601
uccguaaacucaa

SEQ ID NO: 2782228 - RNA, 13 nt, Leptospira interrogans serovar lai str. 56601
uccguaccccaaa

SEQ ID NO: 2782229 - RNA, 21 nt, Leptospira interrogans serovar lai str. 56601
uccguagccgcuucaaaguug

SEQ ID NO: 2782230 - RNA, 14 nt, Leptospira interrogans serovar lai str. 56601
uccgucuuuuguaa

SEQ ID NO: 2782231 - RNA, 18 nt, Leptospira interrogans serovar lai str. 56601
uccgugaacuucuuucau

SEQ ID NO: 2782232 - RNA, 15 nt, Leptospira interrogans serovar lai str. 56601
uccguuauauuaaaa

SEQ ID NO: 2782233 - RNA, 23 nt, Leptospira interrogans serovar lai str. 56601
uccguuuuuaaucgcagguugca

SEQ ID NO: 2782234 - RNA, 19 nt, Leptospira interrogans serovar lai str. 56601
uccguuuuuauuucuuuug

SEQ ID NO: 2782235 - RNA, 17 nt, Leptospira interrogans serovar lai str. 56601
uccuaaaaaauaaaugu

SEQ ID NO: 2782236 - RNA, 19 nt, Leptospira interrogans serovar lai str. 56601
uccuaaaaccucaaaaaau

SEQ ID NO: 2782237 - RNA, 20 nt, Leptospira interrogans serovar lai str. 56601
uccuaaaaugugggaacucu

SEQ ID NO: 2782238 - RNA, 22 nt, Leptospira interrogans serovar lai str. 56601
uccuaaaaugugggaacucuua

SEQ ID NO: 2782239 - RNA, 19 nt, Leptospira interrogans serovar lai str. 56601
uccuaaaauugugggaacu

SEQ ID NO: 2782240 - RNA, 16 nt, Leptospira interrogans serovar lai str. 56601
uccuaagaaucaaauc

SEQ ID NO: 2782241 - RNA, 16 nt, Leptospira interrogans serovar lai str. 56601
uccuaaugaaaaagaa

SEQ ID NO: 2782242 - RNA, 18 nt, Leptospira interrogans serovar lai str. 56601
uccuaaugaaaaagaaac

SEQ ID NO: 2782243 - RNA, 18 nt, Leptospira interrogans serovar lai str. 56601
uccuaaugcagcuucuuc

SEQ ID NO: 2782244 - RNA, 20 nt, Leptospira interrogans serovar lai str. 56601
uccuaaugcagcuucuucca

SEQ ID NO: 2782245 - RNA, 22 nt, Leptospira interrogans serovar lai str. 56601
uccuacaaauuaagucccauuu

SEQ ID NO: 2782246 - RNA, 20 nt, Leptospira interrogans serovar lai str. 56601
uccuacauguaaaacuuaga

SEQ ID NO: 2782247 - RNA, 12 nt, Leptospira interrogans serovar lai str. 56601
uccuacauuuua

SEQ ID NO: 2782248 - RNA, 18 nt, Leptospira interrogans serovar lai str. 56601
uccuacauuuuaaaaauu

SEQ ID NO: 2782249 - RNA, 12 nt, Leptospira interrogans serovar lai str. 56601
uccuacauuuuc

SEQ ID NO: 2782250 - RNA, 12 nt, Leptospira interrogans serovar lai str. 56601
uccuacauuuuu

SEQ ID NO: 2782251 - RNA, 16 nt, Leptospira interrogans serovar lai str. 56601
uccuacauuuuuuaaa

SEQ ID NO: 2782252 - RNA, 15 nt, Leptospira interrogans serovar lai str. 56601
uccuacauuuuuuau

SEQ ID NO: 2782253 - RNA, 18 nt, Leptospira interrogans serovar lai str. 56601
uccuacuuauuucuauaa

SEQ ID NO: 2782254 - RNA, 19 nt, Leptospira interrogans serovar lai str. 56601
uccuacuuauuucuauaaa

SEQ ID NO: 2782255 - RNA, 12 nt, Leptospira interrogans serovar lai str. 56601
uccuauaaauuc

SEQ ID NO: 2782256 - RNA, 16 nt, Leptospira interrogans serovar lai str. 56601
uccuauaucaacaauc

SEQ ID NO: 2782257 - RNA, 19 nt, Leptospira interrogans serovar lai str. 56601
uccuauucaacuugugggg

SEQ ID NO: 2782258 - RNA, 18 nt, Leptospira interrogans serovar lai str. 56601
uccucaacggguucuuca

SEQ ID NO: 2782259 - RNA, 20 nt, Leptospira interrogans serovar lai str. 56601
uccucaacggguucuucauu

SEQ ID NO: 2782260 - RNA, 11 nt, Leptospira interrogans serovar lai str. 56601
uccucaauuag

SEQ ID NO: 2782261 - RNA, 21 nt, Leptospira interrogans serovar lai str. 56601
uccuccaaacaauuuuuugaa

SEQ ID NO: 2782262 - RNA, 19 nt, Leptospira interrogans serovar lai str. 56601
uccuccgauucugaauauu

SEQ ID NO: 2782263 - RNA, 21 nt, Leptospira interrogans serovar lai str. 56601
uccuccuugaguuugagaaau

SEQ ID NO: 2782264 - RNA, 16 nt, Leptospira interrogans serovar lai str. 56601
uccucgcuuuuaauaa

SEQ ID NO: 2782265 - RNA, 13 nt, Leptospira interrogans serovar lai str. 56601
uccucuaugaaac

SEQ ID NO: 2782266 - RNA, 18 nt, Leptospira interrogans serovar lai str. 56601
uccucuaugaaacuuagu

SEQ ID NO: 2782267 - RNA, 13 nt, Leptospira interrogans serovar lai str. 56601
uccucugauaaaa

SEQ ID NO: 2782268 - RNA, 16 nt, Leptospira interrogans serovar lai str. 56601
uccucugauaaaauca

SEQ ID NO: 2782269 - RNA, 22 nt, Leptospira interrogans serovar lai str. 56601
uccucuucuuugucuuugagaa

SEQ ID NO: 2782270 - RNA, 17 nt, Leptospira interrogans serovar lai str. 56601
ucgacauaagaaagaau

SEQ ID NO: 2782271 - RNA, 15 nt, Leptospira interrogans serovar lai str. 56601
ucgaccguuuccaug

SEQ ID NO: 2782272 - RNA, 19 nt, Leptospira interrogans serovar lai str. 56601
ucgacgauuuuacgaacaa

SEQ ID NO: 2782273 - RNA, 14 nt, Leptospira interrogans serovar lai str. 56601
ucgacguaaaaaua

SEQ ID NO: 2782274 - RNA, 14 nt, Leptospira interrogans serovar lai str. 56601
ucgacguaagaaua

SEQ ID NO: 2782275 - RNA, 16 nt, Leptospira interrogans serovar lai str. 56601
ucgacguaagaauauu

SEQ ID NO: 2782276 - RNA, 12 nt, Leptospira interrogans serovar lai str. 56601
ucgacuucuuuu

SEQ ID NO: 2782277 - RNA, 15 nt, Leptospira interrogans serovar lai str. 56601
ucgacuuuaguucuc

SEQ ID NO: 2782278 - RNA, 18 nt, Leptospira interrogans serovar lai str. 56601
ucgacuuuaguucuccua

SEQ ID NO: 2782279 - RNA, 18 nt, Leptospira interrogans serovar lai str. 56601
ucgacuuuugaaaaucca

SEQ ID NO: 2782280 - RNA, 21 nt, Leptospira interrogans serovar lai str. 56601
ucgaguccuuuuugagaaacu

SEQ ID NO: 2782281 - RNA, 22 nt, Leptospira interrogans serovar lai str. 56601
ucgagucgcgugccuucacaua

SEQ ID NO: 2782282 - RNA, 19 nt, Leptospira interrogans serovar lai str. 56601
ucgaguguaaucuuauuuu

SEQ ID NO: 2782283 - RNA, 24 nt, Leptospira interrogans serovar lai str. 56601
ucgauccuguuuauaaccccuaag

SEQ ID NO: 2782284 - RNA, 14 nt, Leptospira interrogans serovar lai str. 56601
ucgaucuacuaaau

SEQ ID NO: 2782285 - RNA, 14 nt, Leptospira interrogans serovar lai str. 56601
ucgaucuguaaaau

SEQ ID NO: 2782286 - RNA, 18 nt, Leptospira interrogans serovar lai str. 56601
ucgaugguuucaauuuaa

SEQ ID NO: 2782287 - RNA, 20 nt, Leptospira interrogans serovar lai str. 56601
ucgauuccuaaaauguggga

SEQ ID NO: 2782288 - RNA, 22 nt, Leptospira interrogans serovar lai str. 56601
ucgauuccuacuuauuucuaua

SEQ ID NO: 2782289 - RNA, 19 nt, Leptospira interrogans serovar lai str. 56601
ucgauucugauaacuauau

SEQ ID NO: 2782290 - RNA, 23 nt, Leptospira interrogans serovar lai str. 56601
ucgauugcucucguuuuuaggau

SEQ ID NO: 2782291 - RNA, 14 nt, Leptospira interrogans serovar lai str. 56601
ucgauuuaauauau

SEQ ID NO: 2782292 - RNA, 14 nt, Leptospira interrogans serovar lai str. 56601
ucgauuucuaaaau

SEQ ID NO: 2782293 - RNA, 15 nt, Leptospira interrogans serovar lai str. 56601
ucgauuucuaauauu

SEQ ID NO: 2782294 - RNA, 19 nt, Leptospira interrogans serovar lai str. 56601
ucgauuucuaauauuaaaa

SEQ ID NO: 2782295 - RNA, 22 nt, Leptospira interrogans serovar lai str. 56601
ucgauuucuaauauuaaaaaca

SEQ ID NO: 2782296 - RNA, 17 nt, Leptospira interrogans serovar lai str. 56601
ucgauuugaucuacaau

SEQ ID NO: 2782297 - RNA, 13 nt, Leptospira interrogans serovar lai str. 56601
ucgauuuguaaaa

SEQ ID NO: 2782298 - RNA, 12 nt, Leptospira interrogans serovar lai str. 56601
ucgauuuuaaau

SEQ ID NO: 2782299 - RNA, 23 nt, Leptospira interrogans serovar lai str. 56601
ucgauuuuacagagauauagaaa

SEQ ID NO: 2782300 - RNA, 20 nt, Leptospira interrogans serovar lai str. 56601
ucgauuuuggguuuggagua

SEQ ID NO: 2782301 - RNA, 15 nt, Leptospira interrogans serovar lai str. 56601
ucgcaaauaauaaaa

SEQ ID NO: 2782302 - RNA, 20 nt, Leptospira interrogans serovar lai str. 56601
ucgcaacauaauguuucaau

SEQ ID NO: 2782303 - RNA, 19 nt, Leptospira interrogans serovar lai str. 56601
ucgcaacggauuccuccag

SEQ ID NO: 2782304 - RNA, 16 nt, Leptospira interrogans serovar lai str. 56601
ucgcaaguugauuaug

SEQ ID NO: 2782305 - RNA, 17 nt, Leptospira interrogans serovar lai str. 56601
ucgcacgucccacaaau

SEQ ID NO: 2782306 - RNA, 17 nt, Leptospira interrogans serovar lai str. 56601
ucgcauaacauuuugcu

SEQ ID NO: 2782307 - RNA, 19 nt, Leptospira interrogans serovar lai str. 56601
ucgcauugaucuuuuagau

SEQ ID NO: 2782308 - RNA, 23 nt, Leptospira interrogans serovar lai str. 56601
ucgcauuguuuaaauagauucaa

SEQ ID NO: 2782309 - RNA, 14 nt, Leptospira interrogans serovar lai str. 56601
ucgcauuuuccuuu

SEQ ID NO: 2782310 - RNA, 16 nt, Leptospira interrogans serovar lai str. 56601
ucgcauuuuccuuuuu

SEQ ID NO: 2782311 - RNA, 22 nt, Leptospira interrogans serovar lai str. 56601
ucgccaaaauauucagaaacug

SEQ ID NO: 2782312 - RNA, 21 nt, Leptospira interrogans serovar lai str. 56601
ucgccccaugcgccccagccc

SEQ ID NO: 2782313 - RNA, 20 nt, Leptospira interrogans serovar lai str. 56601
ucgccguucugggcucaaaa

SEQ ID NO: 2782314 - RNA, 22 nt, Leptospira interrogans serovar lai str. 56601
ucgccguucugggcuccaaaag

SEQ ID NO: 2782315 - RNA, 18 nt, Leptospira interrogans serovar lai str. 56601
ucgccuauuuuuuuaaaa

SEQ ID NO: 2782316 - RNA, 15 nt, Leptospira interrogans serovar lai str. 56601
ucgccucuugaagcc

SEQ ID NO: 2782317 - RNA, 19 nt, Leptospira interrogans serovar lai str. 56601
ucgcguuugaaacucagua

SEQ ID NO: 2782318 - RNA, 21 nt, Leptospira interrogans serovar lai str. 56601
ucgcguuuuauaauaaauuga

SEQ ID NO: 2782319 - RNA, 23 nt, Leptospira interrogans serovar lai str. 56601
ucgcuaaacuaucuauuagaaca

SEQ ID NO: 2782320 - RNA, 13 nt, Leptospira interrogans serovar lai str. 56601
ucgcucaaauuuu

SEQ ID NO: 2782321 - RNA, 17 nt, Leptospira interrogans serovar lai str. 56601
ucgcucaaucaaauuuu

SEQ ID NO: 2782322 - RNA, 12 nt, Leptospira interrogans serovar lai str. 56601
ucgcucgcaaau

SEQ ID NO: 2782323 - RNA, 24 nt, Leptospira interrogans serovar lai str. 56601
ucgcugauaaauuucauaucuaaa

SEQ ID NO: 2782324 - RNA, 22 nt, Leptospira interrogans serovar lai str. 56601
ucgcuguuuuguggucaacauc

SEQ ID NO: 2782325 - RNA, 19 nt, Leptospira interrogans serovar lai str. 56601
ucgcuuaucaauucacucu

SEQ ID NO: 2782326 - RNA, 17 nt, Leptospira interrogans serovar lai str. 56601
ucggaaaauugaauauu

SEQ ID NO: 2782327 - RNA, 18 nt, Leptospira interrogans serovar lai str. 56601
ucggaacaauuacagaag

SEQ ID NO: 2782328 - RNA, 18 nt, Leptospira interrogans serovar lai str. 56601
ucggaacacuugaaaaau

SEQ ID NO: 2782329 - RNA, 17 nt, Leptospira interrogans serovar lai str. 56601
ucggaacuagggaauuu

SEQ ID NO: 2782330 - RNA, 21 nt, Leptospira interrogans serovar lai str. 56601
ucggaacuagggaauuuuuca

SEQ ID NO: 2782331 - RNA, 18 nt, Leptospira interrogans serovar lai str. 56601
ucggaagauuuuucaauc

SEQ ID NO: 2782332 - RNA, 22 nt, Leptospira interrogans serovar lai str. 56601
ucggaaggauuagcaugaaauu

SEQ ID NO: 2782333 - RNA, 15 nt, Leptospira interrogans serovar lai str. 56601
ucggaauaacuuucu

SEQ ID NO: 2782334 - RNA, 21 nt, Leptospira interrogans serovar lai str. 56601
ucggaauauuuuuuccaaaaa

SEQ ID NO: 2782335 - RNA, 17 nt, Leptospira interrogans serovar lai str. 56601
ucggaaucgaggaaauu

SEQ ID NO: 2782336 - RNA, 17 nt, Leptospira interrogans serovar lai str. 56601
ucggaauuucugcuaca

SEQ ID NO: 2782337 - RNA, 23 nt, Leptospira interrogans serovar lai str. 56601
ucggaauuuuaauuguaaaagga

SEQ ID NO: 2782338 - RNA, 13 nt, Leptospira interrogans serovar lai str. 56601
ucggacgauuucu

SEQ ID NO: 2782339 - RNA, 20 nt, Leptospira interrogans serovar lai str. 56601
ucggagucauacauuuugua

SEQ ID NO: 2782340 - RNA, 20 nt, Leptospira interrogans serovar lai str. 56601
ucggccucguuuacaagauu

SEQ ID NO: 2782341 - RNA, 15 nt, Leptospira interrogans serovar lai str. 56601
ucggcuuaagaaaau

SEQ ID NO: 2782342 - RNA, 13 nt, Leptospira interrogans serovar lai str. 56601
ucggcuuuaagug

SEQ ID NO: 2782343 - RNA, 15 nt, Leptospira interrogans serovar lai str. 56601
ucgggacaaaucaua

SEQ ID NO: 2782344 - RNA, 16 nt, Leptospira interrogans serovar lai str. 56601
ucgguauaaucuaauu

SEQ ID NO: 2782345 - RNA, 15 nt, Leptospira interrogans serovar lai str. 56601
ucgguggaaacucag

SEQ ID NO: 2782346 - RNA, 19 nt, Leptospira interrogans serovar lai str. 56601
ucgguggaaacucaguaaa

SEQ ID NO: 2782347 - RNA, 19 nt, Leptospira interrogans serovar lai str. 56601
ucgguugagcaaaaauuuu

SEQ ID NO: 2782348 - RNA, 15 nt, Leptospira interrogans serovar lai str. 56601
ucguaaaaaaauauu

SEQ ID NO: 2782349 - RNA, 17 nt, Leptospira interrogans serovar lai str. 56601
ucguaaaaaaauauuuc

SEQ ID NO: 2782350 - RNA, 12 nt, Leptospira interrogans serovar lai str. 56601
ucguaaaaaaga

SEQ ID NO: 2782351 - RNA, 14 nt, Leptospira interrogans serovar lai str. 56601
ucguaaaaaagaua

SEQ ID NO: 2782352 - RNA, 15 nt, Leptospira interrogans serovar lai str. 56601
ucguaagaaaaaauu

SEQ ID NO: 2782353 - RNA, 12 nt, Leptospira interrogans serovar lai str. 56601
ucuaauaaaaua

SEQ ID NO: 2782354 - RNA, 14 nt, Leptospira interrogans serovar lai str. 56601
ucuaauacaaaaaa

SEQ ID NO: 2782355 - RNA, 17 nt, Leptospira interrogans serovar lai str. 56601
ucuaauagagaaaaauu

SEQ ID NO: 2782356 - RNA, 19 nt, Leptospira interrogans serovar lai str. 56601
ucuaauagagaaaaauuuu

SEQ ID NO: 2782357 - RNA, 16 nt, Leptospira interrogans serovar lai str. 56601
ucuaauagauuuauga

SEQ ID NO: 2782358 - RNA, 22 nt, Leptospira interrogans serovar lai str. 56601
ucuaauagucucauacuuaauu

SEQ ID NO: 2782359 - RNA, 13 nt, Leptospira interrogans serovar lai str. 56601
ucuaauauuaaaa

SEQ ID NO: 2782360 - RNA, 14 nt, Leptospira interrogans serovar lai str. 56601
ucuaauauuaaaaa

SEQ ID NO: 2782361 - RNA, 18 nt, Leptospira interrogans serovar lai str. 56601
ucuaaucacgaaaaauga

SEQ ID NO: 2782362 - RNA, 22 nt, Leptospira interrogans serovar lai str. 56601
ucuaaucccgccaaaaaugccg

SEQ ID NO: 2782363 - RNA, 16 nt, Leptospira interrogans serovar lai str. 56601
ucuaaucgaaacuaua

SEQ ID NO: 2782364 - RNA, 17 nt, Leptospira interrogans serovar lai str. 56601
ucuaaucgaaacuauaa

SEQ ID NO: 2782365 - RNA, 18 nt, Leptospira interrogans serovar lai str. 56601
ucuaauguacaacauccu

SEQ ID NO: 2782366 - RNA, 19 nt, Leptospira interrogans serovar lai str. 56601
ucuaauguacaacauccuu

SEQ ID NO: 2782367 - RNA, 18 nt, Leptospira interrogans serovar lai str. 56601
ucuaaugucguuaaauuu

SEQ ID NO: 2782368 - RNA, 20 nt, Leptospira interrogans serovar lai str. 56601
ucuaauucuaaaaauuuuuu

SEQ ID NO: 2782369 - RNA, 20 nt, Leptospira interrogans serovar lai str. 56601
ucuaauucuucuaaugaagu

SEQ ID NO: 2782370 - RNA, 19 nt, Leptospira interrogans serovar lai str. 56601
ucuaauuuaaaaaagaaga

SEQ ID NO: 2782371 - RNA, 21 nt, Leptospira interrogans serovar lai str. 56601
ucuaauuuaaaaaagaagaau

SEQ ID NO: 2782372 - RNA, 17 nt, Leptospira interrogans serovar lai str. 56601
ucuaauuucagcuagaa

SEQ ID NO: 2782373 - RNA, 15 nt, Leptospira interrogans serovar lai str. 56601
ucuaauuuuauaaau

SEQ ID NO: 2782374 - RNA, 19 nt, Leptospira interrogans serovar lai str. 56601
ucuaauuuuauaaauuauu

SEQ ID NO: 2782375 - RNA, 15 nt, Leptospira interrogans serovar lai str. 56601
ucuaauuuuucaaaa

SEQ ID NO: 2782376 - RNA, 20 nt, Leptospira interrogans serovar lai str. 56601
ucuaauuuuucaaaaacucu

SEQ ID NO: 2782377 - RNA, 15 nt, Leptospira interrogans serovar lai str. 56601
ucuacaaauucuucu

SEQ ID NO: 2782378 - RNA, 19 nt, Leptospira interrogans serovar lai str. 56601
ucuacaaauucuucuuccu

SEQ ID NO: 2782379 - RNA, 17 nt, Leptospira interrogans serovar lai str. 56601
ucuacaaguucauaaga

SEQ ID NO: 2782380 - RNA, 17 nt, Leptospira interrogans serovar lai str. 56601
ucuacaauuauauuaaa

SEQ ID NO: 2782381 - RNA, 22 nt, Leptospira interrogans serovar lai str. 56601
ucuacaccaguauucaauucca

SEQ ID NO: 2782382 - RNA, 23 nt, Leptospira interrogans serovar lai str. 56601
ucuacagaacccaauaaaaacua

SEQ ID NO: 2782383 - RNA, 23 nt, Leptospira interrogans serovar lai str. 56601
ucuacagauaaacgcggauaaac

SEQ ID NO: 2782384 - RNA, 16 nt, Leptospira interrogans serovar lai str. 56601
ucuacaugauucauuu

SEQ ID NO: 2782385 - RNA, 23 nt, Leptospira interrogans serovar lai str. 56601
ucuacaugauucauuuaaaaauu

SEQ ID NO: 2782386 - RNA, 23 nt, Leptospira interrogans serovar lai str. 56601
ucuacauucugaaacuuuucaaa

SEQ ID NO: 2782387 - RNA, 18 nt, Leptospira interrogans serovar lai str. 56601
ucuacauuggaaggacga

SEQ ID NO: 2782388 - RNA, 18 nt, Leptospira interrogans serovar lai str. 56601
ucuacccacucuuugacu

SEQ ID NO: 2782389 - RNA, 14 nt, Leptospira interrogans serovar lai str. 56601
ucuaccccaucucu

SEQ ID NO: 2782390 - RNA, 15 nt, Leptospira interrogans serovar lai str. 56601
ucuacgaauuucaga

SEQ ID NO: 2782391 - RNA, 16 nt, Leptospira interrogans serovar lai str. 56601
ucuacgacuaacaaaa

SEQ ID NO: 2782392 - RNA, 23 nt, Leptospira interrogans serovar lai str. 56601
ucuacgacuaacaaaaugauuuu

SEQ ID NO: 2782393 - RNA, 17 nt, Leptospira interrogans serovar lai str. 56601
ucuacuaagauuucuug

SEQ ID NO: 2782394 - RNA, 22 nt, Leptospira interrogans serovar lai str. 56601
ucuacuauaaacuucucuuaaa

SEQ ID NO: 2782395 - RNA, 13 nt, Leptospira interrogans serovar lai str. 56601
ucuacucuugaag

SEQ ID NO: 2782396 - RNA, 15 nt, Leptospira interrogans serovar lai str. 56601
ucuacugaguuucaa

SEQ ID NO: 2782397 - RNA, 16 nt, Leptospira interrogans serovar lai str. 56601
ucuacuuuauuaaaaa

SEQ ID NO: 2782398 - RNA, 22 nt, Leptospira interrogans serovar lai str. 56601
ucuacuuuauuaaaaaguuuuc

SEQ ID NO: 2782399 - RNA, 13 nt, Leptospira interrogans serovar lai str. 56601
ucuagaaacugca

SEQ ID NO: 2782400 - RNA, 23 nt, Leptospira interrogans serovar lai str. 56601
ucuagaaauaugaauuacuacaa

SEQ ID NO: 2782401 - RNA, 21 nt, Leptospira interrogans serovar lai str. 56601
ucuagaaauuuauaauauucu

SEQ ID NO: 2782402 - RNA, 20 nt, Leptospira interrogans serovar lai str. 56601
ucuagaaccuggaaaagaau

SEQ ID NO: 2782403 - RNA, 21 nt, Leptospira interrogans serovar lai str. 56601
ucuagauuuuacgauuaaauu

SEQ ID NO: 2782404 - RNA, 22 nt, Leptospira interrogans serovar lai str. 56601
ucuagcaacacauuuucauucu

SEQ ID NO: 2782405 - RNA, 23 nt, Leptospira interrogans serovar lai str. 56601
ucuaguauuauuuuccuuuaaua

SEQ ID NO: 2782406 - RNA, 15 nt, Leptospira interrogans serovar lai str. 56601
ucuagucaaguuaau

SEQ ID NO: 2782407 - RNA, 14 nt, Leptospira interrogans serovar lai str. 56601
ucuagucaauuaaa

SEQ ID NO: 2782408 - RNA, 14 nt, Leptospira interrogans serovar lai str. 56601
ucuaguuugaauuu

SEQ ID NO: 2782409 - RNA, 16 nt, Leptospira interrogans serovar lai str. 56601
ucuaguuuuugaauag

SEQ ID NO: 2782410 - RNA, 18 nt, Leptospira interrogans serovar lai str. 56601
ucuauaaaacaaaauaga

SEQ ID NO: 2782411 - RNA, 11 nt, Leptospira interrogans serovar lai str. 56601
ucuauaaaauc

SEQ ID NO: 2782412 - RNA, 13 nt, Leptospira interrogans serovar lai str. 56601
ucuauaaaaucua

SEQ ID NO: 2782413 - RNA, 21 nt, Leptospira interrogans serovar lai str. 56601
ucuauaaaaucuaaaaaaaau

SEQ ID NO: 2782414 - RNA, 20 nt, Leptospira interrogans serovar lai str. 56601
ucuauaaaaucuaaaaaaac

SEQ ID NO: 2782415 - RNA, 21 nt, Leptospira interrogans serovar lai str. 56601
ucuauaaaaucuaaaaagaau

SEQ ID NO: 2782416 - RNA, 19 nt, Leptospira interrogans serovar lai str. 56601
ucuauaaaauuaaauaccu

SEQ ID NO: 2782417 - RNA, 20 nt, Leptospira interrogans serovar lai str. 56601
ucuauaaaauucaaaaagaa

SEQ ID NO: 2782418 - RNA, 16 nt, Leptospira interrogans serovar lai str. 56601
ucuauaaaauugaaua

SEQ ID NO: 2782419 - RNA, 21 nt, Leptospira interrogans serovar lai str. 56601
ucuauaaaauuugaaaguaaa

SEQ ID NO: 2782420 - RNA, 15 nt, Leptospira interrogans serovar lai str. 56601
ucuauaaaguugaau

SEQ ID NO: 2782421 - RNA, 13 nt, Leptospira interrogans serovar lai str. 56601
ucuauaaaugaau

SEQ ID NO: 2782422 - RNA, 20 nt, Leptospira interrogans serovar lai str. 56601
ucuauaaaugaauuuuaaau

SEQ ID NO: 2782423 - RNA, 23 nt, Leptospira interrogans serovar lai str. 56601
ucuauaaauucaucuaaaaaaaa

SEQ ID NO: 2782424 - RNA, 20 nt, Leptospira interrogans serovar lai str. 56601
ucuauaaauugcaucaaaga

SEQ ID NO: 2782425 - RNA, 12 nt, Leptospira interrogans serovar lai str. 56601
ucuauaaauugg

SEQ ID NO: 2782426 - RNA, 14 nt, Leptospira interrogans serovar lai str. 56601
ucuauaauguuaau

SEQ ID NO: 2782427 - RNA, 20 nt, Leptospira interrogans serovar lai str. 56601
ucuauaauuaauaaaacuga

SEQ ID NO: 2782428 - RNA, 21 nt, Leptospira interrogans serovar lai str. 56601
ucuauagccaaguauaaaagu

SEQ ID NO: 2782429 - RNA, 24 nt, Leptospira interrogans serovar lai str. 56601
ucuauagcuuuugagcaguaaaaa

SEQ ID NO: 2782430 - RNA, 13 nt, Leptospira interrogans serovar lai str. 56601
ucuauauauugaa

SEQ ID NO: 2782431 - RNA, 16 nt, Leptospira interrogans serovar lai str. 56601
ucuauaucgugaaacu

SEQ ID NO: 2782432 - RNA, 23 nt, Leptospira interrogans serovar lai str. 56601
ucuauaucgugaaacuuuccacu

SEQ ID NO: 2782433 - RNA, 13 nt, Leptospira interrogans serovar lai str. 56601
ucuauauucaaaa

SEQ ID NO: 2782434 - RNA, 14 nt, Leptospira interrogans serovar lai str. 56601
ucuaucaaacgaag

SEQ ID NO: 2782435 - RNA, 18 nt, Leptospira interrogans serovar lai str. 56601
ucucuaacaaaaaguguu

SEQ ID NO: 2782436 - RNA, 16 nt, Leptospira interrogans serovar lai str. 56601
ucucuaauacaugaua

SEQ ID NO: 2782437 - RNA, 18 nt, Leptospira interrogans serovar lai str. 56601
ucucuagaaauuuauaau

SEQ ID NO: 2782438 - RNA, 18 nt, Leptospira interrogans serovar lai str. 56601
ucucuaucagaaaaacau

SEQ ID NO: 2782439 - RNA, 12 nt, Leptospira interrogans serovar lai str. 56601
ucucuuaaaauu

SEQ ID NO: 2782440 - RNA, 15 nt, Leptospira interrogans serovar lai str. 56601
ucucuuauuagaacu

SEQ ID NO: 2782441 - RNA, 21 nt, Leptospira interrogans serovar lai str. 56601
ucucuugcgguucuugcuuca

SEQ ID NO: 2782442 - RNA, 17 nt, Leptospira interrogans serovar lai str. 56601
ucucuuuauauaaaauu

SEQ ID NO: 2782443 - RNA, 22 nt, Leptospira interrogans serovar lai str. 56601
ucucuuuuacgacuuuauucaa

SEQ ID NO: 2782444 - RNA, 20 nt, Leptospira interrogans serovar lai str. 56601
ucucuuuugagagccuuuuu

SEQ ID NO: 2782445 - RNA, 15 nt, Leptospira interrogans serovar lai str. 56601
ucucuuuuucucuuu

SEQ ID NO: 2782446 - RNA, 13 nt, Leptospira interrogans serovar lai str. 56601
ucucuuuuuuaaa

SEQ ID NO: 2782447 - RNA, 19 nt, Leptospira interrogans serovar lai str. 56601
ucucuuuuuuauaauaguu

SEQ ID NO: 2782448 - RNA, 21 nt, Leptospira interrogans serovar lai str. 56601
ucugaaaaaagcugaacuuaa

SEQ ID NO: 2782449 - RNA, 14 nt, Leptospira interrogans serovar lai str. 56601
ucugaaaaaaguua

SEQ ID NO: 2782450 - RNA, 22 nt, Leptospira interrogans serovar lai str. 56601
ucugaaaaaaguugaaaucuga

SEQ ID NO: 2782451 - RNA, 22 nt, Leptospira interrogans serovar lai str. 56601
ucugaaaagaauugaaaucuga

SEQ ID NO: 2782452 - RNA, 13 nt, Leptospira interrogans serovar lai str. 56601
ucugaaaaguuua

SEQ ID NO: 2782453 - RNA, 16 nt, Leptospira interrogans serovar lai str. 56601
ucugaaaauguaaaag

SEQ ID NO: 2782454 - RNA, 23 nt, Leptospira interrogans serovar lai str. 56601
ucugaaagugaaaguaaucuuuu

SEQ ID NO: 2782455 - RNA, 12 nt, Leptospira interrogans serovar lai str. 56601
ucugaaauaaaa

SEQ ID NO: 2782456 - RNA, 15 nt, Leptospira interrogans serovar lai str. 56601
ucugaaauagaauuu

SEQ ID NO: 2782457 - RNA, 17 nt, Leptospira interrogans serovar lai str. 56601
ucugaaauagaauuuuu

SEQ ID NO: 2782458 - RNA, 16 nt, Leptospira interrogans serovar lai str. 56601
ucugaaccaaauacuu

SEQ ID NO: 2782459 - RNA, 23 nt, Leptospira interrogans serovar lai str. 56601
ucugaaccaaauacuuagaauuu

SEQ ID NO: 2782460 - RNA, 10 nt, Leptospira interrogans serovar lai str. 56601
ucugaaccug

SEQ ID NO: 2782461 - RNA, 14 nt, Leptospira interrogans serovar lai str. 56601
ucugaacuaugaaa

SEQ ID NO: 2782462 - RNA, 18 nt, Leptospira interrogans serovar lai str. 56601
ucugaacuaugaaauuuu

SEQ ID NO: 2782463 - RNA, 18 nt, Leptospira interrogans serovar lai str. 56601
ucugaaggaauauucauu

SEQ ID NO: 2782464 - RNA, 14 nt, Leptospira interrogans serovar lai str. 56601
ucugaaguaucucu

SEQ ID NO: 2782465 - RNA, 19 nt, Leptospira interrogans serovar lai str. 56601
ucugaauaaaaauacuaaa

SEQ ID NO: 2782466 - RNA, 22 nt, Leptospira interrogans serovar lai str. 56601
ucugaauaauugaauaaacugu

SEQ ID NO: 2782467 - RNA, 12 nt, Leptospira interrogans serovar lai str. 56601
ucugaauauuuu

SEQ ID NO: 2782468 - RNA, 17 nt, Leptospira interrogans serovar lai str. 56601
ucugaauuuuaccaaau

SEQ ID NO: 2782469 - RNA, 14 nt, Leptospira interrogans serovar lai str. 56601
ucugaauuuuuaua

SEQ ID NO: 2782470 - RNA, 24 nt, Leptospira interrogans serovar lai str. 56601
ucugacuuggugauaaucaucaaa

SEQ ID NO: 2782471 - RNA, 13 nt, Leptospira interrogans serovar lai str. 56601
ucugaguagaaag

SEQ ID NO: 2782472 - RNA, 19 nt, Leptospira interrogans serovar lai str. 56601
ucugauaaagaaaaccacc

SEQ ID NO: 2782473 - RNA, 17 nt, Leptospira interrogans serovar lai str. 56601
ucugauaacuauauaac

SEQ ID NO: 2782474 - RNA, 19 nt, Leptospira interrogans serovar lai str. 56601
ucugauaacuauauaacaa

SEQ ID NO: 2782475 - RNA, 22 nt, Leptospira interrogans serovar lai str. 56601
ucugauaauuuuuuaaaaaaau

SEQ ID NO: 2782476 - RNA, 17 nt, Leptospira interrogans serovar lai str. 56601
ucugauacuaauaguuu

SEQ ID NO: 2782477 - RNA, 15 nt, Leptospira interrogans serovar lai str. 56601
ucugauagagaaaaa

SEQ ID NO: 2782478 - RNA, 14 nt, Leptospira interrogans serovar lai str. 56601
ucugauauuuuaaa

SEQ ID NO: 2782479 - RNA, 19 nt, Leptospira interrogans serovar lai str. 56601
ucugauauuuuaaauugaa

SEQ ID NO: 2782480 - RNA, 19 nt, Leptospira interrogans serovar lai str. 56601
ucugcaaagcucagauucc

SEQ ID NO: 2782481 - RNA, 20 nt, Leptospira interrogans serovar lai str. 56601
ucugcaaagcucagauucca

SEQ ID NO: 2782482 - RNA, 21 nt, Leptospira interrogans serovar lai str. 56601
ucugcauauacggauuucuau

SEQ ID NO: 2782483 - RNA, 23 nt, Leptospira interrogans serovar lai str. 56601
ucugcauauacggauuucuauaa

SEQ ID NO: 2782484 - RNA, 16 nt, Leptospira interrogans serovar lai str. 56601
ucugccauuuuuaguc

SEQ ID NO: 2782485 - RNA, 18 nt, Leptospira interrogans serovar lai str. 56601
ucugccccaaaauuuaga

SEQ ID NO: 2782486 - RNA, 19 nt, Leptospira interrogans serovar lai str. 56601
ucugccccaaaauuuagaa

SEQ ID NO: 2782487 - RNA, 16 nt, Leptospira interrogans serovar lai str. 56601
ucugcugaauuuaccu

SEQ ID NO: 2782488 - RNA, 22 nt, Leptospira interrogans serovar lai str. 56601
ucuggaaaaauuccuaaaacac

SEQ ID NO: 2782489 - RNA, 14 nt, Leptospira interrogans serovar lai str. 56601
ucuggaaaaguuuu

SEQ ID NO: 2782490 - RNA, 18 nt, Leptospira interrogans serovar lai str. 56601
ucuggaaaaguuuuuaaa

SEQ ID NO: 2782491 - RNA, 17 nt, Leptospira interrogans serovar lai str. 56601
ucuggaagccaaaacca

SEQ ID NO: 2782492 - RNA, 16 nt, Leptospira interrogans serovar lai str. 56601
ucuggagaaagauuuu

SEQ ID NO: 2782493 - RNA, 17 nt, Leptospira interrogans serovar lai str. 56601
ucugguggaauucguua

SEQ ID NO: 2782494 - RNA, 19 nt, Leptospira interrogans serovar lai str. 56601
ucugguuccauaaagacca

SEQ ID NO: 2782495 - RNA, 14 nt, Leptospira interrogans serovar lai str. 56601
ucuguaaaaaauaa

SEQ ID NO: 2782496 - RNA, 15 nt, Leptospira interrogans serovar lai str. 56601
ucuguaaaaaauaaa

SEQ ID NO: 2782497 - RNA, 13 nt, Leptospira interrogans serovar lai str. 56601
ucuguaaaaauaa

SEQ ID NO: 2782498 - RNA, 16 nt, Leptospira interrogans serovar lai str. 56601
ucuguaaaagaaaaau

SEQ ID NO: 2782499 - RNA, 19 nt, Leptospira interrogans serovar lai str. 56601
ucuguaaaagaaaaauuaa

SEQ ID NO: 2782500 - RNA, 14 nt, Leptospira interrogans serovar lai str. 56601
ucuguaaaauucag

SEQ ID NO: 2782501 - RNA, 21 nt, Leptospira interrogans serovar lai str. 56601
ucuguaaaguucagauucgaa

SEQ ID NO: 2782502 - RNA, 20 nt, Leptospira interrogans serovar lai str. 56601
ucuguaaauucaaagcaaga

SEQ ID NO: 2782503 - RNA, 21 nt, Leptospira interrogans serovar lai str. 56601
ucuguaaucuuccgcauuuuu

SEQ ID NO: 2782504 - RNA, 12 nt, Leptospira interrogans serovar lai str. 56601
ucuguaauugga

SEQ ID NO: 2782505 - RNA, 15 nt, Leptospira interrogans serovar lai str. 56601
ucuguaauuggaaug

SEQ ID NO: 2782506 - RNA, 17 nt, Leptospira interrogans serovar lai str. 56601
ucuguagaaauucuauu

SEQ ID NO: 2782507 - RNA, 19 nt, Leptospira interrogans serovar lai str. 56601
ucugucucuuuauauaaaa

SEQ ID NO: 2782508 - RNA, 21 nt, Leptospira interrogans serovar lai str. 56601
ucugucucuuuauauaaaauu

SEQ ID NO: 2782509 - RNA, 20 nt, Leptospira interrogans serovar lai str. 56601
ucugucuuaaaauuugaaaa

SEQ ID NO: 2782510 - RNA, 14 nt, Leptospira interrogans serovar lai str. 56601
ucugugaaacucag

SEQ ID NO: 2782511 - RNA, 16 nt, Leptospira interrogans serovar lai str. 56601
ucuguggacuuaugag

SEQ ID NO: 2782512 - RNA, 23 nt, Leptospira interrogans serovar lai str. 56601
ucuguuccgcuguaguaucucuu

SEQ ID NO: 2782513 - RNA, 19 nt, Leptospira interrogans serovar lai str. 56601
ucuguuuagaauauuuucu

SEQ ID NO: 2782514 - RNA, 15 nt, Leptospira interrogans serovar lai str. 56601
ucuguuuuauagaau

SEQ ID NO: 2782515 - RNA, 23 nt, Leptospira interrogans serovar lai str. 56601
ucuguuuuuagcguaaauucacu

SEQ ID NO: 2782516 - RNA, 12 nt, Leptospira interrogans serovar lai str. 56601
ucuuaaaaaaau

SEQ ID NO: 2782517 - RNA, 15 nt, Leptospira interrogans serovar lai str. 56601
ucuuaaaaaauauuu

SEQ ID NO: 2782518 - RNA, 19 nt, Leptospira interrogans serovar lai str. 56601
ucuuuuuuaauaauguuuu

SEQ ID NO: 2782519 - RNA, 12 nt, Leptospira interrogans serovar lai str. 56601
ucuuuuuuaauu

SEQ ID NO: 2782520 - RNA, 13 nt, Leptospira interrogans serovar lai str. 56601
ucuuuuuuccuuc

SEQ ID NO: 2782521 - RNA, 13 nt, Leptospira interrogans serovar lai str. 56601
ucuuuuuucuaaa

SEQ ID NO: 2782522 - RNA, 14 nt, Leptospira interrogans serovar lai str. 56601
ucuuuuuucuaaau

SEQ ID NO: 2782523 - RNA, 15 nt, Leptospira interrogans serovar lai str. 56601
ucuuuuuucuaaaua

SEQ ID NO: 2782524 - RNA, 14 nt, Leptospira interrogans serovar lai str. 56601
ucuuuuuuucauuu

SEQ ID NO: 2782525 - RNA, 17 nt, Leptospira interrogans serovar lai str. 56601
ucuuuuuuuucuaaaau

SEQ ID NO: 2782526 - RNA, 18 nt, Leptospira interrogans serovar lai str. 56601
ucuuuuuuuucuaaaaua

SEQ ID NO: 2782527 - RNA, 19 nt, Leptospira interrogans serovar lai str. 56601
ugaaaaaaaaauugucuuu

SEQ ID NO: 2782528 - RNA, 13 nt, Leptospira interrogans serovar lai str. 56601
ugaaaaaaaacaa

SEQ ID NO: 2782529 - RNA, 19 nt, Leptospira interrogans serovar lai str. 56601
ugaaaaaaacgucuuuauc

SEQ ID NO: 2782530 - RNA, 24 nt, Leptospira interrogans serovar lai str. 56601
ugaaaaaaauuagaaucugaaccu

SEQ ID NO: 2782531 - RNA, 20 nt, Leptospira interrogans serovar lai str. 56601
ugaaaaaaguuagaaucuaa

SEQ ID NO: 2782532 - RNA, 19 nt, Leptospira interrogans serovar lai str. 56601
ugaaaaaaguugaaaucug

SEQ ID NO: 2782533 - RNA, 21 nt, Leptospira interrogans serovar lai str. 56601
ugaaaaaaguugaaaucugaa

SEQ ID NO: 2782534 - RNA, 18 nt, Leptospira interrogans serovar lai str. 56601
ugaaaaaaguuggaauuu

SEQ ID NO: 2782535 - RNA, 13 nt, Leptospira interrogans serovar lai str. 56601
ugaaaaacuccau

SEQ ID NO: 2782536 - RNA, 11 nt, Leptospira interrogans serovar lai str. 56601
ugaaaaacucg

SEQ ID NO: 2782537 - RNA, 21 nt, Leptospira interrogans serovar lai str. 56601
ugaaaaacucgguuucuuaua

SEQ ID NO: 2782538 - RNA, 17 nt, Leptospira interrogans serovar lai str. 56601
ugaaaaagaauauaacu

SEQ ID NO: 2782539 - RNA, 11 nt, Leptospira interrogans serovar lai str. 56601
ugaaaaagagc

SEQ ID NO: 2782540 - RNA, 16 nt, Leptospira interrogans serovar lai str. 56601
ugaaaaagagcaaagg

SEQ ID NO: 2782541 - RNA, 19 nt, Leptospira interrogans serovar lai str. 56601
ugaaaaagcggucuugaaa

SEQ ID NO: 2782542 - RNA, 19 nt, Leptospira interrogans serovar lai str. 56601
ugaaaaagguuggaaucua

SEQ ID NO: 2782543 - RNA, 20 nt, Leptospira interrogans serovar lai str. 56601
ugaaaaagguuggaaucuaa

SEQ ID NO: 2782544 - RNA, 22 nt, Leptospira interrogans serovar lai str. 56601
ugaaaaagguuggaaucuaaac

SEQ ID NO: 2782545 - RNA, 19 nt, Leptospira interrogans serovar lai str. 56601
ugaaaaaguuggaaucuaa

SEQ ID NO: 2782546 - RNA, 18 nt, Leptospira interrogans serovar lai str. 56601
ugaaaaaguugggaucua

SEQ ID NO: 2782547 - RNA, 23 nt, Leptospira interrogans serovar lai str. 56601
ugaaaaauagaauuguugaaaaa

SEQ ID NO: 2782548 - RNA, 22 nt, Leptospira interrogans serovar lai str. 56601
ugaaaaaugaauucucuaucuu

SEQ ID NO: 2782549 - RNA, 13 nt, Leptospira interrogans serovar lai str. 56601
ugaaaaauuucau

SEQ ID NO: 2782550 - RNA, 22 nt, Leptospira interrogans serovar lai str. 56601
ugaaaaauuuuauaguagauau

SEQ ID NO: 2782551 - RNA, 16 nt, Leptospira interrogans serovar lai str. 56601
ugaaaacgaugucuuu

SEQ ID NO: 2782552 - RNA, 21 nt, Leptospira interrogans serovar lai str. 56601
ugaaaagauccgacauaugcu

SEQ ID NO: 2782553 - RNA, 16 nt, Leptospira interrogans serovar lai str. 56601
ugaaaagucaaaaaau

SEQ ID NO: 2782554 - RNA, 13 nt, Leptospira interrogans serovar lai str. 56601
ugaaaagugaguu

SEQ ID NO: 2782555 - RNA, 18 nt, Leptospira interrogans serovar lai str. 56601
ugaaaagugaguuuucuu

SEQ ID NO: 2782556 - RNA, 18 nt, Leptospira interrogans serovar lai str. 56601
ugaaaaguuuaugaauuu

SEQ ID NO: 2782557 - RNA, 20 nt, Leptospira interrogans serovar lai str. 56601
ugaaaaguuuaugaauuucc

SEQ ID NO: 2782558 - RNA, 14 nt, Leptospira interrogans serovar lai str. 56601
ugaaaauaaaaauc

SEQ ID NO: 2782559 - RNA, 22 nt, Leptospira interrogans serovar lai str. 56601
ugaaaauaaaaaucauaaaaca

SEQ ID NO: 2782560 - RNA, 17 nt, Leptospira interrogans serovar lai str. 56601
ugaaaaucggauaguuu

SEQ ID NO: 2782561 - RNA, 19 nt, Leptospira interrogans serovar lai str. 56601
ugaaaaucggauaguuuaa

SEQ ID NO: 2782562 - RNA, 20 nt, Leptospira interrogans serovar lai str. 56601
ugaaaaucuagguuuccuuc

SEQ ID NO: 2782563 - RNA, 16 nt, Leptospira interrogans serovar lai str. 56601
ugaaaaugaccaaaau

SEQ ID NO: 2782564 - RNA, 12 nt, Leptospira interrogans serovar lai str. 56601
ugaaaauguaaa

SEQ ID NO: 2782565 - RNA, 17 nt, Leptospira interrogans serovar lai str. 56601
ugaaaauucuaagauca

SEQ ID NO: 2782566 - RNA, 22 nt, Leptospira interrogans serovar lai str. 56601
ugaaaauucuauaguaaagauu

SEQ ID NO: 2782567 - RNA, 12 nt, Leptospira interrogans serovar lai str. 56601
ugaaaauucuuu

SEQ ID NO: 2782568 - RNA, 16 nt, Leptospira interrogans serovar lai str. 56601
ugaaaauugugggaac

SEQ ID NO: 2782569 - RNA, 19 nt, Leptospira interrogans serovar lai str. 56601
ugaaaauugugggaacuac

SEQ ID NO: 2782570 - RNA, 11 nt, Leptospira interrogans serovar lai str. 56601
ugaaaauuuaa

SEQ ID NO: 2782571 - RNA, 14 nt, Leptospira interrogans serovar lai str. 56601
ugaaaauuuuccuu

SEQ ID NO: 2782572 - RNA, 13 nt, Leptospira interrogans serovar lai str. 56601
ugaaacaaauucu

SEQ ID NO: 2782573 - RNA, 19 nt, Leptospira interrogans serovar lai str. 56601
ugaaacaucacuuccauuu

SEQ ID NO: 2782574 - RNA, 18 nt, Leptospira interrogans serovar lai str. 56601
ugaaacauuucuaaaaua

SEQ ID NO: 2782575 - RNA, 15 nt, Leptospira interrogans serovar lai str. 56601
ugaaaccagauuucc

SEQ ID NO: 2782576 - RNA, 16 nt, Leptospira interrogans serovar lai str. 56601
ugaaaccagauuuccg

SEQ ID NO: 2782577 - RNA, 19 nt, Leptospira interrogans serovar lai str. 56601
ugaaaccaucgauuuacuu

SEQ ID NO: 2782578 - RNA, 17 nt, Leptospira interrogans serovar lai str. 56601
ugaaaccaucuacagaa

SEQ ID NO: 2782579 - RNA, 21 nt, Leptospira interrogans serovar lai str. 56601
ugaaaccaucuacagaaccca

SEQ ID NO: 2782580 - RNA, 15 nt, Leptospira interrogans serovar lai str. 56601
ugaaacucaaugcau

SEQ ID NO: 2782581 - RNA, 18 nt, Leptospira interrogans serovar lai str. 56601
ugaaacuuuccacuuuuc

SEQ ID NO: 2782582 - RNA, 17 nt, Leptospira interrogans serovar lai str. 56601
ugaaacuuuuaauaaaa

SEQ ID NO: 2782583 - RNA, 18 nt, Leptospira interrogans serovar lai str. 56601
ugaaacuuuuaauaaaac

SEQ ID NO: 2782584 - RNA, 22 nt, Leptospira interrogans serovar lai str. 56601
ugaaagauuguuuugcugaguu

SEQ ID NO: 2782585 - RNA, 13 nt, Leptospira interrogans serovar lai str. 56601
ugaaaguaaucuu

SEQ ID NO: 2782586 - RNA, 20 nt, Leptospira interrogans serovar lai str. 56601
ugaaaguaaucuuuuuaaaa

SEQ ID NO: 2782587 - RNA, 23 nt, Leptospira interrogans serovar lai str. 56601
ugaaaguaauuuaucuguaauuu

SEQ ID NO: 2782588 - RNA, 22 nt, Leptospira interrogans serovar lai str. 56601
ugaaagucuaacaguaaaacuu

SEQ ID NO: 2782589 - RNA, 11 nt, Leptospira interrogans serovar lai str. 56601
ugaaagucuuu

SEQ ID NO: 2782590 - RNA, 19 nt, Leptospira interrogans serovar lai str. 56601
ugaaagugaaaguaaucuu

SEQ ID NO: 2782591 - RNA, 20 nt, Leptospira interrogans serovar lai str. 56601
ugaaaguucccaaauugcca

SEQ ID NO: 2782592 - RNA, 19 nt, Leptospira interrogans serovar lai str. 56601
ugaaaguuuuuuuauaaaa

SEQ ID NO: 2782593 - RNA, 21 nt, Leptospira interrogans serovar lai str. 56601
ugaaaguuuuuuuauaaaauu

SEQ ID NO: 2782594 - RNA, 14 nt, Leptospira interrogans serovar lai str. 56601
ugaaauaaauuuaa

SEQ ID NO: 2782595 - RNA, 17 nt, Leptospira interrogans serovar lai str. 56601
ugaaauacaaaaagaau

SEQ ID NO: 2782596 - RNA, 12 nt, Leptospira interrogans serovar lai str. 56601
ugaaauagaaaa

SEQ ID NO: 2782597 - RNA, 17 nt, Leptospira interrogans serovar lai str. 56601
ugaaauagaauuuugca

SEQ ID NO: 2782598 - RNA, 21 nt, Leptospira interrogans serovar lai str. 56601
ugaaauaguauauuaacuuuc

SEQ ID NO: 2782599 - RNA, 16 nt, Leptospira interrogans serovar lai str. 56601
ugaaauagucaauuga

SEQ ID NO: 2782600 - RNA, 17 nt, Leptospira interrogans serovar lai str. 56601
ugaaauauuauaaauuu

SEQ ID NO: 2782601 - RNA, 23 nt, Leptospira interrogans serovar lai str. 56601
ugaauuaaaaaacuuuuuaaaac

SEQ ID NO: 2782602 - RNA, 13 nt, Leptospira interrogans serovar lai str. 56601
ugaauuaaaagaa

SEQ ID NO: 2782603 - RNA, 16 nt, Leptospira interrogans serovar lai str. 56601
ugaauuaauuuguaau

SEQ ID NO: 2782604 - RNA, 14 nt, Leptospira interrogans serovar lai str. 56601
ugaauuacaauuga

SEQ ID NO: 2782605 - RNA, 13 nt, Leptospira interrogans serovar lai str. 56601
ugaauucauugua

SEQ ID NO: 2782606 - RNA, 13 nt, Leptospira interrogans serovar lai str. 56601
ugaauuccuuaua

SEQ ID NO: 2782607 - RNA, 14 nt, Leptospira interrogans serovar lai str. 56601
ugaauucucuaucu

SEQ ID NO: 2782608 - RNA, 21 nt, Leptospira interrogans serovar lai str. 56601
ugaauucucuaucuuguuucu

SEQ ID NO: 2782609 - RNA, 14 nt, Leptospira interrogans serovar lai str. 56601
ugaauugaauuuuu

SEQ ID NO: 2782610 - RNA, 15 nt, Leptospira interrogans serovar lai str. 56601
ugaauugcuaaaaaa

SEQ ID NO: 2782611 - RNA, 14 nt, Leptospira interrogans serovar lai str. 56601
ugaauuguaaaaaa

SEQ ID NO: 2782612 - RNA, 16 nt, Leptospira interrogans serovar lai str. 56601
ugaauuguaaaaaacc

SEQ ID NO: 2782613 - RNA, 17 nt, Leptospira interrogans serovar lai str. 56601
ugaauuguagaauuuau

SEQ ID NO: 2782614 - RNA, 21 nt, Leptospira interrogans serovar lai str. 56601
ugaauuuaaaacuugucccaa

SEQ ID NO: 2782615 - RNA, 13 nt, Leptospira interrogans serovar lai str. 56601
ugaauuuaaaagu

SEQ ID NO: 2782616 - RNA, 22 nt, Leptospira interrogans serovar lai str. 56601
ugaauuuagaaaauuagaaaga

SEQ ID NO: 2782617 - RNA, 20 nt, Leptospira interrogans serovar lai str. 56601
ugaauuuagcauuuuuaaga

SEQ ID NO: 2782618 - RNA, 21 nt, Leptospira interrogans serovar lai str. 56601
ugaauuuaggaaauuuucaau

SEQ ID NO: 2782619 - RNA, 22 nt, Leptospira interrogans serovar lai str. 56601
ugaauuucagcgcauuuagaag

SEQ ID NO: 2782620 - RNA, 16 nt, Leptospira interrogans serovar lai str. 56601
ugaauuugaggagaau

SEQ ID NO: 2782621 - RNA, 17 nt, Leptospira interrogans serovar lai str. 56601
ugaauuugcaguaaaag

SEQ ID NO: 2782622 - RNA, 17 nt, Leptospira interrogans serovar lai str. 56601
ugaauuuguaauucuuc

SEQ ID NO: 2782623 - RNA, 16 nt, Leptospira interrogans serovar lai str. 56601
ugaauuuguuuuucuu

SEQ ID NO: 2782624 - RNA, 20 nt, Leptospira interrogans serovar lai str. 56601
ugaauuuuaagaucuauucc

SEQ ID NO: 2782625 - RNA, 20 nt, Leptospira interrogans serovar lai str. 56601
ugaauuuuaccaaauuguuu

SEQ ID NO: 2782626 - RNA, 18 nt, Leptospira interrogans serovar lai str. 56601
ugaauuuuacuaaaaauu

SEQ ID NO: 2782627 - RNA, 20 nt, Leptospira interrogans serovar lai str. 56601
ugaauuuuacuaaaaauuca

SEQ ID NO: 2782628 - RNA, 14 nt, Leptospira interrogans serovar lai str. 56601
ugaauuuuauagau

SEQ ID NO: 2782629 - RNA, 20 nt, Leptospira interrogans serovar lai str. 56601
ugaauuuuuaagaauaauuu

SEQ ID NO: 2782630 - RNA, 14 nt, Leptospira interrogans serovar lai str. 56601
ugaauuuuuauaaa

SEQ ID NO: 2782631 - RNA, 12 nt, Leptospira interrogans serovar lai str. 56601
ugaauuuuucau

SEQ ID NO: 2782632 - RNA, 14 nt, Leptospira interrogans serovar lai str. 56601
ugaauuuuuuaaau

SEQ ID NO: 2782633 - RNA, 14 nt, Leptospira interrogans serovar lai str. 56601
ugaauuuuuuauua

SEQ ID NO: 2782634 - RNA, 13 nt, Leptospira interrogans serovar lai str. 56601
ugaauuuuuuccc

SEQ ID NO: 2782635 - RNA, 23 nt, Leptospira interrogans serovar lai str. 56601
ugaauuuuuucugccauuuuuag

SEQ ID NO: 2782636 - RNA, 20 nt, Leptospira interrogans serovar lai str. 56601
ugacaauaaucuaagacgaa

SEQ ID NO: 2782637 - RNA, 21 nt, Leptospira interrogans serovar lai str. 56601
ugacaauaaucuaagacgaaa

SEQ ID NO: 2782638 - RNA, 20 nt, Leptospira interrogans serovar lai str. 56601
ugacaauuugugaacuuuua

SEQ ID NO: 2782639 - RNA, 16 nt, Leptospira interrogans serovar lai str. 56601
ugacacugaaaacauu

SEQ ID NO: 2782640 - RNA, 17 nt, Leptospira interrogans serovar lai str. 56601
ugacacugaaaacauuu

SEQ ID NO: 2782641 - RNA, 15 nt, Leptospira interrogans serovar lai str. 56601
ugacauucuaaacau

SEQ ID NO: 2782642 - RNA, 17 nt, Leptospira interrogans serovar lai str. 56601
ugacauucuaaacauuu

SEQ ID NO: 2782643 - RNA, 12 nt, Leptospira interrogans serovar lai str. 56601
ugaccaccuaua

SEQ ID NO: 2782644 - RNA, 18 nt, Leptospira interrogans serovar lai str. 56601
ugaccaggaauacuugcc

SEQ ID NO: 2782645 - RNA, 12 nt, Leptospira interrogans serovar lai str. 56601
ugaccaucaaug

SEQ ID NO: 2782646 - RNA, 20 nt, Leptospira interrogans serovar lai str. 56601
ugaccauggaugaauugauu

SEQ ID NO: 2782647 - RNA, 24 nt, Leptospira interrogans serovar lai str. 56601
ugaccucuauaauuaauaaaacug

SEQ ID NO: 2782648 - RNA, 12 nt, Leptospira interrogans serovar lai str. 56601
ugacuaaaauug

SEQ ID NO: 2782649 - RNA, 16 nt, Leptospira interrogans serovar lai str. 56601
ugacuaucaacaagaa

SEQ ID NO: 2782650 - RNA, 16 nt, Leptospira interrogans serovar lai str. 56601
ugacuaucacaaaaau

SEQ ID NO: 2782651 - RNA, 19 nt, Leptospira interrogans serovar lai str. 56601
ugacucuaagcuuuagaaa

SEQ ID NO: 2782652 - RNA, 21 nt, Leptospira interrogans serovar lai str. 56601
ugacucuuuugagaaaccuuu

SEQ ID NO: 2782653 - RNA, 22 nt, Leptospira interrogans serovar lai str. 56601
ugacugcccguuucaauuuuug

SEQ ID NO: 2782654 - RNA, 16 nt, Leptospira interrogans serovar lai str. 56601
ugacuugcauuuaaua

SEQ ID NO: 2782655 - RNA, 20 nt, Leptospira interrogans serovar lai str. 56601
ugacuugcauuuaauauauu

SEQ ID NO: 2782656 - RNA, 15 nt, Leptospira interrogans serovar lai str. 56601
ugacuuuaauuuuag

SEQ ID NO: 2782657 - RNA, 22 nt, Leptospira interrogans serovar lai str. 56601
ugacuuucuguauuuuuaaguu

SEQ ID NO: 2782658 - RNA, 15 nt, Leptospira interrogans serovar lai str. 56601
ugagaaaauaaaaaa

SEQ ID NO: 2782659 - RNA, 16 nt, Leptospira interrogans serovar lai str. 56601
ugagaaaccuuuucua

SEQ ID NO: 2782660 - RNA, 23 nt, Leptospira interrogans serovar lai str. 56601
ugagaaagaacaagauuaacaau

SEQ ID NO: 2782661 - RNA, 16 nt, Leptospira interrogans serovar lai str. 56601
ugagaaccauuucaag

SEQ ID NO: 2782662 - RNA, 16 nt, Leptospira interrogans serovar lai str. 56601
ugagaacuacuuuuau

SEQ ID NO: 2782663 - RNA, 19 nt, Leptospira interrogans serovar lai str. 56601
ugagaagcggguuuuucuu

SEQ ID NO: 2782664 - RNA, 16 nt, Leptospira interrogans serovar lai str. 56601
ugagaauauuuguaau

SEQ ID NO: 2782665 - RNA, 15 nt, Leptospira interrogans serovar lai str. 56601
ugagaauuucugcaa

SEQ ID NO: 2782666 - RNA, 23 nt, Leptospira interrogans serovar lai str. 56601
ugagagagaguucuacugaguuu

SEQ ID NO: 2782667 - RNA, 22 nt, Leptospira interrogans serovar lai str. 56601
ugagaguuccacauuuuaaagg

SEQ ID NO: 2782668 - RNA, 23 nt, Leptospira interrogans serovar lai str. 56601
ugagaguucccacguuuuaaagg

SEQ ID NO: 2782669 - RNA, 20 nt, Leptospira interrogans serovar lai str. 56601
ugagaguucgugaagaaauu

SEQ ID NO: 2782670 - RNA, 14 nt, Leptospira interrogans serovar lai str. 56601
ugagauaucacaaa

SEQ ID NO: 2782671 - RNA, 20 nt, Leptospira interrogans serovar lai str. 56601
ugagauaucacaaauuuuaa

SEQ ID NO: 2782672 - RNA, 15 nt, Leptospira interrogans serovar lai str. 56601
ugagauuaaaaagaa

SEQ ID NO: 2782673 - RNA, 15 nt, Leptospira interrogans serovar lai str. 56601
ugagauuaaaacugc

SEQ ID NO: 2782674 - RNA, 17 nt, Leptospira interrogans serovar lai str. 56601
ugagauuaaaacugcuc

SEQ ID NO: 2782675 - RNA, 13 nt, Leptospira interrogans serovar lai str. 56601
ugagauuacaaaa

SEQ ID NO: 2782676 - RNA, 22 nt, Leptospira interrogans serovar lai str. 56601
ugagauuuagagccaaauuuuu

SEQ ID NO: 2782677 - RNA, 23 nt, Leptospira interrogans serovar lai str. 56601
ugagauuugucucaaaauuuaag

SEQ ID NO: 2782678 - RNA, 15 nt, Leptospira interrogans serovar lai str. 56601
ugagcaaaaauuuuc

SEQ ID NO: 2782679 - RNA, 22 nt, Leptospira interrogans serovar lai str. 56601
ugagcaaaauuugcuuccauug

SEQ ID NO: 2782680 - RNA, 18 nt, Leptospira interrogans serovar lai str. 56601
ugagcacagcaaaaaauu

SEQ ID NO: 2782681 - RNA, 19 nt, Leptospira interrogans serovar lai str. 56601
ugagcaguaaaaucuuuaa

SEQ ID NO: 2782682 - RNA, 21 nt, Leptospira interrogans serovar lai str. 56601
ugagcaguaaaaucuuuaagu

SEQ ID NO: 2782683 - RNA, 22 nt, Leptospira interrogans serovar lai str. 56601
ugagcaguaaaaucuuuaaguu

SEQ ID NO: 2782684 - RNA, 16 nt, Leptospira interrogans serovar lai str. 56601
ugaucuauguuauaga

SEQ ID NO: 2782685 - RNA, 16 nt, Leptospira interrogans serovar lai str. 56601
ugaucuccuaaaauaa

SEQ ID NO: 2782686 - RNA, 16 nt, Leptospira interrogans serovar lai str. 56601
ugaucucgauucugau

SEQ ID NO: 2782687 - RNA, 16 nt, Leptospira interrogans serovar lai str. 56601
ugaucucgggaaaaaa

SEQ ID NO: 2782688 - RNA, 16 nt, Leptospira interrogans serovar lai str. 56601
ugaucucuauaaaauc

SEQ ID NO: 2782689 - RNA, 14 nt, Leptospira interrogans serovar lai str. 56601
ugaucuuagaaaac

SEQ ID NO: 2782690 - RNA, 22 nt, Leptospira interrogans serovar lai str. 56601
ugaucuuagaaaaccauuuugu

SEQ ID NO: 2782691 - RNA, 21 nt, Leptospira interrogans serovar lai str. 56601
ugaucuuauacucuuaaaauu

SEQ ID NO: 2782692 - RNA, 14 nt, Leptospira interrogans serovar lai str. 56601
ugaucuuguauaag

SEQ ID NO: 2782693 - RNA, 11 nt, Leptospira interrogans serovar lai str. 56601
ugaucuuuuug

SEQ ID NO: 2782694 - RNA, 20 nt, Leptospira interrogans serovar lai str. 56601
ugaucuuuuugauaaaauau

SEQ ID NO: 2782695 - RNA, 13 nt, Leptospira interrogans serovar lai str. 56601
ugaugaagagaaa

SEQ ID NO: 2782696 - RNA, 20 nt, Leptospira interrogans serovar lai str. 56601
ugaugaucgcguaauauuuc

SEQ ID NO: 2782697 - RNA, 23 nt, Leptospira interrogans serovar lai str. 56601
ugaugcaaauucgggauuuacga

SEQ ID NO: 2782698 - RNA, 15 nt, Leptospira interrogans serovar lai str. 56601
ugaugcauuucugcc

SEQ ID NO: 2782699 - RNA, 20 nt, Leptospira interrogans serovar lai str. 56601
ugaugucacagacuucuuuu

SEQ ID NO: 2782700 - RNA, 23 nt, Leptospira interrogans serovar lai str. 56601
ugaugucacagacuucuuuuggc

SEQ ID NO: 2782701 - RNA, 18 nt, Leptospira interrogans serovar lai str. 56601
ugauuaaaccgguaaaaa

SEQ ID NO: 2782702 - RNA, 14 nt, Leptospira interrogans serovar lai str. 56601
ugauuacaaagcac

SEQ ID NO: 2782703 - RNA, 23 nt, Leptospira interrogans serovar lai str. 56601
ugauuagaaaaaaaguauauauu

SEQ ID NO: 2782704 - RNA, 16 nt, Leptospira interrogans serovar lai str. 56601
ugauuagaguuaaauu

SEQ ID NO: 2782705 - RNA, 18 nt, Leptospira interrogans serovar lai str. 56601
ugauuagaguuaaauuga

SEQ ID NO: 2782706 - RNA, 16 nt, Leptospira interrogans serovar lai str. 56601
ugauuaugauccaaac

SEQ ID NO: 2782707 - RNA, 15 nt, Leptospira interrogans serovar lai str. 56601
ugauucaaaaacuaa

SEQ ID NO: 2782708 - RNA, 14 nt, Leptospira interrogans serovar lai str. 56601
ugauucauuuuuug

SEQ ID NO: 2782709 - RNA, 11 nt, Leptospira interrogans serovar lai str. 56601
ugauuccaaag

SEQ ID NO: 2782710 - RNA, 19 nt, Leptospira interrogans serovar lai str. 56601
ugauuccaaagauaaaaaa

SEQ ID NO: 2782711 - RNA, 18 nt, Leptospira interrogans serovar lai str. 56601
ugauuccaagauuuuuua

SEQ ID NO: 2782712 - RNA, 20 nt, Leptospira interrogans serovar lai str. 56601
ugauuccgguaaauuuuuua

SEQ ID NO: 2782713 - RNA, 18 nt, Leptospira interrogans serovar lai str. 56601
ugauucgaaauuuucagc

SEQ ID NO: 2782714 - RNA, 17 nt, Leptospira interrogans serovar lai str. 56601
ugauucgcccaaauauu

SEQ ID NO: 2782715 - RNA, 14 nt, Leptospira interrogans serovar lai str. 56601
ugauucuauauauu

SEQ ID NO: 2782716 - RNA, 17 nt, Leptospira interrogans serovar lai str. 56601
ugauucuauauauugaa

SEQ ID NO: 2782717 - RNA, 23 nt, Leptospira interrogans serovar lai str. 56601
ugauucuauauauugaaauauua

SEQ ID NO: 2782718 - RNA, 15 nt, Leptospira interrogans serovar lai str. 56601
ugauucugaaaagaa

SEQ ID NO: 2782719 - RNA, 22 nt, Leptospira interrogans serovar lai str. 56601
ugauucuuuaaauguagaaacu

SEQ ID NO: 2782720 - RNA, 16 nt, Leptospira interrogans serovar lai str. 56601
ugauugaauuaaaaaa

SEQ ID NO: 2782721 - RNA, 23 nt, Leptospira interrogans serovar lai str. 56601
ugauugagaaaauaaaaaauuuu

SEQ ID NO: 2782722 - RNA, 15 nt, Leptospira interrogans serovar lai str. 56601
ugauuguuaauuuuc

SEQ ID NO: 2782723 - RNA, 18 nt, Leptospira interrogans serovar lai str. 56601
ugauuguuuguuuuuucc

SEQ ID NO: 2782724 - RNA, 23 nt, Leptospira interrogans serovar lai str. 56601
ugauuuaaaaaccgucccaaaac

SEQ ID NO: 2782725 - RNA, 22 nt, Leptospira interrogans serovar lai str. 56601
ugauuuaaaaauaguauuuugu

SEQ ID NO: 2782726 - RNA, 20 nt, Leptospira interrogans serovar lai str. 56601
ugauuuaaaaucacaaaaaa

SEQ ID NO: 2782727 - RNA, 13 nt, Leptospira interrogans serovar lai str. 56601
ugauuuaauuauu

SEQ ID NO: 2782728 - RNA, 22 nt, Leptospira interrogans serovar lai str. 56601
ugauuuacuacgucuucuaaau

SEQ ID NO: 2782729 - RNA, 15 nt, Leptospira interrogans serovar lai str. 56601
ugauuuaguaaaauu

SEQ ID NO: 2782730 - RNA, 16 nt, Leptospira interrogans serovar lai str. 56601
ugauuuaguaaaauuu

SEQ ID NO: 2782731 - RNA, 18 nt, Leptospira interrogans serovar lai str. 56601
ugauuuaguaaaauuuaa

SEQ ID NO: 2782732 - RNA, 17 nt, Leptospira interrogans serovar lai str. 56601
ugauuucacgaacacaa

SEQ ID NO: 2782733 - RNA, 16 nt, Leptospira interrogans serovar lai str. 56601
ugauuucagauucauc

SEQ ID NO: 2782734 - RNA, 19 nt, Leptospira interrogans serovar lai str. 56601
ugauuucuauaaaauugaa

SEQ ID NO: 2782735 - RNA, 22 nt, Leptospira interrogans serovar lai str. 56601
ugauuucuugagggguuuuucc

SEQ ID NO: 2782736 - RNA, 22 nt, Leptospira interrogans serovar lai str. 56601
ugauuucuugaucgacuguaau

SEQ ID NO: 2782737 - RNA, 19 nt, Leptospira interrogans serovar lai str. 56601
ugauuugagaaucuucauu

SEQ ID NO: 2782738 - RNA, 22 nt, Leptospira interrogans serovar lai str. 56601
ugauuuggaucgguuuuagaau

SEQ ID NO: 2782739 - RNA, 15 nt, Leptospira interrogans serovar lai str. 56601
ugauuuguaauaguu

SEQ ID NO: 2782740 - RNA, 19 nt, Leptospira interrogans serovar lai str. 56601
ugauuuguaauaguuccca

SEQ ID NO: 2782741 - RNA, 22 nt, Leptospira interrogans serovar lai str. 56601
ugauuugugcaaaaauuuuuua

SEQ ID NO: 2782742 - RNA, 13 nt, Leptospira interrogans serovar lai str. 56601
ugauuuguuucuu

SEQ ID NO: 2782743 - RNA, 14 nt, Leptospira interrogans serovar lai str. 56601
ugauuuguuucuuu

SEQ ID NO: 2782744 - RNA, 17 nt, Leptospira interrogans serovar lai str. 56601
ugauuuguuucuuuauc

SEQ ID NO: 2782745 - RNA, 23 nt, Leptospira interrogans serovar lai str. 56601
ugauuuuaccguuuuuaaaugug

SEQ ID NO: 2782746 - RNA, 21 nt, Leptospira interrogans serovar lai str. 56601
ugauuuuacgaaccaauucua

SEQ ID NO: 2782747 - RNA, 13 nt, Leptospira interrogans serovar lai str. 56601
ugauuuucauuuu

SEQ ID NO: 2782748 - RNA, 21 nt, Leptospira interrogans serovar lai str. 56601
ugauuuucauuuugcuaaggu

SEQ ID NO: 2782749 - RNA, 16 nt, Leptospira interrogans serovar lai str. 56601
ugauuuuguuaauuaa

SEQ ID NO: 2782750 - RNA, 14 nt, Leptospira interrogans serovar lai str. 56601
ugauuuuuccauaa

SEQ ID NO: 2782751 - RNA, 18 nt, Leptospira interrogans serovar lai str. 56601
ugauuuuucuguaaaaau

SEQ ID NO: 2782752 - RNA, 12 nt, Leptospira interrogans serovar lai str. 56601
ugauuuuucuuu

SEQ ID NO: 2782753 - RNA, 16 nt, Leptospira interrogans serovar lai str. 56601
ugauuuuuuaaaugug

SEQ ID NO: 2782754 - RNA, 23 nt, Leptospira interrogans serovar lai str. 56601
ugcaaaaaguauguuuuucuaau

SEQ ID NO: 2782755 - RNA, 12 nt, Leptospira interrogans serovar lai str. 56601
ugcaaaaauaga

SEQ ID NO: 2782756 - RNA, 15 nt, Leptospira interrogans serovar lai str. 56601
ugcaaaaauagaauu

SEQ ID NO: 2782757 - RNA, 20 nt, Leptospira interrogans serovar lai str. 56601
ugcaaaagcuccuuucaucu

SEQ ID NO: 2782758 - RNA, 22 nt, Leptospira interrogans serovar lai str. 56601
ugcaaaaucaguuaauacaaaa

SEQ ID NO: 2782759 - RNA, 22 nt, Leptospira interrogans serovar lai str. 56601
ugcaaacggauaaaauguagga

SEQ ID NO: 2782760 - RNA, 17 nt, Leptospira interrogans serovar lai str. 56601
ugcaaagaagaaauaag

SEQ ID NO: 2782761 - RNA, 17 nt, Leptospira interrogans serovar lai str. 56601
ugcaaauacaacuuuuu

SEQ ID NO: 2782762 - RNA, 15 nt, Leptospira interrogans serovar lai str. 56601
ugcaacgaaaucaau

SEQ ID NO: 2782763 - RNA, 17 nt, Leptospira interrogans serovar lai str. 56601
ugcaacgaaaucaaugu

SEQ ID NO: 2782764 - RNA, 18 nt, Leptospira interrogans serovar lai str. 56601
ugcaaguaaaaagacuca

SEQ ID NO: 2782765 - RNA, 19 nt, Leptospira interrogans serovar lai str. 56601
ugcaaguucuggguaaaaa

SEQ ID NO: 2782766 - RNA, 17 nt, Leptospira interrogans serovar lai str. 56601
ugcaauacauucuuaua

SEQ ID NO: 2782767 - RNA, 21 nt, Leptospira interrogans serovar lai str. 56601
ugcugucgcaacauaaugcug

SEQ ID NO: 2782768 - RNA, 15 nt, Leptospira interrogans serovar lai str. 56601
ugcuuaaagcauuaa

SEQ ID NO: 2782769 - RNA, 23 nt, Leptospira interrogans serovar lai str. 56601
ugcuucaacacugagucaacaaa

SEQ ID NO: 2782770 - RNA, 16 nt, Leptospira interrogans serovar lai str. 56601
ugcuucauauaauaaa

SEQ ID NO: 2782771 - RNA, 14 nt, Leptospira interrogans serovar lai str. 56601
ugcuucuuuuaaac

SEQ ID NO: 2782772 - RNA, 18 nt, Leptospira interrogans serovar lai str. 56601
ugcuugaaccauuugaaa

SEQ ID NO: 2782773 - RNA, 15 nt, Leptospira interrogans serovar lai str. 56601
ugcuuuaaucgcuuu

SEQ ID NO: 2782774 - RNA, 20 nt, Leptospira interrogans serovar lai str. 56601
ugcuuuaguaguauuuaaga

SEQ ID NO: 2782775 - RNA, 18 nt, Leptospira interrogans serovar lai str. 56601
ugcuuucucuuuuuagac

SEQ ID NO: 2782776 - RNA, 16 nt, Leptospira interrogans serovar lai str. 56601
ugcuuugguuuucaua

SEQ ID NO: 2782777 - RNA, 13 nt, Leptospira interrogans serovar lai str. 56601
ugcuuuuuaaaag

SEQ ID NO: 2782778 - RNA, 15 nt, Leptospira interrogans serovar lai str. 56601
ugcuuuuuaaaagau

SEQ ID NO: 2782779 - RNA, 13 nt, Leptospira interrogans serovar lai str. 56601
uggaaaaaugaaa

SEQ ID NO: 2782780 - RNA, 17 nt, Leptospira interrogans serovar lai str. 56601
uggaaaacuuucuuuua

SEQ ID NO: 2782781 - RNA, 12 nt, Leptospira interrogans serovar lai str. 56601
uggaaaagaauc

SEQ ID NO: 2782782 - RNA, 12 nt, Leptospira interrogans serovar lai str. 56601
uggaaaaguuuu

SEQ ID NO: 2782783 - RNA, 17 nt, Leptospira interrogans serovar lai str. 56601
uggaaaaguuuuuaaaa

SEQ ID NO: 2782784 - RNA, 18 nt, Leptospira interrogans serovar lai str. 56601
uggaaaaguuuuuaaaaa

SEQ ID NO: 2782785 - RNA, 12 nt, Leptospira interrogans serovar lai str. 56601
uggaaaaugaaa

SEQ ID NO: 2782786 - RNA, 13 nt, Leptospira interrogans serovar lai str. 56601
uggaaaaugaaaa

SEQ ID NO: 2782787 - RNA, 12 nt, Leptospira interrogans serovar lai str. 56601
uggaaaaugaau

SEQ ID NO: 2782788 - RNA, 13 nt, Leptospira interrogans serovar lai str. 56601
uggaaaaugaauu

SEQ ID NO: 2782789 - RNA, 14 nt, Leptospira interrogans serovar lai str. 56601
uggaaaaugaauuu

SEQ ID NO: 2782790 - RNA, 21 nt, Leptospira interrogans serovar lai str. 56601
uggaaacggccgauugaagcg

SEQ ID NO: 2782791 - RNA, 15 nt, Leptospira interrogans serovar lai str. 56601
uggaaacuauuacaa

SEQ ID NO: 2782792 - RNA, 22 nt, Leptospira interrogans serovar lai str. 56601
uggaaagccccagaacaaaucc

SEQ ID NO: 2782793 - RNA, 14 nt, Leptospira interrogans serovar lai str. 56601
uggaaaguaaacua

SEQ ID NO: 2782794 - RNA, 16 nt, Leptospira interrogans serovar lai str. 56601
uggaaaguaaacuaua

SEQ ID NO: 2782795 - RNA, 17 nt, Leptospira interrogans serovar lai str. 56601
uggaaaguguuaguucc

SEQ ID NO: 2782796 - RNA, 18 nt, Leptospira interrogans serovar lai str. 56601
uggaaauaucuaaucuuu

SEQ ID NO: 2782797 - RNA, 14 nt, Leptospira interrogans serovar lai str. 56601
uggaaaucgaaaac

SEQ ID NO: 2782798 - RNA, 15 nt, Leptospira interrogans serovar lai str. 56601
uggaaauuuuuaaua

SEQ ID NO: 2782799 - RNA, 20 nt, Leptospira interrogans serovar lai str. 56601
uggaaauuuuuaauaaaaua

SEQ ID NO: 2782800 - RNA, 15 nt, Leptospira interrogans serovar lai str. 56601
uggaaauuuuuaauc

SEQ ID NO: 2782801 - RNA, 20 nt, Leptospira interrogans serovar lai str. 56601
uggaaauuuuuaaucaagug

SEQ ID NO: 2782802 - RNA, 20 nt, Leptospira interrogans serovar lai str. 56601
uggaacucuauauaaagaaa

SEQ ID NO: 2782803 - RNA, 16 nt, Leptospira interrogans serovar lai str. 56601
uggaacuuuaauuauu

SEQ ID NO: 2782804 - RNA, 21 nt, Leptospira interrogans serovar lai str. 56601
uggaagccaaaaccaauuuuu

SEQ ID NO: 2782805 - RNA, 12 nt, Leptospira interrogans serovar lai str. 56601
uggaauaaaauc

SEQ ID NO: 2782806 - RNA, 14 nt, Leptospira interrogans serovar lai str. 56601
uggaauaaaaucau

SEQ ID NO: 2782807 - RNA, 15 nt, Leptospira interrogans serovar lai str. 56601
uggaauauaaaagaa

SEQ ID NO: 2782808 - RNA, 15 nt, Leptospira interrogans serovar lai str. 56601
uggaaucuaaacucu

SEQ ID NO: 2782809 - RNA, 20 nt, Leptospira interrogans serovar lai str. 56601
uggaaucugcaucuuuucua

SEQ ID NO: 2782810 - RNA, 15 nt, Leptospira interrogans serovar lai str. 56601
uggaaucuuaaaaag

SEQ ID NO: 2782811 - RNA, 21 nt, Leptospira interrogans serovar lai str. 56601
uggaaugacugaccguaaaag

SEQ ID NO: 2782812 - RNA, 22 nt, Leptospira interrogans serovar lai str. 56601
uggaauguacuaaaauuuuaua

SEQ ID NO: 2782813 - RNA, 22 nt, Leptospira interrogans serovar lai str. 56601
uggaauuccgacccagaaaaaa

SEQ ID NO: 2782814 - RNA, 19 nt, Leptospira interrogans serovar lai str. 56601
uggaauucguuaaguuauc

SEQ ID NO: 2782815 - RNA, 19 nt, Leptospira interrogans serovar lai str. 56601
uggaauuggcuucuuauua

SEQ ID NO: 2782816 - RNA, 20 nt, Leptospira interrogans serovar lai str. 56601
uggaauuuuuuaacaacucu

SEQ ID NO: 2782817 - RNA, 19 nt, Leptospira interrogans serovar lai str. 56601
uggacagaauccuuccaaa

SEQ ID NO: 2782818 - RNA, 21 nt, Leptospira interrogans serovar lai str. 56601
uggaccaaaucgcugguuuua

SEQ ID NO: 2782819 - RNA, 20 nt, Leptospira interrogans serovar lai str. 56601
uggacgauuuugagaccagc

SEQ ID NO: 2782820 - RNA, 14 nt, Leptospira interrogans serovar lai str. 56601
uggacuauuuuauu

SEQ ID NO: 2782821 - RNA, 15 nt, Leptospira interrogans serovar lai str. 56601
uggacuauuuuauua

SEQ ID NO: 2782822 - RNA, 20 nt, Leptospira interrogans serovar lai str. 56601
uggacugcaaaaucaguuaa

SEQ ID NO: 2782823 - RNA, 14 nt, Leptospira interrogans serovar lai str. 56601
uggagaaaacgaga

SEQ ID NO: 2782824 - RNA, 21 nt, Leptospira interrogans serovar lai str. 56601
uggagaaaacgagaaagaauu

SEQ ID NO: 2782825 - RNA, 12 nt, Leptospira interrogans serovar lai str. 56601
uggagaaagauu

SEQ ID NO: 2782826 - RNA, 16 nt, Leptospira interrogans serovar lai str. 56601
uggagaauuaauuuuu

SEQ ID NO: 2782827 - RNA, 22 nt, Leptospira interrogans serovar lai str. 56601
uggagaauuaauuuuuuaaaaa

SEQ ID NO: 2782828 - RNA, 17 nt, Leptospira interrogans serovar lai str. 56601
uggagaauucauuuuuc

SEQ ID NO: 2782829 - RNA, 17 nt, Leptospira interrogans serovar lai str. 56601
uggaguauuuuuuccug

SEQ ID NO: 2782830 - RNA, 18 nt, Leptospira interrogans serovar lai str. 56601
uggaguggagauuuugca

SEQ ID NO: 2782831 - RNA, 16 nt, Leptospira interrogans serovar lai str. 56601
uggaguucuaaauuau

SEQ ID NO: 2782832 - RNA, 16 nt, Leptospira interrogans serovar lai str. 56601
uggaguuuuuuaaaau

SEQ ID NO: 2782833 - RNA, 16 nt, Leptospira interrogans serovar lai str. 56601
uggauaaauuuuagaa

SEQ ID NO: 2782834 - RNA, 16 nt, Leptospira interrogans serovar lai str. 56601
uggauagcaaaaaaau

SEQ ID NO: 2782835 - RNA, 15 nt, Leptospira interrogans serovar lai str. 56601
uggauaggauuccau

SEQ ID NO: 2782836 - RNA, 19 nt, Leptospira interrogans serovar lai str. 56601
uggaucaaaaccauuuuug

SEQ ID NO: 2782837 - RNA, 18 nt, Leptospira interrogans serovar lai str. 56601
uggaucauccuuuggaug

SEQ ID NO: 2782838 - RNA, 14 nt, Leptospira interrogans serovar lai str. 56601
uggaucgccguucu

SEQ ID NO: 2782839 - RNA, 16 nt, Leptospira interrogans serovar lai str. 56601
uggaucgguuuuagaa

SEQ ID NO: 2782840 - RNA, 17 nt, Leptospira interrogans serovar lai str. 56601
uggaucuacuaagauuu

SEQ ID NO: 2782841 - RNA, 21 nt, Leptospira interrogans serovar lai str. 56601
uggaucuacuaagauuucuug

SEQ ID NO: 2782842 - RNA, 16 nt, Leptospira interrogans serovar lai str. 56601
uggaucuguaauugga

SEQ ID NO: 2782843 - RNA, 13 nt, Leptospira interrogans serovar lai str. 56601
uggauucaaaauu

SEQ ID NO: 2782844 - RNA, 18 nt, Leptospira interrogans serovar lai str. 56601
uggauucugcucuucuaa

SEQ ID NO: 2782845 - RNA, 21 nt, Leptospira interrogans serovar lai str. 56601
uggauucugcucuucuaauug

SEQ ID NO: 2782846 - RNA, 23 nt, Leptospira interrogans serovar lai str. 56601
uggauucugcucuucuaauugca

SEQ ID NO: 2782847 - RNA, 14 nt, Leptospira interrogans serovar lai str. 56601
uggauucuuucgac

SEQ ID NO: 2782848 - RNA, 20 nt, Leptospira interrogans serovar lai str. 56601
uggauucuuucgacuucuuu

SEQ ID NO: 2782849 - RNA, 22 nt, Leptospira interrogans serovar lai str. 56601
uggauugccacgguuaaaugga

SEQ ID NO: 2782850 - RNA, 19 nt, Leptospira interrogans serovar lai str. 56601
uguaaauucaaagcaagaa

SEQ ID NO: 2782851 - RNA, 16 nt, Leptospira interrogans serovar lai str. 56601
uguaaauuugcuuuaa

SEQ ID NO: 2782852 - RNA, 16 nt, Leptospira interrogans serovar lai str. 56601
uguaacucauauagaa

SEQ ID NO: 2782853 - RNA, 11 nt, Leptospira interrogans serovar lai str. 56601
uguaacuuuua

SEQ ID NO: 2782854 - RNA, 22 nt, Leptospira interrogans serovar lai str. 56601
uguaagaaaaaacuuucuaaaa

SEQ ID NO: 2782855 - RNA, 23 nt, Leptospira interrogans serovar lai str. 56601
uguaagacucauauuuuuagaaa

SEQ ID NO: 2782856 - RNA, 18 nt, Leptospira interrogans serovar lai str. 56601
uguaagaguuccuacauc

SEQ ID NO: 2782857 - RNA, 21 nt, Leptospira interrogans serovar lai str. 56601
uguaagggaaaguuauuucuu

SEQ ID NO: 2782858 - RNA, 18 nt, Leptospira interrogans serovar lai str. 56601
uguaaggugacaauaauc

SEQ ID NO: 2782859 - RNA, 12 nt, Leptospira interrogans serovar lai str. 56601
uguaaguuuucc

SEQ ID NO: 2782860 - RNA, 15 nt, Leptospira interrogans serovar lai str. 56601
uguaaguuuugaauu

SEQ ID NO: 2782861 - RNA, 13 nt, Leptospira interrogans serovar lai str. 56601
uguaauaaaaauu

SEQ ID NO: 2782862 - RNA, 18 nt, Leptospira interrogans serovar lai str. 56601
uguaauaaaaauuuaaaa

SEQ ID NO: 2782863 - RNA, 23 nt, Leptospira interrogans serovar lai str. 56601
uguaauaaaaauuuaaaauacuc

SEQ ID NO: 2782864 - RNA, 19 nt, Leptospira interrogans serovar lai str. 56601
uguaauaaaaauuuacaga

SEQ ID NO: 2782865 - RNA, 13 nt, Leptospira interrogans serovar lai str. 56601
uguaauaguuccc

SEQ ID NO: 2782866 - RNA, 19 nt, Leptospira interrogans serovar lai str. 56601
uguaauaguucccacaaau

SEQ ID NO: 2782867 - RNA, 18 nt, Leptospira interrogans serovar lai str. 56601
uguaauaguucccacagu

SEQ ID NO: 2782868 - RNA, 20 nt, Leptospira interrogans serovar lai str. 56601
uguaauaguucccacauuug

SEQ ID NO: 2782869 - RNA, 20 nt, Leptospira interrogans serovar lai str. 56601
uguaaucucgauuucuaaaa

SEQ ID NO: 2782870 - RNA, 17 nt, Leptospira interrogans serovar lai str. 56601
uguaaucuuauuuuuua

SEQ ID NO: 2782871 - RNA, 21 nt, Leptospira interrogans serovar lai str. 56601
uguaaugacacuuaucaaaua

SEQ ID NO: 2782872 - RNA, 14 nt, Leptospira interrogans serovar lai str. 56601
uguaaugauuucag

SEQ ID NO: 2782873 - RNA, 15 nt, Leptospira interrogans serovar lai str. 56601
uguaauguauaaucc

SEQ ID NO: 2782874 - RNA, 15 nt, Leptospira interrogans serovar lai str. 56601
uguaauuaaaauuua

SEQ ID NO: 2782875 - RNA, 16 nt, Leptospira interrogans serovar lai str. 56601
uguaauuaaaauuuac

SEQ ID NO: 2782876 - RNA, 13 nt, Leptospira interrogans serovar lai str. 56601
uguaauuaauuca

SEQ ID NO: 2782877 - RNA, 19 nt, Leptospira interrogans serovar lai str. 56601
uguaauuaguguuuaccuu

SEQ ID NO: 2782878 - RNA, 20 nt, Leptospira interrogans serovar lai str. 56601
uguaauucuucaauaucuuu

SEQ ID NO: 2782879 - RNA, 11 nt, Leptospira interrogans serovar lai str. 56601
uguacaaaacc

SEQ ID NO: 2782880 - RNA, 14 nt, Leptospira interrogans serovar lai str. 56601
uguacaacauccuu

SEQ ID NO: 2782881 - RNA, 14 nt, Leptospira interrogans serovar lai str. 56601
uguacaucuuaaaa

SEQ ID NO: 2782882 - RNA, 15 nt, Leptospira interrogans serovar lai str. 56601
uguacaucuuaaaaa

SEQ ID NO: 2782883 - RNA, 14 nt, Leptospira interrogans serovar lai str. 56601
uguacguaaaaaug

SEQ ID NO: 2782884 - RNA, 17 nt, Leptospira interrogans serovar lai str. 56601
uguacuaaaauuuuaua

SEQ ID NO: 2782885 - RNA, 21 nt, Leptospira interrogans serovar lai str. 56601
uguacuaaaauuuuauaaaaa

SEQ ID NO: 2782886 - RNA, 16 nt, Leptospira interrogans serovar lai str. 56601
uguacuuaaauuuuau

SEQ ID NO: 2782887 - RNA, 22 nt, Leptospira interrogans serovar lai str. 56601
uguacuuacuaaacgauuuuau

SEQ ID NO: 2782888 - RNA, 18 nt, Leptospira interrogans serovar lai str. 56601
uguagaaauucuauuuua

SEQ ID NO: 2782889 - RNA, 21 nt, Leptospira interrogans serovar lai str. 56601
uguagaaauucuauuuuauug

SEQ ID NO: 2782890 - RNA, 16 nt, Leptospira interrogans serovar lai str. 56601
uguagaaccuggauuu

SEQ ID NO: 2782891 - RNA, 16 nt, Leptospira interrogans serovar lai str. 56601
uguagaauugaaagaa

SEQ ID NO: 2782892 - RNA, 14 nt, Leptospira interrogans serovar lai str. 56601
uguagacaaaucau

SEQ ID NO: 2782893 - RNA, 18 nt, Leptospira interrogans serovar lai str. 56601
uguagagauugauauuca

SEQ ID NO: 2782894 - RNA, 20 nt, Leptospira interrogans serovar lai str. 56601
uguaggaacuacuaauuuau

SEQ ID NO: 2782895 - RNA, 13 nt, Leptospira interrogans serovar lai str. 56601
uguaggaacucau

SEQ ID NO: 2782896 - RNA, 20 nt, Leptospira interrogans serovar lai str. 56601
uguaggaauuacuacauuug

SEQ ID NO: 2782897 - RNA, 14 nt, Leptospira interrogans serovar lai str. 56601
uguaggaauuagua

SEQ ID NO: 2782898 - RNA, 23 nt, Leptospira interrogans serovar lai str. 56601
uguaggaauucauacuuuuaaaa

SEQ ID NO: 2782899 - RNA, 13 nt, Leptospira interrogans serovar lai str. 56601
uguaguaacuacu

SEQ ID NO: 2782900 - RNA, 13 nt, Leptospira interrogans serovar lai str. 56601
uguaguaacuccu

SEQ ID NO: 2782901 - RNA, 13 nt, Leptospira interrogans serovar lai str. 56601
uguaguauuucca

SEQ ID NO: 2782902 - RNA, 23 nt, Leptospira interrogans serovar lai str. 56601
uguaguuuauuuuucuuuuaaaa

SEQ ID NO: 2782903 - RNA, 13 nt, Leptospira interrogans serovar lai str. 56601
uguaguuucaauu

SEQ ID NO: 2782904 - RNA, 18 nt, Leptospira interrogans serovar lai str. 56601
uguaguuucaauuuauua

SEQ ID NO: 2782905 - RNA, 17 nt, Leptospira interrogans serovar lai str. 56601
uguauaaaagaaacaua

SEQ ID NO: 2782906 - RNA, 21 nt, Leptospira interrogans serovar lai str. 56601
uguauaaaagaaacauaauac

SEQ ID NO: 2782907 - RNA, 13 nt, Leptospira interrogans serovar lai str. 56601
uguauacaggaaa

SEQ ID NO: 2782908 - RNA, 16 nt, Leptospira interrogans serovar lai str. 56601
uguauaccaauaauuu

SEQ ID NO: 2782909 - RNA, 16 nt, Leptospira interrogans serovar lai str. 56601
uguauauaaacgagua

SEQ ID NO: 2782910 - RNA, 16 nt, Leptospira interrogans serovar lai str. 56601
uguauauuauaaaauu

SEQ ID NO: 2782911 - RNA, 16 nt, Leptospira interrogans serovar lai str. 56601
uguauccaauccaaaa

SEQ ID NO: 2782912 - RNA, 20 nt, Leptospira interrogans serovar lai str. 56601
uguauccaauccaaaauugu

SEQ ID NO: 2782913 - RNA, 17 nt, Leptospira interrogans serovar lai str. 56601
uguaucccuuuggcaua

SEQ ID NO: 2782914 - RNA, 16 nt, Leptospira interrogans serovar lai str. 56601
uguauggcucauuuuu

SEQ ID NO: 2782915 - RNA, 19 nt, Leptospira interrogans serovar lai str. 56601
uguauggcucauuuuucuu

SEQ ID NO: 2782916 - RNA, 14 nt, Leptospira interrogans serovar lai str. 56601
uguauuaaaaaauc

SEQ ID NO: 2782917 - RNA, 14 nt, Leptospira interrogans serovar lai str. 56601
uguauuuuaaacaa

SEQ ID NO: 2782918 - RNA, 12 nt, Leptospira interrogans serovar lai str. 56601
uguauuuuauuu

SEQ ID NO: 2782919 - RNA, 16 nt, Leptospira interrogans serovar lai str. 56601
ugucaagcccucccgu

SEQ ID NO: 2782920 - RNA, 16 nt, Leptospira interrogans serovar lai str. 56601
ugucaagcccuccuau

SEQ ID NO: 2782921 - RNA, 18 nt, Leptospira interrogans serovar lai str. 56601
ugucaagcccuccuaugu

SEQ ID NO: 2782922 - RNA, 14 nt, Leptospira interrogans serovar lai str. 56601
ugucacagacuucu

SEQ ID NO: 2782923 - RNA, 19 nt, Leptospira interrogans serovar lai str. 56601
ugucaccguuuauucucca

SEQ ID NO: 2782924 - RNA, 22 nt, Leptospira interrogans serovar lai str. 56601
ugucacuauuuuuaugcgugca

SEQ ID NO: 2782925 - RNA, 22 nt, Leptospira interrogans serovar lai str. 56601
ugucauaaaccgauuuucccaa

SEQ ID NO: 2782926 - RNA, 13 nt, Leptospira interrogans serovar lai str. 56601
ugucauguuuuaa

SEQ ID NO: 2782927 - RNA, 15 nt, Leptospira interrogans serovar lai str. 56601
ugucauguuuuaaug

SEQ ID NO: 2782928 - RNA, 13 nt, Leptospira interrogans serovar lai str. 56601
uguccauuucaau

SEQ ID NO: 2782929 - RNA, 18 nt, Leptospira interrogans serovar lai str. 56601
uguccauuuccauaaaau

SEQ ID NO: 2782930 - RNA, 20 nt, Leptospira interrogans serovar lai str. 56601
ugucccaaaaccucaaaaaa

SEQ ID NO: 2782931 - RNA, 22 nt, Leptospira interrogans serovar lai str. 56601
ugucccgaaaccucaaaaaauu

SEQ ID NO: 2782932 - RNA, 18 nt, Leptospira interrogans serovar lai str. 56601
uguccuaaaaccucaaaa

SEQ ID NO: 2782933 - RNA, 18 nt, Leptospira interrogans serovar lai str. 56601
uguuccgaauuaaaaauu

SEQ ID NO: 2782934 - RNA, 21 nt, Leptospira interrogans serovar lai str. 56601
uguuccgcuguaguaucucuu

SEQ ID NO: 2782935 - RNA, 23 nt, Leptospira interrogans serovar lai str. 56601
uguucguauccuugggauaaaua

SEQ ID NO: 2782936 - RNA, 20 nt, Leptospira interrogans serovar lai str. 56601
uguucgucguuuagaggaag

SEQ ID NO: 2782937 - RNA, 18 nt, Leptospira interrogans serovar lai str. 56601
uguucgugaaauugugau

SEQ ID NO: 2782938 - RNA, 16 nt, Leptospira interrogans serovar lai str. 56601
uguucuaaaaacucaa

SEQ ID NO: 2782939 - RNA, 18 nt, Leptospira interrogans serovar lai str. 56601
uguucuaaaaacucaaaa

SEQ ID NO: 2782940 - RNA, 19 nt, Leptospira interrogans serovar lai str. 56601
uguucuccaacuuacauua

SEQ ID NO: 2782941 - RNA, 18 nt, Leptospira interrogans serovar lai str. 56601
uguucuuaaaauugugau

SEQ ID NO: 2782942 - RNA, 14 nt, Leptospira interrogans serovar lai str. 56601
uguucuuagacuca

SEQ ID NO: 2782943 - RNA, 21 nt, Leptospira interrogans serovar lai str. 56601
uguugaacauuccauaaugaa

SEQ ID NO: 2782944 - RNA, 16 nt, Leptospira interrogans serovar lai str. 56601
uguugaguuuuuccua

SEQ ID NO: 2782945 - RNA, 17 nt, Leptospira interrogans serovar lai str. 56601
uguugcuccuugcuguc

SEQ ID NO: 2782946 - RNA, 17 nt, Leptospira interrogans serovar lai str. 56601
uguuguaccauuuugau

SEQ ID NO: 2782947 - RNA, 18 nt, Leptospira interrogans serovar lai str. 56601
uguuuaaauagauucaaa

SEQ ID NO: 2782948 - RNA, 16 nt, Leptospira interrogans serovar lai str. 56601
uguuuaagguugaggu

SEQ ID NO: 2782949 - RNA, 17 nt, Leptospira interrogans serovar lai str. 56601
uguuuaauaccuaauuc

SEQ ID NO: 2782950 - RNA, 15 nt, Leptospira interrogans serovar lai str. 56601
uguuuaauuucuuca

SEQ ID NO: 2782951 - RNA, 16 nt, Leptospira interrogans serovar lai str. 56601
uguuuaccuuuugaau

SEQ ID NO: 2782952 - RNA, 17 nt, Leptospira interrogans serovar lai str. 56601
uguuuacuugaaaauaa

SEQ ID NO: 2782953 - RNA, 22 nt, Leptospira interrogans serovar lai str. 56601
uguuuacuugaaaauaaaaauc

SEQ ID NO: 2782954 - RNA, 15 nt, Leptospira interrogans serovar lai str. 56601
uguuuagaauauuuu

SEQ ID NO: 2782955 - RNA, 18 nt, Leptospira interrogans serovar lai str. 56601
uguuuagaauauuuucuc

SEQ ID NO: 2782956 - RNA, 18 nt, Leptospira interrogans serovar lai str. 56601
uguuuagaguauuauaaa

SEQ ID NO: 2782957 - RNA, 12 nt, Leptospira interrogans serovar lai str. 56601
uguuuauaaaaa

SEQ ID NO: 2782958 - RNA, 13 nt, Leptospira interrogans serovar lai str. 56601
uguuuauuuugaa

SEQ ID NO: 2782959 - RNA, 22 nt, Leptospira interrogans serovar lai str. 56601
uguuucaagacaacagaacaaa

SEQ ID NO: 2782960 - RNA, 14 nt, Leptospira interrogans serovar lai str. 56601
uguuucauaaaauu

SEQ ID NO: 2782961 - RNA, 19 nt, Leptospira interrogans serovar lai str. 56601
uguuucccaguucuuaaau

SEQ ID NO: 2782962 - RNA, 20 nt, Leptospira interrogans serovar lai str. 56601
uguuuccucuugaagauuua

SEQ ID NO: 2782963 - RNA, 14 nt, Leptospira interrogans serovar lai str. 56601
uguuucuguuugau

SEQ ID NO: 2782964 - RNA, 13 nt, Leptospira interrogans serovar lai str. 56601
uguuucuuguguc

SEQ ID NO: 2782965 - RNA, 19 nt, Leptospira interrogans serovar lai str. 56601
uguuucuuuuguaaaacga

SEQ ID NO: 2782966 - RNA, 18 nt, Leptospira interrogans serovar lai str. 56601
uguuugaaaguucccaaa

SEQ ID NO: 2782967 - RNA, 15 nt, Leptospira interrogans serovar lai str. 56601
uguuugaauccaaaa

SEQ ID NO: 2782968 - RNA, 23 nt, Leptospira interrogans serovar lai str. 56601
uguuugaauuuuuaagaauaauu

SEQ ID NO: 2782969 - RNA, 20 nt, Leptospira interrogans serovar lai str. 56601
uguuugagguuuuaaaagug

SEQ ID NO: 2782970 - RNA, 16 nt, Leptospira interrogans serovar lai str. 56601
uguuuguccuagaucu

SEQ ID NO: 2782971 - RNA, 16 nt, Leptospira interrogans serovar lai str. 56601
uguuugucuuuuucua

SEQ ID NO: 2782972 - RNA, 16 nt, Leptospira interrogans serovar lai str. 56601
uguuuguggauuauga

SEQ ID NO: 2782973 - RNA, 11 nt, Leptospira interrogans serovar lai str. 56601
uguuuuaaaac

SEQ ID NO: 2782974 - RNA, 21 nt, Leptospira interrogans serovar lai str. 56601
uguuuuaaaacuuaaaaugug

SEQ ID NO: 2782975 - RNA, 14 nt, Leptospira interrogans serovar lai str. 56601
uguuuuauucuaaa

SEQ ID NO: 2782976 - RNA, 14 nt, Leptospira interrogans serovar lai str. 56601
uguuuucuacaaau

SEQ ID NO: 2782977 - RNA, 23 nt, Leptospira interrogans serovar lai str. 56601
uguuuucuacaaauaaaacuucu

SEQ ID NO: 2782978 - RNA, 16 nt, Leptospira interrogans serovar lai str. 56601
uguuuugcucuaaaau

SEQ ID NO: 2782979 - RNA, 22 nt, Leptospira interrogans serovar lai str. 56601
uguuuuggcucuugcuaaaauu

SEQ ID NO: 2782980 - RNA, 17 nt, Leptospira interrogans serovar lai str. 56601
uguuuugugauaaaauu

SEQ ID NO: 2782981 - RNA, 16 nt, Leptospira interrogans serovar lai str. 56601
uguuuuguuuccuucu

SEQ ID NO: 2782982 - RNA, 15 nt, Leptospira interrogans serovar lai str. 56601
uguuuuuaaaauugu

SEQ ID NO: 2782983 - RNA, 22 nt, Leptospira interrogans serovar lai str. 56601
uguuuuuauaucuuaauuaaaa

SEQ ID NO: 2782984 - RNA, 21 nt, Leptospira interrogans serovar lai str. 56601
uguuuuucacaaguuaaauug

SEQ ID NO: 2782985 - RNA, 21 nt, Leptospira interrogans serovar lai str. 56601
uguuuuucgaaucggguuugu

SEQ ID NO: 2782986 - RNA, 14 nt, Leptospira interrogans serovar lai str. 56601
uguuuuucuugcua

SEQ ID NO: 2782987 - RNA, 20 nt, Leptospira interrogans serovar lai str. 56601
uguuuuuuagaaaauucaaa

SEQ ID NO: 2782988 - RNA, 14 nt, Leptospira interrogans serovar lai str. 56601
uguuuuuuauauaa

SEQ ID NO: 2782989 - RNA, 12 nt, Leptospira interrogans serovar lai str. 56601
uguuuuuuauuu

SEQ ID NO: 2782990 - RNA, 23 nt, Leptospira interrogans serovar lai str. 56601
uguuuuuuccgguaauuauaauu

SEQ ID NO: 2782991 - RNA, 17 nt, Leptospira interrogans serovar lai str. 56601
uguuuuuucuuuaaaau

SEQ ID NO: 2782992 - RNA, 22 nt, Leptospira interrogans serovar lai str. 56601
uguuuuuuugcagaaguauucc

SEQ ID NO: 2782993 - RNA, 13 nt, Leptospira interrogans serovar lai str. 56601
uguuuuuuuggau

SEQ ID NO: 2782994 - RNA, 12 nt, Leptospira interrogans serovar lai str. 56601
uuaaaaaaauaa

SEQ ID NO: 2782995 - RNA, 15 nt, Leptospira interrogans serovar lai str. 56601
uuaaaaaacuauaaa

SEQ ID NO: 2782996 - RNA, 12 nt, Leptospira interrogans serovar lai str. 56601
uuaaaaaacuuu

SEQ ID NO: 2782997 - RNA, 20 nt, Leptospira interrogans serovar lai str. 56601
uuaaaaaagagaaagaaaaa

SEQ ID NO: 2782998 - RNA, 19 nt, Leptospira interrogans serovar lai str. 56601
uuaaaaaaugaauuuuuca

SEQ ID NO: 2782999 - RNA, 20 nt, Leptospira interrogans serovar lai str. 56601
uuaaaaaaugaauuuuucau

SEQ ID NO: 2783000 - RNA, 13 nt, Leptospira interrogans serovar lai str. 56601
uuaaaaaauuaau

SEQ ID NO: 2783001 - RNA, 14 nt, Leptospira interrogans serovar lai str. 56601
uuaaaaaauuuaua

SEQ ID NO: 2783002 - RNA, 17 nt, Leptospira interrogans serovar lai str. 56601
uuaaaaaauuucuuaaa

SEQ ID NO: 2783003 - RNA, 21 nt, Leptospira interrogans serovar lai str. 56601
uuaaaaaccgucccaaaacaa

SEQ ID NO: 2783004 - RNA, 21 nt, Leptospira interrogans serovar lai str. 56601
uuaaaaaccuaguguuuaauu

SEQ ID NO: 2783005 - RNA, 10 nt, Leptospira interrogans serovar lai str. 56601
uuaaaaagaa

SEQ ID NO: 2783006 - RNA, 18 nt, Leptospira interrogans serovar lai str. 56601
uuaaaaagcucaucucau

SEQ ID NO: 2783007 - RNA, 19 nt, Leptospira interrogans serovar lai str. 56601
uuaaaaagcucaucucauc

SEQ ID NO: 2783008 - RNA, 12 nt, Leptospira interrogans serovar lai str. 56601
uuaaaaauaccg

SEQ ID NO: 2783009 - RNA, 14 nt, Leptospira interrogans serovar lai str. 56601
uuaaaaccaaaaug

SEQ ID NO: 2783010 - RNA, 21 nt, Leptospira interrogans serovar lai str. 56601
uuaaaaccaaucgauaacuug

SEQ ID NO: 2783011 - RNA, 19 nt, Leptospira interrogans serovar lai str. 56601
uuaaaacgaauugauaaaa

SEQ ID NO: 2783012 - RNA, 21 nt, Leptospira interrogans serovar lai str. 56601
uuaaaacucaacguuaguaac

SEQ ID NO: 2783013 - RNA, 11 nt, Leptospira interrogans serovar lai str. 56601
uuaaaacucac

SEQ ID NO: 2783014 - RNA, 19 nt, Leptospira interrogans serovar lai str. 56601
uuaaaagaaacuuaauaaa

SEQ ID NO: 2783015 - RNA, 18 nt, Leptospira interrogans serovar lai str. 56601
uuaaaagccauuucaaaa

SEQ ID NO: 2783016 - RNA, 22 nt, Leptospira interrogans serovar lai str. 56601
aaaaaauguaaucucgauuucu

SEQ ID NO: 2783017 - RNA, 11 nt, Leptospira interrogans serovar lai str. 56601
aaaaaauguuu

SEQ ID NO: 2783018 - RNA, 14 nt, Leptospira interrogans serovar lai str. 56601
aaaaaauguuuaaa

SEQ ID NO: 2783019 - RNA, 22 nt, Leptospira interrogans serovar lai str. 56601
aaaaaauguuuagacuucucuu

SEQ ID NO: 2783020 - RNA, 14 nt, Leptospira interrogans serovar lai str. 56601
aaaaaauuaacuuu

SEQ ID NO: 2783021 - RNA, 12 nt, Leptospira interrogans serovar lai str. 56601
aaaaaauuaauu

SEQ ID NO: 2783022 - RNA, 12 nt, Leptospira interrogans serovar lai str. 56601
aaaaaauucaau

SEQ ID NO: 2783023 - RNA, 22 nt, Leptospira interrogans serovar lai str. 56601
aaaaaauucauuccuauaaaua

SEQ ID NO: 2783024 - RNA, 14 nt, Leptospira interrogans serovar lai str. 56601
aaaaaauucgauuu

SEQ ID NO: 2783025 - RNA, 14 nt, Leptospira interrogans serovar lai str. 56601
aaaaaauucuuuuu

SEQ ID NO: 2783026 - RNA, 13 nt, Leptospira interrogans serovar lai str. 56601
aaaaaauuuuaca

SEQ ID NO: 2783027 - RNA, 13 nt, Leptospira interrogans serovar lai str. 56601
aaaaaauuuuuac

SEQ ID NO: 2783028 - RNA, 12 nt, Leptospira interrogans serovar lai str. 56601
aaaaaauuuuuc

SEQ ID NO: 2783029 - RNA, 21 nt, Leptospira interrogans serovar lai str. 56601
aaaaacaaacgagucuuuugu

SEQ ID NO: 2783030 - RNA, 14 nt, Leptospira interrogans serovar lai str. 56601
aaaaacaaauuaag

SEQ ID NO: 2783031 - RNA, 23 nt, Leptospira interrogans serovar lai str. 56601
aaaaacaaauuaaguuuaaaaac

SEQ ID NO: 2783032 - RNA, 19 nt, Leptospira interrogans serovar lai str. 56601
aaaaacaauuaaucaaauu

SEQ ID NO: 2783033 - RNA, 20 nt, Leptospira interrogans serovar lai str. 56601
aaaaacacuuuaucuuuucu

SEQ ID NO: 2783034 - RNA, 18 nt, Leptospira interrogans serovar lai str. 56601
aaaaacagaauugaguuu

SEQ ID NO: 2783035 - RNA, 17 nt, Leptospira interrogans serovar lai str. 56601
aaaaacagguaaaccug

SEQ ID NO: 2783036 - RNA, 23 nt, Leptospira interrogans serovar lai str. 56601
aaaaacaguauuuguaaaaauga

SEQ ID NO: 2783037 - RNA, 18 nt, Leptospira interrogans serovar lai str. 56601
aaaaacauaaaaauuuuu

SEQ ID NO: 2783038 - RNA, 22 nt, Leptospira interrogans serovar lai str. 56601
aaaaacauaaaaauuuuuuaaa

SEQ ID NO: 2783039 - RNA, 22 nt, Leptospira interrogans serovar lai str. 56601
aaaaacauaagaauauuauaaa

SEQ ID NO: 2783040 - RNA, 14 nt, Leptospira interrogans serovar lai str. 56601
aaaaaccacaaaaa

SEQ ID NO: 2783041 - RNA, 17 nt, Leptospira interrogans serovar lai str. 56601
aaaaaccccauuaaaaa

SEQ ID NO: 2783042 - RNA, 19 nt, Leptospira interrogans serovar lai str. 56601
aaaaaccccauuaaaaagc

SEQ ID NO: 2783043 - RNA, 20 nt, Leptospira interrogans serovar lai str. 56601
aaaaaccccauuaaaaagcu

SEQ ID NO: 2783044 - RNA, 18 nt, Leptospira interrogans serovar lai str. 56601
aaaaacccgguaguggaa

SEQ ID NO: 2783045 - RNA, 18 nt, Leptospira interrogans serovar lai str. 56601
aaaaaccgaaauagaaau

SEQ ID NO: 2783046 - RNA, 16 nt, Leptospira interrogans serovar lai str. 56601
aaaaaccgucccaaaa

SEQ ID NO: 2783047 - RNA, 19 nt, Leptospira interrogans serovar lai str. 56601
aaaaaccgucccaaaacaa

SEQ ID NO: 2783048 - RNA, 20 nt, Leptospira interrogans serovar lai str. 56601
aaaaaccgucccaaaacaau

SEQ ID NO: 2783049 - RNA, 17 nt, Leptospira interrogans serovar lai str. 56601
aaaaaccgucccaaaau

SEQ ID NO: 2783050 - RNA, 20 nt, Leptospira interrogans serovar lai str. 56601
aaaaaccgucccaaaaucuu

SEQ ID NO: 2783051 - RNA, 21 nt, Leptospira interrogans serovar lai str. 56601
aaaaaccgucccaaaaucuua

SEQ ID NO: 2783052 - RNA, 21 nt, Leptospira interrogans serovar lai str. 56601
aaaaaccguuccuuucaagaa

SEQ ID NO: 2783053 - RNA, 20 nt, Leptospira interrogans serovar lai str. 56601
aaaaaccuaguguuuaauuu

SEQ ID NO: 2783054 - RNA, 15 nt, Leptospira interrogans serovar lai str. 56601
aaaaaccugauuuuu

SEQ ID NO: 2783055 - RNA, 13 nt, Leptospira interrogans serovar lai str. 56601
aaaaacgucaaaa

SEQ ID NO: 2783056 - RNA, 20 nt, Leptospira interrogans serovar lai str. 56601
aaaaacgucuaguccucuuu

SEQ ID NO: 2783057 - RNA, 23 nt, Leptospira interrogans serovar lai str. 56601
aaaaacuaccacaaaucuaaauu

SEQ ID NO: 2783058 - RNA, 21 nt, Leptospira interrogans serovar lai str. 56601
aaaaacuaucaguuuucagag

SEQ ID NO: 2783059 - RNA, 14 nt, Leptospira interrogans serovar lai str. 56601
aaaaacucaaagaa

SEQ ID NO: 2783060 - RNA, 20 nt, Leptospira interrogans serovar lai str. 56601
aaaaacucagcgaaaauacu

SEQ ID NO: 2783061 - RNA, 21 nt, Leptospira interrogans serovar lai str. 56601
aaaaacucagugaaugccucu

SEQ ID NO: 2783062 - RNA, 16 nt, Leptospira interrogans serovar lai str. 56601
aaaaacucgguuucuu

SEQ ID NO: 2783063 - RNA, 20 nt, Leptospira interrogans serovar lai str. 56601
aaaaacucgguuucuuauau

SEQ ID NO: 2783064 - RNA, 23 nt, Leptospira interrogans serovar lai str. 56601
aaaaacucuguucaguguaagau

SEQ ID NO: 2783065 - RNA, 15 nt, Leptospira interrogans serovar lai str. 56601
aaaaacugauuaaaa

SEQ ID NO: 2783066 - RNA, 16 nt, Leptospira interrogans serovar lai str. 56601
aaaaacugauuuaauu

SEQ ID NO: 2783067 - RNA, 17 nt, Leptospira interrogans serovar lai str. 56601
aaaaacuugauauuucu

SEQ ID NO: 2783068 - RNA, 20 nt, Leptospira interrogans serovar lai str. 56601
aaaaacuuuagaauguaaaa

SEQ ID NO: 2783069 - RNA, 19 nt, Leptospira interrogans serovar lai str. 56601
aaaaacuuucggaauaaaa

SEQ ID NO: 2783070 - RNA, 16 nt, Leptospira interrogans serovar lai str. 56601
aaaaacuuucuaaaaa

SEQ ID NO: 2783071 - RNA, 11 nt, Leptospira interrogans serovar lai str. 56601
aaaaagaaaaa

SEQ ID NO: 2783072 - RNA, 13 nt, Leptospira interrogans serovar lai str. 56601
aaaaagaaagcag

SEQ ID NO: 2783073 - RNA, 15 nt, Leptospira interrogans serovar lai str. 56601
aaaaagaaagcagca

SEQ ID NO: 2783074 - RNA, 12 nt, Leptospira interrogans serovar lai str. 56601
aaaaagaaaguu

SEQ ID NO: 2783075 - RNA, 14 nt, Leptospira interrogans serovar lai str. 56601
aaaaagaauuuuua

SEQ ID NO: 2783076 - RNA, 16 nt, Leptospira interrogans serovar lai str. 56601
aaaaagaauuuuuaaa

SEQ ID NO: 2783077 - RNA, 20 nt, Leptospira interrogans serovar lai str. 56601
aaaaagaauuuuuaaaaaua

SEQ ID NO: 2783078 - RNA, 14 nt, Leptospira interrogans serovar lai str. 56601
aaaaagacuuaaaa

SEQ ID NO: 2783079 - RNA, 22 nt, Leptospira interrogans serovar lai str. 56601
aaaaagacuuaaaagaagauuu

SEQ ID NO: 2783080 - RNA, 17 nt, Leptospira interrogans serovar lai str. 56601
aaaaagagacguaauuu

SEQ ID NO: 2783081 - RNA, 23 nt, Leptospira interrogans serovar lai str. 56601
aaaaagagaugguuuagaaaacg

SEQ ID NO: 2783082 - RNA, 13 nt, Leptospira interrogans serovar lai str. 56601
aaaaagauaaaaa

SEQ ID NO: 2783083 - RNA, 15 nt, Leptospira interrogans serovar lai str. 56601
aaaaagaucuuauaa

SEQ ID NO: 2783084 - RNA, 14 nt, Leptospira interrogans serovar lai str. 56601
aaaaagcagcuaaa

SEQ ID NO: 2783085 - RNA, 18 nt, Leptospira interrogans serovar lai str. 56601
aaaaagcagcuaaaaaga

SEQ ID NO: 2783086 - RNA, 21 nt, Leptospira interrogans serovar lai str. 56601
aaaaagcugaacuuaaaaucu

SEQ ID NO: 2783087 - RNA, 24 nt, Leptospira interrogans serovar lai str. 56601
aaaaagggauucuauucucguuuc

SEQ ID NO: 2783088 - RNA, 21 nt, Leptospira interrogans serovar lai str. 56601
aaaaaguaguaauucuuacau

SEQ ID NO: 2783089 - RNA, 17 nt, Leptospira interrogans serovar lai str. 56601
aaaaaguauaauuuaaa

SEQ ID NO: 2783090 - RNA, 19 nt, Leptospira interrogans serovar lai str. 56601
aaaaaguccaaaacaaagu

SEQ ID NO: 2783091 - RNA, 21 nt, Leptospira interrogans serovar lai str. 56601
aaaaagucugucuuaaaauuu

SEQ ID NO: 2783092 - RNA, 21 nt, Leptospira interrogans serovar lai str. 56601
aaaaaguuaauucuaaaucug

SEQ ID NO: 2783093 - RNA, 23 nt, Leptospira interrogans serovar lai str. 56601
aaaaaguugcuaagaaaaaagca

SEQ ID NO: 2783094 - RNA, 21 nt, Leptospira interrogans serovar lai str. 56601
aaaaaguuggaaucuaaacuu

SEQ ID NO: 2783095 - RNA, 18 nt, Leptospira interrogans serovar lai str. 56601
aaaaaguuuguuuguaaa

SEQ ID NO: 2783096 - RNA, 20 nt, Leptospira interrogans serovar lai str. 56601
aaaaaguuuuacaaagaguu

SEQ ID NO: 2783097 - RNA, 21 nt, Leptospira interrogans serovar lai str. 56601
aaaaaguuuuucuaaauuuua

SEQ ID NO: 2783098 - RNA, 12 nt, Leptospira interrogans serovar lai str. 56601
aaaaauaaaaug

SEQ ID NO: 2783099 - RNA, 12 nt, Leptospira interrogans serovar lai str. 56601
aaaaauaaauca

SEQ ID NO: 2783100 - RNA, 23 nt, Leptospira interrogans serovar lai str. 56601
aaaaauaaaugugggaacucuca

SEQ ID NO: 2783101 - RNA, 17 nt, Leptospira interrogans serovar lai str. 56601
aaaaauaauauauuuau

SEQ ID NO: 2783102 - RNA, 20 nt, Leptospira interrogans serovar lai str. 56601
aaaaauacaaacagucaaaa

SEQ ID NO: 2783103 - RNA, 22 nt, Leptospira interrogans serovar lai str. 56601
aaaaauacgauucgaaagauuu

SEQ ID NO: 2783104 - RNA, 12 nt, Leptospira interrogans serovar lai str. 56601
aaaaauagaauu

SEQ ID NO: 2783105 - RNA, 16 nt, Leptospira interrogans serovar lai str. 56601
aaaaauagauguggga

SEQ ID NO: 2783106 - RNA, 23 nt, Leptospira interrogans serovar lai str. 56601
aaaaauagaugugggaacucuca

SEQ ID NO: 2783107 - RNA, 20 nt, Leptospira interrogans serovar lai str. 56601
aaaaauagcagaugagcauu

SEQ ID NO: 2783108 - RNA, 20 nt, Leptospira interrogans serovar lai str. 56601
aaaaauagggaaaacucaac

SEQ ID NO: 2783109 - RNA, 17 nt, Leptospira interrogans serovar lai str. 56601
aaaaauaguauccaaaa

SEQ ID NO: 2783110 - RNA, 19 nt, Leptospira interrogans serovar lai str. 56601
aaaaauaguauccaaaauu

SEQ ID NO: 2783111 - RNA, 19 nt, Leptospira interrogans serovar lai str. 56601
aaaaauauacaauaaauca

SEQ ID NO: 2783112 - RNA, 18 nt, Leptospira interrogans serovar lai str. 56601
aaaaauaucaccuaacuu

SEQ ID NO: 2783113 - RNA, 16 nt, Leptospira interrogans serovar lai str. 56601
aaaaauaucuuagaau

SEQ ID NO: 2783114 - RNA, 19 nt, Leptospira interrogans serovar lai str. 56601
aaaaauaucuuagaauaau

SEQ ID NO: 2783115 - RNA, 17 nt, Leptospira interrogans serovar lai str. 56601
aaaaauaugauuuaaaa

SEQ ID NO: 2783116 - RNA, 21 nt, Leptospira interrogans serovar lai str. 56601
aaaaauauggaaacuacccau

SEQ ID NO: 2783117 - RNA, 13 nt, Leptospira interrogans serovar lai str. 56601
aaaaauauuaaaa

SEQ ID NO: 2783118 - RNA, 14 nt, Leptospira interrogans serovar lai str. 56601
aaaaauauuauauu

SEQ ID NO: 2783119 - RNA, 19 nt, Leptospira interrogans serovar lai str. 56601
aaaaauauuauauuuuuaa

SEQ ID NO: 2783120 - RNA, 16 nt, Leptospira interrogans serovar lai str. 56601
aaaaaucaggcuuuau

SEQ ID NO: 2783121 - RNA, 18 nt, Leptospira interrogans serovar lai str. 56601
aaaaaucagguuuuauaa

SEQ ID NO: 2783122 - RNA, 15 nt, Leptospira interrogans serovar lai str. 56601
aaaaaucauaaaaca

SEQ ID NO: 2783123 - RNA, 15 nt, Leptospira interrogans serovar lai str. 56601
aaaaaucauauccaa

SEQ ID NO: 2783124 - RNA, 16 nt, Leptospira interrogans serovar lai str. 56601
aaaaauccccuuucua

SEQ ID NO: 2783125 - RNA, 21 nt, Leptospira interrogans serovar lai str. 56601
aaaaaucgacuuuucugauuu

SEQ ID NO: 2783126 - RNA, 14 nt, Leptospira interrogans serovar lai str. 56601
aaaaaucgauuuga

SEQ ID NO: 2783127 - RNA, 12 nt, Leptospira interrogans serovar lai str. 56601
aaaaaucucuuu

SEQ ID NO: 2783128 - RNA, 15 nt, Leptospira interrogans serovar lai str. 56601
aaaaaucugcucuau

SEQ ID NO: 2783129 - RNA, 21 nt, Leptospira interrogans serovar lai str. 56601
aaaaaucuucaguucuuauag

SEQ ID NO: 2783130 - RNA, 22 nt, Leptospira interrogans serovar lai str. 56601
aaaaaugaaagguaauuuugaa

SEQ ID NO: 2783131 - RNA, 14 nt, Leptospira interrogans serovar lai str. 56601
aaaaaugaaaucua

SEQ ID NO: 2783132 - RNA, 14 nt, Leptospira interrogans serovar lai str. 56601
aaaaaugaauguuu

SEQ ID NO: 2783133 - RNA, 15 nt, Leptospira interrogans serovar lai str. 56601
aaaaaugaauguuua

SEQ ID NO: 2783134 - RNA, 17 nt, Leptospira interrogans serovar lai str. 56601
aaaaaugaauguuuaaa

SEQ ID NO: 2783135 - RNA, 17 nt, Leptospira interrogans serovar lai str. 56601
aaaaaugaauucucuau

SEQ ID NO: 2783136 - RNA, 23 nt, Leptospira interrogans serovar lai str. 56601
aaaaaugagaaagaauuucuaaa

SEQ ID NO: 2783137 - RNA, 19 nt, Leptospira interrogans serovar lai str. 56601
aaaaaugauacuauuaauu

SEQ ID NO: 2783138 - RNA, 20 nt, Leptospira interrogans serovar lai str. 56601
aaaaaugauacuauuaauuu

SEQ ID NO: 2783139 - RNA, 18 nt, Leptospira interrogans serovar lai str. 56601
aaaaaugaucuaagauuu

SEQ ID NO: 2783140 - RNA, 16 nt, Leptospira interrogans serovar lai str. 56601
aaaaaugcaaaaguuu

SEQ ID NO: 2783141 - RNA, 17 nt, Leptospira interrogans serovar lai str. 56601
aaaaaugcaaaaguuuu

SEQ ID NO: 2783142 - RNA, 14 nt, Leptospira interrogans serovar lai str. 56601
aaaaauguaaaaaa

SEQ ID NO: 2783143 - RNA, 16 nt, Leptospira interrogans serovar lai str. 56601
aaaaauguaaaaaaau

SEQ ID NO: 2783144 - RNA, 19 nt, Leptospira interrogans serovar lai str. 56601
aaaaaugugggaacuauaa

SEQ ID NO: 2783145 - RNA, 13 nt, Leptospira interrogans serovar lai str. 56601
aaaaauguuuaaa

SEQ ID NO: 2783146 - RNA, 17 nt, Leptospira interrogans serovar lai str. 56601
aaaaauguuuaaagaau

SEQ ID NO: 2783147 - RNA, 12 nt, Leptospira interrogans serovar lai str. 56601
aaaaauuaaaaa

SEQ ID NO: 2783148 - RNA, 15 nt, Leptospira interrogans serovar lai str. 56601
aaaaauuaaaaaaga

SEQ ID NO: 2783149 - RNA, 24 nt, Leptospira interrogans serovar lai str. 56601
aaaaauuaaaauucuagaaagaau

SEQ ID NO: 2783150 - RNA, 18 nt, Leptospira interrogans serovar lai str. 56601
aaaaauuagaaaugauuu

SEQ ID NO: 2783151 - RNA, 18 nt, Leptospira interrogans serovar lai str. 56601
aaaaauucaacuuguaaa

SEQ ID NO: 2783152 - RNA, 20 nt, Leptospira interrogans serovar lai str. 56601
aaaaauucaguucugaacuu

SEQ ID NO: 2783153 - RNA, 10 nt, Leptospira interrogans serovar lai str. 56601
aaaaauucau

SEQ ID NO: 2783154 - RNA, 17 nt, Leptospira interrogans serovar lai str. 56601
aaaaauucauaauaaaa

SEQ ID NO: 2783155 - RNA, 20 nt, Leptospira interrogans serovar lai str. 56601
aaaaauucauaauaaaacua

SEQ ID NO: 2783156 - RNA, 21 nt, Leptospira interrogans serovar lai str. 56601
aaaaauucauuccuauaaaua

SEQ ID NO: 2783157 - RNA, 22 nt, Leptospira interrogans serovar lai str. 56601
aaaaauucauuccuauaaauaa

SEQ ID NO: 2783158 - RNA, 11 nt, Leptospira interrogans serovar lai str. 56601
aaaaauuccau

SEQ ID NO: 2783159 - RNA, 21 nt, Leptospira interrogans serovar lai str. 56601
aaaaauuccauagcaacaauu

SEQ ID NO: 2783160 - RNA, 22 nt, Leptospira interrogans serovar lai str. 56601
aaaaauucgauguuauuuuuaa

SEQ ID NO: 2783161 - RNA, 23 nt, Leptospira interrogans serovar lai str. 56601
aaaaauucuccuccugaaaauuu

SEQ ID NO: 2783162 - RNA, 21 nt, Leptospira interrogans serovar lai str. 56601
aaaaauucugucguaaaaagu

SEQ ID NO: 2783163 - RNA, 14 nt, Leptospira interrogans serovar lai str. 56601
aaaaauugucuuuc

SEQ ID NO: 2783164 - RNA, 18 nt, Leptospira interrogans serovar lai str. 56601
aaaaauuguugaagaauu

SEQ ID NO: 2783165 - RNA, 22 nt, Leptospira interrogans serovar lai str. 56601
aaaaauuuauaaagacuuuaaa

SEQ ID NO: 2783166 - RNA, 13 nt, Leptospira interrogans serovar lai str. 56601
aaaaauuucagau

SEQ ID NO: 2783167 - RNA, 13 nt, Leptospira interrogans serovar lai str. 56601
aaaaauuucauag

SEQ ID NO: 2783168 - RNA, 21 nt, Leptospira interrogans serovar lai str. 56601
aaaaauuucauaguucaauua

SEQ ID NO: 2783169 - RNA, 23 nt, Leptospira interrogans serovar lai str. 56601
aaaaauuucccuaguuccaauua

SEQ ID NO: 2783170 - RNA, 17 nt, Leptospira interrogans serovar lai str. 56601
aaaaauuucuaugaaaa

SEQ ID NO: 2783171 - RNA, 15 nt, Leptospira interrogans serovar lai str. 56601
aaaaauuucuuaaaa

SEQ ID NO: 2783172 - RNA, 17 nt, Leptospira interrogans serovar lai str. 56601
aaaaauuucuuaaaaga

SEQ ID NO: 2783173 - RNA, 18 nt, Leptospira interrogans serovar lai str. 56601
aaaaauuucuuaaaagau

SEQ ID NO: 2783174 - RNA, 17 nt, Leptospira interrogans serovar lai str. 56601
aaaaauuucuucaauug

SEQ ID NO: 2783175 - RNA, 19 nt, Leptospira interrogans serovar lai str. 56601
aaaaauuuuacccugguuu

SEQ ID NO: 2783176 - RNA, 11 nt, Leptospira interrogans serovar lai str. 56601
aaaaauuuuau

SEQ ID NO: 2783177 - RNA, 22 nt, Leptospira interrogans serovar lai str. 56601
aaaaauuuuccgaaccuuacca

SEQ ID NO: 2783178 - RNA, 21 nt, Leptospira interrogans serovar lai str. 56601
aaaaauuuucuaaaaguaaaa

SEQ ID NO: 2783179 - RNA, 23 nt, Leptospira interrogans serovar lai str. 56601
aaaaauuuuuagaguuuguucca

SEQ ID NO: 2783180 - RNA, 18 nt, Leptospira interrogans serovar lai str. 56601
aaaaauuuuucuuaauuu

SEQ ID NO: 2783181 - RNA, 14 nt, Leptospira interrogans serovar lai str. 56601
aaaacuuuuuaaaa

SEQ ID NO: 2783182 - RNA, 15 nt, Leptospira interrogans serovar lai str. 56601
aaaacuuuuuauaaa

SEQ ID NO: 2783183 - RNA, 18 nt, Leptospira interrogans serovar lai str. 56601
aaaacuuuuuauaaagau

SEQ ID NO: 2783184 - RNA, 14 nt, Leptospira interrogans serovar lai str. 56601
aaaagaaaaaucuu

SEQ ID NO: 2783185 - RNA, 14 nt, Leptospira interrogans serovar lai str. 56601
aaaagaaaccaauc

SEQ ID NO: 2783186 - RNA, 16 nt, Leptospira interrogans serovar lai str. 56601
aaaagaaauauuaaaa

SEQ ID NO: 2783187 - RNA, 17 nt, Leptospira interrogans serovar lai str. 56601
aaaagaagaaugaaaaa

SEQ ID NO: 2783188 - RNA, 20 nt, Leptospira interrogans serovar lai str. 56601
aaaagaagaugcuuucucuu

SEQ ID NO: 2783189 - RNA, 21 nt, Leptospira interrogans serovar lai str. 56601
aaaagaagauuuuucuuuaaa

SEQ ID NO: 2783190 - RNA, 16 nt, Leptospira interrogans serovar lai str. 56601
aaaagaauauuucuaa

SEQ ID NO: 2783191 - RNA, 17 nt, Leptospira interrogans serovar lai str. 56601
aaaagaauauuucuaaa

SEQ ID NO: 2783192 - RNA, 21 nt, Leptospira interrogans serovar lai str. 56601
aaaagaaucauacaaucaaau

SEQ ID NO: 2783193 - RNA, 21 nt, Leptospira interrogans serovar lai str. 56601
aaaagaaucgucgcucaauca

SEQ ID NO: 2783194 - RNA, 17 nt, Leptospira interrogans serovar lai str. 56601
aaaagaauuuuuaaaaa

SEQ ID NO: 2783195 - RNA, 18 nt, Leptospira interrogans serovar lai str. 56601
aaaagaauuuuuaaaaau

SEQ ID NO: 2783196 - RNA, 16 nt, Leptospira interrogans serovar lai str. 56601
aaaagacccgcuacua

SEQ ID NO: 2783197 - RNA, 20 nt, Leptospira interrogans serovar lai str. 56601
aaaagacccgcuacuauucu

SEQ ID NO: 2783198 - RNA, 22 nt, Leptospira interrogans serovar lai str. 56601
aaaagacucacaccuucuuuuu

SEQ ID NO: 2783199 - RNA, 22 nt, Leptospira interrogans serovar lai str. 56601
aaaagagacauugaagaaaaaa

SEQ ID NO: 2783200 - RNA, 18 nt, Leptospira interrogans serovar lai str. 56601
aaaagagaugguuuagaa

SEQ ID NO: 2783201 - RNA, 15 nt, Leptospira interrogans serovar lai str. 56601
aaaagaguuuucaau

SEQ ID NO: 2783202 - RNA, 17 nt, Leptospira interrogans serovar lai str. 56601
aaaagauugaauuuuua

SEQ ID NO: 2783203 - RNA, 18 nt, Leptospira interrogans serovar lai str. 56601
aaaagauuucaaaaaacu

SEQ ID NO: 2783204 - RNA, 18 nt, Leptospira interrogans serovar lai str. 56601
aaaagauuuguuuuauaa

SEQ ID NO: 2783205 - RNA, 15 nt, Leptospira interrogans serovar lai str. 56601
aaaagcacaaaacga

SEQ ID NO: 2783206 - RNA, 23 nt, Leptospira interrogans serovar lai str. 56601
aaaagccagaauuuugaacauuu

SEQ ID NO: 2783207 - RNA, 20 nt, Leptospira interrogans serovar lai str. 56601
aaaagccauuucaaaaauau

SEQ ID NO: 2783208 - RNA, 15 nt, Leptospira interrogans serovar lai str. 56601
aaaagcgucaacuga

SEQ ID NO: 2783209 - RNA, 14 nt, Leptospira interrogans serovar lai str. 56601
aaaagcuaauaauc

SEQ ID NO: 2783210 - RNA, 22 nt, Leptospira interrogans serovar lai str. 56601
aaaagcugaacuuaaaaucuau

SEQ ID NO: 2783211 - RNA, 22 nt, Leptospira interrogans serovar lai str. 56601
aaaagcuuauacuuuaagaaaa

SEQ ID NO: 2783212 - RNA, 12 nt, Leptospira interrogans serovar lai str. 56601
aaaaggagccaa

SEQ ID NO: 2783213 - RNA, 14 nt, Leptospira interrogans serovar lai str. 56601
aaaaggauuccauu

SEQ ID NO: 2783214 - RNA, 16 nt, Leptospira interrogans serovar lai str. 56601
aaaaggcucucuuuug

SEQ ID NO: 2783215 - RNA, 19 nt, Leptospira interrogans serovar lai str. 56601
aaaaggcucucuuuugaga

SEQ ID NO: 2783216 - RNA, 19 nt, Leptospira interrogans serovar lai str. 56601
aaaaggcugucuucagcag

SEQ ID NO: 2783217 - RNA, 22 nt, Leptospira interrogans serovar lai str. 56601
aaaaggguuuuuacaauuaaau

SEQ ID NO: 2783218 - RNA, 22 nt, Leptospira interrogans serovar lai str. 56601
aaaaggugaucuuagaaaacca

SEQ ID NO: 2783219 - RNA, 23 nt, Leptospira interrogans serovar lai str. 56601
aaaagguguggauaccuuuaguu

SEQ ID NO: 2783220 - RNA, 15 nt, Leptospira interrogans serovar lai str. 56601
aaaagguuaaaaauu

SEQ ID NO: 2783221 - RNA, 18 nt, Leptospira interrogans serovar lai str. 56601
aaaagguuaaaaauuuaa

SEQ ID NO: 2783222 - RNA, 18 nt, Leptospira interrogans serovar lai str. 56601
aaaaguaacaguuccuaa

SEQ ID NO: 2783223 - RNA, 20 nt, Leptospira interrogans serovar lai str. 56601
aaaaguaacguaaauuuuua

SEQ ID NO: 2783224 - RNA, 15 nt, Leptospira interrogans serovar lai str. 56601
aaaaguaauggauuu

SEQ ID NO: 2783225 - RNA, 21 nt, Leptospira interrogans serovar lai str. 56601
aaaaguacauggcauccagga

SEQ ID NO: 2783226 - RNA, 19 nt, Leptospira interrogans serovar lai str. 56601
aaaaguacgggcucauaca

SEQ ID NO: 2783227 - RNA, 16 nt, Leptospira interrogans serovar lai str. 56601
aaaaguagaaagauua

SEQ ID NO: 2783228 - RNA, 13 nt, Leptospira interrogans serovar lai str. 56601
aaaaguagaauca

SEQ ID NO: 2783229 - RNA, 15 nt, Leptospira interrogans serovar lai str. 56601
aaaaguauaauuuaa

SEQ ID NO: 2783230 - RNA, 16 nt, Leptospira interrogans serovar lai str. 56601
aaaaguauauauuaaa

SEQ ID NO: 2783231 - RNA, 21 nt, Leptospira interrogans serovar lai str. 56601
aaaaguaugaacucuuacaau

SEQ ID NO: 2783232 - RNA, 18 nt, Leptospira interrogans serovar lai str. 56601
aaaagucaaaaaaugguu

SEQ ID NO: 2783233 - RNA, 18 nt, Leptospira interrogans serovar lai str. 56601
aaaagucagguuuuauca

SEQ ID NO: 2783234 - RNA, 17 nt, Leptospira interrogans serovar lai str. 56601
aaaaguccaauuuuaaa

SEQ ID NO: 2783235 - RNA, 14 nt, Leptospira interrogans serovar lai str. 56601
aaaagucgaaagaa

SEQ ID NO: 2783236 - RNA, 17 nt, Leptospira interrogans serovar lai str. 56601
aaaagucuauuucuaaa

SEQ ID NO: 2783237 - RNA, 13 nt, Leptospira interrogans serovar lai str. 56601
aaaaguguuuuug

SEQ ID NO: 2783238 - RNA, 15 nt, Leptospira interrogans serovar lai str. 56601
aaaaguuaauucuaa

SEQ ID NO: 2783239 - RNA, 13 nt, Leptospira interrogans serovar lai str. 56601
aaaaguuagaaua

SEQ ID NO: 2783240 - RNA, 15 nt, Leptospira interrogans serovar lai str. 56601
aaaaguuagaaucua

SEQ ID NO: 2783241 - RNA, 14 nt, Leptospira interrogans serovar lai str. 56601
aaaaguuagaauuu

SEQ ID NO: 2783242 - RNA, 15 nt, Leptospira interrogans serovar lai str. 56601
aaaaguucucuucau

SEQ ID NO: 2783243 - RNA, 21 nt, Leptospira interrogans serovar lai str. 56601
aaaaguuggaaucuaaacuuu

SEQ ID NO: 2783244 - RNA, 18 nt, Leptospira interrogans serovar lai str. 56601
aaaaguuggaaucugaau

SEQ ID NO: 2783245 - RNA, 22 nt, Leptospira interrogans serovar lai str. 56601
aaaaguuggaaucugaauuuua

SEQ ID NO: 2783246 - RNA, 17 nt, Leptospira interrogans serovar lai str. 56601
aaaaguuggaauuugaa

SEQ ID NO: 2783247 - RNA, 22 nt, Leptospira interrogans serovar lai str. 56601
aaaaguugggaucugaauuuua

SEQ ID NO: 2783248 - RNA, 14 nt, Leptospira interrogans serovar lai str. 56601
aaaaguuuauaaac

SEQ ID NO: 2783249 - RNA, 20 nt, Leptospira interrogans serovar lai str. 56601
aaaaguuucaucuuugaacu

SEQ ID NO: 2783250 - RNA, 20 nt, Leptospira interrogans serovar lai str. 56601
aaaaguuugguccuuuguga

SEQ ID NO: 2783251 - RNA, 18 nt, Leptospira interrogans serovar lai str. 56601
aaaaguuuguuuguaaag

SEQ ID NO: 2783252 - RNA, 18 nt, Leptospira interrogans serovar lai str. 56601
aaaaguuuucaaaaaugu

SEQ ID NO: 2783253 - RNA, 18 nt, Leptospira interrogans serovar lai str. 56601
aaaaguuuucucaaaauc

SEQ ID NO: 2783254 - RNA, 22 nt, Leptospira interrogans serovar lai str. 56601
aaaaguuuucucaaaaucuuaa

SEQ ID NO: 2783255 - RNA, 14 nt, Leptospira interrogans serovar lai str. 56601
aaaaguuuuucuaa

SEQ ID NO: 2783256 - RNA, 21 nt, Leptospira interrogans serovar lai str. 56601
aaaaguuuuucuaaauuuuau

SEQ ID NO: 2783257 - RNA, 22 nt, Leptospira interrogans serovar lai str. 56601
aaaaguuuuucuaaauuuuaua

SEQ ID NO: 2783258 - RNA, 23 nt, Leptospira interrogans serovar lai str. 56601
aaaaguuuuucuaaauuuuauaa

SEQ ID NO: 2783259 - RNA, 14 nt, Leptospira interrogans serovar lai str. 56601
aaaaguuuuugaaa

SEQ ID NO: 2783260 - RNA, 12 nt, Leptospira interrogans serovar lai str. 56601
aaaauaaaaaaa

SEQ ID NO: 2783261 - RNA, 13 nt, Leptospira interrogans serovar lai str. 56601
aaaauaaaaaaau

SEQ ID NO: 2783262 - RNA, 14 nt, Leptospira interrogans serovar lai str. 56601
aaaauaaaaaacaa

SEQ ID NO: 2783263 - RNA, 18 nt, Leptospira interrogans serovar lai str. 56601
aaaauaaaaaacaaacac

SEQ ID NO: 2783264 - RNA, 20 nt, Leptospira interrogans serovar lai str. 56601
aaaauccccuuucuaauccc

SEQ ID NO: 2783265 - RNA, 16 nt, Leptospira interrogans serovar lai str. 56601
aaaauccgaaacguuu

SEQ ID NO: 2783266 - RNA, 21 nt, Leptospira interrogans serovar lai str. 56601
aaaauccuaguuuuacgauuu

SEQ ID NO: 2783267 - RNA, 14 nt, Leptospira interrogans serovar lai str. 56601
aaaauccucaacag

SEQ ID NO: 2783268 - RNA, 16 nt, Leptospira interrogans serovar lai str. 56601
aaaauccucaacagau

SEQ ID NO: 2783269 - RNA, 21 nt, Leptospira interrogans serovar lai str. 56601
aaaaucgaguuucacaaaaau

SEQ ID NO: 2783270 - RNA, 17 nt, Leptospira interrogans serovar lai str. 56601
aaaaucgauuacucuuu

SEQ ID NO: 2783271 - RNA, 16 nt, Leptospira interrogans serovar lai str. 56601
aaaaucgauuugaucu

SEQ ID NO: 2783272 - RNA, 16 nt, Leptospira interrogans serovar lai str. 56601
aaaaucggaauuuuaa

SEQ ID NO: 2783273 - RNA, 20 nt, Leptospira interrogans serovar lai str. 56601
aaaaucggcauucaauuuag

SEQ ID NO: 2783274 - RNA, 18 nt, Leptospira interrogans serovar lai str. 56601
aaaaucguaaaaaagaua

SEQ ID NO: 2783275 - RNA, 15 nt, Leptospira interrogans serovar lai str. 56601
aaaaucguuuuaaaa

SEQ ID NO: 2783276 - RNA, 14 nt, Leptospira interrogans serovar lai str. 56601
aaaaucuaaaaaaa

SEQ ID NO: 2783277 - RNA, 15 nt, Leptospira interrogans serovar lai str. 56601
aaaaucuaaaaaaaa

SEQ ID NO: 2783278 - RNA, 15 nt, Leptospira interrogans serovar lai str. 56601
aaaaucuaaaaagaa

SEQ ID NO: 2783279 - RNA, 14 nt, Leptospira interrogans serovar lai str. 56601
aaaaucuaaaaaua

SEQ ID NO: 2783280 - RNA, 14 nt, Leptospira interrogans serovar lai str. 56601
aaaaucuaaaagaa

SEQ ID NO: 2783281 - RNA, 17 nt, Leptospira interrogans serovar lai str. 56601
aaaaucuaaauuuguaa

SEQ ID NO: 2783282 - RNA, 19 nt, Leptospira interrogans serovar lai str. 56601
aaaaucuaucucaaaaaua

SEQ ID NO: 2783283 - RNA, 21 nt, Leptospira interrogans serovar lai str. 56601
aaaaucuaucucaaaaauacu

SEQ ID NO: 2783284 - RNA, 14 nt, Leptospira interrogans serovar lai str. 56601
aaaaucucaaauuc

SEQ ID NO: 2783285 - RNA, 20 nt, Leptospira interrogans serovar lai str. 56601
aaaaucucagaaaauuuuac

SEQ ID NO: 2783286 - RNA, 17 nt, Leptospira interrogans serovar lai str. 56601
aaaaucuuaaaagaaaa

SEQ ID NO: 2783287 - RNA, 22 nt, Leptospira interrogans serovar lai str. 56601
aaaaucuuaaaagaaaaucaca

SEQ ID NO: 2783288 - RNA, 16 nt, Leptospira interrogans serovar lai str. 56601
aaaaucuuaaauuaga

SEQ ID NO: 2783289 - RNA, 15 nt, Leptospira interrogans serovar lai str. 56601
aaaaucuuaauaaaa

SEQ ID NO: 2783290 - RNA, 16 nt, Leptospira interrogans serovar lai str. 56601
aaaaucuuaauaaaau

SEQ ID NO: 2783291 - RNA, 17 nt, Leptospira interrogans serovar lai str. 56601
aaaaucuuaauuuguaa

SEQ ID NO: 2783292 - RNA, 19 nt, Leptospira interrogans serovar lai str. 56601
aaaaucuuaauuuguaaga

SEQ ID NO: 2783293 - RNA, 17 nt, Leptospira interrogans serovar lai str. 56601
aaaaucuuuaaguuugu

SEQ ID NO: 2783294 - RNA, 13 nt, Leptospira interrogans serovar lai str. 56601
aaaaucuuuagaa

SEQ ID NO: 2783295 - RNA, 16 nt, Leptospira interrogans serovar lai str. 56601
aaaaucuuuucuauaa

SEQ ID NO: 2783296 - RNA, 14 nt, Leptospira interrogans serovar lai str. 56601
aaaaugaaaaaacu

SEQ ID NO: 2783297 - RNA, 15 nt, Leptospira interrogans serovar lai str. 56601
aaaaugaaaaaacuu

SEQ ID NO: 2783298 - RNA, 13 nt, Leptospira interrogans serovar lai str. 56601
aaaaugaaaaauu

SEQ ID NO: 2783299 - RNA, 14 nt, Leptospira interrogans serovar lai str. 56601
aaaaugaaaauuau

SEQ ID NO: 2783300 - RNA, 15 nt, Leptospira interrogans serovar lai str. 56601
aaaaugaaaauuaua

SEQ ID NO: 2783301 - RNA, 20 nt, Leptospira interrogans serovar lai str. 56601
aaaaugaaagguaauuuuga

SEQ ID NO: 2783302 - RNA, 15 nt, Leptospira interrogans serovar lai str. 56601
aaaaugaaaucuaca

SEQ ID NO: 2783303 - RNA, 19 nt, Leptospira interrogans serovar lai str. 56601
aaaaugaaaucuacaaaac

SEQ ID NO: 2783304 - RNA, 13 nt, Leptospira interrogans serovar lai str. 56601
aaaaugaacucaa

SEQ ID NO: 2783305 - RNA, 15 nt, Leptospira interrogans serovar lai str. 56601
aaaaugaacucaaca

SEQ ID NO: 2783306 - RNA, 18 nt, Leptospira interrogans serovar lai str. 56601
aaaaugaacucaacagaa

SEQ ID NO: 2783307 - RNA, 13 nt, Leptospira interrogans serovar lai str. 56601
aaaaugaauguuu

SEQ ID NO: 2783308 - RNA, 17 nt, Leptospira interrogans serovar lai str. 56601
aaaaugaauguuuaaaa

SEQ ID NO: 2783309 - RNA, 22 nt, Leptospira interrogans serovar lai str. 56601
aaaaugaauguuuaaaauuuau

SEQ ID NO: 2783310 - RNA, 16 nt, Leptospira interrogans serovar lai str. 56601
aaaaugaauuguaaaa

SEQ ID NO: 2783311 - RNA, 18 nt, Leptospira interrogans serovar lai str. 56601
aaaaugaauuguaaaaaa

SEQ ID NO: 2783312 - RNA, 22 nt, Leptospira interrogans serovar lai str. 56601
aaaaugaauuuuuuauuaagaa

SEQ ID NO: 2783313 - RNA, 16 nt, Leptospira interrogans serovar lai str. 56601
aaaaugaccaaaauuu

SEQ ID NO: 2783314 - RNA, 23 nt, Leptospira interrogans serovar lai str. 56601
aaaaugacuaacuacaucaguau

SEQ ID NO: 2783315 - RNA, 18 nt, Leptospira interrogans serovar lai str. 56601
aaaaugagaaagaauuuc

SEQ ID NO: 2783316 - RNA, 15 nt, Leptospira interrogans serovar lai str. 56601
aaaaugcaaaaguuu

SEQ ID NO: 2783317 - RNA, 21 nt, Leptospira interrogans serovar lai str. 56601
aaaaugcaaaaguuuucaaaa

SEQ ID NO: 2783318 - RNA, 14 nt, Leptospira interrogans serovar lai str. 56601
aaaaugcaaauugg

SEQ ID NO: 2783319 - RNA, 16 nt, Leptospira interrogans serovar lai str. 56601
aaaaugcagcaaaacc

SEQ ID NO: 2783320 - RNA, 19 nt, Leptospira interrogans serovar lai str. 56601
aaaaugcaguaguuccuac

SEQ ID NO: 2783321 - RNA, 19 nt, Leptospira interrogans serovar lai str. 56601
aaaaugccgcaccuaauac

SEQ ID NO: 2783322 - RNA, 14 nt, Leptospira interrogans serovar lai str. 56601
aaaaugcucaaaaa

SEQ ID NO: 2783323 - RNA, 17 nt, Leptospira interrogans serovar lai str. 56601
aaaaugcucaaaaauua

SEQ ID NO: 2783324 - RNA, 14 nt, Leptospira interrogans serovar lai str. 56601
aaaauggaaaaaag

SEQ ID NO: 2783325 - RNA, 22 nt, Leptospira interrogans serovar lai str. 56601
aaaauggacugcaaaaucaguu

SEQ ID NO: 2783326 - RNA, 12 nt, Leptospira interrogans serovar lai str. 56601
aaaauggauacu

SEQ ID NO: 2783327 - RNA, 14 nt, Leptospira interrogans serovar lai str. 56601
aaaaugggaaguuu

SEQ ID NO: 2783328 - RNA, 17 nt, Leptospira interrogans serovar lai str. 56601
aaaauggguuuucauuu

SEQ ID NO: 2783329 - RNA, 19 nt, Leptospira interrogans serovar lai str. 56601
aaaaugguuuuuuaaguuc

SEQ ID NO: 2783330 - RNA, 18 nt, Leptospira interrogans serovar lai str. 56601
aaaauguaaaaacuacca

SEQ ID NO: 2783331 - RNA, 20 nt, Leptospira interrogans serovar lai str. 56601
aaaauguaaaagcuuauacu

SEQ ID NO: 2783332 - RNA, 17 nt, Leptospira interrogans serovar lai str. 56601
aaaauguacaauuaaag

SEQ ID NO: 2783333 - RNA, 19 nt, Leptospira interrogans serovar lai str. 56601
aaaauguagccaaaaauua

SEQ ID NO: 2783334 - RNA, 11 nt, Leptospira interrogans serovar lai str. 56601
aaaauguagga

SEQ ID NO: 2783335 - RNA, 23 nt, Leptospira interrogans serovar lai str. 56601
aaaauguauucuauaaaauuuga

SEQ ID NO: 2783336 - RNA, 19 nt, Leptospira interrogans serovar lai str. 56601
aaaaugucuaugauuaaag

SEQ ID NO: 2783337 - RNA, 17 nt, Leptospira interrogans serovar lai str. 56601
aaaaugugggaacucuu

SEQ ID NO: 2783338 - RNA, 14 nt, Leptospira interrogans serovar lai str. 56601
aaaaugugggaauu

SEQ ID NO: 2783339 - RNA, 22 nt, Leptospira interrogans serovar lai str. 56601
aaaaugugggaauuacuacaaa

SEQ ID NO: 2783340 - RNA, 11 nt, Leptospira interrogans serovar lai str. 56601
aaaauuaaaaa

SEQ ID NO: 2783341 - RNA, 13 nt, Leptospira interrogans serovar lai str. 56601
aaaauuaaaaaau

SEQ ID NO: 2783342 - RNA, 18 nt, Leptospira interrogans serovar lai str. 56601
aaaauuaaaauucuagaa

SEQ ID NO: 2783343 - RNA, 16 nt, Leptospira interrogans serovar lai str. 56601
aaaauuaacuuugaua

SEQ ID NO: 2783344 - RNA, 11 nt, Leptospira interrogans serovar lai str. 56601
aaaauuaagaa

SEQ ID NO: 2783345 - RNA, 15 nt, Leptospira interrogans serovar lai str. 56601
aaaauuaauuccuca

SEQ ID NO: 2783346 - RNA, 12 nt, Leptospira interrogans serovar lai str. 56601
aaaauuagaauc

SEQ ID NO: 2783347 - RNA, 16 nt, Leptospira interrogans serovar lai str. 56601
aaacaaacuuuuguaa

SEQ ID NO: 2783348 - RNA, 18 nt, Leptospira interrogans serovar lai str. 56601
aaacaaagacaaaguauu

SEQ ID NO: 2783349 - RNA, 19 nt, Leptospira interrogans serovar lai str. 56601
aaacaaaguauaacccaaa

SEQ ID NO: 2783350 - RNA, 15 nt, Leptospira interrogans serovar lai str. 56601
aaacaaauagaaaua

SEQ ID NO: 2783351 - RNA, 19 nt, Leptospira interrogans serovar lai str. 56601
aaacaaauccgaaaaugua

SEQ ID NO: 2783352 - RNA, 20 nt, Leptospira interrogans serovar lai str. 56601
aaacaaauccgaaaauguag

SEQ ID NO: 2783353 - RNA, 17 nt, Leptospira interrogans serovar lai str. 56601
aaacaaauggagaauua

SEQ ID NO: 2783354 - RNA, 12 nt, Leptospira interrogans serovar lai str. 56601
aaacaaauuaag

SEQ ID NO: 2783355 - RNA, 16 nt, Leptospira interrogans serovar lai str. 56601
aaacaaauuccgaaau

SEQ ID NO: 2783356 - RNA, 16 nt, Leptospira interrogans serovar lai str. 56601
aaacaaauucuaaaau

SEQ ID NO: 2783357 - RNA, 20 nt, Leptospira interrogans serovar lai str. 56601
aaacaaauucucauuuagag

SEQ ID NO: 2783358 - RNA, 15 nt, Leptospira interrogans serovar lai str. 56601
aaacaacaguacaag

SEQ ID NO: 2783359 - RNA, 21 nt, Leptospira interrogans serovar lai str. 56601
aaacaaggcuuuguaauaaaa

SEQ ID NO: 2783360 - RNA, 16 nt, Leptospira interrogans serovar lai str. 56601
aaacaauaugaaagga

SEQ ID NO: 2783361 - RNA, 14 nt, Leptospira interrogans serovar lai str. 56601
aaacaauucuuccu

SEQ ID NO: 2783362 - RNA, 17 nt, Leptospira interrogans serovar lai str. 56601
aaacaauucuuccuuuu

SEQ ID NO: 2783363 - RNA, 18 nt, Leptospira interrogans serovar lai str. 56601
aaacaauucuuccuuuuu

SEQ ID NO: 2783364 - RNA, 16 nt, Leptospira interrogans serovar lai str. 56601
aaacaauugauugcuu

SEQ ID NO: 2783365 - RNA, 17 nt, Leptospira interrogans serovar lai str. 56601
aaacaauugauugcuuu

SEQ ID NO: 2783366 - RNA, 22 nt, Leptospira interrogans serovar lai str. 56601
aaacaauugauugcuuuuugag

SEQ ID NO: 2783367 - RNA, 15 nt, Leptospira interrogans serovar lai str. 56601
aaacaauuuuuugaa

SEQ ID NO: 2783368 - RNA, 16 nt, Leptospira interrogans serovar lai str. 56601
aaacaauuuuuugaaa

SEQ ID NO: 2783369 - RNA, 23 nt, Leptospira interrogans serovar lai str. 56601
aaacaauuuuuugaaaaagaaua

SEQ ID NO: 2783370 - RNA, 15 nt, Leptospira interrogans serovar lai str. 56601
aaacacaucuuaaaa

SEQ ID NO: 2783371 - RNA, 15 nt, Leptospira interrogans serovar lai str. 56601
aaacacaugagcauu

SEQ ID NO: 2783372 - RNA, 19 nt, Leptospira interrogans serovar lai str. 56601
aaacaccuucucuuuuaaa

SEQ ID NO: 2783373 - RNA, 17 nt, Leptospira interrogans serovar lai str. 56601
aaacacgggaauaaaaa

SEQ ID NO: 2783374 - RNA, 23 nt, Leptospira interrogans serovar lai str. 56601
aaacacgggaauaaaaacaaaau

SEQ ID NO: 2783375 - RNA, 23 nt, Leptospira interrogans serovar lai str. 56601
aaacacuaaguaaaaaugcaaau

SEQ ID NO: 2783376 - RNA, 15 nt, Leptospira interrogans serovar lai str. 56601
aaacacucuaaaucu

SEQ ID NO: 2783377 - RNA, 17 nt, Leptospira interrogans serovar lai str. 56601
aaacacucuaaaucuua

SEQ ID NO: 2783378 - RNA, 22 nt, Leptospira interrogans serovar lai str. 56601
aaacacuguuucgacguaaaaa

SEQ ID NO: 2783379 - RNA, 23 nt, Leptospira interrogans serovar lai str. 56601
aaacacuuuaucuuuucuuaaaa

SEQ ID NO: 2783380 - RNA, 22 nt, Leptospira interrogans serovar lai str. 56601
aaacacuuugagaaagaacaag

SEQ ID NO: 2783381 - RNA, 17 nt, Leptospira interrogans serovar lai str. 56601
aaacaggaaaauuuaaa

SEQ ID NO: 2783382 - RNA, 20 nt, Leptospira interrogans serovar lai str. 56601
aaacaggucccaaacuuucu

SEQ ID NO: 2783383 - RNA, 23 nt, Leptospira interrogans serovar lai str. 56601
aaacaggucccaaacuuucuuuu

SEQ ID NO: 2783384 - RNA, 23 nt, Leptospira interrogans serovar lai str. 56601
aaacaguacuuuguaauuaaaau

SEQ ID NO: 2783385 - RNA, 21 nt, Leptospira interrogans serovar lai str. 56601
aaacaguauauuauaauuuua

SEQ ID NO: 2783386 - RNA, 17 nt, Leptospira interrogans serovar lai str. 56601
aaacaguauuuguaaaa

SEQ ID NO: 2783387 - RNA, 22 nt, Leptospira interrogans serovar lai str. 56601
aaacaguauuuguaaaaaugag

SEQ ID NO: 2783388 - RNA, 14 nt, Leptospira interrogans serovar lai str. 56601
aaacagucaaaagg

SEQ ID NO: 2783389 - RNA, 15 nt, Leptospira interrogans serovar lai str. 56601
aaacauaaaaauuuu

SEQ ID NO: 2783390 - RNA, 12 nt, Leptospira interrogans serovar lai str. 56601
aaacauacuuuu

SEQ ID NO: 2783391 - RNA, 23 nt, Leptospira interrogans serovar lai str. 56601
aaacauacuuuuugcaaguaaaa

SEQ ID NO: 2783392 - RNA, 17 nt, Leptospira interrogans serovar lai str. 56601
aaacauauuggauaauu

SEQ ID NO: 2783393 - RNA, 14 nt, Leptospira interrogans serovar lai str. 56601
aaacaucacuucca

SEQ ID NO: 2783394 - RNA, 15 nt, Leptospira interrogans serovar lai str. 56601
aaacaucacuuccau

SEQ ID NO: 2783395 - RNA, 16 nt, Leptospira interrogans serovar lai str. 56601
aaacaucacuuccauu

SEQ ID NO: 2783396 - RNA, 21 nt, Leptospira interrogans serovar lai str. 56601
aaacauccaauuauaaaauuu

SEQ ID NO: 2783397 - RNA, 24 nt, Leptospira interrogans serovar lai str. 56601
aaacauccucaacggguucuucau

SEQ ID NO: 2783398 - RNA, 12 nt, Leptospira interrogans serovar lai str. 56601
aaacaugaagaa

SEQ ID NO: 2783399 - RNA, 16 nt, Leptospira interrogans serovar lai str. 56601
aaacaugaagaagcua

SEQ ID NO: 2783400 - RNA, 19 nt, Leptospira interrogans serovar lai str. 56601
aaacaugaagaagcuaaaa

SEQ ID NO: 2783401 - RNA, 23 nt, Leptospira interrogans serovar lai str. 56601
aaacauuaacguuuucuaucuuu

SEQ ID NO: 2783402 - RNA, 22 nt, Leptospira interrogans serovar lai str. 56601
aaacauucaaauuucugaaaca

SEQ ID NO: 2783403 - RNA, 20 nt, Leptospira interrogans serovar lai str. 56601
aaacauucaagguaauuuau

SEQ ID NO: 2783404 - RNA, 14 nt, Leptospira interrogans serovar lai str. 56601
aaacauuuaacuuu

SEQ ID NO: 2783405 - RNA, 14 nt, Leptospira interrogans serovar lai str. 56601
aaacauuucuaaaa

SEQ ID NO: 2783406 - RNA, 13 nt, Leptospira interrogans serovar lai str. 56601
aaacauuuugccu

SEQ ID NO: 2783407 - RNA, 14 nt, Leptospira interrogans serovar lai str. 56601
aaacauuuugccuu

SEQ ID NO: 2783408 - RNA, 22 nt, Leptospira interrogans serovar lai str. 56601
aaacauuuugccuuguucauaa

SEQ ID NO: 2783409 - RNA, 14 nt, Leptospira interrogans serovar lai str. 56601
aaaccaaauagaaa

SEQ ID NO: 2783410 - RNA, 16 nt, Leptospira interrogans serovar lai str. 56601
aaaccaagaauagauu

SEQ ID NO: 2783411 - RNA, 13 nt, Leptospira interrogans serovar lai str. 56601
aaaccacaaaaac

SEQ ID NO: 2783412 - RNA, 15 nt, Leptospira interrogans serovar lai str. 56601
aaaccacacuaccau

SEQ ID NO: 2783413 - RNA, 19 nt, Leptospira interrogans serovar lai str. 56601
aaaccacgucccguauaaa

SEQ ID NO: 2783414 - RNA, 15 nt, Leptospira interrogans serovar lai str. 56601
aaaccagcaaaacac

SEQ ID NO: 2783415 - RNA, 18 nt, Leptospira interrogans serovar lai str. 56601
aaaccagcaaaacacuuu

SEQ ID NO: 2783416 - RNA, 21 nt, Leptospira interrogans serovar lai str. 56601
aaaccaguuuguuuuuuauau

SEQ ID NO: 2783417 - RNA, 15 nt, Leptospira interrogans serovar lai str. 56601
aaaccaucucaaaaa

SEQ ID NO: 2783418 - RNA, 16 nt, Leptospira interrogans serovar lai str. 56601
aaaccaucucaaaaac

SEQ ID NO: 2783419 - RNA, 16 nt, Leptospira interrogans serovar lai str. 56601
aaacccaaaaauguag

SEQ ID NO: 2783420 - RNA, 16 nt, Leptospira interrogans serovar lai str. 56601
aaacccaauaccaaac

SEQ ID NO: 2783421 - RNA, 21 nt, Leptospira interrogans serovar lai str. 56601
aaacccagcgccucauuucuu

SEQ ID NO: 2783422 - RNA, 19 nt, Leptospira interrogans serovar lai str. 56601
aaacccaucguaaacaaaa

SEQ ID NO: 2783423 - RNA, 15 nt, Leptospira interrogans serovar lai str. 56601
aaacccugccaaaau

SEQ ID NO: 2783424 - RNA, 22 nt, Leptospira interrogans serovar lai str. 56601
aaaccgaaaaucgucccgauca

SEQ ID NO: 2783425 - RNA, 14 nt, Leptospira interrogans serovar lai str. 56601
aaaccgauuuuccc

SEQ ID NO: 2783426 - RNA, 22 nt, Leptospira interrogans serovar lai str. 56601
aaaccgcuuuuaguuuuuccug

SEQ ID NO: 2783427 - RNA, 19 nt, Leptospira interrogans serovar lai str. 56601
aaaccgucccaaaaucuua

SEQ ID NO: 2783428 - RNA, 19 nt, Leptospira interrogans serovar lai str. 56601
aaaccguuccauaaauuuu

SEQ ID NO: 2783429 - RNA, 17 nt, Leptospira interrogans serovar lai str. 56601
aaaccucgucuaucuuu

SEQ ID NO: 2783430 - RNA, 14 nt, Leptospira interrogans serovar lai str. 56601
aaacuuacauuagu

SEQ ID NO: 2783431 - RNA, 17 nt, Leptospira interrogans serovar lai str. 56601
aaacuuagguuuuguaa

SEQ ID NO: 2783432 - RNA, 12 nt, Leptospira interrogans serovar lai str. 56601
aaacuucaaaaa

SEQ ID NO: 2783433 - RNA, 14 nt, Leptospira interrogans serovar lai str. 56601
aaacuucaaaaaau

SEQ ID NO: 2783434 - RNA, 18 nt, Leptospira interrogans serovar lai str. 56601
aaacuucaaaaaauauag

SEQ ID NO: 2783435 - RNA, 18 nt, Leptospira interrogans serovar lai str. 56601
aaacuucacuucuuuuag

SEQ ID NO: 2783436 - RNA, 22 nt, Leptospira interrogans serovar lai str. 56601
aaacuucuauuuuauaaauugu

SEQ ID NO: 2783437 - RNA, 15 nt, Leptospira interrogans serovar lai str. 56601
aaacuucuauuuuga

SEQ ID NO: 2783438 - RNA, 19 nt, Leptospira interrogans serovar lai str. 56601
aaacuucucuuaaaauuua

SEQ ID NO: 2783439 - RNA, 19 nt, Leptospira interrogans serovar lai str. 56601
aaacuugauuaaacaggac

SEQ ID NO: 2783440 - RNA, 17 nt, Leptospira interrogans serovar lai str. 56601
aaacuuggguuucuuaa

SEQ ID NO: 2783441 - RNA, 19 nt, Leptospira interrogans serovar lai str. 56601
aaacuuggguuucuuaaau

SEQ ID NO: 2783442 - RNA, 21 nt, Leptospira interrogans serovar lai str. 56601
aaacuugguuggauuccuuuc

SEQ ID NO: 2783443 - RNA, 15 nt, Leptospira interrogans serovar lai str. 56601
aaacuuguuguacca

SEQ ID NO: 2783444 - RNA, 12 nt, Leptospira interrogans serovar lai str. 56601
aaacuuuaaaua

SEQ ID NO: 2783445 - RNA, 14 nt, Leptospira interrogans serovar lai str. 56601
aaacuuuaaauacu

SEQ ID NO: 2783446 - RNA, 16 nt, Leptospira interrogans serovar lai str. 56601
aaacuuuaaauacuuu

SEQ ID NO: 2783447 - RNA, 13 nt, Leptospira interrogans serovar lai str. 56601
aaacuuucggaau

SEQ ID NO: 2783448 - RNA, 22 nt, Leptospira interrogans serovar lai str. 56601
aaacuuucggaauaaaacccuu

SEQ ID NO: 2783449 - RNA, 15 nt, Leptospira interrogans serovar lai str. 56601
aaacuuucuaaaaau

SEQ ID NO: 2783450 - RNA, 13 nt, Leptospira interrogans serovar lai str. 56601
aaacuuucuucca

SEQ ID NO: 2783451 - RNA, 18 nt, Leptospira interrogans serovar lai str. 56601
aaacuuucuuccaauugu

SEQ ID NO: 2783452 - RNA, 13 nt, Leptospira interrogans serovar lai str. 56601
aaacuuucuuuuu

SEQ ID NO: 2783453 - RNA, 21 nt, Leptospira interrogans serovar lai str. 56601
aaacuuugaccauucuuuguu

SEQ ID NO: 2783454 - RNA, 23 nt, Leptospira interrogans serovar lai str. 56601
aaacuuuguaaaucuauucuuaa

SEQ ID NO: 2783455 - RNA, 23 nt, Leptospira interrogans serovar lai str. 56601
aaacuuuuaucgaauggaauuua

SEQ ID NO: 2783456 - RNA, 20 nt, Leptospira interrogans serovar lai str. 56601
aaacuuuucuaaaaguauga

SEQ ID NO: 2783457 - RNA, 13 nt, Leptospira interrogans serovar lai str. 56601
aaacuuuuuaaaa

SEQ ID NO: 2783458 - RNA, 16 nt, Leptospira interrogans serovar lai str. 56601
aaacuuuuuaaaacga

SEQ ID NO: 2783459 - RNA, 13 nt, Leptospira interrogans serovar lai str. 56601
aaacuuuuuugaa

SEQ ID NO: 2783460 - RNA, 20 nt, Leptospira interrogans serovar lai str. 56601
aaagaaaaacagguaaaccu

SEQ ID NO: 2783461 - RNA, 19 nt, Leptospira interrogans serovar lai str. 56601
aaagaaaaagagaugguuu

SEQ ID NO: 2783462 - RNA, 11 nt, Leptospira interrogans serovar lai str. 56601
aaagaaaacca

SEQ ID NO: 2783463 - RNA, 11 nt, Leptospira interrogans serovar lai str. 56601
aaagaaaaccu

SEQ ID NO: 2783464 - RNA, 20 nt, Leptospira interrogans serovar lai str. 56601
aaagaaaccuuuauagaauu

SEQ ID NO: 2783465 - RNA, 18 nt, Leptospira interrogans serovar lai str. 56601
aaagaaacggaagaaaau

SEQ ID NO: 2783466 - RNA, 17 nt, Leptospira interrogans serovar lai str. 56601
aaagaaacguaauacga

SEQ ID NO: 2783467 - RNA, 19 nt, Leptospira interrogans serovar lai str. 56601
aaagaaacuguuuaauaaa

SEQ ID NO: 2783468 - RNA, 22 nt, Leptospira interrogans serovar lai str. 56601
aaagaaacuguuuaauaaagau

SEQ ID NO: 2783469 - RNA, 18 nt, Leptospira interrogans serovar lai str. 56601
aaagaaagcagcaaagaa

SEQ ID NO: 2783470 - RNA, 19 nt, Leptospira interrogans serovar lai str. 56601
aaagaaagcagcaaagaag

SEQ ID NO: 2783471 - RNA, 16 nt, Leptospira interrogans serovar lai str. 56601
aaagaaaguugcaaag

SEQ ID NO: 2783472 - RNA, 18 nt, Leptospira interrogans serovar lai str. 56601
aaagaaaguugcaaagaa

SEQ ID NO: 2783473 - RNA, 19 nt, Leptospira interrogans serovar lai str. 56601
aaagaaaguugcaaagaag

SEQ ID NO: 2783474 - RNA, 14 nt, Leptospira interrogans serovar lai str. 56601
aaagaaauagaaaa

SEQ ID NO: 2783475 - RNA, 15 nt, Leptospira interrogans serovar lai str. 56601
aaagaaauauuaaaa

SEQ ID NO: 2783476 - RNA, 19 nt, Leptospira interrogans serovar lai str. 56601
aaagaaauauuaaaaaaau

SEQ ID NO: 2783477 - RNA, 18 nt, Leptospira interrogans serovar lai str. 56601
aaagaaaugugggaacuc

SEQ ID NO: 2783478 - RNA, 14 nt, Leptospira interrogans serovar lai str. 56601
aaagaaauuuaaua

SEQ ID NO: 2783479 - RNA, 11 nt, Leptospira interrogans serovar lai str. 56601
aaagaaauuuu

SEQ ID NO: 2783480 - RNA, 18 nt, Leptospira interrogans serovar lai str. 56601
aaagaacaagauuaacaa

SEQ ID NO: 2783481 - RNA, 14 nt, Leptospira interrogans serovar lai str. 56601
aaagaacgauuuuu

SEQ ID NO: 2783482 - RNA, 16 nt, Leptospira interrogans serovar lai str. 56601
aaagaacgauuuuuua

SEQ ID NO: 2783483 - RNA, 14 nt, Leptospira interrogans serovar lai str. 56601
aaagaacuuugaga

SEQ ID NO: 2783484 - RNA, 21 nt, Leptospira interrogans serovar lai str. 56601
aaagaagagccucaaguaaaa

SEQ ID NO: 2783485 - RNA, 19 nt, Leptospira interrogans serovar lai str. 56601
aaagaagauagauuuauaa

SEQ ID NO: 2783486 - RNA, 21 nt, Leptospira interrogans serovar lai str. 56601
aaagaagauagauuuauaaua

SEQ ID NO: 2783487 - RNA, 19 nt, Leptospira interrogans serovar lai str. 56601
aaagaagaugcuuucucuu

SEQ ID NO: 2783488 - RNA, 19 nt, Leptospira interrogans serovar lai str. 56601
aaagaaggcagcuaagaaa

SEQ ID NO: 2783489 - RNA, 21 nt, Leptospira interrogans serovar lai str. 56601
aaagaaggcagcuaagaaaaa

SEQ ID NO: 2783490 - RNA, 18 nt, Leptospira interrogans serovar lai str. 56601
aaagaagggaugaaauuu

SEQ ID NO: 2783491 - RNA, 23 nt, Leptospira interrogans serovar lai str. 56601
aaagaagggaugaaauuuuaaaa

SEQ ID NO: 2783492 - RNA, 19 nt, Leptospira interrogans serovar lai str. 56601
aaagaagucugguuuauuu

SEQ ID NO: 2783493 - RNA, 15 nt, Leptospira interrogans serovar lai str. 56601
aaagaaguuuguaga

SEQ ID NO: 2783494 - RNA, 16 nt, Leptospira interrogans serovar lai str. 56601
aaagaaguuuguagau

SEQ ID NO: 2783495 - RNA, 17 nt, Leptospira interrogans serovar lai str. 56601
aaagaauaauauuuuaa

SEQ ID NO: 2783496 - RNA, 15 nt, Leptospira interrogans serovar lai str. 56601
aaagaauaccaaaaa

SEQ ID NO: 2783497 - RNA, 15 nt, Leptospira interrogans serovar lai str. 56601
aaagaauacgauuua

SEQ ID NO: 2783498 - RNA, 12 nt, Leptospira interrogans serovar lai str. 56601
aaagaauauuau

SEQ ID NO: 2783499 - RNA, 14 nt, Leptospira interrogans serovar lai str. 56601
aaagaaucauacaa

SEQ ID NO: 2783500 - RNA, 17 nt, Leptospira interrogans serovar lai str. 56601
aaagaaucuuuuuaaaa

SEQ ID NO: 2783501 - RNA, 20 nt, Leptospira interrogans serovar lai str. 56601
aaagaauuaucauguaaaau

SEQ ID NO: 2783502 - RNA, 14 nt, Leptospira interrogans serovar lai str. 56601
aaagaauucauuuu

SEQ ID NO: 2783503 - RNA, 21 nt, Leptospira interrogans serovar lai str. 56601
aaagaauuucuaaaaguaaaa

SEQ ID NO: 2783504 - RNA, 16 nt, Leptospira interrogans serovar lai str. 56601
aaagaauuucuaaaau

SEQ ID NO: 2783505 - RNA, 17 nt, Leptospira interrogans serovar lai str. 56601
aaagaauuucuaaaauu

SEQ ID NO: 2783506 - RNA, 15 nt, Leptospira interrogans serovar lai str. 56601
aaagaauuuuaaauc

SEQ ID NO: 2783507 - RNA, 15 nt, Leptospira interrogans serovar lai str. 56601
aaagaauuuuuacag

SEQ ID NO: 2783508 - RNA, 21 nt, Leptospira interrogans serovar lai str. 56601
aaagacaauauucuugauugg

SEQ ID NO: 2783509 - RNA, 16 nt, Leptospira interrogans serovar lai str. 56601
aaagacgauccuuuuu

SEQ ID NO: 2783510 - RNA, 17 nt, Leptospira interrogans serovar lai str. 56601
aaagacgauccuuuuuu

SEQ ID NO: 2783511 - RNA, 14 nt, Leptospira interrogans serovar lai str. 56601
aaagacuaaaaagu

SEQ ID NO: 2783512 - RNA, 13 nt, Leptospira interrogans serovar lai str. 56601
aaagacuaaucgc

SEQ ID NO: 2783513 - RNA, 20 nt, Leptospira interrogans serovar lai str. 56601
aaagguugaguaguaaaauc

SEQ ID NO: 2783514 - RNA, 21 nt, Leptospira interrogans serovar lai str. 56601
aaagguuggaaucuaaacucu

SEQ ID NO: 2783515 - RNA, 12 nt, Leptospira interrogans serovar lai str. 56601
aaaguaaaaaag

SEQ ID NO: 2783516 - RNA, 16 nt, Leptospira interrogans serovar lai str. 56601
aaaguaaaacccaaua

SEQ ID NO: 2783517 - RNA, 13 nt, Leptospira interrogans serovar lai str. 56601
aaaguaaaauuaa

SEQ ID NO: 2783518 - RNA, 19 nt, Leptospira interrogans serovar lai str. 56601
aaaguaaagguuucacaaa

SEQ ID NO: 2783519 - RNA, 10 nt, Leptospira interrogans serovar lai str. 56601
aaaguaaaug

SEQ ID NO: 2783520 - RNA, 21 nt, Leptospira interrogans serovar lai str. 56601
aaaguaacaguuccuaacaau

SEQ ID NO: 2783521 - RNA, 17 nt, Leptospira interrogans serovar lai str. 56601
aaaguaacguaaauuuu

SEQ ID NO: 2783522 - RNA, 20 nt, Leptospira interrogans serovar lai str. 56601
aaaguaaucguuuaaagauu

SEQ ID NO: 2783523 - RNA, 18 nt, Leptospira interrogans serovar lai str. 56601
aaaguaaucuuuuuaaaa

SEQ ID NO: 2783524 - RNA, 18 nt, Leptospira interrogans serovar lai str. 56601
aaaguaauggauuuuuau

SEQ ID NO: 2783525 - RNA, 13 nt, Leptospira interrogans serovar lai str. 56601
aaaguaauuuauc

SEQ ID NO: 2783526 - RNA, 18 nt, Leptospira interrogans serovar lai str. 56601
aaaguaauuuaucuguaa

SEQ ID NO: 2783527 - RNA, 22 nt, Leptospira interrogans serovar lai str. 56601
aaaguaauuuaucuguaauuuu

SEQ ID NO: 2783528 - RNA, 18 nt, Leptospira interrogans serovar lai str. 56601
aaaguacgaaauuccuac

SEQ ID NO: 2783529 - RNA, 23 nt, Leptospira interrogans serovar lai str. 56601
aaaguacgaaauuccuacaguuu

SEQ ID NO: 2783530 - RNA, 14 nt, Leptospira interrogans serovar lai str. 56601
aaaguacuaauuca

SEQ ID NO: 2783531 - RNA, 16 nt, Leptospira interrogans serovar lai str. 56601
aaaguacuaauucaau

SEQ ID NO: 2783532 - RNA, 21 nt, Leptospira interrogans serovar lai str. 56601
aaaguaguaugcgaaauuccu

SEQ ID NO: 2783533 - RNA, 20 nt, Leptospira interrogans serovar lai str. 56601
aaaguauaacccaaaacuaa

SEQ ID NO: 2783534 - RNA, 21 nt, Leptospira interrogans serovar lai str. 56601
aaaguauaauauuuauuuagu

SEQ ID NO: 2783535 - RNA, 13 nt, Leptospira interrogans serovar lai str. 56601
aaaguauaauuua

SEQ ID NO: 2783536 - RNA, 23 nt, Leptospira interrogans serovar lai str. 56601
aaaguauaauuuaaaaucguaaa

SEQ ID NO: 2783537 - RNA, 19 nt, Leptospira interrogans serovar lai str. 56601
aaaguauauauuaaaguau

SEQ ID NO: 2783538 - RNA, 22 nt, Leptospira interrogans serovar lai str. 56601
aaaguaucaccguaauucuuaa

SEQ ID NO: 2783539 - RNA, 20 nt, Leptospira interrogans serovar lai str. 56601
aaaguauccaguacuuuacg

SEQ ID NO: 2783540 - RNA, 15 nt, Leptospira interrogans serovar lai str. 56601
aaaguaugauuuuac

SEQ ID NO: 2783541 - RNA, 21 nt, Leptospira interrogans serovar lai str. 56601
aaaguauuaauuuaaucaaaa

SEQ ID NO: 2783542 - RNA, 21 nt, Leptospira interrogans serovar lai str. 56601
aaaguauuuaauuuuaagcuc

SEQ ID NO: 2783543 - RNA, 13 nt, Leptospira interrogans serovar lai str. 56601
aaaguauuuuuaa

SEQ ID NO: 2783544 - RNA, 17 nt, Leptospira interrogans serovar lai str. 56601
aaagucaaaaaaugguu

SEQ ID NO: 2783545 - RNA, 17 nt, Leptospira interrogans serovar lai str. 56601
aaagucaaaggagaagg

SEQ ID NO: 2783546 - RNA, 16 nt, Leptospira interrogans serovar lai str. 56601
aaaguccaauuuuaaa

SEQ ID NO: 2783547 - RNA, 17 nt, Leptospira interrogans serovar lai str. 56601
aaaguccaauuuuaaaa

SEQ ID NO: 2783548 - RNA, 14 nt, Leptospira interrogans serovar lai str. 56601
aaagucgaauuuuu

SEQ ID NO: 2783549 - RNA, 17 nt, Leptospira interrogans serovar lai str. 56601
aaagucgcccaaacccc

SEQ ID NO: 2783550 - RNA, 19 nt, Leptospira interrogans serovar lai str. 56601
aaagucuaacaguaaaacu

SEQ ID NO: 2783551 - RNA, 20 nt, Leptospira interrogans serovar lai str. 56601
aaagucuauuucccaaaauu

SEQ ID NO: 2783552 - RNA, 23 nt, Leptospira interrogans serovar lai str. 56601
aaagucuauuucccaaaauuuca

SEQ ID NO: 2783553 - RNA, 12 nt, Leptospira interrogans serovar lai str. 56601
aaagucuugaac

SEQ ID NO: 2783554 - RNA, 22 nt, Leptospira interrogans serovar lai str. 56601
aaagugaaucucuuacgaugag

SEQ ID NO: 2783555 - RNA, 15 nt, Leptospira interrogans serovar lai str. 56601
aaagugaauuuuugu

SEQ ID NO: 2783556 - RNA, 15 nt, Leptospira interrogans serovar lai str. 56601
aaagugaguuuucuu

SEQ ID NO: 2783557 - RNA, 15 nt, Leptospira interrogans serovar lai str. 56601
aaaguguuuuuguaa

SEQ ID NO: 2783558 - RNA, 15 nt, Leptospira interrogans serovar lai str. 56601
aaaguuaauacaaaa

SEQ ID NO: 2783559 - RNA, 16 nt, Leptospira interrogans serovar lai str. 56601
aaaguuaauucuaaau

SEQ ID NO: 2783560 - RNA, 19 nt, Leptospira interrogans serovar lai str. 56601
aaaguuagaaucugaacuu

SEQ ID NO: 2783561 - RNA, 16 nt, Leptospira interrogans serovar lai str. 56601
aaaguuauuauuuuug

SEQ ID NO: 2783562 - RNA, 13 nt, Leptospira interrogans serovar lai str. 56601
aaaguucagauuc

SEQ ID NO: 2783563 - RNA, 16 nt, Leptospira interrogans serovar lai str. 56601
aaaguucagauucgaa

SEQ ID NO: 2783564 - RNA, 20 nt, Leptospira interrogans serovar lai str. 56601
aaaguucccgccaaaugcug

SEQ ID NO: 2783565 - RNA, 15 nt, Leptospira interrogans serovar lai str. 56601
aaaguucguaaacua

SEQ ID NO: 2783566 - RNA, 12 nt, Leptospira interrogans serovar lai str. 56601
aaaguucuuuuc

SEQ ID NO: 2783567 - RNA, 14 nt, Leptospira interrogans serovar lai str. 56601
aaaguucuuuucuu

SEQ ID NO: 2783568 - RNA, 11 nt, Leptospira interrogans serovar lai str. 56601
aaaguugaaag

SEQ ID NO: 2783569 - RNA, 14 nt, Leptospira interrogans serovar lai str. 56601
aaaguugaaaguuu

SEQ ID NO: 2783570 - RNA, 19 nt, Leptospira interrogans serovar lai str. 56601
aaaguugaaaguuuuucuu

SEQ ID NO: 2783571 - RNA, 13 nt, Leptospira interrogans serovar lai str. 56601
aaaguugcaaaga

SEQ ID NO: 2783572 - RNA, 15 nt, Leptospira interrogans serovar lai str. 56601
aaaguugcaaagaag

SEQ ID NO: 2783573 - RNA, 19 nt, Leptospira interrogans serovar lai str. 56601
aaaguugcuaagaaaaaag

SEQ ID NO: 2783574 - RNA, 23 nt, Leptospira interrogans serovar lai str. 56601
aaaguugucucgaaacccaaaaa

SEQ ID NO: 2783575 - RNA, 14 nt, Leptospira interrogans serovar lai str. 56601
aaaguuguugaaaa

SEQ ID NO: 2783576 - RNA, 18 nt, Leptospira interrogans serovar lai str. 56601
aaaguuuagauuuuaacu

SEQ ID NO: 2783577 - RNA, 15 nt, Leptospira interrogans serovar lai str. 56601
aaaguuuauaaacuu

SEQ ID NO: 2783578 - RNA, 19 nt, Leptospira interrogans serovar lai str. 56601
aaaguuuaugaauuuccau

SEQ ID NO: 2783579 - RNA, 14 nt, Leptospira interrogans serovar lai str. 56601
aaaguuucuuauau

SEQ ID NO: 2783580 - RNA, 22 nt, Leptospira interrogans serovar lai str. 56601
aaaguuugggcgaauaaaaaac

SEQ ID NO: 2783581 - RNA, 23 nt, Leptospira interrogans serovar lai str. 56601
aaaguuugggcgaauaaaaaacu

SEQ ID NO: 2783582 - RNA, 17 nt, Leptospira interrogans serovar lai str. 56601
aaaguuuguuuguaaag

SEQ ID NO: 2783583 - RNA, 18 nt, Leptospira interrogans serovar lai str. 56601
aaaguuuucacaaaaaaa

SEQ ID NO: 2783584 - RNA, 12 nt, Leptospira interrogans serovar lai str. 56601
aaaguuuucuuu

SEQ ID NO: 2783585 - RNA, 19 nt, Leptospira interrogans serovar lai str. 56601
aaaguuuugcuguaaaauu

SEQ ID NO: 2783586 - RNA, 14 nt, Leptospira interrogans serovar lai str. 56601
aaaguuuuuaaaaa

SEQ ID NO: 2783587 - RNA, 20 nt, Leptospira interrogans serovar lai str. 56601
aaaguuuuuauauucuagaa

SEQ ID NO: 2783588 - RNA, 17 nt, Leptospira interrogans serovar lai str. 56601
aaaguuuuucaacaacu

SEQ ID NO: 2783589 - RNA, 17 nt, Leptospira interrogans serovar lai str. 56601
aaaguuuuucuaaauuu

SEQ ID NO: 2783590 - RNA, 16 nt, Leptospira interrogans serovar lai str. 56601
aaaguuuuuuaaaaaa

SEQ ID NO: 2783591 - RNA, 17 nt, Leptospira interrogans serovar lai str. 56601
aaaguuuuuuaaaaaau

SEQ ID NO: 2783592 - RNA, 15 nt, Leptospira interrogans serovar lai str. 56601
aaaguuuuuuuauaa

SEQ ID NO: 2783593 - RNA, 18 nt, Leptospira interrogans serovar lai str. 56601
aaaguuuuuuuauaaaau

SEQ ID NO: 2783594 - RNA, 20 nt, Leptospira interrogans serovar lai str. 56601
aaaguuuuuuuauaaaauua

SEQ ID NO: 2783595 - RNA, 14 nt, Leptospira interrogans serovar lai str. 56601
aaauaaaaaacaaa

SEQ ID NO: 2783596 - RNA, 12 nt, Leptospira interrogans serovar lai str. 56601
aaauaggauuua

SEQ ID NO: 2783597 - RNA, 15 nt, Leptospira interrogans serovar lai str. 56601
aaauaggauuuaaau

SEQ ID NO: 2783598 - RNA, 16 nt, Leptospira interrogans serovar lai str. 56601
aaauaggauuuaaauu

SEQ ID NO: 2783599 - RNA, 18 nt, Leptospira interrogans serovar lai str. 56601
aaauaggauuuaaauuuu

SEQ ID NO: 2783600 - RNA, 14 nt, Leptospira interrogans serovar lai str. 56601
aaauagggaaaacu

SEQ ID NO: 2783601 - RNA, 15 nt, Leptospira interrogans serovar lai str. 56601
aaauagggaaaacuc

SEQ ID NO: 2783602 - RNA, 16 nt, Leptospira interrogans serovar lai str. 56601
aaauagggaaaacuca

SEQ ID NO: 2783603 - RNA, 19 nt, Leptospira interrogans serovar lai str. 56601
aaauagggaaaacucaaca

SEQ ID NO: 2783604 - RNA, 20 nt, Leptospira interrogans serovar lai str. 56601
aaauagggaaaacucaacac

SEQ ID NO: 2783605 - RNA, 19 nt, Leptospira interrogans serovar lai str. 56601
aaauagggaaaacucauca

SEQ ID NO: 2783606 - RNA, 19 nt, Leptospira interrogans serovar lai str. 56601
aaauagggaauauuccauu

SEQ ID NO: 2783607 - RNA, 17 nt, Leptospira interrogans serovar lai str. 56601
aaauagggguuuuacca

SEQ ID NO: 2783608 - RNA, 20 nt, Leptospira interrogans serovar lai str. 56601
aaauaguauauuuucugcuu

SEQ ID NO: 2783609 - RNA, 22 nt, Leptospira interrogans serovar lai str. 56601
aaauagugguuuguaguaguuc

SEQ ID NO: 2783610 - RNA, 14 nt, Leptospira interrogans serovar lai str. 56601
aaauauaaaagauu

SEQ ID NO: 2783611 - RNA, 14 nt, Leptospira interrogans serovar lai str. 56601
aaauauaaaucaau

SEQ ID NO: 2783612 - RNA, 18 nt, Leptospira interrogans serovar lai str. 56601
aaauauagugguuuguaa

SEQ ID NO: 2783613 - RNA, 14 nt, Leptospira interrogans serovar lai str. 56601
aaauauaguuaaau

SEQ ID NO: 2783614 - RNA, 19 nt, Leptospira interrogans serovar lai str. 56601
aaauaucaaaugugagagu

SEQ ID NO: 2783615 - RNA, 21 nt, Leptospira interrogans serovar lai str. 56601
aaauaucaaugaucauauccg

SEQ ID NO: 2783616 - RNA, 21 nt, Leptospira interrogans serovar lai str. 56601
aaauaucaguuucuccggcga

SEQ ID NO: 2783617 - RNA, 14 nt, Leptospira interrogans serovar lai str. 56601
aaauaucauuuaac

SEQ ID NO: 2783618 - RNA, 16 nt, Leptospira interrogans serovar lai str. 56601
aaauaucgaauuucuu

SEQ ID NO: 2783619 - RNA, 18 nt, Leptospira interrogans serovar lai str. 56601
aaauaucguucuagaauu

SEQ ID NO: 2783620 - RNA, 20 nt, Leptospira interrogans serovar lai str. 56601
aaauaucuaaucuuuugaaa

SEQ ID NO: 2783621 - RNA, 15 nt, Leptospira interrogans serovar lai str. 56601
aaauaucuuagaaua

SEQ ID NO: 2783622 - RNA, 18 nt, Leptospira interrogans serovar lai str. 56601
aaauaucuuagaauaaua

SEQ ID NO: 2783623 - RNA, 21 nt, Leptospira interrogans serovar lai str. 56601
aaauaugaauuacuacaaaag

SEQ ID NO: 2783624 - RNA, 12 nt, Leptospira interrogans serovar lai str. 56601
aaauaugacgau

SEQ ID NO: 2783625 - RNA, 15 nt, Leptospira interrogans serovar lai str. 56601
aaauaugacgauuaa

SEQ ID NO: 2783626 - RNA, 14 nt, Leptospira interrogans serovar lai str. 56601
aaauaugauuuaaa

SEQ ID NO: 2783627 - RNA, 21 nt, Leptospira interrogans serovar lai str. 56601
aaauauguuuuuuuucaacaa

SEQ ID NO: 2783628 - RNA, 13 nt, Leptospira interrogans serovar lai str. 56601
aaauauuaaaaaa

SEQ ID NO: 2783629 - RNA, 12 nt, Leptospira interrogans serovar lai str. 56601
aaauauuaaaac

SEQ ID NO: 2783630 - RNA, 23 nt, Leptospira interrogans serovar lai str. 56601
aaauauuaagaauucuaaacaca

SEQ ID NO: 2783631 - RNA, 13 nt, Leptospira interrogans serovar lai str. 56601
aaauauuaauuua

SEQ ID NO: 2783632 - RNA, 19 nt, Leptospira interrogans serovar lai str. 56601
aaauauuaauuuaaaaaca

SEQ ID NO: 2783633 - RNA, 19 nt, Leptospira interrogans serovar lai str. 56601
aaauauuauaaauuuaaaa

SEQ ID NO: 2783634 - RNA, 21 nt, Leptospira interrogans serovar lai str. 56601
aaauauuauaaauuuaaaaaa

SEQ ID NO: 2783635 - RNA, 20 nt, Leptospira interrogans serovar lai str. 56601
aaauauuauauuuuuaaaaa

SEQ ID NO: 2783636 - RNA, 18 nt, Leptospira interrogans serovar lai str. 56601
aaauauucagaaacugga

SEQ ID NO: 2783637 - RNA, 19 nt, Leptospira interrogans serovar lai str. 56601
aaauauucgaucaaguaag

SEQ ID NO: 2783638 - RNA, 14 nt, Leptospira interrogans serovar lai str. 56601
aaauauucucuaug

SEQ ID NO: 2783639 - RNA, 19 nt, Leptospira interrogans serovar lai str. 56601
aaauauuugcauaaacuuc

SEQ ID NO: 2783640 - RNA, 24 nt, Leptospira interrogans serovar lai str. 56601
aaauauuuuuuuuaaucauccaau

SEQ ID NO: 2783641 - RNA, 14 nt, Leptospira interrogans serovar lai str. 56601
aaaucaaagauauu

SEQ ID NO: 2783642 - RNA, 13 nt, Leptospira interrogans serovar lai str. 56601
aaaucaaagcaaa

SEQ ID NO: 2783643 - RNA, 20 nt, Leptospira interrogans serovar lai str. 56601
aaaucaaagcaaaguuucuu

SEQ ID NO: 2783644 - RNA, 18 nt, Leptospira interrogans serovar lai str. 56601
aaaucaaauauacaaagu

SEQ ID NO: 2783645 - RNA, 13 nt, Leptospira interrogans serovar lai str. 56601
aaaucaaaucgca

SEQ ID NO: 2783646 - RNA, 12 nt, Leptospira interrogans serovar lai str. 56601
aaaucaagauuu

SEQ ID NO: 2783647 - RNA, 18 nt, Leptospira interrogans serovar lai str. 56601
aaaucaaucauauuuuaa

SEQ ID NO: 2783648 - RNA, 14 nt, Leptospira interrogans serovar lai str. 56601
aaaucaauggaaaa

SEQ ID NO: 2783649 - RNA, 16 nt, Leptospira interrogans serovar lai str. 56601
aaaucaauggaaaauu

SEQ ID NO: 2783650 - RNA, 18 nt, Leptospira interrogans serovar lai str. 56601
aaaucaauggaaaauuaa

SEQ ID NO: 2783651 - RNA, 12 nt, Leptospira interrogans serovar lai str. 56601
aaaucaauuuua

SEQ ID NO: 2783652 - RNA, 14 nt, Leptospira interrogans serovar lai str. 56601
aaaucacaaaaaag

SEQ ID NO: 2783653 - RNA, 15 nt, Leptospira interrogans serovar lai str. 56601
aaaucacaaaaaaga

SEQ ID NO: 2783654 - RNA, 17 nt, Leptospira interrogans serovar lai str. 56601
aaaucacaauuuuaaga

SEQ ID NO: 2783655 - RNA, 22 nt, Leptospira interrogans serovar lai str. 56601
aaaucacaauuuuaagaacaau

SEQ ID NO: 2783656 - RNA, 15 nt, Leptospira interrogans serovar lai str. 56601
aaaucacgauuuuac

SEQ ID NO: 2783657 - RNA, 16 nt, Leptospira interrogans serovar lai str. 56601
aaaucacgauuuuaca

SEQ ID NO: 2783658 - RNA, 21 nt, Leptospira interrogans serovar lai str. 56601
aaaucaggcuuuauaaaauga

SEQ ID NO: 2783659 - RNA, 20 nt, Leptospira interrogans serovar lai str. 56601
aaaucagggccggagaaaau

SEQ ID NO: 2783660 - RNA, 16 nt, Leptospira interrogans serovar lai str. 56601
aaaucagguuuuauaa

SEQ ID NO: 2783661 - RNA, 20 nt, Leptospira interrogans serovar lai str. 56601
aaaucaguuaauacaaaacu

SEQ ID NO: 2783662 - RNA, 16 nt, Leptospira interrogans serovar lai str. 56601
aaaucauacuuuuaaa

SEQ ID NO: 2783663 - RNA, 17 nt, Leptospira interrogans serovar lai str. 56601
aaaucauacuuuuaaaa

SEQ ID NO: 2783664 - RNA, 22 nt, Leptospira interrogans serovar lai str. 56601
aaaucauacuuuuaaaaaauuu

SEQ ID NO: 2783665 - RNA, 19 nt, Leptospira interrogans serovar lai str. 56601
aaaucauauggauuaucca

SEQ ID NO: 2783666 - RNA, 16 nt, Leptospira interrogans serovar lai str. 56601
aaaucauauuuucaaa

SEQ ID NO: 2783667 - RNA, 18 nt, Leptospira interrogans serovar lai str. 56601
aaaucauauuuucaaaaa

SEQ ID NO: 2783668 - RNA, 18 nt, Leptospira interrogans serovar lai str. 56601
aaaucaucuaucuuuuca

SEQ ID NO: 2783669 - RNA, 14 nt, Leptospira interrogans serovar lai str. 56601
aaaucaugauucau

SEQ ID NO: 2783670 - RNA, 17 nt, Leptospira interrogans serovar lai str. 56601
aaaucauggauuuacag

SEQ ID NO: 2783671 - RNA, 18 nt, Leptospira interrogans serovar lai str. 56601
aaaucauuuaaagcaaau

SEQ ID NO: 2783672 - RNA, 17 nt, Leptospira interrogans serovar lai str. 56601
aaauccaacuuaaaacu

SEQ ID NO: 2783673 - RNA, 17 nt, Leptospira interrogans serovar lai str. 56601
aaauccaaucauagaua

SEQ ID NO: 2783674 - RNA, 19 nt, Leptospira interrogans serovar lai str. 56601
aaauccacgauuuguggga

SEQ ID NO: 2783675 - RNA, 12 nt, Leptospira interrogans serovar lai str. 56601
aaaucccaaaac

SEQ ID NO: 2783676 - RNA, 23 nt, Leptospira interrogans serovar lai str. 56601
aaaucccaaaaccgaaucuggaa

SEQ ID NO: 2783677 - RNA, 15 nt, Leptospira interrogans serovar lai str. 56601
aaaucccauuuuaac

SEQ ID NO: 2783678 - RNA, 16 nt, Leptospira interrogans serovar lai str. 56601
aaaucccauuuuaacg

SEQ ID NO: 2783679 - RNA, 14 nt, Leptospira interrogans serovar lai str. 56601
aaauucaucacuuc

SEQ ID NO: 2783680 - RNA, 17 nt, Leptospira interrogans serovar lai str. 56601
aaauucaucuaaaaaaa

SEQ ID NO: 2783681 - RNA, 18 nt, Leptospira interrogans serovar lai str. 56601
aaauucaucuaaaaaaaa

SEQ ID NO: 2783682 - RNA, 21 nt, Leptospira interrogans serovar lai str. 56601
aaauucaucuccuccgauucu

SEQ ID NO: 2783683 - RNA, 22 nt, Leptospira interrogans serovar lai str. 56601
aaauucaugauaguuaauuuua

SEQ ID NO: 2783684 - RNA, 15 nt, Leptospira interrogans serovar lai str. 56601
aaauucauuuuucug

SEQ ID NO: 2783685 - RNA, 18 nt, Leptospira interrogans serovar lai str. 56601
aaauucauuuuucugaaa

SEQ ID NO: 2783686 - RNA, 15 nt, Leptospira interrogans serovar lai str. 56601
aaauuccaauuuuuc

SEQ ID NO: 2783687 - RNA, 20 nt, Leptospira interrogans serovar lai str. 56601
aaauuccaauuuuucugaaa

SEQ ID NO: 2783688 - RNA, 13 nt, Leptospira interrogans serovar lai str. 56601
aaauuccauagca

SEQ ID NO: 2783689 - RNA, 19 nt, Leptospira interrogans serovar lai str. 56601
aaauuccauagcaacaauu

SEQ ID NO: 2783690 - RNA, 20 nt, Leptospira interrogans serovar lai str. 56601
aaauuccauagcaacaauua

SEQ ID NO: 2783691 - RNA, 17 nt, Leptospira interrogans serovar lai str. 56601
aaauuccgaauucuaaa

SEQ ID NO: 2783692 - RNA, 16 nt, Leptospira interrogans serovar lai str. 56601
aaauuccuaaaacacc

SEQ ID NO: 2783693 - RNA, 18 nt, Leptospira interrogans serovar lai str. 56601
aaauuccugccuucucuc

SEQ ID NO: 2783694 - RNA, 23 nt, Leptospira interrogans serovar lai str. 56601
aaauuccuuuuuguaaggauucc

SEQ ID NO: 2783695 - RNA, 13 nt, Leptospira interrogans serovar lai str. 56601
aaauucgaaucau

SEQ ID NO: 2783696 - RNA, 19 nt, Leptospira interrogans serovar lai str. 56601
aaauucgaaucauuuugua

SEQ ID NO: 2783697 - RNA, 15 nt, Leptospira interrogans serovar lai str. 56601
aaauucgcaaaaaaa

SEQ ID NO: 2783698 - RNA, 17 nt, Leptospira interrogans serovar lai str. 56601
aaauucgccguaaaaaa

SEQ ID NO: 2783699 - RNA, 18 nt, Leptospira interrogans serovar lai str. 56601
aaauucgccguaaaaaau

SEQ ID NO: 2783700 - RNA, 16 nt, Leptospira interrogans serovar lai str. 56601
aaauucggaaauuuua

SEQ ID NO: 2783701 - RNA, 14 nt, Leptospira interrogans serovar lai str. 56601
aaauucgucaaaac

SEQ ID NO: 2783702 - RNA, 16 nt, Leptospira interrogans serovar lai str. 56601
aaauucgucaaaacca

SEQ ID NO: 2783703 - RNA, 17 nt, Leptospira interrogans serovar lai str. 56601
aaauucgucaaaaccaa

SEQ ID NO: 2783704 - RNA, 21 nt, Leptospira interrogans serovar lai str. 56601
aaauucgucaaaaccaaaaca

SEQ ID NO: 2783705 - RNA, 13 nt, Leptospira interrogans serovar lai str. 56601
aaauucuaaaaaa

SEQ ID NO: 2783706 - RNA, 17 nt, Leptospira interrogans serovar lai str. 56601
aaauucuaaaaaaauac

SEQ ID NO: 2783707 - RNA, 18 nt, Leptospira interrogans serovar lai str. 56601
aaauucuaaaaaaauacg

SEQ ID NO: 2783708 - RNA, 14 nt, Leptospira interrogans serovar lai str. 56601
aaauucuaaacuug

SEQ ID NO: 2783709 - RNA, 14 nt, Leptospira interrogans serovar lai str. 56601
aaauucuaaaguug

SEQ ID NO: 2783710 - RNA, 15 nt, Leptospira interrogans serovar lai str. 56601
aaauucuaagaucaa

SEQ ID NO: 2783711 - RNA, 16 nt, Leptospira interrogans serovar lai str. 56601
aaauucuaauauaaca

SEQ ID NO: 2783712 - RNA, 23 nt, Leptospira interrogans serovar lai str. 56601
aaauucuacaaauucuucuuccu

SEQ ID NO: 2783713 - RNA, 19 nt, Leptospira interrogans serovar lai str. 56601
aaauucuacaccuucuaaa

SEQ ID NO: 2783714 - RNA, 20 nt, Leptospira interrogans serovar lai str. 56601
aaauucuagcgucuaaaaaa

SEQ ID NO: 2783715 - RNA, 21 nt, Leptospira interrogans serovar lai str. 56601
aaauucuaugggaauuuuugu

SEQ ID NO: 2783716 - RNA, 17 nt, Leptospira interrogans serovar lai str. 56601
aaauucucuuuugacca

SEQ ID NO: 2783717 - RNA, 15 nt, Leptospira interrogans serovar lai str. 56601
aaauucugaaagagu

SEQ ID NO: 2783718 - RNA, 13 nt, Leptospira interrogans serovar lai str. 56601
aaauucugauuuu

SEQ ID NO: 2783719 - RNA, 18 nt, Leptospira interrogans serovar lai str. 56601
aaauucugcucgaauuuu

SEQ ID NO: 2783720 - RNA, 20 nt, Leptospira interrogans serovar lai str. 56601
aaauucugcucgaauuuuuu

SEQ ID NO: 2783721 - RNA, 15 nt, Leptospira interrogans serovar lai str. 56601
aaauucuuaaaaaau

SEQ ID NO: 2783722 - RNA, 20 nt, Leptospira interrogans serovar lai str. 56601
aaauucuuagaguaaaacuu

SEQ ID NO: 2783723 - RNA, 21 nt, Leptospira interrogans serovar lai str. 56601
aaauucuuagaguaaaacuuu

SEQ ID NO: 2783724 - RNA, 13 nt, Leptospira interrogans serovar lai str. 56601
aaauucuuuccuu

SEQ ID NO: 2783725 - RNA, 21 nt, Leptospira interrogans serovar lai str. 56601
aaauucuuuccuuuccuugaa

SEQ ID NO: 2783726 - RNA, 15 nt, Leptospira interrogans serovar lai str. 56601
aaauucuuuuccaaa

SEQ ID NO: 2783727 - RNA, 18 nt, Leptospira interrogans serovar lai str. 56601
aaauucuuuuuauuuuua

SEQ ID NO: 2783728 - RNA, 13 nt, Leptospira interrogans serovar lai str. 56601
aaauugaaaccau

SEQ ID NO: 2783729 - RNA, 23 nt, Leptospira interrogans serovar lai str. 56601
aaauugaaacuauacuuucaaaa

SEQ ID NO: 2783730 - RNA, 23 nt, Leptospira interrogans serovar lai str. 56601
aaauugaacguaauacaaaauau

SEQ ID NO: 2783731 - RNA, 15 nt, Leptospira interrogans serovar lai str. 56601
aaauugaauaucaua

SEQ ID NO: 2783732 - RNA, 19 nt, Leptospira interrogans serovar lai str. 56601
aaauugaauauucacuuuu

SEQ ID NO: 2783733 - RNA, 16 nt, Leptospira interrogans serovar lai str. 56601
aaauugaauucuuccu

SEQ ID NO: 2783734 - RNA, 13 nt, Leptospira interrogans serovar lai str. 56601
aaauugaauuuaa

SEQ ID NO: 2783735 - RNA, 23 nt, Leptospira interrogans serovar lai str. 56601
aaauugacaaagaguuguuuauc

SEQ ID NO: 2783736 - RNA, 17 nt, Leptospira interrogans serovar lai str. 56601
aaauugagaauuuguuu

SEQ ID NO: 2783737 - RNA, 20 nt, Leptospira interrogans serovar lai str. 56601
aaauugagauagguuuugua

SEQ ID NO: 2783738 - RNA, 22 nt, Leptospira interrogans serovar lai str. 56601
aaauugaguaccauaaauuuua

SEQ ID NO: 2783739 - RNA, 20 nt, Leptospira interrogans serovar lai str. 56601
aaauugaguuucacaaaaau

SEQ ID NO: 2783740 - RNA, 15 nt, Leptospira interrogans serovar lai str. 56601
aaauugaguuuucca

SEQ ID NO: 2783741 - RNA, 16 nt, Leptospira interrogans serovar lai str. 56601
aaauugauguuuugua

SEQ ID NO: 2783742 - RNA, 24 nt, Leptospira interrogans serovar lai str. 56601
aaauugcagaauguuuucuacaaa

SEQ ID NO: 2783743 - RNA, 16 nt, Leptospira interrogans serovar lai str. 56601
aaauugcauaaaagaa

SEQ ID NO: 2783744 - RNA, 16 nt, Leptospira interrogans serovar lai str. 56601
aaauugcaucaaagaa

SEQ ID NO: 2783745 - RNA, 17 nt, Leptospira interrogans serovar lai str. 56601
aaauuggguaucuaaau

SEQ ID NO: 2783746 - RNA, 18 nt, Leptospira interrogans serovar lai str. 56601
aaauugguuuuuauuaua

SEQ ID NO: 2783747 - RNA, 16 nt, Leptospira interrogans serovar lai str. 56601
aaauuguaaaucgguu

SEQ ID NO: 2783748 - RNA, 17 nt, Leptospira interrogans serovar lai str. 56601
aaauuguaugaaagaaa

SEQ ID NO: 2783749 - RNA, 18 nt, Leptospira interrogans serovar lai str. 56601
aaauuguaugaagaaaac

SEQ ID NO: 2783750 - RNA, 23 nt, Leptospira interrogans serovar lai str. 56601
aaauuguaugaagaaaaccuaaa

SEQ ID NO: 2783751 - RNA, 19 nt, Leptospira interrogans serovar lai str. 56601
aaauugugagaacuacuuu

SEQ ID NO: 2783752 - RNA, 23 nt, Leptospira interrogans serovar lai str. 56601
aaauugugggaacuauuacaaaa

SEQ ID NO: 2783753 - RNA, 20 nt, Leptospira interrogans serovar lai str. 56601
aaauuguuggccuuuuugaa

SEQ ID NO: 2783754 - RNA, 13 nt, Leptospira interrogans serovar lai str. 56601
aaauuguuucaua

SEQ ID NO: 2783755 - RNA, 20 nt, Leptospira interrogans serovar lai str. 56601
aaauuguuucauaaaauucu

SEQ ID NO: 2783756 - RNA, 14 nt, Leptospira interrogans serovar lai str. 56601
aaauuguuuuaaaa

SEQ ID NO: 2783757 - RNA, 13 nt, Leptospira interrogans serovar lai str. 56601
aaauuuaaaauaa

SEQ ID NO: 2783758 - RNA, 18 nt, Leptospira interrogans serovar lai str. 56601
aaauuuaaaauacucaau

SEQ ID NO: 2783759 - RNA, 16 nt, Leptospira interrogans serovar lai str. 56601
aaauuuaaaauauaaa

SEQ ID NO: 2783760 - RNA, 23 nt, Leptospira interrogans serovar lai str. 56601
aaauuuaagucccgcagaacuau

SEQ ID NO: 2783761 - RNA, 13 nt, Leptospira interrogans serovar lai str. 56601
aaauuuaauaaca

SEQ ID NO: 2783762 - RNA, 19 nt, Leptospira interrogans serovar lai str. 56601
aacaacccccguuauuaaa

SEQ ID NO: 2783763 - RNA, 21 nt, Leptospira interrogans serovar lai str. 56601
aacaacccccguuauuaaaau

SEQ ID NO: 2783764 - RNA, 20 nt, Leptospira interrogans serovar lai str. 56601
aacaacgauuucuguagaaa

SEQ ID NO: 2783765 - RNA, 16 nt, Leptospira interrogans serovar lai str. 56601
aacaacucuaauacaa

SEQ ID NO: 2783766 - RNA, 18 nt, Leptospira interrogans serovar lai str. 56601
aacaacucuaauauaaaa

SEQ ID NO: 2783767 - RNA, 20 nt, Leptospira interrogans serovar lai str. 56601
aacaacucuauuaaagaagu

SEQ ID NO: 2783768 - RNA, 16 nt, Leptospira interrogans serovar lai str. 56601
aacaacucuauuacua

SEQ ID NO: 2783769 - RNA, 15 nt, Leptospira interrogans serovar lai str. 56601
aacaacucuucuucu

SEQ ID NO: 2783770 - RNA, 14 nt, Leptospira interrogans serovar lai str. 56601
aacaagaauuuauu

SEQ ID NO: 2783771 - RNA, 14 nt, Leptospira interrogans serovar lai str. 56601
aacaagauuaacaa

SEQ ID NO: 2783772 - RNA, 21 nt, Leptospira interrogans serovar lai str. 56601
aacaauagcuucuuuaaaaac

SEQ ID NO: 2783773 - RNA, 20 nt, Leptospira interrogans serovar lai str. 56601
aacaauauucuaauuuuaua

SEQ ID NO: 2783774 - RNA, 21 nt, Leptospira interrogans serovar lai str. 56601
aacaauccgcggauguuugaa

SEQ ID NO: 2783775 - RNA, 20 nt, Leptospira interrogans serovar lai str. 56601
aacaaucucggacagauaua

SEQ ID NO: 2783776 - RNA, 22 nt, Leptospira interrogans serovar lai str. 56601
aacaaucuucaaauucuacacc

SEQ ID NO: 2783777 - RNA, 22 nt, Leptospira interrogans serovar lai str. 56601
aacaaugaauuuuuauaaaaau

SEQ ID NO: 2783778 - RNA, 15 nt, Leptospira interrogans serovar lai str. 56601
aacaauuaaucaaau

SEQ ID NO: 2783779 - RNA, 17 nt, Leptospira interrogans serovar lai str. 56601
aacaauuaaucaaauuu

SEQ ID NO: 2783780 - RNA, 23 nt, Leptospira interrogans serovar lai str. 56601
aacaauucagauuccguuuuuau

SEQ ID NO: 2783781 - RNA, 16 nt, Leptospira interrogans serovar lai str. 56601
aacaauucuauuagaa

SEQ ID NO: 2783782 - RNA, 20 nt, Leptospira interrogans serovar lai str. 56601
aacaauucuuccuuuuucau

SEQ ID NO: 2783783 - RNA, 13 nt, Leptospira interrogans serovar lai str. 56601
aacaauuuaaaau

SEQ ID NO: 2783784 - RNA, 14 nt, Leptospira interrogans serovar lai str. 56601
aacaauuuaaaaua

SEQ ID NO: 2783785 - RNA, 12 nt, Leptospira interrogans serovar lai str. 56601
aacaauuuuuca

SEQ ID NO: 2783786 - RNA, 19 nt, Leptospira interrogans serovar lai str. 56601
aacaauuuuuugaaaaaga

SEQ ID NO: 2783787 - RNA, 20 nt, Leptospira interrogans serovar lai str. 56601
aacaauuuuuugaaaaagaa

SEQ ID NO: 2783788 - RNA, 23 nt, Leptospira interrogans serovar lai str. 56601
aacaauuuuuugaaaaagaauau

SEQ ID NO: 2783789 - RNA, 15 nt, Leptospira interrogans serovar lai str. 56601
aacacaacgcucucu

SEQ ID NO: 2783790 - RNA, 20 nt, Leptospira interrogans serovar lai str. 56601
aacacaacgcucuuuaugaa

SEQ ID NO: 2783791 - RNA, 13 nt, Leptospira interrogans serovar lai str. 56601
aacacaacggcuc

SEQ ID NO: 2783792 - RNA, 15 nt, Leptospira interrogans serovar lai str. 56601
aacacaaguuuggaa

SEQ ID NO: 2783793 - RNA, 12 nt, Leptospira interrogans serovar lai str. 56601
aacacaaucugu

SEQ ID NO: 2783794 - RNA, 11 nt, Leptospira interrogans serovar lai str. 56601
aacacacacuu

SEQ ID NO: 2783795 - RNA, 21 nt, Leptospira interrogans serovar lai str. 56601
aacacacacuuuauaaaagua

SEQ ID NO: 2783796 - RNA, 17 nt, Leptospira interrogans serovar lai str. 56601
aacacaucuuaaaaacu

SEQ ID NO: 2783797 - RNA, 15 nt, Leptospira interrogans serovar lai str. 56601
aacaccaccaacagc

SEQ ID NO: 2783798 - RNA, 14 nt, Leptospira interrogans serovar lai str. 56601
aacacgauuuauag

SEQ ID NO: 2783799 - RNA, 13 nt, Leptospira interrogans serovar lai str. 56601
aacacguuaacaa

SEQ ID NO: 2783800 - RNA, 20 nt, Leptospira interrogans serovar lai str. 56601
aacacugagucaacaaauau

SEQ ID NO: 2783801 - RNA, 11 nt, Leptospira interrogans serovar lai str. 56601
aacacuucuug

SEQ ID NO: 2783802 - RNA, 16 nt, Leptospira interrogans serovar lai str. 56601
aacacuugaaaaaugu

SEQ ID NO: 2783803 - RNA, 14 nt, Leptospira interrogans serovar lai str. 56601
aacacuuugagaaa

SEQ ID NO: 2783804 - RNA, 14 nt, Leptospira interrogans serovar lai str. 56601
aacagaacgggcuu

SEQ ID NO: 2783805 - RNA, 16 nt, Leptospira interrogans serovar lai str. 56601
aacagaauguauuaaa

SEQ ID NO: 2783806 - RNA, 20 nt, Leptospira interrogans serovar lai str. 56601
aacagaauguauuaaaaaau

SEQ ID NO: 2783807 - RNA, 16 nt, Leptospira interrogans serovar lai str. 56601
aacagaauguucuuag

SEQ ID NO: 2783808 - RNA, 21 nt, Leptospira interrogans serovar lai str. 56601
aacagagcuuuacaauaaaaa

SEQ ID NO: 2783809 - RNA, 13 nt, Leptospira interrogans serovar lai str. 56601
aacagcccaaaaa

SEQ ID NO: 2783810 - RNA, 18 nt, Leptospira interrogans serovar lai str. 56601
aacagcccaaaaagguga

SEQ ID NO: 2783811 - RNA, 14 nt, Leptospira interrogans serovar lai str. 56601
aacagcuaucgcca

SEQ ID NO: 2783812 - RNA, 15 nt, Leptospira interrogans serovar lai str. 56601
aacaggaaaauuuaa

SEQ ID NO: 2783813 - RNA, 15 nt, Leptospira interrogans serovar lai str. 56601
aacagguaaaccugu

SEQ ID NO: 2783814 - RNA, 14 nt, Leptospira interrogans serovar lai str. 56601
aacaguaaaacuuu

SEQ ID NO: 2783815 - RNA, 14 nt, Leptospira interrogans serovar lai str. 56601
aacaguacuuugua

SEQ ID NO: 2783816 - RNA, 20 nt, Leptospira interrogans serovar lai str. 56601
aacaguacuuuguaauuaaa

SEQ ID NO: 2783817 - RNA, 18 nt, Leptospira interrogans serovar lai str. 56601
aacaguauucaauuuuua

SEQ ID NO: 2783818 - RNA, 19 nt, Leptospira interrogans serovar lai str. 56601
aacaguauucaauuuuuau

SEQ ID NO: 2783819 - RNA, 13 nt, Leptospira interrogans serovar lai str. 56601
aacauaaaaacau

SEQ ID NO: 2783820 - RNA, 17 nt, Leptospira interrogans serovar lai str. 56601
aacauaaaaauuuuuua

SEQ ID NO: 2783821 - RNA, 17 nt, Leptospira interrogans serovar lai str. 56601
aacauaagaauauuaua

SEQ ID NO: 2783822 - RNA, 16 nt, Leptospira interrogans serovar lai str. 56601
aacauaauguuucaau

SEQ ID NO: 2783823 - RNA, 20 nt, Leptospira interrogans serovar lai str. 56601
aacauaauguuucaauuccu

SEQ ID NO: 2783824 - RNA, 22 nt, Leptospira interrogans serovar lai str. 56601
aacauacuaaucuauggaucgc

SEQ ID NO: 2783825 - RNA, 22 nt, Leptospira interrogans serovar lai str. 56601
aacauacuuuuugcaaguaaaa

SEQ ID NO: 2783826 - RNA, 16 nt, Leptospira interrogans serovar lai str. 56601
aacauauuauuuucag

SEQ ID NO: 2783827 - RNA, 20 nt, Leptospira interrogans serovar lai str. 56601
aacaucaauuuuauuucuaa

SEQ ID NO: 2783828 - RNA, 15 nt, Leptospira interrogans serovar lai str. 56601
aacaucacuuccauu

SEQ ID NO: 2783829 - RNA, 16 nt, Leptospira interrogans serovar lai str. 56601
aacaucacuuccauuu

SEQ ID NO: 2783830 - RNA, 20 nt, Leptospira interrogans serovar lai str. 56601
aacaucguuuauaaaucgaa

SEQ ID NO: 2783831 - RNA, 18 nt, Leptospira interrogans serovar lai str. 56601
aacaucucaaucaaaauu

SEQ ID NO: 2783832 - RNA, 20 nt, Leptospira interrogans serovar lai str. 56601
aacaugaagaagcuaaaauu

SEQ ID NO: 2783833 - RNA, 14 nt, Leptospira interrogans serovar lai str. 56601
aacaugagaagcuu

SEQ ID NO: 2783834 - RNA, 22 nt, Leptospira interrogans serovar lai str. 56601
aacauuagaguuguugaaaaau

SEQ ID NO: 2783835 - RNA, 14 nt, Leptospira interrogans serovar lai str. 56601
aacauuauguuaaa

SEQ ID NO: 2783836 - RNA, 17 nt, Leptospira interrogans serovar lai str. 56601
aacauugcgagauuuua

SEQ ID NO: 2783837 - RNA, 18 nt, Leptospira interrogans serovar lai str. 56601
aacauugcgagauuuuaa

SEQ ID NO: 2783838 - RNA, 15 nt, Leptospira interrogans serovar lai str. 56601
aacauuuauuuuucg

SEQ ID NO: 2783839 - RNA, 18 nt, Leptospira interrogans serovar lai str. 56601
aacauuuauuuuucguaa

SEQ ID NO: 2783840 - RNA, 15 nt, Leptospira interrogans serovar lai str. 56601
aacauuucuaaaaua

SEQ ID NO: 2783841 - RNA, 16 nt, Leptospira interrogans serovar lai str. 56601
aacauuucuaaaauau

SEQ ID NO: 2783842 - RNA, 19 nt, Leptospira interrogans serovar lai str. 56601
aacauuucuaaaauauccg

SEQ ID NO: 2783843 - RNA, 18 nt, Leptospira interrogans serovar lai str. 56601
aacauuuguuuuuuauaa

SEQ ID NO: 2783844 - RNA, 17 nt, Leptospira interrogans serovar lai str. 56601
aacauuuugccuuguuc

SEQ ID NO: 2783845 - RNA, 19 nt, Leptospira interrogans serovar lai str. 56601
aacgcgauccauagaaagc

SEQ ID NO: 2783846 - RNA, 19 nt, Leptospira interrogans serovar lai str. 56601
aacgcucucuccuauguuu

SEQ ID NO: 2783847 - RNA, 13 nt, Leptospira interrogans serovar lai str. 56601
aacgcucuuuaug

SEQ ID NO: 2783848 - RNA, 14 nt, Leptospira interrogans serovar lai str. 56601
aacggaauuuuguu

SEQ ID NO: 2783849 - RNA, 20 nt, Leptospira interrogans serovar lai str. 56601
aacggacuguuuuaauuugu

SEQ ID NO: 2783850 - RNA, 22 nt, Leptospira interrogans serovar lai str. 56601
aacggacuguuuuaauuuguag

SEQ ID NO: 2783851 - RNA, 18 nt, Leptospira interrogans serovar lai str. 56601
aacggagaguuaugaguu

SEQ ID NO: 2783852 - RNA, 14 nt, Leptospira interrogans serovar lai str. 56601
aacggauuccucca

SEQ ID NO: 2783853 - RNA, 20 nt, Leptospira interrogans serovar lai str. 56601
aacggccgauugaagcguuu

SEQ ID NO: 2783854 - RNA, 22 nt, Leptospira interrogans serovar lai str. 56601
aacggcuuuaguuugaaagaac

SEQ ID NO: 2783855 - RNA, 23 nt, Leptospira interrogans serovar lai str. 56601
aacggcuuuaguuugaaagaacg

SEQ ID NO: 2783856 - RNA, 21 nt, Leptospira interrogans serovar lai str. 56601
aacggguucuuacaauaaaaa

SEQ ID NO: 2783857 - RNA, 12 nt, Leptospira interrogans serovar lai str. 56601
aacgguaaaauc

SEQ ID NO: 2783858 - RNA, 20 nt, Leptospira interrogans serovar lai str. 56601
aacgguaauuucauaaaauu

SEQ ID NO: 2783859 - RNA, 19 nt, Leptospira interrogans serovar lai str. 56601
aacgguauuuaaaauuaau

SEQ ID NO: 2783860 - RNA, 16 nt, Leptospira interrogans serovar lai str. 56601
aacggugcauuuaaaa

SEQ ID NO: 2783861 - RNA, 18 nt, Leptospira interrogans serovar lai str. 56601
aacgguuuuaguaaaauu

SEQ ID NO: 2783862 - RNA, 20 nt, Leptospira interrogans serovar lai str. 56601
aacgguuuuaguaaaauuua

SEQ ID NO: 2783863 - RNA, 16 nt, Leptospira interrogans serovar lai str. 56601
aacguaagcuugauuu

SEQ ID NO: 2783864 - RNA, 17 nt, Leptospira interrogans serovar lai str. 56601
aacguaaguuaaauaua

SEQ ID NO: 2783865 - RNA, 20 nt, Leptospira interrogans serovar lai str. 56601
aacguaaguuaaauauaaaa

SEQ ID NO: 2783866 - RNA, 16 nt, Leptospira interrogans serovar lai str. 56601
aacguaccaaaaccca

SEQ ID NO: 2783867 - RNA, 14 nt, Leptospira interrogans serovar lai str. 56601
aacguagauaauua

SEQ ID NO: 2783868 - RNA, 16 nt, Leptospira interrogans serovar lai str. 56601
aacguaguaguuccua

SEQ ID NO: 2783869 - RNA, 22 nt, Leptospira interrogans serovar lai str. 56601
aacgucauaguucccacaaauu

SEQ ID NO: 2783870 - RNA, 20 nt, Leptospira interrogans serovar lai str. 56601
aacguccagauaugacaauu

SEQ ID NO: 2783871 - RNA, 20 nt, Leptospira interrogans serovar lai str. 56601
aacgugaacuaaauauggau

SEQ ID NO: 2783872 - RNA, 13 nt, Leptospira interrogans serovar lai str. 56601
aacgugaguucga

SEQ ID NO: 2783873 - RNA, 13 nt, Leptospira interrogans serovar lai str. 56601
aacgugaguucgg

SEQ ID NO: 2783874 - RNA, 22 nt, Leptospira interrogans serovar lai str. 56601
aacgugaguucguggagaaauc

SEQ ID NO: 2783875 - RNA, 23 nt, Leptospira interrogans serovar lai str. 56601
aacgugaguuugacguaaaaaaa

SEQ ID NO: 2783876 - RNA, 23 nt, Leptospira interrogans serovar lai str. 56601
aacgugaguuugauguaagguaa

SEQ ID NO: 2783877 - RNA, 22 nt, Leptospira interrogans serovar lai str. 56601
aacgugucauguuuuaaugaaa

SEQ ID NO: 2783878 - RNA, 19 nt, Leptospira interrogans serovar lai str. 56601
aacguuauacaauauuucg

SEQ ID NO: 2783879 - RNA, 23 nt, Leptospira interrogans serovar lai str. 56601
aacguuauacaauauuucgucuu

SEQ ID NO: 2783880 - RNA, 18 nt, Leptospira interrogans serovar lai str. 56601
aacguuuauuucaaaauu

SEQ ID NO: 2783881 - RNA, 20 nt, Leptospira interrogans serovar lai str. 56601
aacguuuuguugaguuugaa

SEQ ID NO: 2783882 - RNA, 18 nt, Leptospira interrogans serovar lai str. 56601
aacuaaaaccgaccugca

SEQ ID NO: 2783883 - RNA, 21 nt, Leptospira interrogans serovar lai str. 56601
aacuaaagacguaauauugua

SEQ ID NO: 2783884 - RNA, 21 nt, Leptospira interrogans serovar lai str. 56601
aacuaacgcucauuuccauaa

SEQ ID NO: 2783885 - RNA, 13 nt, Leptospira interrogans serovar lai str. 56601
aacuaaguuuuac

SEQ ID NO: 2783886 - RNA, 18 nt, Leptospira interrogans serovar lai str. 56601
aacuaaguuuuacagaag

SEQ ID NO: 2783887 - RNA, 12 nt, Leptospira interrogans serovar lai str. 56601
aacuaauaaaaa

SEQ ID NO: 2783888 - RNA, 15 nt, Leptospira interrogans serovar lai str. 56601
aacuaauaaaaacaa

SEQ ID NO: 2783889 - RNA, 13 nt, Leptospira interrogans serovar lai str. 56601
aacuaaugaagga

SEQ ID NO: 2783890 - RNA, 13 nt, Leptospira interrogans serovar lai str. 56601
aacuaauuuguag

SEQ ID NO: 2783891 - RNA, 22 nt, Leptospira interrogans serovar lai str. 56601
aacuaauuuuaguuuauuuuaa

SEQ ID NO: 2783892 - RNA, 17 nt, Leptospira interrogans serovar lai str. 56601
aacuacacguuuuccua

SEQ ID NO: 2783893 - RNA, 13 nt, Leptospira interrogans serovar lai str. 56601
aacuacagcaaau

SEQ ID NO: 2783894 - RNA, 16 nt, Leptospira interrogans serovar lai str. 56601
aacuacagcaaaucac

SEQ ID NO: 2783895 - RNA, 15 nt, Leptospira interrogans serovar lai str. 56601
aacuaccacaaaacu

SEQ ID NO: 2783896 - RNA, 16 nt, Leptospira interrogans serovar lai str. 56601
aacuaccacaaaacuu

SEQ ID NO: 2783897 - RNA, 19 nt, Leptospira interrogans serovar lai str. 56601
aacuaccaccaaaguauga

SEQ ID NO: 2783898 - RNA, 13 nt, Leptospira interrogans serovar lai str. 56601
aacuacccaaaac

SEQ ID NO: 2783899 - RNA, 18 nt, Leptospira interrogans serovar lai str. 56601
aacuacccagucuccaua

SEQ ID NO: 2783900 - RNA, 20 nt, Leptospira interrogans serovar lai str. 56601
aacuaccgcaaacaucuaga

SEQ ID NO: 2783901 - RNA, 18 nt, Leptospira interrogans serovar lai str. 56601
aacuacuaauuuaucgau

SEQ ID NO: 2783902 - RNA, 14 nt, Leptospira interrogans serovar lai str. 56601
aacuacuacaaaaa

SEQ ID NO: 2783903 - RNA, 22 nt, Leptospira interrogans serovar lai str. 56601
aacuacuacaaaaauuuaauaa

SEQ ID NO: 2783904 - RNA, 15 nt, Leptospira interrogans serovar lai str. 56601
aacuacuacaaauca

SEQ ID NO: 2783905 - RNA, 18 nt, Leptospira interrogans serovar lai str. 56601
aacuacuacaauuaaaaa

SEQ ID NO: 2783906 - RNA, 20 nt, Leptospira interrogans serovar lai str. 56601
aacuacuacgaaaacuuaau

SEQ ID NO: 2783907 - RNA, 16 nt, Leptospira interrogans serovar lai str. 56601
aacuacuacgaaaauu

SEQ ID NO: 2783908 - RNA, 15 nt, Leptospira interrogans serovar lai str. 56601
aacuacuacuuuuag

SEQ ID NO: 2783909 - RNA, 17 nt, Leptospira interrogans serovar lai str. 56601
aacuacuacuuuucuga

SEQ ID NO: 2783910 - RNA, 13 nt, Leptospira interrogans serovar lai str. 56601
aacuacuauaaau

SEQ ID NO: 2783911 - RNA, 23 nt, Leptospira interrogans serovar lai str. 56601
aacuacuccagauuuaauuuuuc

SEQ ID NO: 2783912 - RNA, 16 nt, Leptospira interrogans serovar lai str. 56601
aacuacugcauucuua

SEQ ID NO: 2783913 - RNA, 20 nt, Leptospira interrogans serovar lai str. 56601
aacuacuuccgucuuuugua

SEQ ID NO: 2783914 - RNA, 14 nt, Leptospira interrogans serovar lai str. 56601
aacuacuuuuauaa

SEQ ID NO: 2783915 - RNA, 17 nt, Leptospira interrogans serovar lai str. 56601
aacuacuuuuauaaaaa

SEQ ID NO: 2783916 - RNA, 18 nt, Leptospira interrogans serovar lai str. 56601
aacuagggaaaguuuuuu

SEQ ID NO: 2783917 - RNA, 12 nt, Leptospira interrogans serovar lai str. 56601
aacuaguuccuu

SEQ ID NO: 2783918 - RNA, 18 nt, Leptospira interrogans serovar lai str. 56601
aacuaguuccuuaaauau

SEQ ID NO: 2783919 - RNA, 23 nt, Leptospira interrogans serovar lai str. 56601
aacuauccaaaaguuuauaaacu

SEQ ID NO: 2783920 - RNA, 15 nt, Leptospira interrogans serovar lai str. 56601
aacuaucuuaaaaug

SEQ ID NO: 2783921 - RNA, 19 nt, Leptospira interrogans serovar lai str. 56601
aacuauuacaaaaucugaa

SEQ ID NO: 2783922 - RNA, 15 nt, Leptospira interrogans serovar lai str. 56601
aacuauuacaaaucg

SEQ ID NO: 2783923 - RNA, 15 nt, Leptospira interrogans serovar lai str. 56601
aacuauuauaaaaua

SEQ ID NO: 2783924 - RNA, 23 nt, Leptospira interrogans serovar lai str. 56601
aacuauuaucuuucgauuuuaaa

SEQ ID NO: 2783925 - RNA, 20 nt, Leptospira interrogans serovar lai str. 56601
aacuauucuauuaguuuuua

SEQ ID NO: 2783926 - RNA, 15 nt, Leptospira interrogans serovar lai str. 56601
aacuauuuauaaaau

SEQ ID NO: 2783927 - RNA, 20 nt, Leptospira interrogans serovar lai str. 56601
aacuauuuauaaaauaaaaa

SEQ ID NO: 2783928 - RNA, 17 nt, Leptospira interrogans serovar lai str. 56601
aacuucagccgcuucau

SEQ ID NO: 2783929 - RNA, 19 nt, Leptospira interrogans serovar lai str. 56601
aacuucagccgcuucauca

SEQ ID NO: 2783930 - RNA, 15 nt, Leptospira interrogans serovar lai str. 56601
aacuuccauuuuuua

SEQ ID NO: 2783931 - RNA, 20 nt, Leptospira interrogans serovar lai str. 56601
aacuuccauuuuuuauauuu

SEQ ID NO: 2783932 - RNA, 14 nt, Leptospira interrogans serovar lai str. 56601
aacuuccuugugac

SEQ ID NO: 2783933 - RNA, 21 nt, Leptospira interrogans serovar lai str. 56601
aacuucgguauaaucuaauuc

SEQ ID NO: 2783934 - RNA, 12 nt, Leptospira interrogans serovar lai str. 56601
aacuucuauuuu

SEQ ID NO: 2783935 - RNA, 15 nt, Leptospira interrogans serovar lai str. 56601
aacuucuauuuuaua

SEQ ID NO: 2783936 - RNA, 14 nt, Leptospira interrogans serovar lai str. 56601
aacuucuauuuuga

SEQ ID NO: 2783937 - RNA, 15 nt, Leptospira interrogans serovar lai str. 56601
aacuucuauuuuuua

SEQ ID NO: 2783938 - RNA, 23 nt, Leptospira interrogans serovar lai str. 56601
aacuucuucccagggauaagcau

SEQ ID NO: 2783939 - RNA, 15 nt, Leptospira interrogans serovar lai str. 56601
aacuugaaucgagcg

SEQ ID NO: 2783940 - RNA, 22 nt, Leptospira interrogans serovar lai str. 56601
aacuugaguucgacguaagaau

SEQ ID NO: 2783941 - RNA, 22 nt, Leptospira interrogans serovar lai str. 56601
aacuugaguuugacguaagaaa

SEQ ID NO: 2783942 - RNA, 18 nt, Leptospira interrogans serovar lai str. 56601
aacuugccguuuuucuaa

SEQ ID NO: 2783943 - RNA, 17 nt, Leptospira interrogans serovar lai str. 56601
aacuuggaaucuuaaaa

SEQ ID NO: 2783944 - RNA, 20 nt, Leptospira interrogans serovar lai str. 56601
aacuuggaaucuuaaaaaga

SEQ ID NO: 2783945 - RNA, 16 nt, Leptospira interrogans serovar lai str. 56601
aacuuggguuucuuaa

SEQ ID NO: 2783946 - RNA, 17 nt, Leptospira interrogans serovar lai str. 56601
aacuuggguuucuuaaa

SEQ ID NO: 2783947 - RNA, 21 nt, Leptospira interrogans serovar lai str. 56601
aacuuggguuucuuaaaucuu

SEQ ID NO: 2783948 - RNA, 15 nt, Leptospira interrogans serovar lai str. 56601
aacuugucccaaaac

SEQ ID NO: 2783949 - RNA, 17 nt, Leptospira interrogans serovar lai str. 56601
aacuugucccaaaacuu

SEQ ID NO: 2783950 - RNA, 16 nt, Leptospira interrogans serovar lai str. 56601
aacuugucccaaaauu

SEQ ID NO: 2783951 - RNA, 21 nt, Leptospira interrogans serovar lai str. 56601
aacuugucccaaaauuuuaua

SEQ ID NO: 2783952 - RNA, 20 nt, Leptospira interrogans serovar lai str. 56601
aacuuguccuaaaauuuuaa

SEQ ID NO: 2783953 - RNA, 13 nt, Leptospira interrogans serovar lai str. 56601
aacuuguuccaaa

SEQ ID NO: 2783954 - RNA, 18 nt, Leptospira interrogans serovar lai str. 56601
aacuuguuuuagaaucua

SEQ ID NO: 2783955 - RNA, 12 nt, Leptospira interrogans serovar lai str. 56601
aacuuuaaaaaa

SEQ ID NO: 2783956 - RNA, 15 nt, Leptospira interrogans serovar lai str. 56601
aacuuuaaaaaauaa

SEQ ID NO: 2783957 - RNA, 14 nt, Leptospira interrogans serovar lai str. 56601
aacuuuaauuuucu

SEQ ID NO: 2783958 - RNA, 16 nt, Leptospira interrogans serovar lai str. 56601
aacuuuacaaaaaugu

SEQ ID NO: 2783959 - RNA, 22 nt, Leptospira interrogans serovar lai str. 56601
aacuuuacacgauaauuuuuag

SEQ ID NO: 2783960 - RNA, 23 nt, Leptospira interrogans serovar lai str. 56601
aacuuuaccggguuccauucuaa

SEQ ID NO: 2783961 - RNA, 14 nt, Leptospira interrogans serovar lai str. 56601
aacuuuacgaguuu

SEQ ID NO: 2783962 - RNA, 14 nt, Leptospira interrogans serovar lai str. 56601
aacuuuagaaaaau

SEQ ID NO: 2783963 - RNA, 15 nt, Leptospira interrogans serovar lai str. 56601
aacuuuagaaaaaua

SEQ ID NO: 2783964 - RNA, 16 nt, Leptospira interrogans serovar lai str. 56601
aacuuuagaaaaauau

SEQ ID NO: 2783965 - RNA, 20 nt, Leptospira interrogans serovar lai str. 56601
aacuuuagaaaaauauuaua

SEQ ID NO: 2783966 - RNA, 15 nt, Leptospira interrogans serovar lai str. 56601
aacuuuagaauguaa

SEQ ID NO: 2783967 - RNA, 12 nt, Leptospira interrogans serovar lai str. 56601
aacuuucaaaau

SEQ ID NO: 2783968 - RNA, 17 nt, Leptospira interrogans serovar lai str. 56601
aacuuucaaaauaggaa

SEQ ID NO: 2783969 - RNA, 17 nt, Leptospira interrogans serovar lai str. 56601
aacuuucaaagaauaua

SEQ ID NO: 2783970 - RNA, 20 nt, Leptospira interrogans serovar lai str. 56601
aacuuucaaagaauauaaaa

SEQ ID NO: 2783971 - RNA, 21 nt, Leptospira interrogans serovar lai str. 56601
aacuuucaaagaauauaaaau

SEQ ID NO: 2783972 - RNA, 16 nt, Leptospira interrogans serovar lai str. 56601
aacuuucagauuaaaa

SEQ ID NO: 2783973 - RNA, 22 nt, Leptospira interrogans serovar lai str. 56601
aacuuucauugauaauuucuag

SEQ ID NO: 2783974 - RNA, 12 nt, Leptospira interrogans serovar lai str. 56601
aacuuuccuuuu

SEQ ID NO: 2783975 - RNA, 18 nt, Leptospira interrogans serovar lai str. 56601
aacuuucgagcaguucua

SEQ ID NO: 2783976 - RNA, 16 nt, Leptospira interrogans serovar lai str. 56601
aacuuucgagccauuc

SEQ ID NO: 2783977 - RNA, 14 nt, Leptospira interrogans serovar lai str. 56601
aacuuucuaaaaau

SEQ ID NO: 2783978 - RNA, 13 nt, Leptospira interrogans serovar lai str. 56601
aacuuugaaaauu

SEQ ID NO: 2783979 - RNA, 14 nt, Leptospira interrogans serovar lai str. 56601
aacuuugaaaauuu

SEQ ID NO: 2783980 - RNA, 22 nt, Leptospira interrogans serovar lai str. 56601
aacuuugguuaucauaaaaaua

SEQ ID NO: 2783981 - RNA, 16 nt, Leptospira interrogans serovar lai str. 56601
aacuuuuacuguaaaa

SEQ ID NO: 2783982 - RNA, 14 nt, Leptospira interrogans serovar lai str. 56601
aacuuuuagaauuc

SEQ ID NO: 2783983 - RNA, 16 nt, Leptospira interrogans serovar lai str. 56601
aacuuuuauaauucaa

SEQ ID NO: 2783984 - RNA, 13 nt, Leptospira interrogans serovar lai str. 56601
aacuuuuccagaa

SEQ ID NO: 2783985 - RNA, 15 nt, Leptospira interrogans serovar lai str. 56601
aacuuuuuauaaaga

SEQ ID NO: 2783986 - RNA, 15 nt, Leptospira interrogans serovar lai str. 56601
aacuuuuucaagugu

SEQ ID NO: 2783987 - RNA, 19 nt, Leptospira interrogans serovar lai str. 56601
aacuuuuucagaaaaauga

SEQ ID NO: 2783988 - RNA, 17 nt, Leptospira interrogans serovar lai str. 56601
aacuuuuuuagcaaaua

SEQ ID NO: 2783989 - RNA, 19 nt, Leptospira interrogans serovar lai str. 56601
aacuuuuuuauaaauggau

SEQ ID NO: 2783990 - RNA, 16 nt, Leptospira interrogans serovar lai str. 56601
aacuuuuuucagaaaa

SEQ ID NO: 2783991 - RNA, 16 nt, Leptospira interrogans serovar lai str. 56601
aacuuuuuuuaaaaaa

SEQ ID NO: 2783992 - RNA, 18 nt, Leptospira interrogans serovar lai str. 56601
aacuuuuuuuaaaaaauu

SEQ ID NO: 2783993 - RNA, 19 nt, Leptospira interrogans serovar lai str. 56601
aagaaaaaacuuucuaaaa

SEQ ID NO: 2783994 - RNA, 14 nt, Leptospira interrogans serovar lai str. 56601
aagaaaaaagcagc

SEQ ID NO: 2783995 - RNA, 19 nt, Leptospira interrogans serovar lai str. 56601
aagaaaaaaguugcuaaga

SEQ ID NO: 2783996 - RNA, 23 nt, Leptospira interrogans serovar lai str. 56601
aagaaaaccacccccaccaaaaa

SEQ ID NO: 2783997 - RNA, 15 nt, Leptospira interrogans serovar lai str. 56601
aagaaaaccaugauu

SEQ ID NO: 2783998 - RNA, 19 nt, Leptospira interrogans serovar lai str. 56601
aagaaaaccuaaaauagau

SEQ ID NO: 2783999 - RNA, 23 nt, Leptospira interrogans serovar lai str. 56601
aagaaaagguguggauaccuuua

SEQ ID NO: 2784000 - RNA, 12 nt, Leptospira interrogans serovar lai str. 56601
aagaaacaaaga

SEQ ID NO: 2784001 - RNA, 15 nt, Leptospira interrogans serovar lai str. 56601
aagaaacaaagaaua

SEQ ID NO: 2784002 - RNA, 19 nt, Leptospira interrogans serovar lai str. 56601
aagaaacaaagaauaccaa

SEQ ID NO: 2784003 - RNA, 18 nt, Leptospira interrogans serovar lai str. 56601
aagaaacauaaugcaaua

SEQ ID NO: 2784004 - RNA, 19 nt, Leptospira interrogans serovar lai str. 56601
aagaaaccucuauaaauga

SEQ ID NO: 2784005 - RNA, 19 nt, Leptospira interrogans serovar lai str. 56601
aagaaacggaagaaaauua

SEQ ID NO: 2784006 - RNA, 10 nt, Leptospira interrogans serovar lai str. 56601
aagaaacuca

SEQ ID NO: 2784007 - RNA, 13 nt, Leptospira interrogans serovar lai str. 56601
aagaaacucagua

SEQ ID NO: 2784008 - RNA, 20 nt, Leptospira interrogans serovar lai str. 56601
aagaaacucauaaaauaacu

SEQ ID NO: 2784009 - RNA, 21 nt, Leptospira interrogans serovar lai str. 56601
aagaaacucauuuuucuaaaa

SEQ ID NO: 2784010 - RNA, 23 nt, Leptospira interrogans serovar lai str. 56601
aagaaacuguuuaauaaagauuc

SEQ ID NO: 2784011 - RNA, 16 nt, Leptospira interrogans serovar lai str. 56601
aagacuuaaaagaaga

SEQ ID NO: 2784012 - RNA, 20 nt, Leptospira interrogans serovar lai str. 56601
aagacuuaaaagaagauuuu

SEQ ID NO: 2784013 - RNA, 23 nt, Leptospira interrogans serovar lai str. 56601
aagacuuaaaagaagauuuuucu

SEQ ID NO: 2784014 - RNA, 22 nt, Leptospira interrogans serovar lai str. 56601
aagacuuccacgaauuacauag

SEQ ID NO: 2784015 - RNA, 14 nt, Leptospira interrogans serovar lai str. 56601
aagacuucuauacu

SEQ ID NO: 2784016 - RNA, 18 nt, Leptospira interrogans serovar lai str. 56601
aagacuuuauagucaaau

SEQ ID NO: 2784017 - RNA, 21 nt, Leptospira interrogans serovar lai str. 56601
aagacuuuuccuaaaauuuug

SEQ ID NO: 2784018 - RNA, 19 nt, Leptospira interrogans serovar lai str. 56601
aagagaaccucuauaaaau

SEQ ID NO: 2784019 - RNA, 20 nt, Leptospira interrogans serovar lai str. 56601
aagagaaccucuauaaaauc

SEQ ID NO: 2784020 - RNA, 21 nt, Leptospira interrogans serovar lai str. 56601
aagagaaccucuauaaaaucu

SEQ ID NO: 2784021 - RNA, 13 nt, Leptospira interrogans serovar lai str. 56601
aagagaacucauu

SEQ ID NO: 2784022 - RNA, 19 nt, Leptospira interrogans serovar lai str. 56601
aagagaauuucuauaaaau

SEQ ID NO: 2784023 - RNA, 18 nt, Leptospira interrogans serovar lai str. 56601
aagagaugauuucuugag

SEQ ID NO: 2784024 - RNA, 17 nt, Leptospira interrogans serovar lai str. 56601
aagagccaaguugaauc

SEQ ID NO: 2784025 - RNA, 18 nt, Leptospira interrogans serovar lai str. 56601
aagagccuacaaaucgaa

SEQ ID NO: 2784026 - RNA, 19 nt, Leptospira interrogans serovar lai str. 56601
aagagguacagaaacaaaa

SEQ ID NO: 2784027 - RNA, 20 nt, Leptospira interrogans serovar lai str. 56601
aagagucauuuuuaaauacu

SEQ ID NO: 2784028 - RNA, 18 nt, Leptospira interrogans serovar lai str. 56601
aagagucgcaaguugauu

SEQ ID NO: 2784029 - RNA, 17 nt, Leptospira interrogans serovar lai str. 56601
aagagugcagauuaaaa

SEQ ID NO: 2784030 - RNA, 21 nt, Leptospira interrogans serovar lai str. 56601
aagagugguuuucaaauauuu

SEQ ID NO: 2784031 - RNA, 16 nt, Leptospira interrogans serovar lai str. 56601
aagaguugaauauuuu

SEQ ID NO: 2784032 - RNA, 18 nt, Leptospira interrogans serovar lai str. 56601
aagaguuuuauccauaaa

SEQ ID NO: 2784033 - RNA, 21 nt, Leptospira interrogans serovar lai str. 56601
aagauaaaacucaaaggaaaa

SEQ ID NO: 2784034 - RNA, 16 nt, Leptospira interrogans serovar lai str. 56601
aagauaaaucgcaaau

SEQ ID NO: 2784035 - RNA, 19 nt, Leptospira interrogans serovar lai str. 56601
aagauaaaucguuugcuuu

SEQ ID NO: 2784036 - RNA, 14 nt, Leptospira interrogans serovar lai str. 56601
aagauaaauuauag

SEQ ID NO: 2784037 - RNA, 16 nt, Leptospira interrogans serovar lai str. 56601
aagauaacaucuugaa

SEQ ID NO: 2784038 - RNA, 12 nt, Leptospira interrogans serovar lai str. 56601
aagauaccaaau

SEQ ID NO: 2784039 - RNA, 21 nt, Leptospira interrogans serovar lai str. 56601
aagauaccaaauaaauauuuc

SEQ ID NO: 2784040 - RNA, 20 nt, Leptospira interrogans serovar lai str. 56601
aagauagaaguuuauaauaa

SEQ ID NO: 2784041 - RNA, 19 nt, Leptospira interrogans serovar lai str. 56601
aagauagauuuauaauaaa

SEQ ID NO: 2784042 - RNA, 16 nt, Leptospira interrogans serovar lai str. 56601
aagauaugaauuaauu

SEQ ID NO: 2784043 - RNA, 20 nt, Leptospira interrogans serovar lai str. 56601
aagauaugaauuaauuugua

SEQ ID NO: 2784044 - RNA, 20 nt, Leptospira interrogans serovar lai str. 56601
aagauauuucaauauaaaaa

SEQ ID NO: 2784045 - RNA, 21 nt, Leptospira interrogans serovar lai str. 56601
aagauauuucaauauaaaaau

SEQ ID NO: 2784046 - RNA, 22 nt, Leptospira interrogans serovar lai str. 56601
aagauauuucaauauaaaaauu

SEQ ID NO: 2784047 - RNA, 21 nt, Leptospira interrogans serovar lai str. 56601
aagaucauucuauuuggauuu

SEQ ID NO: 2784048 - RNA, 14 nt, Leptospira interrogans serovar lai str. 56601
aagaucauuuaaaa

SEQ ID NO: 2784049 - RNA, 15 nt, Leptospira interrogans serovar lai str. 56601
aagaucuauuccuaa

SEQ ID NO: 2784050 - RNA, 20 nt, Leptospira interrogans serovar lai str. 56601
aagaugauauguuauauaaa

SEQ ID NO: 2784051 - RNA, 21 nt, Leptospira interrogans serovar lai str. 56601
aagaugcucggcuucuucaau

SEQ ID NO: 2784052 - RNA, 16 nt, Leptospira interrogans serovar lai str. 56601
aagaugcuuucucuuu

SEQ ID NO: 2784053 - RNA, 17 nt, Leptospira interrogans serovar lai str. 56601
aagaugcuuucucuuuu

SEQ ID NO: 2784054 - RNA, 22 nt, Leptospira interrogans serovar lai str. 56601
aagaugggacuuuuuucguugc

SEQ ID NO: 2784055 - RNA, 13 nt, Leptospira interrogans serovar lai str. 56601
aagauuaaagauu

SEQ ID NO: 2784056 - RNA, 13 nt, Leptospira interrogans serovar lai str. 56601
aagauuaacaauc

SEQ ID NO: 2784057 - RNA, 18 nt, Leptospira interrogans serovar lai str. 56601
aagauuaaccguagauuu

SEQ ID NO: 2784058 - RNA, 15 nt, Leptospira interrogans serovar lai str. 56601
aagauuagaaaaacu

SEQ ID NO: 2784059 - RNA, 21 nt, Leptospira interrogans serovar lai str. 56601
aagauuauauuauauuucgua

SEQ ID NO: 2784060 - RNA, 20 nt, Leptospira interrogans serovar lai str. 56601
aagauuaucuucuaauuaaa

SEQ ID NO: 2784061 - RNA, 20 nt, Leptospira interrogans serovar lai str. 56601
aagauuaugguaaaauuuca

SEQ ID NO: 2784062 - RNA, 14 nt, Leptospira interrogans serovar lai str. 56601
aagauuauuuuuga

SEQ ID NO: 2784063 - RNA, 13 nt, Leptospira interrogans serovar lai str. 56601
aagauucaaagau

SEQ ID NO: 2784064 - RNA, 15 nt, Leptospira interrogans serovar lai str. 56601
aagauucuauuuuga

SEQ ID NO: 2784065 - RNA, 16 nt, Leptospira interrogans serovar lai str. 56601
aagauucuauuuugag

SEQ ID NO: 2784066 - RNA, 23 nt, Leptospira interrogans serovar lai str. 56601
aagauugaacgguaaaaucuuua

SEQ ID NO: 2784067 - RNA, 15 nt, Leptospira interrogans serovar lai str. 56601
aagauugaaugaaau

SEQ ID NO: 2784068 - RNA, 14 nt, Leptospira interrogans serovar lai str. 56601
aagauugaauuuuu

SEQ ID NO: 2784069 - RNA, 22 nt, Leptospira interrogans serovar lai str. 56601
aagauuggagggcaaucgauuu

SEQ ID NO: 2784070 - RNA, 16 nt, Leptospira interrogans serovar lai str. 56601
aagauuuaauuuagaa

SEQ ID NO: 2784071 - RNA, 17 nt, Leptospira interrogans serovar lai str. 56601
aagauuuaauuuagaaa

SEQ ID NO: 2784072 - RNA, 19 nt, Leptospira interrogans serovar lai str. 56601
aagauuuaauuuagaaauu

SEQ ID NO: 2784073 - RNA, 20 nt, Leptospira interrogans serovar lai str. 56601
aagauuucguucggaaaaaa

SEQ ID NO: 2784074 - RNA, 22 nt, Leptospira interrogans serovar lai str. 56601
aagauuucguucggaaaaaaua

SEQ ID NO: 2784075 - RNA, 23 nt, Leptospira interrogans serovar lai str. 56601
aagauuucguucggaaaaaauau

SEQ ID NO: 2784076 - RNA, 21 nt, Leptospira interrogans serovar lai str. 56601
aagauuucguucggaaaaagu

SEQ ID NO: 2784077 - RNA, 16 nt, Leptospira interrogans serovar lai str. 56601
aagauuucuauauuca

SEQ ID NO: 2784078 - RNA, 15 nt, Leptospira interrogans serovar lai str. 56601
aagauuuguugaaaa

SEQ ID NO: 2784079 - RNA, 15 nt, Leptospira interrogans serovar lai str. 56601
aagauuuuagaauca

SEQ ID NO: 2784080 - RNA, 22 nt, Leptospira interrogans serovar lai str. 56601
aagauuuuaucgaauaagaaau

SEQ ID NO: 2784081 - RNA, 15 nt, Leptospira interrogans serovar lai str. 56601
aagcaaucuguuuag

SEQ ID NO: 2784082 - RNA, 15 nt, Leptospira interrogans serovar lai str. 56601
aagcaauucuaagac

SEQ ID NO: 2784083 - RNA, 19 nt, Leptospira interrogans serovar lai str. 56601
aagcacauccgcauucuca

SEQ ID NO: 2784084 - RNA, 12 nt, Leptospira interrogans serovar lai str. 56601
aagcaccuucua

SEQ ID NO: 2784085 - RNA, 22 nt, Leptospira interrogans serovar lai str. 56601
aagcacggacauuguuucucga

SEQ ID NO: 2784086 - RNA, 21 nt, Leptospira interrogans serovar lai str. 56601
aagcagaagcuuuauuaaauu

SEQ ID NO: 2784087 - RNA, 20 nt, Leptospira interrogans serovar lai str. 56601
aagcagauuuguccguuuga

SEQ ID NO: 2784088 - RNA, 13 nt, Leptospira interrogans serovar lai str. 56601
aagcagcaaagaa

SEQ ID NO: 2784089 - RNA, 15 nt, Leptospira interrogans serovar lai str. 56601
aagcagcaaagaagg

SEQ ID NO: 2784090 - RNA, 16 nt, Leptospira interrogans serovar lai str. 56601
aagcagcaaagaaggc

SEQ ID NO: 2784091 - RNA, 19 nt, Leptospira interrogans serovar lai str. 56601
aagcagcuaaaaagaaagu

SEQ ID NO: 2784092 - RNA, 14 nt, Leptospira interrogans serovar lai str. 56601
aagcauuaaaaaag

SEQ ID NO: 2784093 - RNA, 19 nt, Leptospira interrogans serovar lai str. 56601
aaguaaucuuuuuaaaagu

SEQ ID NO: 2784094 - RNA, 22 nt, Leptospira interrogans serovar lai str. 56601
aaguaaucuuuuuaaaaguuug

SEQ ID NO: 2784095 - RNA, 20 nt, Leptospira interrogans serovar lai str. 56601
aaguaauuacccuaaagcua

SEQ ID NO: 2784096 - RNA, 15 nt, Leptospira interrogans serovar lai str. 56601
aaguaauuuaaaaaa

SEQ ID NO: 2784097 - RNA, 22 nt, Leptospira interrogans serovar lai str. 56601
aaguaauuuaucuguaauuuua

SEQ ID NO: 2784098 - RNA, 19 nt, Leptospira interrogans serovar lai str. 56601
aaguacauggcauccagga

SEQ ID NO: 2784099 - RNA, 23 nt, Leptospira interrogans serovar lai str. 56601
aaguacgggcucauacauuuuua

SEQ ID NO: 2784100 - RNA, 18 nt, Leptospira interrogans serovar lai str. 56601
aaguagaaagauuaaauu

SEQ ID NO: 2784101 - RNA, 16 nt, Leptospira interrogans serovar lai str. 56601
aaguagagagugaaaa

SEQ ID NO: 2784102 - RNA, 18 nt, Leptospira interrogans serovar lai str. 56601
aaguagagagugaaaaau

SEQ ID NO: 2784103 - RNA, 12 nt, Leptospira interrogans serovar lai str. 56601
aaguagauaaau

SEQ ID NO: 2784104 - RNA, 13 nt, Leptospira interrogans serovar lai str. 56601
aaguagauaaauu

SEQ ID NO: 2784105 - RNA, 17 nt, Leptospira interrogans serovar lai str. 56601
aaguagauaaauucuua

SEQ ID NO: 2784106 - RNA, 16 nt, Leptospira interrogans serovar lai str. 56601
aaguagcgaugaucga

SEQ ID NO: 2784107 - RNA, 22 nt, Leptospira interrogans serovar lai str. 56601
aaguaguagucuuacaauuuua

SEQ ID NO: 2784108 - RNA, 15 nt, Leptospira interrogans serovar lai str. 56601
aaguaguaguuccca

SEQ ID NO: 2784109 - RNA, 18 nt, Leptospira interrogans serovar lai str. 56601
aaguaguaugcgaaauuc

SEQ ID NO: 2784110 - RNA, 20 nt, Leptospira interrogans serovar lai str. 56601
aaguaguaugcgaaauuccu

SEQ ID NO: 2784111 - RNA, 16 nt, Leptospira interrogans serovar lai str. 56601
aaguauauauuaaagu

SEQ ID NO: 2784112 - RNA, 19 nt, Leptospira interrogans serovar lai str. 56601
aaguaugaaguaaguuaua

SEQ ID NO: 2784113 - RNA, 16 nt, Leptospira interrogans serovar lai str. 56601
aaguauguuuuucuga

SEQ ID NO: 2784114 - RNA, 13 nt, Leptospira interrogans serovar lai str. 56601
aaguauuauaaau

SEQ ID NO: 2784115 - RNA, 15 nt, Leptospira interrogans serovar lai str. 56601
aaguauuauuuuuau

SEQ ID NO: 2784116 - RNA, 15 nt, Leptospira interrogans serovar lai str. 56601
aaguauuugaucuca

SEQ ID NO: 2784117 - RNA, 17 nt, Leptospira interrogans serovar lai str. 56601
aaguauuugaucucaau

SEQ ID NO: 2784118 - RNA, 18 nt, Leptospira interrogans serovar lai str. 56601
aaguauuuuacgauucaa

SEQ ID NO: 2784119 - RNA, 21 nt, Leptospira interrogans serovar lai str. 56601
aaguauuuuacgauucaauuc

SEQ ID NO: 2784120 - RNA, 14 nt, Leptospira interrogans serovar lai str. 56601
aaguauuuucuaga

SEQ ID NO: 2784121 - RNA, 23 nt, Leptospira interrogans serovar lai str. 56601
aaguauuuugauccguuuuaaaa

SEQ ID NO: 2784122 - RNA, 17 nt, Leptospira interrogans serovar lai str. 56601
aagucaaaaaaugguuu

SEQ ID NO: 2784123 - RNA, 22 nt, Leptospira interrogans serovar lai str. 56601
aagucacauuguguuuuuuaac

SEQ ID NO: 2784124 - RNA, 23 nt, Leptospira interrogans serovar lai str. 56601
aagucacauuguguuuuuuaaca

SEQ ID NO: 2784125 - RNA, 16 nt, Leptospira interrogans serovar lai str. 56601
aagucagguuuuauca

SEQ ID NO: 2784126 - RNA, 22 nt, Leptospira interrogans serovar lai str. 56601
aagucagguuuuaucaaauaaa

SEQ ID NO: 2784127 - RNA, 16 nt, Leptospira interrogans serovar lai str. 56601
aaguccaaaacaaagu

SEQ ID NO: 2784128 - RNA, 14 nt, Leptospira interrogans serovar lai str. 56601
aaguccaaaucaaa

SEQ ID NO: 2784129 - RNA, 13 nt, Leptospira interrogans serovar lai str. 56601
aaguccaaugaaa

SEQ ID NO: 2784130 - RNA, 20 nt, Leptospira interrogans serovar lai str. 56601
aaguccaauuuuaaaaccaa

SEQ ID NO: 2784131 - RNA, 13 nt, Leptospira interrogans serovar lai str. 56601
aaguccacccaaa

SEQ ID NO: 2784132 - RNA, 15 nt, Leptospira interrogans serovar lai str. 56601
aaguccacccaaacc

SEQ ID NO: 2784133 - RNA, 18 nt, Leptospira interrogans serovar lai str. 56601
aaguccacccaaaccgga

SEQ ID NO: 2784134 - RNA, 13 nt, Leptospira interrogans serovar lai str. 56601
aagucgaaagaau

SEQ ID NO: 2784135 - RNA, 15 nt, Leptospira interrogans serovar lai str. 56601
aagucgaaagaauuu

SEQ ID NO: 2784136 - RNA, 18 nt, Leptospira interrogans serovar lai str. 56601
aagucgaaagaauuuuug

SEQ ID NO: 2784137 - RNA, 14 nt, Leptospira interrogans serovar lai str. 56601
aagucgaauuuuuu

SEQ ID NO: 2784138 - RNA, 19 nt, Leptospira interrogans serovar lai str. 56601
aagucuauuucccaaaauu

SEQ ID NO: 2784139 - RNA, 22 nt, Leptospira interrogans serovar lai str. 56601
aagucugucuuaaaauuugaaa

SEQ ID NO: 2784140 - RNA, 12 nt, Leptospira interrogans serovar lai str. 56601
aagucuuuaaaa

SEQ ID NO: 2784141 - RNA, 19 nt, Leptospira interrogans serovar lai str. 56601
aagugaaccucuguaaaua

SEQ ID NO: 2784142 - RNA, 22 nt, Leptospira interrogans serovar lai str. 56601
aagugaagcgcuugaguugcuu

SEQ ID NO: 2784143 - RNA, 23 nt, Leptospira interrogans serovar lai str. 56601
aagugagauugaguuucacaaaa

SEQ ID NO: 2784144 - RNA, 19 nt, Leptospira interrogans serovar lai str. 56601
aagugaugaagagaaagua

SEQ ID NO: 2784145 - RNA, 14 nt, Leptospira interrogans serovar lai str. 56601
aagugaugaaguuu

SEQ ID NO: 2784146 - RNA, 22 nt, Leptospira interrogans serovar lai str. 56601
aagugauucauucuaagauuuu

SEQ ID NO: 2784147 - RNA, 14 nt, Leptospira interrogans serovar lai str. 56601
aagugcaauaucuu

SEQ ID NO: 2784148 - RNA, 20 nt, Leptospira interrogans serovar lai str. 56601
aaguggguuguuaugcaaau

SEQ ID NO: 2784149 - RNA, 17 nt, Leptospira interrogans serovar lai str. 56601
aaguguaaaauuaaaau

SEQ ID NO: 2784150 - RNA, 18 nt, Leptospira interrogans serovar lai str. 56601
aaguguaaaauuaaaauc

SEQ ID NO: 2784151 - RNA, 20 nt, Leptospira interrogans serovar lai str. 56601
aaguguaucccuuuggcaua

SEQ ID NO: 2784152 - RNA, 13 nt, Leptospira interrogans serovar lai str. 56601
aaguguaugaaaa

SEQ ID NO: 2784153 - RNA, 18 nt, Leptospira interrogans serovar lai str. 56601
aaguguggucuauuacaa

SEQ ID NO: 2784154 - RNA, 20 nt, Leptospira interrogans serovar lai str. 56601
aaguguggucuauuacaaaa

SEQ ID NO: 2784155 - RNA, 18 nt, Leptospira interrogans serovar lai str. 56601
aaguguuccgacaagaau

SEQ ID NO: 2784156 - RNA, 19 nt, Leptospira interrogans serovar lai str. 56601
aaguguuuauaauuuuuac

SEQ ID NO: 2784157 - RNA, 15 nt, Leptospira interrogans serovar lai str. 56601
aaguguuugcugagu

SEQ ID NO: 2784158 - RNA, 22 nt, Leptospira interrogans serovar lai str. 56601
aaguguuuuucacaaguuaaau

SEQ ID NO: 2784159 - RNA, 14 nt, Leptospira interrogans serovar lai str. 56601
aaguuaaaacauuu

SEQ ID NO: 2784160 - RNA, 13 nt, Leptospira interrogans serovar lai str. 56601
aaguuaagaguuu

SEQ ID NO: 2784161 - RNA, 14 nt, Leptospira interrogans serovar lai str. 56601
aaguuaauacaaaa

SEQ ID NO: 2784162 - RNA, 14 nt, Leptospira interrogans serovar lai str. 56601
aaguuaauagaguu

SEQ ID NO: 2784163 - RNA, 12 nt, Leptospira interrogans serovar lai str. 56601
aaguuaauucua

SEQ ID NO: 2784164 - RNA, 17 nt, Leptospira interrogans serovar lai str. 56601
aaguuacauuaugaauu

SEQ ID NO: 2784165 - RNA, 18 nt, Leptospira interrogans serovar lai str. 56601
aaguuacauuaugaauuu

SEQ ID NO: 2784166 - RNA, 14 nt, Leptospira interrogans serovar lai str. 56601
aaguuacucauuuc

SEQ ID NO: 2784167 - RNA, 17 nt, Leptospira interrogans serovar lai str. 56601
aaguuacuucccuucag

SEQ ID NO: 2784168 - RNA, 13 nt, Leptospira interrogans serovar lai str. 56601
aaguuagaauaua

SEQ ID NO: 2784169 - RNA, 18 nt, Leptospira interrogans serovar lai str. 56601
aaguuagaaucuaaacuu

SEQ ID NO: 2784170 - RNA, 17 nt, Leptospira interrogans serovar lai str. 56601
aaguuauauuagaguuu

SEQ ID NO: 2784171 - RNA, 21 nt, Leptospira interrogans serovar lai str. 56601
aaguuaucguccccacucguu

SEQ ID NO: 2784172 - RNA, 19 nt, Leptospira interrogans serovar lai str. 56601
aaguuccaacguaccaaaa

SEQ ID NO: 2784173 - RNA, 16 nt, Leptospira interrogans serovar lai str. 56601
aaguucgauuaaaaua

SEQ ID NO: 2784174 - RNA, 17 nt, Leptospira interrogans serovar lai str. 56601
aaguucgguguaaaaaa

SEQ ID NO: 2784175 - RNA, 14 nt, Leptospira interrogans serovar lai str. 56601
aaguucgucgucua

SEQ ID NO: 2784176 - RNA, 19 nt, Leptospira interrogans serovar lai str. 56601
aauaacaaaaaaugcucaa

SEQ ID NO: 2784177 - RNA, 19 nt, Leptospira interrogans serovar lai str. 56601
aauaacaugcaguaguucc

SEQ ID NO: 2784178 - RNA, 22 nt, Leptospira interrogans serovar lai str. 56601
aauaaccaaccccacaaguguu

SEQ ID NO: 2784179 - RNA, 14 nt, Leptospira interrogans serovar lai str. 56601
aauaacgugaguuu

SEQ ID NO: 2784180 - RNA, 16 nt, Leptospira interrogans serovar lai str. 56601
aauaacuuuacaaaaa

SEQ ID NO: 2784181 - RNA, 19 nt, Leptospira interrogans serovar lai str. 56601
aauaagaagccaauuccaa

SEQ ID NO: 2784182 - RNA, 20 nt, Leptospira interrogans serovar lai str. 56601
aauaagauuuguugaaaagu

SEQ ID NO: 2784183 - RNA, 15 nt, Leptospira interrogans serovar lai str. 56601
aauaagauuuuagaa

SEQ ID NO: 2784184 - RNA, 14 nt, Leptospira interrogans serovar lai str. 56601
aauaagcugaacaa

SEQ ID NO: 2784185 - RNA, 13 nt, Leptospira interrogans serovar lai str. 56601
aauaaguaaaucu

SEQ ID NO: 2784186 - RNA, 16 nt, Leptospira interrogans serovar lai str. 56601
aauaauaauauuuuua

SEQ ID NO: 2784187 - RNA, 20 nt, Leptospira interrogans serovar lai str. 56601
aauaauacagaauucauuuu

SEQ ID NO: 2784188 - RNA, 23 nt, Leptospira interrogans serovar lai str. 56601
aauaauacagaauucauuuuaca

SEQ ID NO: 2784189 - RNA, 23 nt, Leptospira interrogans serovar lai str. 56601
aauaauacauuggggaaguaauu

SEQ ID NO: 2784190 - RNA, 17 nt, Leptospira interrogans serovar lai str. 56601
aauaauaccaaguuauu

SEQ ID NO: 2784191 - RNA, 17 nt, Leptospira interrogans serovar lai str. 56601
aauaauauauuuauaaa

SEQ ID NO: 2784192 - RNA, 21 nt, Leptospira interrogans serovar lai str. 56601
aauaauauauuuauaaaacga

SEQ ID NO: 2784193 - RNA, 15 nt, Leptospira interrogans serovar lai str. 56601
aauaauaucaaaaug

SEQ ID NO: 2784194 - RNA, 16 nt, Leptospira interrogans serovar lai str. 56601
aauaauaugauguaaa

SEQ ID NO: 2784195 - RNA, 13 nt, Leptospira interrogans serovar lai str. 56601
aauaauauuauaa

SEQ ID NO: 2784196 - RNA, 13 nt, Leptospira interrogans serovar lai str. 56601
aauaauauuuuaa

SEQ ID NO: 2784197 - RNA, 14 nt, Leptospira interrogans serovar lai str. 56601
aauaauauuuuuau

SEQ ID NO: 2784198 - RNA, 15 nt, Leptospira interrogans serovar lai str. 56601
aauaaucgauuuuac

SEQ ID NO: 2784199 - RNA, 16 nt, Leptospira interrogans serovar lai str. 56601
aauaaucgauuuuaca

SEQ ID NO: 2784200 - RNA, 15 nt, Leptospira interrogans serovar lai str. 56601
aauaaucuuaaauau

SEQ ID NO: 2784201 - RNA, 15 nt, Leptospira interrogans serovar lai str. 56601
aauaaucuuaacuuu

SEQ ID NO: 2784202 - RNA, 20 nt, Leptospira interrogans serovar lai str. 56601
aauaaucuuaacuuuaagca

SEQ ID NO: 2784203 - RNA, 14 nt, Leptospira interrogans serovar lai str. 56601
aauaauguuuuuag

SEQ ID NO: 2784204 - RNA, 16 nt, Leptospira interrogans serovar lai str. 56601
aauaauuagaaaaaua

SEQ ID NO: 2784205 - RNA, 19 nt, Leptospira interrogans serovar lai str. 56601
aauaauuagaaaaauauuu

SEQ ID NO: 2784206 - RNA, 22 nt, Leptospira interrogans serovar lai str. 56601
aauaauuagcucuuguuaaaau

SEQ ID NO: 2784207 - RNA, 15 nt, Leptospira interrogans serovar lai str. 56601
aauaauucaaaauuu

SEQ ID NO: 2784208 - RNA, 12 nt, Leptospira interrogans serovar lai str. 56601
aauaauucuacg

SEQ ID NO: 2784209 - RNA, 14 nt, Leptospira interrogans serovar lai str. 56601
aauaauucuauuuu

SEQ ID NO: 2784210 - RNA, 22 nt, Leptospira interrogans serovar lai str. 56601
aauaauugauuagaguuaaauu

SEQ ID NO: 2784211 - RNA, 22 nt, Leptospira interrogans serovar lai str. 56601
aauaauuggaucucaauauaaa

SEQ ID NO: 2784212 - RNA, 18 nt, Leptospira interrogans serovar lai str. 56601
aauaauuucccauaaaaa

SEQ ID NO: 2784213 - RNA, 20 nt, Leptospira interrogans serovar lai str. 56601
aauaauuucccauaaaaaga

SEQ ID NO: 2784214 - RNA, 23 nt, Leptospira interrogans serovar lai str. 56601
aauacaaaaaauguuuaaagaau

SEQ ID NO: 2784215 - RNA, 20 nt, Leptospira interrogans serovar lai str. 56601
aauacaaaaacgauuauuag

SEQ ID NO: 2784216 - RNA, 11 nt, Leptospira interrogans serovar lai str. 56601
aauacaaaaag

SEQ ID NO: 2784217 - RNA, 15 nt, Leptospira interrogans serovar lai str. 56601
aauacaaaaagaaua

SEQ ID NO: 2784218 - RNA, 15 nt, Leptospira interrogans serovar lai str. 56601
aauacaaaacaagua

SEQ ID NO: 2784219 - RNA, 12 nt, Leptospira interrogans serovar lai str. 56601
aauacaaaacuu

SEQ ID NO: 2784220 - RNA, 17 nt, Leptospira interrogans serovar lai str. 56601
aauacaaaacuuaaauu

SEQ ID NO: 2784221 - RNA, 15 nt, Leptospira interrogans serovar lai str. 56601
aauacaaaaugaaug

SEQ ID NO: 2784222 - RNA, 21 nt, Leptospira interrogans serovar lai str. 56601
aauacaaaauuuuuuccuuua

SEQ ID NO: 2784223 - RNA, 18 nt, Leptospira interrogans serovar lai str. 56601
aauacaaaguauucuuuc

SEQ ID NO: 2784224 - RNA, 19 nt, Leptospira interrogans serovar lai str. 56601
aauacaaaguuuguaguaa

SEQ ID NO: 2784225 - RNA, 21 nt, Leptospira interrogans serovar lai str. 56601
aauacaaaguuuguaguaacu

SEQ ID NO: 2784226 - RNA, 18 nt, Leptospira interrogans serovar lai str. 56601
aauacaacgaaaacagau

SEQ ID NO: 2784227 - RNA, 17 nt, Leptospira interrogans serovar lai str. 56601
aauacaauaaaaacaga

SEQ ID NO: 2784228 - RNA, 18 nt, Leptospira interrogans serovar lai str. 56601
aauacaauaaaaacagau

SEQ ID NO: 2784229 - RNA, 17 nt, Leptospira interrogans serovar lai str. 56601
aauacaauugauuuaaa

SEQ ID NO: 2784230 - RNA, 18 nt, Leptospira interrogans serovar lai str. 56601
aauacaauugauuuaaaa

SEQ ID NO: 2784231 - RNA, 17 nt, Leptospira interrogans serovar lai str. 56601
aauacacggagauaaaa

SEQ ID NO: 2784232 - RNA, 18 nt, Leptospira interrogans serovar lai str. 56601
aauacacggagauaaaaa

SEQ ID NO: 2784233 - RNA, 23 nt, Leptospira interrogans serovar lai str. 56601
aauacacucuuucaauguuuuuc

SEQ ID NO: 2784234 - RNA, 14 nt, Leptospira interrogans serovar lai str. 56601
aauacaucucuuuu

SEQ ID NO: 2784235 - RNA, 16 nt, Leptospira interrogans serovar lai str. 56601
aauacaucucuuuuuu

SEQ ID NO: 2784236 - RNA, 24 nt, Leptospira interrogans serovar lai str. 56601
aauacaucucuuuuuuaaagccuc

SEQ ID NO: 2784237 - RNA, 19 nt, Leptospira interrogans serovar lai str. 56601
aauacauuaagauuauauu

SEQ ID NO: 2784238 - RNA, 13 nt, Leptospira interrogans serovar lai str. 56601
aauacauuuaaac

SEQ ID NO: 2784239 - RNA, 12 nt, Leptospira interrogans serovar lai str. 56601
aauacauuuuag

SEQ ID NO: 2784240 - RNA, 19 nt, Leptospira interrogans serovar lai str. 56601
aauaccgcacuuuuuuuag

SEQ ID NO: 2784241 - RNA, 22 nt, Leptospira interrogans serovar lai str. 56601
aauaccuaauucucuucguuuu

SEQ ID NO: 2784242 - RNA, 21 nt, Leptospira interrogans serovar lai str. 56601
aauaccugcaaccgaagaauc

SEQ ID NO: 2784243 - RNA, 23 nt, Leptospira interrogans serovar lai str. 56601
aauacgacagauucaauuuuuau

SEQ ID NO: 2784244 - RNA, 21 nt, Leptospira interrogans serovar lai str. 56601
aauacgaucuaauuuguaaga

SEQ ID NO: 2784245 - RNA, 23 nt, Leptospira interrogans serovar lai str. 56601
aauacgauucgaaagauuuuuca

SEQ ID NO: 2784246 - RNA, 21 nt, Leptospira interrogans serovar lai str. 56601
aauacguuuacuccaauuuua

SEQ ID NO: 2784247 - RNA, 22 nt, Leptospira interrogans serovar lai str. 56601
aauacucgaaaccauacaauaa

SEQ ID NO: 2784248 - RNA, 15 nt, Leptospira interrogans serovar lai str. 56601
aauacucuaauuuuu

SEQ ID NO: 2784249 - RNA, 18 nt, Leptospira interrogans serovar lai str. 56601
aauacucuaauuuuuuau

SEQ ID NO: 2784250 - RNA, 13 nt, Leptospira interrogans serovar lai str. 56601
aauacuguuaauu

SEQ ID NO: 2784251 - RNA, 16 nt, Leptospira interrogans serovar lai str. 56601
aauacuguuaauuuuu

SEQ ID NO: 2784252 - RNA, 18 nt, Leptospira interrogans serovar lai str. 56601
aauacuuagaauuuuuuc

SEQ ID NO: 2784253 - RNA, 19 nt, Leptospira interrogans serovar lai str. 56601
aauacuugccguuacauaa

SEQ ID NO: 2784254 - RNA, 11 nt, Leptospira interrogans serovar lai str. 56601
aauacuuuacc

SEQ ID NO: 2784255 - RNA, 21 nt, Leptospira interrogans serovar lai str. 56601
aauacuuuaccgucaauuuuu

SEQ ID NO: 2784256 - RNA, 23 nt, Leptospira interrogans serovar lai str. 56601
aauacuuuuagaaaauuagaaag

SEQ ID NO: 2784257 - RNA, 13 nt, Leptospira interrogans serovar lai str. 56601
aauacuuuucuuc

SEQ ID NO: 2784258 - RNA, 14 nt, Leptospira interrogans serovar lai str. 56601
aauagaaaagcaua

SEQ ID NO: 2784259 - RNA, 18 nt, Leptospira interrogans serovar lai str. 56601
aauauauucaaaagauug

SEQ ID NO: 2784260 - RNA, 15 nt, Leptospira interrogans serovar lai str. 56601
aauauauucaauuuc

SEQ ID NO: 2784261 - RNA, 23 nt, Leptospira interrogans serovar lai str. 56601
aauauauucuuuucugaauaaaa

SEQ ID NO: 2784262 - RNA, 19 nt, Leptospira interrogans serovar lai str. 56601
aauauauuuauaaaacgaa

SEQ ID NO: 2784263 - RNA, 22 nt, Leptospira interrogans serovar lai str. 56601
aauauauuuucaggcauagaau

SEQ ID NO: 2784264 - RNA, 22 nt, Leptospira interrogans serovar lai str. 56601
aauaucaaugaucauauccgaa

SEQ ID NO: 2784265 - RNA, 16 nt, Leptospira interrogans serovar lai str. 56601
aauaucagaucuauuu

SEQ ID NO: 2784266 - RNA, 14 nt, Leptospira interrogans serovar lai str. 56601
aauaucauaaauuu

SEQ ID NO: 2784267 - RNA, 15 nt, Leptospira interrogans serovar lai str. 56601
aauaucauaacaaau

SEQ ID NO: 2784268 - RNA, 17 nt, Leptospira interrogans serovar lai str. 56601
aauauccguaaaaccuc

SEQ ID NO: 2784269 - RNA, 15 nt, Leptospira interrogans serovar lai str. 56601
aauaucguucuagaa

SEQ ID NO: 2784270 - RNA, 14 nt, Leptospira interrogans serovar lai str. 56601
aauaucuaaaaccu

SEQ ID NO: 2784271 - RNA, 15 nt, Leptospira interrogans serovar lai str. 56601
aauaucuaaucuuuu

SEQ ID NO: 2784272 - RNA, 22 nt, Leptospira interrogans serovar lai str. 56601
aauaucuacuuuauuucggauc

SEQ ID NO: 2784273 - RNA, 17 nt, Leptospira interrogans serovar lai str. 56601
aauaucuccaaaaucau

SEQ ID NO: 2784274 - RNA, 17 nt, Leptospira interrogans serovar lai str. 56601
aauaucugaauuuuuau

SEQ ID NO: 2784275 - RNA, 18 nt, Leptospira interrogans serovar lai str. 56601
aauaucugccuucuuuuu

SEQ ID NO: 2784276 - RNA, 16 nt, Leptospira interrogans serovar lai str. 56601
aauaucuuaagaauug

SEQ ID NO: 2784277 - RNA, 18 nt, Leptospira interrogans serovar lai str. 56601
aauaucuuaauauaauaa

SEQ ID NO: 2784278 - RNA, 15 nt, Leptospira interrogans serovar lai str. 56601
aauaugaauuuuuaa

SEQ ID NO: 2784279 - RNA, 19 nt, Leptospira interrogans serovar lai str. 56601
aauaugagugaauggagcu

SEQ ID NO: 2784280 - RNA, 21 nt, Leptospira interrogans serovar lai str. 56601
aauaugauguaaauuugcuuu

SEQ ID NO: 2784281 - RNA, 12 nt, Leptospira interrogans serovar lai str. 56601
aauauuaaaaaa

SEQ ID NO: 2784282 - RNA, 20 nt, Leptospira interrogans serovar lai str. 56601
aauauuaaaaaaauaauaua

SEQ ID NO: 2784283 - RNA, 13 nt, Leptospira interrogans serovar lai str. 56601
aauauuaaaaaca

SEQ ID NO: 2784284 - RNA, 14 nt, Leptospira interrogans serovar lai str. 56601
aauauuaaaacacu

SEQ ID NO: 2784285 - RNA, 15 nt, Leptospira interrogans serovar lai str. 56601
aauauuaaaacacuu

SEQ ID NO: 2784286 - RNA, 13 nt, Leptospira interrogans serovar lai str. 56601
aauauuaaauuuu

SEQ ID NO: 2784287 - RNA, 20 nt, Leptospira interrogans serovar lai str. 56601
aauauuaaauuuuauuuaua

SEQ ID NO: 2784288 - RNA, 21 nt, Leptospira interrogans serovar lai str. 56601
aauauuaaauuuuauuuauau

SEQ ID NO: 2784289 - RNA, 23 nt, Leptospira interrogans serovar lai str. 56601
aauauuaaguuuuuuaaauuuac

SEQ ID NO: 2784290 - RNA, 15 nt, Leptospira interrogans serovar lai str. 56601
aauauuaauuauaug

SEQ ID NO: 2784291 - RNA, 13 nt, Leptospira interrogans serovar lai str. 56601
aauauuagaauug

SEQ ID NO: 2784292 - RNA, 16 nt, Leptospira interrogans serovar lai str. 56601
aauauuauaaauuuaa

SEQ ID NO: 2784293 - RNA, 21 nt, Leptospira interrogans serovar lai str. 56601
aauauuauaaauuuaaaaaac

SEQ ID NO: 2784294 - RNA, 21 nt, Leptospira interrogans serovar lai str. 56601
aauauuauauuuuuaaaaagu

SEQ ID NO: 2784295 - RNA, 22 nt, Leptospira interrogans serovar lai str. 56601
aauauuauauuuuuaaaaagua

SEQ ID NO: 2784296 - RNA, 15 nt, Leptospira interrogans serovar lai str. 56601
aauauuaugaaauaa

SEQ ID NO: 2784297 - RNA, 19 nt, Leptospira interrogans serovar lai str. 56601
aauauuauuuuaacuugag

SEQ ID NO: 2784298 - RNA, 14 nt, Leptospira interrogans serovar lai str. 56601
aauauucaacuuuu

SEQ ID NO: 2784299 - RNA, 22 nt, Leptospira interrogans serovar lai str. 56601
aauauucaacuuuuugaagaaa

SEQ ID NO: 2784300 - RNA, 13 nt, Leptospira interrogans serovar lai str. 56601
aauauucacuuuu

SEQ ID NO: 2784301 - RNA, 17 nt, Leptospira interrogans serovar lai str. 56601
aauauucgaucaaguaa

SEQ ID NO: 2784302 - RNA, 17 nt, Leptospira interrogans serovar lai str. 56601
aauauucuaauuuuaua

SEQ ID NO: 2784303 - RNA, 17 nt, Leptospira interrogans serovar lai str. 56601
aauauucuaauuuuuau

SEQ ID NO: 2784304 - RNA, 12 nt, Leptospira interrogans serovar lai str. 56601
aauauucuuuua

SEQ ID NO: 2784305 - RNA, 20 nt, Leptospira interrogans serovar lai str. 56601
aauauugagcuaauucuuaa

SEQ ID NO: 2784306 - RNA, 11 nt, Leptospira interrogans serovar lai str. 56601
aauauuuaaaa

SEQ ID NO: 2784307 - RNA, 23 nt, Leptospira interrogans serovar lai str. 56601
aauauuuaguauuuuauuauaua

SEQ ID NO: 2784308 - RNA, 17 nt, Leptospira interrogans serovar lai str. 56601
aauauuuauaaaacaau

SEQ ID NO: 2784309 - RNA, 13 nt, Leptospira interrogans serovar lai str. 56601
aauauuucaaaaa

SEQ ID NO: 2784310 - RNA, 15 nt, Leptospira interrogans serovar lai str. 56601
aauauuucaaaaauu

SEQ ID NO: 2784311 - RNA, 17 nt, Leptospira interrogans serovar lai str. 56601
aauauuucaaaaauuuu

SEQ ID NO: 2784312 - RNA, 18 nt, Leptospira interrogans serovar lai str. 56601
aauauuuccaaauuguau

SEQ ID NO: 2784313 - RNA, 14 nt, Leptospira interrogans serovar lai str. 56601
aauauuucuaaaau

SEQ ID NO: 2784314 - RNA, 21 nt, Leptospira interrogans serovar lai str. 56601
aauauuucuucguuauuuuua

SEQ ID NO: 2784315 - RNA, 18 nt, Leptospira interrogans serovar lai str. 56601
aauauuugcauaaacuuc

SEQ ID NO: 2784316 - RNA, 18 nt, Leptospira interrogans serovar lai str. 56601
aauauuuuaaagaaacuc

SEQ ID NO: 2784317 - RNA, 15 nt, Leptospira interrogans serovar lai str. 56601
aauauuuuccaaaaa

SEQ ID NO: 2784318 - RNA, 17 nt, Leptospira interrogans serovar lai str. 56601
aauauuuuccaaaaauu

SEQ ID NO: 2784319 - RNA, 16 nt, Leptospira interrogans serovar lai str. 56601
aauauuuucucaguaa

SEQ ID NO: 2784320 - RNA, 11 nt, Leptospira interrogans serovar lai str. 56601
aauauuuuuaa

SEQ ID NO: 2784321 - RNA, 21 nt, Leptospira interrogans serovar lai str. 56601
aauauuuuuauguauuuuaaa

SEQ ID NO: 2784322 - RNA, 13 nt, Leptospira interrogans serovar lai str. 56601
aauauuuuuucca

SEQ ID NO: 2784323 - RNA, 17 nt, Leptospira interrogans serovar lai str. 56601
aauauuuuuuccaaaaa

SEQ ID NO: 2784324 - RNA, 22 nt, Leptospira interrogans serovar lai str. 56601
aauauuuuuuccaaaaagaaaa

SEQ ID NO: 2784325 - RNA, 23 nt, Leptospira interrogans serovar lai str. 56601
aauauuuuuuccaaaaagaaaaa

SEQ ID NO: 2784326 - RNA, 13 nt, Leptospira interrogans serovar lai str. 56601
aaucaaaaaaguc

SEQ ID NO: 2784327 - RNA, 17 nt, Leptospira interrogans serovar lai str. 56601
aaucaaaaggaauacaa

SEQ ID NO: 2784328 - RNA, 14 nt, Leptospira interrogans serovar lai str. 56601
aaucaaaaugaacu

SEQ ID NO: 2784329 - RNA, 14 nt, Leptospira interrogans serovar lai str. 56601
aaucaaaauuuuuu

SEQ ID NO: 2784330 - RNA, 24 nt, Leptospira interrogans serovar lai str. 56601
aaucaaagauauuucaauauaaaa

SEQ ID NO: 2784331 - RNA, 17 nt, Leptospira interrogans serovar lai str. 56601
aaucaaaggaaauaaaa

SEQ ID NO: 2784332 - RNA, 16 nt, Leptospira interrogans serovar lai str. 56601
aaucaaauacaaaaac

SEQ ID NO: 2784333 - RNA, 14 nt, Leptospira interrogans serovar lai str. 56601
aaucaaauauacaa

SEQ ID NO: 2784334 - RNA, 24 nt, Leptospira interrogans serovar lai str. 56601
aaucaaauuuauaugauuuuauac

SEQ ID NO: 2784335 - RNA, 20 nt, Leptospira interrogans serovar lai str. 56601
aaucaaauuucugcaucaaa

SEQ ID NO: 2784336 - RNA, 13 nt, Leptospira interrogans serovar lai str. 56601
aaucaaauuuuug

SEQ ID NO: 2784337 - RNA, 14 nt, Leptospira interrogans serovar lai str. 56601
aaucaaauuuuugc

SEQ ID NO: 2784338 - RNA, 13 nt, Leptospira interrogans serovar lai str. 56601
aaucaacuuuucc

SEQ ID NO: 2784339 - RNA, 18 nt, Leptospira interrogans serovar lai str. 56601
aaucaagagaacucauua

SEQ ID NO: 2784340 - RNA, 14 nt, Leptospira interrogans serovar lai str. 56601
aaucaauuuuaaau

SEQ ID NO: 2784341 - RNA, 16 nt, Leptospira interrogans serovar lai str. 56601
aaucacaaaaaagaua

SEQ ID NO: 2784342 - RNA, 18 nt, Leptospira interrogans serovar lai str. 56601
aaucgauuucuaaauugu

SEQ ID NO: 2784343 - RNA, 21 nt, Leptospira interrogans serovar lai str. 56601
aaucgauuucuaaauugugag

SEQ ID NO: 2784344 - RNA, 15 nt, Leptospira interrogans serovar lai str. 56601
aaucgauuuguaaaa

SEQ ID NO: 2784345 - RNA, 19 nt, Leptospira interrogans serovar lai str. 56601
aaucgauuuguaaaauuca

SEQ ID NO: 2784346 - RNA, 20 nt, Leptospira interrogans serovar lai str. 56601
aaucgauuuguaaaauucag

SEQ ID NO: 2784347 - RNA, 23 nt, Leptospira interrogans serovar lai str. 56601
aaucgccgcuauggaauuuuuca

SEQ ID NO: 2784348 - RNA, 15 nt, Leptospira interrogans serovar lai str. 56601
aaucgccucuugaag

SEQ ID NO: 2784349 - RNA, 20 nt, Leptospira interrogans serovar lai str. 56601
aaucgccucuugaagccuuc

SEQ ID NO: 2784350 - RNA, 23 nt, Leptospira interrogans serovar lai str. 56601
aaucgcugguuuuauuucugcug

SEQ ID NO: 2784351 - RNA, 23 nt, Leptospira interrogans serovar lai str. 56601
aaucggaacuagggaauuuuuca

SEQ ID NO: 2784352 - RNA, 15 nt, Leptospira interrogans serovar lai str. 56601
aaucggaauuuuaau

SEQ ID NO: 2784353 - RNA, 13 nt, Leptospira interrogans serovar lai str. 56601
aaucggguaaaaa

SEQ ID NO: 2784354 - RNA, 19 nt, Leptospira interrogans serovar lai str. 56601
aaucguaaaaaaauauuuc

SEQ ID NO: 2784355 - RNA, 15 nt, Leptospira interrogans serovar lai str. 56601
aaucguaaaaaagau

SEQ ID NO: 2784356 - RNA, 17 nt, Leptospira interrogans serovar lai str. 56601
aaucguaggcacgugga

SEQ ID NO: 2784357 - RNA, 18 nt, Leptospira interrogans serovar lai str. 56601
aaucgucgcucaaucaaa

SEQ ID NO: 2784358 - RNA, 20 nt, Leptospira interrogans serovar lai str. 56601
aaucguguuugagauuaaaa

SEQ ID NO: 2784359 - RNA, 21 nt, Leptospira interrogans serovar lai str. 56601
aaucguguuugagauuaaaaa

SEQ ID NO: 2784360 - RNA, 17 nt, Leptospira interrogans serovar lai str. 56601
aaucguuuaaagauuaa

SEQ ID NO: 2784361 - RNA, 22 nt, Leptospira interrogans serovar lai str. 56601
aaucguuuuuuguauucugaug

SEQ ID NO: 2784362 - RNA, 15 nt, Leptospira interrogans serovar lai str. 56601
aaucuaaaaaaacaa

SEQ ID NO: 2784363 - RNA, 18 nt, Leptospira interrogans serovar lai str. 56601
aaucuaaacuuacagauu

SEQ ID NO: 2784364 - RNA, 15 nt, Leptospira interrogans serovar lai str. 56601
aaucuaaacuuugua

SEQ ID NO: 2784365 - RNA, 12 nt, Leptospira interrogans serovar lai str. 56601
aaucuaacugua

SEQ ID NO: 2784366 - RNA, 16 nt, Leptospira interrogans serovar lai str. 56601
aaucuaagaagagguu

SEQ ID NO: 2784367 - RNA, 15 nt, Leptospira interrogans serovar lai str. 56601
aaucuaagacgaaaa

SEQ ID NO: 2784368 - RNA, 22 nt, Leptospira interrogans serovar lai str. 56601
aaucuaagaucaacacaaauau

SEQ ID NO: 2784369 - RNA, 11 nt, Leptospira interrogans serovar lai str. 56601
aaucuacaaaa

SEQ ID NO: 2784370 - RNA, 18 nt, Leptospira interrogans serovar lai str. 56601
aaucuacaaaacuuuacg

SEQ ID NO: 2784371 - RNA, 23 nt, Leptospira interrogans serovar lai str. 56601
aaucuacaaaacuuuacgaguuu

SEQ ID NO: 2784372 - RNA, 15 nt, Leptospira interrogans serovar lai str. 56601
aaucuacuuguaucu

SEQ ID NO: 2784373 - RNA, 19 nt, Leptospira interrogans serovar lai str. 56601
aaucuaggauauuugauau

SEQ ID NO: 2784374 - RNA, 23 nt, Leptospira interrogans serovar lai str. 56601
aaucuaguuuauaugaguuccca

SEQ ID NO: 2784375 - RNA, 15 nt, Leptospira interrogans serovar lai str. 56601
aaucuauauuuuaca

SEQ ID NO: 2784376 - RNA, 17 nt, Leptospira interrogans serovar lai str. 56601
aaucuaucucaaaauac

SEQ ID NO: 2784377 - RNA, 21 nt, Leptospira interrogans serovar lai str. 56601
aaucuaucucaaaauacuuua

SEQ ID NO: 2784378 - RNA, 17 nt, Leptospira interrogans serovar lai str. 56601
aaucuauucuuaaaaug

SEQ ID NO: 2784379 - RNA, 20 nt, Leptospira interrogans serovar lai str. 56601
aaucuauuguaauaaaucga

SEQ ID NO: 2784380 - RNA, 16 nt, Leptospira interrogans serovar lai str. 56601
aaucuauuuuugauuu

SEQ ID NO: 2784381 - RNA, 20 nt, Leptospira interrogans serovar lai str. 56601
aaucuauuuuugauuuuaga

SEQ ID NO: 2784382 - RNA, 22 nt, Leptospira interrogans serovar lai str. 56601
aaucucacgguucgguggaaac

SEQ ID NO: 2784383 - RNA, 12 nt, Leptospira interrogans serovar lai str. 56601
aaucuccacuau

SEQ ID NO: 2784384 - RNA, 14 nt, Leptospira interrogans serovar lai str. 56601
aaucuccauuauag

SEQ ID NO: 2784385 - RNA, 19 nt, Leptospira interrogans serovar lai str. 56601
aaucuccgcucuauuucca

SEQ ID NO: 2784386 - RNA, 19 nt, Leptospira interrogans serovar lai str. 56601
aaucucguuaaauuuucgu

SEQ ID NO: 2784387 - RNA, 12 nt, Leptospira interrogans serovar lai str. 56601
aaucucuuaauc

SEQ ID NO: 2784388 - RNA, 14 nt, Leptospira interrogans serovar lai str. 56601
aaucugaaaaagag

SEQ ID NO: 2784389 - RNA, 13 nt, Leptospira interrogans serovar lai str. 56601
aaucugaaauuca

SEQ ID NO: 2784390 - RNA, 19 nt, Leptospira interrogans serovar lai str. 56601
aaucugaaauucaucaaau

SEQ ID NO: 2784391 - RNA, 17 nt, Leptospira interrogans serovar lai str. 56601
aaucugaacauaaaauc

SEQ ID NO: 2784392 - RNA, 14 nt, Leptospira interrogans serovar lai str. 56601
aaucugaacuuuau

SEQ ID NO: 2784393 - RNA, 15 nt, Leptospira interrogans serovar lai str. 56601
aaucugaauuuuaag

SEQ ID NO: 2784394 - RNA, 16 nt, Leptospira interrogans serovar lai str. 56601
aaucugauugagaaaa

SEQ ID NO: 2784395 - RNA, 18 nt, Leptospira interrogans serovar lai str. 56601
aaucugccccaaaauuua

SEQ ID NO: 2784396 - RNA, 16 nt, Leptospira interrogans serovar lai str. 56601
aaucugggcaaauuua

SEQ ID NO: 2784397 - RNA, 15 nt, Leptospira interrogans serovar lai str. 56601
aaucuguaaaucaac

SEQ ID NO: 2784398 - RNA, 19 nt, Leptospira interrogans serovar lai str. 56601
aaucuguggacuuaugaga

SEQ ID NO: 2784399 - RNA, 22 nt, Leptospira interrogans serovar lai str. 56601
aaucugugggaacuaccacaaa

SEQ ID NO: 2784400 - RNA, 20 nt, Leptospira interrogans serovar lai str. 56601
aaucugugggaacucucaca

SEQ ID NO: 2784401 - RNA, 22 nt, Leptospira interrogans serovar lai str. 56601
aaucugugggaacucucacaaa

SEQ ID NO: 2784402 - RNA, 23 nt, Leptospira interrogans serovar lai str. 56601
aaucuguuuagaauauuuucuca

SEQ ID NO: 2784403 - RNA, 18 nt, Leptospira interrogans serovar lai str. 56601
aaucuuaaaagaaaauca

SEQ ID NO: 2784404 - RNA, 17 nt, Leptospira interrogans serovar lai str. 56601
aaucuuaaaucuuuaaa

SEQ ID NO: 2784405 - RNA, 20 nt, Leptospira interrogans serovar lai str. 56601
aaucuuaaaucuuuaaaaua

SEQ ID NO: 2784406 - RNA, 17 nt, Leptospira interrogans serovar lai str. 56601
aaucuuaauauuucucu

SEQ ID NO: 2784407 - RNA, 17 nt, Leptospira interrogans serovar lai str. 56601
aaucuuagaauguggga

SEQ ID NO: 2784408 - RNA, 16 nt, Leptospira interrogans serovar lai str. 56601
aaucuuaggacggauu

SEQ ID NO: 2784409 - RNA, 20 nt, Leptospira interrogans serovar lai str. 56601
aaucuuaggcaucauucuuu

SEQ ID NO: 2784410 - RNA, 12 nt, Leptospira interrogans serovar lai str. 56601
aaucuucaaguu

SEQ ID NO: 2784411 - RNA, 16 nt, Leptospira interrogans serovar lai str. 56601
aaucuuccgcauuuuu

SEQ ID NO: 2784412 - RNA, 19 nt, Leptospira interrogans serovar lai str. 56601
aaucuugggguuuuuguaa

SEQ ID NO: 2784413 - RNA, 23 nt, Leptospira interrogans serovar lai str. 56601
aaucuuuauagguuucuucgccu

SEQ ID NO: 2784414 - RNA, 16 nt, Leptospira interrogans serovar lai str. 56601
aaucuuuguaugaguu

SEQ ID NO: 2784415 - RNA, 17 nt, Leptospira interrogans serovar lai str. 56601
aaucuuuguaugaguuc

SEQ ID NO: 2784416 - RNA, 14 nt, Leptospira interrogans serovar lai str. 56601
aaucuuuuaaaaaa

SEQ ID NO: 2784417 - RNA, 16 nt, Leptospira interrogans serovar lai str. 56601
aaucuuuucuauaauc

SEQ ID NO: 2784418 - RNA, 23 nt, Leptospira interrogans serovar lai str. 56601
aaucuuuucuauaaucugaaaua

SEQ ID NO: 2784419 - RNA, 17 nt, Leptospira interrogans serovar lai str. 56601
aaucuuuuuaaaaguuu

SEQ ID NO: 2784420 - RNA, 16 nt, Leptospira interrogans serovar lai str. 56601
aaugaaaaaaaacaaa

SEQ ID NO: 2784421 - RNA, 15 nt, Leptospira interrogans serovar lai str. 56601
aaugaaaaagaaacg

SEQ ID NO: 2784422 - RNA, 18 nt, Leptospira interrogans serovar lai str. 56601
aaugaaaacgaugucuuu

SEQ ID NO: 2784423 - RNA, 19 nt, Leptospira interrogans serovar lai str. 56601
aaugaaaacuuguuuuaga

SEQ ID NO: 2784424 - RNA, 16 nt, Leptospira interrogans serovar lai str. 56601
aaugaaaagauuucaa

SEQ ID NO: 2784425 - RNA, 16 nt, Leptospira interrogans serovar lai str. 56601
aauguccgaaauuuuu

SEQ ID NO: 2784426 - RNA, 16 nt, Leptospira interrogans serovar lai str. 56601
aaugucguuaaauuuu

SEQ ID NO: 2784427 - RNA, 22 nt, Leptospira interrogans serovar lai str. 56601
aaugugagagaggauacuauac

SEQ ID NO: 2784428 - RNA, 15 nt, Leptospira interrogans serovar lai str. 56601
aaugugccuuuuuga

SEQ ID NO: 2784429 - RNA, 22 nt, Leptospira interrogans serovar lai str. 56601
aauguggaacucuauauaaaga

SEQ ID NO: 2784430 - RNA, 14 nt, Leptospira interrogans serovar lai str. 56601
aaugugggaacuac

SEQ ID NO: 2784431 - RNA, 21 nt, Leptospira interrogans serovar lai str. 56601
aaugugggaacuaccaccaaa

SEQ ID NO: 2784432 - RNA, 22 nt, Leptospira interrogans serovar lai str. 56601
aaugugggaacuacuacaaauc

SEQ ID NO: 2784433 - RNA, 16 nt, Leptospira interrogans serovar lai str. 56601
aaugugggaacuacuc

SEQ ID NO: 2784434 - RNA, 15 nt, Leptospira interrogans serovar lai str. 56601
aauguuaaaaaacua

SEQ ID NO: 2784435 - RNA, 19 nt, Leptospira interrogans serovar lai str. 56601
aauguuaaaaaacuauaaa

SEQ ID NO: 2784436 - RNA, 15 nt, Leptospira interrogans serovar lai str. 56601
aauguuaauuuagaa

SEQ ID NO: 2784437 - RNA, 20 nt, Leptospira interrogans serovar lai str. 56601
aauguuaauuuagaauaaaa

SEQ ID NO: 2784438 - RNA, 21 nt, Leptospira interrogans serovar lai str. 56601
aauguuaauuuagaauaaaaa

SEQ ID NO: 2784439 - RNA, 15 nt, Leptospira interrogans serovar lai str. 56601
aauguuauaaaaugu

SEQ ID NO: 2784440 - RNA, 14 nt, Leptospira interrogans serovar lai str. 56601
aauguuauuuugua

SEQ ID NO: 2784441 - RNA, 16 nt, Leptospira interrogans serovar lai str. 56601
aauguuauuuuguaua

SEQ ID NO: 2784442 - RNA, 17 nt, Leptospira interrogans serovar lai str. 56601
aauguuauuuuguauaa

SEQ ID NO: 2784443 - RNA, 20 nt, Leptospira interrogans serovar lai str. 56601
aauguuauuuuguauaaagu

SEQ ID NO: 2784444 - RNA, 14 nt, Leptospira interrogans serovar lai str. 56601
aauguuauuuuugc

SEQ ID NO: 2784445 - RNA, 22 nt, Leptospira interrogans serovar lai str. 56601
aauguuccaaagccaaggauaa

SEQ ID NO: 2784446 - RNA, 16 nt, Leptospira interrogans serovar lai str. 56601
aauguuuucuacaaau

SEQ ID NO: 2784447 - RNA, 10 nt, Leptospira interrogans serovar lai str. 56601
aauuaaaaaa

SEQ ID NO: 2784448 - RNA, 11 nt, Leptospira interrogans serovar lai str. 56601
aauuaaaaaac

SEQ ID NO: 2784449 - RNA, 13 nt, Leptospira interrogans serovar lai str. 56601
aauuaaaaaacuu

SEQ ID NO: 2784450 - RNA, 17 nt, Leptospira interrogans serovar lai str. 56601
aauuaaaaaagagaaag

SEQ ID NO: 2784451 - RNA, 18 nt, Leptospira interrogans serovar lai str. 56601
aauuaaaaaagagaaaga

SEQ ID NO: 2784452 - RNA, 21 nt, Leptospira interrogans serovar lai str. 56601
aauuaaaaaagagaaagaaaa

SEQ ID NO: 2784453 - RNA, 23 nt, Leptospira interrogans serovar lai str. 56601
aauuaaaaaagagaaagaaaaag

SEQ ID NO: 2784454 - RNA, 12 nt, Leptospira interrogans serovar lai str. 56601
aauuaaaaagau

SEQ ID NO: 2784455 - RNA, 14 nt, Leptospira interrogans serovar lai str. 56601
aauuaaaaagauag

SEQ ID NO: 2784456 - RNA, 11 nt, Leptospira interrogans serovar lai str. 56601
aauuaaaaauu

SEQ ID NO: 2784457 - RNA, 15 nt, Leptospira interrogans serovar lai str. 56601
aauuaaacaaagaau

SEQ ID NO: 2784458 - RNA, 17 nt, Leptospira interrogans serovar lai str. 56601
aauuaaacaaagaauaa

SEQ ID NO: 2784459 - RNA, 20 nt, Leptospira interrogans serovar lai str. 56601
aauuaaacuucaaaaaauau

SEQ ID NO: 2784460 - RNA, 16 nt, Leptospira interrogans serovar lai str. 56601
aauuaaacuuuuauaa

SEQ ID NO: 2784461 - RNA, 20 nt, Leptospira interrogans serovar lai str. 56601
aauuaaacuuuuauaaaauc

SEQ ID NO: 2784462 - RNA, 13 nt, Leptospira interrogans serovar lai str. 56601
aauuaaagaagag

SEQ ID NO: 2784463 - RNA, 19 nt, Leptospira interrogans serovar lai str. 56601
aauuaaaguaaauucgauc

SEQ ID NO: 2784464 - RNA, 22 nt, Leptospira interrogans serovar lai str. 56601
aauuaaauucuacauuugauau

SEQ ID NO: 2784465 - RNA, 21 nt, Leptospira interrogans serovar lai str. 56601
aauuaacgguacucaauuuua

SEQ ID NO: 2784466 - RNA, 18 nt, Leptospira interrogans serovar lai str. 56601
aauuaacggucaauuuua

SEQ ID NO: 2784467 - RNA, 23 nt, Leptospira interrogans serovar lai str. 56601
aauuaagcagaagcuuuauuaaa

SEQ ID NO: 2784468 - RNA, 22 nt, Leptospira interrogans serovar lai str. 56601
aauuaagcauuauaaguuuuua

SEQ ID NO: 2784469 - RNA, 14 nt, Leptospira interrogans serovar lai str. 56601
aauuaaguuacauu

SEQ ID NO: 2784470 - RNA, 16 nt, Leptospira interrogans serovar lai str. 56601
aauuaauauuuauaaa

SEQ ID NO: 2784471 - RNA, 17 nt, Leptospira interrogans serovar lai str. 56601
aauuaauauuuauaaua

SEQ ID NO: 2784472 - RNA, 16 nt, Leptospira interrogans serovar lai str. 56601
aauuaaucuguaaagu

SEQ ID NO: 2784473 - RNA, 20 nt, Leptospira interrogans serovar lai str. 56601
aauuaaucuguaaaguuuag

SEQ ID NO: 2784474 - RNA, 14 nt, Leptospira interrogans serovar lai str. 56601
aauuaauucagcau

SEQ ID NO: 2784475 - RNA, 21 nt, Leptospira interrogans serovar lai str. 56601
aauuaauucuccaucuauuuu

SEQ ID NO: 2784476 - RNA, 15 nt, Leptospira interrogans serovar lai str. 56601
aauuaauuuuuuaaa

SEQ ID NO: 2784477 - RNA, 18 nt, Leptospira interrogans serovar lai str. 56601
aauuacaauugauuauag

SEQ ID NO: 2784478 - RNA, 19 nt, Leptospira interrogans serovar lai str. 56601
aauuacacggccaacaucg

SEQ ID NO: 2784479 - RNA, 16 nt, Leptospira interrogans serovar lai str. 56601
aauuacaguuaauaaa

SEQ ID NO: 2784480 - RNA, 18 nt, Leptospira interrogans serovar lai str. 56601
aauuacaguuaauaaauu

SEQ ID NO: 2784481 - RNA, 21 nt, Leptospira interrogans serovar lai str. 56601
aauuacgaaaacuauuuuucu

SEQ ID NO: 2784482 - RNA, 16 nt, Leptospira interrogans serovar lai str. 56601
aauuacgauuuuuuga

SEQ ID NO: 2784483 - RNA, 19 nt, Leptospira interrogans serovar lai str. 56601
aauuacguagcgaagaaua

SEQ ID NO: 2784484 - RNA, 19 nt, Leptospira interrogans serovar lai str. 56601
aauuacuacauuugauuaa

SEQ ID NO: 2784485 - RNA, 15 nt, Leptospira interrogans serovar lai str. 56601
aauuacugauuucaa

SEQ ID NO: 2784486 - RNA, 16 nt, Leptospira interrogans serovar lai str. 56601
aauuacuuagaugaac

SEQ ID NO: 2784487 - RNA, 18 nt, Leptospira interrogans serovar lai str. 56601
aauuacuucaauugucca

SEQ ID NO: 2784488 - RNA, 22 nt, Leptospira interrogans serovar lai str. 56601
aauuacuucaauuguccauuuc

SEQ ID NO: 2784489 - RNA, 22 nt, Leptospira interrogans serovar lai str. 56601
aauuagaaagaaucuuuuuaaa

SEQ ID NO: 2784490 - RNA, 12 nt, Leptospira interrogans serovar lai str. 56601
aauuagaaagcg

SEQ ID NO: 2784491 - RNA, 14 nt, Leptospira interrogans serovar lai str. 56601
aauuagaaaugauu

SEQ ID NO: 2784492 - RNA, 19 nt, Leptospira interrogans serovar lai str. 56601
aauuagauuuauugaaaaa

SEQ ID NO: 2784493 - RNA, 19 nt, Leptospira interrogans serovar lai str. 56601
aauuagcucuuguuaaaau

SEQ ID NO: 2784494 - RNA, 16 nt, Leptospira interrogans serovar lai str. 56601
aauuagcuuaagaauu

SEQ ID NO: 2784495 - RNA, 17 nt, Leptospira interrogans serovar lai str. 56601
aauuagcuuaagaauuu

SEQ ID NO: 2784496 - RNA, 13 nt, Leptospira interrogans serovar lai str. 56601
aauuaggucacau

SEQ ID NO: 2784497 - RNA, 15 nt, Leptospira interrogans serovar lai str. 56601
aauuaguucuucaaa

SEQ ID NO: 2784498 - RNA, 14 nt, Leptospira interrogans serovar lai str. 56601
aauuauaaaauuuu

SEQ ID NO: 2784499 - RNA, 18 nt, Leptospira interrogans serovar lai str. 56601
aauuauaaaauuuuucuc

SEQ ID NO: 2784500 - RNA, 12 nt, Leptospira interrogans serovar lai str. 56601
aauuauacaaaa

SEQ ID NO: 2784501 - RNA, 19 nt, Leptospira interrogans serovar lai str. 56601
aauuauacuauaaguuuac

SEQ ID NO: 2784502 - RNA, 19 nt, Leptospira interrogans serovar lai str. 56601
aauuauagauaauuuuuac

SEQ ID NO: 2784503 - RNA, 18 nt, Leptospira interrogans serovar lai str. 56601
aauuauaguaacagaaaa

SEQ ID NO: 2784504 - RNA, 18 nt, Leptospira interrogans serovar lai str. 56601
aauuauaguuuuauuaga

SEQ ID NO: 2784505 - RNA, 15 nt, Leptospira interrogans serovar lai str. 56601
aauuauauucuuaua

SEQ ID NO: 2784506 - RNA, 23 nt, Leptospira interrogans serovar lai str. 56601
aauuauauucuuauauaucuuug

SEQ ID NO: 2784507 - RNA, 18 nt, Leptospira interrogans serovar lai str. 56601
aauuaucauguaaaauuu

SEQ ID NO: 2784508 - RNA, 13 nt, Leptospira interrogans serovar lai str. 56601
aauucugaaagag

SEQ ID NO: 2784509 - RNA, 16 nt, Leptospira interrogans serovar lai str. 56601
aauucugaaagaguua

SEQ ID NO: 2784510 - RNA, 15 nt, Leptospira interrogans serovar lai str. 56601
aauucuguaaaaaua

SEQ ID NO: 2784511 - RNA, 15 nt, Leptospira interrogans serovar lai str. 56601
aauucuuaaaaaaua

SEQ ID NO: 2784512 - RNA, 17 nt, Leptospira interrogans serovar lai str. 56601
aauucuuaaaaaauauu

SEQ ID NO: 2784513 - RNA, 15 nt, Leptospira interrogans serovar lai str. 56601
aauucuuaaaaauuu

SEQ ID NO: 2784514 - RNA, 16 nt, Leptospira interrogans serovar lai str. 56601
aauucuuaaaaauuua

SEQ ID NO: 2784515 - RNA, 16 nt, Leptospira interrogans serovar lai str. 56601
aauucuuaaaaugugg

SEQ ID NO: 2784516 - RNA, 16 nt, Leptospira interrogans serovar lai str. 56601
aauucuuagaguaaaa

SEQ ID NO: 2784517 - RNA, 17 nt, Leptospira interrogans serovar lai str. 56601
aauucuucaauaucuuu

SEQ ID NO: 2784518 - RNA, 23 nt, Leptospira interrogans serovar lai str. 56601
aauucuuccgggaggaauuuuua

SEQ ID NO: 2784519 - RNA, 23 nt, Leptospira interrogans serovar lai str. 56601
aauucuuccuucuugaaauaauc

SEQ ID NO: 2784520 - RNA, 20 nt, Leptospira interrogans serovar lai str. 56601
aauucuuccuuuuucauuuu

SEQ ID NO: 2784521 - RNA, 21 nt, Leptospira interrogans serovar lai str. 56601
aauucuuccuuuuucauuuuu

SEQ ID NO: 2784522 - RNA, 15 nt, Leptospira interrogans serovar lai str. 56601
aauucuucuuccuuu

SEQ ID NO: 2784523 - RNA, 16 nt, Leptospira interrogans serovar lai str. 56601
aauucuuuaaaauuuu

SEQ ID NO: 2784524 - RNA, 19 nt, Leptospira interrogans serovar lai str. 56601
aauucuuuaaaauuuuuaa

SEQ ID NO: 2784525 - RNA, 14 nt, Leptospira interrogans serovar lai str. 56601
aauucuuuagaaau

SEQ ID NO: 2784526 - RNA, 19 nt, Leptospira interrogans serovar lai str. 56601
aauucuuuagaaauuuuua

SEQ ID NO: 2784527 - RNA, 20 nt, Leptospira interrogans serovar lai str. 56601
aauucuuucuuaaauuuuuu

SEQ ID NO: 2784528 - RNA, 23 nt, Leptospira interrogans serovar lai str. 56601
aauucuuugaaccacaguuccua

SEQ ID NO: 2784529 - RNA, 17 nt, Leptospira interrogans serovar lai str. 56601
aauucuuuggaaauuuu

SEQ ID NO: 2784530 - RNA, 19 nt, Leptospira interrogans serovar lai str. 56601
aauucuuuggaaauuuuua

SEQ ID NO: 2784531 - RNA, 21 nt, Leptospira interrogans serovar lai str. 56601
aauucuuuugcauaguuuuau

SEQ ID NO: 2784532 - RNA, 18 nt, Leptospira interrogans serovar lai str. 56601
aauucuuuuuauuuuuac

SEQ ID NO: 2784533 - RNA, 16 nt, Leptospira interrogans serovar lai str. 56601
aauugaacauuuuuaa

SEQ ID NO: 2784534 - RNA, 21 nt, Leptospira interrogans serovar lai str. 56601
aauugaagcaguuuugcuaau

SEQ ID NO: 2784535 - RNA, 16 nt, Leptospira interrogans serovar lai str. 56601
aauugaauauaaaauu

SEQ ID NO: 2784536 - RNA, 18 nt, Leptospira interrogans serovar lai str. 56601
aauugaauuuuuuaaaug

SEQ ID NO: 2784537 - RNA, 23 nt, Leptospira interrogans serovar lai str. 56601
aauugacaaagaguuguuuaucu

SEQ ID NO: 2784538 - RNA, 13 nt, Leptospira interrogans serovar lai str. 56601
aauugacuuucug

SEQ ID NO: 2784539 - RNA, 23 nt, Leptospira interrogans serovar lai str. 56601
aauugagauuuggugauuuaaaa

SEQ ID NO: 2784540 - RNA, 22 nt, Leptospira interrogans serovar lai str. 56601
aauugaguuuuuuauucccaaa

SEQ ID NO: 2784541 - RNA, 13 nt, Leptospira interrogans serovar lai str. 56601
aauugaucucaua

SEQ ID NO: 2784542 - RNA, 18 nt, Leptospira interrogans serovar lai str. 56601
aauugauuuuucaacaac

SEQ ID NO: 2784543 - RNA, 20 nt, Leptospira interrogans serovar lai str. 56601
aauugcacaaaagaaacgua

SEQ ID NO: 2784544 - RNA, 14 nt, Leptospira interrogans serovar lai str. 56601
aauugcacauaaaa

SEQ ID NO: 2784545 - RNA, 23 nt, Leptospira interrogans serovar lai str. 56601
aauugcacauaaaagaccuucgg

SEQ ID NO: 2784546 - RNA, 17 nt, Leptospira interrogans serovar lai str. 56601
aauugcaccaguuaaau

SEQ ID NO: 2784547 - RNA, 18 nt, Leptospira interrogans serovar lai str. 56601
aauugcauaaaagaaaca

SEQ ID NO: 2784548 - RNA, 18 nt, Leptospira interrogans serovar lai str. 56601
aauuggaauguacuaaaa

SEQ ID NO: 2784549 - RNA, 19 nt, Leptospira interrogans serovar lai str. 56601
aauuggcagaugaaacuaa

SEQ ID NO: 2784550 - RNA, 21 nt, Leptospira interrogans serovar lai str. 56601
aauuggguauaagaagauuuu

SEQ ID NO: 2784551 - RNA, 14 nt, Leptospira interrogans serovar lai str. 56601
aauuguaaaaaacc

SEQ ID NO: 2784552 - RNA, 17 nt, Leptospira interrogans serovar lai str. 56601
aauuguaaaaggagaau

SEQ ID NO: 2784553 - RNA, 19 nt, Leptospira interrogans serovar lai str. 56601
aauuguaacaguucucaca

SEQ ID NO: 2784554 - RNA, 18 nt, Leptospira interrogans serovar lai str. 56601
aauuguagaaacuuauac

SEQ ID NO: 2784555 - RNA, 22 nt, Leptospira interrogans serovar lai str. 56601
aauuguagaauuuauuuucaua

SEQ ID NO: 2784556 - RNA, 17 nt, Leptospira interrogans serovar lai str. 56601
aauuguagauucuuuua

SEQ ID NO: 2784557 - RNA, 15 nt, Leptospira interrogans serovar lai str. 56601
aauuguaggaacuac

SEQ ID NO: 2784558 - RNA, 17 nt, Leptospira interrogans serovar lai str. 56601
aauuguaggaacuacua

SEQ ID NO: 2784559 - RNA, 15 nt, Leptospira interrogans serovar lai str. 56601
aauuguauccgaaaa

SEQ ID NO: 2784560 - RNA, 16 nt, Leptospira interrogans serovar lai str. 56601
aauuguauccgaaaaa

SEQ ID NO: 2784561 - RNA, 21 nt, Leptospira interrogans serovar lai str. 56601
aauuguauccgaaaaauucca

SEQ ID NO: 2784562 - RNA, 17 nt, Leptospira interrogans serovar lai str. 56601
aauuguaugaagaaaac

SEQ ID NO: 2784563 - RNA, 14 nt, Leptospira interrogans serovar lai str. 56601
aauuguauuuuccc

SEQ ID NO: 2784564 - RNA, 23 nt, Leptospira interrogans serovar lai str. 56601
aauuguauuuucccgaaagaacu

SEQ ID NO: 2784565 - RNA, 22 nt, Leptospira interrogans serovar lai str. 56601
aauuguccauuuccauaaaaua

SEQ ID NO: 2784566 - RNA, 17 nt, Leptospira interrogans serovar lai str. 56601
aauuguccguuucaaua

SEQ ID NO: 2784567 - RNA, 19 nt, Leptospira interrogans serovar lai str. 56601
aauuguccguuucaauaca

SEQ ID NO: 2784568 - RNA, 17 nt, Leptospira interrogans serovar lai str. 56601
aauugugagaacuacuu

SEQ ID NO: 2784569 - RNA, 22 nt, Leptospira interrogans serovar lai str. 56601
aauugugauuugcgacaguucc

SEQ ID NO: 2784570 - RNA, 15 nt, Leptospira interrogans serovar lai str. 56601
aauugugggaacuac

SEQ ID NO: 2784571 - RNA, 20 nt, Leptospira interrogans serovar lai str. 56601
aauugugggaacuauuauaa

SEQ ID NO: 2784572 - RNA, 15 nt, Leptospira interrogans serovar lai str. 56601
aauugugggaacuca

SEQ ID NO: 2784573 - RNA, 19 nt, Leptospira interrogans serovar lai str. 56601
aauugugggaacucacaca

SEQ ID NO: 2784574 - RNA, 16 nt, Leptospira interrogans serovar lai str. 56601
aauuguggguuguaua

SEQ ID NO: 2784575 - RNA, 14 nt, Leptospira interrogans serovar lai str. 56601
aauuguguaugagu

SEQ ID NO: 2784576 - RNA, 15 nt, Leptospira interrogans serovar lai str. 56601
aauuguguaugaguu

SEQ ID NO: 2784577 - RNA, 17 nt, Leptospira interrogans serovar lai str. 56601
aauuguguuaguuccca

SEQ ID NO: 2784578 - RNA, 21 nt, Leptospira interrogans serovar lai str. 56601
aauuguguuaguucccacauu

SEQ ID NO: 2784579 - RNA, 22 nt, Leptospira interrogans serovar lai str. 56601
aauuguuaucgcuaauacaaaa

SEQ ID NO: 2784580 - RNA, 20 nt, Leptospira interrogans serovar lai str. 56601
aauuguuccgaauuaaaaau

SEQ ID NO: 2784581 - RNA, 18 nt, Leptospira interrogans serovar lai str. 56601
aauuguugaaaaauuaau

SEQ ID NO: 2784582 - RNA, 19 nt, Leptospira interrogans serovar lai str. 56601
aauuguugaaaaauuucau

SEQ ID NO: 2784583 - RNA, 17 nt, Leptospira interrogans serovar lai str. 56601
aauuguugcuauggaau

SEQ ID NO: 2784584 - RNA, 22 nt, Leptospira interrogans serovar lai str. 56601
aauuguugcuauggaauuuuuc

SEQ ID NO: 2784585 - RNA, 23 nt, Leptospira interrogans serovar lai str. 56601
aauuguuguuauggaauuuuuca

SEQ ID NO: 2784586 - RNA, 19 nt, Leptospira interrogans serovar lai str. 56601
aauuguuugaaaguuccca

SEQ ID NO: 2784587 - RNA, 21 nt, Leptospira interrogans serovar lai str. 56601
aauuguuugaaaguucccaaa

SEQ ID NO: 2784588 - RNA, 11 nt, Leptospira interrogans serovar lai str. 56601
aauuguuugau

SEQ ID NO: 2784589 - RNA, 16 nt, Leptospira interrogans serovar lai str. 56601
aauuguuuuaaaacuu

SEQ ID NO: 2784590 - RNA, 13 nt, Leptospira interrogans serovar lai str. 56601
aauuguuuuuaaa

SEQ ID NO: 2784591 - RNA, 17 nt, Leptospira interrogans serovar lai str. 56601
aauuguuuuuaaauacu

SEQ ID NO: 2784592 - RNA, 11 nt, Leptospira interrogans serovar lai str. 56601
aauuuaaaaaa

SEQ ID NO: 2784593 - RNA, 16 nt, Leptospira interrogans serovar lai str. 56601
aauuuaaaaaagaaga

SEQ ID NO: 2784594 - RNA, 14 nt, Leptospira interrogans serovar lai str. 56601
aauuuaaaaaugaa

SEQ ID NO: 2784595 - RNA, 12 nt, Leptospira interrogans serovar lai str. 56601
aauuuaaaacuu

SEQ ID NO: 2784596 - RNA, 17 nt, Leptospira interrogans serovar lai str. 56601
aauuuaaaauaauugau

SEQ ID NO: 2784597 - RNA, 21 nt, Leptospira interrogans serovar lai str. 56601
aauuuaaaauaauugauuaga

SEQ ID NO: 2784598 - RNA, 14 nt, Leptospira interrogans serovar lai str. 56601
aauuuaaaaucgua

SEQ ID NO: 2784599 - RNA, 10 nt, Leptospira interrogans serovar lai str. 56601
aauuuaaaga

SEQ ID NO: 2784600 - RNA, 18 nt, Leptospira interrogans serovar lai str. 56601
aauuuaaaucccauuuua

SEQ ID NO: 2784601 - RNA, 17 nt, Leptospira interrogans serovar lai str. 56601
aauuuaaauguucaaau

SEQ ID NO: 2784602 - RNA, 18 nt, Leptospira interrogans serovar lai str. 56601
aauuuaaauguuuuugua

SEQ ID NO: 2784603 - RNA, 15 nt, Leptospira interrogans serovar lai str. 56601
aauuuaaauucccuc

SEQ ID NO: 2784604 - RNA, 13 nt, Leptospira interrogans serovar lai str. 56601
aauuuaacaacau

SEQ ID NO: 2784605 - RNA, 18 nt, Leptospira interrogans serovar lai str. 56601
aauuuaacaacauuagaa

SEQ ID NO: 2784606 - RNA, 20 nt, Leptospira interrogans serovar lai str. 56601
aauuuaacaacauuagaauu

SEQ ID NO: 2784607 - RNA, 14 nt, Leptospira interrogans serovar lai str. 56601
aauuuaacgauauu

SEQ ID NO: 2784608 - RNA, 13 nt, Leptospira interrogans serovar lai str. 56601
aauuuaacgugau

SEQ ID NO: 2784609 - RNA, 18 nt, Leptospira interrogans serovar lai str. 56601
aauuuaagauuacucuac

SEQ ID NO: 2784610 - RNA, 22 nt, Leptospira interrogans serovar lai str. 56601
aauuuaagauuacucuacuaua

SEQ ID NO: 2784611 - RNA, 15 nt, Leptospira interrogans serovar lai str. 56601
aauuuaaguauuaua

SEQ ID NO: 2784612 - RNA, 19 nt, Leptospira interrogans serovar lai str. 56601
aauuuaaguuuuucuuaaa

SEQ ID NO: 2784613 - RNA, 18 nt, Leptospira interrogans serovar lai str. 56601
aauuuaauauauuaaaau

SEQ ID NO: 2784614 - RNA, 21 nt, Leptospira interrogans serovar lai str. 56601
aauuuaauauauuaaaauguu

SEQ ID NO: 2784615 - RNA, 16 nt, Leptospira interrogans serovar lai str. 56601
aauuuaauuugaucau

SEQ ID NO: 2784616 - RNA, 14 nt, Leptospira interrogans serovar lai str. 56601
aauuuaauuuuuua

SEQ ID NO: 2784617 - RNA, 20 nt, Leptospira interrogans serovar lai str. 56601
aauuuacaucauguaauaua

SEQ ID NO: 2784618 - RNA, 18 nt, Leptospira interrogans serovar lai str. 56601
aauuuacggcauuuuuua

SEQ ID NO: 2784619 - RNA, 22 nt, Leptospira interrogans serovar lai str. 56601
aauuuacggcauuuuuuaaaug

SEQ ID NO: 2784620 - RNA, 14 nt, Leptospira interrogans serovar lai str. 56601
aauuuacucuuaua

SEQ ID NO: 2784621 - RNA, 21 nt, Leptospira interrogans serovar lai str. 56601
aauuuacucuuauaaaauuuu

SEQ ID NO: 2784622 - RNA, 13 nt, Leptospira interrogans serovar lai str. 56601
aauuuagaaauag

SEQ ID NO: 2784623 - RNA, 17 nt, Leptospira interrogans serovar lai str. 56601
aauuuagaauaaaaacu

SEQ ID NO: 2784624 - RNA, 12 nt, Leptospira interrogans serovar lai str. 56601
aauuuagaauug

SEQ ID NO: 2784625 - RNA, 22 nt, Leptospira interrogans serovar lai str. 56601
aauuuagaguuguuaaaaaauu

SEQ ID NO: 2784626 - RNA, 15 nt, Leptospira interrogans serovar lai str. 56601
aauuuaggaaauuuu

SEQ ID NO: 2784627 - RNA, 21 nt, Leptospira interrogans serovar lai str. 56601
aauuuagguuaagucguugua

SEQ ID NO: 2784628 - RNA, 16 nt, Leptospira interrogans serovar lai str. 56601
aauuuaguuuuuguau

SEQ ID NO: 2784629 - RNA, 17 nt, Leptospira interrogans serovar lai str. 56601
aauuuaguuuuuguaug

SEQ ID NO: 2784630 - RNA, 20 nt, Leptospira interrogans serovar lai str. 56601
aauuuauaaagacuuuaaau

SEQ ID NO: 2784631 - RNA, 17 nt, Leptospira interrogans serovar lai str. 56601
aauuuauaaaguuuaac

SEQ ID NO: 2784632 - RNA, 14 nt, Leptospira interrogans serovar lai str. 56601
aauuuauaaaugua

SEQ ID NO: 2784633 - RNA, 22 nt, Leptospira interrogans serovar lai str. 56601
aauuuauacuauaacuuuaaaa

SEQ ID NO: 2784634 - RNA, 22 nt, Leptospira interrogans serovar lai str. 56601
aauuuauaggaucguauuuuag

SEQ ID NO: 2784635 - RNA, 13 nt, Leptospira interrogans serovar lai str. 56601
aauuuauauagua

SEQ ID NO: 2784636 - RNA, 17 nt, Leptospira interrogans serovar lai str. 56601
aauuuauauaguaaaua

SEQ ID NO: 2784637 - RNA, 18 nt, Leptospira interrogans serovar lai str. 56601
aauuuauauuuuuugaaa

SEQ ID NO: 2784638 - RNA, 17 nt, Leptospira interrogans serovar lai str. 56601
aauuuaucgauuuaaaa

SEQ ID NO: 2784639 - RNA, 16 nt, Leptospira interrogans serovar lai str. 56601
aauuuaucuauaaaau

SEQ ID NO: 2784640 - RNA, 20 nt, Leptospira interrogans serovar lai str. 56601
aauuuaugaucuacuauuau

SEQ ID NO: 2784641 - RNA, 22 nt, Leptospira interrogans serovar lai str. 56601
aauuuaugaucuacuauuauaa

SEQ ID NO: 2784642 - RNA, 19 nt, Leptospira interrogans serovar lai str. 56601
aauuuauguacuuuuaaga

SEQ ID NO: 2784643 - RNA, 20 nt, Leptospira interrogans serovar lai str. 56601
aauuuauuaugugacuuaau

SEQ ID NO: 2784644 - RNA, 18 nt, Leptospira interrogans serovar lai str. 56601
aauuuauuucaaaauuua

SEQ ID NO: 2784645 - RNA, 13 nt, Leptospira interrogans serovar lai str. 56601
aauuuauuuuuca

SEQ ID NO: 2784646 - RNA, 18 nt, Leptospira interrogans serovar lai str. 56601
aauuuauuuuucaacaac

SEQ ID NO: 2784647 - RNA, 16 nt, Leptospira interrogans serovar lai str. 56601
aauuucagaaacauug

SEQ ID NO: 2784648 - RNA, 23 nt, Leptospira interrogans serovar lai str. 56601
aauuucagucaauaaauuguaua

SEQ ID NO: 2784649 - RNA, 18 nt, Leptospira interrogans serovar lai str. 56601
aauuuccaaacuacaaau

SEQ ID NO: 2784650 - RNA, 15 nt, Leptospira interrogans serovar lai str. 56601
aauuuccaaacucaa

SEQ ID NO: 2784651 - RNA, 14 nt, Leptospira interrogans serovar lai str. 56601
aauuuccacuucaa

SEQ ID NO: 2784652 - RNA, 17 nt, Leptospira interrogans serovar lai str. 56601
aauuuccacuucaaaaa

SEQ ID NO: 2784653 - RNA, 16 nt, Leptospira interrogans serovar lai str. 56601
aauuuccauuucugac

SEQ ID NO: 2784654 - RNA, 18 nt, Leptospira interrogans serovar lai str. 56601
aauuucccauaaaaagag

SEQ ID NO: 2784655 - RNA, 21 nt, Leptospira interrogans serovar lai str. 56601
aauuucccgauucucaaaaug

SEQ ID NO: 2784656 - RNA, 15 nt, Leptospira interrogans serovar lai str. 56601
aauuuccuaaaagua

SEQ ID NO: 2784657 - RNA, 14 nt, Leptospira interrogans serovar lai str. 56601
aauuuccuggauug

SEQ ID NO: 2784658 - RNA, 12 nt, Leptospira interrogans serovar lai str. 56601
aauuucuaaaau

SEQ ID NO: 2784659 - RNA, 14 nt, Leptospira interrogans serovar lai str. 56601
aauuucuaaagaau

SEQ ID NO: 2784660 - RNA, 15 nt, Leptospira interrogans serovar lai str. 56601
aauuucuaaagaauu

SEQ ID NO: 2784661 - RNA, 23 nt, Leptospira interrogans serovar lai str. 56601
aauuucuaauaaaauaugaguuu

SEQ ID NO: 2784662 - RNA, 14 nt, Leptospira interrogans serovar lai str. 56601
aauuucuauaaaau

SEQ ID NO: 2784663 - RNA, 14 nt, Leptospira interrogans serovar lai str. 56601
aauuucugaaacaa

SEQ ID NO: 2784664 - RNA, 13 nt, Leptospira interrogans serovar lai str. 56601
aauuucuucuuuu

SEQ ID NO: 2784665 - RNA, 23 nt, Leptospira interrogans serovar lai str. 56601
aauuucuucuuuuguuuuuauaa

SEQ ID NO: 2784666 - RNA, 13 nt, Leptospira interrogans serovar lai str. 56601
aauuucuuuuuau

SEQ ID NO: 2784667 - RNA, 14 nt, Leptospira interrogans serovar lai str. 56601
aauuucuuuuuaua

SEQ ID NO: 2784668 - RNA, 21 nt, Leptospira interrogans serovar lai str. 56601
aauuugaauauaauaaaauua

SEQ ID NO: 2784669 - RNA, 13 nt, Leptospira interrogans serovar lai str. 56601
aauuugaauuuaa

SEQ ID NO: 2784670 - RNA, 14 nt, Leptospira interrogans serovar lai str. 56601
aauuugaauuuuuu

SEQ ID NO: 2784671 - RNA, 16 nt, Leptospira interrogans serovar lai str. 56601
aauuugaggagaaucu

SEQ ID NO: 2784672 - RNA, 16 nt, Leptospira interrogans serovar lai str. 56601
aauuugcgaaaaaaau

SEQ ID NO: 2784673 - RNA, 17 nt, Leptospira interrogans serovar lai str. 56601
aauuuuuaaaaagaauu

SEQ ID NO: 2784674 - RNA, 18 nt, Leptospira interrogans serovar lai str. 56601
aauuuuuaaaaguagaau

SEQ ID NO: 2784675 - RNA, 12 nt, Leptospira interrogans serovar lai str. 56601
aauuuuuaaaua

SEQ ID NO: 2784676 - RNA, 16 nt, Leptospira interrogans serovar lai str. 56601
aauuuuuaacgugagu

SEQ ID NO: 2784677 - RNA, 16 nt, Leptospira interrogans serovar lai str. 56601
aauuuuuaagaauaau

SEQ ID NO: 2784678 - RNA, 13 nt, Leptospira interrogans serovar lai str. 56601
aauuuuuaauaaa

SEQ ID NO: 2784679 - RNA, 22 nt, Leptospira interrogans serovar lai str. 56601
aauuuuuacauuuucgaaauuu

SEQ ID NO: 2784680 - RNA, 15 nt, Leptospira interrogans serovar lai str. 56601
aauuuuuacuuccca

SEQ ID NO: 2784681 - RNA, 14 nt, Leptospira interrogans serovar lai str. 56601
aauuuuuagagugu

SEQ ID NO: 2784682 - RNA, 14 nt, Leptospira interrogans serovar lai str. 56601
aauuuuuauagaau

SEQ ID NO: 2784683 - RNA, 16 nt, Leptospira interrogans serovar lai str. 56601
aauuuuuauagaauuu

SEQ ID NO: 2784684 - RNA, 20 nt, Leptospira interrogans serovar lai str. 56601
aauuuuuaucauaaaacacu

SEQ ID NO: 2784685 - RNA, 17 nt, Leptospira interrogans serovar lai str. 56601
aauuuuuaucauguuuu

SEQ ID NO: 2784686 - RNA, 13 nt, Leptospira interrogans serovar lai str. 56601
aauuuuucaaaaa

SEQ ID NO: 2784687 - RNA, 15 nt, Leptospira interrogans serovar lai str. 56601
aauuuuucaaaaacu

SEQ ID NO: 2784688 - RNA, 19 nt, Leptospira interrogans serovar lai str. 56601
aauuuuucaacaacucuaa

SEQ ID NO: 2784689 - RNA, 14 nt, Leptospira interrogans serovar lai str. 56601
aauuuuucaacaau

SEQ ID NO: 2784690 - RNA, 16 nt, Leptospira interrogans serovar lai str. 56601
aauuuuucaacaauuc

SEQ ID NO: 2784691 - RNA, 22 nt, Leptospira interrogans serovar lai str. 56601
aauuuuucgguaggauccugac

SEQ ID NO: 2784692 - RNA, 12 nt, Leptospira interrogans serovar lai str. 56601
aauuuuucuagu

SEQ ID NO: 2784693 - RNA, 17 nt, Leptospira interrogans serovar lai str. 56601
aauuuuucuggaaaagu

SEQ ID NO: 2784694 - RNA, 20 nt, Leptospira interrogans serovar lai str. 56601
aauuuuuguaaaauccagaa

SEQ ID NO: 2784695 - RNA, 11 nt, Leptospira interrogans serovar lai str. 56601
aauuuuuguag

SEQ ID NO: 2784696 - RNA, 17 nt, Leptospira interrogans serovar lai str. 56601
aauuuuuuaaaaauuuu

SEQ ID NO: 2784697 - RNA, 19 nt, Leptospira interrogans serovar lai str. 56601
aauuuuuuaacaacucuaa

SEQ ID NO: 2784698 - RNA, 21 nt, Leptospira interrogans serovar lai str. 56601
aauuuuuuacugauucugcau

SEQ ID NO: 2784699 - RNA, 17 nt, Leptospira interrogans serovar lai str. 56601
aauuuuuuagaaacuau

SEQ ID NO: 2784700 - RNA, 23 nt, Leptospira interrogans serovar lai str. 56601
aauuuuuuagaaacuauucuaua

SEQ ID NO: 2784701 - RNA, 15 nt, Leptospira interrogans serovar lai str. 56601
aauuuuuuauuaaga

SEQ ID NO: 2784702 - RNA, 22 nt, Leptospira interrogans serovar lai str. 56601
aauuuuuuauuuuaugaauaaa

SEQ ID NO: 2784703 - RNA, 17 nt, Leptospira interrogans serovar lai str. 56601
aauuuuuugaaaaagaa

SEQ ID NO: 2784704 - RNA, 19 nt, Leptospira interrogans serovar lai str. 56601
aauuuuuugaaaaagaaua

SEQ ID NO: 2784705 - RNA, 24 nt, Leptospira interrogans serovar lai str. 56601
aauuuuuugagguuuugagacaaa

SEQ ID NO: 2784706 - RNA, 19 nt, Leptospira interrogans serovar lai str. 56601
aauuuuuuggaaauuuuua

SEQ ID NO: 2784707 - RNA, 20 nt, Leptospira interrogans serovar lai str. 56601
aauuuuuuggaaauuuuuaa

SEQ ID NO: 2784708 - RNA, 15 nt, Leptospira interrogans serovar lai str. 56601
aauuuuuuuaaaaau

SEQ ID NO: 2784709 - RNA, 12 nt, Leptospira interrogans serovar lai str. 56601
aauuuuuuuaag

SEQ ID NO: 2784710 - RNA, 16 nt, Leptospira interrogans serovar lai str. 56601
aauuuuuuuaagaauu

SEQ ID NO: 2784711 - RNA, 19 nt, Leptospira interrogans serovar lai str. 56601
aauuuuuuucaguauguuu

SEQ ID NO: 2784712 - RNA, 19 nt, Leptospira interrogans serovar lai str. 56601
aauuuuuuucuaaaauaua

SEQ ID NO: 2784713 - RNA, 19 nt, Leptospira interrogans serovar lai str. 56601
aauuuuuuugauucaaaaa

SEQ ID NO: 2784714 - RNA, 15 nt, Leptospira interrogans serovar lai str. 56601
aauuuuuuuguaaaa

SEQ ID NO: 2784715 - RNA, 21 nt, Leptospira interrogans serovar lai str. 56601
aauuuuuuuguaaaaaaauag

SEQ ID NO: 2784716 - RNA, 22 nt, Leptospira interrogans serovar lai str. 56601
aauuuuuuuguaaaaaaauaga

SEQ ID NO: 2784717 - RNA, 14 nt, Leptospira interrogans serovar lai str. 56601
acaaaaaaauucau

SEQ ID NO: 2784718 - RNA, 15 nt, Leptospira interrogans serovar lai str. 56601
acaaaaaaauucaua

SEQ ID NO: 2784719 - RNA, 17 nt, Leptospira interrogans serovar lai str. 56601
acaaaaaaauucuccuc

SEQ ID NO: 2784720 - RNA, 16 nt, Leptospira interrogans serovar lai str. 56601
acaaaaaauauacuuu

SEQ ID NO: 2784721 - RNA, 23 nt, Leptospira interrogans serovar lai str. 56601
acaaaaaauauacuuuucaaacg

SEQ ID NO: 2784722 - RNA, 18 nt, Leptospira interrogans serovar lai str. 56601
acaaaaaaugcucaaaaa

SEQ ID NO: 2784723 - RNA, 17 nt, Leptospira interrogans serovar lai str. 56601
acaaaaaauguuuaaag

SEQ ID NO: 2784724 - RNA, 21 nt, Leptospira interrogans serovar lai str. 56601
acaaaaaauguuuaaagaauu

SEQ ID NO: 2784725 - RNA, 16 nt, Leptospira interrogans serovar lai str. 56601
acaaaaaauucuuuuu

SEQ ID NO: 2784726 - RNA, 14 nt, Leptospira interrogans serovar lai str. 56601
acaaaaauacuuua

SEQ ID NO: 2784727 - RNA, 19 nt, Leptospira interrogans serovar lai str. 56601
acaaaacgccucaaucgac

SEQ ID NO: 2784728 - RNA, 20 nt, Leptospira interrogans serovar lai str. 56601
acaaaacugcuugaaucgac

SEQ ID NO: 2784729 - RNA, 20 nt, Leptospira interrogans serovar lai str. 56601
acaaaaggauuccauuucau

SEQ ID NO: 2784730 - RNA, 15 nt, Leptospira interrogans serovar lai str. 56601
acaaaaguagaaaga

SEQ ID NO: 2784731 - RNA, 16 nt, Leptospira interrogans serovar lai str. 56601
acaaaaguagaaagau

SEQ ID NO: 2784732 - RNA, 21 nt, Leptospira interrogans serovar lai str. 56601
acaaaaucaaagauauuucaa

SEQ ID NO: 2784733 - RNA, 21 nt, Leptospira interrogans serovar lai str. 56601
acaaaaucacgauuuuacgaa

SEQ ID NO: 2784734 - RNA, 12 nt, Leptospira interrogans serovar lai str. 56601
acaaaaucugaa

SEQ ID NO: 2784735 - RNA, 15 nt, Leptospira interrogans serovar lai str. 56601
acaaaaucugaauuu

SEQ ID NO: 2784736 - RNA, 17 nt, Leptospira interrogans serovar lai str. 56601
acaaaaucugaauuuua

SEQ ID NO: 2784737 - RNA, 15 nt, Leptospira interrogans serovar lai str. 56601
acaaaaugauuuacu

SEQ ID NO: 2784738 - RNA, 18 nt, Leptospira interrogans serovar lai str. 56601
acaaaaugcuguaacuca

SEQ ID NO: 2784739 - RNA, 16 nt, Leptospira interrogans serovar lai str. 56601
acaaaauuacuucaau

SEQ ID NO: 2784740 - RNA, 22 nt, Leptospira interrogans serovar lai str. 56601
acaaaauuaggcuuaucuguaa

SEQ ID NO: 2784741 - RNA, 13 nt, Leptospira interrogans serovar lai str. 56601
acaaaauuuaaaa

SEQ ID NO: 2784742 - RNA, 11 nt, Leptospira interrogans serovar lai str. 56601
acaaaauuuag

SEQ ID NO: 2784743 - RNA, 12 nt, Leptospira interrogans serovar lai str. 56601
acaaaauuuuuu

SEQ ID NO: 2784744 - RNA, 14 nt, Leptospira interrogans serovar lai str. 56601
acaaacgguuuuag

SEQ ID NO: 2784745 - RNA, 19 nt, Leptospira interrogans serovar lai str. 56601
acaaacucuuuauuuuuaa

SEQ ID NO: 2784746 - RNA, 15 nt, Leptospira interrogans serovar lai str. 56601
acaaacuuuuagaua

SEQ ID NO: 2784747 - RNA, 15 nt, Leptospira interrogans serovar lai str. 56601
acaaacuuuuaguaa

SEQ ID NO: 2784748 - RNA, 21 nt, Leptospira interrogans serovar lai str. 56601
acaaacuuuuaguaacuuuca

SEQ ID NO: 2784749 - RNA, 22 nt, Leptospira interrogans serovar lai str. 56601
acaaacuuuuguaauaaaaauu

SEQ ID NO: 2784750 - RNA, 15 nt, Leptospira interrogans serovar lai str. 56601
acaaagacaaaguau

SEQ ID NO: 2784751 - RNA, 16 nt, Leptospira interrogans serovar lai str. 56601
acaaagaguuuaaaaa

SEQ ID NO: 2784752 - RNA, 18 nt, Leptospira interrogans serovar lai str. 56601
acaaagaguuuaaaaaau

SEQ ID NO: 2784753 - RNA, 19 nt, Leptospira interrogans serovar lai str. 56601
acaaagccgcacaaaccaa

SEQ ID NO: 2784754 - RNA, 22 nt, Leptospira interrogans serovar lai str. 56601
acaaagccgcacaaaccaaaac

SEQ ID NO: 2784755 - RNA, 17 nt, Leptospira interrogans serovar lai str. 56601
acaaagccguuuucgaa

SEQ ID NO: 2784756 - RNA, 16 nt, Leptospira interrogans serovar lai str. 56601
acaauauucuaauuuu

SEQ ID NO: 2784757 - RNA, 18 nt, Leptospira interrogans serovar lai str. 56601
acaauauucuaauuuuau

SEQ ID NO: 2784758 - RNA, 19 nt, Leptospira interrogans serovar lai str. 56601
acaauauuuugucuuuaau

SEQ ID NO: 2784759 - RNA, 21 nt, Leptospira interrogans serovar lai str. 56601
acaauauuuugucuuuaauuu

SEQ ID NO: 2784760 - RNA, 22 nt, Leptospira interrogans serovar lai str. 56601
acaaucgaacggauucuaauuu

SEQ ID NO: 2784761 - RNA, 20 nt, Leptospira interrogans serovar lai str. 56601
acaaucggagucauaacuug

SEQ ID NO: 2784762 - RNA, 17 nt, Leptospira interrogans serovar lai str. 56601
acaaucggguaaaaaau

SEQ ID NO: 2784763 - RNA, 23 nt, Leptospira interrogans serovar lai str. 56601
acaaucgucaucucgaagaacaa

SEQ ID NO: 2784764 - RNA, 19 nt, Leptospira interrogans serovar lai str. 56601
acaaucuuagaauguggga

SEQ ID NO: 2784765 - RNA, 16 nt, Leptospira interrogans serovar lai str. 56601
acaaucuucaaauucu

SEQ ID NO: 2784766 - RNA, 14 nt, Leptospira interrogans serovar lai str. 56601
acaaugaauuuuua

SEQ ID NO: 2784767 - RNA, 15 nt, Leptospira interrogans serovar lai str. 56601
acaaugaauuuuuau

SEQ ID NO: 2784768 - RNA, 18 nt, Leptospira interrogans serovar lai str. 56601
acaaugcuuuccaaaagg

SEQ ID NO: 2784769 - RNA, 19 nt, Leptospira interrogans serovar lai str. 56601
acaaugcuuuccaaaagga

SEQ ID NO: 2784770 - RNA, 15 nt, Leptospira interrogans serovar lai str. 56601
acaauuaaaaagaua

SEQ ID NO: 2784771 - RNA, 22 nt, Leptospira interrogans serovar lai str. 56601
acaauuaaacuucaaaaaauau

SEQ ID NO: 2784772 - RNA, 14 nt, Leptospira interrogans serovar lai str. 56601
acaauucaucacca

SEQ ID NO: 2784773 - RNA, 14 nt, Leptospira interrogans serovar lai str. 56601
acaauucuagcaaa

SEQ ID NO: 2784774 - RNA, 15 nt, Leptospira interrogans serovar lai str. 56601
acaauucuauuagaa

SEQ ID NO: 2784775 - RNA, 14 nt, Leptospira interrogans serovar lai str. 56601
acaauucuuccuuu

SEQ ID NO: 2784776 - RNA, 15 nt, Leptospira interrogans serovar lai str. 56601
acaauugauugcuuu

SEQ ID NO: 2784777 - RNA, 17 nt, Leptospira interrogans serovar lai str. 56601
acaauugauugcuuuuu

SEQ ID NO: 2784778 - RNA, 15 nt, Leptospira interrogans serovar lai str. 56601
acaauugauuuaaaa

SEQ ID NO: 2784779 - RNA, 13 nt, Leptospira interrogans serovar lai str. 56601
acaauuguaggaa

SEQ ID NO: 2784780 - RNA, 14 nt, Leptospira interrogans serovar lai str. 56601
acaauuuaauaguu

SEQ ID NO: 2784781 - RNA, 22 nt, Leptospira interrogans serovar lai str. 56601
acaauuuaauaguuuauacuuu

SEQ ID NO: 2784782 - RNA, 18 nt, Leptospira interrogans serovar lai str. 56601
acaauuuacaaccacugg

SEQ ID NO: 2784783 - RNA, 13 nt, Leptospira interrogans serovar lai str. 56601
acaauuuauaaag

SEQ ID NO: 2784784 - RNA, 20 nt, Leptospira interrogans serovar lai str. 56601
acaauuuaucuaaaacacau

SEQ ID NO: 2784785 - RNA, 17 nt, Leptospira interrogans serovar lai str. 56601
acaauuuuaagaacaau

SEQ ID NO: 2784786 - RNA, 15 nt, Leptospira interrogans serovar lai str. 56601
acaauuuuacaaaca

SEQ ID NO: 2784787 - RNA, 13 nt, Leptospira interrogans serovar lai str. 56601
acaauuuuagaau

SEQ ID NO: 2784788 - RNA, 14 nt, Leptospira interrogans serovar lai str. 56601
acaauuuuagaauu

SEQ ID NO: 2784789 - RNA, 15 nt, Leptospira interrogans serovar lai str. 56601
acaauuuuagaauuu

SEQ ID NO: 2784790 - RNA, 21 nt, Leptospira interrogans serovar lai str. 56601
acaauuuuaucuuaauguaaa

SEQ ID NO: 2784791 - RNA, 23 nt, Leptospira interrogans serovar lai str. 56601
acaauuuugaauauuauagaaaa

SEQ ID NO: 2784792 - RNA, 21 nt, Leptospira interrogans serovar lai str. 56601
acaauuuuucucuaucagaaa

SEQ ID NO: 2784793 - RNA, 22 nt, Leptospira interrogans serovar lai str. 56601
acaauuuuucucuaucagaaaa

SEQ ID NO: 2784794 - RNA, 17 nt, Leptospira interrogans serovar lai str. 56601
acaauuuuuugaaaaag

SEQ ID NO: 2784795 - RNA, 20 nt, Leptospira interrogans serovar lai str. 56601
acaauuuuuugaaaaagaau

SEQ ID NO: 2784796 - RNA, 17 nt, Leptospira interrogans serovar lai str. 56601
acacaacgcucucuacg

SEQ ID NO: 2784797 - RNA, 17 nt, Leptospira interrogans serovar lai str. 56601
acacaaguuuggaaauu

SEQ ID NO: 2784798 - RNA, 18 nt, Leptospira interrogans serovar lai str. 56601
acacacuguuaguuugca

SEQ ID NO: 2784799 - RNA, 18 nt, Leptospira interrogans serovar lai str. 56601
acacacuuuauaaaagua

SEQ ID NO: 2784800 - RNA, 17 nt, Leptospira interrogans serovar lai str. 56601
acacaguuugaauuuua

SEQ ID NO: 2784801 - RNA, 14 nt, Leptospira interrogans serovar lai str. 56601
acacaugagcauuc

SEQ ID NO: 2784802 - RNA, 15 nt, Leptospira interrogans serovar lai str. 56601
acacauucauuuuuu

SEQ ID NO: 2784803 - RNA, 19 nt, Leptospira interrogans serovar lai str. 56601
acacauucauuuuuucuaa

SEQ ID NO: 2784804 - RNA, 21 nt, Leptospira interrogans serovar lai str. 56601
acacauuccgcaaaaauuccu

SEQ ID NO: 2784805 - RNA, 15 nt, Leptospira interrogans serovar lai str. 56601
acacauucuaaaauu

SEQ ID NO: 2784806 - RNA, 22 nt, Leptospira interrogans serovar lai str. 56601
acacauuuucauucuaaagaag

SEQ ID NO: 2784807 - RNA, 23 nt, Leptospira interrogans serovar lai str. 56601
acacauuuucauucuaaagaagg

SEQ ID NO: 2784808 - RNA, 19 nt, Leptospira interrogans serovar lai str. 56601
acaccaguauucaauucca

SEQ ID NO: 2784809 - RNA, 18 nt, Leptospira interrogans serovar lai str. 56601
acaccgugaucuccuaaa

SEQ ID NO: 2784810 - RNA, 12 nt, Leptospira interrogans serovar lai str. 56601
acaccguugcua

SEQ ID NO: 2784811 - RNA, 15 nt, Leptospira interrogans serovar lai str. 56601
acacgucaauaaugu

SEQ ID NO: 2784812 - RNA, 15 nt, Leptospira interrogans serovar lai str. 56601
acacguuuuccuaau

SEQ ID NO: 2784813 - RNA, 16 nt, Leptospira interrogans serovar lai str. 56601
acacuaaguaaaaaug

SEQ ID NO: 2784814 - RNA, 20 nt, Leptospira interrogans serovar lai str. 56601
acacuaaguaaaaaugcaaa

SEQ ID NO: 2784815 - RNA, 12 nt, Leptospira interrogans serovar lai str. 56601
acacuauaacaa

SEQ ID NO: 2784816 - RNA, 19 nt, Leptospira interrogans serovar lai str. 56601
acacucaacgaagucucca

SEQ ID NO: 2784817 - RNA, 18 nt, Leptospira interrogans serovar lai str. 56601
acacucaacgauaagaau

SEQ ID NO: 2784818 - RNA, 15 nt, Leptospira interrogans serovar lai str. 56601
acacuccucaaagau

SEQ ID NO: 2784819 - RNA, 22 nt, Leptospira interrogans serovar lai str. 56601
acacuguuucgacguaaaaaua

SEQ ID NO: 2784820 - RNA, 20 nt, Leptospira interrogans serovar lai str. 56601
acacuuugcaccgcauugau

SEQ ID NO: 2784821 - RNA, 17 nt, Leptospira interrogans serovar lai str. 56601
acagaacccaauaaaaa

SEQ ID NO: 2784822 - RNA, 18 nt, Leptospira interrogans serovar lai str. 56601
acagaacccaauaaaaac

SEQ ID NO: 2784823 - RNA, 14 nt, Leptospira interrogans serovar lai str. 56601
acagaauugaguuu

SEQ ID NO: 2784824 - RNA, 19 nt, Leptospira interrogans serovar lai str. 56601
acagaauuuuuuaacaauu

SEQ ID NO: 2784825 - RNA, 18 nt, Leptospira interrogans serovar lai str. 56601
acagacguauuuuuaaau

SEQ ID NO: 2784826 - RNA, 14 nt, Leptospira interrogans serovar lai str. 56601
acagacugauuuuu

SEQ ID NO: 2784827 - RNA, 15 nt, Leptospira interrogans serovar lai str. 56601
acagacugauuuuuu

SEQ ID NO: 2784828 - RNA, 18 nt, Leptospira interrogans serovar lai str. 56601
acagagauaggaauguuu

SEQ ID NO: 2784829 - RNA, 13 nt, Leptospira interrogans serovar lai str. 56601
acagauaaaaaua

SEQ ID NO: 2784830 - RNA, 14 nt, Leptospira interrogans serovar lai str. 56601
acagauaaaaauag

SEQ ID NO: 2784831 - RNA, 22 nt, Leptospira interrogans serovar lai str. 56601
acagauacgcccguaaauuucu

SEQ ID NO: 2784832 - RNA, 15 nt, Leptospira interrogans serovar lai str. 56601
acagauuaaauguau

SEQ ID NO: 2784833 - RNA, 21 nt, Leptospira interrogans serovar lai str. 56601
acagauucagucucauuucaa

SEQ ID NO: 2784834 - RNA, 18 nt, Leptospira interrogans serovar lai str. 56601
acagauugauuuuuuaaa

SEQ ID NO: 2784835 - RNA, 13 nt, Leptospira interrogans serovar lai str. 56601
acagcaaauucug

SEQ ID NO: 2784836 - RNA, 14 nt, Leptospira interrogans serovar lai str. 56601
acagccaaagaaau

SEQ ID NO: 2784837 - RNA, 16 nt, Leptospira interrogans serovar lai str. 56601
acagccaccaucaaaa

SEQ ID NO: 2784838 - RNA, 14 nt, Leptospira interrogans serovar lai str. 56601
acaggaaaauuuaa

SEQ ID NO: 2784839 - RNA, 17 nt, Leptospira interrogans serovar lai str. 56601
acauuugcuuugucauu

SEQ ID NO: 2784840 - RNA, 20 nt, Leptospira interrogans serovar lai str. 56601
acauuugguaauuugugaac

SEQ ID NO: 2784841 - RNA, 21 nt, Leptospira interrogans serovar lai str. 56601
acauuuuaaaguuuugaaaua

SEQ ID NO: 2784842 - RNA, 23 nt, Leptospira interrogans serovar lai str. 56601
acauuuuauugugaguuuaaaga

SEQ ID NO: 2784843 - RNA, 13 nt, Leptospira interrogans serovar lai str. 56601
acauuuucaaaau

SEQ ID NO: 2784844 - RNA, 19 nt, Leptospira interrogans serovar lai str. 56601
acauuuucgaaauuuuaca

SEQ ID NO: 2784845 - RNA, 12 nt, Leptospira interrogans serovar lai str. 56601
acauuuuuaaaa

SEQ ID NO: 2784846 - RNA, 14 nt, Leptospira interrogans serovar lai str. 56601
acauuuuuaaaaau

SEQ ID NO: 2784847 - RNA, 17 nt, Leptospira interrogans serovar lai str. 56601
acauuuuuaaaaguuau

SEQ ID NO: 2784848 - RNA, 16 nt, Leptospira interrogans serovar lai str. 56601
acauuuuucuaaauua

SEQ ID NO: 2784849 - RNA, 18 nt, Leptospira interrogans serovar lai str. 56601
acauuuuucuaaauuaau

SEQ ID NO: 2784850 - RNA, 18 nt, Leptospira interrogans serovar lai str. 56601
acauuuuugugaaacuca

SEQ ID NO: 2784851 - RNA, 18 nt, Leptospira interrogans serovar lai str. 56601
acauuuuugugaaacuua

SEQ ID NO: 2784852 - RNA, 12 nt, Leptospira interrogans serovar lai str. 56601
acauuuuuuaaa

SEQ ID NO: 2784853 - RNA, 17 nt, Leptospira interrogans serovar lai str. 56601
acauuuuuuaaauuuau

SEQ ID NO: 2784854 - RNA, 23 nt, Leptospira interrogans serovar lai str. 56601
accaaaaauagggaaaacucaac

SEQ ID NO: 2784855 - RNA, 13 nt, Leptospira interrogans serovar lai str. 56601
accaaaaaucaaa

SEQ ID NO: 2784856 - RNA, 11 nt, Leptospira interrogans serovar lai str. 56601
accaaaaaugc

SEQ ID NO: 2784857 - RNA, 17 nt, Leptospira interrogans serovar lai str. 56601
accaaaccucucggaau

SEQ ID NO: 2784858 - RNA, 21 nt, Leptospira interrogans serovar lai str. 56601
accaaaucuuucacuuuaaaa

SEQ ID NO: 2784859 - RNA, 17 nt, Leptospira interrogans serovar lai str. 56601
accaaauuguuuucuaa

SEQ ID NO: 2784860 - RNA, 13 nt, Leptospira interrogans serovar lai str. 56601
accaacagcauca

SEQ ID NO: 2784861 - RNA, 14 nt, Leptospira interrogans serovar lai str. 56601
accaaccccacaag

SEQ ID NO: 2784862 - RNA, 19 nt, Leptospira interrogans serovar lai str. 56601
accaaccgaaacuuucaaa

SEQ ID NO: 2784863 - RNA, 14 nt, Leptospira interrogans serovar lai str. 56601
accaaccucucacu

SEQ ID NO: 2784864 - RNA, 21 nt, Leptospira interrogans serovar lai str. 56601
accaacucagaugaaaguuug

SEQ ID NO: 2784865 - RNA, 15 nt, Leptospira interrogans serovar lai str. 56601
accaaggauguggaa

SEQ ID NO: 2784866 - RNA, 18 nt, Leptospira interrogans serovar lai str. 56601
accaaguucgauuaaaau

SEQ ID NO: 2784867 - RNA, 21 nt, Leptospira interrogans serovar lai str. 56601
accaauaacuuaaccucgcau

SEQ ID NO: 2784868 - RNA, 12 nt, Leptospira interrogans serovar lai str. 56601
accacaaaucua

SEQ ID NO: 2784869 - RNA, 13 nt, Leptospira interrogans serovar lai str. 56601
accacaguuccua

SEQ ID NO: 2784870 - RNA, 18 nt, Leptospira interrogans serovar lai str. 56601
accaccucuauggaauuu

SEQ ID NO: 2784871 - RNA, 14 nt, Leptospira interrogans serovar lai str. 56601
accagaaaguuagu

SEQ ID NO: 2784872 - RNA, 19 nt, Leptospira interrogans serovar lai str. 56601
accagacuccaagccgcuu

SEQ ID NO: 2784873 - RNA, 22 nt, Leptospira interrogans serovar lai str. 56601
accagagccguaaauauuuuuu

SEQ ID NO: 2784874 - RNA, 17 nt, Leptospira interrogans serovar lai str. 56601
accagaucaauucuuaa

SEQ ID NO: 2784875 - RNA, 17 nt, Leptospira interrogans serovar lai str. 56601
accagauguaaucuaua

SEQ ID NO: 2784876 - RNA, 20 nt, Leptospira interrogans serovar lai str. 56601
accagcaaaacacuuuccuu

SEQ ID NO: 2784877 - RNA, 13 nt, Leptospira interrogans serovar lai str. 56601
accagcaagcaca

SEQ ID NO: 2784878 - RNA, 14 nt, Leptospira interrogans serovar lai str. 56601
accagcaagcacau

SEQ ID NO: 2784879 - RNA, 20 nt, Leptospira interrogans serovar lai str. 56601
accagcguuuugcugaguuu

SEQ ID NO: 2784880 - RNA, 17 nt, Leptospira interrogans serovar lai str. 56601
accaguaauaguuugua

SEQ ID NO: 2784881 - RNA, 19 nt, Leptospira interrogans serovar lai str. 56601
accaguaucguuuuccauu

SEQ ID NO: 2784882 - RNA, 17 nt, Leptospira interrogans serovar lai str. 56601
accagugccauuuuucu

SEQ ID NO: 2784883 - RNA, 18 nt, Leptospira interrogans serovar lai str. 56601
accagugccauuuuucuu

SEQ ID NO: 2784884 - RNA, 18 nt, Leptospira interrogans serovar lai str. 56601
accaguuaaacuuugaaa

SEQ ID NO: 2784885 - RNA, 15 nt, Leptospira interrogans serovar lai str. 56601
accaguuaaauucau

SEQ ID NO: 2784886 - RNA, 20 nt, Leptospira interrogans serovar lai str. 56601
accauaaaauaaaaaacaaa

SEQ ID NO: 2784887 - RNA, 14 nt, Leptospira interrogans serovar lai str. 56601
accauaaauuuuaa

SEQ ID NO: 2784888 - RNA, 14 nt, Leptospira interrogans serovar lai str. 56601
accauaaauuuuga

SEQ ID NO: 2784889 - RNA, 15 nt, Leptospira interrogans serovar lai str. 56601
accauaaauuuugau

SEQ ID NO: 2784890 - RNA, 17 nt, Leptospira interrogans serovar lai str. 56601
accauaaauuuugauua

SEQ ID NO: 2784891 - RNA, 15 nt, Leptospira interrogans serovar lai str. 56601
accauaaauuuuuau

SEQ ID NO: 2784892 - RNA, 20 nt, Leptospira interrogans serovar lai str. 56601
accauaaauuuuuauuacau

SEQ ID NO: 2784893 - RNA, 14 nt, Leptospira interrogans serovar lai str. 56601
accauaaauuuuuu

SEQ ID NO: 2784894 - RNA, 19 nt, Leptospira interrogans serovar lai str. 56601
accauagaagcgagacgaa

SEQ ID NO: 2784895 - RNA, 15 nt, Leptospira interrogans serovar lai str. 56601
accaucaaaauuuaa

SEQ ID NO: 2784896 - RNA, 21 nt, Leptospira interrogans serovar lai str. 56601
accaucaaugucaaaaaaaau

SEQ ID NO: 2784897 - RNA, 17 nt, Leptospira interrogans serovar lai str. 56601
accaucucaaaaacacu

SEQ ID NO: 2784898 - RNA, 15 nt, Leptospira interrogans serovar lai str. 56601
accaucucaaaaaua

SEQ ID NO: 2784899 - RNA, 20 nt, Leptospira interrogans serovar lai str. 56601
accaucucaaaaauaucuua

SEQ ID NO: 2784900 - RNA, 16 nt, Leptospira interrogans serovar lai str. 56601
accaugaauaaacaau

SEQ ID NO: 2784901 - RNA, 22 nt, Leptospira interrogans serovar lai str. 56601
accaugccauuuuuaguuuuaa

SEQ ID NO: 2784902 - RNA, 17 nt, Leptospira interrogans serovar lai str. 56601
accauggaugaauugau

SEQ ID NO: 2784903 - RNA, 15 nt, Leptospira interrogans serovar lai str. 56601
accauggauuuuuac

SEQ ID NO: 2784904 - RNA, 23 nt, Leptospira interrogans serovar lai str. 56601
accauucauuucauauccaaaac

SEQ ID NO: 2784905 - RNA, 18 nt, Leptospira interrogans serovar lai str. 56601
accauuuaauagaucuaa

SEQ ID NO: 2784906 - RNA, 19 nt, Leptospira interrogans serovar lai str. 56601
accauuucaaguuuucuuu

SEQ ID NO: 2784907 - RNA, 11 nt, Leptospira interrogans serovar lai str. 56601
accauuuuugc

SEQ ID NO: 2784908 - RNA, 20 nt, Leptospira interrogans serovar lai str. 56601
acccaaucuuacaaguuaug

SEQ ID NO: 2784909 - RNA, 16 nt, Leptospira interrogans serovar lai str. 56601
acccaaugauucuaac

SEQ ID NO: 2784910 - RNA, 12 nt, Leptospira interrogans serovar lai str. 56601
acccagaaaaaa

SEQ ID NO: 2784911 - RNA, 18 nt, Leptospira interrogans serovar lai str. 56601
acccagucuccauaauac

SEQ ID NO: 2784912 - RNA, 14 nt, Leptospira interrogans serovar lai str. 56601
acccagucuucuug

SEQ ID NO: 2784913 - RNA, 13 nt, Leptospira interrogans serovar lai str. 56601
acccauaaaaaua

SEQ ID NO: 2784914 - RNA, 21 nt, Leptospira interrogans serovar lai str. 56601
acccauacaaaauuuaaaaau

SEQ ID NO: 2784915 - RNA, 19 nt, Leptospira interrogans serovar lai str. 56601
acccauggcuuugaaaaag

SEQ ID NO: 2784916 - RNA, 13 nt, Leptospira interrogans serovar lai str. 56601
acccauuaacuau

SEQ ID NO: 2784917 - RNA, 20 nt, Leptospira interrogans serovar lai str. 56601
acccauucaacaucauucuc

SEQ ID NO: 2784918 - RNA, 15 nt, Leptospira interrogans serovar lai str. 56601
accccacaaguugaa

SEQ ID NO: 2784919 - RNA, 19 nt, Leptospira interrogans serovar lai str. 56601
accccacacguugaauaag

SEQ ID NO: 2784920 - RNA, 17 nt, Leptospira interrogans serovar lai str. 56601
accccgaagagcuuuuc

SEQ ID NO: 2784921 - RNA, 22 nt, Leptospira interrogans serovar lai str. 56601
accccuaagcguucuaagucca

SEQ ID NO: 2784922 - RNA, 16 nt, Leptospira interrogans serovar lai str. 56601
accuuuguuuccucuu

SEQ ID NO: 2784923 - RNA, 15 nt, Leptospira interrogans serovar lai str. 56601
accuuuuaugaguuc

SEQ ID NO: 2784924 - RNA, 16 nt, Leptospira interrogans serovar lai str. 56601
accuuuugaaguagua

SEQ ID NO: 2784925 - RNA, 14 nt, Leptospira interrogans serovar lai str. 56601
accuuuuuuauuuu

SEQ ID NO: 2784926 - RNA, 19 nt, Leptospira interrogans serovar lai str. 56601
accuuuuuuuaugaaaaaa

SEQ ID NO: 2784927 - RNA, 22 nt, Leptospira interrogans serovar lai str. 56601
acgaaaaaauugacuuaggaua

SEQ ID NO: 2784928 - RNA, 19 nt, Leptospira interrogans serovar lai str. 56601
acgaaaaaugaauguuuaa

SEQ ID NO: 2784929 - RNA, 19 nt, Leptospira interrogans serovar lai str. 56601
acgaaaagaccauuuuccu

SEQ ID NO: 2784930 - RNA, 23 nt, Leptospira interrogans serovar lai str. 56601
acgaaaauuuaacgacauuagaa

SEQ ID NO: 2784931 - RNA, 19 nt, Leptospira interrogans serovar lai str. 56601
acgaacaaauucuaaaauu

SEQ ID NO: 2784932 - RNA, 18 nt, Leptospira interrogans serovar lai str. 56601
acgaaccaauucuaaaau

SEQ ID NO: 2784933 - RNA, 15 nt, Leptospira interrogans serovar lai str. 56601
acgaacgaauucuaa

SEQ ID NO: 2784934 - RNA, 22 nt, Leptospira interrogans serovar lai str. 56601
acgaagucuccagcauuuagaa

SEQ ID NO: 2784935 - RNA, 13 nt, Leptospira interrogans serovar lai str. 56601
acgaaguuccaac

SEQ ID NO: 2784936 - RNA, 23 nt, Leptospira interrogans serovar lai str. 56601
acgaaguuccaacguaccaaaac

SEQ ID NO: 2784937 - RNA, 22 nt, Leptospira interrogans serovar lai str. 56601
acgaaucagauccuuauacuuu

SEQ ID NO: 2784938 - RNA, 18 nt, Leptospira interrogans serovar lai str. 56601
acgaauccugcuaacuga

SEQ ID NO: 2784939 - RNA, 22 nt, Leptospira interrogans serovar lai str. 56601
acgaauccugcuaacugauuau

SEQ ID NO: 2784940 - RNA, 20 nt, Leptospira interrogans serovar lai str. 56601
acgaaucuguucgucguuua

SEQ ID NO: 2784941 - RNA, 15 nt, Leptospira interrogans serovar lai str. 56601
acgaauucuaaaauu

SEQ ID NO: 2784942 - RNA, 15 nt, Leptospira interrogans serovar lai str. 56601
acgaauugauaaaac

SEQ ID NO: 2784943 - RNA, 11 nt, Leptospira interrogans serovar lai str. 56601
acgaauuuuuc

SEQ ID NO: 2784944 - RNA, 16 nt, Leptospira interrogans serovar lai str. 56601
acgaauuuuuuagaaa

SEQ ID NO: 2784945 - RNA, 21 nt, Leptospira interrogans serovar lai str. 56601
acgacaaguccucuaugaaac

SEQ ID NO: 2784946 - RNA, 19 nt, Leptospira interrogans serovar lai str. 56601
acgacagauucaauuuuua

SEQ ID NO: 2784947 - RNA, 20 nt, Leptospira interrogans serovar lai str. 56601
acgagcuuuauuuggcuuua

SEQ ID NO: 2784948 - RNA, 14 nt, Leptospira interrogans serovar lai str. 56601
acgaguagaauucu

SEQ ID NO: 2784949 - RNA, 13 nt, Leptospira interrogans serovar lai str. 56601
acgaguaguucuu

SEQ ID NO: 2784950 - RNA, 19 nt, Leptospira interrogans serovar lai str. 56601
acgaguuuaaccuuuacca

SEQ ID NO: 2784951 - RNA, 21 nt, Leptospira interrogans serovar lai str. 56601
acgaguuuuuguuaucaacuu

SEQ ID NO: 2784952 - RNA, 16 nt, Leptospira interrogans serovar lai str. 56601
acgauaagucucucuu

SEQ ID NO: 2784953 - RNA, 14 nt, Leptospira interrogans serovar lai str. 56601
acgauacuuaaaaa

SEQ ID NO: 2784954 - RNA, 15 nt, Leptospira interrogans serovar lai str. 56601
acgauauuagaacug

SEQ ID NO: 2784955 - RNA, 13 nt, Leptospira interrogans serovar lai str. 56601
acgauauuuuguu

SEQ ID NO: 2784956 - RNA, 16 nt, Leptospira interrogans serovar lai str. 56601
acgaucagaaaaacaa

SEQ ID NO: 2784957 - RNA, 15 nt, Leptospira interrogans serovar lai str. 56601
acgauccguaaaaau

SEQ ID NO: 2784958 - RNA, 11 nt, Leptospira interrogans serovar lai str. 56601
acgauccuuuu

SEQ ID NO: 2784959 - RNA, 16 nt, Leptospira interrogans serovar lai str. 56601
acgauccuuuucgccc

SEQ ID NO: 2784960 - RNA, 14 nt, Leptospira interrogans serovar lai str. 56601
acgauccuuuuuug

SEQ ID NO: 2784961 - RNA, 23 nt, Leptospira interrogans serovar lai str. 56601
acgaucuaauuuguaagaacacu

SEQ ID NO: 2784962 - RNA, 19 nt, Leptospira interrogans serovar lai str. 56601
acgaucugcuuuuuuaaac

SEQ ID NO: 2784963 - RNA, 16 nt, Leptospira interrogans serovar lai str. 56601
acgauuauuuuuuaaa

SEQ ID NO: 2784964 - RNA, 15 nt, Leptospira interrogans serovar lai str. 56601
acgauucaguuuuac

SEQ ID NO: 2784965 - RNA, 20 nt, Leptospira interrogans serovar lai str. 56601
acgauucgaaagauuuuuca

SEQ ID NO: 2784966 - RNA, 19 nt, Leptospira interrogans serovar lai str. 56601
acgauugauuuuggaaaga

SEQ ID NO: 2784967 - RNA, 17 nt, Leptospira interrogans serovar lai str. 56601
acgauuucuauccauuc

SEQ ID NO: 2784968 - RNA, 18 nt, Leptospira interrogans serovar lai str. 56601
acgauuucuauccauucu

SEQ ID NO: 2784969 - RNA, 17 nt, Leptospira interrogans serovar lai str. 56601
acgauuucuauuuuucg

SEQ ID NO: 2784970 - RNA, 16 nt, Leptospira interrogans serovar lai str. 56601
acgauuuuuuacaaaa

SEQ ID NO: 2784971 - RNA, 18 nt, Leptospira interrogans serovar lai str. 56601
acgauuuuuugauucauu

SEQ ID NO: 2784972 - RNA, 18 nt, Leptospira interrogans serovar lai str. 56601
acgcagagucuauaaaau

SEQ ID NO: 2784973 - RNA, 23 nt, Leptospira interrogans serovar lai str. 56601
acgcaggcuuguuugaauuuuuc

SEQ ID NO: 2784974 - RNA, 15 nt, Leptospira interrogans serovar lai str. 56601
acgcaugauaaaaau

SEQ ID NO: 2784975 - RNA, 22 nt, Leptospira interrogans serovar lai str. 56601
acgcgaaguauucucccccaac

SEQ ID NO: 2784976 - RNA, 20 nt, Leptospira interrogans serovar lai str. 56601
acgcgauucauaaagagcgu

SEQ ID NO: 2784977 - RNA, 16 nt, Leptospira interrogans serovar lai str. 56601
acgcgccguuugcaag

SEQ ID NO: 2784978 - RNA, 19 nt, Leptospira interrogans serovar lai str. 56601
acgcguaauuuuuuggaaa

SEQ ID NO: 2784979 - RNA, 17 nt, Leptospira interrogans serovar lai str. 56601
acgcucguuauuuagga

SEQ ID NO: 2784980 - RNA, 17 nt, Leptospira interrogans serovar lai str. 56601
acgcucucuacggaucg

SEQ ID NO: 2784981 - RNA, 11 nt, Leptospira interrogans serovar lai str. 56601
acgcugaguuu

SEQ ID NO: 2784982 - RNA, 12 nt, Leptospira interrogans serovar lai str. 56601
acgcuuaaaaau

SEQ ID NO: 2784983 - RNA, 21 nt, Leptospira interrogans serovar lai str. 56601
acgcuucucuugcuugaacca

SEQ ID NO: 2784984 - RNA, 16 nt, Leptospira interrogans serovar lai str. 56601
acgcuuucguaaaaag

SEQ ID NO: 2784985 - RNA, 13 nt, Leptospira interrogans serovar lai str. 56601
acggaagaaaauu

SEQ ID NO: 2784986 - RNA, 14 nt, Leptospira interrogans serovar lai str. 56601
acggaaggaaaaaa

SEQ ID NO: 2784987 - RNA, 14 nt, Leptospira interrogans serovar lai str. 56601
acggagauaaaaaa

SEQ ID NO: 2784988 - RNA, 21 nt, Leptospira interrogans serovar lai str. 56601
acggaucgcguuugaaacuca

SEQ ID NO: 2784989 - RNA, 23 nt, Leptospira interrogans serovar lai str. 56601
acggaucgcguuugaaacucagu

SEQ ID NO: 2784990 - RNA, 24 nt, Leptospira interrogans serovar lai str. 56601
acggaugugaauucucuagaaauu

SEQ ID NO: 2784991 - RNA, 17 nt, Leptospira interrogans serovar lai str. 56601
acggauuccuccagugc

SEQ ID NO: 2784992 - RNA, 16 nt, Leptospira interrogans serovar lai str. 56601
acggcucucuccuaug

SEQ ID NO: 2784993 - RNA, 17 nt, Leptospira interrogans serovar lai str. 56601
acggcuuuaguuugaaa

SEQ ID NO: 2784994 - RNA, 16 nt, Leptospira interrogans serovar lai str. 56601
acgggcccaaauaaaa

SEQ ID NO: 2784995 - RNA, 18 nt, Leptospira interrogans serovar lai str. 56601
acgguaaaaucuuuaagu

SEQ ID NO: 2784996 - RNA, 16 nt, Leptospira interrogans serovar lai str. 56601
acgguaauauauucaa

SEQ ID NO: 2784997 - RNA, 13 nt, Leptospira interrogans serovar lai str. 56601
acgguauaaaaag

SEQ ID NO: 2784998 - RNA, 16 nt, Leptospira interrogans serovar lai str. 56601
acggugcauuuaaaaa

SEQ ID NO: 2784999 - RNA, 23 nt, Leptospira interrogans serovar lai str. 56601
acgguuuuaguaaaauuuaaauu

SEQ ID NO: 2785000 - RNA, 15 nt, Leptospira interrogans serovar lai str. 56601
acguaaaacuucuuu

SEQ ID NO: 2785001 - RNA, 18 nt, Leptospira interrogans serovar lai str. 56601
acguaaaggaauccauga

SEQ ID NO: 2785002 - RNA, 21 nt, Leptospira interrogans serovar lai str. 56601
acguaaauaaaugggccccac

SEQ ID NO: 2785003 - RNA, 14 nt, Leptospira interrogans serovar lai str. 56601
acguaaauucgaua

SEQ ID NO: 2785004 - RNA, 14 nt, Leptospira interrogans serovar lai str. 56601
acguaaggaacuca

SEQ ID NO: 2785005 - RNA, 21 nt, Leptospira interrogans serovar lai str. 56601
acuacuccccgaacuauacaa

SEQ ID NO: 2785006 - RNA, 17 nt, Leptospira interrogans serovar lai str. 56601
acuacucggacgcauga

SEQ ID NO: 2785007 - RNA, 15 nt, Leptospira interrogans serovar lai str. 56601
acuacuguaagauuu

SEQ ID NO: 2785008 - RNA, 18 nt, Leptospira interrogans serovar lai str. 56601
acuacuuuuagaaaaaau

SEQ ID NO: 2785009 - RNA, 21 nt, Leptospira interrogans serovar lai str. 56601
acuaggaaaauuuaacaacau

SEQ ID NO: 2785010 - RNA, 20 nt, Leptospira interrogans serovar lai str. 56601
acuagggaaaguuuuuuaaa

SEQ ID NO: 2785011 - RNA, 16 nt, Leptospira interrogans serovar lai str. 56601
acuagggaauuuuuca

SEQ ID NO: 2785012 - RNA, 23 nt, Leptospira interrogans serovar lai str. 56601
acuaguuccuuaaauauaucuuc

SEQ ID NO: 2785013 - RNA, 15 nt, Leptospira interrogans serovar lai str. 56601
acuauaaaguuuuag

SEQ ID NO: 2785014 - RNA, 13 nt, Leptospira interrogans serovar lai str. 56601
acuauaaaucauu

SEQ ID NO: 2785015 - RNA, 18 nt, Leptospira interrogans serovar lai str. 56601
acuauaacuuuaaaaaau

SEQ ID NO: 2785016 - RNA, 22 nt, Leptospira interrogans serovar lai str. 56601
acuauaacuuuaaaaaauaaga

SEQ ID NO: 2785017 - RNA, 18 nt, Leptospira interrogans serovar lai str. 56601
acuauaauaacaaaaaau

SEQ ID NO: 2785018 - RNA, 18 nt, Leptospira interrogans serovar lai str. 56601
acuauacuuguuucuaau

SEQ ID NO: 2785019 - RNA, 18 nt, Leptospira interrogans serovar lai str. 56601
acuauacuuucaaaaaau

SEQ ID NO: 2785020 - RNA, 21 nt, Leptospira interrogans serovar lai str. 56601
acuauacuuucaaaaaauaua

SEQ ID NO: 2785021 - RNA, 22 nt, Leptospira interrogans serovar lai str. 56601
acuauacuuucaaaaaauauaa

SEQ ID NO: 2785022 - RNA, 13 nt, Leptospira interrogans serovar lai str. 56601
acuauauucuucg

SEQ ID NO: 2785023 - RNA, 12 nt, Leptospira interrogans serovar lai str. 56601
acuauauuuuug

SEQ ID NO: 2785024 - RNA, 17 nt, Leptospira interrogans serovar lai str. 56601
acuauauuuuugugaaa

SEQ ID NO: 2785025 - RNA, 15 nt, Leptospira interrogans serovar lai str. 56601
acuaucaacaagaau

SEQ ID NO: 2785026 - RNA, 21 nt, Leptospira interrogans serovar lai str. 56601
acuaucacaaaaaugaaaaaa

SEQ ID NO: 2785027 - RNA, 15 nt, Leptospira interrogans serovar lai str. 56601
acuaucgcaaauaau

SEQ ID NO: 2785028 - RNA, 16 nt, Leptospira interrogans serovar lai str. 56601
acuaucuacccacucu

SEQ ID NO: 2785029 - RNA, 11 nt, Leptospira interrogans serovar lai str. 56601
acuaugaagac

SEQ ID NO: 2785030 - RNA, 15 nt, Leptospira interrogans serovar lai str. 56601
acuauuacaaaaucu

SEQ ID NO: 2785031 - RNA, 16 nt, Leptospira interrogans serovar lai str. 56601
acuauuacaaaaucug

SEQ ID NO: 2785032 - RNA, 17 nt, Leptospira interrogans serovar lai str. 56601
acuauuacuuuuuaaac

SEQ ID NO: 2785033 - RNA, 13 nt, Leptospira interrogans serovar lai str. 56601
acuauuauaauag

SEQ ID NO: 2785034 - RNA, 20 nt, Leptospira interrogans serovar lai str. 56601
acuauucuacagauaaaaau

SEQ ID NO: 2785035 - RNA, 20 nt, Leptospira interrogans serovar lai str. 56601
acuauucuauuaguuuuuau

SEQ ID NO: 2785036 - RNA, 22 nt, Leptospira interrogans serovar lai str. 56601
acuauuuauaaaauaaaaaaau

SEQ ID NO: 2785037 - RNA, 15 nt, Leptospira interrogans serovar lai str. 56601
acuauuuuauuacaa

SEQ ID NO: 2785038 - RNA, 16 nt, Leptospira interrogans serovar lai str. 56601
acuauuuuauuacaau

SEQ ID NO: 2785039 - RNA, 19 nt, Leptospira interrogans serovar lai str. 56601
acuauuuugaugaaugaau

SEQ ID NO: 2785040 - RNA, 20 nt, Leptospira interrogans serovar lai str. 56601
acuauuuugaugaaugaaua

SEQ ID NO: 2785041 - RNA, 23 nt, Leptospira interrogans serovar lai str. 56601
acuauuuuuuguaugaguuccua

SEQ ID NO: 2785042 - RNA, 16 nt, Leptospira interrogans serovar lai str. 56601
acucaaaaaauuuuua

SEQ ID NO: 2785043 - RNA, 21 nt, Leptospira interrogans serovar lai str. 56601
acucaaagaaucgagauugau

SEQ ID NO: 2785044 - RNA, 22 nt, Leptospira interrogans serovar lai str. 56601
acucaaaggaaaaugaagaaac

SEQ ID NO: 2785045 - RNA, 17 nt, Leptospira interrogans serovar lai str. 56601
acucaacgaagucucca

SEQ ID NO: 2785046 - RNA, 18 nt, Leptospira interrogans serovar lai str. 56601
acucaaugcaucucuucu

SEQ ID NO: 2785047 - RNA, 23 nt, Leptospira interrogans serovar lai str. 56601
acucaauguguugucuacgaucg

SEQ ID NO: 2785048 - RNA, 22 nt, Leptospira interrogans serovar lai str. 56601
acucaauuugauaugaaucagc

SEQ ID NO: 2785049 - RNA, 17 nt, Leptospira interrogans serovar lai str. 56601
acucacaccuucuuuuu

SEQ ID NO: 2785050 - RNA, 19 nt, Leptospira interrogans serovar lai str. 56601
acucacaccuucuuuuuug

SEQ ID NO: 2785051 - RNA, 16 nt, Leptospira interrogans serovar lai str. 56601
acucacauuauuuaau

SEQ ID NO: 2785052 - RNA, 15 nt, Leptospira interrogans serovar lai str. 56601
acucacgcuaaaaua

SEQ ID NO: 2785053 - RNA, 21 nt, Leptospira interrogans serovar lai str. 56601
acucacguuaaguaggaacua

SEQ ID NO: 2785054 - RNA, 15 nt, Leptospira interrogans serovar lai str. 56601
acucacguuacuacu

SEQ ID NO: 2785055 - RNA, 19 nt, Leptospira interrogans serovar lai str. 56601
acucacguuauuuuaacuu

SEQ ID NO: 2785056 - RNA, 21 nt, Leptospira interrogans serovar lai str. 56601
acucagagcgauauaauaaaa

SEQ ID NO: 2785057 - RNA, 22 nt, Leptospira interrogans serovar lai str. 56601
acucagagcgauauaauaaaau

SEQ ID NO: 2785058 - RNA, 15 nt, Leptospira interrogans serovar lai str. 56601
acucagaugaaaguu

SEQ ID NO: 2785059 - RNA, 17 nt, Leptospira interrogans serovar lai str. 56601
acucagcgaaaauacuu

SEQ ID NO: 2785060 - RNA, 24 nt, Leptospira interrogans serovar lai str. 56601
acucauaaaauaacuuccaucaga

SEQ ID NO: 2785061 - RNA, 18 nt, Leptospira interrogans serovar lai str. 56601
acucauacuucuaaaaaa

SEQ ID NO: 2785062 - RNA, 17 nt, Leptospira interrogans serovar lai str. 56601
acucauacuuuuagaag

SEQ ID NO: 2785063 - RNA, 18 nt, Leptospira interrogans serovar lai str. 56601
acucauauagaaauuaua

SEQ ID NO: 2785064 - RNA, 16 nt, Leptospira interrogans serovar lai str. 56601
acucauauuuuuagaa

SEQ ID NO: 2785065 - RNA, 16 nt, Leptospira interrogans serovar lai str. 56601
acucauggagaauaaa

SEQ ID NO: 2785066 - RNA, 18 nt, Leptospira interrogans serovar lai str. 56601
acucauucaaguaacgag

SEQ ID NO: 2785067 - RNA, 14 nt, Leptospira interrogans serovar lai str. 56601
acucauucuaguuu

SEQ ID NO: 2785068 - RNA, 22 nt, Leptospira interrogans serovar lai str. 56601
acucauucuugucggaacacuu

SEQ ID NO: 2785069 - RNA, 19 nt, Leptospira interrogans serovar lai str. 56601
acucauuuccaucuuuaua

SEQ ID NO: 2785070 - RNA, 22 nt, Leptospira interrogans serovar lai str. 56601
acucauuuugcccuauugcuuu

SEQ ID NO: 2785071 - RNA, 12 nt, Leptospira interrogans serovar lai str. 56601
acucauuuuuag

SEQ ID NO: 2785072 - RNA, 14 nt, Leptospira interrogans serovar lai str. 56601
acucauuuuuagau

SEQ ID NO: 2785073 - RNA, 18 nt, Leptospira interrogans serovar lai str. 56601
acucauuuuucuaaaaaa

SEQ ID NO: 2785074 - RNA, 20 nt, Leptospira interrogans serovar lai str. 56601
acuccaagccgcuugaacaa

SEQ ID NO: 2785075 - RNA, 20 nt, Leptospira interrogans serovar lai str. 56601
acuccagaauuagauuaaau

SEQ ID NO: 2785076 - RNA, 12 nt, Leptospira interrogans serovar lai str. 56601
acuccauucuua

SEQ ID NO: 2785077 - RNA, 16 nt, Leptospira interrogans serovar lai str. 56601
acucccacuuuuaaag

SEQ ID NO: 2785078 - RNA, 19 nt, Leptospira interrogans serovar lai str. 56601
acucccacuuuuaaagaaa

SEQ ID NO: 2785079 - RNA, 21 nt, Leptospira interrogans serovar lai str. 56601
acucgcaaacguccagauaug

SEQ ID NO: 2785080 - RNA, 17 nt, Leptospira interrogans serovar lai str. 56601
acucggcguaagaaagu

SEQ ID NO: 2785081 - RNA, 17 nt, Leptospira interrogans serovar lai str. 56601
acucgguguaaaaaaau

SEQ ID NO: 2785082 - RNA, 20 nt, Leptospira interrogans serovar lai str. 56601
acucguuuuuaguuucuuuu

SEQ ID NO: 2785083 - RNA, 21 nt, Leptospira interrogans serovar lai str. 56601
acucguuuuuaguuucuuuuu

SEQ ID NO: 2785084 - RNA, 19 nt, Leptospira interrogans serovar lai str. 56601
acucuaaaucuuaggaacu

SEQ ID NO: 2785085 - RNA, 17 nt, Leptospira interrogans serovar lai str. 56601
acucuaagcuauuuuug

SEQ ID NO: 2785086 - RNA, 18 nt, Leptospira interrogans serovar lai str. 56601
acucuaagcuauuuuuga

SEQ ID NO: 2785087 - RNA, 14 nt, Leptospira interrogans serovar lai str. 56601
acuuauuuuugaaa

SEQ ID NO: 2785088 - RNA, 16 nt, Leptospira interrogans serovar lai str. 56601
acuuauuuuugaaaag

SEQ ID NO: 2785089 - RNA, 15 nt, Leptospira interrogans serovar lai str. 56601
acuucaauuaucuau

SEQ ID NO: 2785090 - RNA, 22 nt, Leptospira interrogans serovar lai str. 56601
acuucaucaaugguuuuucuuc

SEQ ID NO: 2785091 - RNA, 21 nt, Leptospira interrogans serovar lai str. 56601
acuucauccgggcuuuucuuu

SEQ ID NO: 2785092 - RNA, 19 nt, Leptospira interrogans serovar lai str. 56601
acuuccauuggauucugcu

SEQ ID NO: 2785093 - RNA, 20 nt, Leptospira interrogans serovar lai str. 56601
acuuccauuggauucugcuc

SEQ ID NO: 2785094 - RNA, 15 nt, Leptospira interrogans serovar lai str. 56601
acuuccauuuuuuau

SEQ ID NO: 2785095 - RNA, 19 nt, Leptospira interrogans serovar lai str. 56601
acuuccauuuuuugauuug

SEQ ID NO: 2785096 - RNA, 22 nt, Leptospira interrogans serovar lai str. 56601
acuucccagacguaucaaaaua

SEQ ID NO: 2785097 - RNA, 16 nt, Leptospira interrogans serovar lai str. 56601
acuucgaucauuuuac

SEQ ID NO: 2785098 - RNA, 20 nt, Leptospira interrogans serovar lai str. 56601
acuucgucuaagggaauuug

SEQ ID NO: 2785099 - RNA, 19 nt, Leptospira interrogans serovar lai str. 56601
acuucgugggcauaggaaa

SEQ ID NO: 2785100 - RNA, 19 nt, Leptospira interrogans serovar lai str. 56601
acuucguuauaauuuucau

SEQ ID NO: 2785101 - RNA, 17 nt, Leptospira interrogans serovar lai str. 56601
acuucuaaaaaauucuu

SEQ ID NO: 2785102 - RNA, 18 nt, Leptospira interrogans serovar lai str. 56601
acuucuaaaaaauucuuu

SEQ ID NO: 2785103 - RNA, 13 nt, Leptospira interrogans serovar lai str. 56601
acuucuaacgcaa

SEQ ID NO: 2785104 - RNA, 13 nt, Leptospira interrogans serovar lai str. 56601
acuucuauacucu

SEQ ID NO: 2785105 - RNA, 16 nt, Leptospira interrogans serovar lai str. 56601
acuucuauacucuuca

SEQ ID NO: 2785106 - RNA, 13 nt, Leptospira interrogans serovar lai str. 56601
acuucucaaauug

SEQ ID NO: 2785107 - RNA, 12 nt, Leptospira interrogans serovar lai str. 56601
acuucucuaaag

SEQ ID NO: 2785108 - RNA, 14 nt, Leptospira interrogans serovar lai str. 56601
acuucucuuaaaau

SEQ ID NO: 2785109 - RNA, 16 nt, Leptospira interrogans serovar lai str. 56601
acuucucuuaaaauuu

SEQ ID NO: 2785110 - RNA, 21 nt, Leptospira interrogans serovar lai str. 56601
acuucucuuaaaauuuagaaa

SEQ ID NO: 2785111 - RNA, 22 nt, Leptospira interrogans serovar lai str. 56601
acuucucuuuucgaaaauucug

SEQ ID NO: 2785112 - RNA, 18 nt, Leptospira interrogans serovar lai str. 56601
acuucuuaaguagauaaa

SEQ ID NO: 2785113 - RNA, 19 nt, Leptospira interrogans serovar lai str. 56601
acuucuuaaguagauaaau

SEQ ID NO: 2785114 - RNA, 17 nt, Leptospira interrogans serovar lai str. 56601
acuucuugaaaggugau

SEQ ID NO: 2785115 - RNA, 16 nt, Leptospira interrogans serovar lai str. 56601
acuucuugaacucaau

SEQ ID NO: 2785116 - RNA, 17 nt, Leptospira interrogans serovar lai str. 56601
acuucuugaacucaaug

SEQ ID NO: 2785117 - RNA, 13 nt, Leptospira interrogans serovar lai str. 56601
acuucuuuuuugu

SEQ ID NO: 2785118 - RNA, 19 nt, Leptospira interrogans serovar lai str. 56601
acuugaaaaagcggucuug

SEQ ID NO: 2785119 - RNA, 12 nt, Leptospira interrogans serovar lai str. 56601
acuugaaaaaug

SEQ ID NO: 2785120 - RNA, 20 nt, Leptospira interrogans serovar lai str. 56601
acuugaacuguuuaauuucu

SEQ ID NO: 2785121 - RNA, 22 nt, Leptospira interrogans serovar lai str. 56601
acuugagaagggugaauuuuuu

SEQ ID NO: 2785122 - RNA, 20 nt, Leptospira interrogans serovar lai str. 56601
acuugagauuccuuuuaaga

SEQ ID NO: 2785123 - RNA, 20 nt, Leptospira interrogans serovar lai str. 56601
acuugauuugagaaucuuca

SEQ ID NO: 2785124 - RNA, 12 nt, Leptospira interrogans serovar lai str. 56601
acuugauuuuac

SEQ ID NO: 2785125 - RNA, 14 nt, Leptospira interrogans serovar lai str. 56601
acuugcaauuuuac

SEQ ID NO: 2785126 - RNA, 15 nt, Leptospira interrogans serovar lai str. 56601
acuugccauggaaau

SEQ ID NO: 2785127 - RNA, 18 nt, Leptospira interrogans serovar lai str. 56601
acuugccauggaaauuuu

SEQ ID NO: 2785128 - RNA, 16 nt, Leptospira interrogans serovar lai str. 56601
acuuggaaucuuaaaa

SEQ ID NO: 2785129 - RNA, 20 nt, Leptospira interrogans serovar lai str. 56601
acuugguuggauuccuuucu

SEQ ID NO: 2785130 - RNA, 17 nt, Leptospira interrogans serovar lai str. 56601
acuugucccaaaacuuc

SEQ ID NO: 2785131 - RNA, 17 nt, Leptospira interrogans serovar lai str. 56601
acuugucccaaaauuuc

SEQ ID NO: 2785132 - RNA, 16 nt, Leptospira interrogans serovar lai str. 56601
acuuguuccaaaacua

SEQ ID NO: 2785133 - RNA, 17 nt, Leptospira interrogans serovar lai str. 56601
acuuguuguaccauuuu

SEQ ID NO: 2785134 - RNA, 22 nt, Leptospira interrogans serovar lai str. 56601
acuuuaaaaaauaagaagccaa

SEQ ID NO: 2785135 - RNA, 22 nt, Leptospira interrogans serovar lai str. 56601
acuuuaaaaaugaucuaagauu

SEQ ID NO: 2785136 - RNA, 20 nt, Leptospira interrogans serovar lai str. 56601
acuuuaaaguugguuuuguu

SEQ ID NO: 2785137 - RNA, 12 nt, Leptospira interrogans serovar lai str. 56601
acuuuaagaaaa

SEQ ID NO: 2785138 - RNA, 21 nt, Leptospira interrogans serovar lai str. 56601
acuuuaagaaaauuuaaaaua

SEQ ID NO: 2785139 - RNA, 20 nt, Leptospira interrogans serovar lai str. 56601
acuuuaagcaaagauuaagu

SEQ ID NO: 2785140 - RNA, 21 nt, Leptospira interrogans serovar lai str. 56601
acuuuaauaauaugaauucau

SEQ ID NO: 2785141 - RNA, 16 nt, Leptospira interrogans serovar lai str. 56601
acuuuaaucauuuuca

SEQ ID NO: 2785142 - RNA, 15 nt, Leptospira interrogans serovar lai str. 56601
acuuuaauuuuagua

SEQ ID NO: 2785143 - RNA, 16 nt, Leptospira interrogans serovar lai str. 56601
acuuuaauuuucuuag

SEQ ID NO: 2785144 - RNA, 22 nt, Leptospira interrogans serovar lai str. 56601
acuuuaauuuucuuaguuuugu

SEQ ID NO: 2785145 - RNA, 17 nt, Leptospira interrogans serovar lai str. 56601
acuuuacagacugauuu

SEQ ID NO: 2785146 - RNA, 21 nt, Leptospira interrogans serovar lai str. 56601
acuuuaccgucaauuuuuagu

SEQ ID NO: 2785147 - RNA, 18 nt, Leptospira interrogans serovar lai str. 56601
acuuuagaaaaauauuau

SEQ ID NO: 2785148 - RNA, 21 nt, Leptospira interrogans serovar lai str. 56601
acuuuagaaaaauauuauauu

SEQ ID NO: 2785149 - RNA, 12 nt, Leptospira interrogans serovar lai str. 56601
acuuuaguucuc

SEQ ID NO: 2785150 - RNA, 15 nt, Leptospira interrogans serovar lai str. 56601
acuuuaguucuccua

SEQ ID NO: 2785151 - RNA, 22 nt, Leptospira interrogans serovar lai str. 56601
acuuuauaauugaacauuuuua

SEQ ID NO: 2785152 - RNA, 17 nt, Leptospira interrogans serovar lai str. 56601
acuuuauagucaaauuu

SEQ ID NO: 2785153 - RNA, 16 nt, Leptospira interrogans serovar lai str. 56601
acuuuauuaaaaaguu

SEQ ID NO: 2785154 - RNA, 13 nt, Leptospira interrogans serovar lai str. 56601
acuuuauucaaaa

SEQ ID NO: 2785155 - RNA, 19 nt, Leptospira interrogans serovar lai str. 56601
acuuuauucaaaauagaau

SEQ ID NO: 2785156 - RNA, 21 nt, Leptospira interrogans serovar lai str. 56601
acuuuauuuguauucaagagc

SEQ ID NO: 2785157 - RNA, 17 nt, Leptospira interrogans serovar lai str. 56601
acuuuauuuuauaauuc

SEQ ID NO: 2785158 - RNA, 16 nt, Leptospira interrogans serovar lai str. 56601
acuuucaaaaaauaua

SEQ ID NO: 2785159 - RNA, 15 nt, Leptospira interrogans serovar lai str. 56601
acuuucagauuaaaa

SEQ ID NO: 2785160 - RNA, 18 nt, Leptospira interrogans serovar lai str. 56601
acuuucagcuacaaucaa

SEQ ID NO: 2785161 - RNA, 22 nt, Leptospira interrogans serovar lai str. 56601
acuuucauugauaauuucuagu

SEQ ID NO: 2785162 - RNA, 12 nt, Leptospira interrogans serovar lai str. 56601
acuuuccacuuu

SEQ ID NO: 2785163 - RNA, 15 nt, Leptospira interrogans serovar lai str. 56601
acuuuccagaaagaa

SEQ ID NO: 2785164 - RNA, 21 nt, Leptospira interrogans serovar lai str. 56601
acuuucgagcaguucuaaugu

SEQ ID NO: 2785165 - RNA, 12 nt, Leptospira interrogans serovar lai str. 56601
acuuucuaaaaa

SEQ ID NO: 2785166 - RNA, 14 nt, Leptospira interrogans serovar lai str. 56601
acuuucuaaaaaua

SEQ ID NO: 2785167 - RNA, 14 nt, Leptospira interrogans serovar lai str. 56601
acuuucucgaaaau

SEQ ID NO: 2785168 - RNA, 23 nt, Leptospira interrogans serovar lai str. 56601
acuuucucgaaaaucucagaaaa

SEQ ID NO: 2785169 - RNA, 18 nt, Leptospira interrogans serovar lai str. 56601
acuuucuguauuuuuaag

SEQ ID NO: 2785170 - RNA, 10 nt, Leptospira interrogans serovar lai str. 56601
agaaaauuca

SEQ ID NO: 2785171 - RNA, 13 nt, Leptospira interrogans serovar lai str. 56601
agaaaauuuaaac

SEQ ID NO: 2785172 - RNA, 23 nt, Leptospira interrogans serovar lai str. 56601
agaaaauuuaaacaacaguacaa

SEQ ID NO: 2785173 - RNA, 11 nt, Leptospira interrogans serovar lai str. 56601
agaaacaaaga

SEQ ID NO: 2785174 - RNA, 22 nt, Leptospira interrogans serovar lai str. 56601
agaaacaaagaauaccaaaaaa

SEQ ID NO: 2785175 - RNA, 17 nt, Leptospira interrogans serovar lai str. 56601
agaaacaaggcuuugua

SEQ ID NO: 2785176 - RNA, 20 nt, Leptospira interrogans serovar lai str. 56601
agaaacacucccccuuccga

SEQ ID NO: 2785177 - RNA, 20 nt, Leptospira interrogans serovar lai str. 56601
agaaacacuuugagaaagaa

SEQ ID NO: 2785178 - RNA, 23 nt, Leptospira interrogans serovar lai str. 56601
agaaacacuuugagaaagaacaa

SEQ ID NO: 2785179 - RNA, 14 nt, Leptospira interrogans serovar lai str. 56601
agaaaccaguaaua

SEQ ID NO: 2785180 - RNA, 15 nt, Leptospira interrogans serovar lai str. 56601
agaaaccauaaaaua

SEQ ID NO: 2785181 - RNA, 17 nt, Leptospira interrogans serovar lai str. 56601
agaaaccauaaaauaaa

SEQ ID NO: 2785182 - RNA, 18 nt, Leptospira interrogans serovar lai str. 56601
agaaaccauaaaauaaaa

SEQ ID NO: 2785183 - RNA, 14 nt, Leptospira interrogans serovar lai str. 56601
agaaaccuuuucua

SEQ ID NO: 2785184 - RNA, 15 nt, Leptospira interrogans serovar lai str. 56601
agaaaccuuuucuag

SEQ ID NO: 2785185 - RNA, 16 nt, Leptospira interrogans serovar lai str. 56601
agaaacggaagaaaau

SEQ ID NO: 2785186 - RNA, 18 nt, Leptospira interrogans serovar lai str. 56601
agaaacggaagaaaauua

SEQ ID NO: 2785187 - RNA, 22 nt, Leptospira interrogans serovar lai str. 56601
agaaacggugcauuuaaaaaau

SEQ ID NO: 2785188 - RNA, 16 nt, Leptospira interrogans serovar lai str. 56601
agaaacucaguaaaac

SEQ ID NO: 2785189 - RNA, 20 nt, Leptospira interrogans serovar lai str. 56601
agaaacucgcaaacguccag

SEQ ID NO: 2785190 - RNA, 21 nt, Leptospira interrogans serovar lai str. 56601
agaaacucgcaaacguccaga

SEQ ID NO: 2785191 - RNA, 21 nt, Leptospira interrogans serovar lai str. 56601
agaaacuggaauauucuuuuu

SEQ ID NO: 2785192 - RNA, 16 nt, Leptospira interrogans serovar lai str. 56601
agaaacuuauacuuua

SEQ ID NO: 2785193 - RNA, 22 nt, Leptospira interrogans serovar lai str. 56601
agaaacuuauacuuuauagaaa

SEQ ID NO: 2785194 - RNA, 17 nt, Leptospira interrogans serovar lai str. 56601
agaaacuuuaaauacuu

SEQ ID NO: 2785195 - RNA, 13 nt, Leptospira interrogans serovar lai str. 56601
agaaagaauuuaa

SEQ ID NO: 2785196 - RNA, 15 nt, Leptospira interrogans serovar lai str. 56601
agaaagaauuucuaa

SEQ ID NO: 2785197 - RNA, 22 nt, Leptospira interrogans serovar lai str. 56601
agaaagacuuuuccuaaaauuu

SEQ ID NO: 2785198 - RNA, 10 nt, Leptospira interrogans serovar lai str. 56601
agaaagauuu

SEQ ID NO: 2785199 - RNA, 22 nt, Leptospira interrogans serovar lai str. 56601
agaaagcaaacuuuuuauaaaa

SEQ ID NO: 2785200 - RNA, 20 nt, Leptospira interrogans serovar lai str. 56601
agaaagcccguucuguugag

SEQ ID NO: 2785201 - RNA, 21 nt, Leptospira interrogans serovar lai str. 56601
agaaagcccguucuguugagu

SEQ ID NO: 2785202 - RNA, 18 nt, Leptospira interrogans serovar lai str. 56601
agaaagcgacuccuauau

SEQ ID NO: 2785203 - RNA, 20 nt, Leptospira interrogans serovar lai str. 56601
agaaagcgcagacucuucuc

SEQ ID NO: 2785204 - RNA, 17 nt, Leptospira interrogans serovar lai str. 56601
agaaagcucuccaucuu

SEQ ID NO: 2785205 - RNA, 17 nt, Leptospira interrogans serovar lai str. 56601
agaaaggaacuaaguuu

SEQ ID NO: 2785206 - RNA, 21 nt, Leptospira interrogans serovar lai str. 56601
agaaaggcggagaaauuaauu

SEQ ID NO: 2785207 - RNA, 14 nt, Leptospira interrogans serovar lai str. 56601
agaaaguaaaauua

SEQ ID NO: 2785208 - RNA, 16 nt, Leptospira interrogans serovar lai str. 56601
agaaaguaaaauuaca

SEQ ID NO: 2785209 - RNA, 14 nt, Leptospira interrogans serovar lai str. 56601
agaaaguauuaauu

SEQ ID NO: 2785210 - RNA, 13 nt, Leptospira interrogans serovar lai str. 56601
agaaaguuaguag

SEQ ID NO: 2785211 - RNA, 16 nt, Leptospira interrogans serovar lai str. 56601
agaaaguugcaaagaa

SEQ ID NO: 2785212 - RNA, 17 nt, Leptospira interrogans serovar lai str. 56601
agaaaguugcaaagaag

SEQ ID NO: 2785213 - RNA, 20 nt, Leptospira interrogans serovar lai str. 56601
agaaaguugcaaagaagaaa

SEQ ID NO: 2785214 - RNA, 21 nt, Leptospira interrogans serovar lai str. 56601
agaaaguugcaaagaagaaau

SEQ ID NO: 2785215 - RNA, 22 nt, Leptospira interrogans serovar lai str. 56601
agaaaguugcaaagaagaaaua

SEQ ID NO: 2785216 - RNA, 19 nt, Leptospira interrogans serovar lai str. 56601
agaaaguuuauaaagcaaa

SEQ ID NO: 2785217 - RNA, 21 nt, Leptospira interrogans serovar lai str. 56601
agaaauaaguaaaucuagcaa

SEQ ID NO: 2785218 - RNA, 23 nt, Leptospira interrogans serovar lai str. 56601
agaaauacacggagauaaaaaag

SEQ ID NO: 2785219 - RNA, 20 nt, Leptospira interrogans serovar lai str. 56601
agaaauaccauucauuucau

SEQ ID NO: 2785220 - RNA, 17 nt, Leptospira interrogans serovar lai str. 56601
agaaauacuuaaaauga

SEQ ID NO: 2785221 - RNA, 12 nt, Leptospira interrogans serovar lai str. 56601
agaaauacuuug

SEQ ID NO: 2785222 - RNA, 15 nt, Leptospira interrogans serovar lai str. 56601
agaaauacuuugauu

SEQ ID NO: 2785223 - RNA, 22 nt, Leptospira interrogans serovar lai str. 56601
agaaauacuuugauuauaaccu

SEQ ID NO: 2785224 - RNA, 15 nt, Leptospira interrogans serovar lai str. 56601
agaaauagaaaagca

SEQ ID NO: 2785225 - RNA, 16 nt, Leptospira interrogans serovar lai str. 56601
agaaauagaaaagcau

SEQ ID NO: 2785226 - RNA, 19 nt, Leptospira interrogans serovar lai str. 56601
agaaauagaaaagcauaau

SEQ ID NO: 2785227 - RNA, 14 nt, Leptospira interrogans serovar lai str. 56601
agaaauagaaaccu

SEQ ID NO: 2785228 - RNA, 15 nt, Leptospira interrogans serovar lai str. 56601
agaaauagaaaccuu

SEQ ID NO: 2785229 - RNA, 17 nt, Leptospira interrogans serovar lai str. 56601
agaaauagaaaccuuuc

SEQ ID NO: 2785230 - RNA, 12 nt, Leptospira interrogans serovar lai str. 56601
agaaauauuaaa

SEQ ID NO: 2785231 - RNA, 15 nt, Leptospira interrogans serovar lai str. 56601
agaaauauuaaaaaa

SEQ ID NO: 2785232 - RNA, 19 nt, Leptospira interrogans serovar lai str. 56601
agaaaucaauggaaaauua

SEQ ID NO: 2785233 - RNA, 17 nt, Leptospira interrogans serovar lai str. 56601
agaaaucauuuuuuguu

SEQ ID NO: 2785234 - RNA, 17 nt, Leptospira interrogans serovar lai str. 56601
agaaaucgauuuguaaa

SEQ ID NO: 2785235 - RNA, 22 nt, Leptospira interrogans serovar lai str. 56601
agaaaucgauuuguaaaauuca

SEQ ID NO: 2785236 - RNA, 22 nt, Leptospira interrogans serovar lai str. 56601
agaaaugagggcucccacaauu

SEQ ID NO: 2785237 - RNA, 19 nt, Leptospira interrogans serovar lai str. 56601
agaaaugauuuuuuaaaau

SEQ ID NO: 2785238 - RNA, 15 nt, Leptospira interrogans serovar lai str. 56601
agaaauguaggaacu

SEQ ID NO: 2785239 - RNA, 17 nt, Leptospira interrogans serovar lai str. 56601
agaaauuaaaguaucca

SEQ ID NO: 2785240 - RNA, 19 nt, Leptospira interrogans serovar lai str. 56601
agaaauuaaaguauccauu

SEQ ID NO: 2785241 - RNA, 17 nt, Leptospira interrogans serovar lai str. 56601
agaaauuaauuucuaaa

SEQ ID NO: 2785242 - RNA, 20 nt, Leptospira interrogans serovar lai str. 56601
agaaauuaauuucuaaacaa

SEQ ID NO: 2785243 - RNA, 23 nt, Leptospira interrogans serovar lai str. 56601
agaaauuauaguaacagaaaaau

SEQ ID NO: 2785244 - RNA, 13 nt, Leptospira interrogans serovar lai str. 56601
agaaauuugauuu

SEQ ID NO: 2785245 - RNA, 18 nt, Leptospira interrogans serovar lai str. 56601
agaaauuuucaaaaaaua

SEQ ID NO: 2785246 - RNA, 21 nt, Leptospira interrogans serovar lai str. 56601
agaaauuuucaaaaaauauca

SEQ ID NO: 2785247 - RNA, 17 nt, Leptospira interrogans serovar lai str. 56601
agaaauuuuuaauaaaa

SEQ ID NO: 2785248 - RNA, 18 nt, Leptospira interrogans serovar lai str. 56601
agaaauuuuuaauaaaau

SEQ ID NO: 2785249 - RNA, 21 nt, Leptospira interrogans serovar lai str. 56601
agaaauuuuuaauaaaaugca

SEQ ID NO: 2785250 - RNA, 18 nt, Leptospira interrogans serovar lai str. 56601
agaaauuuuuaauauacu

SEQ ID NO: 2785251 - RNA, 19 nt, Leptospira interrogans serovar lai str. 56601
agaaauuuuuaaucaaaug

SEQ ID NO: 2785252 - RNA, 21 nt, Leptospira interrogans serovar lai str. 56601
agaacaaauccuggacugaau

SEQ ID NO: 2785253 - RNA, 23 nt, Leptospira interrogans serovar lai str. 56601
agaaucauuggaguuuuuuaaaa

SEQ ID NO: 2785254 - RNA, 22 nt, Leptospira interrogans serovar lai str. 56601
agaauccuguuugaaaaaaugu

SEQ ID NO: 2785255 - RNA, 17 nt, Leptospira interrogans serovar lai str. 56601
agaaucgaaaaaauaca

SEQ ID NO: 2785256 - RNA, 19 nt, Leptospira interrogans serovar lai str. 56601
agaaucgauaggaguauaa

SEQ ID NO: 2785257 - RNA, 20 nt, Leptospira interrogans serovar lai str. 56601
agaaucgucgcucaaucaaa

SEQ ID NO: 2785258 - RNA, 12 nt, Leptospira interrogans serovar lai str. 56601
agaaucuaucuc

SEQ ID NO: 2785259 - RNA, 17 nt, Leptospira interrogans serovar lai str. 56601
agaaucugaacuuuaua

SEQ ID NO: 2785260 - RNA, 23 nt, Leptospira interrogans serovar lai str. 56601
agaaucuguuuuguuuccuucuu

SEQ ID NO: 2785261 - RNA, 15 nt, Leptospira interrogans serovar lai str. 56601
agaaucuugggguuu

SEQ ID NO: 2785262 - RNA, 18 nt, Leptospira interrogans serovar lai str. 56601
agaaucuugggguuuuug

SEQ ID NO: 2785263 - RNA, 21 nt, Leptospira interrogans serovar lai str. 56601
agaaucuugggguuuuuguaa

SEQ ID NO: 2785264 - RNA, 18 nt, Leptospira interrogans serovar lai str. 56601
agaaugaaaaaacggccg

SEQ ID NO: 2785265 - RNA, 20 nt, Leptospira interrogans serovar lai str. 56601
agaaugagaaggaucaaaac

SEQ ID NO: 2785266 - RNA, 14 nt, Leptospira interrogans serovar lai str. 56601
agaaugagcugagu

SEQ ID NO: 2785267 - RNA, 16 nt, Leptospira interrogans serovar lai str. 56601
agaaugagucuuuuua

SEQ ID NO: 2785268 - RNA, 17 nt, Leptospira interrogans serovar lai str. 56601
agaaugaucaauagaau

SEQ ID NO: 2785269 - RNA, 19 nt, Leptospira interrogans serovar lai str. 56601
agaaugaucaauagaauug

SEQ ID NO: 2785270 - RNA, 20 nt, Leptospira interrogans serovar lai str. 56601
agaauguaaaugaauuggaa

SEQ ID NO: 2785271 - RNA, 14 nt, Leptospira interrogans serovar lai str. 56601
agaauguucuuaga

SEQ ID NO: 2785272 - RNA, 22 nt, Leptospira interrogans serovar lai str. 56601
agaauguucuuagacucaguau

SEQ ID NO: 2785273 - RNA, 22 nt, Leptospira interrogans serovar lai str. 56601
agaauguuugagguuuuaaaag

SEQ ID NO: 2785274 - RNA, 18 nt, Leptospira interrogans serovar lai str. 56601
agaauguuuuccagaaac

SEQ ID NO: 2785275 - RNA, 14 nt, Leptospira interrogans serovar lai str. 56601
agaauguuuucuac

SEQ ID NO: 2785276 - RNA, 13 nt, Leptospira interrogans serovar lai str. 56601
agaauuaaaaauu

SEQ ID NO: 2785277 - RNA, 16 nt, Leptospira interrogans serovar lai str. 56601
agaauuaaaaauuaau

SEQ ID NO: 2785278 - RNA, 15 nt, Leptospira interrogans serovar lai str. 56601
agaauuaauuuuuca

SEQ ID NO: 2785279 - RNA, 15 nt, Leptospira interrogans serovar lai str. 56601
agaauuaauuuuuua

SEQ ID NO: 2785280 - RNA, 15 nt, Leptospira interrogans serovar lai str. 56601
agaauuagauuaaau

SEQ ID NO: 2785281 - RNA, 20 nt, Leptospira interrogans serovar lai str. 56601
agaauuauuuacuuuuucca

SEQ ID NO: 2785282 - RNA, 23 nt, Leptospira interrogans serovar lai str. 56601
agaauuauuuacuuuuuccaaaa

SEQ ID NO: 2785283 - RNA, 22 nt, Leptospira interrogans serovar lai str. 56601
agaauucauuuuacagaauauu

SEQ ID NO: 2785284 - RNA, 22 nt, Leptospira interrogans serovar lai str. 56601
agaauucauuuuucuacaauua

SEQ ID NO: 2785285 - RNA, 17 nt, Leptospira interrogans serovar lai str. 56601
agaauucuacauucuga

SEQ ID NO: 2785286 - RNA, 13 nt, Leptospira interrogans serovar lai str. 56601
agaauucuccaca

SEQ ID NO: 2785287 - RNA, 16 nt, Leptospira interrogans serovar lai str. 56601
agaauucuuugaacca

SEQ ID NO: 2785288 - RNA, 14 nt, Leptospira interrogans serovar lai str. 56601
agaauugaaagaag

SEQ ID NO: 2785289 - RNA, 19 nt, Leptospira interrogans serovar lai str. 56601
agaauugaaagaagauaga

SEQ ID NO: 2785290 - RNA, 14 nt, Leptospira interrogans serovar lai str. 56601
agaauugaucuaaa

SEQ ID NO: 2785291 - RNA, 15 nt, Leptospira interrogans serovar lai str. 56601
agaauugauuuuuca

SEQ ID NO: 2785292 - RNA, 21 nt, Leptospira interrogans serovar lai str. 56601
agaauugauuuuucaacaacu

SEQ ID NO: 2785293 - RNA, 19 nt, Leptospira interrogans serovar lai str. 56601
agaauuguguuaguuccca

SEQ ID NO: 2785294 - RNA, 14 nt, Leptospira interrogans serovar lai str. 56601
agaauuguugaaaa

SEQ ID NO: 2785295 - RNA, 15 nt, Leptospira interrogans serovar lai str. 56601
agaauuguugaaaaa

SEQ ID NO: 2785296 - RNA, 17 nt, Leptospira interrogans serovar lai str. 56601
agaauuguugaaaaacu

SEQ ID NO: 2785297 - RNA, 18 nt, Leptospira interrogans serovar lai str. 56601
agaauuguugaaaaauua

SEQ ID NO: 2785298 - RNA, 19 nt, Leptospira interrogans serovar lai str. 56601
agaauuguugaaaaauuaa

SEQ ID NO: 2785299 - RNA, 16 nt, Leptospira interrogans serovar lai str. 56601
agaauuuaauaaaaaa

SEQ ID NO: 2785300 - RNA, 17 nt, Leptospira interrogans serovar lai str. 56601
agaauuuauucguaaaa

SEQ ID NO: 2785301 - RNA, 20 nt, Leptospira interrogans serovar lai str. 56601
agaauuuauucguaaaaucu

SEQ ID NO: 2785302 - RNA, 20 nt, Leptospira interrogans serovar lai str. 56601
agaauuuauuucaaaauuua

SEQ ID NO: 2785303 - RNA, 15 nt, Leptospira interrogans serovar lai str. 56601
agaauuuauuuguaa

SEQ ID NO: 2785304 - RNA, 15 nt, Leptospira interrogans serovar lai str. 56601
agaauuuauuuucau

SEQ ID NO: 2785305 - RNA, 17 nt, Leptospira interrogans serovar lai str. 56601
agaauuuccuaaaagua

SEQ ID NO: 2785306 - RNA, 17 nt, Leptospira interrogans serovar lai str. 56601
agaauuucuaaaauucu

SEQ ID NO: 2785307 - RNA, 21 nt, Leptospira interrogans serovar lai str. 56601
agaauuucuaaaauucuuccg

SEQ ID NO: 2785308 - RNA, 21 nt, Leptospira interrogans serovar lai str. 56601
agaauuuguuuguaaaauagu

SEQ ID NO: 2785309 - RNA, 17 nt, Leptospira interrogans serovar lai str. 56601
agaauuuguuugucuuu

SEQ ID NO: 2785310 - RNA, 15 nt, Leptospira interrogans serovar lai str. 56601
agaauuuguuuuaaa

SEQ ID NO: 2785311 - RNA, 16 nt, Leptospira interrogans serovar lai str. 56601
agaauuuguuuuaaaa

SEQ ID NO: 2785312 - RNA, 17 nt, Leptospira interrogans serovar lai str. 56601
agaauuuguuuuaaaau

SEQ ID NO: 2785313 - RNA, 23 nt, Leptospira interrogans serovar lai str. 56601
agaauuuguuuuaaaauuuauga

SEQ ID NO: 2785314 - RNA, 13 nt, Leptospira interrogans serovar lai str. 56601
agaauuuuaaaaa

SEQ ID NO: 2785315 - RNA, 15 nt, Leptospira interrogans serovar lai str. 56601
agaauuuuaaaaaau

SEQ ID NO: 2785316 - RNA, 16 nt, Leptospira interrogans serovar lai str. 56601
agaauuuuaaaaaaug

SEQ ID NO: 2785317 - RNA, 13 nt, Leptospira interrogans serovar lai str. 56601
agaauuuuagaau

SEQ ID NO: 2785318 - RNA, 14 nt, Leptospira interrogans serovar lai str. 56601
agaauuuuagaaua

SEQ ID NO: 2785319 - RNA, 20 nt, Leptospira interrogans serovar lai str. 56601
agaauuuucuaaaaguauga

SEQ ID NO: 2785320 - RNA, 19 nt, Leptospira interrogans serovar lai str. 56601
agaauuuugaacauuuuca

SEQ ID NO: 2785321 - RNA, 14 nt, Leptospira interrogans serovar lai str. 56601
agaauuuugcaaaa

SEQ ID NO: 2785322 - RNA, 22 nt, Leptospira interrogans serovar lai str. 56601
agaauuuugcaaaaaaaauacg

SEQ ID NO: 2785323 - RNA, 17 nt, Leptospira interrogans serovar lai str. 56601
agaauuuuuaaaaauau

SEQ ID NO: 2785324 - RNA, 17 nt, Leptospira interrogans serovar lai str. 56601
agaauuuuuacagaaaa

SEQ ID NO: 2785325 - RNA, 21 nt, Leptospira interrogans serovar lai str. 56601
agaauuuuuaugagcuuugua

SEQ ID NO: 2785326 - RNA, 20 nt, Leptospira interrogans serovar lai str. 56601
agaauuuuucgaaacaaaau

SEQ ID NO: 2785327 - RNA, 20 nt, Leptospira interrogans serovar lai str. 56601
agaauuuuuggaacgaagaa

SEQ ID NO: 2785328 - RNA, 12 nt, Leptospira interrogans serovar lai str. 56601
agacaaaaaauu

SEQ ID NO: 2785329 - RNA, 12 nt, Leptospira interrogans serovar lai str. 56601
agacaaaaauac

SEQ ID NO: 2785330 - RNA, 17 nt, Leptospira interrogans serovar lai str. 56601
agacaaaaauacuaaau

SEQ ID NO: 2785331 - RNA, 14 nt, Leptospira interrogans serovar lai str. 56601
agacaaaguauuuu

SEQ ID NO: 2785332 - RNA, 17 nt, Leptospira interrogans serovar lai str. 56601
agacaaaguauuuucua

SEQ ID NO: 2785333 - RNA, 16 nt, Leptospira interrogans serovar lai str. 56601
agacaaauauuucgac

SEQ ID NO: 2785334 - RNA, 12 nt, Leptospira interrogans serovar lai str. 56601
agacaagaagaa

SEQ ID NO: 2785335 - RNA, 20 nt, Leptospira interrogans serovar lai str. 56601
agacaggcucaauauuuaaa

SEQ ID NO: 2785336 - RNA, 17 nt, Leptospira interrogans serovar lai str. 56601
agagugguuuucaaaua

SEQ ID NO: 2785337 - RNA, 19 nt, Leptospira interrogans serovar lai str. 56601
agagugguuuucaaauauu

SEQ ID NO: 2785338 - RNA, 22 nt, Leptospira interrogans serovar lai str. 56601
agaguuccacauuuuaaagguu

SEQ ID NO: 2785339 - RNA, 10 nt, Leptospira interrogans serovar lai str. 56601
agaguuccua

SEQ ID NO: 2785340 - RNA, 16 nt, Leptospira interrogans serovar lai str. 56601
agaguucguuaagaau

SEQ ID NO: 2785341 - RNA, 19 nt, Leptospira interrogans serovar lai str. 56601
agaguuguccuaaaaccuc

SEQ ID NO: 2785342 - RNA, 14 nt, Leptospira interrogans serovar lai str. 56601
agaguuguugaaaa

SEQ ID NO: 2785343 - RNA, 17 nt, Leptospira interrogans serovar lai str. 56601
agaguuguugaaagggg

SEQ ID NO: 2785344 - RNA, 23 nt, Leptospira interrogans serovar lai str. 56601
agaguuguuuaucuucucuagaa

SEQ ID NO: 2785345 - RNA, 13 nt, Leptospira interrogans serovar lai str. 56601
agaguuuaaaaaa

SEQ ID NO: 2785346 - RNA, 17 nt, Leptospira interrogans serovar lai str. 56601
agaguuucuaaaaaaau

SEQ ID NO: 2785347 - RNA, 18 nt, Leptospira interrogans serovar lai str. 56601
agaguuucuaaaaaaauu

SEQ ID NO: 2785348 - RNA, 17 nt, Leptospira interrogans serovar lai str. 56601
agaguuugaguuucuuu

SEQ ID NO: 2785349 - RNA, 11 nt, Leptospira interrogans serovar lai str. 56601
agauaaaaaag

SEQ ID NO: 2785350 - RNA, 18 nt, Leptospira interrogans serovar lai str. 56601
agauaaaacucaaaggaa

SEQ ID NO: 2785351 - RNA, 20 nt, Leptospira interrogans serovar lai str. 56601
agauaaaacucaaaggaaaa

SEQ ID NO: 2785352 - RNA, 15 nt, Leptospira interrogans serovar lai str. 56601
agauaaauauuucca

SEQ ID NO: 2785353 - RNA, 22 nt, Leptospira interrogans serovar lai str. 56601
agauaacaucuugaaaccccau

SEQ ID NO: 2785354 - RNA, 12 nt, Leptospira interrogans serovar lai str. 56601
agauaauuaaac

SEQ ID NO: 2785355 - RNA, 21 nt, Leptospira interrogans serovar lai str. 56601
agauaauuaaacaaagaauaa

SEQ ID NO: 2785356 - RNA, 17 nt, Leptospira interrogans serovar lai str. 56601
agauacucaauuugaua

SEQ ID NO: 2785357 - RNA, 20 nt, Leptospira interrogans serovar lai str. 56601
agauagagaauuaauuuuuc

SEQ ID NO: 2785358 - RNA, 15 nt, Leptospira interrogans serovar lai str. 56601
agauagguuuuguaa

SEQ ID NO: 2785359 - RNA, 17 nt, Leptospira interrogans serovar lai str. 56601
agauagguuuuguaaga

SEQ ID NO: 2785360 - RNA, 18 nt, Leptospira interrogans serovar lai str. 56601
agauagugcacugcuaua

SEQ ID NO: 2785361 - RNA, 20 nt, Leptospira interrogans serovar lai str. 56601
agauauuaguaaaacuguuu

SEQ ID NO: 2785362 - RNA, 21 nt, Leptospira interrogans serovar lai str. 56601
agauauuaguaaaacuguuuc

SEQ ID NO: 2785363 - RNA, 16 nt, Leptospira interrogans serovar lai str. 56601
agauauugagcaagac

SEQ ID NO: 2785364 - RNA, 16 nt, Leptospira interrogans serovar lai str. 56601
agauauugcacaugau

SEQ ID NO: 2785365 - RNA, 22 nt, Leptospira interrogans serovar lai str. 56601
agauauuucaagaauuuuagaa

SEQ ID NO: 2785366 - RNA, 13 nt, Leptospira interrogans serovar lai str. 56601
agaucaaauaagc

SEQ ID NO: 2785367 - RNA, 17 nt, Leptospira interrogans serovar lai str. 56601
agaucaauucuuaaaau

SEQ ID NO: 2785368 - RNA, 14 nt, Leptospira interrogans serovar lai str. 56601
agaucaauucuuua

SEQ ID NO: 2785369 - RNA, 15 nt, Leptospira interrogans serovar lai str. 56601
agaucaauucuuuaa

SEQ ID NO: 2785370 - RNA, 23 nt, Leptospira interrogans serovar lai str. 56601
agaucaauuuguuccuaaaaaau

SEQ ID NO: 2785371 - RNA, 15 nt, Leptospira interrogans serovar lai str. 56601
agaucaguuauaagu

SEQ ID NO: 2785372 - RNA, 16 nt, Leptospira interrogans serovar lai str. 56601
agaucaguuauaagua

SEQ ID NO: 2785373 - RNA, 15 nt, Leptospira interrogans serovar lai str. 56601
agaucauuaaugcga

SEQ ID NO: 2785374 - RNA, 17 nt, Leptospira interrogans serovar lai str. 56601
agaucauuaaugcgaaa

SEQ ID NO: 2785375 - RNA, 22 nt, Leptospira interrogans serovar lai str. 56601
agaucauuaaugcgaaaauuua

SEQ ID NO: 2785376 - RNA, 17 nt, Leptospira interrogans serovar lai str. 56601
agaucauuuaaaacuca

SEQ ID NO: 2785377 - RNA, 15 nt, Leptospira interrogans serovar lai str. 56601
agauccaaauuuuuu

SEQ ID NO: 2785378 - RNA, 18 nt, Leptospira interrogans serovar lai str. 56601
agaucgauucuuuaaaug

SEQ ID NO: 2785379 - RNA, 16 nt, Leptospira interrogans serovar lai str. 56601
agaucggcauucaggg

SEQ ID NO: 2785380 - RNA, 21 nt, Leptospira interrogans serovar lai str. 56601
agaucuacggaagcuaaaacu

SEQ ID NO: 2785381 - RNA, 21 nt, Leptospira interrogans serovar lai str. 56601
agaucuacuuacauagaacuc

SEQ ID NO: 2785382 - RNA, 15 nt, Leptospira interrogans serovar lai str. 56601
agaucuaucucaaaa

SEQ ID NO: 2785383 - RNA, 16 nt, Leptospira interrogans serovar lai str. 56601
agaucuauuccuaaaa

SEQ ID NO: 2785384 - RNA, 20 nt, Leptospira interrogans serovar lai str. 56601
agaucuauuccuaaaaugug

SEQ ID NO: 2785385 - RNA, 22 nt, Leptospira interrogans serovar lai str. 56601
agaucugauauuuuaaauugaa

SEQ ID NO: 2785386 - RNA, 23 nt, Leptospira interrogans serovar lai str. 56601
agaucuugagauccaauuauuua

SEQ ID NO: 2785387 - RNA, 17 nt, Leptospira interrogans serovar lai str. 56601
agaugaauugaauuuuu

SEQ ID NO: 2785388 - RNA, 18 nt, Leptospira interrogans serovar lai str. 56601
agaugaauugaauuuuuu

SEQ ID NO: 2785389 - RNA, 17 nt, Leptospira interrogans serovar lai str. 56601
agaugcuuucucuuuuu

SEQ ID NO: 2785390 - RNA, 22 nt, Leptospira interrogans serovar lai str. 56601
agaugcuuucucuuuuuagaca

SEQ ID NO: 2785391 - RNA, 19 nt, Leptospira interrogans serovar lai str. 56601
agauggagaauuaauuuuu

SEQ ID NO: 2785392 - RNA, 14 nt, Leptospira interrogans serovar lai str. 56601
agauggaucuauau

SEQ ID NO: 2785393 - RNA, 19 nt, Leptospira interrogans serovar lai str. 56601
agaugggcacugaauaaaa

SEQ ID NO: 2785394 - RNA, 15 nt, Leptospira interrogans serovar lai str. 56601
agaugggguugaauc

SEQ ID NO: 2785395 - RNA, 14 nt, Leptospira interrogans serovar lai str. 56601
agaugucuuugagg

SEQ ID NO: 2785396 - RNA, 15 nt, Leptospira interrogans serovar lai str. 56601
agaugugggaacuac

SEQ ID NO: 2785397 - RNA, 19 nt, Leptospira interrogans serovar lai str. 56601
agauguugaguuucuuuug

SEQ ID NO: 2785398 - RNA, 15 nt, Leptospira interrogans serovar lai str. 56601
agauguuuuaaaagu

SEQ ID NO: 2785399 - RNA, 12 nt, Leptospira interrogans serovar lai str. 56601
agauuaaaaaga

SEQ ID NO: 2785400 - RNA, 14 nt, Leptospira interrogans serovar lai str. 56601
agauuaaaaagaac

SEQ ID NO: 2785401 - RNA, 13 nt, Leptospira interrogans serovar lai str. 56601
agauuaaaaccgu

SEQ ID NO: 2785402 - RNA, 14 nt, Leptospira interrogans serovar lai str. 56601
agauuaaaaucgga

SEQ ID NO: 2785403 - RNA, 12 nt, Leptospira interrogans serovar lai str. 56601
agauuaaagauu

SEQ ID NO: 2785404 - RNA, 19 nt, Leptospira interrogans serovar lai str. 56601
agauuaacaaucaauugaa

SEQ ID NO: 2785405 - RNA, 13 nt, Leptospira interrogans serovar lai str. 56601
agauuaauuuuua

SEQ ID NO: 2785406 - RNA, 20 nt, Leptospira interrogans serovar lai str. 56601
agauuacauaacuaauaaaa

SEQ ID NO: 2785407 - RNA, 22 nt, Leptospira interrogans serovar lai str. 56601
agauuacauaacuaauaaaaac

SEQ ID NO: 2785408 - RNA, 17 nt, Leptospira interrogans serovar lai str. 56601
agauuaccuaacuaugu

SEQ ID NO: 2785409 - RNA, 23 nt, Leptospira interrogans serovar lai str. 56601
agauuacuaugaaaauucuuucu

SEQ ID NO: 2785410 - RNA, 17 nt, Leptospira interrogans serovar lai str. 56601
agauuaguuuaaaaacu

SEQ ID NO: 2785411 - RNA, 15 nt, Leptospira interrogans serovar lai str. 56601
agauuaugguaaaau

SEQ ID NO: 2785412 - RNA, 17 nt, Leptospira interrogans serovar lai str. 56601
agauuauuuacauauau

SEQ ID NO: 2785413 - RNA, 19 nt, Leptospira interrogans serovar lai str. 56601
agauuauuucaaaaauuua

SEQ ID NO: 2785414 - RNA, 23 nt, Leptospira interrogans serovar lai str. 56601
agauuauuucaaaaauuuaaaug

SEQ ID NO: 2785415 - RNA, 16 nt, Leptospira interrogans serovar lai str. 56601
agauucaaagauaaaa

SEQ ID NO: 2785416 - RNA, 22 nt, Leptospira interrogans serovar lai str. 56601
agauucaaagauaaaauauagu

SEQ ID NO: 2785417 - RNA, 14 nt, Leptospira interrogans serovar lai str. 56601
agauucaauuuuua

SEQ ID NO: 2785418 - RNA, 16 nt, Leptospira interrogans serovar lai str. 56601
agauucacuuuugcug

SEQ ID NO: 2785419 - RNA, 13 nt, Leptospira interrogans serovar lai str. 56601
agcaauuugugaa

SEQ ID NO: 2785420 - RNA, 17 nt, Leptospira interrogans serovar lai str. 56601
agcacaagcuuccuuuu

SEQ ID NO: 2785421 - RNA, 14 nt, Leptospira interrogans serovar lai str. 56601
agcacaauauauuc

SEQ ID NO: 2785422 - RNA, 16 nt, Leptospira interrogans serovar lai str. 56601
agcagaagcuuuauua

SEQ ID NO: 2785423 - RNA, 16 nt, Leptospira interrogans serovar lai str. 56601
agcagauucuaaaaau

SEQ ID NO: 2785424 - RNA, 19 nt, Leptospira interrogans serovar lai str. 56601
agcagauucuaaaaaugaa

SEQ ID NO: 2785425 - RNA, 12 nt, Leptospira interrogans serovar lai str. 56601
agcagcaaagaa

SEQ ID NO: 2785426 - RNA, 20 nt, Leptospira interrogans serovar lai str. 56601
agcauaacgucuugauuauu

SEQ ID NO: 2785427 - RNA, 19 nt, Leptospira interrogans serovar lai str. 56601
agcaugaaauuuucuuaga

SEQ ID NO: 2785428 - RNA, 13 nt, Leptospira interrogans serovar lai str. 56601
agcauggucuguc

SEQ ID NO: 2785429 - RNA, 15 nt, Leptospira interrogans serovar lai str. 56601
agcauuaaaaaagau

SEQ ID NO: 2785430 - RNA, 22 nt, Leptospira interrogans serovar lai str. 56601
agcauuacuacagacaauccua

SEQ ID NO: 2785431 - RNA, 17 nt, Leptospira interrogans serovar lai str. 56601
agcauuauaaguuuuua

SEQ ID NO: 2785432 - RNA, 14 nt, Leptospira interrogans serovar lai str. 56601
agcauuuuuaagau

SEQ ID NO: 2785433 - RNA, 12 nt, Leptospira interrogans serovar lai str. 56601
agccaaaaguuu

SEQ ID NO: 2785434 - RNA, 14 nt, Leptospira interrogans serovar lai str. 56601
agccaaaccaaaua

SEQ ID NO: 2785435 - RNA, 18 nt, Leptospira interrogans serovar lai str. 56601
agccaauuccaaaaaucu

SEQ ID NO: 2785436 - RNA, 12 nt, Leptospira interrogans serovar lai str. 56601
agccaucuuuuu

SEQ ID NO: 2785437 - RNA, 15 nt, Leptospira interrogans serovar lai str. 56601
agccauucuaauuuc

SEQ ID NO: 2785438 - RNA, 17 nt, Leptospira interrogans serovar lai str. 56601
agccauuucaaaaauau

SEQ ID NO: 2785439 - RNA, 16 nt, Leptospira interrogans serovar lai str. 56601
agcccccgaagaauua

SEQ ID NO: 2785440 - RNA, 19 nt, Leptospira interrogans serovar lai str. 56601
agcccucccguuauuuuuu

SEQ ID NO: 2785441 - RNA, 22 nt, Leptospira interrogans serovar lai str. 56601
agcccuccuauguuucuugugu

SEQ ID NO: 2785442 - RNA, 23 nt, Leptospira interrogans serovar lai str. 56601
agccgcgcuuuccuuauuaaaac

SEQ ID NO: 2785443 - RNA, 17 nt, Leptospira interrogans serovar lai str. 56601
agccgcggccaacacac

SEQ ID NO: 2785444 - RNA, 14 nt, Leptospira interrogans serovar lai str. 56601
agccgcuauggaag

SEQ ID NO: 2785445 - RNA, 15 nt, Leptospira interrogans serovar lai str. 56601
agccguaaauauuuu

SEQ ID NO: 2785446 - RNA, 18 nt, Leptospira interrogans serovar lai str. 56601
agccuaauuuacuacauc

SEQ ID NO: 2785447 - RNA, 13 nt, Leptospira interrogans serovar lai str. 56601
agccuacaaaucg

SEQ ID NO: 2785448 - RNA, 14 nt, Leptospira interrogans serovar lai str. 56601
agccuauauuuuga

SEQ ID NO: 2785449 - RNA, 16 nt, Leptospira interrogans serovar lai str. 56601
agccucaaguaaaacg

SEQ ID NO: 2785450 - RNA, 13 nt, Leptospira interrogans serovar lai str. 56601
agccugauaaauu

SEQ ID NO: 2785451 - RNA, 23 nt, Leptospira interrogans serovar lai str. 56601
agccugccaaaagaacuuugaga

SEQ ID NO: 2785452 - RNA, 13 nt, Leptospira interrogans serovar lai str. 56601
agccuggaauucu

SEQ ID NO: 2785453 - RNA, 15 nt, Leptospira interrogans serovar lai str. 56601
agccuggaauucuuu

SEQ ID NO: 2785454 - RNA, 18 nt, Leptospira interrogans serovar lai str. 56601
agcgaacacguuaacaau

SEQ ID NO: 2785455 - RNA, 20 nt, Leptospira interrogans serovar lai str. 56601
agcgacgauagaagcgagag

SEQ ID NO: 2785456 - RNA, 13 nt, Leptospira interrogans serovar lai str. 56601
agcgauauaauaa

SEQ ID NO: 2785457 - RNA, 16 nt, Leptospira interrogans serovar lai str. 56601
agcgauauaauaaaau

SEQ ID NO: 2785458 - RNA, 18 nt, Leptospira interrogans serovar lai str. 56601
agcgaugaucgauuuuuu

SEQ ID NO: 2785459 - RNA, 21 nt, Leptospira interrogans serovar lai str. 56601
agcgcagacucuucucccauc

SEQ ID NO: 2785460 - RNA, 19 nt, Leptospira interrogans serovar lai str. 56601
agcgcuuauugcaaaaccg

SEQ ID NO: 2785461 - RNA, 17 nt, Leptospira interrogans serovar lai str. 56601
agcgggaccgggcucuc

SEQ ID NO: 2785462 - RNA, 18 nt, Leptospira interrogans serovar lai str. 56601
agcggucuugaaaauuca

SEQ ID NO: 2785463 - RNA, 15 nt, Leptospira interrogans serovar lai str. 56601
agcgucaacugaaac

SEQ ID NO: 2785464 - RNA, 13 nt, Leptospira interrogans serovar lai str. 56601
agcgugacuaaaa

SEQ ID NO: 2785465 - RNA, 21 nt, Leptospira interrogans serovar lai str. 56601
agcguucuaaguccacccaaa

SEQ ID NO: 2785466 - RNA, 15 nt, Leptospira interrogans serovar lai str. 56601
agcguuuuacugagu

SEQ ID NO: 2785467 - RNA, 16 nt, Leptospira interrogans serovar lai str. 56601
agcguuuuacugaguu

SEQ ID NO: 2785468 - RNA, 21 nt, Leptospira interrogans serovar lai str. 56601
agcguuuuguuaauuguugcu

SEQ ID NO: 2785469 - RNA, 23 nt, Leptospira interrogans serovar lai str. 56601
agcuaaaaagaaaguugcaaaga

SEQ ID NO: 2785470 - RNA, 23 nt, Leptospira interrogans serovar lai str. 56601
agcuaagucuuuaaaaauaggaa

SEQ ID NO: 2785471 - RNA, 22 nt, Leptospira interrogans serovar lai str. 56601
agcuacagcugaggaguuuuua

SEQ ID NO: 2785472 - RNA, 22 nt, Leptospira interrogans serovar lai str. 56601
agcuaucgccaucgucagggaa

SEQ ID NO: 2785473 - RNA, 18 nt, Leptospira interrogans serovar lai str. 56601
agcuauuuucagaaaaau

SEQ ID NO: 2785474 - RNA, 20 nt, Leptospira interrogans serovar lai str. 56601
agcuauuuucagaaaaauga

SEQ ID NO: 2785475 - RNA, 15 nt, Leptospira interrogans serovar lai str. 56601
agcucacguugaagu

SEQ ID NO: 2785476 - RNA, 20 nt, Leptospira interrogans serovar lai str. 56601
agcucagauuccaacuuuuu

SEQ ID NO: 2785477 - RNA, 13 nt, Leptospira interrogans serovar lai str. 56601
agcucagcaaagc

SEQ ID NO: 2785478 - RNA, 22 nt, Leptospira interrogans serovar lai str. 56601
agcucauaaucaauuaaccuga

SEQ ID NO: 2785479 - RNA, 14 nt, Leptospira interrogans serovar lai str. 56601
agcucaucauucug

SEQ ID NO: 2785480 - RNA, 22 nt, Leptospira interrogans serovar lai str. 56601
agcucaucauucugaaaaaagu

SEQ ID NO: 2785481 - RNA, 19 nt, Leptospira interrogans serovar lai str. 56601
agcucaugauuauuacucg

SEQ ID NO: 2785482 - RNA, 23 nt, Leptospira interrogans serovar lai str. 56601
agcuccuacauuuuauuuuuuau

SEQ ID NO: 2785483 - RNA, 21 nt, Leptospira interrogans serovar lai str. 56601
agcuccuccaaccagagcaua

SEQ ID NO: 2785484 - RNA, 15 nt, Leptospira interrogans serovar lai str. 56601
agcucgaauaaaaac

SEQ ID NO: 2785485 - RNA, 19 nt, Leptospira interrogans serovar lai str. 56601
agcucgaauaaaaacaaac

SEQ ID NO: 2785486 - RNA, 14 nt, Leptospira interrogans serovar lai str. 56601
agcucuagucaagu

SEQ ID NO: 2785487 - RNA, 23 nt, Leptospira interrogans serovar lai str. 56601
agcucucguaauaucuaaaaccu

SEQ ID NO: 2785488 - RNA, 16 nt, Leptospira interrogans serovar lai str. 56601
agcucuggucaaguua

SEQ ID NO: 2785489 - RNA, 13 nt, Leptospira interrogans serovar lai str. 56601
agcucuuuugcuu

SEQ ID NO: 2785490 - RNA, 23 nt, Leptospira interrogans serovar lai str. 56601
agcugaggaguuuuuauaaaauc

SEQ ID NO: 2785491 - RNA, 16 nt, Leptospira interrogans serovar lai str. 56601
agcuggaugaagcuau

SEQ ID NO: 2785492 - RNA, 20 nt, Leptospira interrogans serovar lai str. 56601
agcuguucuuagucuaaaaa

SEQ ID NO: 2785493 - RNA, 21 nt, Leptospira interrogans serovar lai str. 56601
agcuguuguuauagaugaaau

SEQ ID NO: 2785494 - RNA, 14 nt, Leptospira interrogans serovar lai str. 56601
agcuuaaaagugau

SEQ ID NO: 2785495 - RNA, 18 nt, Leptospira interrogans serovar lai str. 56601
agcuuauugaugauugaa

SEQ ID NO: 2785496 - RNA, 23 nt, Leptospira interrogans serovar lai str. 56601
agcuuuagaaaauaauaauauuu

SEQ ID NO: 2785497 - RNA, 22 nt, Leptospira interrogans serovar lai str. 56601
agcuuucuccuucccucgaaau

SEQ ID NO: 2785498 - RNA, 18 nt, Leptospira interrogans serovar lai str. 56601
agcuuuuaguuguacaaa

SEQ ID NO: 2785499 - RNA, 20 nt, Leptospira interrogans serovar lai str. 56601
agcuuuugagcaguaaaaaa

SEQ ID NO: 2785500 - RNA, 18 nt, Leptospira interrogans serovar lai str. 56601
agcuuuuuuaaauuuuua

SEQ ID NO: 2785501 - RNA, 19 nt, Leptospira interrogans serovar lai str. 56601
agcuuuuuuaaauuuuuau

SEQ ID NO: 2785502 - RNA, 21 nt, Leptospira interrogans serovar lai str. 56601
aggugauuaaaccgguaaaaa

SEQ ID NO: 2785503 - RNA, 16 nt, Leptospira interrogans serovar lai str. 56601
aggugguugggaacaa

SEQ ID NO: 2785504 - RNA, 17 nt, Leptospira interrogans serovar lai str. 56601
agguguuuauaaaaacc

SEQ ID NO: 2785505 - RNA, 17 nt, Leptospira interrogans serovar lai str. 56601
agguuaaaaauuuaauu

SEQ ID NO: 2785506 - RNA, 21 nt, Leptospira interrogans serovar lai str. 56601
agguuaaaaauuuaauuuuuu

SEQ ID NO: 2785507 - RNA, 20 nt, Leptospira interrogans serovar lai str. 56601
agguuauuuacgccgaauuc

SEQ ID NO: 2785508 - RNA, 22 nt, Leptospira interrogans serovar lai str. 56601
agguuccgggagcgcuugaaaa

SEQ ID NO: 2785509 - RNA, 20 nt, Leptospira interrogans serovar lai str. 56601
agguucgaacguauaaaaac

SEQ ID NO: 2785510 - RNA, 16 nt, Leptospira interrogans serovar lai str. 56601
agguucuuagaacuua

SEQ ID NO: 2785511 - RNA, 18 nt, Leptospira interrogans serovar lai str. 56601
agguucuugcaaaaauag

SEQ ID NO: 2785512 - RNA, 14 nt, Leptospira interrogans serovar lai str. 56601
agguuguaacucaa

SEQ ID NO: 2785513 - RNA, 14 nt, Leptospira interrogans serovar lai str. 56601
agguuuuauaaaau

SEQ ID NO: 2785514 - RNA, 15 nt, Leptospira interrogans serovar lai str. 56601
agguuuugagacaaa

SEQ ID NO: 2785515 - RNA, 20 nt, Leptospira interrogans serovar lai str. 56601
agguuuuucgaaaagaaaua

SEQ ID NO: 2785516 - RNA, 14 nt, Leptospira interrogans serovar lai str. 56601
aguaaaaaagcgaa

SEQ ID NO: 2785517 - RNA, 13 nt, Leptospira interrogans serovar lai str. 56601
aguaaaaauggau

SEQ ID NO: 2785518 - RNA, 16 nt, Leptospira interrogans serovar lai str. 56601
aguaaaacgcucucua

SEQ ID NO: 2785519 - RNA, 18 nt, Leptospira interrogans serovar lai str. 56601
aguaaaacgcucucuacg

SEQ ID NO: 2785520 - RNA, 15 nt, Leptospira interrogans serovar lai str. 56601
aguaaaacuuuuaaa

SEQ ID NO: 2785521 - RNA, 15 nt, Leptospira interrogans serovar lai str. 56601
aguaaaagaaaauua

SEQ ID NO: 2785522 - RNA, 12 nt, Leptospira interrogans serovar lai str. 56601
aguaaaaucgag

SEQ ID NO: 2785523 - RNA, 15 nt, Leptospira interrogans serovar lai str. 56601
aguaaaaucuaaauu

SEQ ID NO: 2785524 - RNA, 20 nt, Leptospira interrogans serovar lai str. 56601
aguaaaaucuaaauuuguaa

SEQ ID NO: 2785525 - RNA, 22 nt, Leptospira interrogans serovar lai str. 56601
aguaaaaucuucaaguuuguga

SEQ ID NO: 2785526 - RNA, 23 nt, Leptospira interrogans serovar lai str. 56601
aguaaaaucuucaaguuugugag

SEQ ID NO: 2785527 - RNA, 23 nt, Leptospira interrogans serovar lai str. 56601
aguaaaaucuuuaaguuugugag

SEQ ID NO: 2785528 - RNA, 13 nt, Leptospira interrogans serovar lai str. 56601
aguaaaauuuaaa

SEQ ID NO: 2785529 - RNA, 20 nt, Leptospira interrogans serovar lai str. 56601
aguaaaauuuaaauuuauaa

SEQ ID NO: 2785530 - RNA, 15 nt, Leptospira interrogans serovar lai str. 56601
aguaaacuacuaaau

SEQ ID NO: 2785531 - RNA, 22 nt, Leptospira interrogans serovar lai str. 56601
aguaaacuacuaaaucucaauu

SEQ ID NO: 2785532 - RNA, 14 nt, Leptospira interrogans serovar lai str. 56601
aguaaagauggauc

SEQ ID NO: 2785533 - RNA, 11 nt, Leptospira interrogans serovar lai str. 56601
aguaaauaaac

SEQ ID NO: 2785534 - RNA, 20 nt, Leptospira interrogans serovar lai str. 56601
aguaaauggauaaauuuuag

SEQ ID NO: 2785535 - RNA, 21 nt, Leptospira interrogans serovar lai str. 56601
aguaaauggauaaauuuuaga

SEQ ID NO: 2785536 - RNA, 14 nt, Leptospira interrogans serovar lai str. 56601
aguaacgaguagaa

SEQ ID NO: 2785537 - RNA, 15 nt, Leptospira interrogans serovar lai str. 56601
aguaacgauuucuau

SEQ ID NO: 2785538 - RNA, 14 nt, Leptospira interrogans serovar lai str. 56601
aguaagaaacauca

SEQ ID NO: 2785539 - RNA, 15 nt, Leptospira interrogans serovar lai str. 56601
aguaagaaacaucaa

SEQ ID NO: 2785540 - RNA, 16 nt, Leptospira interrogans serovar lai str. 56601
aguaaggauucuuuuc

SEQ ID NO: 2785541 - RNA, 17 nt, Leptospira interrogans serovar lai str. 56601
aguaauaugauuaugug

SEQ ID NO: 2785542 - RNA, 16 nt, Leptospira interrogans serovar lai str. 56601
aguaaucuuuuuaaaa

SEQ ID NO: 2785543 - RNA, 21 nt, Leptospira interrogans serovar lai str. 56601
aguaaucuuuuuaaaaguuug

SEQ ID NO: 2785544 - RNA, 16 nt, Leptospira interrogans serovar lai str. 56601
aguaaugccuacaaau

SEQ ID NO: 2785545 - RNA, 23 nt, Leptospira interrogans serovar lai str. 56601
aguaauuacccuaaagcuauuuu

SEQ ID NO: 2785546 - RNA, 22 nt, Leptospira interrogans serovar lai str. 56601
aguaauucuaaguaauuuaaaa

SEQ ID NO: 2785547 - RNA, 12 nt, Leptospira interrogans serovar lai str. 56601
aguaauuuaaaa

SEQ ID NO: 2785548 - RNA, 14 nt, Leptospira interrogans serovar lai str. 56601
aguaauuuaaaaaa

SEQ ID NO: 2785549 - RNA, 16 nt, Leptospira interrogans serovar lai str. 56601
aguaauuuaaaaaaau

SEQ ID NO: 2785550 - RNA, 18 nt, Leptospira interrogans serovar lai str. 56601
aguaauuuaauauauuaa

SEQ ID NO: 2785551 - RNA, 13 nt, Leptospira interrogans serovar lai str. 56601
aguacaauucaaa

SEQ ID NO: 2785552 - RNA, 16 nt, Leptospira interrogans serovar lai str. 56601
aguaccaaguuauuaa

SEQ ID NO: 2785553 - RNA, 18 nt, Leptospira interrogans serovar lai str. 56601
aguaccauaaauuuuuau

SEQ ID NO: 2785554 - RNA, 22 nt, Leptospira interrogans serovar lai str. 56601
aguaccuaauauuuugcaugaa

SEQ ID NO: 2785555 - RNA, 23 nt, Leptospira interrogans serovar lai str. 56601
aguaccuaauauuuugcaugaaa

SEQ ID NO: 2785556 - RNA, 14 nt, Leptospira interrogans serovar lai str. 56601
aguacgaucaaauc

SEQ ID NO: 2785557 - RNA, 19 nt, Leptospira interrogans serovar lai str. 56601
aguacuauauuuuugugaa

SEQ ID NO: 2785558 - RNA, 20 nt, Leptospira interrogans serovar lai str. 56601
aguacuauauuuuugugaaa

SEQ ID NO: 2785559 - RNA, 14 nt, Leptospira interrogans serovar lai str. 56601
aguagaauucucag

SEQ ID NO: 2785560 - RNA, 18 nt, Leptospira interrogans serovar lai str. 56601
aguagacaacuaaaagac

SEQ ID NO: 2785561 - RNA, 21 nt, Leptospira interrogans serovar lai str. 56601
aguagauuccuacauuauuuu

SEQ ID NO: 2785562 - RNA, 17 nt, Leptospira interrogans serovar lai str. 56601
aguaggauaauacaaau

SEQ ID NO: 2785563 - RNA, 23 nt, Leptospira interrogans serovar lai str. 56601
aguaggugguugggaacaauccg

SEQ ID NO: 2785564 - RNA, 21 nt, Leptospira interrogans serovar lai str. 56601
aguaguaaaaucuucaaguuu

SEQ ID NO: 2785565 - RNA, 16 nt, Leptospira interrogans serovar lai str. 56601
aguaguaaauaaaaaa

SEQ ID NO: 2785566 - RNA, 15 nt, Leptospira interrogans serovar lai str. 56601
aguaguaaauuaaca

SEQ ID NO: 2785567 - RNA, 13 nt, Leptospira interrogans serovar lai str. 56601
aguaguagucuua

SEQ ID NO: 2785568 - RNA, 16 nt, Leptospira interrogans serovar lai str. 56601
aguaguucccacaaau

SEQ ID NO: 2785569 - RNA, 22 nt, Leptospira interrogans serovar lai str. 56601
aguaguucccacauuuugugaa

SEQ ID NO: 2785570 - RNA, 20 nt, Leptospira interrogans serovar lai str. 56601
aguaguuccuacauuuuaaa

SEQ ID NO: 2785571 - RNA, 19 nt, Leptospira interrogans serovar lai str. 56601
aguaguucucacauuuaag

SEQ ID NO: 2785572 - RNA, 11 nt, Leptospira interrogans serovar lai str. 56601
aguaguuuuuu

SEQ ID NO: 2785573 - RNA, 14 nt, Leptospira interrogans serovar lai str. 56601
aguaguuuuuugau

SEQ ID NO: 2785574 - RNA, 16 nt, Leptospira interrogans serovar lai str. 56601
aguauaaauucgcaaa

SEQ ID NO: 2785575 - RNA, 17 nt, Leptospira interrogans serovar lai str. 56601
aguauaagucgaucuac

SEQ ID NO: 2785576 - RNA, 17 nt, Leptospira interrogans serovar lai str. 56601
aguauaauauuuauuua

SEQ ID NO: 2785577 - RNA, 14 nt, Leptospira interrogans serovar lai str. 56601
aguauaauuuaaaa

SEQ ID NO: 2785578 - RNA, 14 nt, Leptospira interrogans serovar lai str. 56601
aguauccaaaauua

SEQ ID NO: 2785579 - RNA, 14 nt, Leptospira interrogans serovar lai str. 56601
aguaucguuuucca

SEQ ID NO: 2785580 - RNA, 14 nt, Leptospira interrogans serovar lai str. 56601
aguaucuaaaaguu

SEQ ID NO: 2785581 - RNA, 23 nt, Leptospira interrogans serovar lai str. 56601
aguaugaguuccuacaauuuuag

SEQ ID NO: 2785582 - RNA, 13 nt, Leptospira interrogans serovar lai str. 56601
aguaugauuuuac

SEQ ID NO: 2785583 - RNA, 18 nt, Leptospira interrogans serovar lai str. 56601
aguauguuuuucggaauc

SEQ ID NO: 2785584 - RNA, 14 nt, Leptospira interrogans serovar lai str. 56601
aguauguuuuucug

SEQ ID NO: 2785585 - RNA, 13 nt, Leptospira interrogans serovar lai str. 56601
aguuaaauuuuuu

SEQ ID NO: 2785586 - RNA, 15 nt, Leptospira interrogans serovar lai str. 56601
aguuaagaagauaaa

SEQ ID NO: 2785587 - RNA, 23 nt, Leptospira interrogans serovar lai str. 56601
aguuaagaagauaaauauuucca

SEQ ID NO: 2785588 - RNA, 17 nt, Leptospira interrogans serovar lai str. 56601
aguuaagaguuuguucc

SEQ ID NO: 2785589 - RNA, 19 nt, Leptospira interrogans serovar lai str. 56601
aguuaagugaaaauuacaa

SEQ ID NO: 2785590 - RNA, 16 nt, Leptospira interrogans serovar lai str. 56601
aguuaauaaauuuuug

SEQ ID NO: 2785591 - RNA, 13 nt, Leptospira interrogans serovar lai str. 56601
aguuaauucuaaa

SEQ ID NO: 2785592 - RNA, 22 nt, Leptospira interrogans serovar lai str. 56601
aguuaauuuuaucuuuuucuau

SEQ ID NO: 2785593 - RNA, 17 nt, Leptospira interrogans serovar lai str. 56601
aguuaauuuucgauuua

SEQ ID NO: 2785594 - RNA, 15 nt, Leptospira interrogans serovar lai str. 56601
aguuacaauuuauua

SEQ ID NO: 2785595 - RNA, 15 nt, Leptospira interrogans serovar lai str. 56601
aguuacauuaugaau

SEQ ID NO: 2785596 - RNA, 20 nt, Leptospira interrogans serovar lai str. 56601
aguuacauuaugaauuuuua

SEQ ID NO: 2785597 - RNA, 21 nt, Leptospira interrogans serovar lai str. 56601
aguuacgcugaguuugagaga

SEQ ID NO: 2785598 - RNA, 16 nt, Leptospira interrogans serovar lai str. 56601
aguuacucauuuccau

SEQ ID NO: 2785599 - RNA, 21 nt, Leptospira interrogans serovar lai str. 56601
aguuacuuauuuuugaaaaga

SEQ ID NO: 2785600 - RNA, 16 nt, Leptospira interrogans serovar lai str. 56601
aguuauacaguuugau

SEQ ID NO: 2785601 - RNA, 22 nt, Leptospira interrogans serovar lai str. 56601
aguuauagcgucguuaaauuug

SEQ ID NO: 2785602 - RNA, 16 nt, Leptospira interrogans serovar lai str. 56601
aguuaugaauaaaaaa

SEQ ID NO: 2785603 - RNA, 17 nt, Leptospira interrogans serovar lai str. 56601
aguuaugacccaagauu

SEQ ID NO: 2785604 - RNA, 20 nt, Leptospira interrogans serovar lai str. 56601
aguuaugacccaagauucaa

SEQ ID NO: 2785605 - RNA, 16 nt, Leptospira interrogans serovar lai str. 56601
aguuauuaacagccga

SEQ ID NO: 2785606 - RNA, 14 nt, Leptospira interrogans serovar lai str. 56601
aguuauugaaaaau

SEQ ID NO: 2785607 - RNA, 14 nt, Leptospira interrogans serovar lai str. 56601
aguucaaaaaaagg

SEQ ID NO: 2785608 - RNA, 19 nt, Leptospira interrogans serovar lai str. 56601
aguucaaaaaaaggauuau

SEQ ID NO: 2785609 - RNA, 22 nt, Leptospira interrogans serovar lai str. 56601
aguucaacguaagaaaauuugg

SEQ ID NO: 2785610 - RNA, 20 nt, Leptospira interrogans serovar lai str. 56601
aguucaacuuaaggaaauuc

SEQ ID NO: 2785611 - RNA, 21 nt, Leptospira interrogans serovar lai str. 56601
aguucaauguaagaaacucau

SEQ ID NO: 2785612 - RNA, 14 nt, Leptospira interrogans serovar lai str. 56601
aguucaauuaacaa

SEQ ID NO: 2785613 - RNA, 23 nt, Leptospira interrogans serovar lai str. 56601
aguucagaugaauugaauuuuuu

SEQ ID NO: 2785614 - RNA, 13 nt, Leptospira interrogans serovar lai str. 56601
aguucagauucga

SEQ ID NO: 2785615 - RNA, 16 nt, Leptospira interrogans serovar lai str. 56601
aguucauaagauugga

SEQ ID NO: 2785616 - RNA, 12 nt, Leptospira interrogans serovar lai str. 56601
aguucauauuuu

SEQ ID NO: 2785617 - RNA, 20 nt, Leptospira interrogans serovar lai str. 56601
aguucauucccuuaaucauu

SEQ ID NO: 2785618 - RNA, 18 nt, Leptospira interrogans serovar lai str. 56601
aguuccaacguaccaaaa

SEQ ID NO: 2785619 - RNA, 19 nt, Leptospira interrogans serovar lai str. 56601
aguuccacauuuauuuuua

SEQ ID NO: 2785620 - RNA, 16 nt, Leptospira interrogans serovar lai str. 56601
aguuccacauuuuaaa

SEQ ID NO: 2785621 - RNA, 18 nt, Leptospira interrogans serovar lai str. 56601
aguucccaaauugccaaa

SEQ ID NO: 2785622 - RNA, 13 nt, Leptospira interrogans serovar lai str. 56601
aguucccacaaau

SEQ ID NO: 2785623 - RNA, 17 nt, Leptospira interrogans serovar lai str. 56601
aguucccacaaauucca

SEQ ID NO: 2785624 - RNA, 19 nt, Leptospira interrogans serovar lai str. 56601
aguucccacaaauuccaau

SEQ ID NO: 2785625 - RNA, 18 nt, Leptospira interrogans serovar lai str. 56601
aguucccacaaauuccug

SEQ ID NO: 2785626 - RNA, 20 nt, Leptospira interrogans serovar lai str. 56601
aguucccacaaauuccugcc

SEQ ID NO: 2785627 - RNA, 18 nt, Leptospira interrogans serovar lai str. 56601
aguucccacaguuugaaa

SEQ ID NO: 2785628 - RNA, 16 nt, Leptospira interrogans serovar lai str. 56601
aguucccacauuugau

SEQ ID NO: 2785629 - RNA, 16 nt, Leptospira interrogans serovar lai str. 56601
aguucccacauuuugu

SEQ ID NO: 2785630 - RNA, 17 nt, Leptospira interrogans serovar lai str. 56601
aguucccacauuuuuca

SEQ ID NO: 2785631 - RNA, 20 nt, Leptospira interrogans serovar lai str. 56601
aguucccacauuuuugugaa

SEQ ID NO: 2785632 - RNA, 23 nt, Leptospira interrogans serovar lai str. 56601
aguucccaccuuuuuuuaugaaa

SEQ ID NO: 2785633 - RNA, 21 nt, Leptospira interrogans serovar lai str. 56601
aguucccacguuuugaagguu

SEQ ID NO: 2785634 - RNA, 16 nt, Leptospira interrogans serovar lai str. 56601
aguucccauagauuaa

SEQ ID NO: 2785635 - RNA, 16 nt, Leptospira interrogans serovar lai str. 56601
aguucccgccucacaa

SEQ ID NO: 2785636 - RNA, 15 nt, Leptospira interrogans serovar lai str. 56601
aguuccgaaaauuug

SEQ ID NO: 2785637 - RNA, 21 nt, Leptospira interrogans serovar lai str. 56601
aguuccuaaaauuacgcugau

SEQ ID NO: 2785638 - RNA, 17 nt, Leptospira interrogans serovar lai str. 56601
aguuccuaacuuugaaa

SEQ ID NO: 2785639 - RNA, 13 nt, Leptospira interrogans serovar lai str. 56601
aguuccuacaaau

SEQ ID NO: 2785640 - RNA, 20 nt, Leptospira interrogans serovar lai str. 56601
aguuccuacaauucaucacc

SEQ ID NO: 2785641 - RNA, 22 nt, Leptospira interrogans serovar lai str. 56601
aguuccuacaauuuuagaauuu

SEQ ID NO: 2785642 - RNA, 17 nt, Leptospira interrogans serovar lai str. 56601
aguuccuacauuuuaaa

SEQ ID NO: 2785643 - RNA, 20 nt, Leptospira interrogans serovar lai str. 56601
aguuccuacauuuuaaaaau

SEQ ID NO: 2785644 - RNA, 20 nt, Leptospira interrogans serovar lai str. 56601
aguuccuuaaauauaucuuc

SEQ ID NO: 2785645 - RNA, 22 nt, Leptospira interrogans serovar lai str. 56601
aguucgacauaagaaagaauuu

SEQ ID NO: 2785646 - RNA, 19 nt, Leptospira interrogans serovar lai str. 56601
aguucgacguaaagaauuc

SEQ ID NO: 2785647 - RNA, 16 nt, Leptospira interrogans serovar lai str. 56601
aguucgacguaaguaa

SEQ ID NO: 2785648 - RNA, 14 nt, Leptospira interrogans serovar lai str. 56601
aguucgauuaaaau

SEQ ID NO: 2785649 - RNA, 18 nt, Leptospira interrogans serovar lai str. 56601
aguucgauuaaaauaaac

SEQ ID NO: 2785650 - RNA, 21 nt, Leptospira interrogans serovar lai str. 56601
aguucggcguaagaaaaccau

SEQ ID NO: 2785651 - RNA, 22 nt, Leptospira interrogans serovar lai str. 56601
aguucgguagaaagaauuuucu

SEQ ID NO: 2785652 - RNA, 16 nt, Leptospira interrogans serovar lai str. 56601
aguucgguauacgaau

SEQ ID NO: 2785653 - RNA, 21 nt, Leptospira interrogans serovar lai str. 56601
aguucgguguaaaaaaucaug

SEQ ID NO: 2785654 - RNA, 17 nt, Leptospira interrogans serovar lai str. 56601
aguucgguguaaggaau

SEQ ID NO: 2785655 - RNA, 14 nt, Leptospira interrogans serovar lai str. 56601
aguucguaugaguu

SEQ ID NO: 2785656 - RNA, 16 nt, Leptospira interrogans serovar lai str. 56601
aguucgugaagaaauu

SEQ ID NO: 2785657 - RNA, 16 nt, Leptospira interrogans serovar lai str. 56601
aguucguuauaaacaa

SEQ ID NO: 2785658 - RNA, 16 nt, Leptospira interrogans serovar lai str. 56601
aguucuaaaucgaauc

SEQ ID NO: 2785659 - RNA, 19 nt, Leptospira interrogans serovar lai str. 56601
aguucuacuuuauuaaaaa

SEQ ID NO: 2785660 - RNA, 22 nt, Leptospira interrogans serovar lai str. 56601
aguucuauaaacucaaagaauu

SEQ ID NO: 2785661 - RNA, 15 nt, Leptospira interrogans serovar lai str. 56601
aguucuauuuuauca

SEQ ID NO: 2785662 - RNA, 20 nt, Leptospira interrogans serovar lai str. 56601
aguucucaagaucauucuau

SEQ ID NO: 2785663 - RNA, 21 nt, Leptospira interrogans serovar lai str. 56601
aguucucaagaucauucuauu

SEQ ID NO: 2785664 - RNA, 17 nt, Leptospira interrogans serovar lai str. 56601
aguucucacauuuaagg

SEQ ID NO: 2785665 - RNA, 19 nt, Leptospira interrogans serovar lai str. 56601
aguucugaaaucuuaggac

SEQ ID NO: 2785666 - RNA, 18 nt, Leptospira interrogans serovar lai str. 56601
aguucuggguaaaaaaaa

SEQ ID NO: 2785667 - RNA, 17 nt, Leptospira interrogans serovar lai str. 56601
aguuuuuucguaaaaaa

SEQ ID NO: 2785668 - RNA, 19 nt, Leptospira interrogans serovar lai str. 56601
aguuuuuugagaaacaacg

SEQ ID NO: 2785669 - RNA, 13 nt, Leptospira interrogans serovar lai str. 56601
aguuuuuugagau

SEQ ID NO: 2785670 - RNA, 21 nt, Leptospira interrogans serovar lai str. 56601
aguuuuuugaguccacagguu

SEQ ID NO: 2785671 - RNA, 11 nt, Leptospira interrogans serovar lai str. 56601
auaaaaaaaug

SEQ ID NO: 2785672 - RNA, 19 nt, Leptospira interrogans serovar lai str. 56601
auaaaaaaaugaauuuuuu

SEQ ID NO: 2785673 - RNA, 12 nt, Leptospira interrogans serovar lai str. 56601
auaaaaaaaugu

SEQ ID NO: 2785674 - RNA, 20 nt, Leptospira interrogans serovar lai str. 56601
auaaaaaaauucauuucguu

SEQ ID NO: 2785675 - RNA, 13 nt, Leptospira interrogans serovar lai str. 56601
auaaaaaauaaua

SEQ ID NO: 2785676 - RNA, 14 nt, Leptospira interrogans serovar lai str. 56601
auaaaaaaugaaug

SEQ ID NO: 2785677 - RNA, 21 nt, Leptospira interrogans serovar lai str. 56601
auaaaaaaugaauguuuaaaa

SEQ ID NO: 2785678 - RNA, 12 nt, Leptospira interrogans serovar lai str. 56601
auaaaaacaaaa

SEQ ID NO: 2785679 - RNA, 23 nt, Leptospira interrogans serovar lai str. 56601
auaaaaacaaguuuaaaugaaau

SEQ ID NO: 2785680 - RNA, 18 nt, Leptospira interrogans serovar lai str. 56601
auaaaaacgguauuuaaa

SEQ ID NO: 2785681 - RNA, 12 nt, Leptospira interrogans serovar lai str. 56601
auaaaaagaacc

SEQ ID NO: 2785682 - RNA, 20 nt, Leptospira interrogans serovar lai str. 56601
auaaaaaguuuguuuguaaa

SEQ ID NO: 2785683 - RNA, 21 nt, Leptospira interrogans serovar lai str. 56601
auaaaaaguuuguuuguaaag

SEQ ID NO: 2785684 - RNA, 21 nt, Leptospira interrogans serovar lai str. 56601
auaaaaauaguauccaaaauu

SEQ ID NO: 2785685 - RNA, 15 nt, Leptospira interrogans serovar lai str. 56601
auaaaaaucuaggaa

SEQ ID NO: 2785686 - RNA, 18 nt, Leptospira interrogans serovar lai str. 56601
auaaaaauuucagauuuu

SEQ ID NO: 2785687 - RNA, 23 nt, Leptospira interrogans serovar lai str. 56601
auaaaaauuucagauuuuauuuu

SEQ ID NO: 2785688 - RNA, 13 nt, Leptospira interrogans serovar lai str. 56601
auaaaacaaaaua

SEQ ID NO: 2785689 - RNA, 15 nt, Leptospira interrogans serovar lai str. 56601
auaaaacaaaauaga

SEQ ID NO: 2785690 - RNA, 18 nt, Leptospira interrogans serovar lai str. 56601
auaaaacaaucuucaaau

SEQ ID NO: 2785691 - RNA, 18 nt, Leptospira interrogans serovar lai str. 56601
auaaaacccuuagucuga

SEQ ID NO: 2785692 - RNA, 17 nt, Leptospira interrogans serovar lai str. 56601
auaaaaccgcugaaaaa

SEQ ID NO: 2785693 - RNA, 18 nt, Leptospira interrogans serovar lai str. 56601
auaaaaccguuuuauaaa

SEQ ID NO: 2785694 - RNA, 20 nt, Leptospira interrogans serovar lai str. 56601
auaaaaccguuuuauaaaua

SEQ ID NO: 2785695 - RNA, 21 nt, Leptospira interrogans serovar lai str. 56601
auaaaaccugauuuuucugua

SEQ ID NO: 2785696 - RNA, 19 nt, Leptospira interrogans serovar lai str. 56601
auaaaacgaaauuauacaa

SEQ ID NO: 2785697 - RNA, 17 nt, Leptospira interrogans serovar lai str. 56601
auaaaacguggauuuua

SEQ ID NO: 2785698 - RNA, 17 nt, Leptospira interrogans serovar lai str. 56601
auaaaacucaaaggaaa

SEQ ID NO: 2785699 - RNA, 21 nt, Leptospira interrogans serovar lai str. 56601
auaaaacucaaaggaaaauga

SEQ ID NO: 2785700 - RNA, 22 nt, Leptospira interrogans serovar lai str. 56601
auaaaacucaaaggaaaaugaa

SEQ ID NO: 2785701 - RNA, 14 nt, Leptospira interrogans serovar lai str. 56601
auaaaacucuaaau

SEQ ID NO: 2785702 - RNA, 16 nt, Leptospira interrogans serovar lai str. 56601
auaaaacucuaaauuc

SEQ ID NO: 2785703 - RNA, 16 nt, Leptospira interrogans serovar lai str. 56601
auaaaagaaacauaau

SEQ ID NO: 2785704 - RNA, 19 nt, Leptospira interrogans serovar lai str. 56601
auaaaagauucguuuuaua

SEQ ID NO: 2785705 - RNA, 20 nt, Leptospira interrogans serovar lai str. 56601
auaaaagauucguuuuauaa

SEQ ID NO: 2785706 - RNA, 21 nt, Leptospira interrogans serovar lai str. 56601
auaaaagauucguuuuauaaa

SEQ ID NO: 2785707 - RNA, 18 nt, Leptospira interrogans serovar lai str. 56601
auaaaaggcugcuuuuuu

SEQ ID NO: 2785708 - RNA, 16 nt, Leptospira interrogans serovar lai str. 56601
auaaaaguauaauauu

SEQ ID NO: 2785709 - RNA, 14 nt, Leptospira interrogans serovar lai str. 56601
auaaaagugaauuu

SEQ ID NO: 2785710 - RNA, 15 nt, Leptospira interrogans serovar lai str. 56601
auaaaauacaaaaga

SEQ ID NO: 2785711 - RNA, 17 nt, Leptospira interrogans serovar lai str. 56601
auaaaauacaaaagaau

SEQ ID NO: 2785712 - RNA, 23 nt, Leptospira interrogans serovar lai str. 56601
auaaaauacaaaagaaucaucau

SEQ ID NO: 2785713 - RNA, 12 nt, Leptospira interrogans serovar lai str. 56601
auaaaauaccaa

SEQ ID NO: 2785714 - RNA, 16 nt, Leptospira interrogans serovar lai str. 56601
auaaaauaccauaaau

SEQ ID NO: 2785715 - RNA, 15 nt, Leptospira interrogans serovar lai str. 56601
auaaaauauaguuaa

SEQ ID NO: 2785716 - RNA, 21 nt, Leptospira interrogans serovar lai str. 56601
auaaaauaucuuuaauugaau

SEQ ID NO: 2785717 - RNA, 20 nt, Leptospira interrogans serovar lai str. 56601
auaaaaucauauuuucaaaa

SEQ ID NO: 2785718 - RNA, 22 nt, Leptospira interrogans serovar lai str. 56601
auaaaauccccaguauuuugca

SEQ ID NO: 2785719 - RNA, 23 nt, Leptospira interrogans serovar lai str. 56601
auaaaauccccaguauuuugcac

SEQ ID NO: 2785720 - RNA, 14 nt, Leptospira interrogans serovar lai str. 56601
auaaaaucuaaaaa

SEQ ID NO: 2785721 - RNA, 22 nt, Leptospira interrogans serovar lai str. 56601
auaaaaucuaaaaaaacaauua

SEQ ID NO: 2785722 - RNA, 18 nt, Leptospira interrogans serovar lai str. 56601
auaaaaucuaaaaagaau

SEQ ID NO: 2785723 - RNA, 15 nt, Leptospira interrogans serovar lai str. 56601
auaaaaucuaaaaau

SEQ ID NO: 2785724 - RNA, 13 nt, Leptospira interrogans serovar lai str. 56601
auaaaaucuuaaa

SEQ ID NO: 2785725 - RNA, 15 nt, Leptospira interrogans serovar lai str. 56601
auaaaaucuuaaauu

SEQ ID NO: 2785726 - RNA, 16 nt, Leptospira interrogans serovar lai str. 56601
auaaaaugaaaaauua

SEQ ID NO: 2785727 - RNA, 19 nt, Leptospira interrogans serovar lai str. 56601
auaaaaugcaguaguuccu

SEQ ID NO: 2785728 - RNA, 14 nt, Leptospira interrogans serovar lai str. 56601
auaaaauguaggaa

SEQ ID NO: 2785729 - RNA, 16 nt, Leptospira interrogans serovar lai str. 56601
auaaaauguaggaacu

SEQ ID NO: 2785730 - RNA, 12 nt, Leptospira interrogans serovar lai str. 56601
auaaaauuaacg

SEQ ID NO: 2785731 - RNA, 17 nt, Leptospira interrogans serovar lai str. 56601
auaaaauuaagcauuau

SEQ ID NO: 2785732 - RNA, 16 nt, Leptospira interrogans serovar lai str. 56601
auaaaauuauuaacua

SEQ ID NO: 2785733 - RNA, 14 nt, Leptospira interrogans serovar lai str. 56601
auaaaauucaaaaa

SEQ ID NO: 2785734 - RNA, 17 nt, Leptospira interrogans serovar lai str. 56601
auaaaauucaaaaagaa

SEQ ID NO: 2785735 - RNA, 21 nt, Leptospira interrogans serovar lai str. 56601
auaaaauucuccgauuugguu

SEQ ID NO: 2785736 - RNA, 18 nt, Leptospira interrogans serovar lai str. 56601
auaaaauucuuagaguaa

SEQ ID NO: 2785737 - RNA, 11 nt, Leptospira interrogans serovar lai str. 56601
auaaaauugag

SEQ ID NO: 2785738 - RNA, 19 nt, Leptospira interrogans serovar lai str. 56601
auaaaauugaguguuuuua

SEQ ID NO: 2785739 - RNA, 14 nt, Leptospira interrogans serovar lai str. 56601
auaaaauuugaaag

SEQ ID NO: 2785740 - RNA, 23 nt, Leptospira interrogans serovar lai str. 56601
auaaaauuugaaaguaaaaaaga

SEQ ID NO: 2785741 - RNA, 22 nt, Leptospira interrogans serovar lai str. 56601
auaaaauuugauuccaagauuu

SEQ ID NO: 2785742 - RNA, 13 nt, Leptospira interrogans serovar lai str. 56601
auaaaauuuuaga

SEQ ID NO: 2785743 - RNA, 15 nt, Leptospira interrogans serovar lai str. 56601
auaaaauuuuagaua

SEQ ID NO: 2785744 - RNA, 16 nt, Leptospira interrogans serovar lai str. 56601
auaaaauuuuccggac

SEQ ID NO: 2785745 - RNA, 22 nt, Leptospira interrogans serovar lai str. 56601
auaaaauuuuccggacuuucca

SEQ ID NO: 2785746 - RNA, 14 nt, Leptospira interrogans serovar lai str. 56601
auaaaauuuuuaaa

SEQ ID NO: 2785747 - RNA, 16 nt, Leptospira interrogans serovar lai str. 56601
auaaaauuuuuaaaaa

SEQ ID NO: 2785748 - RNA, 18 nt, Leptospira interrogans serovar lai str. 56601
auaaaauuuuuaaaaaau

SEQ ID NO: 2785749 - RNA, 22 nt, Leptospira interrogans serovar lai str. 56601
auaaaauuuuuaaaaaauuaau

SEQ ID NO: 2785750 - RNA, 11 nt, Leptospira interrogans serovar lai str. 56601
auaaauuuuuu

SEQ ID NO: 2785751 - RNA, 16 nt, Leptospira interrogans serovar lai str. 56601
auaaauuuuuuggaaa

SEQ ID NO: 2785752 - RNA, 13 nt, Leptospira interrogans serovar lai str. 56601
auaacaaaguauu

SEQ ID NO: 2785753 - RNA, 14 nt, Leptospira interrogans serovar lai str. 56601
auaacaaauaaaag

SEQ ID NO: 2785754 - RNA, 17 nt, Leptospira interrogans serovar lai str. 56601
auaacaaauaaaaggag

SEQ ID NO: 2785755 - RNA, 20 nt, Leptospira interrogans serovar lai str. 56601
auaacaaccaccuuuacaua

SEQ ID NO: 2785756 - RNA, 22 nt, Leptospira interrogans serovar lai str. 56601
auaacaacgauuucuguagaaa

SEQ ID NO: 2785757 - RNA, 17 nt, Leptospira interrogans serovar lai str. 56601
auaacaauagcuuaaaa

SEQ ID NO: 2785758 - RNA, 23 nt, Leptospira interrogans serovar lai str. 56601
auaacaauucucgauagaacaau

SEQ ID NO: 2785759 - RNA, 21 nt, Leptospira interrogans serovar lai str. 56601
auaacagagugcucaauccaa

SEQ ID NO: 2785760 - RNA, 16 nt, Leptospira interrogans serovar lai str. 56601
auaaccguaauuagcu

SEQ ID NO: 2785761 - RNA, 16 nt, Leptospira interrogans serovar lai str. 56601
auaaccuaaaauuucc

SEQ ID NO: 2785762 - RNA, 17 nt, Leptospira interrogans serovar lai str. 56601
auaaccuaaaauuucca

SEQ ID NO: 2785763 - RNA, 18 nt, Leptospira interrogans serovar lai str. 56601
auaaccuaaaauuuccau

SEQ ID NO: 2785764 - RNA, 18 nt, Leptospira interrogans serovar lai str. 56601
auaaccuuacccacaaau

SEQ ID NO: 2785765 - RNA, 20 nt, Leptospira interrogans serovar lai str. 56601
auaaccuuacccacaaauaa

SEQ ID NO: 2785766 - RNA, 14 nt, Leptospira interrogans serovar lai str. 56601
auaacgauccuaaa

SEQ ID NO: 2785767 - RNA, 15 nt, Leptospira interrogans serovar lai str. 56601
auaacgauuccauuu

SEQ ID NO: 2785768 - RNA, 20 nt, Leptospira interrogans serovar lai str. 56601
auaacgauuccauuuuuuag

SEQ ID NO: 2785769 - RNA, 22 nt, Leptospira interrogans serovar lai str. 56601
auaacgauuccauuuuuuagaa

SEQ ID NO: 2785770 - RNA, 22 nt, Leptospira interrogans serovar lai str. 56601
auaacggaguuucucauuuuau

SEQ ID NO: 2785771 - RNA, 22 nt, Leptospira interrogans serovar lai str. 56601
auaacgucuugauuauuuucug

SEQ ID NO: 2785772 - RNA, 14 nt, Leptospira interrogans serovar lai str. 56601
auaacguuauaaaa

SEQ ID NO: 2785773 - RNA, 21 nt, Leptospira interrogans serovar lai str. 56601
auaacuaacgugaguucagac

SEQ ID NO: 2785774 - RNA, 14 nt, Leptospira interrogans serovar lai str. 56601
auaacuaauaaaaa

SEQ ID NO: 2785775 - RNA, 18 nt, Leptospira interrogans serovar lai str. 56601
auaacuaauaaaaacaau

SEQ ID NO: 2785776 - RNA, 19 nt, Leptospira interrogans serovar lai str. 56601
auaacucuauuaguuuaau

SEQ ID NO: 2785777 - RNA, 19 nt, Leptospira interrogans serovar lai str. 56601
auaacugcaagaaaccucu

SEQ ID NO: 2785778 - RNA, 17 nt, Leptospira interrogans serovar lai str. 56601
auaacuuacugauuucu

SEQ ID NO: 2785779 - RNA, 19 nt, Leptospira interrogans serovar lai str. 56601
auaacuuagaaucuaucuc

SEQ ID NO: 2785780 - RNA, 13 nt, Leptospira interrogans serovar lai str. 56601
auaacuugacucc

SEQ ID NO: 2785781 - RNA, 13 nt, Leptospira interrogans serovar lai str. 56601
auaacuuuaaaaa

SEQ ID NO: 2785782 - RNA, 18 nt, Leptospira interrogans serovar lai str. 56601
auaacuuuaaaaaauaag

SEQ ID NO: 2785783 - RNA, 19 nt, Leptospira interrogans serovar lai str. 56601
auaacuuuaaaaaauaaga

SEQ ID NO: 2785784 - RNA, 21 nt, Leptospira interrogans serovar lai str. 56601
auaacuuuaaaaaauaagaag

SEQ ID NO: 2785785 - RNA, 13 nt, Leptospira interrogans serovar lai str. 56601
auaacuuuacaaa

SEQ ID NO: 2785786 - RNA, 20 nt, Leptospira interrogans serovar lai str. 56601
auaacuuucuucgaucggaa

SEQ ID NO: 2785787 - RNA, 14 nt, Leptospira interrogans serovar lai str. 56601
auaagaaagaauuu

SEQ ID NO: 2785788 - RNA, 15 nt, Leptospira interrogans serovar lai str. 56601
auaagaaaguauuaa

SEQ ID NO: 2785789 - RNA, 15 nt, Leptospira interrogans serovar lai str. 56601
auaagaucuaucuca

SEQ ID NO: 2785790 - RNA, 21 nt, Leptospira interrogans serovar lai str. 56601
auaagaucuaucucaaaaccu

SEQ ID NO: 2785791 - RNA, 22 nt, Leptospira interrogans serovar lai str. 56601
auaagauuuguugaaaagugag

SEQ ID NO: 2785792 - RNA, 14 nt, Leptospira interrogans serovar lai str. 56601
auaagauuuuagaa

SEQ ID NO: 2785793 - RNA, 16 nt, Leptospira interrogans serovar lai str. 56601
auaagauuuuagaauc

SEQ ID NO: 2785794 - RNA, 18 nt, Leptospira interrogans serovar lai str. 56601
auaagauuuuagaaucag

SEQ ID NO: 2785795 - RNA, 14 nt, Leptospira interrogans serovar lai str. 56601
auaagcaaaaauaa

SEQ ID NO: 2785796 - RNA, 19 nt, Leptospira interrogans serovar lai str. 56601
auaagcuaagcauaaaauu

SEQ ID NO: 2785797 - RNA, 18 nt, Leptospira interrogans serovar lai str. 56601
auaagcugaacaaacucu

SEQ ID NO: 2785798 - RNA, 15 nt, Leptospira interrogans serovar lai str. 56601
auaaggcaaaagacu

SEQ ID NO: 2785799 - RNA, 21 nt, Leptospira interrogans serovar lai str. 56601
auaaggcgguaaaacaaaaaa

SEQ ID NO: 2785800 - RNA, 22 nt, Leptospira interrogans serovar lai str. 56601
auaagguuagauuauuucaaaa

SEQ ID NO: 2785801 - RNA, 14 nt, Leptospira interrogans serovar lai str. 56601
auaagguuuuauaa
